United States Patent 9,283,287 (MODIFIED POLYNUCLEOTIDES FOR THE PRODUCTION OF NUCLEAR PROTEINS) - sequence listing, part 11

SEQ ID NO: 19357 - DNA, 6192 bp, Artificial Sequence
  Description of Artificial Sequence: Synthetic coding sequence
atgaccagcctggcccagcagctgcagcggctggccctgccccagtcagacgccagtttgctgtctcgggatgaagtggcgtccctcttgtttgatccaaaggaagccgccacaatcgatcgtgacaccgcttttgcgattggatgcacgggcctcgaggaactgcttgggatcgatcccagtttcgagcaattcgaagcccctctcttctctcaacttgctaaaacacttgagaggagcgtgcaaactaaagctgtgaataaacagctcgatgagaacatttcactgttcctcattcatctctctccatactttctcctgaaaccggcccagaagtgtctcgaatggcttatccacaggttccatattcatctatataaccaggatagcctgattgcctgtgtgcttccataccacgaaaccagaattttcgtgagagtgatccagctgctcaagataaataattctaagcacagatggttttggctgctgcccgtgaaacaatctggtgtcccattagccaagggtacacttataacccactgttacaaggacttgggattcatggattttatatgcagtctggtcaccaaaagtgtgaaggtgttcgccgaatatcccggttcctccgcccaactgagagtactcttggctttctacgcctcaactatagtatccgcattggttgctgccgaagatgtgtccgacaatattatcgcaaagctgtttccatacatccagaagggattgaagagcagtctgcccgactatcgggcagccacttacatgatcatttgccaaatttccgttaaggttaccatggagaatacttttgttaactcgctcgcttcccagattattaagaccctgactaagatcccctcactcattaaggacggtctctcttgccttattgttctgttgcagagacaaaagcccgagagtcttggcaaaaagccatttccccatctctgcaacgtccctgatctgatcaccatattgcatggaataagcgagacatacgacgtcagtccactactgcactacatgcttcctcatctagtcgtgtccatcatccaccatgtgactggcgaggagaccgaggggatggacgggcaaatatacaagcggcatctcgaagcaatccttaccaagatctcattgaaaaacaatctcgaccaccttttagcttcgctgttatttgaggagtacatcagctactcttctcaggaagaaatggattcaaataaggttagcctgttgaatgaacagtttctccctctgattagacttttggaatctaagtatcccagaacactcgacgtggttttggaagagcacctgaaggaaatcgctgatctgaagaaacaggagttgtttcatcagttcgtgtcgctctctacctccggtggaaaataccagttcctggctgatagtgatacctctctgatgctctcactcaatcatcccctggcacctgttcggatcctggcaatgaaccatctgaaaaagattatgaaaactagtaaggaaggtgttgacgaaagcttcataaaagaagcagtgctcgcgcggctcggcgatgataatatcgatgtggttctgagcgcaatttcagctttcgaaatatttaaggagcatttctcctctgaagtcaccatctccaatctcctgaatctgttccagagggcagaattgagcaagaacggggagtggtatgaagtgctgaaaattgctgccgatatcctgatcaaagaggaaatcctgagcgagaatgaccagctctccaaccaggtcgtggtttgtctgctgcccttcatggtaataaacaacgacgacaccgagagtgctgagatgaagatcgccatctacctgagtaaatccggtatctgtagcctgcaccctctccttcgcggctgggaggaagccctggagaacgtgatcaaatctaccaagccgggaaaactgatcggtgtcgccaatcagaagatgatcgaattgctggcagacaatatcaacctgggtgacccgagttctatgctgaaaatggtggaggacctgatcagcgtgggtgaggaagaatcatttaacctgaagcagaaggtcaccttccacgtgattctgagcgtccttgtaagttgttgtagcagcctgaaagagacgcatttccctttcgcgatcagggtgttttccctgctccagaaaaagattaagaagctcgaaagtgtgatcaccgcagtggagatcccttccgaatggcatatagagctcatgctggaccggggaatcccagtcgaattgtgggcccactacgtggaagaattgaacagcactcaacgggtggccgtggaagactcagtgtttcttgtcttctctctgaaaaagttcatttatgcccttaaagcccccaagtcctttcctaaaggcgatatttggtggaatcccgagcagctcaaagaggactctcgcgattacctacatctcctgattgggctcttcgagatgatgttgaacggcgccgacgccgtccacttccgcgtgttaatgaaactgttcatcaaggtgcacctagaagatgtgttccaactgtttaaattctgctctgttctgtggacttacggcagctccttgagcaatcctcttaattgcagcgtgaagacagttcttcaaacacaggctctgtatgtaggctgcgcaatgttgagttcccaaaagactcagtgcaaacaccagctagcctccatctcctcccccgtagtgacctctctgctcataaacctgggttccccagtgaaggaggtgaggcgcgcagccatacagtgtctgcaggccttgtctggggtcgcttcacccttttacttaattatcgaccacctgatttctaaggccgaggagatcacatcagatgcagcctacgtgatccaagaccttgccactttgtttgaggagctccagcgggaaaagaagctgaaaagtcaccaaaaactgagcgagaccctgaagaacctcctgtcatgtgtgtattcgtgtccatcctacatcgcgaaggacctgatgaaggtgctgcagggcgtaaacggcgaaatcaccaaaccattcttcgccgctatctccgacgagaaggttcagcagaagctgctgcggatgctgttcgacctcctagttaattgcaagaacagtcactgtgctcagacagtgtcttctgtgttcaaagggatatccgtcaacgcggaacaagtgcgtatcgaactggagccaccagataaggccaagccacttggcacagtccagcagaagcggcgacaaaagatgcagcagaaaaaatctcaggaccttgagtcagtacaggaggttgggggctcttattggcagcgggtgaccctgatcctagaactcctgcagcataaaaagaaactaagatctccgcaaattttagtgcctactttgttcaatttactctcgcgttgcctggagcccctgccccaagaacaaggaaatatggaatatactaaacagctgatcctgtcatgtctgctgaacatctgtcagaagttgtcacctgacggaggaaagattcccaaggacatcttggatgaagaaaagttcaacgtggagctcattgttcagtgcattcgactgtcagagatgccccagacccatcatcacgccctgttgctccttgggaccgtcgccggaattttcccagacaaggtcctccataacatcatgagtattttcacattcatgggggctaacgtgatgcggctggacgatacttatagtttccaagttatcaacaaaaccgtaaaaatggtaatacctgctctcatacagtccgacagtggtgattcgatcgaagtgtctcgcaacgttgaagagattgtcgtaaagatcatctccgtattcgtggacgccctgccacacgtgccagagcatcggcgcttgcccatactggtgcaacttgtggataccctaggcgcagaaaagtttctatggatcctgctgattcttctgtttgagcagtacgttaccaaaaccgtgctggccgcagcatatggagagaaggacgctatactggaagctgacaccgagttctggtttagcgtctgctgtgagttctcagtgcagcatcaaatccaatctctgatgaacattcttcagtatttgctgaagctgccagaagagaaagaagaaacaatcccaaaggccgtcagctttaacaagtcagagagccaagaggaaatgctgcaggtgttcaacgtcgagacacacacctccaagcagttgcgccacttcaaattcctgagtgtgtcgttcatgagtcaactgctgtccagcaacaactttttaaaaaaggtcgtagaatccggaggcccggagattctgaagggcctcgaagaacgcctcctggaaacagtcttaggctacattagcgcagtcgcccaatcaatggagcggaacgccgacaaactgacggtgaagttttggcgtgccctgttatctaaggcctacgacctgttggacaaagtcaatgccctcctccctacggaaacatttattcccgtcatccgggggcttgtaggcaatcccctcccttcagtcagaaggaaagcattggatctccttaacaacaaattacaacagaatattagctggaagaaaacgatagttacacggtttctgaagttggtacccgaccttttagccatcgtccagaggaagaagaaggagggggaggaggaacaggccataaacaggcagaccgctctctacaccctaaaactgttgtgcaagaacttcggcgcagagaatccagatcctttcgtccctgtgctaaacactgcagtcaagctgatcgctccggagagaaaggaggagaaaaacgtcctgggttccgcgttattgtgtatcgctgaagtgacatccaccctcgaggcactcgcgattcctcagctccctagtttgatgccttcacttctcacaaccatgaagaacactagcgaactggtctcgtctgaggtgtacctactatctgcattggccgccctgcagaaggttgtggagactttgcctcattttatttctccttatctcgaaggaatcctttcacaggtgatccaccttgagaaaatcacctccgagatggggtcagcctcccaagcgaatattcggctgacgagcctgaagaagaccctggctacaacactcgcgccccgtgttctgctgcctgcgatcaagaagacatacaagcagattgagaaaaactggaagaatcacatgggtccattcatgtcaatcctgcaggagcacattggggttatgaaaaaagaagagctgacttcccaccagtcccagctgaccgctttcttcctggaagccctcgacttcagggctcaacactctgagaatgacctcgaagaggtaggtaagaccgagaattgcatcatagactgtcttgttgctatggttgtcaagttgtctgaggtcacttttcggccattatttttcaagttgttcgattgggcaaagactgaggatgcccctaaggatcggttactcacattttacaatctggcggactgcattgcagagaagctcaagggcctttttaccttgtttgccggacacctagtaaagccattcgcagataccctaaatcaagtgaacattagcaagacagatgaggcattcttcgactccgagaacgaccctgaaaaatgctgcttgcttctccaatttatcttgaattgtttatacaagatcttcttatttgatacacagcactttatcagcaaagagagagctgaggctctgatgatgccacttgtggaccaattggagaaccgcctgggaggggaggagaaattccaagaaagagtgaccaagcacctgataccatgcatcgcccaatttagtgtggcgatggcggatgactcactttggaagccccttaattatcaaattttgctgaagacgagagattccagtcctaaagtgcggttcgccgctctgataaccgtgctggccctggcagagaagctgaaagaaaattatatcgtgctcctgccagagagcataccctttctggcagaacttatggaagacgagtgcgaggaggttgagcatcaatgtcagaaaacaatccagcagcttgagactgttctgggagagcccctgcagtcgtacttttag

SEQ ID NO: 19358 - DNA, 6435 bp, Artificial Sequence
  Description of Artificial Sequence: Synthetic coding sequence
atgaccagcctggcccagcagctgcagcggctggccctgccccagtcagacgcctcactgctgtcacgggatgaagttgcctccctgctttttgatccaaaggaagctgctactatcgatagggacactgcgtttgcaatcggttgtacaggtctggaagagctgcttggtatcgaccctagcttcgaacagtttgaagcccctctgtttagccagctcgcaaaaactctggagcgcagcgtgcagactaaggccgtgaacaaacaactggacgaaaatatctcactgtttctaatccatcttagcccctacttcctgctcaaacctgcacagaagtgccttgagtggttgatacacaggttccacattcatctttataaccaagactctctcattgcctgcgtactgccttaccacgagactagaattttcgtgagggtgatccaactcttaaagattaacaacagcaagcatcgctggttttggctgctacccgtcaagcaaagtggagtgcccttggccaagggaactctaataacacattgttacaaggatctgggcttcatggacttcatttgttctctcgtaactaagtctgtgaaagtgttcgccgagtatcccggctcaagcgcccagctgcgcgtccttttggcattctacgcgtccactatcgtcagcgccttggtcgctgctgaagacgttagcgacaacattatcgcgaaacttttcccatacatccagaagggcctgaagagtagtctgcccgactacagagccgcaacttacatgataatatgtcagatcagtgtcaaggttactatggaaaataccttcgtcaattcccttgcctcccagataatcaagaccctcaccaagattcccagccttattaaggatggactaagctgtttaattgtgctccttcagaggcagaagcctgagagcttgggtaaaaagccttttcctcatctgtgtaacgtccccgatctcatcaccattcttcacggaataagtgaaacctatgatgtgagccccctcctgcactacatgctgcctcatctggtggttagcattatccaccatgtgaccggtgaggagaccgagggtatggacgggcagatttacaagcgccatctagaggcgattctcaccaaaattagcctcaagaacaacctggaccatctgctggctagcctgctgtttgaagaatatataagttattcgagccaagaggagatggatagcaataaggtgtccctgcttaatgagcagtttctgcccctaatccgccttctggagtcaaaatacccaaggactctggacgttgtgctggaggaacatttaaaggagattgctgaccttaagaaacaggaacttttccatcaatttgtgtccttgagtacatccggaggtaaataccaatttctcgctgatagcgatacctccctaatgctctccctcaaccatcctctggcacccgttcgtatcttagccatgaatcatctaaagaaaattatgaaaacatctaaagaaggagtggacgaaagtttcattaaggaggccgtcctagctcgtctgggagatgacaatatcgacgtagtcctgtccgccatcagtgccttcgagatttttaaggagcatttcagctcagaggtgacaatatctaacctcttgaacctgtttcaacgcgctgagctgtctaaaaatggagaatggtacgaggttctaaagattgccgccgacatcctgattaaggaggagatcttgagtgaaaatgaccaattgtctaaccaagtcgtggtgtgcctgcttccgttcatggtgataaataacgacgacacagaaagcgctgagatgaagatcgctatttatctgtcaaaatccggcatttgctcccttcaccctcttctccggggctgggaggaggcactggagaatgtgatcaagtccaccaaaccaggcaaactaataggggtcgccaaccaaaaaatgattgagctgctggcagataatatcaacctgggggatccctcttccatgttgaagatggtcgaagatctgatttctgttggggaggaggaatcctttaaccttaagcaaaaagtaacgtttcatgtgatcctctcagtgcttgtgtcttgttgttccagcttaaaggagactcatttcccattcgcgatcagagtgttctcccttctgcaaaagaagataaagaagttggagtccgtcatcacagcagttgagatcccgtctgagtggcacatagagttgatgttggatcgcggcatcccagtggagctttgggcacattacgtagaagaattaaacagcacccagcgagtagcggtcgaggacagcgtgtttttagtcttctcacttaagaaatttatttacgctctgaaagcccctaagagttttccaaaaggcgatatctggtggaatcctgagcagctgaaggaagacagtcgcgattacctgcatttgcttatcggcctctttgagatgatgcttaatggtgcggacgctgttcattttcgcgtattgatgaagctttttattaaggtgcacctggaagacgtcttccagctattcaaattctgtagtgttctttggacctatggttcctccctgtctaacccactgaattgctcggtgaagaccgttttgcaaactcaggcactctacgtgggttgtgctatgcttagctcccagaagacacagtgtaagcaccagctcgcttcaatcagttctcccgttgttacctctctcctcattaatctcggatcgcccgtgaaggaggttcggcgggccgccatccagtgcctgcaggctctctcaggcgtcgccagcccgttttacttgattattgatcacctgatctccaaagcagaagaaataacctctgacgccgcatacgtcattcaagacctggccacactatttgaggaactgcagcgggagaagaaactgaaatcccatcagaagctcagcgagaccttaaaaaacctgctgagctgcgtatacagctgcccctcctatatcgctaaagatttgatgaaggtcttgcagggggtgaacggcgaaatggttctttctcagctcctgccaatggcagagcagctactggagaagatacagaaggagcctaccgcagtgctgaaagacgaagccatggtcctgcatctgacccttggaaaatacaacgagttcagtgtctcgctactgaacgaggacccaaagtcactagatatcttcattaaagcagtccacactaccaaagagctgtatgccgggatgcccacgatccagataaccgctctggagaaaattactaagccatttttcgccgctatcagcgatgagaaagttcaacaaaaacttctgaggatgctcttcgatttgctggtgaattgtaagaactcccactgtgcccaaacagtgtcttcagtttttaaaggaatctccgtaaatgccgaacaggtgaggatcgagctcgagccaccagacaaagcaaagccgctgggcaccgtgcagcagaaacgcagacagaagatgcagcaaaaaaaaagccaagatctggagagcgtgcaggaggtgggcggttcctactggcagcgggtcaccctcatactggagctactgcagcataaaaagaagcttcgcagcccacagattctggttccaactttgtttaacctgctgagcaggtgcctcgaaccacttcctcaagagcagggcaacatggaatacacaaagcagttgattttgtcctgtctgctaaatatttgccaaaaactgtcacccgatggcgggaaaattcccaaggatattcttgatgaagaaaagttcaacgtggaactcattgtacagtgcataaggctctccgagatgccccagactcatcaccatgcgctgcttttacttggtacagttgcaggcatctttcccgacaaggttcttcacaacataatgagtatattcacttttatgggcgcaaatgttatgcggctcgacgacacatactcctttcaggtcataaacaagacagtcaaaatggtcatacctgccttgattcagtcagattctggcgactcgatagaggtttctagaaacgtcgaagaaattgtggtgaagattatttccgtattcgtcgacgccctgccacatgtgcctgagcatcgaagactccccattctcgtccaacttgttgacacactcggggccgagaagtttctatggattctgctaatcctactcttcgaacaatatgtcacgaaaacagtgctggccgcggcttacggagagaaagatgcaatcttggaagcagataccgaattctggttttctgtgtgttgtgaattcagtgtccagcatcagatccaatctctgatgaatattctgcagtacctgctaaaattgccagaagagaaagaggagacaatccccaaagcagttagcttcaataaatcagagtctcaggaggaaatgctgcaggtgttcaatgtcgagacacacactagcaagcagttgcgtcattttaagttcctctctgtgtcattcatgtcacaattgttatcctcaaataatttcctgaagaaagtggtggagagcggtggcccagaaatactgaaggggctcgaagagaggctgctggaaacagtcttgggatacatctccgcagtcgctcaatccatggagaggaacgctgataagctgaccgtaaaattttggcgggcccttctgtccaaagcttatgaccttctggacaaggtgaatgcactcctccccactgaaacttttattccagtgattagaggactggttggtaaccccttgccaagtgtgcggaggaaggctctagacctgcttaataacaaattacagcagaatatcagctggaagaaaacgatcgtaacccgtttcctcaaactggtgcccgatctcctcgcaatagtccaaagaaaaaaaaaggagggtgaagaggagcaggccatcaatagacaaaccgcactctacactctgaaactgctttgcaagaatttcggcgcggagaatcctgaccctttcgtgcccgtccttaatacagccgtaaagctgatcgccccagagcggaaggaggagaaaaacgtcctgggttcggctttgctctgtatagccgaagtaacttccacattggaggcgttagccatcccacagctcccttccttaatgcccagcctcctgacgaccatgaagaatactagcgaattggtgtcctcggaagtctacttgctcagcgcccttgctgcactccaaaaggttgtggagaccctcccccattttatatctccctatctggaggggattctatctcaagtcatccacctggagaaaattacatctgaaatgggaagtgccagtcaggctaacatcagactgacttcccttaagaagacactggcaacaaccttggcacctagagtattgctcccggctatcaaaaaaacatataaacaaatcgaaaagaactggaagaaccatatgggccccttcatgtccatattacaggaacatatcggcgtgatgaagaaagaggaactgacctctcatcagagccagctgactgcgttctttcttgaggcccttgattttcgcgcacagcatagtgaaaacgatctggaagaggttggaaaaacggaaaactgtatcatcgattgcctcgttgcgatggtcgtaaagctgagtgaggtgacgtttcgaccactgttcttcaaactgtttgactgggctaaaactgaggacgcgcctaaggaccggctcctgacgttctacaatctcgccgattgtatcgccgagaagcttaaaggtctgttcactctctttgctgggcaccttgtgaagcctttcgccgatacattgaaccaggttaatattagcaaaactgacgaagctttttttgactcagagaacgatcccgaaaagtgctgtctcctgctgcagttcatcctgaattgcctctacaagatatttctgtttgatacgcaacacttcatcagcaaagaacgcgccgaggccttgatgatgcccttggtggaccagttagaaaaccggctcggcggagaggagaaatttcaagagagagtgaccaaacatctgatcccctgtatcgcgcagttcagtgtcgctatggccgacgactctctgtggaaaccccttaattatcagatcctgctgaaaacgagagatagttctccaaaggtgaggttcgcagcccttatcacggtgcttgcccttgctgaaaaactgaaggaaaactatatcgtgctgctgcctgaatccattcctttcctcgcggagcttatggaggacgaatgcgaagaggtggaacatcagtgccaaaagactatccaacaattagagactgtccttggagaacccctccaatcttacttctag

SEQ ID NO: 19359 - DNA, 231 bp, Artificial Sequence
  Description of Artificial Sequence: Synthetic coding sequence
atggccgagaccgaccccaagaccgtgcaggacctgaccagcgtggtccagaccctgcttcagcagatgcaagacaaatttcaaaccatgtccgatcagattattggacggattgatgacatgtctagtcggattgatgatcttgaaaagaacattgctgatctgatgacacaggccggcgtggaggaacttgaatcagagaataagataccagccactcagaaaagctag

SEQ ID NO: 19360 - DNA, 1791 bp, Artificial Sequence
  Description of Artificial Sequence: Synthetic coding sequence
atggaggccctgctgagcacccccatcaaccccaacaacttccccgccaagctctggaggctggttaactcacccagataccggtccataagatgggacggccgaggagagggcctgttgatcgatcaacccctgttcgaagcagagctgctgagcccacccgggccgggagggggaggcgggaccgctggcgccggcgccgaaccggagctcttcaagaccacaagcttcacaagctttatcaggcagttgaacctatatggatttcgaaaagtcgtgcttggcggaccaggggggggtaaacctgccggcaacggtcctctgcaccactttcacaacccccacttcaggagagaccagcctcagctactagtccacctcaaacgtctgacttccgctaacaaagccaagttggccgcagggctcgaggttccctgtcgtccgccgaaccgattccaaagactgctcattacaagcgcttctgccgcaactgccccactccagcaccaacaacctcctcccccggctgggcccagaccagaaccgcatggtccagtcgccgtgggccaatttcaccgatctttcaggcgcgattctctgagcccatattcttgcgtgagcactccaagccatgatcattcaacctaccctctcaaaggtctcgaccggacccctgtgcctcaccggatttggcagaacagtctgggcatgcacccaggccaggtggaaacctcccctacctttagcgataagggtgtccctttcccagtgctgcagagattccctacggaggtgacttatacacttcagccctcgaccacgagtgtgcatgtacaacagggtccgcagacaatggtgagcagctcacaaaaatattcaaattacacaccttcagcacagtatagtcaggcctactatcctactgctgtactgcagtgttgtagcccaacccacatggacgcactcagttcttgtgtcacacctaacgccagctcctacgcccactgcaattactttcaaaatccctccatgcagtcttcgtacccggtggagtttctacccagcaactggccgtgctccaccactgatgagaataccaaaactgaggtgaacttagaggccgtgttccagatcgtggatgaactacactcttcccccaagttagagatggtgaaagtagagcccgtcgagaatcagtgcccaacatcaccgtcataccgtggtcagcacatactagctaattcaaataattcaaacccatgttctgcttcccaggcatcacaactggagcctctcacccctgtgggcagtgacattatgtcctttgttgtagggactgagcaggccgttgcatgcagcctgccacagtcgcctgaatatatctatactatccacacggctcagcccgtggagaacagcacaatccaggagtccgccgccattcaacaggctcacgtgaaattgaaggagcacctgaatcacaacccctcacctagttccgtcgtttttgtccaggaagggccgcccttcagtacacatcaggttgatgctaatatcaagtgtcagacatcttcacgcgagaacatcctcccctccgagcagatgggcttccttatttctgagatgggtcccgcctctaaaccatctgaagacacaggcctggccacccctgctcgttaccgagagcataggagtaactcacagcagggaaaaagccctgacctgcatttgctggtcgatgtcgcctgcaagcaggaacgcttccctaaagaggaggaactgaaggagtag

SEQ ID NO: 19361 - DNA, 1491 bp, Artificial Sequence
  Description of Artificial Sequence: Synthetic coding sequence
ggcggcatcgagaacggcgtgggcgagctgggcagcggcggcgaggctccggcccgccgcggtgacggcggcgctgccctgcatcctcatcagccgcagcagctcccacgccaggccgtggcacctggggaacagcccgcactcccactgcacccactgggaaggcctagacgaggcgcggcataccggagtgccgctctgaggggcagggcagcccagcccccagccggccctcgaccagaaccccacggtcccgtagctgttggacagtttcataggtcattccggcgcgattcactttctccatactcctgtgtgtcgacgcccagccacgaccacagcacgtatccactgaagggactagacagaacacctgtgcctcacagaatctggcagaactcactgggcatgcatccgggacaagtcgagactagtccaacattttccgataagggggtgccgtttcctgtgctgcaacgatttcctacggaggtaacatataccctccagcccagcactacctcagtccacgttcaacaggggccgcaaaccatggtatctagctcacagaaatactctaattacactcccagtgcccagtactcacaggcctattatcctaccgctgttctccagtgttgctctccgactcacatggacgcgctttctagctgcgttacacccaacgcttcctcctacgcccattgcaattatttccagaatccttctatgcagagttcttaccccgtcgagttcctgcccagcaactggccatgctccactactgacgagaacaccaaaacagaagtaaacctggaagccgtgttccagattgtagatgagcttcatagctctccgaagctcgaaatggtgaaagtcgagcctgttgagaaccaatgcccaacaagcccgagctaccgcgggcagcacattctagctaactccaataactccaacccatgctctgcgagccaggctagtcagctggaaccactgacccctgtggggagcgacatcatgagctttgtggtcggtacggagcaggccgttgcatgtagcctcccacagtcccccgagtacatctacactattcataccgctcagccagtagagaattcaacaattcaagagagcgccgcgattcagcaggctcacgtcaagttgaaagagcatcttaaccacaacccatctccaagctctgttgttttcgtccaggaaggcccgcccttttcaactcatcaggtcgatgccaatatcaagtgccagacgtcatctcgcgaaaacattttaccctccgagcagatggggtttctaatttcagaaatgggcccagcatcaaaaccatccgaagacacaggcttggctacacccgccaggtacagggaacataggtcaaacagccaacaggggaaatcaccggatttgcacctgttagtggacgtggcctgtaagcaagaaagatttcctaaggaagaagaattgaaagaatag

SEQ ID NO: 19362 - DNA, 3264 bp, Artificial Sequence
  Description of Artificial Sequence: Synthetic coding sequence
atggcccggagcagcccctacctgcggcagctgcagggccccctgctcccgccacgggacctggtggaggaagacgacgattacctgaatgatgacgtggaggaggacgaggaaagtgtattcatcgatgctgaagagctgtgctcagggggagtgaaagctgggagcttgcctggctgtctgagggtcagtatctgcgacgagaatactcaggagacgtgtaaagtttttggacgctttcctatcacaggcgcttggtggagagttaaagtgcaggtgaagcctgtcgtcggatcacggagttatcaataccaggtccagggctttccatcatattttctccagtccgacatgtcccctccgaaccagaaacacatttgcgcactgttcctgaaagagtgtgaagtgtctagtgatgacgtcaacaaattcctgacctgggtcaaagaggtgtctaattacaagaatctgaactttgagaatttgagagagaccctgagaacctttcacaaagaaaccggtcgaaaggatcagaagcaaccaactcagaacggccaggaggagttatttctcgacaacgaaatgagcctaccactcgaaaacactattcctttccgcaatgttatgactgctctccagtttcctaaaatcatggagtttctgccggtccttttacccagacactttaaatggattataggcagcggcagcaaagaaatgctgaaggagatcgaggagatccttggaacccacccatggaagctcgggttcagtaaaatcacgtacagggaatggaaactcctccgctgcgaggcttcatggattgccttttgccaatgtgaatcgctgctccagctcatgactgatctggagaaaaatgctctgatcatgtacagccgcctcaaacagatttgtagagaggatggacatacatacgtcgaggtgaatgaccttacattaaccctgtcaaaccacatgagctttcatgctgccagcgagagtcttaagtttctcaaggatatcggggtcgtcacatacgaaaaatcctgcgtatttccatacgacctgtaccatgctgagcgtgcgatagcctttagcatctgtgacctcatgaagaaaccaccatggcatctatgtgtcgatgtagaaaaggtgctggcttccatccacacgaccaaacctgaaaactcctcggacgatgcccttaatgaaagtaaacctgacgaagtgcgccttgagaatcctgtggatgttgtcgacacccaggacaacggtgaccacatctggacaaatggagagaatgagattaatgcagagatttctgaggtacagctcgaccaggaccaggtggaagtccctctcgaccgagatcaggtcgcagctttagagatgatctgttcgaacccagtgacagtgattagcggcaagggaggatgcggtaagacgacaatcgtgtcacggcttttcaaacacatagagcagctggaagagcgagaggtcaaaaaagcgtgcgaagatttcgagcaagatcaaaatgcctccgaggaatggatcacctttacggagcagagccagctggaagctgacaaagctattgaggtacttctcactgcgcctacgggcaaagctgcaggtttactgcgacagaagactggtctgcacgcgtacacactgtgtcaggtcaactattctttttattcctggacccagaccatgatgacaactaataaaccatggaagttctcctccgtacgagtgctggtggtggatgaggggtcactagtctccgtgggtatctttaaatcagttctgaatcttttatgcgagcactctaaactgagcaaactgattattctgggcgacattcgccaactgccatccatcgagcctggaaacttactgaaggatctgttcgagacgcttaagtcccggaactgtgccattgagctcaagacgaaccacagagctgagtctcagctcatcgttgataacgcgacacgcataagtcgaagacagtttcccaagttcgacgccgagttgaacatcagtgataatccaacactgccgatttctattcaagataagacattcatcttcgtccgattaccggaagaggatgcgagcagtcaaagtagcaaaactaaccaccacagttgtctttactctgccgttaagaccttactgcaggaaaataatctgcagaacgccaagaccagccagtttatcgctttcaggcgacaggattgcgaccttattaacgattgttgctgcaaacattacaccggccatctcacaaaggaccaccagtctagactggttttcggcattggggataaaatatgttgcacccgcaacgcatatctgtctgacttgttaccagagaacatcagcggcagtcagcaaaacaacgatctcgatgctagctccgaagatttctccggaaccctgccagatttcgccaagaataagcgcgacttcgagagtaacgtgaggctctgcaatggtgagatctttttcatcactaacgacgtgacagatgtgaccttcggaaagagaagatccctgactatcaacaacatggcaggactcgaggtgaccgttgattttaaaaagctgatgaagtactgtcgtatcaagcacgcctgggccagaaccatccataccttccaggggtccgaggagcagaccgtcgtttatgttgtaggcaaggcaggcagacagcactggcaacacgtgtatacagccgtcacacgtgggaggtgccgagtgtacgttattgccgaggagagccagctccgcaatgccataatgaaaaacagcttccctcggaagactcgcctcaagcacttccttcaatccaagctgagctcttccggagcccccccagccgacttcccttctcctagaaaatccagcggggactcaggtggacccagcacaccaagcgcctctcctcttcctgtggttactgaccacgccatgacaaacgatgtcacttggagtgaagcctctagccccgacgagcgcaccctgacgttcgccgaacggtggcagctatcgtctcccgacggcgtggataccgacgacgaccttcccaaatccagggcctccaaacgcacttgcggagtgaacgacgatgagagcccatccaagatcttcatggtgggggagtcgcctcaggtttccagtaggctgcagaatctgagattaaataacctcattcctcgccaactcttcaagcccactgacaatcaggaaacctag

SEQ ID NO: 19363 - DNA, 3264 bp, Artificial Sequence
  Description of Artificial Sequence: Synthetic coding sequence
atggcccggagcagcccctacctgcggcagctgcagggccccctgttgccaccgcgagacctagttgaggaagacgacgattacttgaacgacgatgtggaagaagacgaagagagtgtcttcatcgatgcggaagaattgtgttccggaggagtcaaagctggctcactgcctggctgcctcagagtgagtatttgtgatgagaacacccaggagacttgcaaggttttcggccgttttcccatcaccggagcctggtggcgagtcaaagtgcaggtgaaaccagttgtggggtccaggtcctatcagtaccaggttcagggttttccaagctattttctgcagtctgatatgtctccaccgaatcagaaacacatttgcgcccttttcctgaaagagtgtgaggtgtcttccgacgatgtcaacaagtttttgacttgggtcaaagaggtatccaactataagaatctgaacttcgagaacctgcgtgagacactccgtacatttcataaagagaccgggaggaaggatcaaaaacagcccacacagaacggacaggaagagctatttttagacaacgagatgagcctgcctctcgaaaatactattccattccgtaatgtgatgacggccctccagttcccaaagattatggagtttttgcctgtgcttctgccccggcatttcaaatggatcattggatcgggcagtaaagagatgctcaaagaaattgaagagatactcggcactcatccctggaaactaggcttctccaagattacatatagggagtggaaactgctccggtgtgaggctagctggatcgcattttgccaatgtgagtccttgctccagctgatgacagatctggagaaaaacgcattgattatgtatagcagattaaagcagatctgtcgggaggatggacatacatatgttgaggtgaacgacctgaccttgaccctgtcaaaccatatgagctttcacgccgcaagcgagtcgctcaagttccttaaagacatcggcgttgtgacctatgaaaagtcttgcgttttcccttacgatctctaccacgccgagcgcgcaattgccttttccatttgtgatttaatgaagaaaccaccgtggcacctctgtgtcgacgtggaaaaagtcttggccagtatccacacaacaaagcctgagaactccagcgacgatgcacttaatgaaagtaagcctgacgaagtacggttggagaatccagtggacgtggtggacacccaggataacggggatcatatttggacgaacggggaaaacgaaattaatgctgagatttctgaggttcagctggaccaggatcaggtcgaagtaccattagaccgggaccaggtggccgccctggaaatgatctgctctaatcccgtgacagtaatttccggtaaagggggctgcgggaagacaacgattgtgtcacgtctttttaaacacatcgagcaacttgaggaaagggaagtgaaaaaggcctgtgaagacttcgaacaggaccagaatgcctcagaagagtggattaccttcactgagcagagccagctcgaggccgataaggccattgaggtgctgctcactgcccctacagggaaggcggctggcttgcttcggcagaagacaggtctgcacgcctacacactctgtcaggtgaactacagcttttattcttggacccagaccatgatgacaactaacaaaccttggaaatttagcagcgtcagggtcttggtggttgacgagggcagcctggtgtccgtcgggatttttaagagcgtgcttaatcttctttgtgaacacagcaagctttcaaagttgattatcctgggtgacataaggcagctcccgagtatcgaacccggcaacctattgaaggatctgtttgaaaccttaaagtcgagaaactgtgctatcgagctaaagactaaccatagagctgagtctcagctcattgtggataacgccaccagaatcagtcgacggcagttccctaaatttgatgcggagctcaacatttcggacaatcccactctcccaatttccattcaggacaaaacctttatttttgttaggctaccagaagaagacgcatcgtcgcaatcaagcaaaacaaatcatcactcttgtttgtatagcgctgttaaaaccctgttacaagagaataatttgcagaacgctaagacatcccagtttattgcattccggcgacaggattgtgacctgattaatgactgctgctgcaagcattatacaggacaccttactaaggatcaccagagccgactggtgtttggcattggtgacaagatctgttgcacccgcaatgcttacctaagcgatttgctccctgaaaacatcagcggttctcagcagaacaatgacctggatgccagtagcgaggactttagtggaactctgccagacttcgccaaaaataaacgcgactttgagtccaacgtgcggctttgcaacggcgagatcttctttatcactaacgatgtaaccgatgtcacgttcggcaaacgccgctctctaacaattaataacatggcaggacttgaggtgaccgtggacttcaagaaacttatgaagtactgccgcataaagcatgcctgggccaggactattcacacgtttcagggcagcgaggaacagactgttgtatacgtggtggggaaagctggtcggcagcactggcaacatgtatacacagctgtgacgcgcggcaggtgtagagtctatgtgattgctgaagagagtcagctgcgaaatgccattatgaaaaattcttttccacggaagacgcgtttgaagcactttctgcaatccaaactctcctctagtggggccccacctgccgatttccctagccccagaaaaagcagtggcgatagcggcggcccctcaacgccatctgcatcacccttgcctgtggtcactgaccatgcaatgaccaatgatgttacctggagcgaagcatcatctcccgacgagagaaccctgacctttgccgagaggtggcaactgagcagtccagacggtgtcgatacagacgatgatctccccaaaagccgagcctccaagcgcacgtgtggagtcaacgatgacgaatcccccagcaaaattttcatggtaggcgagagtccacaagtgtcttctagattgcaaaacctgagattaaacaacctgattccgagacaactcttcaagcccacagacaatcaggaaacatag

SEQ ID NO: 19364 - DNA, 3030 bp, Artificial Sequence
  Description of Artificial Sequence: Synthetic coding sequence
atgagctggatgttcaagcgggaccccgtgtggaagtacctgcagaccgtgcaatacggcgttcacgggaatttcccgcgactttcttatcccaccttctttccccgatttgaatttcaggatgtgatccctccagacgatttccttacaagcgacgaagaggttgacagcgtgttgtttggtagtcttagaggtcacgtggtgggtttacgttactacacaggtgttgtgaataataacgagatggttgccctgcagagagaccctaataacccgtacgacaagaacgccatcaaagtgaataacgtgaacgggaaccaggttggccacctgaagaaggagctggccggggcattggcatatattatggataacaagctggcacagattgagggtgttgtgccatttggggccaataacgcatttacaatgcctttgcacatgacattctggggcaaggaggaaaatcggaaagcagtgagtgaccagctcaagaagcatggtttcaagttgggtcccgctccaaaaacgctggggtttaacttggaatcagggtggggaagcggaagggccggtccgagctacagcatgccggtccacgccgccgtgcagatgacaactgagcaactgaaaaccgaatttgacaagctgttcgaggatctgaaggaagatgacaagacgcacgagatggagcctgccgaagcaatagagactcccttgttaccacatcagaagcaagccctggcttggatggtgtcaagagagaattcgaaggagctgccgcctttctgggagcagcgcaacgacttgtattacaatacgatcactaacttcagcgagaaagatcgtcccgaaaacgtccacgggggcatcctggcagacgatatggggctgggaaagacgctcacagccatcgcagtgatcctgacaaatttccatgatggtcggccgctgcccattgaaagggtgaagaagaacctgttgaagaaggaatacaatgtcaacgacgatagcatgaaactggggggaaacaacacctcagagaaagctgatgggctatcaaaggacgcctctcggtgttccgagcagcccagcatctctgacattaaagagaaatctaaatttagaatgtccgaactctccagttcacggcctaagcgtcgcaaaaccgctgttcagtacatcgaaagctcagattccgaggaaattgaaaccagcgagctcccccagaagatgaaaggcaaacttaaaaatgtacagagcgagaccaagggccgagcaaaggcgggttcttcaaaggtcattgaggacgtggcattcgcctgcgctcttacctcatccgtgcccactacgaagaagaaaatgctgaagaaaggcgcctgcgctgttgagggatccaagaagaccgatgtcgaggagaggccgcgcacgacccttatcatctgtccattgtccgtgctcagcaattggatcgaccaatttggccaacatattaaaagcgacgtacatctcaacttctacgtatactatggacctgatagaattagggagcctgccttgttaagtaaacaggatatagtgctcaccacctataacatcctgacccatgactacggcactaaaggagattccccgctgcattcaatccgatggctgagggtgattctggacgagggccatgccataaggaaccctaacgcccagcaaactaaggctgtgttggatctggagtccgagcgacggtgggtactcacaggtacccccatccagaattccctcaaagatctgtggagtctgctttctttcctgaagcttaagccctttatcgaccgggagtggtggcaccgtaccatccagaggcctgttactatgggggatgaaggcggtttgagacggcttcaatccctaatcaagaatatcacacttcgtcgcacgaaaacaagcaagattaaggggaaaccagtactggagctgcccgagcgaaaggtgtttatacaacatatcaccctgtccgacgaggagcgcaaaatttatcagtctgtcaagaacgaggggcgggccaccattggccggtatttcaatgaaggtacagtcttagctcactacgctgacgttcttggactgctgctccggctccgccagatatgttgccacacctacctgctcactaatgctgtgtcctctaatggaccgtcaggcaacgatactccagaggagctcagaaagaagctcataagaaagatgaagctcattttatcctcaggatcggatgaggaatgtgctatctgcctcgactccctgaccgttccagtgattacacactgcgctcacgtgttctgcaaaccttgtatttgccaggtgatacagaacgaacaaccacatgcaaagtgccccctgtgtagaaacgatatccacgaagacaacctcctggagtgtccacccgaagaactcgccagggactcagagaagaagtctgatatggaatggaccagctccagcaaaatcaatgctctcatgcatgcccttaccgatcttcgtaagaagaatcccaatatcaagtcgctggttgtctcacagttcacaactttcctctccctgatcgagattccattgaaggcttcaggatttgttttcactcgcctcgacggttccatggctcaaaaaaaacgcgtggagtctatccaatgttttcagaacacggaggcaggatctccaactatcatgcttctgtcgctgaaggctggtggtgttggccttaatctgtccgctgcgtctcgtgtcttcttgatggatccagcctggaaccctgctgctgaagatcaatgcttcgacagatgccatcggctaggccaaaagcaggaggtaattatcacaaaattcattgtcaaggactccgtggaggagaatatgctcaaaattcaaaacaagaagcgcgaattggcggccggcgcctttggaacgaagaagcccaacgcggacgaaatgaagcaggctaaaattaacgaaatccgtacgcttatcgacctgtag

SEQ ID NO: 19365 - DNA, 3030 bp, Artificial Sequence
  Description of Artificial Sequence: Synthetic coding sequence
atgagctggatgttcaagcgggaccccgtgtggaagtacctgcagacggtgcagtatggcgttcacgggaactttccccgtttatcttacccgaccttctttccaaggttcgagtttcaagacgtgatccccccggacgattttttaacatccgatgaagaagtggatagcgtgctttttgggtcactccgggggcacgttgttggattaaggtactataccggcgtcgttaataataacgagatggttgcactgcagcgcgaccccaataacccatatgacaagaacgcgattaaagttaacaatgtgaatgggaatcaggtcggtcatttaaagaaagaacttgcaggagccttggcgtatatcatggacaacaagctggctcaaattgaaggggttgtgcccttcggggcgaacaacgcgttcacaatgcctctgcatatgacattttggggcaaagaagaaaatcggaaagccgtgtcagaccagctgaaaaagcacggttttaaactgggacctgcgccaaaaacattaggttttaacctggagtcaggctggggctcaggacgagctggtccttcgtatagtatgccagtgcatgcggccgtgcagatgactaccgagcagctgaagacagaatttgacaagctcttcgaagacttgaaagaggatgataaaacccatgagatggaacctgcagaagctattgaaaccccactgctcccacaccagaagcaggcccttgcctggatggtctcgcgagagaattccaaggaactcccgcctttctgggagcagagaaacgacctgtactataacacaatcacaaatttctcggagaaagaccgccccgagaacgtgcatgggggtatactcgccgatgatatggggctgggaaagacactgaccgctatcgctgtaatcctgacaaacttccacgatggcagaccgctgcctatagaaagggtcaaaaagaacctgctcaaaaaagagtacaatgttaatgatgactccatgaaactgggcggcaataacacttccgagaaagccgatgggctaagcaaggatgcgtctcgctgttccgagcagccatcaatctccgatatcaaagagaagtcaaaatttcgtatgagtgagctgtccagcagtagaccaaagagacgaaagaccgccgtacaatacatagaatcatccgattccgaggagatcgaaacctcagaattgcctcagaagatgaaaggcaaactgaaaaatgtacagtctgagaccaagggtcgcgcgaaggccggctctagcaaagtgatcgaggacgtagcatttgcatgcgcactgactagctccgttccaacgacaaagaagaagatgcttaagaagggggcatgcgcagtcgaaggaagcaaaaagaccgatgtcgaagaaagaccacgtacaacacttatcatctgcccactgtccgttcttagtaactggatcgatcagttcggtcagcatatcaaatcagacgtccacctcaatttctatgtctactatgggccagacagaatccgagagcccgcgctcttgtccaagcaggatatcgtccttaccacttataacatactgacccacgactacggaacaaagggtgatagccccctgcattccatccgctggttgagggtcattcttgatgagggccatgcgattcgcaatccgaatgcccagcaaacgaaagccgtcctcgacttagaaagcgagaggcggtgggtgctaaccggcaccccgatacaaaatagccttaaggacctctggtcattgctttcattcctgaagctgaaaccctttatcgatagagaatggtggcatagaaccatccaaagacctgtcaccatgggggacgagggcggattgcggagactgcagagtctgattaagaatatcactttgagacgcacaaaaacatccaaaatcaagggcaagcccgtgcttgagctcccagagaggaaagtcttcatccaacacatcacactttcggatgaggaacggaagatttatcagagtgtcaagaacgagggccgcgctaccatcggtcggtatttcaatgagggaaccgttctcgctcactatgccgacgttctgggactgctgctacggctgcggcagatctgttgccacacctacttgctgaccaacgcagtctcctccaatgggccatccggcaacgacacccccgaggagctgcggaagaagctcatccgaaaaatgaagctaatcctgtccagtgggtcagatgaagagtgtgcaatctgcctggattccttaactgtcccagtgatcactcactgcgcacacgtattctgcaagccctgcatatgtcaggtcatccagaacgaacaacctcacgctaagtgcccactttgtcggaacgacatccacgaagataatttgctggagtgtccccccgaagagctcgcaagagactcagagaaaaagtctgacatggagtggacgagtagctctaagattaatgcgctgatgcacgcactgacagatcttagaaaaaagaaccctaacataaagtccctggtggtaagccaatttacaacatttctgagtctgatagagatcccactgaaggcctctggattcgtctttacccggctcgatggctccatggcccaaaagaagcgagtggaatcaatacagtgcttccagaacacagaagctggttctcctaccattatgctgcttagcttgaaggctggcggtgtgggactgaacttgagcgccgcttcccgcgtctttctcatggatcctgcctggaacccagcggctgaggaccagtgcttcgaccgttgtcacagattggggcagaagcaggaggtaataatcactaagtttatagtgaaggactctgtcgaggagaatatgctgaagattcagaacaaaaaaagagaactggcagcaggggcctttgggaccaagaagcccaacgctgacgaaatgaagcaagccaaaattaatgagatcagaaccctcatagacctatag

SEQ ID NO: 19366 - DNA, 1179 bp, Artificial Sequence
  Description of Artificial Sequence: Synthetic coding sequence
atgttcaagcgggaccccgtgtggaagtacctgcagaccgtgcagtacggggtccatggtaacttccccaggctatcatatccaacatttttcccaagatttgaattccaggacgtgatcccgccagatgacttcctgacctccgatgaagaagtggatagtgtattatttggaagcttgagaggtcatgtcgtgggactccggtattatactggggtagtcaacaacaacgagatggttgccctgcaacgcgatccaaacaacccctatgataagaacgccattaaagtaaataatgtaaacggtaatcaggtgggacatctgaagaaggagctggccggcgccttagcatacatcatggacaataagctagcacagattgaaggcgtggtgccttttggcgctaataatgcttttacaatgccattgcatatgacattttggggaaaggaggagaataggaaggctgtcagtgaccaacttaagaagcacgggtttaaactgggacctgccccaaagaccttgggctttaacctcgagtcaggctggggatccgggcgggcaggtcctagttactctatgcctgttcacgctgcagttcagatgactactgagcagctcaaaacagagttcgataagctatttgaggatcttaaggaggatgacaagacccatgagatggagcctgccgaggctattgagactcccctgctccctcaccaaaaacaggccctcgcctggatggtgagtcgcgagaattcgaaagaattgccaccattctgggaacaacggaatgacctctattacaacacaatcaccaacttttccgagaaggacaggcctgaaaacgtccacggaggaattttggcagacgatatgggtctggggaagactcttactgcaatcgcagttatacttactaacttccatgacggacgccccttgcccatcgagcgggtgaagaagaacctgctgaaaaaagagtacaatgtcaacgacgactccatgaaattaggcggaaataacacgagcgaaaaggctgacgggctcagtaaggacgcttctcggtgtagtgagcagccctccataagtgacattaaagagaaaagtaagttcagaatgagcgaactatccagtagtagaccaaagtctcaaaagaagaagaaaaaacgggaatag

SEQ ID NO: 19367 - DNA, 1374 bp, Artificial Sequence
  Description of Artificial Sequence: Synthetic coding sequence
atgttcaagcgggaccccgtgtggaagtacctgcagaccgtgcagtatggggtgcacggcaatttcccacggctgtcttaccccaccttctttcctcggtttgaattccaagatgtaattccccctgacgacttcctgacatctgacgaggaggtagatagcgttctatttggatccttgagggggcatgtcgttgggctaaggtattataccggcgtcgtgaataacaacgaaatggtcgcgctccagcgcgacccaaacaatccctatgacaagaatgccatcaaggtgaataatgtgaatggcaatcaggtgggacacttgaagaaggagttggctggagccctggcctacatcatggataacaaattggcccagatcgaaggggttgtgccttttggcgcaaacaacgcctttacaatgccactccatatgaccttttggggcaaggaagagaaccgaaaagcagtttcagatcaattgaagaagcacgggttcaagcttggacctgccccgaagactctaggcttcaatctcgaatccggctggggtagtggaagggcgggccctagttactccatgccagtgcatgcggccgtgcagatgaccacagagcagttgaaaacagaattcgacaagctcttcgaagatctgaaggaggacgataagactcatgaaatggaacccgcggaagcaatcgagactccacttttgcctcatcagaaacaagcactcgcttggatggtgagcagagagaactccaaggagttgccccctttctgggaacagcggaatgacttgtactacaatacgatcactaacttctccgagaaagataggcctgaaaatgtccacggcggtatcctggcagatgacatgggcctcggcaaaaccttaactgccattgctgtgattctgacgaattttcatgacggacggccacttcccattgaaagagtcaaaaagaatctactcaagaaggagtacaatgtcaatgatgattcgatgaagctgggaggcaataatacaagtgaaaaggccgatgggcttagtaaagacgcttcacggtgttctgagcagccaagtattagtgacataaaagagaagtccaagtttagaatgagtgagttgtctagctcaaggcccaaacggcgcaagacagccgtacagtacatcgaaagctcggattccgaagagatcgagactagcgagctgcctcaaaagatgaagggaaagctgaaaaacgttcaaagcgagaccaaggggcgagctaaagcagggtcctctaaggtgatcgaggatgtcgcttttgcatgcgctcttactagttcagtgcccaccaccaagaagaaaatgctgaaaaaagtcaagtag

SEQ ID NO: 19368 - DNA, 3030 bp, Artificial Sequence
  Description of Artificial Sequence: Synthetic coding sequence
atgagctggatgttcaagcgggaccccgtgtggaagtacctgcagaccgtgcagtacggcgtgcatgggaacttcccccgcctttcctatcccactttcttcccccggttcgagttccaagacgtgatccctcccgacgactttctaacatccgatgaggaagtggactcagtgttgttcggttctcttagggggcacgtggtcgggcttcgctactatactggtgtggtcaataacaacgaaatggtggcgttgcagcgggaccccaacaacccctatgacaagaatgctattaaagtgaacaatgtgaacggtaaccaggtagggcacctcaagaaggaattggccggggcattggcttacataatggacaacaaactagctcagattgaaggcgtagtgcctttcggagccaataatgccttcacgatgccactgcatatgactttttgggggaaagaggagaacagaaaggcggttagtgatcaactcaagaagcatggatttaaactcggacccgctccgaagaccctggggtttaatttggaaagcggatggggttccggccgtgccggcccctcctattctatgccggtccacgccgccgtgcagatgacgactgaacagctgaagactgagttcgacaagctgttcgaggacctgaaagaagatgataaaacacacgagatggaacccgccgaagcaatagaaacacccttgctgcctcaccagaagcaagccctcgcctggatggtgtcccgagagaattcaaaggagctgccgcctttctgggaacagaggaacgatctgtactacaacaccatcacaaactttagcgagaaggatcgccctgagaacgtgcatggcgggattctggccgacgacatggggctcgggaagacactcactgccatcgctgttattctcaccaatttccatgacggccggccactaccaattgaaagagtcaaaaagaatctgctgaagaaggagtataacgtgaatgatgattcgatgaagctaggaggcaataacacctcagaaaaagctgacggtctgtcaaaagacgctagcagatgttccgaacagcccagcatctctgatattaaggagaagtccaaatttcggatgagcgaactgtctagcagcagacctaagcgtagaaagaccgctgtgcagtacattgaatcctccgactccgaggagatcgagacaagtgaactcccccagaaaatgaagggaaaactgaagaatgtgcagtctgaaactaaaggtagggccaaggctggcagcagtaaggtgattgaggacgtagcatttgcttgcgccctgacgagcagcgtgcccacaacgaaaaaaaagatgcttaagaaaggcgcctgtgcagtcgaagggtccaaaaaaacagatgtcgaagagcgccctcgcacgacactaataatctgcccactgtccgtgctgagcaactggatcgaccaatttgggcagcatattaagtcagacgtacacctcaatttctacgtttactacgggccagacaggatccgcgagccagcattactcagtaagcaagacatagtcctgactacttataacattttaacacacgactacggaaccaagggtgacagtcccctgcactcaattagatggctgcgggtaatccttgacgagggccacgccattcgtaatcccaacgcccaacaaaccaaagctgttctggacctcgagtctgaacggcgatgggtattaacaggcactcccattcagaattctctgaaagatctgtggtccctgctgagcttccttaagctgaagcccttcattgaccgcgagtggtggcacaggactatccaacgcccagttacaatgggagacgagggtggcctgcgtcggctacagagcctaatcaagaacatcacgctcaggagaacgaagactagcaaaatcaaaggaaaaccagtcctggagcttcctgagcgaaaggttttcatccagcacattacattgtctgacgaggaacggaaaatctatcagagcgtgaagaacgagggacgagcaactatcgggcggtattttaatgagggtactgtgttagcccactatgcggacgtcctcggcctcctgcttaggctgagacagatttgttgccatacctatttgcttaccaatgcggtttccagtaatggaccaagcggtaatgataccccagaggagcttcgcaagaaactgatacggaagatgaagctgattttgtcctccggctccgacgaagagtgcgctatatgtctggattccttaaccgtgcctgttattacacactgtgctcacgtcttttgtaagccttgcatctgccaagtgatccagaacgagcagccgcatgcaaagtgcccactctgccgaaacgatattcacgaagataaccttttggagtgccccccggaagagcttgccagggatagcgagaagaaatcagacatggagtggacctcctcttccaagatcaatgctctcatgcatgcccttaccgatctaaggaaaaagaatcctaatattaaaagcctggtggtgagccagtttacaaccttcctttccctgatagaaattccattaaaggcttctggctttgtgtttacccgcttggacggctcaatggcgcaaaagaagcgcgtggaaagcatccagtgctttcagaacactgaggccggaagtccaacaatcatgctcctgtctctgaaggccggcggagtcggcctgaatttaagtgccgcttctcgcgtcttcttgatggaccctgcctggaaccccgctgcagaagatcaatgttttgacagatgccaccgactcgggcagaagcaggaggtcatcatcacaaaatttatcgtaaaagacagtgtggaagagaatatgctgaagatccaaaacaagaagcgggagctcgccgcgggggccttcggtacgaagaagcccaacgctgatgaaatgaagcaggccaagatcaatgagatcaggacccttatagacctgtag

SEQ ID NO: 19369 - DNA, 984 bp, Artificial Sequence
  Description of Artificial Sequence: Synthetic coding sequence
atgagcgacaagctgaaggagcggaaggtgagccggctgagccccaatgggacctgtgccctggtagttgaggctagtgattcacctacacgacacctcggtggaccaatggccggcaagtgtccacatggtacactctcagtggaggagagccgtgtgcgaacgccggtttcacacaaagtcattgaaaaaaggagaagagatcggatcaaccgatgcttaaacgaactgggcaaaacagtgcccatggcactggcaaagcagggcgaaccacaggaggcccttgcacagattcgttctcgcgtacgctctttggttctctcctctgccactgtcccagatcagcaggccctggggaggtgtgaaggcccattcctgctgctacagtcttccgggaaactcgagaaagctgaaattcttgagatgacagtgcagtacctgagagcactgcacagcgctgattttccccgcggacgagagaaggctgagctgctggcggagttcgcaaattacttccattatggttatcacgaatgtatgaagaacctggttcattacctcaccaccgtcgaacgaatggagacgaaagacactaaatacgctcgcatattggcatttcttcagtccaaggcccggctgggggcggagcccgcttttcctccccttggctctctgcccgaaccagacttctcctatcagctccatcctgcaggccctgagttcgccggacactcaccaggggaagctgctgttttcccccaggggtcaggggcaggcccctttccttggcctcccggcgcagcccggagccctgctttaccctacttaccttccgcaccagtgcccttggcctcacccgcccagcaacacagcccctttctgacgcccgttcaaggactcgatcgccactaccttaacctgattggccatgctcatcctaatgctttgaacctccatacaccacagcacccacccgtgctatag

SEQ ID NO: 19370 - DNA, 726 bp, Artificial Sequence
  Description of Artificial Sequence: Synthetic coding sequence
atgagcgacaagctgaaggagcggaagcggacccccgtgagccacaaagttattgagaaacgccggcgcgaccggatcaaccggtgtctcaatgagctgggcaaaacagttccgatggccctggccaaacaatcgagtggcaagttggaaaaggccgagattttggagatgaccgtgcagtacctacgggccctgcatagcgcagactttcccagaggacgggagaaggagctgttagccgagttcgcaaattattttcactatggatatcacgaatgtatgaagaatctggtgcattacctgaccacggtagaacggatggaaactaaagataccaagtatgcaaggattttagccttcctgcaatccaaggccagactgggcgccgagccagcatttccccccctgggctcgctgcctgagccggacttttcttaccagctccacccggctgggccggagttcgccgggcactctcccggggaagccgccgtctttccccagggatccggagctgggccctttccatggccccccggcgcagcaagatccccagctctcccttacttgcccagcgccccagtgccgctggcttctccagcccaacaacacagtccgttcctgacccctgtacagggactggacagacattacttaaatctcatcggacacgcccacccaaacgctctaaatctacatacaccacaacacccccccgtgctatag

SEQ ID NO: 19371 - DNA, 729 bp, Artificial Sequence
  Description of Artificial Sequence: Synthetic coding sequence
atgagcgacaagctgaaggagcggaagcggacccccgtgagccacaaggtcatcgagaagcggcgcagagaccggattaatagatgcttaaatgagctgggcaagaccgtacccatggccctggctaaacagtcaagcggcaagttggagaaggcagagatcctggaaatgaccgtccagtaccttagagccctgcattctgctgatttcccgcgaggtcgggaaaaagctgaactgctcgccgaattcgcgaattactttcactacggctaccatgagtgcatgaaaaacctcgtacactacttgacaacggtggagaggatggagaccaaagatacgaagtacgcccggatcctggcgtttctgcagtccaaagcacgcttgggcgctgagcctgctttcccccctttggggagcctgccagagcctgacttttcctaccaattacatcctgctggccctgagttcgctggacactctccaggcgaggcagctgtgttcccccaaggctctggtgccggcccgtttccctggcctcccggcgctgcccgcagtcctgcactaccctaccttccatctgcacctgtccctcttgctagtccggctcagcaacactcaccatttctgacacctgttcaggggttggaccgccattatctgaacctcattggccatgcgcaccccaatgctcttaaccttcatactcctcagcacccacctgtgctttag

SEQ ID NO: 19372 - DNA, 2031 bp, Artificial Sequence
  Description of Artificial Sequence: Synthetic coding sequence
atgccccacgccttcaagcccggcgacctggtgttcgccaagatgaaagggtatccgcactggccagccagaatcgacgatatcgccgatggagcagtgaaacctcctcccaataagtatcctatattcttttttggtactcacgagacagccttcctcggccccaaagatttgtttccctacgacaagtgtaaggacaagtatggcaagcctaacaagagaaagggtttcaacgagggcctgtgggagattcagaacaacccacacgcaagctactcagcaccacctccagtcagttcttcagactccgaagcacccgaggctaaccctgcagacggaagcgacgctgacgaggatgatgaggatcggggagttatggccgttactgccgtcaccgccactgcggcttcggatcgaatggaaagcgactcagatagcgacaaatcatcggacaattcaggcctgaaacgcaaaactcctgcgctgaaaatgagtgtgtcaaagcgagcacgcaaggccagttcagacctggatcaagcatcagtcagcccctctgaggaggaaaactcagagagctcatccgagtccgagaagacgtctgatcaggactttacccccgagaaaaaggcagcagtaagggcaccccgcaggggcccattaggcggccggaaaaaaaagaaggcaccttctgcgtcagatagtgatagtaaggccgacagtgatggcgccaaacctgaaccggtggcgatggctcgatcggctagcagctcaagctcctcctcaagcagttctgattcagatgtaagcgtgaagaagccccctcggggtcgcaagcccgcggagaagccgctgccaaaacctcgcggcagaaaacctaagcccgaacggccccctagctcctcatcatccgacagtgactccgatgaagttgaccgcattagcgaatggaagaggcgggatgaggcacgacgacgtgagttagaagcacgccgaaggagggagcaagaggaggaacttcgacggctgagagaacaggagaaggaggagaaggagaggaggcgggaaagggccgaccgtggcgaggccgagaggggatctgggggatcctcaggcgatgagctgcgtgaggatgatgagcctgttaagaaaaggggaaggaaaggtcgaggacgagggccacctagctcatctgactcagagcctgaggccgaactggagagggaagcaaagaagagtgctaagaagcctcagtctagcagtactgagcccgcccgtaagcctggacaaaaagagaagcgggtgcggccagaggagaagcaacaggcaaaacccgtcaaagttgagaggacaagaaagcgcagcgaagggttctctatggacaggaaagtggaaaaaaaaaaagagccctctgtggaagaaaagctgcagaagctgcacagtgagataaagttcgcgttaaaggtggactcccccgacgtgaaacgttgcttgaacgccttggaagagctgggaactctgcaggtgactagtcagatattgcagaagaatactgacgtggtggccacccttaagaagattcgacgttataaggctaacaaagatgtgatggagaaggcagcagaagtgtacactaggctaaaatcacgcgtcttaggacctaagatagaagctgttcaaaaggtgaacaaggctggaatggaaaaagagaaggccgaagagaaacttgcgggcgaggaacttgcaggtgaagagctggccggggaagaagccccacaagaaaaagccgaggataaacctagcaccgatctgtctgcacccgtgaacggcgaagccacctcccagaagggcgaaagcgccgaggacaaagagcatgaggaggggagggattccgaggaaggtcccagatgcggtagcagtgaggatcttcacgactctgtccgggaggggcccgaccttgatcggccaggctctgacagacaggagcgggagcgggcccgcggcgacagtgaggccctggacgaagaatcctag

SEQ ID NO: 19373 - DNA, 1524 bp, Artificial Sequence
  Description of Artificial Sequence: Synthetic coding sequence
atgaagggctacccccactggcccgcccggatcgacgacatcgccgatggggccgtgaagccaccaccgaataaataccccattttcttttttggaactcacgaaactgcattcctggggcccaaggatctctttccttatgacaaatgcaaggacaagtatggcaaacctaataagcgaaagggattcaatgaaggcctgtgggaaatccaaaataatccccatgccagttatagcgcaccacccccagtgagctctagtgacagcgaagctcctgaggcgaacccggctgacggctcagatgcagatgaggatgacgaagaccgcggggtgatggctgtgacagctgtgactgcaaccgcagcttctgatcgcatggaatctgactccgactcagataagtcctctgataatagtggcctcaagagaaagacaccagctctgaaaatgtcagtgtctaagcgagcccggaaggcctcttctgatctggaccaagccagcgtgtcaccctctgaagaggaaaattcggagtcctccagcgagtctgagaagacgagcgatcaggatttcacaccggagaaaaaagctgctgtccgcgcaccgcgccggggtccacttgggggcagaaaaaaaaagaaggcgccctctgccagtgatagcgatagtaaagctgattccgacggcgctaagcctgaacctgtggccatggccaggagcgcctcatcctcttcctctagcagtagttcctcagacagcgacgtgtcagtgaaaaagccccctcggggccgaaaacccgcagagaaacctttacccaagcctcgcgggcgcaagccaaagcctgagaggccaccaagttccagcagttccgattcagattccgacgaagttgatcggatttctgagtggaaaagacgcgacgaagctcgtcggcgcgagcttgaggcccgtcgcaggcgggagcaggaggaagaactgaggcgtttaagggagcaggaaaaggaggagaaggaaagacgacgggagcgtgctgaccgaggtgaggcagaaagggggtctggaggttcttccggcgatgaactccgcgaagatgatgagcctgtcaagaagcgtggccgcaaaggccgcgggaggggcccacctagtagctcggatagtgagcccgaggcagagctcgaacgtgaggccaagaagtcggccaaaaagccccagagcagcagcacagagccggccagaaaaccaggacagaaagagaagcgcgttcggcccgaagaaaaacaacaggcaaagctggaatgcaatggtgtaattagtgcgcactgcaacctccgcctgcctggctccagcgatagtccggcgagtgccctccccagctcctgggactatcgccacccacctccaaggcttgcaaacttctgttgctttagtagacacggggtgtccagctgctggccgggttggtcacgttctccagaccctgtgatctgtccccctcagccacccaaagtgctgggtctgcaggtatag

SEQ ID NO: 19374 - DNA, 1662 bp, Artificial Sequence
  Description of Artificial Sequence: Synthetic coding sequence
atggccaccgacaccagccagggcgagctggtgcaccccaaggccttgcccttgatcgttggcgcccagctgatacacgcagacaagctgggcgaaaaagtggaagacagtactatgcctatccggcgcacagtaaattcaacaagggaaacccccccaaaaagcaagctcgccgagggggaagaggagaaaccagaacccgacatttcttctgaagagagtgtgtcaaccgtcgaagagcaggagaatgaaaccccacccgccacgagctccgaagcggagcagccaaagggcgaacctgagaacgaagagaaggaggagaataagtcctctgaggaaaccaaaaaggacgagaaggatcagtctaaagaaaaggaaaagaaggtgaaaaaaacgatccccagctgggccacattgtcagcctctcagctggcgcgggcacagaagcagaccccaatggcctcctcgccccgaccgaaaatggatgcaattctgacagaggccatcaaagcctgtttccagaaaagcggcgctagtgtggtggcgatccgaaagtacatcatccataaatatcctagcttggaattggagaggagggggtatctgctcaaacaggccctgaaaagggaactcaacaggggcgttattaagcaggtgaagggcaagggtgcctctgggtcattcgttgtagtgcagaaaagcagaaaaactccccagaagtcgagaaatcgcaagaataggtcctccgctgtcgatcctgaacctcaagtgaaactcgaggacgttctgcctctggcttttacccgtctgtgtgaacctaaggaagcctcatattctctcatccgcaagtatgtatcacaatactatccaaagttgagagtcgatatccggccacagttgctgaagaacgctttgcagcgggcggttgagcgcggccaattagaacagatcacggggaagggagcttctggaacatttcagcttaaaaaaagcggggagaaacctctgttgggcggatccctcatggaatatgctatattgagcgctatcgctgctatgaacgagcctaaaacttgcagcacaaccgcccttaaaaaatatgtgcttgaaaatcaccctggaacgaacagcaactatcaaatgcatctgctgaagaaaactcttcagaagtgtgagaagaacggctggatggaacagataagtggcaaaggcttttccggtacttttcagctctgtttcccgtactaccccagccccggtgtgctcttcccaaaaaaggagcccgatgactctcgagatgaggacgaagatgaggatgagagtagcgaggaagacagcgaagatgaggagcctcctcccaaacggagactccagaaaaagacccctgctaagtccccaggaaaagccgccagcgtgaaacaaagaggcagtaagccggccccgaaagtttctgctgcccaaaggggaaaggccaggccattgcccaaaaaagcaccacccaaagcgaagacaccagccaaaaagaccagaccaagtagcacagtgataaagaaaccaagcgggggttcttctaagaaacctgctacatccgctcgcaaggaagtgaaattacctggtaagggaaagagcacgatgaagaagtcctttcgcgttaaaaagtag

SEQ ID NO: 19375 - DNA, 402 bp, Artificial Sequence
  Description of Artificial Sequence: Synthetic coding sequence
atggccaccgacaccagccagggcgagctggtgcaccccaaggccctgcctctaatcgtgggcgcgcagctcatccatgccgacaaattgggcgagaaagtggaggatagcaccatgccaatccgtagaaccgtaaacagcacgcgagagactcccccaaagtccaaactggcagagggagaagaagaaaaacccgaacctgatatatcctccgaagagagtgtgagtacagtggaagaacaagagaatgagacgccacctgccacctccagtgaggccgagcagcctaagggagaacccgaaaacgaagaaaaggaagaaaacaagtcgtctgaagaaactaagaaggaaagggccgattctatacattccacattgttcatcattgggcagaattcatag

SEQ ID NO: 19376 - DNA, 1206 bp, Artificial Sequence
  Description of Artificial Sequence: Synthetic coding sequence
atggccagcagcccccggcccaagatggacgccatcctgaccgaggcaattaaagcgtgcttccagaagtcaggggcaagtgttgtagccattcggaagtacatcattcataaatatccctctttggagctggagagacgtggttaccttctcaaacaagccctgaagcgggagctcaaccgcggggtcataaaacaggtgaaaggcaagggcgccagcggatcattcgttgtggttcaaaaaagtcgcaaaaccccccagaagtccaggaacaggaaaaaccgtagttccgctgttgatcccgaacctcaggtcaagctggaggacgtcttgcccctggcgttcactcggttgtgtgagccgaaagaggcctcttacagtctgattaggaaatacgtgtcccagtattatccgaaactgcgggtagatatccgccctcagctgctgaagaacgccttgcagcgggctgtggagcgtgggcagctggaacagatcacgggcaagggcgcatctggcactttccagctcaaaaagagcggagagaagccactgctgggtgggtctctgatggaatacgccatactgtccgccatcgctgccatgaacgaaccaaagacttgctcgacgactgcactgaaaaaatacgtgttggaaaatcatcctgggacaaactctaattaccagatgcacctgctgaagaaaacactgcagaaatgcgagaagaacgggtggatggagcagatatccgggaagggcttctccggtaccttccagctctgcttcccgtactatcctagccccggagtgctgttcccgaaaaaggagcccgatgatagcagggatgaggacgaagatgaagatgagtcctctgaagaagattctgaagacgaggagccacctcccaagcggaggctgcagaaaaaaactccagccaaaagtcccggcaaagcagcaagcgtcaaacagcgcggcagcaagcccgccccaaaggtcagcgccgcacagcgtgggaaggccagacctctgccaaaaaaggcgcctcctaaagctaagacacccgccaaaaaaaccagaccctcaagcaccgtcatcaagaaaccaagcgggggcagctccaagaaaccagcaacatctgcccggaaggaggtgaagcttcctggcaaaggcaagagcactatgaagaagtcatttagagttaagaaatag

SEQ ID NO: 19377 - DNA, 1548 bp, Artificial Sequence
  Description of Artificial Sequence: Synthetic coding sequence
atgcccatccggcggaccgtgaacagcacccgggagaccccccccaaaagtaagctggccgaaggcgaggaggagaagccggaaccagatatttcatccgaagagagtgttagtacggtggaagaacaggaaaacgaaacgcctccggccacaagctctgaggccgagcagcctaaaggagagcctgagaacgaggagaaggaggaaaataagtcttcagaggaaacaaaaaaagatgagaaggaccaatcgaaagagaaggagaagaaagtgaagaaaactatacccagctgggccacactgagtgcctctcagctcgctagagcgcagaaacagacccctatggctagtagccctcgaccaaagatggatgccatactgactgaagctatcaaagcttgtttccaaaaatcaggcgcctccgtggtggctattcggaaatatatcatccataaatatccatcgctggagctcgaaaggaggggttaccttctcaagcaggcgctaaaaagggaactgaatagaggggtcatcaaacaggtgaagggcaagggcgcatccgggagcttcgtggtggttcaaaaatcgagaaagacaccgcaaaagagcagaaaccgcaaaaaccggagtagtgcagtggacccagagccccaagtgaaactcgaagacgtcttgccgctggccttcacgagattatgtgagccaaaagaggcctcatactctctgatccgaaagtatgtgagccagtattaccccaaactgcgggtcgacatcagacctcagctgttaaaaaatgccttacagagggccgtggagcggggacaactggaacaaataactggcaagggcgcatcgggcacgttccagctgaaaaagagtggggaaaaacccctcttaggaggcagtctgatggaatacgctattctgagcgctattgcagccatgaatgagccaaaaacttgtagcactacagccctgaaaaagtacgttctggaaaatcacccaggcacaaatagcaattaccagatgcacctgctgaaaaaaacgctgcagaaatgcgagaaaaatggctggatggagcagatatcaggtaagggattttccggcacctttcagctatgcttcccatactatccttctcccggcgtattgttcccaaagaaggagcctgacgactctagggacgaagacgaggacgaagacgagagttccgaagaggattctgaagacgaggagccaccccctaagcgaaggctgcagaagaaaactccagcaaagtcgcccggaaaggctgcaagtgtgaaacagagaggttccaaaccagccccaaaggtgtcagctgcccagaggggcaaggcccggcccctgccgaagaaggcgccaccaaaagctaaaactccagctaaaaaaacccgcccttcttcgaccgtgatcaaaaaacccagtggcggaagttctaaaaaaccagccacctcggcgcggaaggaggtgaaactgcctggcaagggcaagtccaccatgaagaagtcatttcgtgtgaagaagtag

SEQ ID NO: 19378 - DNA, 231 bp, Artificial Sequence
  Description of Artificial Sequence: Synthetic coding sequence
atggccaccgacaccagccagggcgagctggtgcaccccaaggccttgcccttgatcgtgggcgcacagctgatccatgcagataaactgggagaaaaggtcgaggattccaccatgccaatccggcgcaccgttaattcaacaagagagacaccccctaagagtaagctggcagagggggaggaagagaaaccagagcccgacatctcctctgaggaatcagtttcctag

SEQ ID NO: 19379 - DNA, 375 bp, Artificial Sequence
  Description of Artificial Sequence: Synthetic coding sequence
atggccaccgacaccagccagggcgagctggtgcaccccaaggccctgccccttattgtgggcgcccagctcatccacgcagacaaactgggggaaaaggtggaggatagcacgatgccaatcaggagaacggttaatagcactagagagacccctcctaaatctaaactggcagagggtgaggaggagaagcctgaacccgacatatccagtgaagagtctgtctccacggtggaagaacaagaaaatgaaactccacctgctacttcttcagaggcggagcaacccaagggggagcccgagaatgaggagaaggaggaaaataagagctcagaggagacaaagaaagatgaaaaggaccaatccaaagaatag

SEQ ID NO: 19380 - DNA, 123 bp, Artificial Sequence
  Description of Artificial Sequence: Synthetic coding sequence
atgcccatccggcggaccgtgaacagcacccgggagaccccccccaagtccaagttagctgagggggaagaagaaaagcccgagccagatatttcctctgaggaaagtgtctccactgtgtag

SEQ ID NO: 19381 - DNA, 762 bp, Artificial Sequence
  Description of Artificial Sequence: Synthetic coding sequence
aagaaggacgagaaggaccagagcaaggagaaggagaagaaggtgaaaaaaacaataccctcttgggccacgctcagtgcctcccagcttgctagggcacagaagcagacccctatggcgtcttcccctcgacccaagatggatgccattctgactgaggctatcaaggcctgttttcagaagtcaggcgcgagtgtggttgcaatcagaaagtacattatccataagtatccttctttggaactcgagcgcaggggctacttgttaaaacaggccctgaaacgcgagctcaatcggggagtgatcaagcagaacaggtcatccgccgttgatcctgaacctcaggtcaaactagaagatgtgctgccgctggcttttaccagactctgtgaacctaaggaagcctcctatagcctgatccgaaagtatgtgtctcagtattatcctaagctaagagtcgatatcagaccccaactgctgaagaacgcattgcagagggcggtagagagggggcaactagagcagattactgggaaaggcgccagcgggaccttccagctgaagaagtcgggggagaaacccttactaggcggatcactcatggagtatgcgatcctgtctgccatcgccgccatgaacgagccgaagacatgtagtaccacagctctgaagaagtatgtgttggagaatcaccctggaaccaactccaattaccagatgcacctgctcaagaagaccctccagaagtgcgagaagaattag

SEQ ID NO: 19382 - DNA, 837 bp, Artificial Sequence
  Description of Artificial Sequence: Synthetic coding sequence
atgcccatccggcggaccgtgaacagcacccgggagaccccccccaagagcaagttagctgagggcgaggaggagaaaccagagcctgatataagttctgaagagtctgtgtctaccgtggaggaacaagagaatgaaaccccaccggcaacctcttccgaggctgaacagcccaaaggcgagccagaaaacgaggaaaaggaggagaataaatccagtgaggaaactaaaaaggacgagaaagatcagtccaaggagaaagagaaaaaagtgaagaagacaataccgtcatgggcaaccttgtcagccagccagttagcccgcgcccagaagcagactcccatggcgtcctctccccgaccaaaaatggacgcaatcttgactgaggctataaaggcttgttttcagaaatccggtgcatctgttgtggctattaggaaatatattattcacaaatacccatctttggaactcgagcgccggggctacctcctaaagcaggccctcaaaagagaactgaatcgcggagttattaagcaggtgaaggggaaaggagcctcaggctcattcgttgtagtccagaaaagcagaaaaaccccacagaagagcaggaatcggaaaaaccgctctagtgcggttgaccccgagccacaggtcaaactggaagacgtgttgcctctggccttcactagactgtgtgagcccaaagaggctagctactctctcattagaaagtacgtgtctcagtactatccgaagctgcgcgtggacataagaccccagctgctgaaaaacgccctgcagcgcgctgtggaaagaggccagctggagcaatag

SEQ ID NO: 19383 - DNA, 138 bp, Artificial Sequence
  Description of Artificial Sequence: Synthetic coding sequence
atgcccatccggcggaccgtgaacagcacccgggagaccccccccaagagcaaactcgccgaaggagaagaggagaagcctgagcctgacataagttctgaggaatcagtcagtaccgtggaagaacaagagaattag

SEQ ID NO: 19384 - DNA, 984 bp, Artificial Sequence
  Description of Artificial Sequence: Synthetic coding sequence
atggccaccgacaccagccagggcgagctggtgcaccccaaggcccttcctctgatcgttggtgcacagctgattcatgccgacaagctgggagagaaggtcgaagattccaccatgcctatacgacgaaccgtaaatagcactcgcgagacaccacccaagtctaagctggccgagggcgaagaagagaagcccgagcctgacatttcaagcgaagaaagtgtatcgactgttgaggagcaggagaacgaaactccgcctgctaccagctctgaagctgaacagccaaagggtgagcctgagaacgaggagaaagaagaaaacaagtctagcgaagagacgaagaaagatgaaaaggaccagtcaaaagagaaagagaagaaagttaagaaaactatcccatcttgggccacactgtcggctagccagctggcgagagctcagaagcaaactcctatggccagctcccctcggccaaaaatggatgccatcctgacagaggctatcaaggcctgtttccagaaaagcggcgcatccgtggtggcaatcagaaagtacatcattcacaaatatccatctctcgaactcgaaagacgcggctacctattgaaacaggctcttaaaagagagctgaaccggggcgtcatcaaacaggtgaagggcaaaggagctagtggatctttcgtggtggtgcagaagagcaggaaaaccccccagaagagtcgcaaccgtaagaatagatcttccgcagttgatccagagcctcaggtcaagctggaggatgttctgccattggcctttacccgcctctgcgagcctaaggaggcttcatatagccttatacgtaagtatgtgtcccagtattacccgaagttgcgggtggacatccggccccagctcctgaagaacgctctgcagagggccgtggagcgcggtcagttagagcagattaccggtaagggagccagtgggacctttcaatag

SEQ ID NO: 19385 - DNA, 60 bp, Artificial Sequence
  Description of Artificial Sequence: Synthetic coding sequence
atgcccatccggcggaccgtgaacagcacccgggagaccccccccaagagtaaactgtag

SEQ ID NO: 19386 - DNA, 918 bp, Artificial Sequence
  Description of Artificial Sequence: Synthetic coding sequence
atggagaacagccagctgtgcaagctgttcatcggcggcctgaacgttcagactagcgaatcaggcctaagggggcactttgaggcctttggcacactgaccgactgtgtagtcgtggttaacccccagaccaaacgaagccggtgctttggatttgtgacctattcaaacgtggaagaagctgatgccgctatggccgcctcaccgcacgcggtggacggcaacaccgtcgaacttaagcgcgctgtctcccgcgaggattctgctagacctggagctcacgcaaaagttaagaagctgtttgtgggaggcttgaagggtgacgtggcggagggagatttaatcgaacatttctcccagttcggcacggtcgaaaaagccgaaattattgctgacaaacagtcaggcaaaaagcggggatttggatttgtatactttcagaaccacgatgcagctgacaaagccgccgtggtgaaattccatccaattcagggacatagggtcgaggtgaaaaaagcagtgcccaaggaggacatctacagtggcggcggcggtggagggagccgcagtagccgaggcggccggggtggaaggggcaggggaggcggtagagaccaaaatgggctgtcaaaaggcgggggtggtggctacaatagttacggggggtacggaggaggggggggaggcgggtacaatgcatatggaggcggagggggaggctcgagctacggggggagcgactatggaaacgggttcggcgggttcggctcatattcacagcatcagagcagctatgggcccatgaagagcggggggggcgggggcgggggtggctcctcatggggggggcggagtaattcaggaccttatcgcgggggatatggtggcgggggagggtacggtggaagcagcttctag

SEQ ID NO: 19387 - DNA, 1107 bp, Artificial Sequence
  Description of Artificial Sequence: Synthetic coding sequence
atgggcaccccccccggcctgcagaccgactgcgaggccctgctgtcacgattccaggagacagatagtgtccgatttgaggatttcacggaattgtggcgaaacatgaagttcggtacgattttctgcggtcgaatgaggaatctcgaaaagaatatgtttaccaaagaggccttggcactagcatggcgatatttcctacccccatataccttccagatcagagttggcgctctctatctgttatacggcctatacaatacccaactttgccagccaaaacagaaaatccgcgtggcgctgaaagactgggatgaagttctgaagtttcagcaagacctggttaacgcccaacactttgacgccgcttatatttttcgaaaactgcggctcgacagggcttttcacttcacggcaatgccaaagctcttgtcttacaggatgaagaagaagatccatagagccgaggtaacagaagaatttaaagacccaagcgatagagtgatgaaactgatcacctcagacgtgctggaggagatgctgaatgtgcatgatcattaccaaaacatgaagcatgtgatatctgtagacaagagtaaaccggataaggcgttgtcactgatcaaggacgattttttcgataacataaaaaatatcgtgctggagcaccagcagtggcacaaggatagaaaaaacccctctctcaaatcaaagactaacgacggcgaggagaaaatggagggcaacagtcaagaaactgagcgctgtgaacgggcagagtcactggcaaagatcaaatctaaggcgttcagtgtggtgatccaagcttctaaatccagacgtcacaggcaggtgaagctggactcctcagatagcgattctgccagcggacagggacaggtcaaggccacccggaaaaaagaaaaaaaagaaagacttaagcccgctggaaggaagatgtcgcttagaaacaagggtaacgttcaaaacattcataaagaagacaagcccttgtccctgagtatgcccgttataacggaagaggaagagaacgagtcactgtcaggcactgagtttaccgctagtaagaagaggaggaaacattag

SEQ ID NO: 19388 - DNA, 921 bp, Artificial Sequence
  Description of Artificial Sequence: Synthetic coding sequence
atggccagcaacgtgaccaacaagaccgacccccggagcatgaactctcgcgtgtttatcgggaacctgaataccctggtagttaaaaagagcgacgtggaggcaatcttcagcaaatatgggaagattgtcggctgctccgtccacaaaggctttgcattcgtgcagtacgtgaatgagagaaatgcccgggctgcggtagcaggagaggatggacggatgattgctggccaggtgctcgatattaatcttgctgccgagcctaaggtcaatagaggtaaggccggagtcaaacgctccgctgcagagatgtacggtagtgtgacggagcacccttctccttccccgctgctttcctcgtcattcgaccttgactacgacttccagcgggattattatgaccggatgtactcctaccctgcgagagtgcccccacccccaccaatcgcgcgtgccgttgtcccatcaaagagacagagggtgtctgggaataccagccggcgcgggaagagcggcttcaattcaaagtctggccagagaggttctagcaaaagcggcaaactcaaaggcgatgacctccaagccatcaagaaagagctgacacagatcaaacaaaaggttgatagtctccttgagaacctggagaaaattgaaaaggagcagagcaaacaggccgtagagatgaaaaacgacaagagcgaagaagaacagtctagctctagcgtcaagaaggatgagactaatgtaaagatggaatctgaaggcggcgccgacgactccgcagaggaaggggatctccttgacgatgacgacaacgaagaccgaggggacgatcagttagaacttatcaaggacgatgagaaggaggccgaggagggggaggacgatagagactctgctaatggcgaggatgactcttag

SEQ ID NO: 19389 - DNA, 309 bp, Artificial Sequence
  Description of Artificial Sequence: Synthetic coding sequence
atggccagcaacgtgaccaacaagaccgacccccggagcatgaactcacgtgtttttatagggaacctgaatacccttgtggttaaaaaatcagatgtggaagcaattttttcaaaaaaggatgagacaaacgtaaagatggagtctgaaggcggtgccgacgattcagccgaagaaggggatctgctcgacgatgacgacaatgaggatcggggtgacgatcaactcgaactgatcaaggacgatgagaaggaggccgaggagggcgaagatgacagagactcagcaaacggtgaggatgattcatag

SEQ ID NO: 19390 - DNA, 921 bp, Artificial Sequence
  Description of Artificial Sequence: Synthetic coding sequence
atggccagcaacgtgaccaacaagaccgacccccggagcatgaacagcagagttttcatcggtaatctcaataccctagtggtcaagaagagcgatgtggaagccatctttagcaagtacggaaaaatagtgggatgcagcgtacacaagggattcgccttcgttcagtacgtgaacgagcgaaacgctagggctgcagtggccggcgaggatgggagaatgatcgccggacaggttctggatatcaacttagctgctgagccaaaagttaatcgtggaaaggccggggtcaagcgtagtgcagccgagatgtacgggtccgttacggagcatccctctccgtcgccactacttagctcttcttttgatctggactacgactttcagagggactattatgatcggatgtatagctatcctgccagggtacctcccccccctccaatagcaagggccgtcgtgccatctaagcggcagagagtaagcggaaacaccagccggcggggtaaaagcggattcaatagcaagtctgggcaacgaggttccagtaaatctggaaagctgaaaggcgatgacctacaggcaatcaaaaaggaattgacacagatcaagcagaaagtggacagtttgttggaaaacctggaaaagatagagaaagagcagtccaagcaggcagtggagatgaaaaatgacaaaagcgaggaggaacagtctagttcgagcgtgaagaaagacgaaacgaacgtgaagatggaaagcgagggcggcgccgatgactccgccgaggagggggacctgttggacgacgatgacaacgaagaccggggagatgaccagctggagctaatcaaggacgatgagaaggaggcggaggagggcgaagatgatcgcgactccgctaacggtgaagatgactcttag

SEQ ID NO: 19391 - DNA, 882 bp, Artificial Sequence
  Description of Artificial Sequence: Synthetic coding sequence
atggccagcaacgtgaccaacaagaccgacccccggagcatgaactcaagagtgttcatagggaatctgaacacactggtggtcaagaaaagcgatgtggaagccatcttctcaaagtacggtaagattgtcggctgctccgtgcataaagggttcgcctttgtgcagtacgtgaatgaacgaaacgccagagctgcagtcgcaggagaggacgggcgcatgattgctggacaggttctagatattaacttggccgctgagcccaaggtcaatcgaggcaaggccggcgtgaagcgaagcgctgccgaaatgtacgggtcgagcttcgacctagattatgactttcaacgcgactactatgaccgcatgtacagctatcctgccagagttcccccgcccccgcctatcgccagagccgtagtacccagcaagagacagagggtctctgggaataccagccgccgcggaaagtctgggttcaatagcaaatcagggcagcgaggctcgtctaaatctggtaagttgaagggtgatgacctccaagcgattaaaaaagagctcacgcaaatcaagcagaaagtggattccctcctagaaaatctcgagaagattgagaaggagcagtcaaaacaggccgtagaaatgaaaaatgataaatcagaggaagaacaaagctcaagcagcgtcaaaaaggacgagacaaacgtgaaaatggaatcggagggcggcgctgatgactccgctgaagaaggtgacctgcttgacgatgacgacaatgaggatcggggagatgatcagctcgaactgattaaggatgatgaaaaagaggcagaggagggcgaagacgatcgagatagcgccaatggagaagatgattcctag

SEQ ID NO: 19392 - DNA, 912 bp, Artificial Sequence
  Description of Artificial Sequence: Synthetic coding sequence
atggccagcaacgtgaccaacaagaccgacccccggagcatgaactctcgcgtttttattggcaatttaaacaccctcgtggttaagaagtcggacgttgaggccatattttccaaatatggcaagatagttggatgctcagttcataaggggttcgcattcgtgcagtatgtcaacgagcgcaatgcccgtgccgccgtcgccggggaagatggtagaatgattgccggacaggtccttgatataaacctggcggccgagcccaaagtcaacagaggaaaagccggcgttaaacggagcgctgccgagatgtatggaagtgtgactgagcatccttcaccatcacccttgctgtccagtagcttcgatctggactatgattttcagagggactactacgatcgaatgtactcttaccccgctagggtgcccccacctccccccattgctcgggccgttgtaccttcgaagagacagagagttagtggcaacacgagccgacgcggcaaatccggttttaactctaagtctggacaacggggatcttccaaatccgggaagcttaaaggtgacgacctccaggctattaaaaaagaactgacccagattaagcagaaggttgacagcctgctagagaatctcgagaaaatcgaaaaggaacagtccaaacaggccgttgagatgaagaacgataagagcgaggaggaacagtctagctcaagtgtgaaaaaggatgagactaatgtgaagatggagagcgaaggcggcgccgacgacagtgccgaagaaggggatctattggacgacgacgacaacgaagacagaggcgatgatcagcttgaactcatcaaagacgatgagaaagaggctgaggagggggaagacgatagggacagtgccaacggaggttag

SEQ ID NO: 19393 - DNA, 882 bp, Artificial Sequence
  Description of Artificial Sequence: Synthetic coding sequence
atggccagcaacgtgaccaacaagaccgacccccggagcatgaactcaagggtgttcattgggaacctcaatacgcttgtggtgaaaaagagtgacgtggaagccattttttccaagtacggaaagattgtgggctgcagtgttcataaagggttcgctttcgtgcagtatgtgaatgagaggaacgcccgggctgccgttgctggtgaagacggtcggatgattgccggtcaggtgctcgatattaatctggctgccgagcctaaagtgaaccgaggtaaggccggggtgaaacggtcagcagccgagatgtacggatcctccttcgatttagattatgactttcagcgcgattactatgatcggatgtactcctacccggctagagtcccaccacctcccccaatcgcaagggccgtcgtcccatccaagagacagagggtgagcggtaataccagcagaagaggaaaatctggattcaatagtaagagcggtcagcggggcagttcaaaatcgggcaagttgaagggcgatgatttacaggccatcaagaaggagctcacccaaatcaaacagaaggtggactcattgctggagaacctggagaagatcgagaaggaacagtcaaagcaggccgtcgagatgaaaaatgacaaaagcgaagaagaacagtccagcagcagtgtgaagaaggatgagacgaacgtgaagatggaaagcgaaggcggtgccgacgactccgcggaagagggcgatctactcgacgatgacgacaacgaggataggggcgatgaccagttggagctgattaaggacgacgaaaaggaggcagaggaaggggaagacgaccgtgactccgctaatggtgaggacgactcttag

SEQ ID NO: 19394 - DNA, 444 bp, Artificial Sequence
  Description of Artificial Sequence: Synthetic coding sequence
atggccagcaacgtgaccaacaagaccgacccccggagcatgaactcccgggtgtttatcggtaacctgaataccttggtggtcaagaagagcgatgtcgaagctatttttagcaagtacgggaaaatcgtgggatgttctgtacacaagggttttgctttcgtgcaatatgtcaacgagcgtaatgctcgcgccgccgtggccggggaagacggcaggatgatcgccggccaggtgctcgacattaacttagccgctgaacctaaagtgaacagaggcaaggcgggagttaaacgttccgccgctgagatgtacggctccgtgacagaacacccaagccctagcccacttctgtccgtctatcaggagacattacatgaaggtgccaaggtggccagcattctccgggttgattctggtgacctgccctcactggagtcctag

SEQ ID NO: 19395 - DNA, 882 bp, Artificial Sequence
  Description of Artificial Sequence: Synthetic coding sequence
atggccagcaacgtgaccaacaagaccgacccccggagcatgaacagcagagtgttcatcggaaatctgaatacactggttgtcaaaaaatctgatgtggaagccatattctccaagtatggcaaaatagttggctgtagtgtccacaaggggtttgcattcgtgcagtacgtgaatgagcgtaatgcgcgcgccgccgttgcaggagaggacggacgaatgattgccggacaagtgctcgacattaatctggccgccgaacccaaagtgaatcgggggaaggcaggcgtaaagagatcggccgctgagatgtacggtagcagcttcgatctggattacgacttccagagagactattatgaccggatgtattcctaccctgcccgggtgcccccaccaccacccatcgcgagagccgtggtgcctagcaagcgccagcgggtctcgggcaatactagccgccgggggaagtctggcttcaatagtaagtcgggccagcgtggatcctcaaaatcaggaaagctgaagggcgacgacctacaggcgattaaaaaggagctgacgcagataaaacaaaaggtggactccctgttggagaatctggaaaaaatagagaaagagcagtcaaagcaggccgtagagatgaaaaacgataaatccgaggaggaacagagttccagtagcgtgaagaaggacgagaccaacgttaagatggaatctgaaggtggcgccgatgattcagccgaagaaggagacctcttagacgacgacgataacgaggatagaggagatgaccaactggagctcattaaagacgacgagaaggaggccgaggagggcgaagacgaccgcgactccgcaaatggtgaggatgattcctag

SEQ ID NO: 19396 - DNA, 789 bp, Artificial Sequence
  Description of Artificial Sequence: Synthetic coding sequence
atggccagcaacgtgaccaacaagaccgacccccggagcatgaactcacgagtgtttattggaaacctgaatacattggtagtcaagaagtccgacgtggaggccatatttagcaagtatggtaaaatcgtggggtgctcggttcacaaggggtttgctttcgtgcagtacgtgaacgaacgtaacgcccgcgccgcagtggccggagaagatggaagaatgatcgccggccaggtgctggacattaacctagccgctgaacctaaagtgaatagggggaaggccggcgtgaagcggagcgccgccgagatgtacggaagtagttttgacttggactacgacttccagagggactattacgaccgcatgtattcataccccgcaagggtgcctcctcccccaccaatcgcaagagcagttgtgccgtcaaagcgacaacgggtgagtggcaacacctctcggagaggcaaatcaggctttaattccaaaagcgggcaaaggggaagctcgaagtctggaaagctgaagggggacgatctgcaggcaataaagaaggaattaacccaaatcaagcagaaggtcgatagtctgctggagaatctggagaaaattgagaaggagcagtctaagcaggccgtggaaatgaagaatgacaaatccgaggaggaacagtcctcgtcttcagtaaagaaagacgagacaaacgtcaaaatggagtcggagggcggggccgatgacagtgccgaagagggggatctgctagacgacgacgataacgaagacagatag

SEQ ID NO: 19397 - DNA, 921 bp, Artificial Sequence
  Description of Artificial Sequence: Synthetic coding sequence
atggccagcaacgtgaccaacaagaccgacccccggagcatgaactcgcgtgtctttatcggaaacctgaacaccctcgtggttaagaaatctgatgtggaggccatcttttccaagtacggaaaaatagtggggtgctcagtgcacaaaggcttcgcttttgtccaatacgtcaatgagaggaacgccagagccgcagtcgctggcgaggacggccggatgatcgccgggcaggtgctggatataaatctggctgccgaacccaaagtcaatcgagggaaggcaggggtaaagcgatcggctgccgagatgtatggcagcgtgaccgaacatccttcaccttccccccttttgagctccagcttcgatctagactacgacttccagagggattattacgaccgcatgtacagctacccggctcgagtgcccccgcccccacccatcgcaagagccgtcgtgcccagtaagcgccagagagtgtctgggaacacctctcgtagggggaagagcggatttaactccaagagtggccagaggggttcttccaaatcaggaaagctgaagggggatgatctccaggccattaagaaggaactgacccaaattaaacagaaagtggatagcctgctcgagaacctagaaaagatcgaaaaagagcagtcaaaacaggcggtagaaatgaaaaacgataagtctgaagaggagcagtcctccagctctgtaaagaaggatgagaccaacgtcaagatggagtcagagggcggcgcagatgatagcgccgaggaaggcgacctgctggacgatgacgacaatgaggacaggggagacgatcagttggaattgatcaaagacgacgagaaagaggctgaggaaggagaagatgatcgcgatagcgctaatggagaggatgactcatag

SEQ ID NO: 19398 - DNA, 381 bp, Artificial Sequence
  Description of Artificial Sequence: Synthetic coding sequence
atggccagcaacgtgaccaacaagaccgacccccggagcatgaactcccgtgtatttatcgggaacttgaacacccttgtagtcaagaaatccgacgtggaggccatattctcaaaatacggcaaaatcgtcggctgctccgtacacaagggcttcgcctttgtacagtacgtcaatgaaaggaatgcaagagccgctgtggctggagaggacggaaggatgatcgccggacaggtcttggatatcaatctggccgctgagcccaaagtcaacagaggtaaagcgggtgtgaaacgcagtgcagccgagatgtatggctccagttttgatctcgactacgattttcaaagagactactacgaccgaatgtacagctactag

SEQ ID NO: 19399 - DNA, 882 bp, Artificial Sequence
  Description of Artificial Sequence: Synthetic coding sequence
atggccagcaacgtgaccaacaagaccgacccccggagcatgaacagccgcgtcttcatcggcaacttaaataccctggtcgtgaaaaagtctgatgtggaggctattttttccaagtacggcaaaatagttggttgttctgtgcataagggttttgctttcgtgcaatatgttaatgaaaggaatgctcgcgcagctgtggcgggcgaggatggtcggatgatagctgggcaggtcctggacattaatctggctgcagagcctaaggtaaacagggggaaggctggagtgaagagaagcgctgctgagatgtacggcagtagcttcgacctcgattacgactttcaacgagactactatgatagaatgtattcttatcccgctagagttccaccgcccccgccaattgcccgcgcagtggtgccctccaagaggcaaagagtgtcagggaatacatcccggcgaggtaaatctggcttcaacagtaagagtggtcagcgtggtagctctaaaagcggcaagctgaagggtgatgaccttcaggcgattaaaaaagagctgactcagattaagcagaaagtagactcactcctcgaaaacctggagaaaatcgaaaaggagcagagtaagcaagctgtcgaaatgaaaaacgacaaatccgaagaggagcagtccagttcttctgtcaaaaaggatgagactaacgtaaagatggagagtgaagggggagcagatgatagcgccgaagagggggatctcttggacgatgatgacaatgaagacagaggtgacgaccagctggagcttattaaggatgatgagaaggaagccgaggagggcgaggacgacagagactctgcaaacggggaagacgactcatag

SEQ ID NO: 19400 - DNA, 528 bp, Artificial Sequence
  Description of Artificial Sequence: Synthetic coding sequence
atggccagcaacgtgaccaacaagaccgacccccggagcatgaactcacgtgtttttattggcaaccttaatactctcgttgtgaagaaatccgatgtggaggccattttttccaagtacggaaagattgtcggctgctctgtgcataaaggatttgcctttgtccagtacgttaatgagcgcaatgccagggctgctgtcgccggcgaagacggaaggatgatcgctggccaggtgcttgacataaatctcgctgcagagcccaaagtgaatagggggaaagctggcgtaaaaagatctgccgctgaaatgtacggctctgtgacagagcatccctccccctcacccttgctgtcatcatcgttcgacctggactatgatttccagcgagactattatgatcgcatgtatagctaccctgcgagggtccccccacctcctccaatagctagggcagtggtgcctagcaaacgtcagagagtgtctggtaacacctctcgaagaggcaaaagcgggttcaatagttag

SEQ ID NO: 19401 - DNA, 354 bp, Artificial Sequence
  Description of Artificial Sequence: Synthetic coding sequence
atggccagcaacgtgaccaacaagaccgacccccggagcatgaacagtagggtgttcataggcaatctcaatacacttgtcgttaagaagtcagacgttgaagcgatcttcagtaagtatggtaagattgtaggttgcagtgtgcacaagggctttgccttcgtgcaatacgtcaatgagagaaatgctagagctgccgttgctggggaggacggcaggatgatcgctggacaagttctagatataaaccttgctgccgagcccaaggtgaatcggggaaaagctggcgtcaagcggtctgccgccgagatgtatggtagttccttcgatcttgattatgattttcagcggtag

SEQ ID NO: 19402 - DNA, 564 bp, Artificial Sequence
  Description of Artificial Sequence: Synthetic coding sequence
atggccagcaacgtgaccaacaagaccgacccccggagcatgaacagcagggtgttcattggcaatctgaacacgttagtagtaaaaaaaagcgacgtagaggctatttttagcaaatacggcaagatcgtagggtgcagcgtgcataaaggctttgcttttgtacaatacgtgaacgagcgtaacgcgagagcggcagtagccggcgaggatggccgcatgatagccggacaggtgctcgacatcaatctcgcagccgagccaaaggtcaacaggggcaaagccggggtcaaacgatcagcggccgagatgtacggctctgttactgaacacccaagtccctcgcctttactgagcagcagcttcgacctggactatgactttcaaagggactactatgaccgtatgtacagctatcctgcaagggtccctccacctcctcccatcgcgcgcgcagtagtcccaagcaaacggcagcgtgtatctggcaatacaagccgtcgagggaaatcgggattcaattccaaaagcggacagcgaggcagtagcaagtccggaaaatag

SEQ ID NO: 19403 - DNA, 753 bp, Artificial Sequence
  Description of Artificial Sequence: Synthetic coding sequence
atggccagcaacgtgaccaacaagaccgacccccggagcatgaacagccgcgtgttcatcggcaacctgaacacactggttgtaaagaaatccgacgtcgaagccatcttctccaaatatggtaagatcgtcggatgcagcgtgcacaaggggttcgcgtttgttcagtacgtgaacgagagaaacgcccgcgccgcagttgcaggagaggatggacgaatgatagcaggtcaggtgttagatattaacctcgctgctgaacccaaagtgaatagaggaaaagccggggttaaaagatcggcagccgaaatgtatggcagtagtttcgatctggactatgatttccagagagactactacgatcgcatgtacagctacccggctcgcgtgccaccacctcctccaattgcaagagccatcaaaaaagagctcactcagataaaacaaaaagtcgactctctgttggaaaaccttgagaagatagagaaagagcaatcaaagcaggccgtagaaatgaagaatgacaagagcgaggaagagcagtcaagctcttcggtgaaaaaggacgaaactaacgtgaaaatggaatccgagggcggagccgatgatagcgccgaggaaggagacctcctggatgatgacgacaatgaggaccgcggtgatgatcagttggagttaattaaagatgacgaaaaggaggcggaagagggggaagatgaccgagatagcgcgaatggggaggacgacagctag

SEQ ID NO: 19404 - DNA, 366 bp, Artificial Sequence
  Description of Artificial Sequence: Synthetic coding sequence
atggccagcaacgtgaccaacaagaccgacccccggagcatgaactctagagtttttataggtaatctgaacaccctggtggtgaaaaagtctgacgtggaagccatcttttctaagtacggcaagattgtgggctgctctgtgcacaagggatttgctttcgtgcaatacgtgaatgaaagaaacgcacgcgcagccgttgccggtgaagatggtcgcatgatcgccgggcaggtgctggatatcaacctcgctgccgaacccaaggtgaatagaggcaaagccggggtgaaaaggagcgccgcggagatgtatggcagcagcttcgatttagactacgacttccagcgcgactattatgattag

SEQ ID NO: 19405 - DNA, 681 bp, Artificial Sequence
  Description of Artificial Sequence: Synthetic coding sequence
atggccagcaacgtgaccaacaagaccgacccccggagcatgaacagtagggtcttcattgggaacctgaataccttagtcgtgaaaaaatctgatgtggaggcaattttttctaactcctcttttgatctggactatgatttccaacgggactactacgatcgcatgtacagctatcctgcccgggttcccccgccccccccgattgcgagggctgtggttcctagcaaacgccagagggtgagtggcaacacaagtaggaggggaaagtccggctttaattctaagtcaggacaaaggggatcctccaaaagcggtaagctgaaaggagacgacctccaagctataaagaaggaactgactcagattaaacagaaggttgattcattgctcgagaatttggaaaagatcgaaaaggagcagtcaaaacaagccgttgagatgaaaaatgataagagcgaggaggagcagagttcttcctctgttaaaaaagacgagacaaatgtcaaaatggaatcagaggggggggctgacgattccgccgaggaaggagacttgctcgacgatgatgataacgaggatcggggggacgaccaactggagctgatcaaggacgatgagaaggaggccgaggaaggcgaagatgatagggactcagccaacggtgaggacgactcatag

SEQ ID NO: 19406 - DNA, 882 bp, Artificial Sequence
  Description of Artificial Sequence: Synthetic coding sequence
atggccagcaacgtgaccaacaagaccgacccccggagcatgaactcgcgcgttttcatcggcaacctgaataccctcgttgtgaagaaatccgacgttgaagccatattctcaaaatacggaaagattgtgggatgtagcgtgcacaagggatttgctttcgtgcagtacgtcaacgagcgcaacgctcgggccgcagtggctggagaggatgggcgcatgatcgccggccaagtgctggatattaacttggcggcagaaccaaaagtcaatcgcggcaaggcaggggtcaaacgaagcgccgctgagatgtatggatcttccttcgacctggattacgattttcagagggattactacgacaggatgtattcctatcccgcccgcgttccaccccccccccctattgctcgggcagttgtcccttccaagagacagagggtgagcggaaacaccagccgcagggggaaatcagggtttaacagtaaatctggacagcgaggcagctccaagtctgggaaactcaaaggtgacgatctgcaggcaataaagaaggaattaactcaaatcaagcaaaaggtcgatagtcttctggagaatctagaaaagattgagaaagagcaaagcaaacaggccgtagagatgaagaacgacaagtcagaggaggagcagagttctagcagcgtgaagaaagatgaaaccaatgtcaaaatggaaagcgaggggggtgctgatgatagtgcagaggaaggcgatcttctcgatgacgacgacaacgaggatcgaggagatgaccagctggagcttataaaagatgatgagaaagaggccgaggagggcgaggacgatcgggactccgctaatggcgaggacgacagttag

SEQ ID NO: 19407 - DNA, 921 bp, Artificial Sequence
  Description of Artificial Sequence: Synthetic coding sequence
atggccagcaacgtgaccaacaagaccgacccccggagcatgaactctagggtgttcatcgggaatctcaacactctggtagtgaagaagtcagatgttgaggctatcttttcaaaatacgggaagatcgttggctgctcagttcacaaaggcttcgcgttcgtgcagtacgtcaacgagagaaatgccagggcagccgtcgccggagaagacgggcggatgatcgctgggcaggtcctggacatcaatctggccgcggaaccaaaagtgaatagggggaaggccggcgttaagcgatccgcagctgagatgtacggttccgtcacggagcatccttcaccctctccactcctgtcctcatccttcgaccttgactacgattttcaacgcgattattacgatcgaatgtacagttacccagctagggtgcctcccccccctcctatcgcaagagcagtagttccctcaaagagacagagggtcagcggcaacaccagtagaagaggcaaatccgggtttaactctaagtctggccagcgcggatccagtaagtccgggaagcttaagggcgacgacctgcaagccattaagaaagaactaacacagatcaaacagaaggtggacagtttactggaaaatcttgagaagatcgagaaggagcagtctaagcaagccgtggaaatgaaaaacgacaagtctgaggaggaacagtcaagtagctctgtcaagaaagacgaaacaaatgtgaaaatggaatcagaaggcggcgctgacgactctgcggaagagggcgacctcctggacgacgatgataatgaggatcggggagatgatcagctggagctgattaaggacgacgaaaaggaagcagaggagggggaggacgaccgggacagtgctaatggcgaagacgactcctag

SEQ ID NO: 19408 - DNA, 201 bp, Artificial Sequence
  Description of Artificial Sequence: Synthetic coding sequence
atggccagcaacgtgaccaacaagaccgacccccggagcatgaacagtcgggtgtttattgggaatctgaatacacttgtggtgaaaaagtcagacgtagaagctatcttcagtaaatacggaaagatcgtagggtgttctgtgcataagggcttcgccttcgttcagtacgtgaatgagaggaatgccagagctgcctag

SEQ ID NO: 19409 - DNA, 444 bp, Artificial Sequence
  Description of Artificial Sequence: Synthetic coding sequence
atggccagcaacgtgaccaacaagaccgacccccggagcatgaactctcgtgtttttataggcaacctaaatacgctcgtggtgaaaaagtccgacgtggaggccatattctccaagtatggcaaaatagtgggatgttcggtccataaggggttcgcattcgtccaatacgtgaatgagcgcaacgctcgggcagcagtcgccggagaggacggacggatgatcgccggacaggtgcttgatataaatctagctgctgaacccaaagttaataggggtaaggctggcgtaaagcgcagcgcagcggaaatgtacggtagcgtgacggaacatccaagcccatctccactgctcagcgtgtatcaagagacgctgcatgagggcgccaaagtggctagcattctacgcgttgacagcggcgacttacccagcctggagtcttag

SEQ ID NO: 19410 - DNA, 165 bp, Artificial Sequence
  Description of Artificial Sequence: Synthetic coding sequence
atggccagcaacgtgaccaacaagaccgacccccggagcatgaactccagggtgtttattgggaacctgaataccctggtcgtgaagaagagcgatgttgaagccattttctccaaatatggaaagattgttggctgtagcgtccacaaaggctttgctttttag

SEQ ID NO: 19411 - DNA, 882 bp, Artificial Sequence
  Description of Artificial Sequence: Synthetic coding sequence
atggccagcaacgtgaccaacaagatggacccccacagcatgaactcgcgcgtgttcatcggcaaccttaacactctcgtcgtgaagaagagcgacgtcgaggcgattttcagcaaatacggaaaaatcgccggatgtagcgtgcacaaaggcttcgcatttgtacaatatgacaaggagaaaaacgctcgcgccgccgtggccggcgaggatggcagaatgatcgcgtcccaggtggtcgatattaaccttgccgcagaaccaaaggtgaatcggggaaacgcaggcgtgaaaagaagcgccgcagagatgtatggtagcagctttgatctcgactacggctttcagcgcgattattacgatggcatgtactctttccccgcacgtgtccccccaccgccccctattgctctggccgttgtgccctctaaacgccaacgattgtcaggaaatacttcaagacgtggaaaaagcggctttaactcaaagagtgggaaaaggggaagttctaaaagcgggaagctgaaaggcgacgatttgcaggccattaagcaggaattgacacaaattaagcagaaggtggattctctactggagaacctcgagaaaattgagaaggaacagagtaaacaagaagtggaggtcaagaatgccaagagcgaagaagagcaatcaagctcctccatgaagaaagacgaaacccacgtcaagatggagtctgaagggggtgctgaagactctgctgaggagggagatcccttggacgatgacgtgaacgaagaccagggcgatgaccaactggagcttattaaagacgatgagaaggaggctgaagagggggaggacgatcgggacagcaccaatgggcaggacgactcctag

SEQ ID NO: 19412 - DNA, 1041 bp, Artificial Sequence
  Description of Artificial Sequence: Synthetic coding sequence
atggactgggtgatgaagcacaacggccccaacgacgccagcgacgggacagtgcgcttgagagggctgcctttcggatgtagcaaagaggagattgtacaatttttccagggactggaaattgtcccgaatggcatcaccctgaccatggactaccaaggtcgaagtactggagaagcctttgtccagttcgccagcaaggaaattgcggaaaatgcattaggcaagcataaagagcggatcgggcaccggtacattgaaatttttcgctcttcaagatccgaaattaaggggttttacgatccacctcgtagacttctaggtcagagaccagggccatacgatcgcccgattggagggagaggcggatactatggcgccggtcgtggtagcatgtatgaccggatgcggagaggcggggacggctacgacggcggctatggaggatttgacgattatggaggatacaacaactatggctacgggaatgacggcttcgacgatcgtatgcgcgacgggagggggatgggggggcacggatacgggggcgccggagatgcctcttctggcttccacggtggtcacttcgtgcacatgagaggattaccctttcgggccactgagaatgacatcgcgaacttcttttcacccctcaacccaattcgggtgcatatcgatatcggggctgatggacgagctacgggggaggccgacgttgagttcgtgacccatgaggacgcagtggccgcgatgagcaaagacaaaaacaacatgcagcacagatatattgaactgtttctgaactccaccccaggtggcggatccggaatgggcggcagtgggatgggtggctacggccgtgatggcatggacaatcagggtggatatggatctgttggccgcatgggcatgggaaataactattcaggggggtacggtacccccgacgggctgggaggctatggcagaggcggtggcgggagcggaggctattatgggcaggggggaatgagtggcggagggtggagaggaatgtactag

SEQ ID NO: 19413 - DNA, 996 bp, Artificial Sequence
  Description of Artificial Sequence: Synthetic coding sequence
atggactgggtgatgaagcacaacggccccaacgacgccagcgacgggaccgtgcgtttgcgtgggctgcccttcggatgcagcaaggaggagatcgtgcagtttttccagggtctggagatcgtcccgaatggcataacattgactatggactatcagggtagatcaacaggagaggcttttgtacagttcgcctcaaaggaaatcgccgaaaacgcactgggcaagcataaggaaaggatagggcataggtacatagaaatcttcagaagctctcgttctgagatcaaggggttttacgaccctccacggcgcctattggggcagagacccggaccgtacgaccggccgataggaggccgcggagggtactatggggctggtcggggtagttacggggggttcgatgactacggaggatacaacaactacggttatgggaacgatggttttgacgaccgcatgcgggatggccgcgggatggggggtcatggctacgggggtgctggagatgcatcaagtggattccacggaggtcactttgtacacatgcggggtctgcctttccgtgccaccgagaacgatatcgctaacttctttagtcccctaaatccaatacgagttcacatcgacatcggtgccgacggcagagcgactggtgaagcagacgttgagttcgttacccacgaggatgccgttgccgctatgagtaaagacaaaaacaacatgcagcaccgctacatcgagctgtttctcaattccactccaggcggcgggtccggaatgggcggctctggaatgggaggatacggtcgcgatggaatggataatcagggaggctacggctccgtggggcgtatggggatggggaataactacagcggcggatatggaacaccagatggtctgggtggttatgggcggggcggaggcgggtcagggggctactacggccaggggggcatgtccggcgggggctggcgtggcatgtactag

SEQ ID NO: 19414 - DNA, 717 bp, Artificial Sequence
  Description of Artificial Sequence: Synthetic coding sequence
atggactgggtgatgaagcacaacggccccaacgacgccagcgacggcacggtccgccttagggggctgccttttggctgctccaaagaggagatcgtgcagttctttcagggctacggtggatttgatgattatggcggatataataactacggttatgggaacgacggcttcgatgaccgcatgagggatgggcgaggaatgggagggcatggttacggcggagccggcgacgcctcctccggcttccacggcggtcacttcgtgcacatgcgggggctcccctttcgcgccaccgaaaatgatatcgctaactttttttcccctctcaatccgatcagagtccacatcgatatcggcgccgatggcagggcaactggcgaagccgatgttgaattcgttactcatgaagatgctgttgccgcaatgagcaaggataaaaacaacatgcaacatcgatacatagagttattcctgaattccactcccggaggcggatccggaatgggtggatcaggcatgggagggtacggcagggacggtatggataatcaggggggatatggcagcgtcggcagaatgggaatggggaacaactattccggcggttacggaactcccgacggtttagggggatacgggcgcggtggaggcggctccggaggctattacggacagggcggaatgtctggcggggggtggcggggcatgtactag

SEQ ID NO: 19415 - DNA, 1392 bp, Artificial Sequence
  Description of Artificial Sequence: Synthetic coding sequence
atggagaccgagcagcccgaggagaccttccccaacaccgagaccaacggggaattcggaaagaggccagccgaggatatggaggaagaacaggccttcaaaagaagcagaaacaccgatgagatggtcgaactgcgaatcttattacaatccaagaacgccggcgcagtcatcggcaaaggaggcaaaaacatcaaggctcttcggaccgactacaacgcctctgtttctgtgcctgattcatccggacctgaacgtattctttccatttccgctgacatcgaaactatcggcgagatcctgaagaagataattcctactcttgaagaggggctgcagctgccttccccaacggccactagtcagctgcccttggaatctgatgccgtggaatgtctcaactaccaacactacaaaggtagcgacttcgattgtgagctgcggctgctcattcaccagagcttggcgggaggcattatcggagtgaaaggggcaaaaatcaaggaactgcgcgagaatactcagaccacaatcaaattgtttcaagaatgttgtcctcatagtaccgatcgggtggtgttaattggagggaagcctgatcgtgtagtagagtgcatcaaaattatattggacctgattagtgaatccccaattaaggggagggcgcaaccatacgaccccaacttctatgacgagacctacgactacggaggcttcactatgatgttcgatgatcggcgggggaggccggtaggattccctatgcgcgggagaggcggttttgaccggatgcccccgggacggggcggaaggcctatgccgccgtcgcgtagagattacgacgacatgtccccacgccgaggcccacctccccctcccccagggcgcgggggacgcgggggctctcgagcccggaacctcccacttcctccacctccaccccctcggggaggcgacctaatggcttacgatcgtaggggcagaccaggagataggtatgacggtatggtcggcttctctgcagatgaaacttgggacagcgcaatagacacctggagccccagcgagtggcagatggcctacgagccccagggtggaagtggctacgattattcgtatgccggaggtagggggtcttacggtgacctggggggccccattattactacacaggtgaccattcctaaagaccttgccggatcaatcattggcaagggcgggcaacggataaaacaaattaggcacgaatccggcgcctctataaaaatcgacgagccattagagggaagcgaagatagaattattaccataacgggtacacaagaccaaatccagaatgcacaatatctgcttcagaacagtgtcaagcagtactcgggcaaatttttctag

SEQ ID NO: 19416 - DNA, 1392 bp, Artificial Sequence
  Description of Artificial Sequence: Synthetic coding sequence
atggagaccgagcagcccgaggagaccttccccaacaccgagaccaatggggagtttggtaagcggcccgcagaggacatggaggaggagcaggcttttaaacgcagccggaacacagacgaaatggtggagctgagaatcctgttacagagcaagaatgccggagctgtcatcggaaaaggtggcaagaatataaaagcccttcgcactgactacaacgcgtcagtgagcgtccctgattcttcgggcccagagcgcattttgagcatttcagcggacattgagaccatcggcgaaatccttaagaagatcattccaactttggaggagggactgcagctcccttcccctaccgccacctctcaactccccctggaaagcgacgcagtcgagtgtctgaactaccagcattacaaaggatccgatttcgattgtgaactccgcctcctgattcaccagtcccttgcagggggtatcattggggtcaagggagcaaagattaaggagctgcgcgagaatacacaaactacaattaaactgttccaggaatgttgtccacatagtactgatagagtagtgctgatcggtggcaagcctgatcgggtcgtggaatgcatcaaaataatcctggaccttatctccgagagtccaataaagggtcgagcgcagccatacgaccccaatttctacgatgagacctacgattacggcggcttcacaatgatgttcgatgacagacgcgggcggcccgtcggttttcccatgaggggtagagggggtttcgataggatgcccccaggccgcgggggcagaccaatgcctccatccagacgcgattatgatgacatgagtccacggagggggcccccccccccgcctcccgggagggggggccgaggggggagtagggcccgaaaccttcccctgccaccgcccccaccaccaagaggcggggatttgatggcctatgatcggcgcggaagaccaggtgacaggtatgacggtatggttgggttcagtgctgacgagacatgggactctgccatcgatacttggtcaccttcggagtggcaaatggcttacgagccgcaggggggttctggctacgactatagttacgctggaggtcggggcagctacggggatctaggtggccccataattacaacacaggtgacaatcccaaaagacctggcgggcagtattatcgggaagggagggcagagaatcaagcagatcagacatgagtccggtgcctctatcaaaatcgatgaacccctcgagggatctgaagacagaatcataacaataacaggcacccaggatcaaatccagaatgctcagtacctcctgcaaaattcggttaaacaatacagcggaaagtttttctag

SEQ ID NO: 19417 - DNA, 921 bp, Artificial Sequence
  Description of Artificial Sequence: Synthetic coding sequence
atgcagtacaacgccagcgtgagcgtgcccgacagcagcggccccgagagaattctgtccatctccgcagacatagagaccattggagagatcctgaaaaagattatccctacactggaagaaggactgcagctcccaagtcccactgccacatctcagctgcccttggagagtgatgcagttgagtgcctgaactaccagcattataagggttccgatttcgactgcgagttgcggctgctgatacatcagtccttagctggaggcatcataggagtgaaaggtgcaaagatcaaagagctcagagagaacacccagactactattaaactttttcaggagtgctgccctcactctacggatagagtagttctgatcggaggtaagcccgatcgtgtagtagaatgtattaaaatcatcttggatctaatctccgaaagcccaatcaaggggcgcgcccagccctacgatccaaacttctatgatgaaacttatgactatggcggatttacaatgatgttcgacgaccgccgtggtcggccagtgggatttcctatgagaggacgggggggctttgacagaatgccaccagggaggggcgggaggcccatgcctccttcaagacgggactacgacgacatgtctccccgtcgggggcctcccccccccccccctggacgaggtggccgcggcgggtcgcgggctagaaatctgcccctcccgccccctcctcccccacgcggtggcgatctgatggcctacgatagacggggtaggcccggggatcgatacgacggcatggtcgggttctcagccgatgaaacctgggactctgctatcgacacttggtccccctctgagtggcagatggcatatgaacctcaggtggaataccactcatgttcctgcgtgtaccagtag

SEQ ID NO: 19418 - DNA, 1380 bp, Artificial Sequence
  Description of Artificial Sequence: Synthetic coding sequence
atggagaccgagcagcccgaggagaccttccccaacaccgagaccaacggagaatttggcaagcggcccgcagaagacatggaagaagagcaagcgtttaagcggtcacgaaacactgatgagatggtggaactcaggatacttctgcaatcaaagaatgccggagccgtgataggaaagggcggcaagaatataaaagccctgcgtaccgactattatctggtgttcgtggtgtttgattccatcctaagcatctcagcagacatagagacaataggggagatactcaaaaagattattcccacccttgaagaaggtcttcagttaccgagtccaactgcaacctcccagctacccctggagtcggacgccgtggagtgcctgaattatcagcattataagggctctgactttgattgcgaactcagacttctgattcatcagagcctggcaggaggcatcatcggagtgaagggggcaaagatcaaagaattaagggaaaacactcagaccaccatcaagcttttccaggagtgttgcccccactccactgatcgcgtggtcctcattggaggcaagcccgacagggtggtcgagtgtatcaagattatactcgacttgatttcggagagcccaataaaaggccgggcacaaccatacgaccccaacttttacgatgagacctacgattacggcgggtttaccatgatgtttgatgacaggcgaggacgaccggttgggttcccaatgcgtggacgagggggcttcgatagaatgccgccaggacgaggaggccggccaatgcccccaagcagacgggactacgatgatatgtcccctcgcagaggcccgcctccacctccacctggcagaggtgggaggggcggctcgagagcacgaaacctgccactcccccctcctccacctcctcggggtggggatctgatggcatatgaccggcgggggagacccggcgatcgttacgacggaatggttggtttttctgccgatgagacctgggattcagccatcgacacatggagcccttccgaatggcaaatggcgtacgaaccacaggggggcagcggttacgattactcttatgcaggcggccgcgggtcctatggtgacctaggtggccctataattacaacacaagtgaccataccaaaagacctggccggctccattattggaaagggcgggcagcgtatcaaacagattcgccacgagtccggtgcctctattaagatagacgaaccacttgaaggaagtgaggatagaatcattactattactgggactcaggaccagatacaaaacgcgcagtacctgctgcaaaattcggtgaagcaatacgctgatgttgagggcttttag

SEQ ID NO: 19419 - DNA, 1395 bp, Artificial Sequence
  Description of Artificial Sequence: Synthetic coding sequence
atggagaccgagcagcccgaggagaccttccccaacaccgagaccaatggggagttcgggaaaaggccggccgaagacatggaggaagagcaggccttcaagcgttctaggaacacggacgagatggtggaattgagaatcctcttgcagtcaaaaaacgccggggccgtcatcggtaaaggggggaaaaatattaaggcccttcggaccgactataacgcatctgtatcagtacccgatagctcaggaccagagcgtatattgtccatcagtgctgatatcgaaaccataggtgaaatactgaagaaaattattccaactcttgaggagggtctgcagctcccctcacccaccgctacctcccaactgccactggagtccgatgctgtagagtgcctcaattaccagcactataaaggctcggattttgattgcgaattgagactgttgattcaccagtccttggccggtggtattattggagtcaagggggcaaagataaaagaactgcgcgagaacacacagacaactattaaactgttccaggaatgctgtccccatagcacggacagggtggtcctcatcggtggaaagcctgaccgggtggtcgagtgcattaagatcattctggacttgatcagcgagtcccctataaaggggcgagcacaaccatacgaccccaacttctatgacgaaacctacgactatggaggctttaccatgatgtttgatgataggcgcggtcgcccggtgggcttcccaatgcggggacgcggtgggtttgaccggatgcctcctggaaggggcggaaggcccatgcctccctcacggagagactatgatgatatgtctcctcggcggggcccgccacctccccccccaggcagaggggggagaggcggatctagagcccgtaaccttccccttccccctccccccccacccaggggaggcgacctgatggcctacgaccggagaggcagaccaggggatcgttatgacggcatggtggggttcagcgccgatgagacgtgggactccgctatcgatacctggagccctagtgagtggcagatggcttatgagcctcagggtggaagtgggtacgactacagttatgcaggagggcgtggcagctacggtgatctgggaggacctatcattaccacgcaggtaacgatccctaaagaccttgctggttctatcattggcaagggtggccagcggattaaacaaattcggcatgagtccggagcctctatcaagatcgacgagccactggaggggagcgaggatcggataataacaataacgggcacccaggatcagatacaaaacgctcagtacctccttcagaactctgtgaagcaatatgccgatgtggaagggttttag

SEQ ID NO: 19420 - DNA, 1392 bp, Artificial Sequence
  Description of Artificial Sequence: Synthetic coding sequence
atggagaccgagcagcccgaggagaccttccccaacaccgagaccaacggagagtttggcaagagacccgcagaggatatggaggaagaacaggctttcaagcgatccaggaatacagacgagatggtggaactaaggatcctgttgcagtccaaaaatgccggtgccgtgatcggcaaaggaggtaaaaatattaaggcgctgcggaccgactacaacgccagtgtgtccgtgcccgattcttccggacccgagcggatcctgagcatcagtgctgatatcgaaacaattggcgagatcttgaagaagatcatccccaccctggaggaggggctgcagctgccatctcctacagccacttctcagttgccactagaatccgacgcagtggaatgtcttaactaccagcactataaggggagtgacttcgactgtgaactgcggctgttgatccaccaatcactcgcgggaggtataattggggtgaagggcgctaaaattaaggagctgagggagaacacccagacaacaataaagttgttccaggagtgttgccctcactcaacagacagagtcgtgctcattggcggtaagccagacagagtggtggaatgtatcaaaatcatcttggatctcatctccgagagtcctatcaaaggccgtgcacagccatatgacccaaatttctatgacgaaacctacgactatgggggcttcacgatgatgttcgacgataggagaggtcggccagtgggattcccaatgcggggcagaggcggcttcgatcgcatgccccctggccggggtgggcgccctatgcctccgagcaggcgtgattacgacgacatgagccccaggaggggacctccccctccgcctcctggtcggggaggaagggggggatctagggcccgcaatctccctctgcctccacctccgcctccccgaggaggggacctgatggcctacgatcgcagaggcagacctggggataggtacgacggcatggtggggtttagtgcagacgaaacatgggactctgctatagatacgtggtccccttcggaatggcaaatggcatatgaacctcagggggggagtggatatgattactcatatgccggaggcagaggatcttatggggacctgggaggccccataatcaccacacaggtaacaatccccaaggatctggctggctccatcataggcaaaggcgggcagcgtattaaacaaataaggcacgaaagcggggcttctattaaaattgatgagccactcgagggatctgaagatagaatcatcacgatcactggtacccaggatcaaatccagaacgcacagtacctgttacagaactccgtcaagcaatacagtggtaagtttttctag

SEQ ID NO: 19421 - DNA, 1395 bp, Artificial Sequence
  Description of Artificial Sequence: Synthetic coding sequence
atggagaccgagcagcccgaggagaccttccccaacaccgagaccaatggagagttcggtaagcggcccgctgaagatatggaggaggagcaggcctttaagcgctcccggaataccgatgagatggtggaactacgtatcctgctgcagtcaaagaacgccggggccgtgatcggcaaaggtggtaaaaatattaaggccctgcggacagattataacgcctccgtgagcgttcctgactcttccggccctgagaggatcctgtcaatctctgccgacatcgagaccatcggtgagattttaaaaaagatcattcctacactggaggagggcctccaactgccttcccccaccgccacctcacagcttcctctagagtccgacgccgttgagtgtctgaattatcagcactacaaaggctccgattttgactgtgaattaagattattgatccatcaatcactggctggtggcattatcggagttaaaggtgccaaaatcaaagagttgcgggagaatacgcagaccacgattaaattgttccaggaatgctgccctcattctacggacagggttgtactcatcgggggcaaaccagaccgggttgtggaatgcatcaaaataatcttggacctcatcagcgagtctccaattaaggggagggcccaaccttatgaccctaatttctatgatgagacatatgactacggagggtttacaatgatgtttgacgacagacgggggcgtcctgttggctttcccatgagaggccgaggaggcttcgaccggatgccgcccggaaggggcggaaggcccatgccaccctctcggcgcgactatgacgatatgtcgcccaggcggggacctcccccacctccacctggccgcggaggcagggggggctcccgcgccagaaatctgccacttccgccgcccccccctccgaggggaggtgatctaatggcatacgatcggcggggtaggcctggggataggtacgatggaatggtaggcttttctgccgatgagacttgggatagcgcaattgacacctggtccccttcagagtggcaaatggcgtatgagccacagggcgggtctggctacgattattcttacgctggaggaagaggctcgtacggtgacttagggggacccatcattaccacccaggtgaccattcctaaagacttagcagggtcaattatcgggaagggcggccagcggatcaagcagattagacacgagagcggagcctctattaaaattgatgagcctctcgaagggagcgaagatagaataatcaccatcacaggtacacaggaccagatccagaatgcccagtatcttctccaaaactccgtcaagcagtacgccgatgtggaaggcttttag

SEQ ID NO: 19422 - DNA, 1395 bp, Artificial Sequence
  Description of Artificial Sequence: Synthetic coding sequence
atggagaccgagcagcccgaggagaccttccccaacaccgagaccaatggtgagttcggcaagcgccccgccgaggacatggaggaggagcaggcattcaaaaggagccggaatacggatgaaatggtcgagctccgcatcttactgcaaagtaagaacgccggcgctgttatcggcaaagggggcaagaacattaaggcactcagaactgattacaacgcctctgtatcagtccccgattcgagcggacctgagcggatattgtcaatctcggccgacattgaaaccattggggaaatcctgaagaagatcatacccactctcgaggagggactccagttgccaagtcccacagccaccagtcaactgccactggaaagtgatgctgtggagtgcctgaattatcaacattacaaaggatcggacttcgattgtgaattgcgactcctaatacatcagtcactcgccggcggtatcattggggtaaagggagccaaaatcaaagagctaagggaaaacactcagacgactatcaagcttttccaagagtgttgcccccactccaccgatcgggttgtccttatcgggggcaagccagatcgagtggtcgaatgtataaaaattatactagatctcatctcagaaagtcctattaaagggcgtgcacaaccatatgatcccaatttctatgacgaaacatacgattatgggggctttacaatgatgtttgacgatcgcaggggaaggcctgttgggttccctatgagaggtaggggcggatttgatcgcatgccaccaggacgcggaggacgcccaatgccaccctccagacgcgactatgatgatatgtctcctcggaggggacctccccctccacctccaggccgtgggggtaggggggggtctagagcacgcaacctgccgctaccaccaccccccccccctcggggcggggatctcatggcctacgataggcgcgggcggcctggtgatagatatgacgggatggtagggttttcagcagatgagacctgggactccgctatcgatacttggtcgccatccgaatggcagatggcttatgaaccccagggagggagcggctacgactatagttacgcaggaggccgcggcagctatggcgatttgggcggccccatcatcaccacacaagtaaccatcccgaaggatttagccggatccattattggtaaaggaggtcaacgcataaaacagatcagacatgagtccggcgcatccattaagattgatgaaccactcgaaggaagcgaggacagaatcattacaatcaccgggacacaggatcagatccagaacgcacagtacctcctccagaactccgtgaagcagtacgcagacgtggaggggttctag

SEQ ID NO: 19423 - DNA, 1287 bp, Artificial Sequence
  Description of Artificial Sequence: Synthetic coding sequence
atggagaccgagcagcccgaggagaccttccccaacaccgagaccaacggggaattcggaaagagacccgcagaggacatggaggaggagcaggcgttcaaaagatcaagaaatactgacgaaatggtggagcttcggattctcctgcagagcaaaaacattaaggccctgcggactgactataacgctagtgtgagtgtgccagactctagcgggcccgaaaggattttaagtatctcagccgacattgagaccatcggagaaatactgaagaagattattcctaccctcgaggagtatcagcattacaaaggcagcgattttgattgcgaactgaggctgctcatccaccagagtcttgccggcggtatcataggcgtaaagggggccaagatcaaggagttacgagagaatacacagaccaccatcaaactctttcaggagtgttgtccacactccactgacagagtggtgctgatcggcggtaaacccgaccgggttgtggagtgcatcaagattatcctcgacctaatctctgagtctcccatcaaagggagagcccagccctacgacccaaatttttatgacgagacgtacgattacggcggttttacaatgatgttcgatgaccggaggggccgtcccgtcggttttccgatgcgtgggaggggggggttcgatcgtatgccacctggacgcggtggccgacctatgccgccatctaggcgcgattacgatgacatgtctccccggcggggccccccgcccccccccccagggagaggcggaaggggagggagccgtgcacggaacctcccactgccaccccctccccccccacggggtggggatctgatggcctatgataggcgaggtcgcccaggagacaggtatgatggaatggtgggtttctcagctgatgaaacctgggactccgctattgatacttggagcccttccgagtggcagatggcatatgagcctcagggtggtagcggatatgactattcatacgccggtggcagggggtcctacggggacctgggagggcccatcattactacccaggtcaccatacctaaggatctcgcgggatctattatcgggaaaggcggacagcggatcaaacaaattcggcatgaaagtggggcatctatcaagattgacgagcccctggaaggatcggaagataggatcatcactattacaggtacacaagaccagatccagaatgctcagtatctgttacagaattcagtcaaacagtattcaggaaaattcttctag

SEQ ID NO: 19424 - DNA, 1140 bp, Artificial Sequence
  Description of Artificial Sequence: Synthetic coding sequence
atggagaccgagcagcccgaggagaccttccccaacaccgagaccaatggcgagttcgggaagcgaccagcagaagacatggaagaagagcaggcgtttaagcgaagcaggaacacagatgaaatggttgagttaagaattttattgcagtctaaaaacgcaggggctgtgattgggaagggtgggaaaaatatcaaagctctgagaaccgattataacgccagcgtcagcgtaccagactcgtctggaccggagagaattctatcaatctctgccgacatcgagaccatcggggaaattttaaagaaaatcataccgaccctcgaagagtaccagcattataaaggatccgattttgactgtgaactgagattgctgatccaccagtctctggccggcgggattatcggggtcaaaggggcaaaaatcaaggagcttcgggagaatacacaaacgacaatcaagctcttccaggagtgctgcccccattctactgaccgcgtggtcctaatcggcgggaagcccgaccgtgttgtcgagtgcatcaaaatcatccttgatctcatatcagaatctcctatcaaggggagggcccaaccctacgatccgaacttctatgatgaaacttatgattatggcggcttcacgatgatgttcgacgatcgccggggccgcccagtggggtttcccatgaggggccgtggcgggtttgataggatgccgccaggcaggggaggaaggcctatgcccccttccaggcgagactacgacgatatgtcccctcgtagagggccaccaccgccacctcccggtagagggggacggggcggttcaagagcgagaaacctccccttaccacctccccctccgccacgcggaggcgacctgatggcatacgaccggcgcgggagaccaggcgaccgctatgatggaatggtcggcttttcagccgatgaaacttgggattccgctattgacacatggagcccctcggagtggcagatggcttatgaacctcaaggcgggtctgggtatgactattcttatgcaggcggtcggggaagttatggcgacctgggaggcccaattatcaccacccaggtgacaattccaaaagacctcgcgggttcaattatctag

SEQ ID NO: 19425 - DNA, 987 bp, Artificial Sequence
  Description of Artificial Sequence: Synthetic coding sequence
atggccgccggcatcgtggccagccggcggctgcgggacctgctgactcgcagactgacagggagcaactaccctggcctttccatcagcctacgcctgactggatcaagtgcgcaagaagaggcatccggcgtggctttgggagaggctcctgaccacagttacgagtctctcagggtcaccagtgcacagaagcacgtgttgcatgtgcagctcaatcgacctaataagcgaaacgctatgaataaggtcttctggagggaaatggtggaatgttttaacaaaattagcagggacgccgattgtagagccgttgttatctcaggcgccgggaagatgttcaccgcgggaatcgatttgatggatatggcctccgacattctgcagccaaaaggtgacgatgtggctaggatctcttggtacctccgcgacatcattacccgttaccaggaaacgtttaacgtgatcgagaggtgccctaagcctgtgattgccgccgtgcacggcggatgcatcggcgggggcgttgatctcgtaaccgcttgcgacatccggtactgtgcccaggacgcttttttccaggtgaaagaggtggacgtgggcttagccgcagacgtaggcacactccagcggctacccaaggtgatcgggaaccagagtcttgtcaatgagctcgcattcactgccaggaagatgatggcagatgaagcgctaggtagcgggctggtcagccgcgtgtttcctgataaagaggtcatgctggacgcagccctagccctcgctgctgaaattagcagcaagagccctgtggctgtccagtcgactaaagtgaacctactgtattcccgagatcatagtgtggcagaatctctgaactacgtcgcttcctggaatatgtccatgctgcagacccaggacctcgtcaaatcagtacaggctacgacagagaataaagagttaaagaccgtgaccttcagtaagctgtag

SEQ ID NO: 19426 - DNA, 1371 bp, Artificial Sequence
  Description of Artificial Sequence: Synthetic coding sequence
atgcccaagaagcggcaggccctggtggagttcgaggacgtgctgggggcgtgcaacgctgtgaactatgccgccgataaccagatttatatagccggtcacccagctttcgttaattattctacctcccagaaaattagcagacccggggatagcgatgactcccggtcagttaacagcgtgctcctgttcaccattctaaaccccatctactccataacaacagacgtgctgtacaccatctgtaacccgtgcggaccggtgcaaaggatcgtgattttccgtaagaacggggttcaggcaatggtggaatttgacagtgtgcaaagcgcacagagagctaaggcctctctaaacggtgctgacatatactccggatgctgtactctgaagatagagtatgccaaaccaaccaggctgaatgtgttcaaaaacgatcaggatacttgggattacaccaatcccaacctctccggtcagggcgatcctggaagtaaccctaacaagagacagcgccaaccacctctcttgggtgatcacccggcggaatacgggggaccacacggggggtaccacagccactatcatgacgagggctacggccccccacctccacactacgaaggccgcagaatgggaccccccgtaggtggacaccgcaggggaccatcacggtacggaccccaatatgggcacccgccacctcccccgcccccaccagaatacggtccacacgccgattcccccgtcctgatggtgtacggcttagaccaatctaaaatgaactgcgaccgggtgtttaatgttttctgtctgtacggcaatgttgaaaaggtcaaatttatgaagtcaaagcctggcgctgccatggtggaaatggcggatgggtatgctgtggatagagcaattactcacctgaataataattttatgttcggtcagaaactaaacgtgtgtgtctccaagcagcctgcgattatgcccggacagtcctacgggctcgaggacggatcatgtagttataaagacttctccgagtcacggaataataggttttcgactccggaacaagccgcaaaaaaccggatccagcatccatcaaacgtactgcacttcttcaacgcacctctcgaagtcactgaggaaaactttttcgaaatctgtgacgagctgggtgtcaagcgaccgagtagcgttaaggtgttcagcggcaagtccgagaggtcttcttccgggctactggaatgggagtctaagtctgacgccctcgagactttgggctttctgaatcattatcagatgaagaacccaaatgggccctacccctacactcttaaactgtgttttagcacagcgcagcacgcatcctag

SEQ ID NO: 19427 - DNA, 1371 bp, Artificial Sequence
  Description of Artificial Sequence: Synthetic coding sequence
atgcccaagaagcggcaggccctggtggagttcgaggacgtgctgggggcttgtaatgccgtgaactatgccgccgataaccagatctatatcgcaggacaccctgctttcgtgaactactccacaagccagaaaatatctaggccaggtgacagtgacgactctagatctgtgaatagtgtgctgttatttaccatattaaatcctatatattccatcaccaccgatgtcctctatactatctgcaatccctgtggaccagtgcagagaattgttattttccgaaaaaacggagtgcaggctatggtcgagtttgatagcgtccagagcgcacagagggctaaggcttcactgaatggcgcagacatctacagtgggtgctgtactctcaagatcgagtatgccaaaccgacccggcttaacgtgtttaaaaatgatcaggacacttgggattacactaaccctaatctgagtgggcagggggatcctggttcaaatccgaacaagaggcagcgccaacccccgttgctgggagaccaccctgcggaatacgggggaccgcatggaggctaccattcccactatcatgatgaagggtacggaccccctccacctcactacgaaggcaggaggatggggcctccggtgggcggacatcggaggggaccttccaggtacggccctcagtacggacatcctccccctccgccccctcccccagaatacggcccccacgctgactcgcccgttctgatggtttacggattagaccagagcaagatgaactgcgaccgagtcttcaacgtgttctgtctgtacggaaacgtggagaaggtcaagttcatgaagtcaaaaccaggggctgcaatggtcgagatggcagatgggtatgccgtggaccgagcaataacacatctgaacaacaactttatgtttggccagaagttgaacgtgtgcgtctcgaaacagcctgctatcatgccggggcaatcctatgggttagaagacggatcctgcagctataaagacttttctgaaagcagaaacaacagatttagcaccccagaacaggccgcaaaaaaccgcatccaacacccttccaatgtgctccatttttttaacgctccattagaagtgaccgaggagaacttcttcgaaatttgcgatgaacttggtgtgaagagacccagcagcgttaaagtcttttccggcaagtcggagcgcagcagtagcgggctgctcgagtgggaatcaaaaagcgacgccctggagactttaggctttctgaaccattaccaaatgaaaaaccctaacggaccctacccatataccctaaaattatgcttttctaccgcccagcatgctagttag

SEQ ID NO: 19428 - DNA, 540 bp, Artificial Sequence
  Description of Artificial Sequence: Synthetic coding sequence
atgcccaagaagcggcaggccctggtggagttcgaggacgtgctgggcgcctgcaacgccgtcaattacgccgctgataaccaaatctacatagccgggcatcctgctttcgtgaactatagcaccagtcagaaaattagccgcccaggcgattctgatgatagccggtccgtcaattcagtgcttcttttcacaattctcaatcctatatattcaattactactgacgttctctacaccatatgcaacccatgtgggccggtgcagcggatcgttatttttaggaagaatggggtgcaggccatggtggagttcgattctgtgcaatcagctcaaagagcgaaggccagcctcaacggtgccgatatatacagcggttgctgtaccctgaagatcgagtatgccaagcccacaagattaaatgtatttaaaaatgaccaggacacatgggattacaccaacccaaatctgtccgggcaaggtagtcagtgcatgttcgacggcactccaagcttccggactgtcctgactcactgctag

SEQ ID NO: 19429 - DNA, 723 bp, Artificial Sequence
  Description of Artificial Sequence: Synthetic coding sequence
atggtgaagatggccgccgccggcggcggcggcggcggcggccggtattatggcggagggtctgaggggggtagggccccagcatctcccgtggtgcacatccggggtctgatcgatggcgtagtcgaggccgatctagtagaggccctgcaggagtttggaccgatatcttatgttgtcgtgatgccaaagaagcgtcaagccctagtcgagtttgaagacgtgctgggcgcctgcaatgcagtgaattatgcggccgacaaccaaatctacattgcaggccaccctgctttcgtcaattatagcacatcacagaaaattagtaggccaggcgatagtgacgactctcggtccgtgaactccgtgttgctttttacaattctgaatccaatatatagcatcactacagatgttctctatacaatctgtaacccttgcggtcccgttcagcggatagtgattttccgcaagaatggtgttcaagcaatggtggaattcgacagtgtgcagtcagcgcagagagccaaggcttctttgaacggtgcagatatatattctggttgttgcaccttaaagatagaatatgccaaaccgacgcgcctcaatgtttttaagaacgatcaggacacttgggactacactaatccgaacctgtcaggccaggggagtcagtgtatgttcgatggcaccccctcttttcgcaccgtgctaacccactgttag

SEQ ID NO: 19430 - DNA, 849 bp, Artificial Sequence
  Description of Artificial Sequence: Synthetic coding sequence
atgagcagcagcagcagcagcccccgggagacctacgaggaggacagggaatacgaatcacaggccaagcgcttgaaaacagaagagggagagatagattatagcgctgaggaaggtgagaaccgtagagaggccacaccgagagggggcggcgacggtggtggcggcgggagatctttctcccagcccgaggccggagggtcacatcacaaagtgtcagtgtcccctgtggtgcatgtgcgcggactgtgtgaatcggtcgtggaagctgaccttgtggaggccttggaaaagttcggcacaatctgttacgtgatgatgatgccattcaagcgccaggctctggtagagtttgagaacattgactcggcgaaggaatgcgtgactttcgcggccgacgagcctgtctacattgctggacagcaggcttttttcaactactccactagtaaacgtattacacgtccaggcaatacggatgacccatccggcggtaacaaagtccttctcctgtctatccaaaacccattgtatccaatcacggttgatgtgctgtacactgtgtgcaatcctgtgggtaaagttcagagaatcgttattttcaaaagaaatgggatacaggctatgcttatgtttgagtcagtcctgtgcgcccaaaaggcaaaagcagccttaaacggtgcagacatttacgcgggctgttgtaccctgaagattgagtacgccaggcccacacgcctgaacgtgatcaggaacgacaatgactcatgggattacaccaagccttatctgggccgcagggggtgttgttggcttatgctcaagcttctggagcgctcccctctgtag

SEQ ID NO: 19431 - DNA, 1527 bp, Artificial Sequence
  Description of Artificial Sequence: Synthetic coding sequence
atgagcagcagcagcagcagcccccgggagacctacgaggaggaccgagagtacgaaagccaagctaagcgactgaagactgaggagggtgagatcgattatagcgcggaagagggcgaaaatcggagagaggccacacctcgcggcggcggcgatggtggcggcgggggcagatccttctctcaaccggaggctgggggcagtcatcacaaggtatccgtgagtccagtggtgcacgtccgtggtctgtgcgagtctgtcgtggaggccgacctcgtggaagcacttgaaaaattcggtacaatttgctacgtgatgatgatgccatttaaaaggcaggctctagttgaattcgagaacatcgactccgccaaagaatgtgtgaccttcgctgccgacgagccggtctatatcgcaggacagcaggccttttttaattactccaccagcaagcgcatcaccagaccagggaacaccgacgatccatccggggggaacaaagtgctgttactcagcatccaaaatccactttatcccataaccgtggacgtcctctatacagtgtgcaatcccgtggggaaggtccagcggatcgtgattttcaaaagaaatggcattcaagcgatgccaactagactcaatgtcataaggaatgataacgacagctgggattacacaaaaccatacctcggcagacgtgaccgaggcaaaggtcggcaacggcaagccatactgggagaacatccttcaagcttccgccacgacggatatggttcccacgggccccttctgcccctgccttcacgctacaggatgggtagtcgtgacaccccggagctagttgcatacccactgcctcaggctagctctagttatatgcacggcggaaacccgtccgggagtgtggtgatggtgagcgggctgcatcaacttaaaatgaattgctcccgagtcttcaacctgttctgtttatacggcaatatagagaaagtaaagttcatgaaaactatccccgggacagctctcgtcgagatgggagacgagtacgcagtagagcgcgcagttacgcacctcaataatgtaaagttatttggaaagagattgaacgtgtgtgtcagcaagcagcactctgttgtccctagccagatcttcgaactggaggacgggacctctagttataaagattttgctatgagcaaaaataatcgcttcaccagcgctgggcaggcctctaagaatataatacagccaccctcttgtgtgttgcattattataacgtacctttgtgcgtaaccgaagaaaccttcactaaattgtgcaacgaccatgaagttcttaccttcatcaagtataaagtgttcgacgcaaagcctagtgccaagaccctaagcggtctgctggagtgggaatgtaagaccgacgccgtagaagccctgactgctctgaatcattaccagattagggtgccgaatggatcgaacccgtataccctgaaactgtgtttttcaacctcctcgcatctctag

SEQ ID NO: 19432 - DNA, 1527 bp, Artificial Sequence
  Description of Artificial Sequence: Synthetic coding sequence
atgagcagcagcagcagcagcccccgggagacctacgaggaggacagagagtatgaaagccaggcaaaaaggctgaaaaccgaggagggcgagattgactactccgcggaagagggcgaaaacagaagagaggcaacaccgaggggtgggggggacggaggaggcgggggaaggagcttctcccaaccagaggccggaggatcccatcacaaggtgagcgtgtcaccggtcgtgcacgttaggggactgtgcgagagcgtggttgaagctgatctggtcgaagcacttgagaagtttggaacaatctgctacgtgatgatgatgccatttaagaggcaggctctcgtagagttcgagaatattgacagtgcaaaggagtgcgtgacctttgcagccgatgaacctgtgtatatcgctgggcagcaggccttctttaactacagtacaagcaagagaatcacgagaccgggcaatacagacgatccatcaggaggcaacaaggtcctactgctgtccattcagaaccctctataccctataaccgtggacgtgctttatacagtgtgcaatcccgtaggcaaggttcagcggattgtgatctttaagagaaacggcatacaggcaatggtagataggctcaacgtcatccggaacgataacgactcttgggattacaccaaaccatacctcgggagacgcgatcggggaaaaggccgtcagcggcaagcaatcttgggagagcaccctagctcctttcggcacgatggatacggatcacacggtccgctgctccctctcccctcccgctacagaatgggaagcagagacacccctgagttagtggcttaccccttgcctcaggcatcctccagctacatgcatggcggaaatccctcgggctctgtagtgatggtgtcggggcttcaccagctgaagatgaattgttcccgggttttcaatctcttttgtctgtacgggaatatcgagaaggtaaaattcatgaagactattcccggcaccgccttggtggagatgggcgacgaatacgctgtagagagagctgtgacccatctcaacaacgtcaaactattcggtaagcggctgaatgtgtgtgtttctaaacagcactcagtggtcccgtctcaaatctttgagctcgaggatggcacttcgtcctacaaggatttcgctatgtctaagaataacagattcacctcagctgggcaagcttctaagaacataatccagccccctagttgtgtcctccattattacaacgtcccgctgtgtgtgactgaagagaccttcaccaaactctgtaacgatcatgaggttctaacgttcattaaatataaagtatttgatgctaagccctccgcaaaaaccttgtcaggcctcctggagtgggaatgcaagactgacgccgtcgaggcgcttaccgctctgaatcattaccaaatccgcgtccctaacggctccaacccttacacattgaagctgtgtttctctacatcatctcacttgtag

SEQ ID NO: 19433 - DNA, 1614 bp, Artificial Sequence
  Description of Artificial Sequence: Synthetic coding sequence
atgctggcccgggagacctacgaggaggaccgggagtacgagagccaggctaaacgtctgaagaccgaagagggtgagattgattactccgctgaggagggcgagaaccgacgggaggccacacctagaggcggaggtgatgggggtgggggaggacgctcattttctcagcccgaggctggcggttcccaccacaaagtttctgtaagccccgtcgttcatgttcgcggcctttgcgaatcagtggtggaagcggatctggtagaggctctggagaagttcgggactatctgctatgtgatgatgatgcccttcaaacgacaagcgttagtggagtttgagaacattgatagcgctaaagagtgcgtcacatttgcagcagatgagcccgtctacattgcaggccaacaggcgttctttaactatagcaccagcaaacggatcacacggccagggaataccgatgatccctctggaggaaacaaagtactgttgttaagtattcagaacccgttgtatcctataaccgtcgacgttctctacacagtctgcaacccggtcgggaaagttcagagaatcgtaattttcaaacggaatggcattcaggccatggtggaattcgaatccgtcttgtgcgcccagaaggccaaagcagcactcaatggagctgatatctacgcaggatgctgtactctcaagatagaatacgcccggccaacaagacttaacgttatcagaaacgacaatgactcttgggactacacaaagccctatcttgggcgtagggacagggggaaaggcaggcaaagacaggccattctgggcgagcacccttctagcttccggcacgacggatacggttcccatggcccactgctaccactgccctctcgctacaggatgggtagtcgtgacacgcctgagctcgttgcctatccattacctcaggctagttcttcgtacatgcacgggggaaacccctcgggcagtgttgtaatggtgagtggtttgcaccagctcaaaatgaactgcagtagggtttttaacctgttttgtctgtatgggaatatcgagaaggttaaattcatgaaaaccattcccggcacagctctggtggaaatgggagacgagtatgccgtggagcgggcagtcacacacctgaataatgtcaagctgttcggcaagcggctgaacgtgtgcgttagcaaacagcatagtgtagttccgtcacagatctttgagcttgaggatggcacttccagctacaaggatttcgctatgtccaagaacaaccgttttacctcagctggccaggccagcaaaaatatcatccaacctccctcttgtgtgctccattattataacgtgccactctgcgttactgaagaaacttttacaaagctctgtaatgaccacgaagttctgacatttataaagtataaggtcttcgatgcaaagccctctgcaaagactttgagcgggttgttggaatgggaatgtaaaacagacgctgtggaggcccttacagccctgaaccactatcagatacgggttccaaatggctcaaacccctatactctgaagttgtgcttctctacaagttcccatctgtag

SEQ ID NO: 19434 - DNA, 828 bp, Artificial Sequence
  Description of Artificial Sequence: Synthetic coding sequence
atgctggcccgggagacctacgaggaggaccgggagtacgagagccaggctaagcggcttaaaactgaagagggggaaatcgattactccgccgaagagggtgagaaccgccgcgaggcaacgccccggggcggcggtgatggggggggcgggggcagatccttttcgcaacccgaggcgggagggtcccaccacaaggtgtctgttagccctgttgttcatgtgcggggcctctgcgagtcagtagttgaagctgacttagtcgaggctttagagaaatttggaacgatctgttatgtaatgatgatgccgttcaagcggcaggccctggtggagtttgagaacattgatagcgctaaggagtgtgtcacttttgccgctgacgagcccgtgtacattgccgggcagcaagcgttctttaactacagcaccagcaagagaatcaccagaccaggcaatactgatgaccctagcggggggaataaggtgctcttgctaagtatccagaatcctttgtaccctatcacggttgacgtcctgtacaccgtgtgcaaccccgtgggcaaggtgcagcgtatcgtgatatttaaaaggaacggcattcaggccatggtggagttcgagtcagttctatgcgctcaaaaggctaaagccgcactgaatggcgcagatatttacgcggggtgttgtacactgaaaatcgaatatgcgcggccaacccgcctcaatgttatccgcaacgacaatgatagttgggactatactaagccttacctaggccggcggggccggtactttatccactttcgcatgtatctcatttgttag

SEQ ID NO: 19435 - DNA, 1629 bp, Artificial Sequence
  Description of Artificial Sequence: Synthetic coding sequence
atgagcagcagcagcagcagcccccgggagacctacgaggaggaccgagagtacgaatctcaggcaaagcggctgaagacggaggagggtgaaatagactactcagccgaggagggagaaaacaggagggaggccacgcctcgtggcggcggagatgggggagggggcgggcggtctttcagtcagccagaggcaggcggatcacatcataaagtgtccgtatctccagtggtgcatgtgagggggctgtgtgaaagcgtggtcgaggccgacttagtagaggcgttggagaaattcggcaccatctgttatgtgatgatgatgccatttaagcgacaagctctggtggagttcgaaaacatagattcagcaaaagagtgtgtcacgttcgcagcagacgaacctgtgtacatagccggtcagcaggccttttttaactactccacttccaagcggatcacacgcccaggcaacactgacgaccccagtgggggcaataaggtactcctcttaagtatccagaaccccctctaccccatcaccgtggacgttctgtataccgtgtgtaatccagtgggtaaagtgcagagaatagtcatttttaaacggaatggtatccaggctatgctgatgttcgaaagtgttttatgcgctcaaaaagcaaaggccgccttgaacggtgccgatatatatgcaggatgttgtactttgaagattgagtacgctagacctacccgcctgaacgttattcgaaatgataacgactcttgggattacactaagccctacctggggagaagagacagaggtaaggggagacagcgccaggccattttaggcgaacacccttctagttttaggcacgacggatatgggtctcacggccccctgctccctctgccttcaaggtaccgtatgggaagccgggatacacccgagctcgtagcctatcctctccctcaggcaagttcatcatacatgcatggcggaaacccgtctgggagtgttgtcatggtttccgggctgcatcagctgaagatgaactgttccagagtctttaacctgttctgcttgtatgggaatatcgaaaaagtgaaatttatgaaaacgataccaggaaccgcgctcgtggaaatgggtgacgaatacgcagtagagcgcgctgttacccacctcaacaacgttaagctttttggcaaaaggctgaatgtgtgcgtttctaagcaacattccgtcgttcctagccagatcttcgaacttgaggacggcacctcgtcctataaggacttcgcgatgtccaagaataatagatttacaagcgccggccaggcctcaaaaaatattattcagcctccaagctgtgtgctgcattattataacgtgcccctttgtgtcacagaggagacgttcactaagctttgcaatgaccacgaagtcctgacattcataaaatataaggtgttcgatgccaagccctccgctaagacgctttcaggtctactagagtgggagtgtaaaaccgacgccgttgaagctcttactgccctcaaccattaccagatcagagttcctaacggctcaaatccatatacccttaagctgtgtttctctacttcgagtcacctatag

SEQ ID NO: 19436 - DNA, 2244 bp, Artificial Sequence
  Description of Artificial Sequence: Synthetic coding sequence
atggaggtgaagcggctgaaggtgaccgagctgcggagcgagctgcagagaaggggcctggatagccggggcctgaaagtggatctggcgcagaggctgcaggaggctctcgatgctgaaatgctggaagatgaggcagggggcggcggagcagggcctggaggtgcctgcaaagccgagccgcggccagttgccgcctccggcggggggcccgggggcgatgaagaggaggacgaggaggaagaagaagaggacgaggaggccctccttgaagacgaggacgaggagccccccccagcacaggctctcggtcaggctgcccaacccccccccgagccccctgaggctgctgccatggaggcagcagccgaacccgacgcaagtgagaagcccgccgaggccactgctggcagcggaggtgtgaacggaggtgaagagcaaggcttagggaagcgggaagaggacgaacccgaggagcggtctggtgacgagacgccaggctctgaagtgcccggagacaaggccgcagaggaacaaggggacgatcaggattcagagaaatctaaacctgcagggagtgatggtgagaggcggggagtgaaacgacaacgcgatgaaaaggatgaacatggtagggcctattacgagtttcgtgaggaagcctatcactcacgcagtaagtccccactccctcccgaagaagaggccaaagatgaggaggaagatcaaacgttggttaatctggacacctatactagtgacctgcattttcaggtttccaaggacagatatggaggccagcccctgttctcagagaaattccccacactctggtcaggggccaggtccacttacggagttaccaaaggcaaggtttgctttgaagcgaaggtgacacagaatctgccaatgaaggaaggctgcaccgaggtgtccctgttgagagtgggatggtctgttgacttttctagacctcagctcggcgaggacgaattttcttatggatttgatggaagaggactgaaggccgaaaacggtcagtttgaggagtttggtcaaacttttggcgagaacgatgtcatagggtgcttcgcaaactttgagactgaggaggtggagttatccttctctaagaatggcgaggacttgggcgtagctttctggataagcaaagacagtttggctgatcgggccttactcccccatgtgctgtgtaaaaactgtgttgttgaacttaacttcggccagaaagaggagcccttcttccctccacccgaagagttcgttttcattcacgccgtacccgtggaagagcgagtgcggaccgctgtcccccccaagacaatagaagagtgtgaggtgatactgatggtggggctgcccgggtctggaaaaactcagtgggctcttaagtacgctaaagaaaaccccgagaagagatacaacgtgctgggcgcggagacagtgcttaatcagatgagaatgaaaggccttgaagaaccagaaatggatcctaagtctagggatctcctggtgcaacaggcgtctcagtgcctgtccaaactggtgcagatagcttccaggaccaagagaaatttcatcctcgatcagtgcaacgtatataattccggtcagagacgcaagctgctgctgtttaaaacgtttagtcgcaaagtagtagtcgtggtcccaaacgaggaggactggaagaaaagactcgagctccgaaaagaggtcgaaggtgatgacgtgccagagtccatcatgttggaaatgaaagccaacttctctctgcccgagaagtgcgactatatggacgaggttacatacggagagctcgagaaagaagaagcacaaccaattgtgactaaatacaaggaagaggctagaaagctcctgccaccgagtgagaagaggacaaaccggcggaacaaccgaaacaagagaaaccgtcagaacaggagtcgcggccagggttatgtaggaggacaacgacggggttatgataacagagcatacggccagcagtactgggggcaacccggaaataggggaggatatagaaatttttatgatagataccgcggagattacgatcgcttctatgggagggactatgaatataatcgttaccgcgactactaccgccagtacaaccgggactggcagtcctattactaccaccacccacaagaccgagatcggtactatcgaaattattacggctaccagggctatcgctag

SEQ ID NO: 19437 - DNA, 561 bp, Artificial Sequence
  Description of Artificial Sequence: Synthetic coding sequence
atgggcaaggagatccagctgaagcccaaggccaacgtgagcagctatgttcattttctcctcaattatcgcaataagtttaaagagcagcagcccaacacctatgtaggatttaaagaattttctaggaagtgtagcgagaagtggagaagcataagtaaacacgaaaaggctaagtacgaggccctggccaaattagataaggcccgttaccaagaagagatgatgaactatgtcggaaaacgcaaaaagagacggaagcgcgaccctcaagagccacggagacccccttcttcattcttattattctgtcaggaccactacgcacaactgaaacgggagaaccctaactggagcgtagtccaggtggctaaagctactggtaaaatgtggtcaaccgctacggacctggaaaagcacccttacgaacagagggtagcgctgctccgggccaaatactttgaggagttagagctgtaccgtaaacaatgtaacgcccgcaaaaaatacagaatgagcgcaaggaaccgttgcaggggcaaacgggtgcgccaatcttag

SEQ ID NO: 19438 - DNA, 561 bp, Artificial Sequence
  Description of Artificial Sequence: Synthetic coding sequence
atgggcaaggagatccagctgaagcccaaggccaacgtgagcagctatgtccatttcctcctcaattatcggaataaattcaaagagcaacagcctaatacttatgtgggattcaaagaatttagccgcaaatgtagcgagaagtggagatctatttctaagcatgaaaaggctaagtacgaagctctcgctaagctggataaagcccggtaccaggaggagatgatgaactatgtgggaaagaggaagaagcggaggaaacgggatccccaggaaccgaggaggccgccttcctcatttctgcttttctgccaggatcactatgctcagctgaaacgggaaaaccccaattggtccgtagtgcaggtcgcgaaagcgactggtaagatgtggtctacggcaactgacctggaaaagcacccgtacgagcaacgagtggctctgctccgggcaaaatactttgaggagttagaactataccggaaacaatgtaacgcccggaaaaaatatcgtatgtccgccaggaaccggtgtcggggaaaaagggtgcggcaaagctag

SEQ ID NO: 19439 - DNA, 273 bp, Artificial Sequence
  Description of Artificial Sequence: Synthetic coding sequence
atgcccaagcggaaggccaagggcgacgccaagggcgacaaggccaaggtcaaggatgagccacagcggcgcagcgcaaggctttcggccaagcccgcgcctcctaagccagagcctcggcccaaaaaggcctcagcaaagaaaggagaaaaacttcccaagggccgcaaaggcaaggcggatgcaggtaaggacgggaataacccagctaagaacagagatgcctctaccttacagtcgcagaaagctgaaggaaccggagatgccaagtag

SEQ ID NO: 19440 - DNA, 273 bp, Artificial Sequence
  Description of Artificial Sequence: Synthetic coding sequence
atgcccaagcggaaggccaagggcgacgccaagggcgacaaggccaaggtaaaagacgagccccaaaggcggagtgctagactgagcgcaaaacccgcccctccaaaacctgagccccgtccaaaaaaggcttctgcaaagaagggcgagaaactgcccaagggccgaaaggggaaagcagacgccggaaaggacgggaacaacccagcgaagaatcgtgacgctagtaccctccagagccaaaaagccgaaggaacaggtgatgcaaagtag

SEQ ID NO: 19441 - DNA, 849 bp, Artificial Sequence
  Description of Artificial Sequence: Synthetic coding sequence
atgcccaagcggaaggccgccggccagggcgacatgcggcaggagcctaaaaggcgttccgcgagactctcagctatgctcgtccccgttactcccgaggtcaagcccaaacgtacttcttctagtagaaagatgaagaccaagagtgacatgatggaagaaaatattgatacgtcagcccaagctgtcgccgagacgaagcaggaggcggtggttgaagaggactataacgaaaacgctaagaatggtgaggccaaaattacagaggcacccgcctcagaaaaggaaatagtggaggtgaaagaggaaaacattgaagatgccacagagaagggaggagaaaagaaagaagcagtggcagccgaggtcaaaaacgaggaggaggatcagaaagaggacgaagaggatcagaacgaggagaaaggcgaagccggcaaggaagataaagatgagaaaggcgaagaagatggcaaggaggataaaaacgggaatgagaagggagaagacgcgaaggaaaaagaagacgggaagaagggtgaagacggcaagggcaatggggaagacggcaaagagaagggtgaggacgaaaaggaggaggaagatcggaaggagacaggagatgggaaggagaacgaagacggaaaggagaaaggcgataaaaaggaggggaaggacgtaaaggtcaaggaggacgaaaaagagagagaggatgggaaggaggatgaggggggcaatgaggaagaagcaggaaaggagaaagaggatctcaaagaagaagaggaaggaaaggaggaggatgagattaaagaggacgacgggaaaaaagaagaaccacagtcaattgtctag

SEQ ID NO: 19442 - DNA, 486 bp, Artificial Sequence
  Description of Artificial Sequence: Synthetic coding sequence
atgcccaagcggaagcccaagcggcggagcgcccggctgagcgccatgttggtacctgttaccccagaagtcaagcctaaacggacctcctcatcgcggaagatgaaaaccaaatctgacatgatggaggagaatatagatacaagcgcccaggcagtcgctgaaactaaacaagaggcggtcgtagaggaggattacaatgagaatgcgaagaacggagaggccaagatcacggaggcaccggccagcgaaaaagagattgtagaagtgaaagaggaaaatatagaagatgcaactgaaaaggggggtgagaaaaaggaggctgttgctgccgaagtgaagaatgaggaagaagaccagaaggaagacgaagaagatcagaacgaagagaagggcgaagctgggaaggaagacaaggacgaaaagggggaggaggacggtaaggaagacaagaacgggaacgaaaagggagaggatgccaagtag

SEQ ID NO: 19443 - DNA, 447 bp, Artificial Sequence
  Description of Artificial Sequence: Synthetic coding sequence
atgcccaagcggaaggccgccggccagggcgacatgcggcaggagcctaaacgaagaagtgcccgcctgagcgctatgctggtgccggtgacccccgaggtcaagccaaaacgaacctccagctctcggaaaatgaagacaaagtccgatatgatggaagaaaacatcgacacaagcgcccaggcggtggctgagacaaagcaggaggccgtagtcgaggaggactacaacgaaaatgcgaagaatggagaggcgaaaattacagaggccccagccagtgaaaaggaaattgtggaggttaaggaagagaacattgaagatgccacagaaaaaggcggcgagaaaaaagaagctgtggcagcagaggtaaagaatgaagaagaagatcagaaggaagatgaagaagaccagaatgaggagaaaggagaggcagggaaggaggactag

SEQ ID NO: 19444 - DNA, 309 bp, Artificial Sequence
  Description of Artificial Sequence: Synthetic coding sequence
atgcccaagcggaaggccgccggccagggcgacatgcggcaggagcctaaacgacgaagcgctcggctaagtgcaatgttggtccctgtgactccagaagtcaagcctaagcggacatcatctagccgtaagatgaaaacaaaaagtgatatgatggaggagaacatcgacactagcgcacaggctgtcgccgagaccaagcaggaggccgtggtggaggaagactataatgaaaacgctaagaatggagaggcaaaaatcacagaggccccagccagcgaaaaggagatagtggaggttaaagaatag

SEQ ID NO: 19445 - DNA, 606 bp, Artificial Sequence
  Description of Artificial Sequence: Synthetic coding sequence
atgcccaagcggaagatgctggtgcccgtgacccccgaggtgaagcccaagcgcacctcctcatcccgcaagatgaagacaaaatcagacatgatggaggagaacatagatacctctgcccaggcggtcgccgaaacgaagcaggaagcggtggtggaggaggattacaacgagaacgccaaaaatggggaggcaaagatcaccgaagcacccgcgtctgaaaaggaaatcgtcgaagtgaaggaagagaatatagaggacgcaacagaaaaagggggagaaaagaaggaggccgtggcagctgaagtcaaaaatgaggaggaggaccagaaggaagatgaggaggatcagaatgaagagaaaggggaggcaggcaaagaggataaggacgagaaaggcgaagaggatggaaaagaagacaaaaatggaaacgagaaaggcgaagacgctaaggagaaagaagacggaaaaaagggagaggacggaaaagggaatggtgaagacggcaaggagaaaggggaagacgagaaggaagaagaggataggaaagagacaggggatggtaaggagaacgaggacggtaaggaaaagggcgataaaaagtag

SEQ ID NO: 19446 - DNA, 270 bp, Artificial Sequence
  Description of Artificial Sequence: Synthetic coding sequence
atgcccaagcggaaggccgccggccagggcgacatgcggcaggagcccaaacggcgatcagcgcgcctgtccgcaatgttggtcccggtgactcccgaggtgaagccaaaacgcacttcgtcctcacggaagatgaagacgaagagtgacatgatggaggagaacattgacactagtgctcaggccgtggctgaaactaagcaggaggctgtagtagaggaggattacaacgagaatgccaagaatggggaagccaagatcacggaatag

SEQ ID NO: 19447 - DNA, 2073 bp, Artificial Sequence
  Description of Artificial Sequence: Synthetic coding sequence
atgaacctgcggagcgtgttcaccgtggagcagcagcggatcctgcaaaggtactacgaaaatggaatgaccaaccagtccaagaattgtttccaactcatacttcagtgcgcccaagagactaagttagattttagcgtggttaggacctgggttggaaacaaacggcggaagatgtcctccaagaattcagaaagcggcacagctacgacaggcacctcactgtctgcacccgacatcacagtccggaatgtggtcaacattgcgcgccctagctcacagcaaagcagttggaccagcgcaaataacgacgtcattgttacagggatttatagtcctgcctcttcatcaagtcggcaagggactaacaagcatacagatacacagataacagaggcacacaagatccccatccagaagaccgctaccaagaatgacacagaatttcagctgcacatccccgttcagaggcaagttgctcactgtaaaaatgcaagtctgctactcggagagaaaaccattattttaagccgccagactagcgtgctgaatgccggaaactcagtatttaaccacgctaaaaagaattatggtaactcaagcgtacaggcttccgagatgacagtgccgcaaaagcccagtgtgtgtcaccggccttgtaagatcgaacccgtgggcattcagcgcagctataagcctgaacataccggtccggctcttcataacctctgcgggcagaaaccaaccattagagatccgtactgccgtacccagaatctcgaaatcagggaggtgttctcattagccgtctctgattaccctcagcgcattttaggcggaaacgccccccagaagccatcttcagccgaaggcaactgtttgtcaatagccatggagacgggagacgccgaagacgaatacgcgcgggaagaggaactggccagtatgagagctcaaatcccgtcctatagtcggttctatgaatctggctcctctctgcgcgccgagaatcagtctacgactctcccagggcctggccgtaacatgcccaattcccagatggtaaatattcgcgatatgtccgacaacgtgctatatcagaacaggaattaccacctgacaccaaggacctccctgcacaccgcttctagcacaatgtactctaacaccaacccactcagatcaaacttttcaccacattttgcctccagtaaccaacttcgcttaagtcagaaccagaataattatcaaatcagcggaaatttaactgtgccttggattaccggctgcagccgcaagcgggcactccaggacagaacacaatttagtgatcgagacttagctactctgaagaagtattgggacaacggcatgacgagccttggatcagtgtgcagagagaagattgaagctgtggcaactgagctgaacgttgactgtgaaatcgtaagaacctggattgggaatcggaggcggaagtaccgacttatggggatagaggtcccccctccgaggggaggccccgcagacttttccgagcagcccgagtcgggttccctgtctgctctgaccccaggcgaggaggcagggcccgaagtcggtgaggataacgatcggaacgatgaggtgtccatctgtctttccgaagggtctagtcaggaagagccgaatgaagtggtgccaaatgatgctcgggcccacaaagaagaggatcatcatgcagtgactacagacaacgtaaagatcgagatcatcgatgatgaagagagtgacatgatctccaactcagaggtcgaacaggtgaactccttcctcgattataaaaatgaagaggtgaaattcatcgaaaacgaactagaaatccagaaacagaaatatttcaaactgcagactttcgttaggtcactgatcctggccatgaaggctgatgataaagagcagcaacaggcactattatcagacctgccgcctgagttagaagagatggacttcaaccatgccagtttagagccagatgacaccagtttctcagtgagcagcctgagtgaaaagaacgtcagtgagtctctgtag

SEQ ID NO: 19448 - DNA, 1899 bp, Artificial Sequence
  Description of Artificial Sequence: Synthetic coding sequence
atgagcagcaagaacagcgagagcggcaccgccaccaccggcacctctctgtccgctccagacattaccgtacgtaatgtggtgaacatagcacgtccttcttcccagcagtcttcgtggacctccgctaacaacgacgtgatagtgactggtatttactcacccgcttcgtcttcctcgaggcaagggacaaataaacatactgatacccagataaccgaggcccataaaatccccatccagaagaccgccaccaaaaatgatacagagttccagctccatattcccgttcaaaggcaggttgcacattgtaaaaacgcctcactgctcttgggagagaaaactatcatcctgagccggcagaccagcgttctgaatgctggcaactccgtgtttaaccacgctaaaaaaaactatggcaatagctcagtgcaggcaagtgaaatgacagtgccacagaaaccctctgtctgccatcggccttgcaaaattgaacccgtggggatccagcgatcctataaaccagaacataccgggcctgccctgcataatctctgtggacagaagcctacaattagagacccctactgtcgtacgcagaatctagagatccgtgaggtttttagtctggctgtcagcgactatccgcagcgaatccttggcggcaacgctcctcagaaaccttctagcgctgaggggaactgtctctctattgctatggaaaccggagacgccgaagacgagtacgcaagagaggaggagcttgcgagtatgcgtgcccagataccttcttatagtaggttctacgaatcggggtccagtctacgcgccgaaaaccagtctaccacactgcccggacccggccgcaatatgcctaactctcagatggtgaatatccgggacatgtcagacaatgtgctgtatcaaaacaggaactatcacttgactccccgtactagcctccatacagcctctagcaccatgtacagcaataccaatccccttcggtcaaacttcagcccacactttgcatcatctaaccagcttcggttgtcgcaaaatcagaacaactatcagatatcaggaaatctaacggtcccttggattacaggctgtagtcgaaaaagagccctgcaagaccgtacccagttctccgacagggacctagcaaccctgaaaaagtactgggataacggcatgacgtctctcgggtctgtgtgccgggagaagatcgaggccgtcgccacagagttaaacgtggactgcgagatcgtaaggacatggattggtaacagaagacgaaaatatcggctgatggggatcgaggttcctcctcctcggggcggccccgccgatttttccgagcaacctgaaagcggcagcttgtctgctttaacccctggggaagaggctggccctgaagttggagaagataatgatagaaatgacgaggtgagcatctgcctttccgaaggatcatctcaggaagaaccaaatgaagtggttcccaatgatgcaagggctcataaagaagaagaccatcatgcagtaacaactgataatgtgaagattgaaatcattgatgacgaagagtcagatatgatctctaactctgaagtggaacaggtgaattcttttttagactacaagaatgaggaggtcaaatttattgaaaatgagttggaaatccaaaagcagaaatatttcaaacttcagacattcgttaggtccctgattctggccatgaaggctgacgataaggagcagcaacaagccctgttgtctgatttgcctccagagcttgaggagatggactttaatcacgcaagtttggagccagatgacacatcattttcagtgagctcactctctgaaaagaacgtgagtgagtctctctag

SEQ ID NO: 19449 - DNA, 624 bp, Artificial Sequence
  Description of Artificial Sequence: Synthetic coding sequence
atgagcagcaagaacagcgagagcggcaccgccaccaccggcacctccctgagcgctcctgacataactgtgcgcaatgtggtgaatatcgctcgcccatcctcacagcagtcatcttggacctctgccaacaatgacgtgattgtcactggtatttattcaccagcatcatcctcctcccggcagggaaccaacaagcacaccgacacccagatcacagaggcccacaaaatccctatacaaaagacggctactaaaaacgacacagaatttcagctgcatattcccgtacagcggcaggttgcccactgcaagaatgccagcctgctcctcggagaaaaaactattattttgtcccgtcaaacatctgttctgaatgctggtaatagtgtgttcaaccacgccaaaaagaactacggcaattcatccgtgcaagcctccgagatgaccgtgccacagaaaccctctgtgtgtcatcgcccttgcaagattgaaccagtcggcatccagcggtcttacaagccagaacacacaggacctgcccttcataacctgtgtggccagaagcctaccatcagagacccatattgtcgcacacagaatttagagattagagaagtgtag

SEQ ID NO: 19450 - DNA, 2073 bp, Artificial Sequence
  Description of Artificial Sequence: Synthetic coding sequence
atgaacctgcggagcgtgttcaccgtggagcagcagcggatcctgcagcgctactacgaaaatgggatgacaaaccagtccaagaattgcttccagctgattttgcagtgcgcccaggagacgaagctggacttcagcgttgtcaggacgtgggtgggcaacaagcggcggaagatgtccagtaagaactctgaatctgggacagccaccaccgggactagcctgtcagctcccgacataaccgtgcggaacgtggttaatatcgcgaggcccagctcacagcagagcagctggacctccgcaaacaacgatgtcatagtgacaggaatatattcccccgccagctcaagttccagacaaggaacaaacaaacacaccgatacccagatcaccgaggcccacaaaattccgattcagaagaccgctactaagaacgacaccgagttccaactgcacattccagtgcagcgccaagtcgcacattgcaagaatgcctctcttttgctgggggaaaagactattattctatcccggcaaactagtgttctaaatgccggaaacagcgtttttaatcatgccaagaaaaactatggcaacagcagcgtgcaggccagcgaaatgaccgttccgcagaaaccaagtgtctgccacaggccctgtaaaattgagccagttggtattcaacgcagttacaagcccgaacacactggcccagccctccacaatttgtgtggccagaaaccaacaatccgagacccctactgtcgcacgcagaatcttgaaatcagggaggttttctccctagccgtttccgattatccccagaggatattgggtggaaacgctccacagaagccctcttcagctgaggggaattgcttatccattgctatggaaacaggcgatgccgaggatgagtatgcgagggaggaggagctggcttctatgagagcccaaatcccatcttactccaggttctacgagagtggaagcagtctcagggcagaaaatcagagtacaaccttgcctggtcccggtaggaacatgccaaatagtcagatggttaatatcagagacatgagcgataacgtattataccagaatcgcaattatcacctcacaccccgcacatcactgcatactgcttcaagcacaatgtacagtaacaccaaccccttaagatctaatttcagccctcactttgcaagctcgaaccaattaagactgtcacagaaccagaacaattatcagatttcaggtaatttgactgtgccctggatcacgggctgcagccgcaaacgcgctctgcaggaccgcacacaattctctgaccgggatttagctacgctcaagaaatattgggacaacgggatgacatcactgggctcggtctgccgagagaagatcgaggctgtggcaacagagctgaacgttgactgtgagattgtgcgcacctggatcggcaaccgtagacgtaaatataggctgatggggatagaagtgccgccaccccgcggaggccctgcagacttcagtgaacagcccgaatctggaagcttgtccgcattaacaccaggggaagaagcaggtcctgaggtgggtgaggacaacgatcggaatgatgaggtctcaatctgtttgagcgaagggagctcccaggaggaacccaacgaggtggtccccaacgatgctcgcgcacataaggaggaagatcatcacgccgttaccactgacaatgttaagatagagatcatcgacgacgaggaatccgacatgataagcaatagcgaagtagagcaggttaatagctttctcgattataagaatgaagaggtgaaatttatagagaatgagctggaaatccaaaagcagaaatatttcaaactgcagacattcgttagaagcctaattctggccatgaaagcagatgacaaagaacagcaacaggcacttctctccgacctgccgcccgagctcgaagaaatggatttcaaccacgcctctctggaacctgatgataccagtttcagtgtctccagcctgtctgaaaagaacgtgtccgaatcactgtag

SEQ ID NO: 19451 - DNA, 1671 bp, Artificial Sequence
  Description of Artificial Sequence: Synthetic coding sequence
atggcccgggagaaggagatgcaggagttcacccggagcttcttccggggacgccccgacctgtcaactctaacacattccattgtgaggcgccgttacctggcccactctgggagaagccacttggaacccgaagaaaaacaggccttgaaaagactcgtcgaggaagagttgctaaagatgcaggttgatgaggccgcgtccagagaggacaaattggacttgaccaaaaaaggaaagaggccacccacaccttgcagcgaccctgaaaggaaacgtttccggtttaattccgaatcagagtcgggttcagaagcgagtagccctgattacttcggtccacccgcaaaaaacggtgtggccgcagaagtatcacctgctaaggaagaaaacccccgacgtgcatccaaagccgtggaggaaagcagcgatgaagaaaggcaacgagacttgccggcacaacgcggagaagagtcgtcagaagaggaggaaaaaggatacaaaggaaagaccagaaaaaagccagtggtgaagaaacaggctcctgggaaagcgtccgtcagcaggaagcaggcccgtgaggagagcgaagaatccgaagccgaacccgtccagagaacagccaaaaaggtggaaggcaacaaggggacaaagtcactgaaggagtccgagcaagaatccgaggaggagatattggcccagaaaaaagaacagcgagaggaggaagtggaggaagaggagaaagaggaagatgaggagaaaggagactggaaaccccggacgagatcaaacgggaggagaaaatccgcgagggaggagcgttcatgcaaacaaaaatcacaggcaaaacggctcctgggcgattccgacagtgaggaagagcagaaggaagctgcatcttcaggagatgactctggtcgggatagggaacctccagtgcaacgaaaatccgaggaccgcacccagctcaaaggcggtaagcggctcagtggcagctctgaggatgaggaagatagcggcaagggcgagcctaccgcaaaaggatctcgcaagatggccaggctcgggagcactagtggtgaagagtcagacctggagagggaagtgagcgactctgaggctggcggcggaccccaaggcgagcgtaaaaaccgcagtagtaaaaagtcttcccgcaaagggcgaactcgctccagttcgtctagttcagatggaagcccagaagcgaaaggtggtaaagctggaagtggacgcagaggggaagatcatcctgctgtgatgcggctcaagcgatatatcagggcctgcggagcacacagaaattacaaaaagctattggggtcttgctgttcccacaaggagagactgtccatcttgagagccgaattagaggccctgggcatgaaaggtactcctagtctcggcaaatgccgagccctgaaagagcagcgcgaggaagccgccgaagtggcatctcttgacgtggctaatataattagcggcagcggcaggcctcggagacgcacagcttggaatcctttaggggaagcagcaccccctggtgagttgtaccgtaggacccttgactctgatgaggagaggccaaggcccgcacccccagactggtcacacatgcggggtatcatctcatcagacggggagtcaaactag

SEQ ID NO: 19452 - DNA, 732 bp, Artificial Sequence
  Description of Artificial Sequence: Synthetic coding sequence
atggcccgggagaaggagatgcaggagttcacccggagcttcttccgtgggcgccctgacttatccactctgactcattccattgtgcgacgcaggtatctagcgcacagtggaagatctcacctagagccagaagagaagcaggccctcaaaaggctggtcgaggaagaactgctgaagatgcaagtcgacgaagcagcctcccgggaggataagcttgatttgaccaagaaaggaaagaggccaccaaccccctgcagcgaccctgaaagaaagcgtttccgattcaattccgagtcagccggctccggcaggaggggtgaggatcatcccgctgtcatgagactgaaaaggtatataagagcttgtggggctcatcgcaattacaaaaaactcctcggatcctgctgctcccataaagaacgtctgtccatcctgagagcggagctcgaggccctaggtatgaaaggcacccccagcctcgggaaatgtcgcgccttaaaagagcagagggaagaagccgcagaagtggctagcctggacgtggcaaatattatctcaggctccggtcgcccaaggcgtaggaccgcctggaacccattaggtgaggcagcgccccccggtgaactttacagacggaccttggatagtgacgaagagcgccctcggcctgctcctcctgattggtctcacatgaggggcattataagcagtgacggggagtccaactag

SEQ ID NO: 19453 - DNA, 1362 bp, Artificial Sequence
  Description of Artificial Sequence: Synthetic coding sequence
atggagcgggccccccccgacggccccctgaacgccagcggcgcccttgccggtgaagctgccgccgcaggcggagctaggggcttcagcgccgcctggacggccgtgctggccgcactcatggcgcttctgattgtggccactgtactcggtaacgctttagtaatgctggcctttgtggccgactccagtcttcggacacagaataattttttcctgctcaatcttgccatatctgatttcttggtgggcgcgttttgtatccccctctatgtcccatacgtgctgacaggcaggtggacctttgggagagggctgtgcaaactgtggctggtggtggactatcttctctgtaccagttccgcttttaacatagttttgattagctatgatcgctttttgagtgttacccgcgccgtgtcgtatagagcgcagcagggcgacactaggcgtgctgttaggaaaatgttactcgtttgggtgctcgcttttctcctgtatggacctgcaatcctgtcctgggagtatctgtcaggagggagcagtatcccagaagggcactgttacgccgaattcttttataattggtatttcctgataacagcttccacattggagttctttacaccattcctgtccgtgacattctttaacctcagcatatacttgaacatccagaggcggactcgacttcgactggacggggcccgcgaagctgccggaccggagcctccacccgaagcccagccgagcccgccccccccgcccggttgctgggggtgctggcagaaaggacacggagaggcgatgccattgcacagatatggcgtgggggaggcagccgtgggggcggaggccggtgaggctaccttggggggggggggcggagggggctctgtcgctagccctacctcgtcgtctggttcctcctctcgtggaactgagcgccctcggtcactcaagcggggcagtaagccgagtgctagtagcgcctctctggagaagcgcatgaagatggtgtcccagagctttacacagcggtttcggctgagtcgagatcggaaggtggccaaatcccttgccgttattgtgagtatctttgggctgtgttgggcgccttacacccttctgatgatcatcagagcagcctgccacggacactgtgttcctgactactggtacgaaacttctttctggttattatgggccaatagcgcggtgaaccctgttctgtacccattgtgtcatcattctttcagaagagcattcactaagttactgtgtccacaaaagctgaaaattcagccgcactcttcattggaacactgttggaaaaaaatgaagaagaagacatgtctctag

SEQ ID NO: 19454 - DNA, 1338 bp, Artificial Sequence
  Description of Artificial Sequence: Synthetic coding sequence
atggagcgggccccccccgacggccccctgaacgccagcggcgccttagcaggggaggcagccgcagcgggtggtgccaggggtttcagcgcggcatggaccgcagtcctggctgccctgatggccctgcttatcgtagctacagtgttaggtaatgcgttggttatgttggcgttcgtcgcagactccagccttaggacacaaaacaacttctttctgctcaacctcgctataagtgattttctcgtaggcgcattttgtatccccttgtatgtcccttacgtgctcacaggtcgctggacgttcggcagaggcctgtgtaaactctggctggtcgtagattacctcttatgcacctcttccgcattcaacattgtgctaatttcatatgatcggtttctttctgttaccagagccgtgagctacagagcccaacagggggacaccaggcgggctgtccggaaaatgctgctggtatgggtgctcgcttttttgctgtatggacccgcaatcctgagttgggagtatctgtctggcgggagcagtatcccggaggggcactgttacgctgaatttttttacaactggtactttctgatcacagcctctaccctggaattttttacaccttttctcagcgtaaccttcttcaacctgtcaatctacctcaatatccagcgccgcaccaggctgcggttggacggggcccgggaggctgctgggccagagccaccacccgaggcacagccgagtcctccaccacctccaggctgttggggttgttggcaaaaagggcacggtgaggccatgcctcttcatcggtacggggtgggcgaagctgcagtgggcgcagaagccggagaagcaacgctcggaggcggcggcggtggcgggagcgtggcgagtccgacatcatcttccggctcatccagccgtggtacggagaggcccaggagtttgaagcgcggttccaaacctagtgcttcatctgcatcactggaaaagcgcatgaaaatggtctcacagagtttcactcagaggttcaggctttctagagatcgaaaagttgccaaatcgcttgccgtgatcgtgtcaatttttggcttgtgttgggcaccttatactcttctcatgataatccgggcagcatgtcacggccattgcgttcccgattattggtacgagacatccttttggctactctgggccaattccgctgtgaatcccgtgctttacccattgtgccaccacagtttccggcgcgcttttactaaactgctgtgtccccagaagcttaagattcagccacattcatccctggagcactgctggaaatag

SEQ ID NO: 19455 - DNA, 1248 bp, Artificial Sequence
  Description of Artificial Sequence: Synthetic coding sequence
atggagcgggccccccccgacggccccctgaacgccagcggcgccctggccggagaggcggcagcagccgggggcgctcggggattttctgctgcttggaccgcggtgcttgcggctctaatggcactactcatagtcgctactgttttggggaatgctctagtgatgttagcattcgtggctgacagtagcttaagaactcaaaataactttttcctcctgaacctggcaatcagtgacttcctcgtgggtgccttctgtattccactttacgtaccatatgtcctcacgggtcgctggacatttggcagggggttatgtaagctgtggctcgtggtcgattacctgttgtgcacctcaagtgcgtttaacattgtgctaatctcctacgatagattcctgtctgtgactcgggctgtcagctatcgagctcaacaaggagacacccgccgggcagtgagaaaaatgttactggtttgggtgttagccttccttctctacggcccagccatcttaagctgggagtatctgtcggggggcagttctatcccggaaggtcattgttacgctgagttcttttacaactggtacttcctgataacagccagtacccttgagtttttcacacccttcctgtcagtaactttctttaatctgagcatatatctgaatattcagcggagaacaagactacggctcaaagggcatggcgaggcaatgcccctgcatcgctacggggtgggtgaggcagccgtaggagctgaagccggggaggctaccctcggcggcggcggcggtggagggtctgtggcgtcgcctacttcttcctccgggagttcctctcgaggcactgagcggcctcggtcattgaagcgggggtctaagccgtctgcctcttctgcctctctcgagaagaggatgaaaatggttagccagtcattcacccagaggtttaggttgtctcgggaccggaaagtggccaaatccctcgccgtgattgtaagcatctttggcttgtgctgggccccctacacactgttgatgatcatccgtgccgcttgtcacggacactgcgtacccgactattggtacgagacatcattctggttgctctgggcgaattctgccgtgaacccggtgctgtacccactctgccatcacagcttcaggagagcgttcaccaagctgctgtgcccacaaaagctaaagatccagccacattctagcctggagcactgttggaagtag

SEQ ID NO: 19456 - DNA, 396 bp, Artificial Sequence
  Description of Artificial Sequence: Synthetic coding sequence
atgagcggccggggcaagcagggcggcaaggcccgggccaagagcaagtccaggagtagtagagcgggcctccagttcccagtagggcgtatccaccgcctgctgcgcaaggggaattacgcggaacgcattggggccggcgccccggtgtaccttgcggccgtgcttgagtatctgaccgcagagatcctggagctcgcgggcaatgctagtcgggataacaaaaagacacgcatcatacctcgtcatttgcagcttgcaatccgcaatgacgaagaactgaacaagctgcttggtggggtgacaattgcccaaggcggcgttctcccaaatattcaggcagtactcctccccaaaaagaccgaatcccaccaccataaggcccagtcgaaatag

SEQ ID NO: 19457 - DNA, 393 bp, Artificial Sequence
  Description of Artificial Sequence: Synthetic coding sequence
atgagcggccggggcaagcagggcggcaaggcccgggccaaggccaaaacgaggtccagcagagctgggcttcagtttcccgttgggcgggtccaccgcctcttgaggaaggggaactacgccgagcgggttggcgcaggcgctcccgtctatctggcagctgtattagagtatctgactgctgagattttagaattggctggtaacgcagcccgcgacaacaaaaagactcggatcattcctcggcatttgcaattggctatcagaaacgacgaggagctcaataaactgcttgggaaggtcactattgcccaggggggcgtgctccctaatatccaggcagtactgctgcccaagaaaacagaatcccatcacaaggcaaagggcaaatag

SEQ ID NO: 19458 - DNA, 387 bp, Artificial Sequence
  Description of Artificial Sequence: Synthetic coding sequence
atgagcggccggggcaagcagggcggcaaggcccgggccaaggccaagacccgcagctctcgagccggtcttcagttcccagttgggagagttcaccgcttgctccggaaggggaactacgctgagagagtgggagccggcgccccggtctacctggcggctgtgttagagtatttaacagccgaaatcttggagctggctggcaacgccgcccgggacaataagaagacccggattatacctagacatcttcaattggcaattagaaatgatgaagaactgaataagcttctgggcaaggtgactattgcccagggaggggtgcttcccaacatacaggccgtactcctgcctaagaagacggagtctcatcacaaggccaagtag

SEQ ID NO: 19459 - DNA, 381 bp, Artificial Sequence
  Description of Artificial Sequence: Synthetic coding sequence
atgcccgagcccgccaagagcgcccccgcccccaagaagggcagcaaaaaggccgtcacaaaagcacagaaaaaagacggtaagaagagaaagaggtcccgtaaggagtcatatagcatttatgtctacaaggtactaaaacaggtacacccagacacagggatcagcagcaaagccatgggcattatgaattccttcgtgaatgatatcttcgaaagaatcgccggagaagcctctcggttggcacactacaataaacgcagtacaatcacttcccgagagatacagaccgcagtgcgattacttttgcctggagaactggccaaacacgccgtgtccgagggcaccaaagccgttacgaagtacactagtgcaaaatag

SEQ ID NO: 19460 - DNA, 381 bp, Artificial Sequence
  Description of Artificial Sequence: Synthetic coding sequence
atgcccgagcccgccaagagcgcccccgcccccaagaagggcagcaagaaagctgtaacgaaggctcagaaaaaagatggaaagaaaagaaaacgatctagaaaagaaagctactccatctacgtctacaaggtgttgaagcaagttcaccctgacaccggaatcagcagcaaggcaatggggattatgaattctttcgtcaatgacatctttgagagaattgccggggaggcatctcgtttggcacactataataagagaagcacgatcacgagtagggaaattcagaccgccgtgcggctgttattgccgggtgagctggcaaaacatgccgtctcagaggggactaaagcggttactaagtacacatctgccaaatag

SEQ ID NO: 19461 - DNA, 381 bp, Artificial Sequence
  Description of Artificial Sequence: Synthetic coding sequence
atgcccgagcccgccaagagcgcccccgcccccaagaagggcagcaagaaggctgttaccaaagctcagaaaaaggatggaaaaaaaaggaagaggtcaagaaaggaatcttactcagtctacgtgtacaaagtgcttaagcaggtgcaccccgacacagggatctctagcaaggccatgggcattatgaactcatttgtcaatgatattttcgaacggatcgccggcgaagcctctagacttgcccactacaacaagcgaagcacaattacttcgagggaaatccagacggccgtgcgcctgttgctgcctggcgagttggctaaacacgccgtttcagagggcacaaaagccgttactaaatacacaagcgcaaagtag

SEQ ID NO: 19462 - DNA, 381 bp, Artificial Sequence
  Description of Artificial Sequence: Synthetic coding sequence
atgcccgagcccgccaagagcgcccccgcccccaagaagggcagcaagaaggccgttactaaagcccagaaaaaggacggcaagaagcgaaaaaggtcgagaaaggaatcatactcggtgtatgtttacaaagtgttaaagcaggtccatcctgacacagggataagtagcaaggccatgggaattatgaacagctttgtcaatgatatcttcgagaggattgccggagaggcaagcagactggcacattataataagcggagcacaattacctctagagagatccagactgctgtaaggctgttgctaccgggggaactggccaagcacgccgtgagcgagggcacaaaggcagttactaagtatacatcagcaaagtag

SEQ ID NO: 19463 - DNA, 393 bp, Artificial Sequence
  Description of Artificial Sequence: Synthetic coding sequence
atgagcggccggggcaagcagggcggcaaggcccgggccaaggccaaaagccgttcttccagggctggactgcaattccccgtgggtcgcgttcatcggctactacgcaaggggaattacgccgagagagtcggtgccggcgcacccgtttacatggcggcggttctggagtaccttacagctgagatactggagctggcgggcaatgcagcacgggacaataagaagacacgtattatacctaggcatctccagcttgcaataagaaacgacgaggaattgaataaactactcgggaaggtaactatcgctcagggtggcgtgcttcccaatattcaggctgtcctactccctaaaaagaccgaatcccatcacaaggctaaaggaaagtag

SEQ ID NO: 19464 - DNA, 393 bp, Artificial Sequence
  Description of Artificial Sequence: Synthetic coding sequence
atgagcggccggggcaagcagggcggcaaggcccgggccaaggccaaatctcgttcgtcccgggccggcttgcaatttcctgtgggccgcgtgcacagactactacgtaagggcaactatgccgagcgggttggagccggggctcccgtgtatatggccgccgtgctggaatacctgacagctgaaatcttagagctggccggaaatgcagcacgcgataataaaaagacaagaatcattccacgccacctgcaattggcaatcaggaatgatgaagagctcaacaagttactaggaaaggtgaccatcgcccagggaggtgtgctccccaatattcaggctgtgcttctgcctaagaaaaccgaatcacatcacaaagccaaagggaagtag

SEQ ID NO: 19465 - DNA, 393 bp, Artificial Sequence
  Description of Artificial Sequence: Synthetic coding sequence
atgagcggccggggcaagcagggcggcaaggcccgggccaaggccaaatctcggagctctagagcgggcttacaattccccgtcggaagagtccaccgtctgctgaggaagggaaactatgccgagagagtaggcgcgggcgcaccagtctaccttgccgctgtgctggaatacctcactgccgagattttagagctggctgggaatgctgcccgagacaacaaaaagacacgcattattccccggcacctgcagctggcagtacgtaatgacgaggaacttaataagctgttaggtggtgtgacaatcgctcagggcggagtgctaccaaatattcaggccgtgctgcttcccaaaaaaacagagtctcataagccggggaagaacaagtag

SEQ ID NO: 19466 - DNA, 381 bp, Artificial Sequence
  Description of Artificial Sequence: Synthetic coding sequence
atgcccgaccccgccaagagcgcccccgcccccaagaagggcagcaagaaggccgtcaccaaggtgcagaaaaaggacggtaagaagcggaaaagatcacgcaaagaatcctattccgtctatgtgtacaaggttctcaagcaggtccaccctgataccgggattagctctaaagctatggggatcatgaacagcttcgtgaacgatatctttgagcgcatcgcaggagaagcctcccggctcgcgcattataataagcgttcaacgatcaccagtagagaaatccagactgctgtacggctcctgctccccggagagctggcaaagcacgccgtgtctgaaggcactaaggccgtgaccaaatatacctctagcaaatag

SEQ ID NO: 19467 - DNA, 501 bp, Artificial Sequence
  Description of Artificial Sequence: Synthetic coding sequence
atgcccgaccccgccaagagcgcccccgcccccaagaagggcagcaaaaaggccgtgactaaagtccaaaaaaaggatggcaagaagcggaaaaggagccgaaaagagtcctacagtgtgtacgtctataaagtcttaaaacaggttcaccccgacaccggaatatcaagtaaggctatgggcataatgaactctttcgtcaacgatatttttgaaaggatcgccggagaagccagccgcctcgcccattataataaacgtagtacaatcacaagccgggagattcaaacggcagtgcgactgctccttcctggcgagctagcaaaacatgccgttagcgaaggaacgaaggcagttacaaaatacacttctagcaatcctaggaatttatcaccaaccaagcctggaggatctgaggaccggcagcctcccccatctcagcttagcgccatcccccctttttgcctggttctgcgcgccggcatcgcaggccaagtctag

SEQ ID NO: 19468 - DNA, 405 bp, Artificial Sequence
  Description of Artificial Sequence: Synthetic coding sequence
atgcccgaccccgccaagagcgcccccgcccccaagaagggcagcaagaaagctgtcaccaaggtgcaaaagaaggacggcaagaaacgcaagcgttcaaggaaagagagttacagcgtgtatgtctacaaagtcctgaaacaggtgcaccccgacactggcatttcctctaaagcaatgggcatcatgaattccttcgtaaacgacattttcgaacggatcgcaggtgaagcctcacgcctggctcattacaataaacgctccaccatcacgagccgagaaattcaaactgcagttagattgctgctgcctggcgaactcgccaaacatgccgtttccgaaggcactaaggcagttactaaatacacgtcatcaaagttgatcggaccaattctgtggaagtag

SEQ ID NO: 19469 - DNA, 411 bp, Artificial Sequence
  Description of Artificial Sequence: Synthetic coding sequence
atggcccggaccaagcagaccgcccggaagagcaccggcggcaaggccccccgaaaacagttagcaaccaaggccgcccggaagagcgcccctgccactggtggcgtcaagaagccacacaggtatagacctggcaccgtcgcactgagggagatcagaaggtatcagaaatctacagaactgttaatcaggaagcttccattccaaagactcgtgcgcgagattgcccaggagttcaagaccgatctgcgctttcagtctagcgccgtgatggccttgcaggaagccagagaggcttacctggtgggcttgttcgaggacactaacctctgtgcgatccacgccaaacgtgtgacaatcatgccgaaggacattcaactggtgtcaagaattaggggcgagcgggcttag

SEQ ID NO: 19470 - DNA, 393 bp, Artificial Sequence
  Description of Artificial Sequence: Synthetic coding sequence
atgagcggccggggcaagcagggcggcaaggcccgggccaaggccaaatctagatccagcagagctgggctgcagttccctgtcgggcgggtgcatagactgctgaggaaagggaactactccgagcgggtcggtgccggagcgcctgtgtacctggccgctgtgctcgagtacctgaccgcagaaattcttgaactcgcaggcaacgcagcaagagataacaagaaaacgcggattattcctcgccaccttcagctagcaatccggaacgatgaggagctgaacaaacttttggggagagttacgattgcccaagggggagtccttcctaatatccaagccgtgctgctgcccaaaaagacggagtcacatcacaaagccaagggtaaatag

SEQ ID NO: 19471 - DNA, 381 bp, Artificial Sequence
  Description of Artificial Sequence: Synthetic coding sequence
atgcccgaccccagcaagagcgcccccgcccccaagaagggcagcaagaaagccgttaccaaagctcagaaaaaggacggtaagaagaggaaacgaggacggaaggagagttattccatttacgtgtacaaggtgctgaagcaggtccacccggacaccgggattagtagtaaggccatgggcatcatgaattcctttgttaatgacatcttcgaacgaattgcatccgaggcgtctagattggcccattataacaagcgcagtactataaccagtagggaagtgcagacagcagtgcggctcttgctgcccggagaattagccaagcatgccgtctccgaaggcactaaggccgttactaagtacaccagctctaagtag

SEQ ID NO: 19472 - DNA, 1554 bp, Artificial Sequence
  Description of Artificial Sequence: Synthetic coding sequence
atgcccccccccggcaaggtgccccggaaggagaacctgtggctgcaatgtgagtggggttcatgttcgttcgtctgcagcaccatggaaaaattttttgagcatgttacccagcacctgcagcagcacctgcacggctctggagaggaggaagaggaagaggaagaggacgatcccttagaagaggaattcagctgcctttggcaggagtgcggcttttgtagtttagatagcagcgccgatttgatccggcacgtgtattttcattgttatcacaccaagctcaaacaatgggggctgcaggccctccagtctcaggcagatcttggcccttgcatcctcgattttcagagccgtaatgtgatccctgatattcctgatcattttctatgtttgtgggagcactgcgaaaactcttttgataatccagagtggttctaccgacacgtcgaggcccactccctctgctgcgagtacgaggccgtcggaaaggacaatcctgtggtgctgtgtggctggaaaggctgtacctgcacatttaaagataggagcaaactcagggaacatctgcgctctcacacccaggaaaaggtagtggcctgtcctacttgtggaggcatgtttgcaaataacacaaagttccttgaccatatccgccgacaaactagtctcgaccagcagcattttcaatgctcccattgtagcaaaagattcgccactgagcggttgcttcgagaccacatgcggaaccatgtaaatcactataaatgtcccttgtgtgacatgacttgtccactaccttcttcattacgaaaccatatgcgctttcgtcactcagaggacaggccattcaaatgtgactgctgcgattactcctgtaagaatctgattgatctccaaaagcatctcgatactcacagcgaggaacccgcttatcggtgcgacttcgaaaattgcacctttagtgcgaggtcactgtgctcaattaagtcccactatcggaaagtgcacgaaggggacagcgagcctaggtacaaatgtcatgtttgtgataagtgcttcacgagaggcaataaccttacagtgcatctgcggaaaaagcaccaatttaagtggccttcgggacacccccgttttagatataaggaacacgaagatggttatatgaggttgcagctagtgaggtatgaatccgtagagctgacccagcagctcctcaggcagccccaggaaggaagcggtctcggaacctctttgaacgaatctagcctgcaaggcatcatcttggagactgtcccaggagagccaggacgtaaggaggaggaagaggagggcaaaggcagcgaggggacggctctgagtgcctctcaggacaaccctagctccgtgattcatgtcgtgaaccagactaatgcccaggggcagcaagagatcgtgtattatgttctaagcgaagcccccggggagcccccccctgcacctgaaccgccttccggcggaatcatggagaaacttcagggtattgctgaggaacccgaaatacagatggtctag

SEQ ID NO: 19473 - DNA, 1260 bp, Artificial Sequence
  Description of Artificial Sequence: Synthetic coding sequence
atgcccccccccggcaaggtgccccggaaggagaacctgtggctgcagtgcgagtgggggagctgtagttttgtgtgctctaccatggagaagttcttcgagcacgtcacccagcatctgcagcagcatctgcacggatccggcgaagaagaggaagaagaagaggaggacgaccccctcgaagaggagttttcatgtttatggcaggaatgtggcttttgttccctggattcatctgcagatctgattcggcacgtttacttccattgctatcataccaaactgaaacagtgggggctccaggccttgcaatctcaagccgatctcggaccatgcatacttgattttcaaagtcggaacgttattccagacatccccgaccactttctatgcctttgggagcactgtgaaaatagcttcgataatccggagtggttctataggcatgttgaggcccacagcctgtgttgtgaatacgaagctgtgggtaaagataacccagtggtcctttgcggatggaaaggttgtacgtgtacgtttaaagataggagtaagctccgggagcatttgaggagccacacacaggaaaaggtggtggcttgtccaacctgcggtgggatgtttgccaacaacaccaaatttcttgaccatatacggagacaaactagccttgaccagcaacatttccaatgctcacactgctccaagcgttttgccaccgagcggttgctccgggaccacatgagaaatcatgtgaatcattacaagtgcccgctctgtgacatgacctgtcctctgccgagttcgctccgcaatcatatgagatttcgccattccgaagaccgccctttcaaatgtgactgctgtgactatagctgtaaaaatctcatagacttgcagaagcatttggacacgcatagtgaagagcctgcctacagatgcgattttgagaattgcaccttctcagctcgcagcctctgctctatcaaatcccactacaggaaagtgcatgaaggcgactcagagcccagatataaatgccacgtatgcgacaaatgcttcacacgcggcaacaacctcactgtacatctgcgtaaaaaacaccagttcaagtggcccagcggtcatcccagattcaggcttggtcacttctgtatcccattacccggatttgccgctctgtacgcacccacatctcctggcacgcgaaacatgaaaatggccatatgtggctgctcatggttcgctacccgggtatag

SEQ ID NO: 19474 - DNA, 306 bp, Artificial Sequence
  Description of Artificial Sequence: Synthetic coding sequence
atgaacctggagcgggtgagcaacgaggagaagctgaacctgtgccggaagtactacctgggaggcttcgcttttctgccgttcctgtggctggttaacattttctggttctttagggaggcgttcctcgtgcctgcctacacggaacagagccagatcaaggggtacgtttggcgatccgccgtcggattcctgttctgggtcattgtgctgacttcgtggattaccattttccagatttatcggcctcggtggggcgcactaggcgactacctgagcttcaccattccactggggactccttag

SEQ ID NO: 19475 - DNA, 1749 bp, Artificial Sequence
  Description of Artificial Sequence: Synthetic coding sequence
atggccgccgccgccggcggcggcagctgccccggccccggcagcgcccgtggccggttccctgggagaccccgtggcgcaggtggaggtggtgggagaggcggccgcgggaatggagctgagagggtgagagtggcactgcgccgaggtggaggagccacaggaccaggtggtgcagagccgggggaggacactgcgctactccgcctgctcggcctgaggcgcggactgcgtagactgagacggttgtgggcaggaccccgggttcagcgtggccggggaaggggcaggggccggggctgggggccaagcagagggtgcgtgcctgaggaggaaagttctgacggagaatctgatgaggaagagtttcagggttttcatagtgacgaagacgtcgccccttcttccctgcgcagcgctttacgctctcaacgtgggagggctccacggggccgcggccgcaagcacaaaaccactccgctgccacctcccagactggcggacgtggctcctacaccacctaagactcctgcccgaaagcgtggcgaggagggcacggaacgcatggtgcaggcccttaccgagctcctccgcagagcacaagccccacaagcaccccgtagcagagcctgtgagccctctactccaaggaggtcacgcggtaggcctccaggacggcctgccggcccctgtcgcaggaagcaacaggcagtcgttgttgccgaagcagccgtgactattcctaaaccagaacccccccctcctgtggttccagttaagcaccagaccggttcctggaaatgcaaagaaggccctggcccgggccccggtacgcccagaaggggtgggcagtcctctaggggtgggagaggaggccgaggcagaggccgaggcggcgggctcccattcgtaataaaattcgtgtctcgggccaagaaggtgaagatgggccagctgtctctggggctagagagtggccaaggacagggtcagcatgaggaaagctggcaggacgtaccccagcgcagggtcggctctggacagggcggatccccctgctggaagaaacaggaacaaaaactcgatgacgaggaggaagagaagaaagaggaggaggagaaggataaggaaggcgaggagaaggaggaacgggccgtggctgaggagatgatgccagccgccgaaaaggaagaggctaagctacctccacccccgctaacccccccggcgccgtcacccccgccacccctaccgccaccaagcacaagccctcctcccccactgtgcccaccaccccctccccccgtgagtccacctcccctgccaagtccccccccgccgcccgctcaggaagagcaagaagagtcaccaccccctgtagttcccgccacatgcagccgcaagcgcggccggccacctctgacaccgtcacagagggccgagcgggaagccgcccgcgcgggcccagaggggacatctccaccgactccgacaccctctacggcaactggagggccgcctgaggacagccccacggtggcccctaagtccacgacttttttaaaaaatattcggcaattcataatgcctgtccctctaagtcagtccttgctgttacctatgaccttgcagctgtccctgagtcttggccagtgggccgctcccaccacttcggcatgcctggactctcctctctggagtcctttactactcaggcctaggtgcccactcaccggattgcagctctag

SEQ ID NO: 19476 - DNA, 8148 bp, Artificial Sequence
  Description of Artificial Sequence: Synthetic coding sequence
atggccgccgccgccggcggcggcagctgccccggccccggcagcgccaggggtcgcttccccgggagaccaaggggagcaggagggggcgggggccggggcggacgtggtaacggcgccgaaagggttagagtggctctgcggcgtggcggaggggccacaggcccagggggcgcagaaccaggagaggacacagccttgcttcggttgttgggcttacggcgcggactaagacggctacggaggctgtgggctggtccccgcgtgcagcggggacgtgggcgagggagaggccggggatggggaccctcacgaggatgcgtgcccgaggaagagtctagtgatggggagagcgacgaggaggaattccagggcttccactcagacgaagacgtggccccatcttccctgcggtctgccctgcgatcccaacgaggaagggcccccagagggaggggcaggaagcacaagactactccgcttccaccacccaggttagccgacgttgcaccaacgccacccaaaacccccgcacggaagagaggggaagagggtacggagcgtatggtgcaggctctgactgaactgttgagaagggctcaagccccacaggctcctagatcccgagcctgcgaaccctccactcccagacgcagcagagggcgtccacctggcaggccggctggaccctgcaggaggaaacagcaggcggtggtcgttgcagaggccgctgtgacaataccaaaacctgaacctccaccccctgttgtgcccgtgaagcaccagacaggcagctggaaatgtaaagagggacctggccccggcccagggacccctcggcgcggagggcagagctctcggggcgggaggggcgggcggggtcgtggccgcgggggaggtcttcctttcgtcattaaatttgtatctcgggcaaagaaggtgaaaatggggcagctgagccttggtctggaatctggacaggggcaaggccagcacgaggagtcatggcaggacgtcccccagaggagggtgggatctggtcagggcgggtctccctgctggaagaagcaggagcagaagcttgacgatgaagaagaggaaaagaaggaagaggaagaaaaggataaggagggcgaagaaaaggaggaacgcgcagtggccgaggagatgatgccagctgctgagaaggaggaagcgaaattacctccccctcccctgaccccccctgcccccagtcctccaccccctttaccgcctccatctacatctcccccccccccactgtgcccacccccacccccacccgtgtctccaccgcctctgcccagccctccccccccacctgcccaggaagagcaggaagagagtcctccgcctgtcgtcccagccacctgctctcgtaagagagggcgtcccccactcaccccttctcagcgggcagagagagaagctgcgagggctggacctgaaggcacttcccccccaacccccacccccagcactgccacaggtgggccgcctgaggatagtcccaccgttgcaccaaagagtactacttttttgaaaaatatacgacagtttatcatgccagtcgtgtcagctagatccagccgggtgatcaagacccctaggcgtttcatggacgaagaccctcctaagccaccaaaggtggaggtgagccccgtcctgcggccaccaataactacatccccaccagtgcctcaggaaccggcacctgtgccaagtccaccccgtgctcccacccccccttcaacgcctgttcccttgccagagaagaggcgctccattctgcgggagcctacgttcagatggacaagcttgactcgcgagttgccacctccccctcctgcccctcccccaccccccgcaccctcccctccccccgctcccgccaccagtagcaggcggccattactgctgcgggccccccagttcaccccctctgaggctcatctgaagatttacgaatccgtgctgacccctcctcccctgggcgcccctgaggctcctgaaccagaacctccccctgctgatgactctcctgccgagcccgaacccagggccgtcggcagaaccaatcacctgtcactgccccgtttcgcacctgtcgtaactacaccggtgaaggcagaggtatcccctcacggcgcacctgccttatccaacggacctcagactcaggcccagctcctgcaacccctccaggccttgcagactcagctcctcccacaggctctgccaccccctcagccccagctgcaacctcctccctcaccacagcaaatgcctcctctggagaaggctaggatcgccggcgtggggtctctgcccctgtccggcgttgaggagaagatgttcagtctcctcaagcgagcaaaggttcaactgttcaaaatcgaccagcagcaacagcagaaggtggccgcttctatgccactgtctcctggcggacagatggaagaagtagccggtgccgtgaagcagatttccgatcggggcccagtgcgatctgaggacgagagtgtggaggctaagcgtgaacgtccttcaggaccagagagccccgtccaaggcccccgcattaagcacgtgtgccggcacgctgccgtggccttgggccaagcacgggccatggtgcctgaagatgtaccacgtctgagtgccctacccctacgggatcgacaagatttggccaccgaggacacttcttccgcctccgagacagaatcagtgccgagccgcagccgcaggggtaaagtggaagcagctggccctggtggtgagagtgagcccactggttccggaggaactctggcacacactcctcgacgaagtctcccgtctcatcacgggaagaaaatgcgcatggccaggtgcggccattgcagggggtgtctgcgtgtgcaagactgcggatcttgcgtaaattgtttggataagccaaaattcggcggcccaaacaccaagaaacaatgctgcgtgtatagaaaatgcgacaagattgaggcgcgtaaaatggagcggctggcaaagaagggaagaactatagttaagactctgctcccatgggactcagatgagtcacctgaagcttcacccggcccgccggggccccgccgtggagccggagcgggcggaccacgggaggaagtggttgcccacccggggcctgaagagcaggatagcctgttgcagagaaaaagcgcgcgtcgatgcgtcaagcagaggccaagttatgatatttttgaggactcagacgactcggagccgggcggtccacccgccccacggcggaggacaccccgcgagaatgaactaccgttgcccgaaccagaggaacagtcgcggcctcgaaaacctacactgcagccagtgcttcaactcaaggctaggaggcggctcgacaaggacgctttggcccctggtccttttgcctcattccccaatgggtggaccggcaaacagaaatcaccggatggggtccatcgcgtgagagtggactttaaggaggattgcgacttagaaaacgtttggctcatgggcgggctctccgtgctgactagcgtgccaggaggcccgcctatggtttgcctcctgtgcgccagtaagggactccacgaactcgtcttctgccaggtatgttgcgatccttttcaccctttttgcttggaagaggctgaaaggcccctcccccagcatcacgatacatggtgctgccgcaggtgtaagttctgccacgtgtgtggacggaaggggagaggttcaaaacacctgctggagtgtgaacggtgtcgtcacgcataccaccccgcctgcttgggaccttcttatccgacaagggcgacaagaaaacggagacattggatctgctccgcatgtgttaggtgtaagtcctgtggggctacgcccgggaagaattgggacgtggagtggagtggggactactcactgtgcccgcgttgtacccaactctatgaaaaaggtaattactgcccaatctgtacacgatgctatgaagacaacgattatgagagcaaaatgatgcaatgtgcccaatgtgaccattgggttcacgctaaatgtgaaggcctgtctgatgaggattacgagatcctttctggcttgcccgactccgtcctgtacacttgcggtccctgcgcaggggctgcccagccaaggtggcgggaggctctgtccggggctctgcagggtggtttgcgccaggtgctgcaaggattgctctcatctaaagtggtaggcccacttctgctctgcacccaatgcggccctgatggcaagcagttgcatccaggtccgtgcggcctgcaggctgttagtcagcgctttgaagatggacactacaagagcgtccacagcttcatggaagacatggtgggcatcctgatgagacatagcgaggagggcgagaccccagacagacgggcggggggtcagatgaaggggctcttactaaagttgctggaatcggcttttggatggttcgacgcccacgatccaaagtactggcgcaggagcaccaggctgcctaatggggtgctgccgaatgccgttctgccaccatccttggaccacgtctatgcccagtggcgccaacaggaacccgaaacgccagagtccgggcagccgccaggtgatccttcggccgcctttcaaggcaaggaccccgcagccttctcacacttagaggatcctcgccagtgcgccctgtgtttaaagtacggcgacgctgacagtaaagaggctgggagactcctgtatattggccagaatgaatggacccatgtgaactgtgctatctggtcggccgaggtgtttgaagaaaatgacggctcccttaagaacgtgcacgctgcagtcgcaagaggccgtcaaatgaggtgtgagctgtgtctgaagccaggggccaccgtgggctgctgcttgagctcctgcttgagtaattttcacttcatgtgtgcccgcgcatcttactgtatttttcaggatgataagaaggtgttttgccagaagcatacagaccttcttgacggaaaggagattgttaacccagatggctttgatgtacttagacgcgtatacgtggacttcgagggcataaacttcaagcgtaagttcctgacgggcctggaacctgacgccattaatgtgcttattggatcgatccggatcgattcccttgggactctctcagatctgtcagactgtgaaggtaggttgttcccaattggctaccagtgctcaaggctgtattggtcaaccgtggacgccaggcgtaggtgttggtacaggtgccgcattcttgagtacagaccctgggggccacgggaggagcccgcccatctggaggccgcggaggagaatcaaacgatagtgcacagccctgcgccgagtagtgaaccaccagggggggaagaccctcctctggatacagacgtcttagtgcccggcgccccagagcggcactccccgatccagaatctagaccctcctctgagacccgatagcggctccgccccccctccagctccccgcagtttctcgggagctaggattaaggtgccaaattatagcccaagccggcgacctcttggaggggtcagcttcggtccattgccttcgcctgggagcccgtcaagtctgacacaccatatccccaccgtgggcgaccccgattttcctgcacctccacggagaagccgaaggccgtcgccgctcgccccacggcctcctcccagcaggtgggccagcccgcctctaaagacaagcccgcagctgagggtccctccaccaacgagtgtggtaaccgctctcacccccacgagcggagaactggcccctcctggaccagccccatctccacccccccccgaagatctcgggcccgacttcgaagacatggaggtcgtttccggcttatctgccgcagaccttgatttcgctgcatccctgctaggcacggaaccattccaggaagaaattgtggccgccggcgctatggggtccagccacgggggtcccggcgatagttcagaggaagagagcagtccaacctctaggtacatccactttccggtgaccgtggtgtctgcccccggactggctcccagtgccaccccaggcgccccccggatagagcaactggatggcgtcgatgatggcaccgacagtgaagcagaagccgtgcaacaacctaggggccagggaacaccaccctcaggcccgggtgtggtccgcgccggagtgctgggagctgccggcgatcgcgctcggccccccgaggatctcccttcagagatcgtggattttgtgctcaagaaccttggcgggccaggcgacggtggtgccgggcctagagaggagtcgctcccaccagccccacctctagccaatggaagtcagccaagccagggactgacagctagccctgcagatcccacgagaacctttgcgtggctcccgggcgcccccggagtaagggtgctaagtctcgggccggccccagagcccccaaaacccgccactagtaagatcatccttgttaataaattaggtcaggtcttcgtgaagatggctggagagggggaaccggtacccccgccagtcaaacagccccctttgccccccactatcagtcctaccgcccctacgtcatggactcttcctcccgggcccttattgggcgtccttccggttgttggcgttgtccgtcccgcacctccacctcccccccctccactaacccttgtgctgtcttcgggacccgcttctcccccacgccaggccatcagagtcaagcgcgtgagtaccttctccggacgttccccccctgcaccacctccttataaggcgcctcgactcgatgaagatggcgaggcttccgaggacacgccacaggtgcccggactgggctccggaggcttcagcagagtgcggatgaaaactccaacagtgcggggggtcctggaccttgatcgacctggggagcctgccggagaggaaagccccggcccgctgcaagaaagatctccattgttgcccctacccgaagacggccccccgcaggtccctgacggtcctccagaccttttgctcgaaagtcagtggcaccactactctggcgaggcgagcagtagtgaggaggaacctccatctccggacgataaagaaaaccaagcccctaagaggactggaccacacctgaggtttgagatcagcagcgaagatggcttttcagtcgaagcggagagtctggagggcgcgtggagaacgctgatcgagaaggttcaggaggcaagggggcatgcaagattgagacacctctctttttccggcatgtcaggcgcccggcttctggggattcatcacgacgccgtaatttttctggctgagcagcttcctggagctcagcggtgtcaacactataaattcaggtaccaccaacaaggggaggggcaagaggagccccctcttaatccacacggtgctgctcgcgctgaggtgtatctgcgaaagtgtacattcgatatgttcaacttcctggcgagccagcatcgtgtgctgccagagggggcaacatgtgacgaggaggaagacgaagtgcaactcaggagtactcggcgcgccacaagccttgagctgcctatggctatgcgctttaggcacctgaagaagacaagtaaggaggcggtgggggtctatcgctccgctatccatggacgggggctgttttgcaaaagaaacatcgacgcaggggaaatggtgattgaatactccggtatcgttatacgtagcgttctgacagataaacgggagaaattctacgacgggaagggtattggttgctatatgttccggatggatgatttcgacgtggtggacgccacgatgcatggcaacgctgccaggtttatcaatcacagctgcgagccaaactgcttcagtcgcgtgatccatgttgagggccagaagcatatcgttatttttgccctgcggcggattctgcgtggagaggaacttacttatgactacaaattccctatcgaagacgccagtaacaagctcccttgcaattgtggtgccaagcgctgtcgcaggtttctgaactag

SEQ ID NO: 19477 - DNA, 2892 bp, Artificial Sequence
  Description of Artificial Sequence: Synthetic coding sequence
atggccgtggccccccggctgttcggcggcctgtgcttccggttcagggatcagaacccagaggtcgcggtggaaggccgcctgccgatttcccacagttgcgttggctgtcgccgggaacgtaccgctatggccactgttgcagctaacccagccgccgccgcggccgcagtggcagcggctgcagctgttacagaagatcgcgagccccaacatgaggagctgcccgggctcgattcacagtggcgtcaaattgagaatggcgagtccggtagggaacgaccactgcgcgccggcgaatcttggttcctggtcgaaaaacactggtataaacaatgggaagcatatgttcagggtggcgaccaggatagctctactttccccggatgcatcaacaacgctacgctcttccaggatgagatcaattggcgcctgaaggagggcctggtcgagggggaagattatgttctacttcccgcggcagcatggcactaccttgtctcatggtatgggctggaacacgggcagccccctattgaaaggaaagtgatcgagctgccaaatatccagaaagtggaagtttaccccgtagagctgctattggtccgacacaatgacctgggtaaatctcatactgttcagttctctcacacagattcaatcggactggtgctgcgaacagctagagagaggttcctggtcgaacctcaggaggatacaaggctctgggcaaagaattccgaggggagtctggaccgcctgtacgatactcacatcaccgtcttagacgccgctctcgaaacaggtcaactcatcattatggagacaaggaagaaagacgggacctggccatccgcacagttgcatgtcatgaacaacaacatgtctgaagaggacgaggattttaaggggcagcccggcatatgcgggttaactaatttaggcaatacgtgtttcatgaattctgcactgcagtgcctctcaaatgtaccccagctgactgagtacttcttgaacaattgttatttagaagaactaaatttccgaaaccccctcggcatgaagggcgaaattgccgaagcatacgccgaccttgttaaacaggcgtggtctggacatcatcgatcaattgtgcctcatgtttttaagaataaagttggccacttcgcctcccagtttctcgggtatcagcaacatgactcccaggagctgctgtcattcctgttggacgggctccacgaagatctcaaccgggtaaagaagaaagaatatgtagaattatgcgacgcagctggaagacccgatcaggaagtggctcaagaagcatggcagaatcacaagaggagaaacgattcagtcatcgttgatacttttcacggtttattcaaaagtacgttggtgtgtccggactgtgggaatgtgtcagtcacattcgatcccttctgctatttatctgtacctctacctatcagccacaaacgggtactggaagtgttttttatacccatggacccacgaagaaagcccgagcagcatcgccttgttgtcccgaagaaagggaagatctcagacctgtgtgtggcgcttagcaagcacaccggcatctcccctgaacgcatgatggtagcagacgttttctctcaccggttttataagctctatcaacttgaagaacctctaagttctattctagacagagatgacatttttgtctatgaggtgtctgggagaatcgaggctatcgaaggatctcgcgaagacatcgtggtacccgtctacctccgggagcggacccctgcccgcgattataacaactcttactatgggctgatgctgtttggtcacccccttctggtatctgtcccaagagacaggtttacctgggaaggcctctataatgtccttatgtatcgactatcccgatacgttaccaaaccaaacagcgatgatgaggatgacggtgacgaaaaagaagatgacgaggaagacaaagatgatgtgcctggaccttccacaggcggaagtttacgtgatcccgaacccgagcaggccggcccatcatccggggttactaaccggtgcccatttctcctggataactgtcttggtacctcccagtggccccccagacggcgacgcaagcaactttttacattgcagaccgtaaactctaatggcacaagcgaccgaactacctcacccgaagaagtgcacgcacaaccttacattgctatagactgggaacccgaaatgaaaaagcgctactatgatgaggtggaagcagagggctacgtcaagcacgactgcgtcggctacgtgatgaaaaaagcacctgtgagactgcaggaatgtatagagctcttcactacggtggagacgcttgaaaaagagaacccatggtactgccccagctgtaagcaacaccagctggcaactaagaagcttgatctgtggatgcttccggaaattctgatcatccatctgaaaagattttcatacaccaagttcagtagagagaagctagacactctcgtagagtttcccataagggatttagatttctcagagttcgtaattcagccccagaacgaatccaaccccgagctttacaagtatgacctcattgccgtctccaatcattatggtgggatgcgcgacgggcattataccactttcgcctgtaacaaagacagcggccagtggcattattttgacgacaactccgtgtcgcctgtaaatgaaaatcagattgagagtaaagctgcatacgtattattctatcagcgccaggacgtggctcggcggttgctttccccagcaggctcatcaggcgcccccgcttcccccgcatgttccagtccacctagtagcgagtttatggacgtgaactag

SEQ ID NO: 19478 - DNA, 2166 bp, Artificial Sequence
  Description of Artificial Sequence: Synthetic coding sequence
atgagcggcaccaacctggacggcaacgacgagttcgacgagcagctccgcatgcaagagctgtacggggacggcaaagacggtgacacacagactgatgcggggggcgagcctgacagtctcggtcagcagcccacagacacgccatacgagtgggacctcgacaaaaaagcctggttccccaagattactgaggatttcatagcaacataccaggccaactatgggtttagcaatgacggagcttcatcctcaactgctaatgtagaggatgttcacgctcgcacagccgaggaaccgccacaagaaaaagcccctgaaccaaccgacgcgcgcaaaaaaggcgaaaaacgcaaggccgaaagtggatggtttcacgttgaagaggataggaacacaaatgtgtatgttagcggcctgccccccgacattaccgttgacgagttcattcaactgatgtctaagtttggtatcattatgcgggatccacagacagaggagtttaaagttaaactttacaaggacaaccagggcaatctaaagggagacgggctgtgttgctatctgaagcgggaatctgtggaactcgccttgaagctgctggacgaggatgaaattcggggctacaaacttcacgttgaagtcgcaaaatttcaactgaaaggagagtatgacgctagcaaaaagaaaaagaagtgtaaagattataagaagaaattatctatgcagcagaagcagctggattggcgccctgagaggcgcgctggacctagtcgcatgagacacgaaagggtcgttatcatcaagaatatgtttcacccgatggattttgaggatgatccgctcgtattaaacgagataagggaagaccttcgcgtggagtgctctaagtttggccagattcgaaaactgctgctgtttgatagacacccagatggagtggcctcagtatcatttcgagatccagaggaggccgactattgcattcagaccttggatggccggtggttcggcgggcggcaaatcaccgcgcaagcatgggatgggacaacagactatcaggtcgaagaaaccagcagagagcgtgaggagcgactcaggggctgggaggcctttctaaacgctccagaagccaacaggggcctccggcggtcagatagcgtgagtgcaagtgaacgtgccggccctagccgtgccaggcacttttccgaacacccatccacgtcaaagatgaacgcccaggaaacagccacgggaatggcttttgaagaacccattgatgagaagaagttcgagaagaccgaagacggcggagagttcgaggagggtgcttctgagaataatgcaaaagagagttctcctgagaaagaggctgaggaaggctgtccggagaaagaaagcgaggagggctgccccaagcgcggctttgaagggtcttgcagccaaaaagagagcgaggagggcaaccctgtccgcggctctgaggaagacagcccaaagaaagaatccaaaaaaaagactttaaagaatgactgtgaagaaaacggactggccaaggaatccgaagacgacttgaacaaggaatctgaggaagaagtcggtcccactaaagaaagcgaggaggacgactcagaaaaagagagtgatgaagactgttcagagaaacagtctgaggatggttcagagcgtgagttcgaagagaatggtctcgaaaaggatctggatgaagagggaagcgaaaaagagctgcacgagaacgtgcttgacaaggaattagaagagaacgatagtgagaactccgagtttgaagacgacggcagcgagaaagtcctcgacgaagaggggtcggaacgggaattcgatgaagacagtgatgaaaaagaggaagaggaagatacttatgaaaaagtgtttgacgatgaatccgacgagaaggaggacgaggatgcagatggaaaagaagtggaggatgcagatgaaaaactgttcgaagacgatgattcaaatgagaagctgtttgatgaagaggaagattcctcagaaaaactgttcgacgacagtgatgagcgaggtaccctcggtggcttcgggagcgtggaggaagggccgctgtccaccgggtcaagtttcattctgtctagcgacgatgacgacgacgacatctag

SEQ ID NO: 19479 - DNA, 672 bp, Artificial Sequence
  Description of Artificial Sequence: Synthetic coding sequence
atgagcggcaccaacctggacggcaacgacgagttcgacgagcagctgcgtatgcaagagctgtacggcgacgggaaagacggcgacacacagactgacgccgggggagagccagattcactgggacaacagcctacagacaccccttatgagtgggatctcgacaagaaagcctggttccccaagattaccgaggactttatcgcaacttaccaagcaaactatgggttttcaaacgatggcgcatcatcttccacggccaacgttgaagacgtgcatgccaggaccgccgaagagccaccacaagagaaggcacccgagcccaccgacgccaggaagaaaggcgagaaacggaaggccgagtcggggtggtttcatgtggaagaagataggaacactaatgtgtatgtctctggacttccccccgacatcacagtcgacgaatttattcagctaatgagcaaattcggaattatcatgagagacccgcaaacagaggagttcaaggtgaaactgtacaaggacaaccaaggtaacctgaaaggcgacggtctctgctgctacctgaagagggaatcggtcgagcttgcccttaaattgttggatgaggatgagatcagagggtacaagctccacgtcgaggtcgccaaattccagttgaaaggcgaatag

SEQ ID NO: 19480 - DNA, 735 bp, Artificial Sequence
  Description of Artificial Sequence: Synthetic coding sequence
atgagcggcaccaacctggacggcaacgacgagttcgacgagcagctgcgaatgcaggagctttatggggatggaaaagacggagacacccaaaccgacgccggtggggagcccgattctctaggccaacagcctaccgacaccccctatgagtgggatctagacaagaaggcctggttcccaaagatcacagaagatttcattgccacataccaggcaaattacggcttctcaaatgacggggcctcctctagcaccgctaatgtggaagacgttcacgccagaacggcagaagagcccccacaggagaaggcccccgagcctaccgatgcgcgtaagaagggcgagaaaagaaaggccgagtctgggtggttccacgtcgaggaagacagaaataccaacgtgtacgtctccgggttgcctcctgacattactgtggatgaatttatccaactaatgtctaagttcggcatcatcatgagagaccctcaaactgaagagttcaaagttaaactgtacaaggataatcaaggtaacttaaagggcgacggtctttgttgctacctcaagcgtgaaagcgttgagcttgcattaaagctgctggacgaagacgaaatccgcggttataagctgcacgttgaggtggcaaaattccagcttaaaggcgaatatgatgccagtaaaaaaaagaagaagtgtaaagactataaaaaaaaactgagcatgcagcagtag

SEQ ID NO: 19481 - DNA, 2268 bp, Artificial Sequence
  Description of Artificial Sequence: Synthetic coding sequence
atgagcggcaccaacctggacggcaacgacgagttcgacgagcagctcagaatgcaggaactgtatggcgatggaaaggacggagacacacagacagacgccgggggtgaaccagattctctgggacaacagccaacagacaccccatatgaatgggacctggacaaaaaggcgtggttcccaaagataactgaggacttcattgccacataccaggctaactacgggttcagcaacgacggggccagctcctctaccgcgaatgtggaagatgtccatgctcgcactgccgaggaacccccccaggaaaaggcgcctgagcccacagacgctaggaagaagggggagaaaagaaaagccgaatccggatggtttcacgtcgaagaggatcgtaatactaacgtgtacgtgtccgggctgccaccagatattacggtagatgaatttattcaactgatgtctaagtttggaatcatcatgagggacccacagactgaggaattcaaggtgaaattatataaagataaccaggggaacttaaaaggtgacggactgtgctgctacttaaagagagaatcagtagagctggcgctgaagttactggatgaggacgaaatacggggatataaactccacgtggaggtcgctaaatttcagctgaaaggggaatacgatgcaagcaagaagaaaaaaaagtgcaaggactacaagaagaaattaagcatgcagcagaagcagctcgactggcgcccagaaagacgcgcaggtcctagcaggatgcggcacgaacgtgttgtaataatcaagaatatgttccatccaatggattttgaagacgatccactcgtgctgaatgaaatcagagaggatctccgggtggagtgctctaagttcggccagatcaggaaactgctgctttttgatcggcatcctgacggggtggcttccgtcagctttagagatccggaagaggccgactattgtatccagacgctggacgggcgctggtttggtggaaggcagatcactgcccaggcttgggacggcaccaccgattatcaggtcgaggagacctctcgcgagcgagaggagcgcctaaggggctgggaggctttcctcaatgctcccgaagccaaccgcggcttacgtaggagtgacagcgtttcggcatcagagagagccgggccctcgcgtgcaagacatttttctgagcacccatcaacgtccaaaatgaacgctcaagagaccgccacaggtatggctttcgaagagcctatcgatgaaaagaagtttgaaaagactgaggatggcggtgaattcgaggagggagccagcgagaacaatgccaaagaatcatctcccgagaaggaggccgaggaaggctgtcctgagaaggaatccgaggaagggtgtcctaaaaggggctttgagggctcttgctcacagaaagagtctgaagaaggcaatcctgtgcgaggctctgaggaagattcaccaaagaaagagtcaaagaaaaaaactctgaagaacgactgcgaggaaaatgggttggccaaagagtccgaggacgacctcaacaaggaatctgaggaggaggtcggaccaacaaaggagtctgaagaggatgatagcgaaaaggaaagcgacgaagactgtagtgaaaagcagtctgaagacggttccgaaagggagtttgaggagaatggcctggaaaaggatctggacgaggagggatctgaaaaggaactgcacgaaaatgtgctggacaaagaacttgaggagaacgactccgagaactccgagttcgaagacgacggcagcgagaaagtgctagacgaggaaggatcggaacgagagtttgacgaagattcagatgaaaaagaagaagaggaggacacatacgagaaagtctttgatgacgagtctgatgagaaggaggatgaagagtacgcggatgaaaagggcctggaggccgctgacaagaaagcagaagagggagacgctgatgaaaaactgtttgaggaatctgacgataaggaggacgaggatgcggatgggaaggaggtggaggatgcagatgaaaagctttttgaggacgatgactctaatgagaagctctttgacgaagaggaagactctagcgaaaaattgttcgacgattcagatgagcgtggcactttggggggcttcggaagcgttgaagaggggcctctgtcaacagggtcctcctttatcttatccagcgatgatgacgacgacgacatctag

SEQ ID NO: 19482 - DNA, 3879 bp, Artificial Sequence
  Description of Artificial Sequence: Synthetic coding sequence
atggacgccagctacgacggcaccgaggtgaccgtggtgatggaggaaatagaagaagcatattgttacacgtcccccggcccgcctaaaaagaagaaaaagtacaaaatacacggggagaaaaccaaaaaacccagaagcgcttacctcctgtactactatgatatctatttgaaagtgcagcaagaactgccccacctccctcagtcagagatcaataaaaaaatttctgagtcctggcgcctgctgtccgtggcagagcggagctattatctggagaaggcgaaactagaaaaagaaggactggacccgaacagcaagcttagtgcgctcacggctgtggtgcccgatattcctggtttccggaagatcttgcctcgatccgattacattatcatccctaaatccagcctgcaggaggacaggtcgtgcccccagctggagctgtgtgtggcccagaatcagatgtcaccaaagggacctccgttggtgagcaacacagctcctgagactgttccatcgcacgccgggatggccgaacagtgcctcgcggtggaggccctcgccgaggaggtgggagccctgactcagagcggagctgtccaggaaatcgcgaccagtgaaattctgagtcaggacgtgctcctagaagatgcttctctggaagtgggtgaatcacaccagccctatcaaactagtctagtaatcgaagagaccctggtaaacgggagtccggacctccccacaggaagcctagctgtcccacatccgcaagtgggggaatcagtttccgttgtgactgtgatgagggattctagtgagagttcatcctcagcacccgctacccagtttatcatgcttcccctgcctgcatatagcgtcgttgaaaatccaacatctatcaagctgacgactacgtatacaagacgggggcatggaacctgcactagtcccggttgtagcttcacgtacgttacgcggcacaaacctccaaaatgcccgacatgcgggaactttctgggagggaagtggatcccgaaagagaagcctgcaaaagttaaagtggaactggcctcgggcgtttcttcgaaggggagtgtggtcaaacgaaatcagcagcctgtcaccacggagcagaactcaagcaaggagaatgcttccaagcttacgcttgagaattcagaggcagtctcccaactccttaatgtcgccccgccgagagaggtgggcgaagaatcagaatgggaggaggtcataatctctgatgcccacgtactagtgaaggaagcccccggcaactgtgggactgccgtcacaaagacccctgtagttaaatcgggggtacagccagaagtgaccttgggaactacagacaacgattcacctggtgccgatgtgcctacaccatctgaaggcaccagcacttcttcacctctaccagcccctaagaagcccactggagccgatctcctgacccctggatcgagagctccagaactgaagggccgtgcccgtggtaagccatcactgctcgccgccgcccgccctatgagagccattctcccagcacctgttaacgtaggcagaggtagtagcatgggcttacctcgggccagacaagcatttagcctgtccgacaaaacaccttccgtgagaacatgtggtcttaaaccatccactttaaaacaactcgggcagccaatccagcaaccgtccggtccgggagaggttaagctaccatccggacctagtaatagaacttctcaggtgaaagtggtggaggtgaaaccggatatgttcccaccatacaagtatagctgcaccgtaaccttggacttgggactggctacctctcgtggaagaggaaaatgcaagaatccctcctgctcctacgtttacacgaacaggcacaaaccccgtatatgtccaagctgcggagtgaacctcgcaaaagatcgcacagaaaagactaccaaggccattgaggtgtcatcacctctgcccgatgtgttgaacgccactgagcccctgtccaccgcacagcgtgagatccagcggcagtccaccctgcagcttctcaggaaggtcctgcagatcccggaaaacgagagcgaactggcagaggtgttcgctttgattcacgagttgaactcctcccggctgatcctgtccaatgtgtccgaggaaacggtcacaattgaacagacctcctggtctaactattacgagagcccatccactcagtgcctgctttgcagttcgccccttttcaagggcgggcagaatagcctggctgggccacaggagtgctggctgcttaccgctagccgattgcaaaccgttaccgcgcaggttaaaatgtgcctgaatccacattgtctggcactgcactcattcattgacatatacactggacttttcaatgtcggtaacaagctacttgtgtcattagacctactgtttgcgattcggaaccaaatcaagctgggagaagacccgcgtgtaagtatcaatgtcgtgcttaaatctgtccaggagcagaccgaaaagacactgactagcgaggaattgagtcaactgcaggaactgctttgcaatggctattgggctttcgagtgtttgacagtgagggattacaatgatatgatctgcggaatttgtggggtggcccctaaggtcgagatggcccaacgatccgaagaaaatgtgctcgcacttaagtcagtggaattcacttggcccgagtttctgggctccaacgaggttaatgtggaagacttttgggctaccatggagactgaagttattgagcaggtggcattcccagcttcaatccccatcaccaagtttgatgcttccgttattgctccattctttccgcctcttatgaggggcgccgtggtggttaacaccgagaaagacaagaacctggatgtccagcccgtgccagggagcgggtcggctctggtcagactcctgcaggaggggacttgcaagctcgacgagatcggctcgtacagcgaagaaaagctgcagcatctgctacgccaatgcggaatccctttcggcgccgaagatagcaaggatcagttatgtttctcactgctggccttgtacgagtctgtgcagaacggagcccgggccatccggccaccgcggcattttacgggtgggaagatttataaagtctgcccacaccaggtggtctgtggatcaaagtacctcgtgagaggagaatccgcaagagatcatgtggatctgctggcttcgagccggcattggcctcccgtgtatgttgtcgatatggctacctctgtggctttgtgcgccgacctctgttacccagagctgacaaatcagatgtggggccggaatcagggctgtttctcatccccgaccgagcccccagtgtccgtttcctgtccagagctgctcgaccaacactacaccgtggacatgaccgagaccgagcatagtattcaacaccctgtaacaaagaccgccactcgccgcatagtgcatgccggcctgcaacctaacccaggcgacccttccgcagggcaccattcacttgcgctctgcccagagcttgccccatatgccaccatcttggcatccatcgttgattcaaagcccaacggggtgaggcagcgacccattgcttttgataacgctactcactattatttgtataaccggctgatggattttttaaccagccgcgaaatagtcaatcggcagatacatgatatcgttcagagctgtcaaccgggagaggtagttattcgggacacactgtatcggctgggtgtagcccaaattaagaccgagaccgaagaggagggggaggaagaagaggtcgccgccgtggcagaatag

SEQ ID NO: 19483 - DNA, 2310 bp, Artificial Sequence
  Description of Artificial Sequence: Synthetic coding sequence
atgtgcggcagcgccctggccttcttcaccgccgccttcgtgtgccttcagaatgatcgaaggggtcctgcttctttcctgtgggcggcctgggtgttttctctggtcttgggactgggtcagggcgaggacaatcgctgcgccagcagtaatgccgcgagctgcgcaaggtgtcttgctctcgggccggaatgtggttggtgtgtacaggaagatttcataagcggcgggagcagatctgagcgatgcgacatcgtctctaacctgatatctaaggggtgctccgtggatagcatcgaatacccatccgtgcacgtaattattcccacagaaaacgagataaatacccaggtaactccaggtgaggtctctattcagttacgccccggcgccgaagctaatttcatgctgaaagtgcatccattaaagaagtacccagtggacttgtactatttggtcgacgtcagcgcaagtatgcataacaatattgagaagctaaattccgtggggaacgacctgagccgaaagatggcctttttctctcgggactttcggctaggctttggatcttatgttgacaaaaccgtgtccccttacatcagcatccatccggagaggatccacaatcagtgcagtgactacaacctcgactgcatgcctccccacggttacatccatgtcctttccctgacagaaaacatcacagagttcgagaaagccgtccaccggcagaaaatttctggcaatattgacaccccagagggagggttcgatgccatgctgcaagctgcagtttgtgagagccatattggctggcgaaaagaggcaaaaagattgctgcttgtcatgacagaccagacgagccaccttgcgttggactcaaaacttgcaggtatagtcgtgccaaatgacggaaactgccacctgaagaacaatgtatacgtgaaatcaacaaccatggagcatccatccctggggcagttatcagaaaagctgatcgacaataacattaacgttatttttgcagtacaggggaaacagttccactggtacaaggatctcctgcccctcttacccgggacgattgcgggtgaaatcgagtccaaggctgcaaacctcaacaaccttgtagtcgaggcctatcagaaactcatttccgaggtgaaagttcaagtcgaaaatcaggtccaggggatttattttaatattacggccatttgtcctgatggatcacggaaaccaggtatggagggctgccggaacgtgacctccaatgacgaagttctttttaatgtcacggtcacaatgaaaaagtgtgacgttaccgggggaaaaaattacgctatcattaaaccaattggctttaatgagaccgctaagatccacattcacagaaactgctcttgtcagtgcgaagacaaccggggcccaaaagggaagtgtgtcgatgaaacatttctcgatagcaagtgcttccagtgtgatgagaacaaatgccactttgatgaagaccagttttcttcagagtcttgcaaatctcacaaggaccagcctgtttgcagcgggcgtggggtttgtgtgtgcggaaaatgtagctgccacaaaatcaagttagggaaggtgtacggcaaatactgtgaaaaagatgatttctcttgtccataccatcacgggaatttatgtgcagggcacggagagtgtgaggctggtcggtgccagtgtttcagcggctgggaaggcgaccggtgtcaatgtccaagcgctgctgcccaacactgtgtcaatagcaaaggccaggtatgttccgggagggggacttgtgtttgcggacgttgcgagtgcacagatccacgtagcattgggaggttttgcgaacattgcccgacctgttacactgcatgtaaagaaaactggaattgcatgcagtgtctccatccgcacaacctcagccaggccattctagaccagtgcaagaccagttgcgccctcatggagcaacagcactatgtggatcagacgtccgagtgtttctctagtcctagttacctcaggatcttttttattatctttattgtaactttcctgattggcctgcttaaagtgctgataatcagacaggtgatcctgcaatggaacagtaacaaaattaagtcttcctccgactaccgggttagcgcctccaagaaggacaaactgatcctccaaagcgtgtgcaccagggccgtgacgtatcggagggaaaaacccgaagagattaagatggacatcagtaagctgaatgcgcacgaaacatttagatgtaatttctag

SEQ ID NO: 19484 - DNA, 375 bp, Artificial Sequence
  Description of Artificial Sequence: Synthetic coding sequence
atggtgtgggaggtgaagaccaaccagatgcccaacgccgtgcagaagttgctgttggtcatggacaagcgagcatcaggaatgaacgattctctagagcttctgcagtgtaacgaaaatcttccatccagccctggttacaatagctgcgatgagcatatggagctagacgatctcccagagctgcaagccgtgcaatccgatccaacacagtcaggcatgtatcagctatctagcgatgtgagtcatcaggaataccccagatcgtcttggaaccaaaatacctcagacattcctgagacaacctaccgggagaatgaggttgactggcttacggagctcgccaatattgcaacctcgccacagagcccctag

SEQ ID NO: 19485 - DNA, 87 bp, Artificial Sequence
  Description of Artificial Sequence: Synthetic coding sequence
atggtgtgggaggtgaagaccaaccagatgcccaacgccgtgcagaaattgctcctcgtgatggacaagcgggctagcggcatgtag

SEQ ID NO: 19486 - DNA, 1545 bp, Artificial Sequence
  Description of Artificial Sequence: Synthetic coding sequence
atggtgtgggaggtgaagaccaaccagatgcccaacgccgtgcagaaactgctgctggtcatggataagcgcgcatctggaatgaatgacagtctggaactactacaatgcaatgaaaaccttccaagttcacccggctataactcttgtgacgaacatatggaactggacgatctgccggagctccaggccgtccagtccgaccctacccagagcgggatgtatcaacttagctcggatgtctctcaccaggagtacccccgctccagttggaatcagaacacgtcagatattccagaaactacctaccgcgagaacgaggtggattggctgactgagttggcaaacattgccaccagcccacaatctccactcatgcaatgttccttctacaatagaagttctcccgttcatatcatcgccacatcaaagtctctccactcgtatgcgcgaccaccccccgttagctcatcatcaaagagtgagcctgcctttccacatcaccactggaaagaagaaacccctgtgcggcatgaaagggctaacagcgaaagtgaaagtgggattttctgtatgtcgtccctgtcagacgatgacgacctcgggtggtgcaactcttggccctccacagtatggcactgtttcttgaaaggaacgcgcttatgcttccataaggggtccaacaaagagtggcaggacgtcgaggattttgctagggcagaagggtgtgacaatgaggaggatctgcagatgggcattcacaaagggtacggaagtgacggtcttaagttgctctcccacgaagaatcggtgagctttggcgagtctgttcttaagcttacttttgaccctgggaccgtggaggacggcctcctcactgtggagtgcaaactagaccatcccttttacgttaagaacaaaggctggagcagcttttaccctagcttgaccgtagtgcaacatggaatcccctgttgtgaggttcacattggagatgtttgccttccgccagggcatcctgacgccatcaatttcgacgacagtggcgtctttgatacgtttaagtcttatgactttacacccatggattctagcgccgtctatgtccttagttctatggctagacaacgcagagcatcactctcctgcggcggccctggaggccaggattttgccaggtcgggttttagtaagaactgtggctcgcccggatcttcacagctgagcagcaactccctgtatgcgaaagcggtgaaaaatcactcttcaggcacagtaagtgcaacatctcctaacaagtgcaaaagacccatgaacgccttcatgctttttgccaagaaataccgcgtggaatatacccaaatgtatcccggaaaggacaaccgagctatctccgtgattctaggggacagatggaagaagatgaaaaatgaggaacggcgcatgtatacactggaggctaaagcactggccgaggagcagaagagactgaatccagattgttggaaacgcaagcgtactaatagcggcagccagcagcactag

SEQ ID NO: 19487 - DNA, 213 bp, Artificial Sequence
  Description of Artificial Sequence: Synthetic coding sequence
atggtgtgggaggtgaagaccaaccagatgcccaacgccgtgcagaaactgctcttagtgatggacaaaagggcatcggggatgaatgatagcctggagctgctccaatgtaacgaaaacttgccaagcagccccggttataactcctgtgatgagcacatggagctggacgacctccccgagctgcaagccgttcagagtgatcccacatag

SEQ ID NO: 19488 - DNA, 336 bp, Artificial Sequence
  Description of Artificial Sequence: Synthetic coding sequence
atggtgtgggaggtgaagaccaaccagatgcccaacgccgtgcagaaacttcttctcgtgatggataaacgagcctctggcatgaatgactctctagagcttttgcaatgcaatgagaatctgccttctagcccagggtataatagctgcgacgagcacatggaactggatgatctgcctgagctgcaggccgtgcagtcggaccctacacaatctggcatgtatcaattatcctcggacgtgtcgcaccaagaatatcctcggtccagctggaaccagaacacaagcgacatacccgagacaacctacagagaaaacgaagttgactggttatag

SEQ ID NO: 19489 - DNA, 1545 bp, Artificial Sequence
  Description of Artificial Sequence: Synthetic coding sequence
atggtgtgggaggtgaagaccaaccagatgcccaacgccgtgcagaagctgttgctggtaatggacaaaagagccagcgggatgaacgattccctcgaactccttcagtgcaacgaaaacctgccatcctctcccggctacaattcctgcgatgaacacatggagctggatgacttgccagaacttcaggccgtgcagagcgaccctactcaatctggaatgtaccagctgtcttctgatgtgtcccaccaggaatacccccggagttcctggaaccagaatacttctgacattcctgagaccacctaccgagagaatgaagtagactggctgaccgagttggccaatattgccacttccccacagtccccgctgatgcagtgtagtttctataaccgcagttcgcctgttcacatcatagcaacttcaaaatctctgcactcgtacgccagacccccacctgtttcatcctcatctaagagtgaacccgccttcccccatcaccactggaaagaggagacccctgtgcggcatgagagagccaactcagagtccgagagcggaattttctgcatgagcagtctgtccgacgacgatgacctgggatggtgcaattcttggccatctacagtctggcattgtttcctaaaaggaacccgcctctgtttccataaggggagcaacaaagaatggcaggatgttgaggatttcgccagagccgaaggctgtgataatgaggaggatctgcagatggggatacataaaggctacgggtccgatgggcttaagctgttgtcccatgaagagagcgtgtcgtttggcgaaagcgttcttaagttaacttttgaccctgggacggttgaagatggtctactcacagtagagtgcaaattggaccacccgttctacgtgaagaacaaaggttggagctcattctacccctctctgacagtggtccaacacgggatcccctgttgtgaggtgcacatcggcgacgtgtgtctccctccaggacatcccgatgccatcaatttcgatgatagcggagttttcgacacatttaaatcctatgattttaccccaatggactcatcggctgtctacgtgttgagttcaatggccaggcaaaggagggcttccttgagctgcggaggcccaggtggacaggatttcgcccgctctgggttctccaagaattgtggcagccccggctcatcccagctgtctagcaactctttgtatgctaaggccgtcaaaaatcattcttccggcaccgtctctgctaccagtcctaacaagtgtaaacggcccatgaacgcctttatgttgttcgccaaaaagtatcgggtcgaatacacacagatgtatcctggtaaagacaaccgcgccatatccgtgatacttggggaccgctggaaaaaaatgaagaatgaggaacggagaatgtatactttagaagccaaggcactggctgaggagcaaaaaaggttgaaccccgactgctggaagcgaaagcgcacaaatagcggctcacaacagcactag

SEQ ID NO: 19490 - DNA, 327 bp, Artificial Sequence
  Description of Artificial Sequence: Synthetic coding sequence
atggtgtgggaggtgaagaccaaccagatgcccaacgccgtgcagaagttactgttagtgatggataagcgggcatccgggatgaacgattctttagaactgcttcagtgcaacgagaacctcccttcttcccctggatacaatagctgtgatgaacacatggaactggatgaccttccggaattgcaggccgtgcaatctgacccaacccagtctggtatgtaccagctgagctctgatgtgagtcaccaagagtacccaagatcaagctggaatcagaacaccagcgacattccagaaaccacctatcgcgagaacgaagtgtag

SEQ ID NO: 19491 - DNA, 1365 bp, Artificial Sequence
  Description of Artificial Sequence: Synthetic coding sequence
cagatgcccaacgccgtgcagaagctgctgctggtgatggacaagagagcttctgggatgaatgatagcctggagctgctgcagtgtaacgaaaacttgccaagcagcccgggctacaattcatgtgatgagcatatggaactggacgacctgccagagctccaggcggtccagagcgacccaacccagtctggaatgtatcagctgtccagtgacgtgtcccatcaggagtatccacgttcgagctggaatcagaatacttctgacatcccggagacgacatatcgggaaaatgaagtcgactggctgaccgagttggccaatatcgcaacctccccccagagcccactaatgcagtgctccttctataaccgtagctcccccgtacacataatcgcaacctccaagtcactgcacagctatgctaggccccccccagtgtcatcctcctcaaaatcagagcccgctttcccacaccaccactggaaggaggaaacacccgtcagacatgaacgggcaaattccgagtccgaaagcggcattttctgcatgtcatctctgagtgacgacgatgacctggggtggtgcaacagctggccctccactgtgtggcactgtttcctgaagggtactcggctgtgttttcataaggggagtaacaaggagtggcaggatgtggaggatttcgctcgagcagagggctgcgataacgaggaagacctgcagatgggtattcataaaggctacggctctgatggtctcaaattactgagtcatgaagagagcgtctcatttggcgaatctgtcctcaaactgacattcgatcctggaactgtggaggatggcctgctaacggtggaatgtaaattagaccaccccttttatgtgaagaataagggatggtcctctttttacccttcattgaccgtggtgcagcacggcattccatgctgcgaggtccacatcggggacgtgtgtctcccacctggacaccctgatgctattaacttcgacgactccggagtgttcgacacctttaaaagttacgactttaccccaatggacagttctgctgtctatgttctatcaagcatggccagacagagaagggcatcccttagttgtggcggcccaggcggccaggatttcgctaggagtggatttagcaaaaattgtggctcccctggcagctctcaactgagctcaaacagtctgtacgcgaaagcagtgaaaaatcactcttcagggacagtgagtgctacgtctccaaataagtgtaagaggcctatgaatgcatttatgcttttcgccaaaaaataccgggtggagtatacccagatgtaccctggaaaagataatagatag

SEQ ID NO: 19492 - DNA, 1332 bp, Artificial Sequence
  Description of Artificial Sequence: Synthetic coding sequence
atgcagaaggccacctactacgacagcagcgccatctacggcggctacccataccaagccgcgaacggcttcgcctacaacgccaaccagcagccctacccagccagtgctgccctgggcgcagatggagagtatcacaggcctgcatgttcactgcagtcacccagtagcgccggcggccacccaaaagcgcacgaattatcggaggcctgtttgaggactctctctgcgcctccctcccaaccaccttccttgggagagcctcccctgcatcctcctccgcctcaggcagcccctcccgcaccccagcctccacagccagctccacagccacctgcgccgacccccgctgctcctccaccaccctctagcgcttctcccccacagaacgcctctaataatcccacacctgccaacgctgcaaagagccctctgttgaattccccaaccgtggcgaaacaaatcttcccctggatgaaggagtctcgacagaatacaaagcagaaaactagctcttcttcctccggagagtcctgtgccggggacaagagcccccctggccaggcttccagtaaaagggcgcgcactgcctatacctctgcccagttggtcgagcttgagaaggagttccacttcaataggtacttgtgtaggccgcggcgagtagagatggcgaacctcttgaatctcactgaaaggcagatcaaaatctggtttcaaaacagaaggatgaaatacaaaaaggaccaaaagggcaaggggatgctgacaagttccggtggtcagtcaccaagtcgctctcccgtccctcccggtgcaggaggttacctgaactcaatgcactctctcgtgaattctgtcccttacgagccccagtcacccccacctttctccaagcctcctcaagggacatatggcctgccacctgccagttaccccgcatccctgcctagttgcgctccacctccaccaccacaaaaacggtacacagccgccggcgctggggccggcggtacaccagactacgaccctcatgcacacgggctccagggaaacggatcgtacgggacgcctcatatccagggtagtccagttttcgtgggagggagctatgtggagccaatgtctaacagcggacccgccctctttggcctcacccacctgcctcatgcggcaagcggggccatggactatgggggtgccggtccgctgggtagcgggcatcaccatgggcccgggcctggggagcctcaccctacctatacggacttaacaggccatcatccgagccaggggcgcattcaggaagctccgaaactcacccacttgtag

SEQ ID NO: 19493 - DNA, 858 bp, Artificial Sequence
  Description of Artificial Sequence: Synthetic coding sequence
atgaaggagagccggcagaacaccaagcagaagaccagcagcagcagttccggggagagctgcgccggggacaagtccccccccgggcaggcttcatccaagcgggcccggacggcatacacgagcgcacagctcgtcgagctcgaaaaagagttccactttaacagatacctgtgccgccctagacgagtggagatggcaaacctgctgaacttgacagagaggcagattaagatctggtttcagaatagacgaatgaaatacaaaaaggaccaaaagggcaaaggtatgctaacctcatccggcggccaaagtccttcccgcagtcccgtccccccaggggcgggtggatacctcaacagtatgcattctctggtcaattctgttccatacgaacctcagtcgccccctcccttttctaagccaccccaggggacttacggcctgccacccgcctcctaccctgcttcacttccgagctgtgcccccccacctcctccccagaagcggtatacagctgcgggagcaggggcaggtggtactcccgactacgatccccacgcccatggattgcaaggaaatgggtcctatggtacacctcacatccaagggtctcccgtcttcgtgggcggcagctacgtggagcccatgagcaattccggccccgccttgttcgggctcacccacctgccgcatgccgcctcaggagcaatggactacggtggagcagggcctctagggtcaggccaccaccacggacctggcccgggggagcctcaccccacctacaccgatttgactgggcaccacccctctcaggggcggattcaggaggcacccaagctgactcacctttag

SEQ ID NO: 19494 - DNA, 1332 bp, Artificial Sequence
  Description of Artificial Sequence: Synthetic coding sequence
atgcagaaggccacctactacgacagcagcgccatctacggcggctacccttatcaagccgccaatggatttgcctataacgcaaatcagcagccttatcccgcatcggcagctttgggagccgacggtgagtatcaccgcccagcatgttctctgcagagtccgagcagcgctggcggacatcctaaggctcacgaactttcagaggcctgtctccggactctgtctgcccccccgtcacagcctccatctttgggtgagccaccattgcacccgccccctccgcaggctgccccccctgccccccagcctccgcaacccgcaccccagccccctgctccaaccccagccgctcccccccccccgagttcagctagcccacctcagaatgcatcaaataacccgacccctgccaacgctgcaaagtcaccattgctgaattcccccactgtggctaaacaaatattcccatggatgaaagaatcccgacagaacacaaaacagaaaaccagttccagcagcagtggggaatcatgcgccggcgacaagtctcctcctgggcaagccagctctaagagagcgcggacagcatacacgtcagcacagctagttgaactggaaaaggagttccatttcaatcgatatttgtgtcgccctcgccgtgtggagatggctaatctattaaacctgacggagaggcagattaaaatatggtttcaaaataggcgtatgaagtacaaaaaggatcagaagggcaagggcatgctcacatcctccggtggtcagtctccctcacgcagtcctgtcccgccaggagccggagggtacttaaattcaatgcattctctggtcaatagcgtgccatatgaaccgcagagcccccctcccttcagcaagccaccacaaggcacttacggtctgccccccgcaagttatccagcatcacttcccagttgcgccccacccccccccccacagaagcggtacaccgctgcgggcgctggggccggcgggacccccgactacgacccccacgcacatgggctgcagggcaatgggtcctatggcacaccccacatccagggcagccccgtcttcgtggggggatcatacgtggagcccatgtcgaattcaggcccggcactgttcggactcacacatctaccgcatgccgctagtggagcaatggactatggcggtgctgggcccctggggagtggacaccaccacggccccggacctggcgagcctcaccccacatacacggacctcacaggccaccaccctagtcaaggacgcatccaggaggcccctaaactgactcacctgtag

SEQ ID NO: 19495 - DNA, 39 bp, Artificial Sequence; identical to SEQ ID NO: 8389
  Description of Artificial Sequence: Synthetic coding sequence

SEQ ID NO: 19496 - DNA, 165 bp, Artificial Sequence
  Description of Artificial Sequence: Synthetic coding sequence
atgcagaaggccacctactacgacagcagcgccatctacggcggctatccctaccaggccgccaatggatttgcatacaacgccaaccaacagccctacccggcctctgccgccttgggcgccgatggggagtaccatcgtcctgcctgtagcctgcaaagttag

SEQ ID NO: 19497 - DNA, 255 bp, Artificial Sequence
  Description of Artificial Sequence: Synthetic coding sequence
atgcagaaggccacctactacgacagcagcgccatctacggcggctacccgtaccaggccgccaatggattcgcctacaacgccaatcagcaaccttaccctgccagtgccgcactgggggccgacggtgagtatcaccggccagcatgtagtttacagtcaccgagttccgcaggcggccacccaaaagcccatgagctgtcagaagcttgcttacggaccctgtctgctccgcctagccagcccccttcatag

SEQ ID NO: 19498 - DNA, 1653 bp, Artificial Sequence
  Description of Artificial Sequence: Synthetic coding sequence
atggtgcggggctgggagcccccccccggcctggactgcgccatcagtgaggggcataagagtgaaggcaccatgccacccaacaaagaggcttctggcttgtcttcaagcccagcgggacttatctgtctccctcctattagtgaggaattgcagctcgtttggacccaggccgcccagacctctgagctggactctaatgaacatctgttgaagactttctcatactttccttatccaagtttggcagacatcgcactcttatgtctgagatacggcttacaaatggaaaaagtgaaaacctggttcatggcccagaggcttcgctgtggaatatcatggagctctgaggagattgaagaaactcgtgcccgcgtagtttacagaagagaccaactgcacttcaaaagtttgctctccttcacccaccatgcgggccggccaccagaagaagtgcctcctccacctgtgcccgcaccagaacaagtcgggatcggcattggtcctcctaccctgtccaagcccacacaaaccaagggtcttaaggtagaacccgaagaaccttcgcaaatgccccctctcccacagagccaccagaagctgaaagagagtctcatgaccccgggctctggcgcattcccctatcaatcagatttttggcagcacctgcaaagctccggtctctctaaagagcaagctggaaggggtcccaatcagtcccacggaatcggcacagcgagttggaaccactccacaacagttccccagccacaggctagagacaaacctcctcccatcgcactgatcgcctcgagctgtaaagaggagtcggcctcctctgtgactccatccagctcctcgactagctcttcatttcaggtactggctaatggtgcaactgccgccagtaaaccattgcagccattgggctgtgtaccgcagtcggtctctccgagtgagcaggcgctgccgccccaccttgagcccgcgtggcctcaaggactgcgccataactcggttcctggacgggttggccccacagaatatctctcacctgacatgcaaaggcagcgcaaaacaaagagaaagactaaagagcagctcgccatcctgaaatccttctttctacaatgccagtgggcccgcagggaggattatcagaaactcgaacaaataactggtctcccaagacctgaaattatccaatggttcggtgacaccagatacgcgttgaaacatggccagctaaaatggtttcgtgataacgctgtccccggggctcccagttttcaggacccagcaatccctacccctccaccgtcaacccggagcctcaacgaacgcgccgagacgcctcccctccccatccctccacctccgcccgacatacaacctctggagcggtactgggcggcgcaccaacaacttagggagaccgacattcctcagctgagtcaagcctcccgcctatctacgcagcaagtgctggactggtttgactccagactcccccagcctgccgaagtagtagtgtgcttagacgaagaggaagaggaggaagaggaggaactgcccgaggatgatgaggaggaggaggaggaggaagaagaagatgacgacgacgatgatgacgatgtgattatccaggactag

SEQ ID NO: 19499 - DNA, 1032 bp, Artificial Sequence
  Description of Artificial Sequence: Synthetic coding sequence
atgagccgggccggcagctgggacatggacggcctgcgggccgacggcggtggcgccggtggcgccccagccagttctagcagcagttctgtggccgcagcggcagcctctggccagtgtagaggttttctgtctgcgcctgtcttcgcaggaactcactctggcagggccgctgcagcagctgcggcggctgccgccgccgcagccgccgcatccgggttcgcttatcccgggacctctgagaggaccggatcgtcatccagctcctctagctcagccgtagtggccgccagaccggaagcaccaccagctaaagaatgccctgcccctactcctgccgccgcagctgccgcaccaccaagcgcgccagctctgggatacggctatcacttcggcaatggctattattcttgcagaatgtcccacggcgttggactacagcaaaacgccttgaaatctagtccacacgctagcctgggcggcttccctgtggaaaaatatatggacgtgagtgggttagcaagctcctccgtgcccgctaatgaagttcctgctagggccaaggaagtctccttttaccagggatatacatcgccatatcagcatgtcccaggctacattgatatggtgtccacattcggatccggcgaaccccggcatgaagcttacatctcaatggagggttaccagtcttggacacttgccaatggctggaattcccaggtttattgcactaaagatcaaccccagggatctcacttctggaagagctctttccccggggatgtggcgcttaatcagcccgacatgtgcgtctataggcgggggcgcaaaaagcgggtgccatatacaaagttacaactcaaagagctggagaatgaatatgcgatcaataagttcattaacaaagacaagcgacgacggatttccgctgctaccaatctgtccgagaggcaggtcaccatctggtttcaaaatcggcgcgtcaaggacaaaaaaatcgtcagtaagctgaaggataccgtgtcctag

SEQ ID NO: 19500 - DNA, 924 bp, Artificial Sequence
  Description of Artificial Sequence: Synthetic coding sequence
atggccaccgcccagctgagccactgcatcaccatccacaaggcctctaaggagaccgtatttccaagccaaatcactaacgagcatgagagtctaaagatggtgaagaaacttttcgcaaccagtataagttgcataacgtatctccggggtttatttcctgagtcctcatacggagaaaggcatctggatgatctgagcctcaagatcctccgtgaagacaaaaagtgcccgggctcgttgcacattattcgatggatacaggggtgcttcgacgctctggagaagcggtacttgcgcatggccgtgcttacactctacaccgatccgatgggttccgaaaaagtcacagagatgtaccaatttaaatttaaatacaccaaggagggtgccacaatggactttgactcacacagctcttcaacttcctttgaaagtggtacaaataacgaggatatcaagaaggctagcgtcttactgattcgaaagctgtacattctgatgcaagatctggagccactgccaaataatgtggtactcactatgaaactccactattataacgccgtcaccccccacgactatcagccactgggattcaaagaaggagtaaatagccactttcttttgttcgataaggaacctattaacgtccaggtgggattcgtgagcactggatttcacagcatgaaagtcaaagttatgactgaggcaacaaaagttatagatctggaaaacaatctgttccgtgagaacagtaccacggaaatcgcgcatcagggactggattgtgacgaggaagaggagtgtaacgaccacatccaacggatgaactttgtttgctctcaacagagctcggagtgtagccgtaagaaaaggaaggtgtctgaacctgtgaaagtgttcatccccaaccgtaagtag

SEQ ID NO: 19501 - DNA, 924 bp, Artificial Sequence
  Description of Artificial Sequence: Synthetic coding sequence
atggccaccgcccagctgagccactgcatcaccatccacaaggcctctaaggagacagtcttccctagtcaaatcacaaacgaacatgaaagcctgaaaatggtgaaaaaactttttgccacaagcatatcctgcatcacttatctcaggggactgttcccagaatcatcatacggggagcggcacctcgacgatctgtcacttaagatcttgcgggaagacaaaaaatgcccagggagcttacatataatcaggtggatccaaggctgttttgacgccctagaaaagaggtatctgagaatggccgtgttgaccctctacacagatcccatgggctccgagaaagtgaccgaaatgtatcagtttaagtttaaatacaccaaagaaggagcaacaatggatttcgactcccatagcagttctactagttttgagtcagggacgaacaatgaggatattaaaaaagccagcgtccttctcattcgaaaactttatatcttgatgcaggacttggaacccctccccaataacgtggtgctgactatgaagctccactattataatgctgtaactccacatgattatcagccactgggcttcaaggaaggggtgaactctcactttctgctgtttgataaagagcccatcaacgtccaggtgggattcgtaagtaccggcttccactcgatgaaggtgaaggttatgactgaggcaacaaaggttatcgacctggagaataacctctttagagagaacagtaccaccgagattgcccaccagggcctggactgtgatgaggaagaggagtgtaacgaccacatccagagaatgaacttcgtctgcagtcaacaaagttctgagtgtagtcggaagaagaggaaagtctcagagcctgtgaaagtgttcatccctaacagaaaatag

SEQ ID NO: 19502 - DNA, 1074 bp, Artificial Sequence
  Description of Artificial Sequence: Synthetic coding sequence
atgcaggcccgggccctgctgctggccgccctggccgccctggccctggccagagagcccccagctgccccctgccccgccagatgcgatgtgtcccgatgcccctcccctagatgccccggcggctacgtgcctgacttgtgcaattgctgcctggtctgtgccgctagcgaaggggaaccatgcggcggtccgctcgactccccctgcggggaaagccttgaatgtgttagaggcctgtgtcggtgtcgatggtctcacgctgtgtgcggaaccgacggacatacgtacgctaatgtttgtgctttgcaggcggccagccggagagccctgcagctgagtggcactcccgttagacagctccagaagggggcatgtcctctgggcctgcatcagctgagcagcccgcggtataaatttaactttatcgccgatgtcgtcgaaaaaatcgccccagcggttgtgcatatcgagctatttctgcgacacccactgttcggaaggaatgtgcccctgagctccggcagcggcttcattatgagtgaggctggactgattatcactaacgctcatgttgtcagctcaaacagcgctgcacccggtcggcagcagttgaaagtacagttacagaacggagacagctatgaggctacaataaaggatatcgacaagaaatctgatatcgcaactatcaagatccaccctaaaaaaaaattgccggtgctgttacttggacatagtgccgatctgcggccaggggaatttgtggtcgccattggctccccgtttgctttgcagaacactgttacaacagggattgtgagcactgctcagcgcgaaggaagagagctgggcttaagggactcggacatggactacatccagaccgacgctattatcaattacggtaactccggcggaccactggttaacctggacggtgaggtgataggcattaataccttgaaagtcactgctgggattagtttcgcaatccccagcgaccgcataacaagattcctgaccgagtttcaggataaacagatcaaggcacccagccttgcagtccactag

SEQ ID NO: 19503 - DNA, 1599 bp, Artificial Sequence
  Description of Artificial Sequence: Synthetic coding sequence
atgcactgcaccctgaccatggagaccgaggccatcgacggctacatcacctgcgacaacgagctcagccctgagcgcgagcacagcaatatggcaatagatttgaccagcagtacacctaatggacagcacgcaagtccaagtcatatgacttctacaaattccgtgaagttggaaatgcagagcgatgaagagtgcgatcggaaaccactttcaagggaagatgaaattagaggacacgacgagggctcttctctggaggagccactgatcgaatccagcgaagtggccgacaaccggaaagtccaggagctccagggagaaggtgggataagactaccaaatggcaagttgaagtgcgatgtatgtggcatggtctgcattggcccgaatgtgctgatggttcataaacggtcgcatacaggcgagcgaccatttcactgtaaccagtgtggtgccagtttcacccagaaggggaatctgttgcggcatattaagctacactctggagagaaaccattcaaatgccctttctgctcttacgcttgcaggcgcagagacgcactgactggacaccttcgcacacactcagtgggaaagccccataagtgtaattattgtgggcgatcctacaaacagagaagttcactggaggagcataaagagcggtgccataactatctgcagaacgtctctatggaagcagccggccaggtgatgagccaccacgttccccccatggaagattgtaaggagcaggaacctattatggataacaacatatccctggtgccatttgagagaccagccgttatcgagaagctgacaggaaatatgggtaagcgcaagagctctacaccccagaagttcgttggcgaaaagctgatgcggttctcttatcctgatatacattttgacatgaatctcacatatgagaaggaggcagaacttatgcagagccacatgatggaccaggctataaacaatgcgatcacctatctaggggcggaggccctgcatcctctgatgcagcaccctccttctacgattgccgaggtagctcccgtaatatcctctgcttactcccaggtgtaccatcccaataggattgagaggcccatatctcgcgaaacagctgattcgcatgagaacaacatggacggccctatttctttgatcagaccaaaaagccggcctcaagaacgggaagcctcccccagtaattcctgcctggactctacagactctgaatcttctcatgatgatcaccagtcgtaccagggacatcccgcactgaatcccaaaaggaagcagtcgcccgcctatatgaaggaggacgtcaaggcgttagatactacaaaagcacctaaggggagcctgaaggacatctataaagtcttcaacggcgaaggcgagcagatcagggcatttaaatgtgagcactgtcgggtgctgttcctggaccacgtgatgtacacaatccacatgggctgtcacgggtacagggaccctttggagtgcaatatatgcggctatagatctcaggataggtacgaattctcctcccatatcgtgcgcggggaacatacttttcactag

SEQ ID NO: 19504 - DNA, 1503 bp, Artificial Sequence
  Description of Artificial Sequence: Synthetic coding sequence
atggagaccgaggccatcgacggctacatcacctgcgacaacgagttatcgccagaaagagagcactctaatatggcaattgacctcacctctagcacacctaatggacagcacgcttccccctcgcatatgacttcaactaatagcgttaaactggaaatgcagtccgacgaagagtgtgaccggaaaccattgtcacgcgaggacgaaatccgcggccacgacgagggctcatcactggaagaacccctgatcgagtcctccgaagtcgctgacaatcgcaaggtccaggagctgcaaggggagggtggtataagactcccaaacggagagagaccattccattgtaatcagtgtggagcttcctttacccagaaagggaacctgctgcgccatattaaactgcacagcggagaaaagccttttaaatgtccattctgtagttatgcttgtcggcgtcgtgacgcactaacaggtcatctgcgcacccactctgtcggcaagcctcataaatgcaactattgtggaagaagttacaaacagcgctcaagcttggaggagcataaagaacgctgccacaactatctccagaacgtgtccatggaggctgctggacaggtgatgagccatcatgttcccccgatggaagactgtaaagaacaagaaccaatcatggataacaacattagccttgtacccttcgagaggcccgcagtcattgagaaactcaccggaaacatgggcaaaaggaaatcttcaaccccacagaagtttgtgggagagaagctcatgagattttcatacccagacattcattttgatatgaatctgacgtacgaaaaggaggccgagttaatgcagagccatatgatggatcaggcaatcaataatgctataacatatctgggcgcagaagccctccatccattgatgcagcacccgccttccactatcgccgaggtggccccagttatctcctccgcgtatagccaggtttatcatcctaatcggatcgagcgacccatcagccgtgaaacagcagactcacacgagaacaatatggacggcccaatctctcttatccgacccaagagccggccccaggagagagaggcttccccttccaacagctgtcttgattctactgattctgagtccagtcacgacgatcaccagtcctatcaggggcacccggctctgaaccccaaaagaaaacagtcacctgcttatatgaaggaggacgtgaaagccttggataccaccaaggccccaaaaggtagcctgaaggatatttacaaggtgtttaatggtgaaggggagcaaatccgagccttcaagtgcgaacactgccgggtgctgtttctggatcacgttatgtacacaattcatatgggttgtcacggttacagagatccattagagtgcaatatctgcggatatcgttcccaggacaggtatgagttttcgagccatattgtccggggcgaacacacctttcattag

SEQ ID NO: 19505 - DNA, 1146 bp, Artificial Sequence
  Description of Artificial Sequence: Synthetic coding sequence
atggagaccgaggccatcgacggctacatcacctgcgacaacgagctctccccagaaagagagcattcgaacatggccattgatcttaccagcagcacccccaacggccagcacgcatccccaagtcatatgacctcaatggggaaaccacacaagtgcaattactgcggacggtcatacaagcagcgctcaagcctggaggagcataaggagcgctgtcataactatcttcagaatgtatccatggaggctgctggtcaagtgatgagccatcatgtaccccccatggaagactgtaaggagcaggaacccatcatggataacaacatatccctggtgcctttcgaacgtcctgcagtcattgagaagctgacaggaaacatgggcaaacggaaatcgtccacgcctcaaaagttcgtgggggaaaagctcatgaggttttcctatcctgatatccatttcgacatgaacctcacttacgagaaggaagccgagctcatgcaaagtcacatgatggaccaggcgatcaataacgccatcacctatctgggcgctgaggctcttcatcccctgatgcaacacccgccgagtaccatcgccgaagtcgcgcccgtgatcagtagcgcctactcccaagtctaccatcctaaccggatcgagagacctattagccgcgagaccgccgattcccacgaaaataacatggacggacccattagtttgataagaccaaaatcccggccacaggagagggaggcatcaccaagcaactcatgcctcgattccaccgacagtgagtcatcgcatgatgaccatcaatcctatcaggggcacccagctttaaatccaaagagaaagcaatcgccggcttacatgaaagaggatgtaaaggctctggacacgaccaaggccccaaaggggtccctgaaggacatttacaaagtttttaacggtgagggcgagcaaattcgcgcattcaagtgcgaacattgccgagtcctgttcctagaccacgtgatgtacacaatccacatggggtgtcacggttatcgtgaccctctggagtgtaacatctgtggctacagaagtcaagatagatatgaattttcctcccacatcgtacggggagaacacaccttccattag

SEQ ID NO: 19506 - DNA, 720 bp, Artificial Sequence
  Description of Artificial Sequence: Synthetic coding sequence
atggagaccgaggccatcgacggctacatcacctgcgacaacgagttgtctcctgagcgggagcactctaatatggcaatcgatctgactagctcaaccccgaatggccagcacgcaagccccagtcatatgacctccaccaattcagtcaagttggagatgcagagtgatgaggaatgcgaccggaaacctctttcaagggaggacgaaatcagaggacacgacgaggggtcctctttggaggaacccctcattgaaagttctgaggtggccgataacaggaaggttcaggaactccaaggcgaagggggtataagattaccaaacggaaaattaaagtgcgacgtgtgcggaatggtgtgtattggacccaatgtcctgatggtacataaacgctctcatacaggcgaaaggccttttcactgtaaccagtgcggtgcttcctttacccagaagggtaacctgcttcggcacatcaagctgcacagtggcgagaaaccctttaagtgtccattctgtagctacgcctgtagacgaagggacgccctcacgggtcatctgagaacacactctgtcggcaaacctcacaaatgtaactactgtggccgctcctataaacaacgctcatcgctagaggaacataaagaacgctgccacaactacctgcagaacgtctcaatggaggcggccggtcaggtgatgagccaccacgactcatag

SEQ ID NO: 19507 - DNA, 1359 bp, Artificial Sequence
  Description of Artificial Sequence: Synthetic coding sequence
atggagaccgaggccatcgacggctacatcacctgcgacaacgagctgagccccgaacgagaacattcaaacatggctattgacttgacctcaagcactcccaatggccaacatgccagccctagtcacatgacatctaccaacagcgttaagctcgaaatgcagtctgatgaagagtgcgataggaaacccttgtcccgagaggacgagataaggggccacgatgaggggagttcactggaggagcccctgatagaaagttctgaagtcgcggataaccggaaggtacaagaactgcagggcgaaggcggcatacgactgcctaacggcgagagaccattccattgtaaccagtgcggggcttctttcacccagaagggcaacctgctcagacatattaagttgcattccggcgaaaaaccttttaagtgccctttttgttcgtacgcctgcagacgtcgtgacgcactcacaggccacctgcgaacccatagcgtgggcaaaccgcataagtgcaactattgtggacgatcttacaagcaaaggtcctcccttgaggagcataaggaacggtgtcacaattatcttcagaatgtgtctatggaagccgccggtcaagttatgagccaccatggcgaaaaattgatgaggttttcctatccagacattcactttgatatgaaccttacctatgagaaagaggcagagttgatgcaatcccacatgatggaccaagccatcaataacgctattacctatctgggagctgaggcgctacaccctctgatgcagcaccccccttcaactattgcggaggtggccccagtgattagtagtgcctattctcaggtctatcatcccaaccgcattgagaggcctatctctcgcgaaactgccgattcgcacgagaacaatatggacggtccaatctccctaatcaggcctaagtctaggcctcaagaaagggaggcatctcctagcaactcctgcctggacagtaccgacagcgagtcctcacacgacgatcaccagagttatcagggccatcctgccctgaaccccaagcgcaagcagtcccccgcctatatgaaggaggatgtcaaggccctggacaccaccaaggcgccaaaggggtccctcaaagatatatacaaagtatttaacggcgagggagaacagattagagcctttaaatgcgagcactgccgagttcttttcctggatcacgtcatgtacacaatccatatgggctgtcatggataccgagaccctctagaatgcaacatctgtggctacaggtcccaggataggtatgaatttagttcacacatcgtcaggggggagcacacttttcattag

SEQ ID NO: 19508 - DNA, 720 bp, Artificial Sequence
  Description of Artificial Sequence: Synthetic coding sequence
atggagaccgaggccatcgacggctacatcacctgcgacaacgagttatccccggagcgcgaacacagcaacatggctattgatctgactagttcgacccccaacggacaacatgcaagtccaagtcatatgactagtacgaactcagtgaagttggagatgcagagtgacgaagaatgcgaccggaaaccgttgagccgagaagacgaaatccggggccatgatgagggcagctcgctagaagagccactcatcgagtctagcgaagtcgccgacaacaggaaagtacaggaacttcaaggcgaaggcggcataaggttgcccaatgggaaactgaaatgtgatgtgtgcgggatggtgtgcatcggaccaaatgtcctaatggttcataagcggtcgcacactggcgagcggccttttcactgcaatcagtgtggcgcgtcttttacccagaaggggaaccttctgaggcatattaaactacactccggcgagaaaccttttaaatgccccttctgttcatacgcctgtcgacgacgggatgcacttactggccacctccggacacacagcgtgggcaagccacacaaatgtaactattgtggacgttcctataagcaaaggtcttcactggaggagcacaaggaacggtgtcacaattacttgcagaacgtgagcatggaggctgccggacaggtcatgagtcaccacgattcctag

SEQ ID NO: 19509 - DNA, 381 bp, Artificial Sequence
  Description of Artificial Sequence: Synthetic coding sequence
atgcactgcaccctgaccatggagaccgaggccatcgacggctacatcacctgcgataacgagttgtcaccagagagggagcactccaatatggctatagaccttaccagtagcacgcctaatggccagcacgcctccccatcccatatgacctctacgaattctgtgaaacttgagatgcaatctgacgaggaatgtgacaggaagccactttctagggaggacgagatccggggccatgacgaggggagttccctcgaagagccccttattgaatcatctgaagtggccgacaatcgcaaggtgcaggaactgcagggtgaaggagggattaggctcccaaacggggagcggccttttcattgcaatcagtgcggctag

SEQ ID NO: 19510 - DNA, 1581 bp, Artificial Sequence
  Description of Artificial Sequence: Synthetic coding sequence
atggagaccgaggccatcgacggctacatcacctgcgacaacgagctctcaccagaacgtgagcactcgaatatggctattgatttgacctcctctacccctaatggacagcatgcctccccttcacacatgacctctacgaatagtgttaagctcgaaatgcagagcgacgaagagtgtgatagaaagcccttgagccgcgaagatgagatccgcggccatgacgagggctcctcactcgaggaacccctgattgagtcctcggaagtcgccgacaatcggaaagtccaggaactgcagggggagggtgggataagactgcctaatggtaaacttaaatgcgacgtatgcgggatggtctgtatcggccccaatgttttaatggtgcacaagcgctcccacactggcgaaagacctttccattgcaaccagtgtggcgcctcatttacccaaaaaggaaacctcttgcggcacatcaagctccatagcggcgagaaaccctttaagtgccctttttgttcttacgcctgccggagaagagatgctctcactggacaccttcgcacccactcagtgggcaaaccgcacaaatgcaactactgcgggcgctcatataagcaaagatctagcctggaggaacacaaggagagatgtcacaactacctgcagaatgtgtctatggaggcagctgggcaagtgatgagccaccacgtgccaccaatggaagattgtaaagagcaggaacctattatggacaataacatctccctcgtgccctttgagcgcccggccgtgattgaaaagctgaccggcaacatgggaaagcgtaaatcatctacccctcaaaagttcgtgggtgagaagttaatgcgctttagttaccccgatatccacttcgacatgaatttaacctacgaaaaagaggccgagctcatgcagagccatatgatggaccaggcaatcaacaatgccattacctatctaggggcggaggcattacatcctctgatgcagcacccaccatcaaccattgccgaggtggcaccagtgatatcgtccgcctatagccaagtgtaccatcctaaccgcatcgaaaggccaataagcagagagaccgcggattcccacgaaaacaacatggacggcccgataagcctgatcaggcccaaatcacggccacaggagcgggaagcctccccttctaattcctgtttagatagcaccgacagcgagtcgagtcacgacgaccaccagtcataccaagggcacccggctctgaatccaaagcgcaaacaaagtccggcttatatgaaggaggatgtgaaggctctcgacaccacaaaggcccctaagggctctctcaaggatatatataaagtgtttaacggagagggagagcagatccgcgcgttcaagtgtgaacactgccgcgtgctgttcctggatcacgtcatgtacacaatccatatgggatgccacggatatagagatcccctcgagtgtaacatttgcggctatagatcccaggataggtacgagtttagcagtcacatagtacgtggagaacatacttttcactag

SEQ ID NO: 19511 - DNA, 447 bp, Artificial Sequence
  Description of Artificial Sequence: Synthetic coding sequence
atggagaccgaggccatcgacggctacatcacctgcgacaacgagctgtcgccagagcgcgaacactcaaatatggccattgacttgacatcgagcacaccgaacggccagcatgcaagcccaagccatatgacctcgacgaatagtgtaaaactggagatgcagagcgacgaagaatgtgacaggaagcccctaagcagggaggacgaaatcaggggacatgacgaaggcagttcacttgaagagcccctgatcgagtccagcgaggtggcggataataggaaagttcaagaactccagggggagggcggaatacggcttccaaacggcaaactaaaatgtgatgtgtgcgggatggtgtgcatcggaccaaatgtccttatggttcacaagagatcccatacgggtgtggctgttgttaagactacgtttagtgagttctgttag

SEQ ID NO: 19512 - DNA, 1365 bp, Artificial Sequence
  Description of Artificial Sequence: Synthetic coding sequence
atggagaccgaggccatcgacggctacatcacctgcgacaacgagttgtcgcccgaacgcgaacacagtaatatggcaatcgatctgacctcatccactcctaatggtcagcatgcatcacccagccacatgacttccacaaatagcgtcaaattggaaatgcagtctgatgaagagtgcgaccgcaaacctctcagtagggaggacgaaatccggggccacgacgagggatccagcttagaggaaccccttatcgagtccagcgaggtggctgacaaccgaaaagtccaagagcttcaaggggaaggcggtatacgccttcccaacggggaacggcccttccactgcaaccagtgtggagctagttttactcagaagggaaacctgctgcgccacattaaactacactcaggcgagaaaccatttaagtgccctttttgttcttacgcatgccgcagacgggacgctctaacaggccacctgcgcacgcacagtgttcctcccatggaggactgtaaggagcaagagccaatcatggataataacatcagtctcgtcccttttgagagacccgccgtcattgagaagcttacgggaaatatgggtaagcgaaagtccagcacgccccagaaattcgtgggcgagaagctgatgaggtttagctaccccgacatccatttcgacatgaacctgacctacgaaaaggaagccgaactcatgcagtctcacatgatggaccaggccattaataatgcaatcacatatctcggcgccgaggctctccaccctctcatgcagcacccacctagcacaatcgccgaagtggcgcccgtcatctcgagcgcctactctcaggtctaccaccccaatcgcattgaacgaccgataagtcgggaaacggccgactcccacgagaacaatatggacggccccatcagcctgatccgcccaaagtctcgtccccaagagcgggaggcctctccctccaactcctgcctggatagcaccgacagcgaaagcagccatgatgatcaccaatcgtaccagggccatccagccttaaatcccaaaaggaaacagtctcctgcttacatgaaggaggatgttaaagcactggacacgactaaagccccaaagggatccctcaaggatatttacaaggtattcaatggcgagggcgaacagattcgggcttttaagtgtgaacactgcagagtactattcctggaccacgtgatgtatactattcatatgggttgccacggctatcgggaccccctggagtgcaacatctgtggatacaggtctcaggaccgctatgagttcagcagccatatcgtgcggggggaacacacttttcactag

SEQ ID NO: 19513 - DNA, 252 bp, Artificial Sequence
  Description of Artificial Sequence: Synthetic coding sequence
atggagaccgaggccatcgacggctacatcacctgcgacaacgagctgtcacccgagcgtgagcattctaatatggccatagacctcacgagtagtacgccaaatggccagcatgcctctcctagccacatgaccagcacaaacagtgtgaaactggaaatgcaaagtgatgaagagtgcgacagaaaaccactgagccgggaggatgaaatacgtggccatgatgaaggcagctcacttgaagagccctag

SEQ ID NO: 19514 - DNA, 1581 bp, Artificial Sequence
  Description of Artificial Sequence: Synthetic coding sequence
atggagaccgaggccatcgacggctacatcacctgcgacaacgagctcagcccagagcgcgagcactctaacatggcaatagaccttacctcatctacccctaacggccaacatgcatccccatcccacatgacgtctacaaatagtgtcaagcttgagatgcagtccgatgaggagtgcgataggaaaccgctcagccgcgaggatgagatcagagggcacgatgagggctcatctctggaagagccccttatcgagagtagtgaggtagccgacaaccgtaaggttcaggagctgcagggagaaggcgggattagactacccaatggaaagctgaaatgcgacgtgtgtggaatggtctgtataggaccaaacgtgctcatggtgcacaaaaggtctcacacaggggaacgccccttccattgcaaccagtgtggagcctctttcacacaaaaaggcaacctcctgcggcatattaaattacactctggtgagaaacctttcaagtgtcctttttgctcatacgcttgtcggcggcgcgacgccctcacagggcatttgcgcacacatagtgtagggaaaccacacaaatgtaattactgtggccgaagctataagcagcgctcctccttggaagagcacaaggagagatgccacaactatctgcaaaacgtgtctatggaagctgccggacaggttatgtcgcaccatgttccccctatggaggactgcaaggaacaggagccaataatggataataatatcagcctggtcccctttgagcgcccggccgtgatcgagaagctgacaggcaatatgggaaaaaggaaatcgtccaccccacaaaagttcgtgggggagaaattaatgcggttttcctacccggacatccacttcgacatgaatttaacttacgagaaagaagcggagcttatgcaaagccacatgatggaccaagcgatcaacaatgccattacgtatctgggtgccgaggctctgcaccccctcatgcagcaccctccatccacgattgccgaggtggcccccgttatcagctcggcttattcacaggtttatcatcctaaccggattgagaggcctatttcgagagagaccgccgactcccacgagaataacatggacgggccaatttccttgatcagacctaagtcaaggcctcaggagcgcgaagcatcccctagcaactcctgcttggattcgaccgattcagaaagttcacacgacgatcaccagagctaccagggccatcctgctcttaatcctaagaggaagcagtcgccagcatacatgaaggaggacgtgaaagccctagataccactaaggctccaaaaggcagcctgaaggacatctataaagtgttcaatggcgaaggcgagcagatccgtgcgttcaagtgcgagcactgccgggtgctttttctagatcatgtgatgtatactatccacatggggtgtcacggttaccgagaccctctggagtgtaatatctgcgggtacaggagccaggaccggtacgagtttagctctcacattgtcagaggcgagcacacctttcactag

SEQ ID NO: 19515 - DNA, 693 bp, Artificial Sequence
  Description of Artificial Sequence: Synthetic coding sequence
atggagaccgaggccatcgacggctacatcacctgcgacaacgagctgagccccgagagagaacatagcaacatggccatcgaccttacctcttcaacacccaatggacagcacgcgtcaccgtctcacatgaccagtaccatagcggaggttgctcccgttatcagctctgcatatagtcaagtgtatcaccccaataggatagagcggccaatcagccgggagaccgcagacagccacgaaaacaatatggacggaccaatcagtttaatcagacctaaaagtagaccccaggagcgtgaagcatcaccctccaacagctgtctggacagcacagactctgagtcgagtcacgatgaccatcaatcttatcagggtcatcctgccctcaacccaaaacgtaagcagtcccccgcgtacatgaaagaagacgttaaagcgttagataccacaaaggccccaaaggggagtctcaaggacatatacaaagtatttaatggcgagggggaacagatccgagcctttaagtgtgagcactgtagagtgttgtttcttgatcatgtgatgtataccatccacatgggctgccacggctatcgtgacccattggagtgcaacatctgcgggtatcgcagccaagacagatacgagttttccagtcacatcgtccgcggagagcacacattccattag

SEQ ID NO: 19516 - DNA, 1260 bp, Artificial Sequence
  Description of Artificial Sequence: Synthetic coding sequence
atgggcgagaagaagcccgagcccctggacttcgtgaaggacttccaggagtatttaacacaacaaacccaccacgtgaatatgatctccggtagtgtgtctggcgacaaggaggcagaggctctacagggggcagggacagacggcgatcagaacggcctggatcacccgagtgtggaggtgtctctggacgagaactccggaatgctggtggacggcttcgaaagaacttttgacggaaagttgaagtgccggtactgcaattacgctagtaagggcacagcgagactaatcgagcacatcagaatccacacaggagagaaaccccacaggtgccacctatgtccttttgcctctgcatacgaaaggcatctggaggctcacatgcggagccacacgggggaaaagccctacaagtgtgaactgtgtagcttccgctgttccgaccggtcaaatctgtcacatcaccgtcggcgtaaacacaagatggtacccatcaaaggaaccagaagcagtctaagcagcaaaaaaatgtggggggtattgcaaaagaagacctccaacctaggctacagccggagggcactgatcaatctgtctccaccaagcatggtggttcaaaagcctgattacttgaacgatttcacccacgagatccctaatattcagaccgactcttatgaatccatggcgaagaccaccccaaccggaggactgcctcgcgatccacaggagctgatggtagacaacccccttaaccagctgtccaccctggctggacaactttcctctctgccacctgaaaatcaaaatcccgcatctcccgatgtcgtcccttgccccgatgaaaagccctttatgattcagcagccctcaacgcaggccgtggtgtccgccgtgtcggcttctataccacagagttcgtctccaacatcccccgaacctcggcccagtcattcgcagcgtaattacagccccgtggcaggaccttcaagtgagccaagtgcccatactagtaccccctcgattggaaattcacagccctcaacgcctgcccccgccctccctgtacaggatcctcagctgctgcatcactgtcagcactgcgatatgtacttcgcagataatatcttgtacacaatccacatgggttgccacgggtacgaaaatccattccagtgtaatatttgcgggtgtaaatgcaagaacaaatacgacttcgcttgtcatttcgcccgagggcaacataatcagcactag

SEQ ID NO: 19517 - DNA, 1542 bp, Artificial Sequence
  Description of Artificial Sequence: Synthetic coding sequence
atgcgggagggcgcctgcaagctgctggccgcctgcagccagcgggaacaggcccttgaggccactaaatctctcctcgtatgtaatagccgaatcctctcttacatgggggaactccaaaggcgcaaggaggcacaggtgctgggtaagactagccgcagaccgagtgactccgggccccccgcagaacgatccccgtgccgcggtcgcgtttgtatcagtgatctgaggattcctctcatgtggaaagataccgagtactttaagaataagggcgatttgcatcgatgggcagtcttcttgctgcttcagctaggcgagcatatacaagatacggagatgattttagtcgacaggactctaacagacatcagcttccaatcaaatgtgctgtttgcggaggctggcccggacttcgaacttcgcctcgagctatatggggcatgtgtagaggaagaaggtgcactgactggcggtccaaaacgcctcgctacgaagttatcatcaagccttgggagatcatcaggcaggagagtgagggctagcctggactctgcaggaggaagtggatctagtcctatcctactgcccacgcccgtggtcgggggccctagatatcacttactcgcccataccactctgaccctggccgccgtacaggatgggttcagaacccatgaccttaccctcgccagccacgaagagaacccggcatggttgcccctgtatgggagcgtgtgctgtcggctggccgcccagccgctatgtatgacccaacctacagcgagcgggaccttaagagtgcaacaggccggcgaaatgcagaactgggctcaagtccacggtgtcctgaaaggtaccaacttgttctgctatcggcagcctgaggacgccgacaccggggaagagccccttctcacaatcgcagtgaataaagaaacacgtgtgcgcgctggagagctggatcaggcattaggaaggcccttcaccctctccatctctaaccagtacggcgacgatgaagtaacacataccttgcagaccgagtcacgcgaagcgctgcaatcgtggatggaggccttgtggcaactcttttttgacatgagtcagtggaagcagtgttgcgacgaaataatgaaaatcgaaacacccgcgcctcggaagccacctcaggccctcgctaaacagggttctctgtatcacgagatggccatcgagcccctggatgatatagctgcagtgaccgacatcctgacacagcgcgaaggcgccagactggaaaccccccccccctggctcgccatgtttacggatcagccagcactgcctaatccatgcagcccagcctctgttgcgccagcacctgactggacgcatccgttgccttggggacgcccaagaaccttctcgttggatgccgttcctcccgatcattcacccagggcgaggtcagttgctccacttccgccccagaggagtcctagaacgagagggctgtgtagcaaggggcagcccagaacttggctacagtctcccgtgtag

SEQ ID NO: 19518 - DNA, 1092 bp, Artificial Sequence
  Description of Artificial Sequence: Synthetic coding sequence
atgagcaagctgtggcggcggggcagcaccagcggcgccatggaggctccagagcctggcgaagccctcgagttgagcctggcaggcgcccacggccacggcgtccacaagaagaaacataagaagcacaagaaaaagcataaaaaaaaacatcaccaagaagaggatgccggtccaactcagccatctccagcaaagcctcagctgaagctcaagattaagctcggcggacaggttcttgggaccaagagcgtgccaacgttcactgttattcctgaaggacctcgcagcccctcaccgcttatggtggtcgacaacgaagaggagccaatggaaggggtccccctcgagcaatatcgggcatggctcgatgaggacagtaatctgtcaccatctcctttgagagatttgtcgggtggccttggcggtcaggaagaggaggaagaacagcgctggctggacgccctcgaaaagggagagctagatgataatggcgacctcaaaaaagagatcaatgaacgcttgttgaccgcccgccagcgcgcccttcttcaaaaggcaagaagccaacctagccctatgctgccccttcccgtggcagaaggttgtccccctccagccctgaccgaagagatgctgctaaagcgtgaggaacgagcccgcaaaagaaggctccaggcggctcggcgggcagaggaacacaagaatcagacaatagagagattgaccaaaacagctgcaacttctgggcgaggcggcaggggaggggccagaggcgaaagaagaggcggcagagccgcggctcctgccccgatggtgcggtattgcagcggtgctcagggctccaccctgtccttcccgcctggggtgcccgcccccacagctgtatcccaacgcccctctccatccggcccccccccccgctgtagcgttcctggctgcccccacccacgcagatacgcatgctcccgcacgggacaagcactgtgttcactgcagtgttaccgtattaatttgcaaatgagattgggtggcccagagggaccgggaagccccctcctggccacctttgaatcttgtgcccaagagtag

SEQ ID NO: 19519 - DNA, 594 bp, Artificial Sequence
  Description of Artificial Sequence: Synthetic coding sequence
atggccgcccagatccccatcgtggccaccaccagcacccccggcattgtgcgaaactcaaaaaaacggcccgccagcccaagtcacaacggctcttccggcggaggctacggcgccagtaaaaagaaaaaagcctcggcctcaagcttcgctcagggtatttcgatggaagccatgtctgaaaacaagatggtcccatctgagttctcaaccggtcccgtggaaaaagcggctaaacctctgccttttaaagatccgaactttgtgcattcaggacacggaggcgccgtcgccggcaagaaaaaccggacctggaaaaacctcaaacagatactggccagcgagcgagcgctcccttggcagttgaacgacccaaactacttcagcatagatgctcctccaagtttcaagccagcaaagaagtactctgatgttagcgggctgctcgagcctcccaattgcttccctcagcgcctgcatcagctgaccttcccactggccatggatgaaggcagcaatttcagcagatgctcccccaccctcgtaaactttggattcgtattcattatggccattctggtaggagtaaagtag

SEQ ID NO: 19520 - DNA, 579 bp, Artificial Sequence
  Description of Artificial Sequence: Synthetic coding sequence
atggccgcccagatccccatcgtggccaccaccagcacccccggcattgttcgaaacagtaagaagcgtcccgcctcccctagccacaacggaagcagtggtggcggatacggagcatcgaaaaagaaaaaagcaagcgccagcagtttcgcccagggtattagcatggaagctatgtccgagaataagatggtgccaagtgaattctccaccggacccgtggaaaaagccgccaaacccctgccttttaaagatcctaacttcgtgcattccggccatggaggcgccgtggcggggaaaaaaaacagaacctggaagaacctgaaacagatccttgcatctgagagagcgcttccttggcagctgaatgatccgaactatttctctattgacgcaccaccctccttcaagcctgccaaaaaatactctgacgtcagcggtctgctcgccaactacactgatccacaaagtaaattgagatttagtaccatcgaagagttttcttatatccgaaggctgccatccgacgtcgtcactggctaccttgctctacgaaaggccacttccattgtcccatag

SEQ ID NO: 19521 - DNA, 687 bp, Artificial Sequence
  Description of Artificial Sequence: Synthetic coding sequence
atggccgcccagatccccatcgtggccaccaccagcacccccggcatcgtgcggaactctaaaaagagacccgcaagccctagccataacgggtcaagcgggggaggctacggcgcctctaaaaaaaagaaggcctctgcatccagttttgcccagacatgcctgagcccttccacaatgattgtgcgccccccgcagccaaggggaaccacttgcctactgccatctgcgatgatcgtgaggcccccgcagcctcgcgggaatggtatttctatggaggccatgtcagaaaataagatggtccccagtgaattcagtactggccctgtagagaaggccgctaagccccttcctttcaaggacccgaatttcgttcattccggtcacgggggcgctgttgccggaaagaagaatcgtacatggaaaaatctcaagcagatcctggcctccgagagagcgctcccatggcagttgaatgaccccaactacttttccatcgatgccccgccctcatttaaacctgccaagaaatattctgatgtgagcggcttactcgcaaattacactgaccctcagtccaagctgagattcagtacaattgaggagttctcctacatcaggagactcccttcagacgtcgtaaccggctaccttgcattacgaaaagccacatctatcgtgccttag

SEQ ID NO: 19522 - DNA, 13692 bp, Artificial Sequence
  Description of Artificial Sequence: Synthetic coding sequence
atggaccccccccggcccgccctgctggccctgctggccctgcccgcactcctgcttctgttgctggctggtgctcgggcggaggaggagatgcttgagaatgtttcattagtgtgtccgaaggacgctacccggtttaagcaccttcggaaatacacctataattatgaagcagagtccagcagcggtgtgccaggcacggctgacagcagatccgcaactcggatcaactgcaaggtcgaactcgaagttccacagttgtgttcttttatcctgaagacctcacagtgcacactcaaagaggtgtacggcttcaacccagaaggcaaagccttgctaaagaaaacaaagaactcagaggaatttgccgctgcgatgagccggtacgagttaaagctcgcgattccagaggggaagcaggtgtttctttatcctgagaaggacgagcccacctatatcctgaatatcaaacggggcataatatctgcactcctcgtgcccccagagaccgaggaggccaagcaggtactctttctggacaccgtttacggaaactgctctacccacttcacagttaaaacaaggaaaggcaacgtggctaccgaaatcagtaccgaaagggacctcggccagtgtgatcgcttcaaaccaatcaggacaggtatctcacccttggctttgattaaaggcatgactcgcccgctctcaacactgatttcttcgagccagtcatgccagtacaccttagatgccaagcggaaacatgttgccgaggcaatatgcaaagagcaacacctttttctgcctttctcttataaaaacaaatacggaatggtagcacaagtgactcagaccctcaagctcgaagacacccccaagattaatagccgctttttcggagaaggcacgaaaaaaatgggacttgcgttcgagtcgaccaagtccacctctcctcctaaacaggcagaggccgtgctcaaaacactccaggaactcaagaaactgacaatctctgagcagaacatccagagggctaacctgttcaacaaattagtgaccgagctgagggggttgtcggatgaggccgtgacaagcctcttgccgcagttgatcgaagtctcctcacctatcactttacaggcattggtccagtgtggtcagccccaatgctcaacgcatattctgcagtggctgaaacgggttcatgcaaatcccctgcttatagatgtggtgacgtatctggttgccttgattccggaaccttcggcacagcagttgcgcgaaatcttcaacatggcgagggatcagcggagtcgagctaccctgtacgccctcagccacgcagttaataactaccacaagactaatcctactggcacgcaggagctgcttgatatcgcgaattacttgatggagcagatccaggacgattgcacgggggatgaggattacacctatctgatactcagagttattggcaacatggggcagactatggaacaacttactcctgaacttaagtcaagtattctgaaatgcgtgcaatccaccaaaccaagtttaatgatccagaaggccgccattcaagcacttagaaaaatggaaccaaaggacaaagaccaggaagttctcctccagacattcctggatgacgcatctccaggcgacaaaagactagctgcctacctaatgctgatgaggtccccatcacaggcagacattaacaagatcgtccaaatcctgccatgggagcagaatgaacaggtaaagaattttgtggcatcgcacattgctaacattcttaatagtgaggagctggacatccaggacctcaagaagttggtgaaagaagccttgaaagaaagtcagctgcctacagtcatggattttcgaaagttctccagaaactatcagctttataagagcgtttctctgccgagcttagaccccgcatctgccaagatcgaaggcaatttaatttttgaccctaataattatttacctaaggaaagtatgctcaagactaccctcaccgcatttgggttcgcatccgcagatttaattgagattggccttgagggcaagggcttcgaacccaccctagaggcgctattcggaaaacaggggttcttcccggattccgtcaataaggccctgtactgggtaaatgggcaagtacctgacggtgtgagtaaagtgttggtcgatcatttcgggtacaccaaggatgacaagcacgagcaagacatggtcaacggtatcatgctgtcagttgaaaaactaattaaggacttgaagagcaaagaggtcccagaagcaagagcctaccttcggatcctcggagaagaactgggatttgcctccttacacgaccttcagctgcttggcaagctgctacttatgggcgcccgcacattgcagggaataccacagatgatcggtgaagtaatcaggaaaggaagcaaaaatgacttcttcctccattacatctttatggagaacgccttcgagctacccactggagccggcctgcagttgcagattagtagctcgggggtcatcgctcctggagccaaggccggagtaaagctcgaagttgctaacatgcaagccgaattggtggccaagccatctgttagcgtagaattcgtcactaatatgggaatcatcatccccgacttcgcgcgatctggagttcaaatgaatacaaacttttttcacgaatccggtctcgaagctcatgtggctttaaaggccggtaagcttaaatttattatcccctcaccaaaaagacctgtcaagctgctgtccggggggaacaccctgcatttggtaagcaccacaaaaacggaggtcatccctccgttgatcgaaaaccggcagtcgtggagtgtatgcaaacaggtgttccccggcctgaactactgtacctctggagcatatagcaacgcctcctcaacagacagcgcctcgtactatccactcacaggcgataccaggctggaattggagctgcggcccactggagaaatcgagcagtactcagtctccgctacctacgaactgcagcgtgaagatcgagccttagtagataccttaaagtttgtgacccaggccgaaggcgctaagcaaactgaggcgacgatgacattcaaatacaataggcaaagcatgactctgtcaagtgaggtccagatccccgacttcgatgtcgacctgggtacgatccttcgagtaaatgacgagtctactgagggaaaaacatcttacaggctcacactggacatacagaataaaaaaattaccgaggttgcattaatggggcacctctcttgcgacactaaggaggagcgaaaaattaagggtgtcatctccataccccgcctccaggctgaggcccggtccgaaatcctggcccattggtcccccgccaaactgctgttacagatggattcatctgctacagcctacggcagtactgtttccaagagagtggcttggcattacgatgaagaaaagatcgaattcgagtggaatactggtaccaacgtggatactaagaagatgacatccaatttcccagtcgacctaagcgactaccccaagagtctgcacatgtatgctaaccggctgctggatcaccgtgtccctcaaacagatatgaccttccgccacgttgggagtaagcttatcgtcgccatgtcaagctggctgcagaaggcctctggcagcctgccctacacccagaccctacaggatcacctgaacagcttgaaagagttcaatctgcagaacatgggattacccgactttcacatcccagagaacctgtttttaaaaagtgatggacgggtgaagtacaccctgaacaaaaactctttaaagatcgaaatcccactgccttttggcggcaagagcagccgcgatctaaagatgttggaaaccgtgcggactcccgcattgcacttcaagtctgtcgggttccacttaccttcaagggaattccaagttcccacattcacaatccccaagctgtaccaacttcaggtgccattactaggggtgctggacctgagcaccaacgtgtacagcaatctttacaactggagcgcatcatactctgggggtaacacttctactgaccacttcagcttaagggccagataccacatgaaagccgattctgtcgtcgatttgctgtcctacaatgtacagggctctggtgagaccacttatgatcacaagaatactttcactctgtcatacgacggttcacttagacataagttcctagattccaacatcaagttcagccatgtcgagaagctcgggaataacccagtttccaagggactgcttattttcgacgcctcatctagctggggccctcagatgtcggcctccgttcacctggatagcaagaagaagcagcacttattcgtaaaggaggtcaaaattgatggccagttcagagtcagctcgttttacgcaaagggaacctatgggctgtcatgccagcgcgatcccaacaccggccggctcaacggggagagtaatttaagatttaattcttcttacctccagggtaccaatcagatcacaggaagatacgaggacggaactctaagtttgactagcacctccgacctgcaaagcgggatcataaagaatacagcaagtctgaagtacgaaaactacgaactcacgttgaagtcagacaccaacgggaagtataagaacttcgccaccagcaataaaatggacatgaccttcagcaaacagaacgcattgttacgatccgagtatcaggccgactatgagtcattgagatttttttccctgttgagcggctcactgaattctcatggccttgaattaaacgccgacatcctgggcaccgataagatcaactctggtgcacacaaagcaacactccggatagggcaggacgggataagcacttctgctaccactaatttgaaatgtagtctcctggtattggaaaatgagttgaatgccgaactcgggctctcaggtgccagcatgaagctgaccaccaacggcaggttccgagagcacaatgctaaattttccctcgatggcaaggcagctctgacagagttgagcctgggcagtgcatatcaagctatgatcctcggggtcgactctaaaaacatcttcaattttaaggtaagccaggaagggctgaagctgtccaacgacatgatgggaagctacgccgaaatgaaatttgaccatacaaattctctgaacatcgccggactgtccctcgatttctcctctaaactggataatatctacagcagtgacaaattttacaagcagacagtgaatctacagcttcaaccttacagcctcgttactacgttgaatagcgatttaaagtacaatgcccttgatctgactaataatggaaaactgcggttggaacccctgaaattgcacgtcgcagggaacctgaagggcgcgtaccagaataacgagatcaaacatatatacgccatctcctcagccgccttgagcgccagctacaaggccgacaccgtggccaaggtgcagggagtggagttctctcatagactgaacaccgatattgctggcctggcctctgctattgacatgtcaactaactataattcagatagtctgcacttcagcaacgtgtttcgctccgtgatggctcctttcacgatgaccattgacgctcacacgaacggcaacggtaagctagcactgtggggggagcatacaggccagctatatagcaagttcctgcttaaagctgagcctctcgccttcacgttttctcacgactacaagggttccacatcacaccacttggtctcacgcaaatcaatctccgctgctctggaacacaaggtgtctgccttgttgaccccggcagagcaaaccggcacttggaaactgaagacccagtttaacaacaatgaatactcccaggatttagatgcgtataacaccaaggacaagatcggtgtagagctgaccggtcgtacactcgcagatctgactctcctggattcccccattaaagttcctctcctgttaagcgaaccaattaatattattgacgctctggagatgcgggatgccgttgaaaagccgcaggaatttacaatagtagcttttgtcaaatacgacaagaatcaggacgtgcactctatcaacctgcccttcttcgaaacacttcaagagtatttcgaacggaatagacaaacgattatcgtagtcttagagaacgtgcaacgtaacttgaagcacataaacattgatcagtttgttaggaagtatagggccgcgctgggaaaactcccgcaacaggccaacgattatctgaactcctttaattgggagcgccaagtctctcatgcgaaagaaaagctcaccgcactcaccaaaaagtaccgcatcaccgagaacgacatccagatcgccttagacgatgcaaagatcaacttcaacgagaagctttcccagctccagacatatatgatccagtttgaccagtacattaaggatagttacgatttacacgacctcaagatcgccattgccaatatcatcgacgaaatcatcgaaaaactgaagtctctggatgaacattatcacattagagtcaatctggttaagaccatccacgacctacacctgtttatagaaaatatagacttcaataaaagcggctctagcaccgccagctggatacagaatgtagataccaagtaccaaatccggattcagatccaagagaagctgcagcaactcaagagacacatccagaacattgatatacagcatttggcgggcaaattgaaacagcatatcgaagccatcgacgttcgggtactgctggaccaactgggcacaacaatctctttcgagaggatcaatgatatactggagcatgtcaaacattttgtgattaatctgatcggcgattttgaggtcgctgagaagattaacgctttcagggctaaggtgcacgaattgattgaacggtatgaggtggaccagcagatccaggtgctaatggacaaactcgtggagttggcacaccagtacaagctgaaggaaaccattcaaaagttaagcaatgtgcttcagcaagtgaaaattaaagactatttcgaaaaactggtgggttttatcgatgacgctgtgaagaaacttaacgagctgtccttcaaaacttttatcgaagatgtcaacaagtttctagatatgttgataaagaagctcaagtccttcgattatcatcagttcgttgatgagactaacgataaaatccgtgaggtaacacaaagactcaatggggagatccaggctctggaacttccacaaaaggccgaagcattgaaactgtttctggaagaaactaaggctaccgtggcagtatatttagagagtttgcaggacactaaaattaccctaataataaattggctgcaagaggcactgtcaagcgcttctcttgcgcacatgaaagccaaatttcgggagacactagaagacacccgggatcgtatgtaccagatggacattcagcaggaattgcagcggtacctcagtctggtaggacaggtctatagcactctggtgacgtacatttcagattggtggactctggccgcaaagaacttaactgattttgcggagcagtactcgatacaggactgggcaaagagaatgaaggctctggtcgagcagggctttacagttccagagataaaaactattctgggaacgatgccagcgttcgaagtttccttgcaggcccttcagaaagcaactttccagacacccgatttcattgttcctctgaccgaccttcgcatcccttccgtccagattaactttaaggacctaaagaatatcaagattcctagccggttcagcactcccgagtttaccatcttgaatacattccatatcccttcattcactatcgattttgttgagatgaaggtcaaaatcattcgcaccatcgaccagatgttgaactcagaattacagtggccagtgcctgacatctacctgcgtgacctcaaggtagaggatatccccctcgctcgtatcacactgcccgattttaggctgccagagatcgccattccagaattcatcattcccactctcaacctaaacgactttcaagtccccgacctgcacatcccggaatttcagcttccccacatctcacataccattgaggtaccaaccttcggtaagctgtactccatactgaagatacaatcccccctgttcactcttgacgccaatgccgatattggcaacgggacaacttcagcgaatgaggcgggaatcgcagcctccataacggcaaaaggagaaagcaagctggaagtgcttaacttcgactttcaggcaaacgcccagctctctaacccaaaaatcaacccattagccctgaaagaaagcgtcaaattttcatcaaaatatctgcggaccgaacatggcagtgagatgctgtttttcggtaacgctatagaaggcaagtcgaacactgtcgcctcactccacacagaaaagaacactctagagttgtccaacggagtgatcgtaaagatcaataatcagctgacccttgactctaacacaaagtattttcacaagctaaacatccctaaactcgacttctcctctcaggcagatctgaggaacgagatcaagactttgcttaaagccggacacatcgcctggacttctagcgggaaaggctcatggaaatgggcctgcccccgcttctccgacgaagggacccacgagtctcagatctcattcactatcgaaggaccactgaccagcttcggtctctccaacaagattaattctaaacacctccgtgtcaaccaaaaccttgtgtatgagtcagggtctctcaacttcagtaagctggagattcagtctcaggttgatagccagcatgtgggacactccgtgttgacggccaagggtatggctctgttcggcgaggggaaggccgagtttacaggtagacacgatgcccacctgaatgggaaggtgataggtaccctgaagaactctttgttcttctccgcccagccattcgaaattacggcatccaccaataacgaaggcaatctcaaggtacggtttcctttaaggctgactggaaagatcgattttcttaataattacgcactctttctgagccctagcgcccaacaggcgtcctggcaggtgagcgctcggttcaaccaatacaagtacaaccagaacttcagcgcagggaacaatgaaaatatcatggaagcccacgtaggtattaatggggaagcaaacctagattttcttaatatccctctgaccattccagagatgagacttccctacaccatcattactacgccacccctgaaagactttagcctgtgggagaagactgggttgaaggagttcctgaagacaaccaagcagtccttcgatctcagtgtcaaagcacaatataagaagaataagcaccgccactccatcaccaatccgctggccgtgctttgtgagttcatttcacagagcattaagagcttcgaccggcatttcgagaaaaacaggaataatgctctggacttcgtaactaaaagttataacgaaaccaaaattaagtttgacaagtataaggctgagaaaagccatgatgagctccccagaaccttccagattcccggatatactgtcccagtcgtcaacgtcgaggtgtccccttttaccatcgaaatgtccgcatttggctacgtgtttcctaaggcagtgtccatgccatccttttccatcttaggatcggacgtcagagtgccaagttataccctcatcctgccttccttggagctgcccgtgctccacgtcccacggaacctgaagctcagcctgcccgacttcaaggagctgtgtacaatctctcatattttcatcccggccatggggaatataacctatgatttttccttcaagtcatccgtgatcactctcaatactaacgccgaactgtttaatcagagtgatatcgtagcccaccttcttagcagttccagctcagttatagacgctctgcagtataagttagaggggacaactcggctgacgcgaaagcgcgggttaaaacttgcgacagccctcagtctgagcaataagtttgtggaggggtctcacaacagcaccgtttctctcaccaccaaaaacatggaggtgagcgttgctaccactacaaaggcacaaatccccatactgaggatgaactttaagcaggagctgaatggcaatacaaaaagtaaacctacggtgagttcatcaatggagttcaagtacgacttcaacagctccatgttatactcaactgcgaagggtgccgttgatcacaagttgtcactagaaagccttacttcctacttctcaatcgaatcttccactaagggagacgttaaaggctcagtcctgtcaagggaatatagcggcaccatagcctccgaagcaaatacatacctgaattccaagtctaccagatcttctgtcaagttacagggaacatccaaaatagatgacatttggaacctagaggttaaggagaatttcgccggtgaagcaaccctgcaaagaatttattctctctgggagcatagtactaagaatcatcttcaattggagggactgttcttcaccaacggggagcatacgtcgaaagcaacactggagctctccccatggcagatgtccgctttagtgcaggtgcatgcatcgcagccatcgtccttccatgacttccctgacctggggcaagaagtggccttgaatgccaacacaaagaatcagaaaattcggtggaagaacgaggtcagaatccattccggctcattccagtctcaagtggagttgtcaaacgatcaggaaaaagctcacctcgatatcgccgggagtttagagggacacctccgcttcctgaaaaatatcatcctaccagtatatgacaagagcctgtgggactttcttaagctagacgtgacgacctctatagggaggcggcagcatcttagagtgtcaacggctttcgtatacaccaaaaatccaaatggctattcgttctctatcccggtcaaggttctagcggataaattcatcatacccggcctgaagctgaatgatctgaattctgtcctggtaatgcccaccttccatgttccctttaccgatctgcaggtcccctcctgtaaactcgacttcagagagatccagatctataaaaaactaaggacatcctcttttgctctgaaccttccgactctgccggaagtgaaattccccgaggttgacgtgctgacaaaatattctcaacctgaggacagcctgattcccttttttgagatcactgtgcccgaatctcagcttacagtctcccagtttacccttcctaagagtgtgagtgatgggatagcagccctagacctcaacgctgtcgctaacaaaattgctgattttgaactccccaccatcattgtaccagagcaaactattgagatcccctccattaagtttagcgtgccagccggcattgtcattccatctttccaagcgttaacggctcgttttgaagtggacagtccagtctacaacgccacgtggagcgcaagcctcaaaaacaaggctgattatgtggagacggttctagattctacatgttcctccacagtccagttcttagaatacgaactgaatgtgctcggcacacacaagatagaagacggtacacttgcctcaaagactaaaggaaccttcgcccaccgggacttctctgccgaatacgaagaagacggcaaatacgagggtttgcaggagtgggaaggcaaggctcacctgaatattaagtccccggcattcacagacctgcacttgcgctaccaaaaagataaaaagggcatctccacatctgcagcgagtcctgctgtgggcaccgtcggtatggatatggacgaagacgatgatttctcaaagtggaacttttactattccccacagagtagcccagacaagaaactgacaatctttaagactgaactgagggtgagagagtcagacgaagagacacagatcaaggtcaattgggaggaggaagctgcaagcgggctgcttacaagcctaaaggacaatgtacccaaggctacaggcgtactatatgattatgtcaataagtatcactgggagcacaccggattgaccctgcgagaggtttcttccaaactcagacgaaatctgcagaacaatgcggagtgggtgtaccagggcgccatcaggcagatcgacgatatagacgttaggtttcagaaagccgctagcggcacaacgggcacttaccaggagtggaaggacaaagctcaaaacctgtatcaagagctactgacccaggagggccaagcttcgtttcagggcctgaaggataatgtctttgacggattagtgagggtgacgcaggagttccacatgaaggtgaagcacctaatcgattccctgatagattttttaaatttccctcgttttcagttccctgggaagcctggcatttatacaagagaggagctctgtacaatgttcatccgcgaggtcggaactgtcctcagccaggtgtacagtaaagttcacaacgggagtgagattctttttagttactttcaagaccttgtgatcacactcccgttcgaactgaggaagcacaaactcatagacgtaattagtatgtaccgcgagctccttaaggatctgtctaaggaggcgcaggaggtgttcaaagccatacagagcctgaagactacagaggtcctccggaacctgcaggacctccttcagttcatctttcagctgatcgaagataacattaagcagttaaaggagatgaagttcacctacctgattaactatatacaggatgaaatcaacacaatcttcagtgactacatcccttatgtgttcaagttacttaaagaaaacttgtgcctgaacctgcacaagttcaatgaatttattcagaatgaactgcaggaagcctctcaggagttacagcagatccaccagtacattatggccctcagagaagagtattttgacccgtctattgttggctggaccgttaagtactacgaacttgaggagaagatcgtgtcgctgattaagaacctactagtggcgctgaaagattttcactctgaatacattgtgtctgcttccaatttcacctcacagctcagctcgcaggtcgagcaatttctgcatcgaaatatccaagagtacttgtcgatcttaactgatcctgacggtaaaggtaaggagaagatcgccgagctgtctgccactgcacaggagatcataaaatcccaagccatcgcaaccaagaagattatttcagattatcatcagcaattcaggtacaagctgcaggatttttctgaccaattgtcagactactatgaaaaatttatcgccgagtccaagagattgatcgacctgagtattcagaattaccataccttcctgatttacataaccgaattgctaaaaaagctccaatccactacggtcatgaacccctacatgaagctcgctccaggagagctgaccattattctttag

SEQ ID NO: 19523 - DNA, 3084 bp, Artificial Sequence
  Description of Artificial Sequence: Synthetic coding sequence
atgtacgagggcaagcacatccacttcagcgaggtggacaacaagccattgtgctcatactcacccaaactgtgtaaacagcgcagactgaacggttacgcgttctgtatcaggcacgttctggaggataaaacggcacccttcaaacagtgtgaatacgttgctaagtacaactctcaacgatgtaccaacccaataccaaaaagtgaggaccggaggtactgcaactcgcacctacaagtgctgggctttatccctaagaaggagaggaagaagaagaatgatcccatagacgaagtgaaagtacgacaccagatggacacaatggcgttttcgttgactgttccaactctggccctgaagatgcctaatggcctggacgggatgagtctctctcctcctggcgctagggtgcccctacattatctggagaccgaactcgaggacccattcgcctttaatgaggaggacgatgatctcaagaagggtgctaccgttcgtaaaaaactgcaaagcaagttagcccagaataggcagaggcaacgagaaaccgagatacttaaagtgaggcaggagcacttcagcccccctccggctccaagtcaacagcaacctccacaacagcactcacatctgtcccccctctctacctccctgaagccacctgcgcctccacagggaagcgtgtgcaagtcaccacagccccagaacacatcccttcctatgcagggcgttgcgcctacaacccatacaatcgcccaggcccggcagctttcacacaagagaccccttccgctgcttccctcatcacgggcacccactgtggatcctccccgaacggatcggattctcatgaaggcgaccgccttcagcccccatttctcatgtatatccagacttcagcggctcgtgaagctgtgtactcagaaacaccagcttgataccgatctgttcccgcacttgggtctggactggagcgaggaatccggagaggagcccgaagacagcgaacaggcaagtccctatcaggttgcttggagtatccgcgagacactgcgttaccagagacatgcaagcgatgacgatgatgcggagagtaggtcttcacgcgtaacccagctgtgtacatatttccagcagaaatacaagcacctatgccggctcgaacgggccgagtcccggcagaagaagtgcagacacacattcagaaaggctctgctacaggccgctagcaaagaacccgaatgcaccgggcagctgattcaggagcttaggagggccgcgtgctctagaacatccatttctcgtacgaaactgcgagaggtggagccggctgcctgctccggtacagtgaagggcgagcagtgcgctaataaggccctgcccttcacccggcattgctttcagcacatcctcttgaaccattctcaacagctgttttcttcgtgtaccgctaagtttgctgacggccagcagtgtagcgtgccagtgtttgatattacccatcaaactccgctatgcgaagagcacgcaaaaaagatggacaacttcctacgcggagataacagcaggaaagttcaacaccagcagcagagaaagccacggaagaagaccaaaccaccagctctcactaagaagcataagaagaagcggcgaagaggcccaaggagacctcagaagcccatccccccagctgtgccacagggtaacctctcaatgcccgcctcagtttccctgccagtcgaggcttcccatatccggtctccttccaccccggagctctctgctgacgaactcccggacgacattgccaacgaaataactgatatcccccatgatctggagcttaaccaggaggatttttccgacgtgttaccccgtctaccggacgatctgcaagacttcgattttttcgaaggcaaaaatggggacttacttccgactaccgaggaggccgaagagctagagcgtgccctgcaggccgtaacgtctctggaatgcctgtccaccattggcgttttagcacagtctgatggggtacccgtccaagagctgagcgacagagggatcggggtattctcaaccgggaccggcgcctcaggcatccaatctctgagcagggaggtcaacactgatttgggcgaactattgaacggaaggattgtgcacgacaattttagctctttggaactcgacgagaatctcctgcggtcagccaccctctccaatccccctacccctctggcgggacagatacaaggacaattttcagcaccggcgaacgtgggtctgacaagtgccaccctcatttcccagtcagccctgggtgagagggccttccccgggcagttccatggactgcacgatggatcccacgctagtcagaggcctcatcccgcccagctcctgtccaaagcagatgatctgatcacaagtaggcagcaatatagttctgaccatagccattcctctcctcatggttcccactacgattccgagcatgtgccctctccatacagcgatcacatcacctccccccataccacatcatattcgggtgacaacatggctgctaccttctctgcagaaatgcccattatggcacagcatcttcttcctacgcagctcgaggttccgttaggtggggtggtcaatccacggacacattggggtaacttgcctgttaacctaggcgatccatcgccatttagtaacctgctgggggcagatggccatctgttaagtacctccttgtctactccccctacaacgtccaactcggagactacccagcctgctttcgccaccgtgactccaagctcttcaagcgtgttgccaggactcccacagacgtcattctcgggtatggggcctagcgctgagctgatggcttcaacatcaccaaagcaacagttgccacagttttccgctgccttcggacaccagctctcctcacattccggcatccctaaggatctgcagccgtcgcacagttcaattgcgccccctactggtttcacggttacaggggctaccgctactagcaccaataacgctagttcaccgtttccgtcaccgaattag

SEQ ID NO: 19524 - DNA, 114 bp, Artificial Sequence
  Description of Artificial Sequence: Synthetic coding sequence
atgtacgagggcaagcacatccacttcagcgaggtggacaacaagcctctgtgcagctacagcccaaaactgtgcaagcaaagacgtctgaacgggtacgccttctgtatctag

SEQ ID NO: 19525 - DNA, 735 bp, Artificial Sequence
  Description of Artificial Sequence: Synthetic coding sequence
atgaacggccccgccgacggcgaggtggactacaagaagaagtacagaaacctgaaacgcaaactgaagtttctgatatatgagcacgaatgttttcaggaagagctgcgaaaggcccagaggaagctgctgaaagtatcacgcgacaaatccttcctcttagaccgcttactgcaatatgagaacgttgacgaggattcctctgacagcgatgcaactgcatcatctgacaacagcgagacagagggaacccccaagctgagcgacacgccagcgccaaagcgaaagaggtcacctccactcggcggggcacccagcccctccagcctgtctttgcccccaagcaccggattcccactccaggcctccggggttcccagcccataccttagctcactcgcatcttccaggtaccccccctttccttcagattacttggctctacagctcccagaaccaagtcctctcagacccaaacgagagaaaaggccccgtctcccacgcaaacttaagatggcagttgggccgccagactgccctgttggcgggccacttacatttccaggaagaggaagcggcgccggggtggggacaactcttacacctctgcctccacctaagatgcctcctccaaccatcttgtccacggtgcccaggcaaatgttttccgacgccgggtctggcgatgatgccctcgatggagacgatgatctcgttatagatatcccagagtag

SEQ ID NO: 19526 - DNA, 486 bp, Artificial Sequence
  Description of Artificial Sequence: Synthetic coding sequence
gccggcgccgcccggcagcccctgctgggcgtggccggcggccagacgttgggggccacgccaggaccggtgatgaacggcccagctgacggcgaggtcgattacaagaaaaaatacaggaatctcaagaggaagttgaagttcctcatctacgagcatgagtgctttcaggaggaacttcgcaaagcacaaaggaaactgctaaaagtgagtagagacaagtcctttctgctggatagactgcttcagtacgagaatgtggacgaggatagctccgatagtgatgccactgcctcaagtgataatagcgagacagagggcacgcccaagttaagtgatacccccgcccctaagcgtaagcgtagcccacctcttgggggggcacccagcccaagttccctcagtctgcccccctctaccggctttccactccaggctagcggggtacccagcccgtacctgtcctccgagcgaggacaggcttag

SEQ ID NO: 19527 - DNA, 414 bp, Artificial Sequence
  Description of Artificial Sequence: Synthetic coding sequence
atgaacggccccgccgacggcgaggtggactacaagaagaagtacagaaatctcaagcggaagctcaagttcctcatttatgagcatgagtgctttcaagaggagctgcggaaggcccagcgaaaattgttgaaagtgtcaagggacaagtcttttttgctggatcgattattacagtacgaaaatgtggatgaggatagtagtgacagcgacgccaccgcgagtagcgacaattccgagacggaaggcacaccgaagctgtccgacaccccggcacctaaacgcaagagatctcctcccctgggcggggcgccttctccttccagtctgtcacttccacccagcaccggtttcccccttcaggcatcgggtgtgccgagcccatatctgtcttctgagcgcggacaggcttag

SEQ ID NO: 19528 - DNA, 735 bp, Artificial Sequence
  Description of Artificial Sequence: Synthetic coding sequence
atgaacggccccgccgacggcgaggtggactacaagaagaagtacagaaatctgaaaagaaaactgaaatttctgatctacgagcacgagtgctttcaggaagagctcaggaaggctcagagaaagttgctgaaggtgagccgcgacaagtctttcctgttggatcgattgcttcagtatgaaaacgtcgatgaagattcctcagattctgatgcaaccgcatcctcagacaacagcgaaactgagggaacacccaagcttagtgacacacctgcacccaagcgtaagcgctcaccgcctcttggcggcgcaccctccccctcctctctctcgctccctccgtccaccggttttcctctgcaggcaagcggggtgccaagcccatacctgagtagcctggcgagcagtcgttaccctccattccctagcgactaccttgctttacagctgccggaaccctcaccacttaggcctaagcgtgagaaacgcccaaggctgcctcgcaaacttaagatggctgtgggtccgcctgactgccctgtggggggtccgctgaccttcccgggccgcgggtccggggccggcgtgggaactacactcactcccctgcctcctccaaaaatgccccctcccacaattctatcaacagtcccaaggcagatgttctcagacgcaggatccggtgatgacgccttggacggcgatgatgatctggtgattgatattcctgagtag

SEQ ID NO: 19529 - DNA, 2133 bp, Artificial Sequence
  Description of Artificial Sequence: Synthetic coding sequence
atgagcgcccagggcgactgcgagttcctggtgcagcgggcccgggagttagtccctcaggacctgtgggcagctaaagcctggttaataacagcgcggtctctctaccccgccgactttaatatccagtacgagatgtataccatcgagagaaatgctgaaaggacagcgacagccggcaggttactgtacgatatgtttgtcaactttcccgatcaaccggttgtttggcgcgagattagtataatcacaagtgctctgcggaacgatagtcaagataagcagacccagttcctgcgctcccttttcgagaccttgcctggccgggtacagtgtgagatgctcctcaaggtgacggaacaatgtttcaatacactggaaagaagtgaaatgttactgctcttacttagacgatttccagagaccgtggtgcagcacggcgtcggactgggagaagctctgcttgaggccgagactattgaggagcaggagtcacccgtgaattgttttaggaaactgtttgtgtgtgacgtgctgcctctgattattaacaatcatgacgttcgactgcccgccaatctgctatacaagtacctgaataaggctgccgagttctacatcaattatgtcacccgcagcacacagattgaaaatcaacaccagggagcccaggataccagcgacctgatgagtccatccaaaaggagcagccaaaaatatataatcgaagggctgaccgagaagagctctcagatagtggatccctgggagcgattgtttaagatcttaaacgtggtgggaatgcgctgtgaatggcaaatggacaaggggcggagatcttacggcgacatactccacagaatgaaggatctgtgccgttatatgaacaacttcgacagtgaggctcatgctaaatataaaaaccaagtagtctattcaacaatgctggtgttttttaagaacgcgttccagtatgtgaactccatccaaccctcactgtttcagggccctaacgccccgtcccaggtaccactggttctgctggaggacgtgagcaacgtatatggagatgtcgagatagacaggaataaacacatacacaagaagagaaaactggccgaggggagagagaagacgatgtcttcggatgacgaagattgttctgccaaaggccggaacaggcatatcgtggtgaataaggccgaactagccaatagcactgaggtcttagagtcgttcaaactggccagggagagttgggaactgctctacagtctagaatttctggacaaggagtttacgcgaatctgcctcgcgtggaagaccgatacctggctctggctaagaatctttctcacagacatgattatctaccagggccagtataaaaaagcgatcgcgtccctgcaccacttggcagcactccaagggagcataagccagccccaaatcacaggacaaggaacgctagagcatcaacgagccctgattcagttagccacctgccatttcgccctgggcgaatacaggatgacgtgcgagaaggttttggacctcatgtgctacatggtgctccctatccaggacggaggcaaaagccaagaagagccctctaaggtaaagcctaaatttaggaaggggtctgaccttaaactgctaccgtgcacttcaaaggcgatcatgccttactgtctgcacctgatgctggcttgctttaaactgcgggcattcaccgacaaccgcgatgacatggcgcttggacacgtaattgtgctcctgcagcaggagtggccaaggggcgagaacctctttctgaaggctgtgaacaaaatctgccaacagggcaactttcagtacgaaaatttcttcaattacgtgaccaacattgacatgctcgaggagttcgcctatctgcgcacccaggagggtggtaagatccacttggagcttctgcccaaccaagggatgcttatcaagcatcacaccgtgacaagagggatcaccaaaggcgtgaaggaggacttccgacttgcaatggagcggcaggtgtcaaggtgtggggaaaatctgatggtggtactgcatcggttttgcatcaacgaaaaaattctcctgctacagactctgacgtag

SEQ ID NO: 19530 - DNA, 1389 bp, Artificial Sequence
  Description of Artificial Sequence: Synthetic coding sequence
atggccgccaccgtgaacctggagctggaccccatcttcctgaaggcgctaggattccttcattctaaaagcaaagactccgccgaaaaattgaaggccctactggacgaaagcctcgctcgggggatcgactctagctatcgccccagccagaaggacgtcgagcctcccaaaatctcgagcactaagaacatttccatcaagcaggaacccaaaatttcgtccagtctgcccagcgggaacaacaacggaaaagtgcttaccaccgaaaaggtgaagaaggaggcagagaaacgcccggcagacaaaatgaagtctgacattactgagggtgtggatataccaaagaagccccgtcttgaaaagccggagacccagtcctctcccattaccgtccagagttccaaggacctgccgatggccgacctttcatcttttgaggaaactagtgcggatgatttcgctatggagatgggcctggcatgtgtggtgtgtcgtcagatgatggttgctagcggtaatcaactcgttgaatgccaagagtgtcataatctttaccatagagactgccacaaaccccaggtcacagataaggaggccaatgatcccagactggtttggtactgcgcccgctgtacccggcagatgaaacgtatggcccagaaaactcagaagcccccacagaagccggctcccgccgtggtttccgtgaccccagcggtcaaggacccgctggttaaaaagcctgaaaccaagctcaaacaggaaactacttttcttgcattcaagagaactgaggtgaaaactagcaccgtcattagcggcaactcatcttcagctagcgtgtccagttccgtcaccagcggcctgaccgggtgggccgcattcgctgcgaaaacctcatctgctggcccatctaccgccaagctttcctcaacgactcagaataacactggcaagcccgctacttccagcgccaaccagaaaccagtcggccttactgggctggctacttctagcaaaggagggattggctctaagatcgggtccaataattcaacaacccctacagtgccactcaaacccccaccaccactaacactgggtaaaaccggcttgtcccggtccgtatcctgtgataatgtttccaaagttggcctgccgtccccctcatcacttgtgcccggcagctcaagtcagctttccggcaacggtaacagcgggactagcggtccttctggctccactacctccaagacgacatctgaaagctctagtagtccctcagcttctttaaagggtcctacttctcaggaatctcagctgaatgcaatgaaacgactgcaaatggtaaaaaagaaagccgcccagaagaaactaaagaagtag

SEQ ID NO: 19531 - DNA, 1389 bp, Artificial Sequence
  Description of Artificial Sequence: Synthetic coding sequence
atggccgccaccgtgaacctggagctggaccccatcttcctgaaggcattgggatttcttcattctaagtctaaggatagtgccgaaaagttaaaggctctgctggacgagagtctggcccggggaattgacagctcttaccgacccagtcaaaaagacgtcgagcccccgaaaattagctctaccaagaatatttccataaagcaagaaccaaaaatctcaagttccctgcccagcggcaataataacgggaaggtcttaaccacagaaaaagtaaaaaaggaggctgagaaaaggcccgccgacaagatgaaatccgacataactgaaggagtggacattcctaagaagcccaggctggagaaacccgagacccagtctagccccatcacagtgcaatcctccaaagacctccccatggccgacttgtcctcatttgaggagacttctgcagacgacttcgctatggaaatgggcctcgcatgtgtggtctgtcgtcagatgatggtcgcctccggaaaccaactagttgagtgccaggaatgccacaatctctaccacagggattgtcacaaaccacaggtcactgataaggaagcgaatgatcctcgtctggtgtggtactgcgcgcgatgtacaaggcaaatgaaaagaatggcccaaaagacccagaaacccccccaaaagcccgccccagctgtggtctccgtaactccagccgttaaagacccgctcgtgaaaaaacccgagacgaaactcaaacaggaaacgacctttctggctttcaagcggactgaggtgaagacttccaccgtcatttctggcaactcaagtagcgcatctgtgtcctcctcggtaacatcaggactcacaggatgggcagcgtttgcagccaaaaccagtagtgctgggccgtctactgcaaagctgtcatccacgacacaaaacaatactggcaagcctgccacttcatccgccaatcagaagccggtcggcttaaccggattagctaccagctccaaggggggaatcggctccaagattgggtcaaataattcaaccacccccactgtccccctgaaacccccccctcccctgaccctagggaagacaggcctgagcaggagtgtttcatgtgataacgtatctaaagtcgggctcccatctccctcttcactcgtaccgggatcctcttctcaattatctggcaatggcaactccggaacctctggcccaagcggctctacaacatccaagacaacatccgaatcatcttccagcccctctgcttctcttaaaggacccaccagccaggaatcccagttgaatgccatgaaacgtcttcaaatggtaaaaaagaaagccgcacaaaaaaaactcaaaaagtag

SEQ ID NO: 19532 - DNA, 267 bp, Artificial Sequence
  Description of Artificial Sequence: Synthetic coding sequence
atggccgccaccgtgaacctggagctggaccccatcttcctgaaggcactgggctttctgcatagcaagtcaaaagattctgccgagaagctgaaggcccttctggacgaaagcttggcgcgcggcattgattcatcttacagaccctctcagaaagatgttgagccccccaagatatccagtaccaagaacatctccatcaagcaggaaccaaagatcagttcttccttgccctcgggcaacaataatggcaaggttttgacatag

SEQ ID NO: 19533 - DNA, 399 bp, Artificial Sequence
  Description of Artificial Sequence: Synthetic coding sequence
atggccgccaccgtgaacctggagctggaccccatcttcctgaaggctctcggtttcttacactcgaagtccaaggactccgcagaaaaactgaaagctttgctggacgagtctctggctagggggatagactctagctacagacctagtcagaaagacgtagaaccccctaagatctcttctaccaaaaacatatctattaagcaggagccaaagatcagcagcagtctccccagcggcaacaacaatggcaaggtcttgaccaccgagaaggtaaaaaaagaagctgagaaacgccccgccgataagatgaagtcagatattaccgaaggagtggatatcccaaagaagccacggcttgaaaagccagagacccagtcatctccaataactgtgtag

SEQ ID NO: 19534 - DNA, 267 bp, Artificial Sequence
  Description of Artificial Sequence: Synthetic coding sequence
atggccgccaccgtgaacctggagctggaccccatcttcctgaaggccctgggctttctgcattccaagtccaaggacagcgcggagaagctgaaggccctgctggacgaatctttagcccgcggaatcgattcttcttaccggccctcccaaaaggacgtggagcccccgaagatctcatccaccaagaacatctctatcaagcaggaaccgaaaatttctagctctttgccatcaggaaataataacgggaaagtattaacatag

SEQ ID NO: 19535 - DNA, 1389 bp, Artificial Sequence
  Description of Artificial Sequence: Synthetic coding sequence
atggccgccaccgtgaacctggagctggaccccatcttcctgaaggctcttggcttcctgcatagtaagagtaaggatagcgccgagaaactcaaagctctgctggatgagtcactcgcgcgggggatcgatagctcttaccgccctagtcaaaaagacgtggaaccaccgaaaatctcatctaccaagaatatcagcatcaaacaagagccaaagatcagtagctctttaccctcagggaacaataatggcaaggtattgacgactgaaaaagttaagaaagaagccgaaaagaggccagccgacaagatgaaatccgatatcacagaaggagttgatatacccaaaaagccccgcctagagaaaccggagacacagtcctcaccgatcactgtgcagtcaagcaaagatttacctatggctgatctcagctcgttcgaagaaactagtgcggatgattttgccatggagatgggcctggcttgtgtcgtgtgccgacagatgatggtcgcctcaggcaaccaacttgtggaatgccaggaatgccacaacctgtatcacagagactgccataaaccacaggtcacagataaggaggccaatgacccgcgactggtctggtactgtgcccgatgcactaggcagatgaagcgcatggcgcaaaaaacacagaaacccccccagaagcccgctccagctgtggtgtcagtgacccccgccgtaaaggatcctttggttaaaaaacccgaaactaagttgaagcaggagacaacattcctggccttcaagcggacagaagtgaaaacgtccacagttatttccggcaacagttctagcgcctcagttagtagtagcgttacaagtggtctgacaggatgggccgcctttgcagcaaagacatcttctgctgggcctagcacagccaagttgagcagtaccacacaaaacaacaccgggaagccagcaacgtcttcagccaaccaaaaacctgtgggactgactgggctagccacaagcagcaaggggggcatcgggagcaagattggcagcaacaacagcacgaccccgaccgttccactaaagccacctccacctttgactttaggaaagactgggctgtctcgcagcgtgtcatgcgataatgtctctaaggttggactgccatctccgtccagtctggtgcctggatcctcaagtcagctgtccggtaacgggaatagcggcacgtccgggccgagtggcagtactacatcaaagaccacctcagagtcaagcagttcccctagtgcctctctgaaaggacccacgtcccaggagtcccagttgaacgccatgaagcgcctccagatggtcaaaaaaaaggccgctcagaagaaactgaagaagtag

SEQ ID NO: 19536 - DNA, 480 bp, Artificial Sequence
  Description of Artificial Sequence: Synthetic coding sequence
atggccgccaccgtgaacctggagctggaccccatcttcctgaaggcactgggattccttcattctaaaagcaaagactcggctgagaagttaaaagcactgctagatgagtcactggctagaggaattgatagtagttacagaccgagtcagaaagacgtagagcctcccaagatcagcagcaccaagaatatttccataaagcaggagccaaaaatcagctcaagcctgccatccgggaacaacaatggaaaagttctgaccacggagaaggtaaaaaaagaagcagaaaagaggcctgctgacaaaatgaaaagtgatattactgaaggcgtggacatcccgaagaaaccacgcttggagaaacccgaaactcaatcctcgccaatcaccgtacagagcagtaaagatctacccatggcagatttgtcatccttcgaagagacctccgctgatgacttcgccatggagatggggtag

SEQ ID NO: 19537 - DNA, 57 bp, Artificial Sequence
  Description of Artificial Sequence: Synthetic coding sequence
atggccgccaccgtgaacctggagctggaccccatcttcctgaaggctctggggtag

SEQ ID NO: 19538 - DNA, 3129 bp, Artificial Sequence
  Description of Artificial Sequence: Synthetic coding sequence
atggagctgcagaagggcaagggcgccgccgccgccgccgccgcctccggagcagctggggggggaggaggtggggccggggccggcgccccaggtggggggcgcctcctgctctcaacaagtctggatgccaaagatgagttagaagaacgccttgagagatgtatgtcaattgtgacatcaatgaccgctggggtgtctgaacgtgaagccaatgacgctctgaatgcatacgtgtgcaagggcctgcctcagcacgaggagatctgcctagggttatttacgctcatcctcactgaaccagcccaggctcagaagtgctatagagatctggccctagtgtcccgcgatggcatgaacatcgtcttgaacaagatcaaccaaatattgatggagaaataccttaagctgcaggacacatgccgcactcagttagtttggctcgttagggaactggttaaatcaggagtactaggggctgatggtgtctgtatgacattcatgaaacagatcgccggtggtgacgtgactgccaaaaatatttggctagcagaaagcgttctcgacatccttacagaacagcgcgagtgggttttaaaaagctcgatcctgatcgccatggctgtttatacatatctccgcttaattgtggatcaccatgggacagctcagctccaggccctgcggcaaaaagaagtcgatttctgcatcagcctgctgcgggagagattcatggagtgcttgatgatcggcagagatttagttcgcctcctccagaatgtggctagaatccctgagttcgagcttctgtggaaggatatcatacacaacccccaggcgctgtctccgcaatttacgggaattctgcagctcttacagagccggacatcaagaaaattcctggcatgtcgtctgactccagacatggagactaagctgttattcatgacatctagggtgaggtttgggcagcagaaaaggtatcaagattggtttcaacgccagtatctatctactccagatagccaatctctgcgctgcgacctgatacgctatatatgcggtgttgtccacccctcaaatgaagtactatcgtcagatatcctaccacggtgggcaatcatcggctggctgctcaccacatgcacttcaaacgtagccgcctctaacgctaagctggccctgttttatgactggcttttcttttcgcccgacaaagattccattatgaatatagagcctgctatcctcgtgatgcatcacagcatgaaacctcatcccgccattaccgcgacgctgttggatttcatgtgtaggataatccccaacttctacccgcccttagaaggccacgttcgacaaggggtgtttagctcccttaaccatatcgtggagaaacgggtacttgcacatctcgcgccattattcgacaaccctaaactcgataaggaactgcgggctatgctgcgggaaaaatttccagagttctgctcatcaccctcaccgcctgtggaagtcaaaatcgaggaacccgtatcaatggagatggacaaccacatgtctgacaaagacgagtcgtgctacgataatgcggaggctgcctttagtgatgacgaagaggatctgaattcaaagggcaagaagagagagtttagattccatccaattaaagaaaccgtagttgaagagcccgtggacatcaccccctacttggatcagctggatgagtcattgcgcgacaaagtgctccagctgcagaaaggaagcgacacagaggcacagtgcgaagtgatgcaggagattgtcgatcaggtgcttgaggaggacttcgactcagagcagctatcagtactcgcaagctgcctccaggaactatttaaagctcattttaggggggaagttctgcccgaggagattacggaggaaagcctggaggagtctgtaggcaagcccctgtatctgatttttagaaatctctgtcaaatgcaggaggataactcctcttttagtctgctcctcgacctcttgagcgaactttaccaaaagcagccaaaaataggctaccaccttttgtactatttgcgggcatctaaagctgctgccggcaagatgaacttgtatgaaagttttgcacaggccacccaattgggagatctgcacacatgtttgatgatggacatgaaggcttgccaagaagacgacgtgcggctgctgtgtcacctgacaccaagtatttacacagagttccccgacgagaccctgagatcgggggaactcttaaatatgattgtcgccgtgatcgattcagcccagcttcaggaactggtgtgtcacgttatgatggggaatctcgttatgttcagaaaagacagtgtgcttaacattttaatacagtccctggattgggagacttttgagcagtactgcgcgtggcaattattcttggcccacaatatcccactggaaaccatcatccccattctacaacacctaaagtacaaggaacacccagaggctctttcttgcttactgcttcagctgaggcgtgagaagccaagcgaggagatggtcaagatggtcctgagcagaccctgccatcctgacgaccaatttacaacttcaatcctgaggcattggtgcatgaagcacgacgagctgctcgcagaacacattaagagcctactcataaaaaataattctctccctaggaagcgacaatctctacgatcctctagctctaaactggctcagctgacactggaacagatcctggagcacctcgacaatttgaggctgaacttgactaatacaaaacagaactttttcagtcagaccccaatccttcaggccctgcagcatgtgcaagccagttgcgacgaagcacacaaaatgaaattcagcgatttgtttagtctggcagaagaatacgaagacagttccacaaagccccctaagtcaaggaggaaagctgctttgtccagcccccggagtcgcaagaacgccactcagcctcctaacgccgaagaagaaagtgggtccagctcagcctccgaagaagaggacacgaagcccaagccgaccaagcgcaaaaggaaggggagttccgcggtaggctccgattcagattag

SEQ ID NO: 19539 - DNA, 3129 bp, Artificial Sequence
  Description of Artificial Sequence: Synthetic coding sequence
atggagctgcagaagggcaagggcgccgccgccgccgccgccgcctcaggagccgctggcgggggtggcggtggggcaggagccggagcaccaggcggaggcagactcctcctgtctacctccctggacgcaaaagatgagctggaagaacgattggagcggtgcatgtccatcgttacctcaatgacagctggtgtttccgaacgcgaggccaacgacgccttaaatgcttacgtgtgcaagggactgccgcagcatgaagaaatctgtttgggtttgtttactctgatcctaacagaacctgctcaggcccagaagtgctaccgcgacctggccctggtttcacgcgacggcatgaacatcgttctgaataaaatcaaccagattctgatggagaaatacttgaagctgcaggatacatgcagaacacagctggtttggttggtgagggagctggtaaaatctggcgtcctcggcgccgatggggtgtgtatgacattcatgaaacaaattgccggcggagacgtgaccgcaaaaaatatttggctcgccgagtcggtcttggacattctcactgagcagcgggagtgggttctgaagtcctcgattctgatagccatggccgtatatacatacctgagactcattgtagatcaccatgggactgcccaactgcaggctctcaggcagaaagaagtagacttctgcatcagcctcttgcgagagcggttcatggagtgtcttatgattggtcgcgatctggtccgactgctgcagaacgtggcccgaattcccgagtttgaacttctttggaaggatatcattcacaaccctcaagcactttcccctcagttcactggcatcctgcagctcctgcagagtagaacaagtcgaaagttcctcgcatgtagattgactccagatatggagaccaagctgctttttatgacaagtagggtgagatttggccagcagaaaaggtaccaggactggttccagcgccagtatttgtccaccccggactcgcagtcactaaggtgcgatttgattcgctacatttgcggagtggtacatcctagcaatgaggtactgtccagcgacattttacctcggtgggcgataattggatggctgcttaccacttgcacaagcaacgtggcagccagcaacgccaagctcgcactgttctacgattggctgtttttctccccggataaggactccataatgaacatcgaaccagcgatcctggttatgcaccacagcatgaagccacaccccgcaattactgcaacactgctggatttcatgtgcaggattattcccaatttttatcctcccctggagggccacgtgagacagggagtgttttcaagtctcaatcatattgtggagaagagagtcctggcccacctggcccctttatttgataatcctaaactggacaaggaactgagggccatgcttagagagaagtttccagaattctgtagctccccttccccaccagttgaggtgaaaatagaagaacccgtaagtatggagatggataatcatatgagtgacaaggatgagagctgttacgacaacgccgaggcggccttcagtgatgatgaggaagatctgaactcgaagggcaagaaacgcgaattccggtttcaccccattaaggaaacagtggtggaggagcctgttgacatcactccatacctggaccagttggatgaatccttgcgggacaaagtgctacagctgcagaaaggcagtgatacggaagcacagtgcgaagtaatgcaggagatcgttgatcaagtgctcgaggaggacttcgactctgagcagttgtccgtcttggctagctgtctccaagaactgtttaaggcgcactttagaggagaagtcctccctgaggagattaccgaagagtctctggaggagtccgtgggtaaaccactgtacctaattttccggaacctgtgccaaatgcaggaggataatagctctttttcactgctattggatctgctgtcggagttgtaccagaagcagccgaaaatcggttaccatctactgtattacctccgagccagcaaggcagccgctgggaagatgaacttatatgagtcttttgcccaggccacccaactgggagacctacacacctgtttgatgatggacatgaaggcctgtcaggaagatgatgtccgcctcttgtgtcacctgactccttccatttataccgaatttccggatgaaaccctccggtctggagagctccttaacatgatcgtcgcagtgatcgactctgctcagctgcaggagcttgtgtgccatgtcatgatggggaacctggtgatgtttcgaaaggattccgtgctgaatatactcatacagtccctggattgggagacattcgagcaatattgtgcctggcaactcttcctcgcccataatattccgctggaaacgatcattcctatattgcagcacctgaagtacaaagagcaccccgaggcattgagctgtctgctcttgcaactgcgccgggagaagccctctgaggaaatggttaaaatggtgcttagccggccctgtcaccccgacgaccagtttaccacttctatcctgcgccactggtgcatgaaacacgatgagctgcttgccgaacacattaaatccctgctcatcaaaaacaactctcttcccagaaaaaggcagtccttgaggtcatcctccagtaagttggcccaactcaccttagagcaaatcctggaacacttggacaaccttcgcctgaatctcacgaacaccaagcaaaacttttttagccagactccaatactgcaggccttacagcacgtgcaagctagctgtgacgaggcccacaaaatgaaattctctgacctgttcagcctggccgaagagtacgaggacagttccacaaagcccccaaaaagcagaaggaaagcagcgttgtcttccccccgctctaggaagaatgccacacaaccaccgaatgctgaagaggaatccgggtcaagtagcgcatctgaagaggaggataccaaaccaaaaccgaccaaacgaaaacgcaagggaagctctgccgtgggtagcgacagtgattag

SEQ ID NO: 19540 - DNA, 2709 bp, Artificial Sequence
  Description of Artificial Sequence: Synthetic coding sequence
atggccgtgtacacctacctgcggctgatcgtggaccaccacggcacagcccagctgcaagccttgcgacagaaagaagttgacttttgcatctccttgctccgtgagcggttcatggaatgtttgatgataggcagggacctggtgcggctcctgcagaacgtggctcgcatccccgaattcgagctcctttggaaggacattattcacaacccccaagctctgagtccccaattcacaggtattttacaactgctgcagtccaggacctctagaaagttcttggcttgcagactgacaccggacatggagactaagcttctgttcatgacttccagggtcaggtttggacagcaaaaacggtatcaagactggttccaacggcagtatctgtccacacctgattcccaatcactgcggtgtgacctgatccgctatatctgcggagtggtgcatccatcaaacgaagtcctctcttcagatatattgcctcggtgggccatcatagggtggttgctgactacatgtacttcgaatgtagccgcatctaacgctaagctggcgctgttttatgattggctgttcttcagcccagacaaagactcaataatgaatatcgagccagccattctggtgatgcaccactccatgaagcctcacccagccatcacggctacattgttggacttcatgtgcaggattatccccaatttttatcccccactggaggggcatgtgcggcagggggtcttttcttctttaaatcatatagtggagaagcgtgttctggcgcatcttgccccactgttcgacaatccgaaattagataaggaactgcgggctatgctgcgcgaaaagttccctgaattctgtagctccccaagcccacccgtcgaagtgaagattgaggagcctgtgagcatggagatggacaaccatatgtcagataaggatgagtcttgctacgataatgctgaggccgcattctctgacgacgaggaggacctgaattcaaaagggaaaaagcgagagtttagattccatccaattaaagaaactgtagtggaagagcccgttgacatcactccgtatttggaccagctggatgaaagtctcagagataaagtccttcagttgcagaagggaagtgatacggaagctcaatgcgaggtgatgcaggagatagtggaccaggttcttgaagaagacttcgatagcgaacaactctctgtgcttgcctcatgcctgcaggaactgtttaaggctcacttccgcggagaagtgttacccgaggagatcacagaggagagcctcgaggaaagcgtgggcaagcctctgtacctgatctttagaaacttatgccagatgcaggaagacaacagttcttttagtctgctactggacctgctaagcgaattgtatcagaagcagcccaagattggctaccacctcttgtattacttaagggcctcaaaagccgccgcgggaaagatgaacctttacgaatctttcgcccaggcaactcagctaggcgacttgcacacgtgccttatgatggacatgaaagcttgtcaggaagacgacgtgcggttgctgtgtcatttgactcctagtatttatacggaattccccgacgaaactcttaggtccggtgaacttctgaatatgattgtagcagtgatcgacagtgcgcaactacaagaactggtgtgccatgtgatgatgggaaatctggtcatgtttagaaaagactccgtgctgaatatactcatccagagtttggactgggaaacgttcgagcaatactgtgcatggcagttattccttgcacataacatccctctggaaacaataatccctatactgcagcaccttaaatacaaagaacaccctgaagctctcagctgtctgctcctgcaattaagaagagaaaagcccagcgaggagatggttaagatggtcttatcccgcccatgccaccccgacgatcaatttaccacatccatcctgcgacattggtgtatgaaacacgatgaacttctggcagagcatatcaagtcactgttgattaagaacaactcccttcctcgcaaacggcaaagcctcagaagctcgtctagcaaactcgctcagttaacgttggagcagatactggaacacctggataacttgagactcaatctgacgaataccaaacagaattgtatgccttctacgttaggcgtacagtgtaggagatgctgtccaggcccagactacgcctggagtcaggccggcggtcgtggacgcacgcctggagcgaccactcacacaagagataagactacatgtgcctgttgcctcatatcatcccagacatccgattgcttttcctttccagccctaccctttcttccgttggtgttctcacaaactcccattcttcaggccctgcagcacgttcaggcctcctgtgatgaggcgcacaaaatgaaattcagcgacctgttttccctggctgaggagtatgaggatagctccactaaaccgcctaaatctaggaggaaagccgccttgtcatcccctcgatccagaaagaatgcaacacaacccccgaatgcagaggaggagtcaggctcttcctctgcgagcgaggaggaggacacaaagcccaagccgacaaaaaggaagcggaaaggctcttctgccgttggctctgacagcgattag

SEQ ID NO: 19541 - DNA, 2709 bp, Artificial Sequence
  Description of Artificial Sequence: Synthetic coding sequence
atggccgtgtacacctacctgcggctgatcgtggaccaccacggcacggctcagctccaggctctcagacagaaggaggtggacttttgcataagtctccttagagagcggtttatggaatgcttgatgatcgggagggacctcgtcagactgctccagaacgttgcacggattcctgaatttgaattactgtggaaggatatcatacataatccccaggcactgagcccccaatttaccgggattctgcagttactgcagagccgcacaagcagaaagttcctcgcctgtaggttaacccctgacatggagaccaagctgttattcatgactagtcgcgttcggttcggtcaacagaagcggtaccaagactggttccagcgacagtatctgagcacaccagactcccagagcctaaggtgcgatttaatccgctacatctgcggcgttgtgcatccatccaatgaagtgctttcttctgacattctacccagatgggctattattggatggctgttaaccacttgtacctccaacgtagcggcctccaacgctaagctggccctgttctatgactggctatttttttctcccgataaggacagcattatgaatatcgaaccagcaattctggttatgcatcatagtatgaaacctcaccccgccatcacggccaccctgttagacttcatgtgtcgcattatcccgaatttttaccctcccctggagggccacgtgagacagggcgtgttctcatctctcaaccatatcgtcgaaaaaagagtgttggcccatttagccccactcttcgacaatcccaaattggataaagagctgcgagctatgcttagagaaaaatttccagagttctgttcaagcccaagcccccccgtcgaggttaaaattgaggagccagtgtccatggaaatggacaaccatatgagcgacaaagacgaaagttgctacgacaatgccgaggcagcattctcagatgacgaagaagacttgaacagtaaaggcaagaagcgcgagtttcggtttcatcctatcaaggagaccgtggtggaggaacccgtggatatcaccccttaccttgatcagctagacgaaagtctgagggataaggtgctgcagttgcagaagggctcggacacagaggctcagtgcgaggtgatgcaggaaatcgtggatcaggtcctggaggaagactttgacagtgaacagttatcggtgctggccagttgtttacaagaactgttcaaggctcactttcggggggaggtcctcccggaagaaattaccgaggagagcttggaggagagcgtggggaaacctttgtatctgatctttcggaatttgtgtcagatgcaggaggataatagtagcttctcactgttactggacttactctccgaactctaccagaagcagccaaaaatcggctaccacctgctttattacctgcgggcctctaaggcagccgcaggcaagatgaatctgtacgagtctttcgctcaagccacccagttaggggatctccatacttgtttgatgatggacatgaaggcctgccaggaagacgatgtccgtctcctatgccatttgaccccctcaatctacactgagttcccagacgagactcttaggtcaggggaactgctgaatatgatagtcgcggtcatcgactctgctcaactgcaggagctggtgtgccacgtcatgatgggaaatctggtcatgtttcggaaggatagtgtgttaaacatcttgatacagtctttggactgggaaacctttgaacagtactgcgcttggcaactgttcctcgctcataacatccccctcgagaccatcattcccattcttcagcacttaaaatacaaagagcaccctgaggcactgtcatgcttactactgcagctgcgacgcgaaaagccgagtgaggaaatggtcaaaatggtcctatcccggccatgccatcctgatgatcagttcactacatcaatactccgccactggtgcatgaaacacgatgaactgttagcggagcacatcaaatctctgctcattaaaaacaactctctgcctagaaagaggcaaagcctgcgaagcagtagtagcaagctagcacaactcaccctcgagcagattctcgaacacctggataacctgcggctgaacctcaccaacaccaaacaaaactgcatgccctctaccctaggagtacagtgtagacggtgctgccccggcccagactatgcctggagccaggccggcggccgaggccgaacccccggcgctacaacccacacaagagacaaaacaacatgtgcatgctgcctcatcagctctcagacttcggactgtttcagtttccccgcactccctttcctgccactggttttctcacagacacctattcttcaagccctgcagcacgtgcaggcctcctgcgacgaggcccacaagatgaagtttagcgatctgtttagcctggcagaggaatatgaagacagctccaccaagccaccaaaatccagacgaaaggccgctctgtccagtccacggagtcgaaaaaatgctactcagccacccaacgctgaggaagagtcaggatcgtccagcgcatcggaggaagaggacaccaagccgaaacccaccaagagaaaaagaaaaggttccagtgccgtagggtccgactcggactag

SEQ ID NO: 19542 - DNA, 1530 bp, Artificial Sequence
  Description of Artificial Sequence: Synthetic coding sequence
cccaacagcatctgccggcacctgcacctgaccgacaccagccacggggttaggaacaaatgtctccagctcttgggtaacttaggctctctggagaagagtgtcactaaggatgctgaaggccttgccgccagggacgtccaaaagatcatcggtgattacttttccgaccaggacccccgcgtgcgtaccgccgctatcaaagcgatgctgcagctgcacgaacgggggctcaagctgcaccagaccatatataaccaggcgtgtaaacttctgagcgatgactacgaacaggtgaggtctgcagctgtgcagttaatttgggttgtgtcacagctgtatcccgaatcaattgtaccaatccccagtagcaacgaggaaatccgattagtggacgacgcctttggcaagatttgccacatggtgagcgatggatcttgggtggtcagggtgcaggccgccaaactcctgggcagcatggaacaggtgtcatcccattttctggaacaaactttggataaaaaactgatgtccgacctgaggcgaaagcggacagcacatgaacgagccaaagaattatacagttcgggggagttcagctctggcagaaagtggggcgacgacgctcccaaagaggaagttgataccggtgcagtgaatctcatcgaatctggagcttgtggagcgttcgtgcatggacttgaggatgagatgtacgaggtacgaatcgctgccgtggaagctctgtgcatgctggcacagtcctccccatcgttcgctgagaaatgcttagacttcttggtcgacatgttcaatgatgaaatcgaggaggtgaggctgcaatctattcacaccatgagaaaaatctcaaacaatataacgctcagagaggaccagctggatacagtcctcgcagttctggaagactcttctagggacatccgagaggccttgcatgaactgctgtgctgtacgaatgtttcaacaaaggagggtattcatttggccctggtcgaactgctgaagaacttaacgaagtaccctaccgatcgcgacagcatctggaagtgcctgaaattcctaggaagtcggcaccccacgctagtgctcccactagtgcctgagctgctctccacccatccttttttcgacactgccgagcccgacatggatgacccagcttatatcgcagtcttggtgctcatttttaatgccgcaaagacatgcccaacgatgccagccctctttagcgatcacaccttccggcactacgcatatctgagagactcactctcacacttggtgccagcattgaggctgcctggccggaaattggtaagcagtgccgtaagcccaagtatcatccctcaggaggaccctagccagcaattcctccagcaatcgctggagagagtgtactccctccagcatctcgacccacagggagcccaggagctgttggaattcactattagagtggaggtgtcaccttggtggcctgggtggagccagacccccgagcttaaatag

SEQ ID NO: 19543 - DNA, 2892 bp, Artificial Sequence
  Description of Artificial Sequence: Synthetic coding sequence
atggccgcccacctgaagaagcgggtgtacgaggagttcaccaaggtcgtccagccacaggaggaaattgcaaccaagaagttaagacttactaaaccctcgaagtcagcggccctgcacatcgacctgtgtaaggctacaagcccagctgacgctctccagtatctgctgcagtttgctagaaagccagtggaagctgagtcggtcgagggagttgtgcgaattctcttagagcattactacaaggaaaatgacccgagcgttagactaaaaatagcctccctactgggactcctcagcaaaactgctggcttctcaccggactgtatcatggatgatgctatcaacattctgcagaacgaaaaaagccaccaggttctcgcccagttgctggacactctcttggcaattggcaccaaattaccagaaaatcaggctatccaaatgaggcttgtggatgtggcctgcaagcacctgaccgacacctcccacggggtgaggaataagtgcctccagctgttaggcaaccttggcagcctggagaaatcagttaccaaggatgccgaaggcctggccgcccgcgacgtgcaaaaaatcataggcgactacttttcagaccaagaccccagggtgcgtacagccgctattaaagccatgctccagctgcacgaacgaggcttaaagctgcaccagactatctataaccaggcctgtaaactcttgtctgatgattatgaacaggtgcgctcagctgcagttcaactcatatgggtggtgagtcagttgtatcccgaaagtatagtacctatcccctctagcaacgaggaaattcgtctggtggatgacgcattcgggaaaatctgtcatatggtcagcgatgggtcctgggtggtccgcgtgcaggctgccaagttgctgggctccatggaacaagttagcagtcactttttagaacaaactttggataaaaagctgatgtctgatttgcgcagaaaacggactgcccatgagcgcgcaaaggagctgtactcctccggagagttctcctcaggccgcaagtggggtgacgacgctcctaaggaggaagtggatacaggggctgtaaatctcatagagagcggagcatgtggggccttcgtgcacggactggaggatgaaatgtatgaggtgcgaatcgcagccgtggaagccctctgcatgctggcgcaatcgagccccagctttgcagagaagtgtttggacttcctcgtggatatgttcaacgacgaaatagaggaggtcaggctgcagagcatccacacaatgagaaaaattagtaataatatcacgttacgggaggaccagttggacactgttttggctgtattagaagactctagtcgcgacatacgagaggcactacacgaacttctatgttgcaccaatgtctcgacaaaagaagggattcacttggcactggttgagctgctgaaaaacttaaccaagtatcctaccgatagagattctatatggaagtgtttgaaattccttggcagtaggcatcccactctggtgctgcctttggtacccgagctactatccacgcacccattctttgatacggcagaaccggatatggacgaccctgcatatatagctgtcctggttctgatctttaatgctgctaagacttgcccgacgatgcctgcacttttcagcgatcacacttttaggcattacgcgtatctgcgggatagcctcagccaccttgtgccagccctgaggctgccaggccgaaaacttgtgtccagcgctgtgtcccccagcattataccccaggaggacccgagccagcagttcttgcagcagagcttggaaagggtatatagccttcaacatctggatccacaaggggcccaagaactcctggaatttaccattagggacctccagaggttaggggaactgcagagtgaacttgcgggagtcgctgactttagcgcgacttatttaagatgccagctattgctgattaaagcattacaggagaaactctggaacgtggccgctcccctgtatctgaaacagagtgatctggcctctgcggccgcaaagcagatcatggaagagacatataaaatggagtttatgtatagcggggtggagaataagcaggttgtaattatccaccacatgagactacaggccaaagccttgcagttgattgtcacggccaggactactcgtggtctggaccccctgtttgggatgtgcgagaaatttttgcaagaggtagatttctttcagcgctacttcatagcagacctgccacatttacaggacagctttgttgataagctattggacttaatgccaagactgatgactagcaaaccagcagaagtggtgaaaattttgcaaacaatgctcaggcaatccgcttttttacatctgcccttaccagagcagatccacaaggcatcagccactattatcgaacctgcaggcgaaagtgacaacccactccggtttacatccggtctcgtggtagctctcgacgtggacgctacactggaacatgtccaggacccccaaaacaccgtgaaggtgcaggttctatacccagatggccaggcgcagatgatccatcctaaaccagccgacttccggaatccaggtcccggcaggcaccggctgatcactcaggtttacctaagccacaccgcgtggaccgaagcctgtcaggtggaagtgaggctactcttggcttacaactccagtgcccggataccaaaatgtccctggatggaggggggagaaatgagtcctcaggtagaaacttccattgaaggaaccattccattctcgaaacctgttaaagtgtacatcatgcctaagcctgcgcgtagatag

SEQ ID NO: 19544 - DNA, 1017 bp, Artificial Sequence
  Description of Artificial Sequence: Synthetic coding sequence
atgcccgccctgaagcagaccgccagccaggtgacccagaccctgcgcgatctacaacgacttggcgagttacagtctgagctggccggcgttgcagactttagtgccacctacttaaggtgccagttgctgcttatcaaggcgctccaggagaagctctggaatgtagcagcccctttgtatttaaaacagagcgacttggcatccgccgccgccaaacagatcatggaagagacgtataagatggaatttatgtactctggagtggagaacaaacaagtcgtgattattcaccacatgcggctccaagctaaagccctccaactgattgttacagctaggaccacgcgcggcttagaccctctgttcgggatgtgtgagaagttcctgcaagaagtggatttctttcagcgatatttcatcgcagacttaccccatctacaggacagttttgtggacaagctgctggatctcatgcccaggctgatgacctcgaaacctgcagaggtggtgaaaatcctgcaaactatgctgcgtcagtccgctttcctgcatctgcctctcccagaacagatccacaaagcatcggctaccatcattgagccagccggcgagtccgacaacccacttcgtttcacatccggcctggtggtggctttagacgtggatgcaaccctggagcacgttcaggatccccagaataccgttaaggttcaggtactgtacccggacggccaggcccagatgattcaccctaagccggccgacttccggaaccctggcccggggcgacatcgcttaatcacccaggtgtaccttagtcatactgcctggactgaagcctgtcaggtggaggtccgcctgctgctggcgtacaatagctcagcaagaatacctaaatgtccgtggatggaaggaggcgagatgtcgccacaagtcgaaacctcgatagagggcaccataccctttagcaaaccagtgaaagtatatataatgcctaagcctgcccgacgctag

SEQ ID NO: 19545 - DNA, 2829 bp, Artificial Sequence
  Description of Artificial Sequence: Synthetic coding sequence
atggccagcaacagcaccaagagcttcctggccgacgccggctacggcgagcaggagcttgacgcgaacagcgcccttatggagttggataaggggttgagatcaggcaagttgggcgaacagtgtgaggcggtggtgcgctttccgcggctgttccagaagtatcctttccccatcctaatcaacagtgcgttccttaagctggcagacgtgtttcgtgttggaaataacttcttacggctctgcgtgttaaaagtgacccagcagtcagaaaaacacctggagaaaatcctgaacgtagacgagttcgtcaaacgtatattctccgtgatccactcaaacgacccagtggccagagccatcaccctcaggatgctgggcagcctggcaagtataatccctgagcggaagaacgcacatcatagcattcgacagagtttggattcacatgacaacgtggaagtggaagcagccgtcttcgccgctgctaatttctcagcacagagcaaggacttcgctgttggtatctgcaataagatctcagaaatgatccaggggctggcaactcccgtcgacctcaagctcaaactgatcccaatcctccaacatatgcatcacgatgctatcctggccagcagcgctaggcagttgctccagcagctggtgacgtcctatccaagtaccaaaatggtgattgtgagtcttcatacctttacacttctggccgcgagctcactggtcgatacacctaagcagatccaattgctgcttcagtacctcaagaacgacccgcggaaagcggttaaaagactggccattcaggacctgaagttactcgccaacaaaacccctcacacctggtctcgagagaacattcaggctctatgcgagtgtgccttgcagaccccctatgactctctgaaattaggaatgctgagcgtcttgagcaccctgtcagggacgatagctattaagcactatttttccatagtgcctggcaacgtgtctagctctccacggtcctcagaccttgtgaaactggcccaagagtgctgctatcacaataatcggggtatcgcggcgcatggagtacgggtgttaacaaatattactgtctcttgtcaggaaaaggacctccttgccctggagcaggacgctgtatttggactcgagtctctattagttctctgctcccaggacgatagccctggcgctcaagccaccctgaagatcgcccttaactgtatggttaaactggcaaaaggcaggcctcacctgtcccagagcgtggtagagacgctcctgactcaactacactccgcacaggacgctgcacggatcctaatgtgtcactgtttagccgccattgcaatgcagctgccagtccttggcgacggcatgcttggggacctaatggaactgtataaggtaatcggccgctccgcaacggataaacagcaggagctgctcgtatcactggccaccgtgatcttcgtggcctcccagaaggcactgagtgtagaatctaaggcagttattaagcagcaattagagagtgtgtccaatggctggaccgtgtaccggattgctcgccaagcttcaagaatggggaatcacgacatggctaaagagctctaccagtctctcctgacgcaagtcgctagcgagcacttctatttttggttgaactccctcaaagagttcagccacgccgaacagtgcttgaccggcctacaggaggaaaattatagctcagctctgtcttgcatcgccgaatccttaaaattctaccacaaaggtatcgcctctctgaccgcagcctctacacccctcaacccactgtcattccagtgcgagttcgtgaagctaaggattgacctattacaggccttctcacagttaatctgcacatgcaacagccttaagactagccccccaccagctatagccaccaccatagctatgacccttggcaatgatcttcagagatgcggccgcatctctaatcagatgaagcagtctatggaagaattcaggagtctggcgtcacggtacggggatctctatcaggctagcttcgatgcagactctgcgactcttagaaacgtggaactgcagcagcagagctgtctgctcatcagccatgcgatcgaagcccttatcctggacccggagtctgcatctttccaggagtacggaagtactggtactgcccacgctgactctgagtatgagagaagaatgatgagtgtctacaaccatgtgctggaagaagttgaatctttgaataggaagtacacccccgtttcctatatgaggtacttttttcagaagttgcagtctaccagtatcaaattggctctgagtccatccccccgcaatcctgccgaacctatcgcggtacaaaataaccagcagctcgctcttaaggttgagggagtggtgcagcatggcagcaagcccggcttattccgtaaaattcagtccgtatgcctaaacgtctcatcgaccctccagtcaaaaagcggccaagattataagatccccatcgataatatgaccaatgagatggaacagagagtggaaccgcacaacgactacttttccacccaatttttattgaattttgctatcctgggcacccataatatcaccgttgagtcatccgtgaaagacgccaatggcattgtgtggaagacagggccgaggaccacaattttcgtgaaatcgctcgaggatccatactcccagcagatccgcctccagcagcagcaagcgcagcaaccattacagcagcagcagcaacgcaacgcgtacacaagattctag

SEQ ID NO: 19546 - DNA, 2847 bp, Artificial Sequence
  Description of Artificial Sequence: Synthetic coding sequence
atggccagcaacagcaccaagagcttcctggccgacgccggctacggagagcaggagttggacgcgaacagcgctcttatggaactggataaggggttgcgtagcggcaagctcggcgagcagtgtgaggccgtcgtgaggttcccccgcttatttcaaaagtaccctttccctatcctgatcaattctgcttttctcaagctagccgatgtgttcagagtaggcaacaacttcctgagactatgtgttctcaaggtgacacagcaatcagagaaacatctcgaaaaaatactgaatgtggacgagtttgtcaagagaattttttccgtgatccactcaaatgacccagtcgcacgagcaatcacgttacggatgcttggaagtttagcgagcatcatccctgagagaaaaaatgcacatcacagtatcaggcaatccttggattcccacgacaatgtggaggttgaggcggcagtgttcgcagcagcaaacttttcagcccaatctaaagatttcgctgtgggtatctgtaacaaaataagcgagatgatccaaggtctggctactccagtcgaccttaagcttaagttaattccaatcctgcagcacatgcaccacgacgcaatactagcaagcagtgctcgccaacttttgcagcagctcgtcacgtcgtacccttcgaccaagatggtgattgtgtcccttcatacattcaccttactcgcagctagctctttggttgacacacctaagcagattcagttgctgctgcagtatctgaagaatgacccgcggaaagcagttaagcggctagccatccaggatctcaagctgctggctaataagacacctcacacctggagccgcgaaaacatccaggctctgtgtgagtgcgccctgcaaaccccttatgactcattgaagctggggatgttgtcggtcctttcaaccctgagcgggacgatcgccataaaacattatttttcaatagtgcctggaaatgtgtcttcctcccctcgatctagcgacctggtcaagcttgcgcaggaatgttgctatcacaataatagaggaatcgccgctcacggtgttagggtgctcaccaatattaccgtgtcctgccaggagaaggatctgttggcactcgagcaagacgccgtgtttggcctggagtctcttttggtgctgtgttcacaggacgattctcccggggcccaggccactctgaagatcgcactgaactgtatggtgaagctggctaagggaagaccacatcttagccagagcgtggtagaaacactcttgactcagctccacagcgctcaggatgcagcgagaattctgatgtgccactgtttagcggcgatcgctatgcaactgccagtactgggagacgggatgctcggtgacctcatggagctgtacaaggttattggcagaagcgctactgataaacagcaagaactgttggtcagccttgctaccgtgatttttgtagccagccagaaagcgctgtcagtggagtccaaagccgtaataaaacagcagcttgaatcggtctccaacggctggacagtctacagaatcgctcgtcaagcttccaggatggggaaccatgatatggcaaaagaactctaccagtcactacttacccaggtcgcgtctgagcacttttacttctggcttaatagtttaaaagagtttagccacgccgagcagtgtttgacaggccttcaggaggagaactactcaagcgccttatcatgtatagccgagagcctaaagttttaccataaagggatagccagcctcacagcagcaagcactcctctgaaccccttatcatttcagtgcgagtttgtgaaactcagaatagacctgctgcaagccttctctcagcttatttgtacgtgtaacagtctgaaaacatccccacccccagcaatcgccacaaccatcgcaatgactcttggaaatgatctgcagaggtgcggccggatcagtaaccagatgaagcaaagcatggaggagttcaggtccttagcttcgaggtatggggacctgtatcaggcctccttcgacgcggacagtgccacactgaggaatgtggagctgcagcagcagtcatgcttacttatcagccacgctattgaggctttaatcctcgaccccgaatccgcctcattccaggaatatgggagtacaggcaccgctcacgcggatagcgagtatgaacgtcggatgatgtcagtgtacaaccatgtgctggaggaacacactgcctgcctatgtaacgccatcattgcattactgaaggttcccctgtcctttcaacgctatttctttcagaaacttcaaagcacttccattaagctcgcgctttcacctagccccagaaacccagccgaaccaatcgcagtccaaaacaatcagcagctggcccttaaggtcgagggggtggtccagcatgggtcgaagcctggtctctttaggaagatccagagcgtgtgcctaaacgtaagctctacgcttcagagcaaatccgggcaggattataagatcccaatagacaacatgaccaacgagatggagcaacgggtggagccccacaatgattacttctcaacacagtttcttctgaacttcgccatcctgggcacccataacattaccgtggagagctcagtcaaggatgccaacggcatagtatggaagacaggaccgcgtaccacaattttcgttaagagtctggaagacccatattcgcaacagattagacttcagcaacagcaggctcagcagcccctgcaacaacagcagcagcgtaatgcgtatactcgcttctag

SEQ ID NO: 19547 - DNA, 2889 bp, Artificial Sequence
  Description of Artificial Sequence: Synthetic coding sequence
atggccagcaacagcaccaagagcttcctggccgacgccggctacggtgagcaggagctggatgctaattctgctttgatggaactggataaaggactgcgatcaggcaagctgggagaacagtgtgaagccgtcgtgcgcttcccacggttgtttcaaaaatacccattccccatcctcattaattcggcattccttaaactcgctgatgtctttcgcgtgggtaataacttcctgaggctgtgtgttcttaaggtgacccaacagtcagagaaacatctcgagaagatcctcaatgtggatgagtttgttaaaagaatattcagcgtgatccactccaatgatcccgttgcacgagccatcacgctgagaatgttggggtccttggccagcatcatccctgagcgtaagaatgcacatcattctattcgccagagtctagactcacatgataatgtggaggtcgaggccgccgttttcgcagcagctaacttctctgcacagtccaaggatttcgcagtgggtatctgtaacaagatctctgaaatgatccaggggctggcgaccccggtggatctaaagctgaagctgattcccattttgcagcatatgcaccatgacgccatcctcgcgagctctgcacggcagttactccaacagctcgtcacctcttatccttccaccaagatggtaatcgtgtcgcttcatacttttacactgttggctgcctcctctctggtcgacacacccaagcagatacagctcctgctacagtatcttaagaacgacccaaggaaggctgttaagaggcttgctattcaggacttgaagttactcgctaacaaaacccctcatacttggagcagagaaaatattcaggccctgtgcgaatgcgctctccagactccgtatgattcactgaaactggggatgctctctgtgttaagtactctatctggtacaatcgctatcaagcactatttcagcattgtgccgggtaacgtatcatcctctcccagatcctctgatttagtgaaattggcccaggagtgctgctatcacaacaataggggaatcgctgcgcacggcgtacgggtgctcacaaacataaccgtctcgtgtcaagagaaggatctgcttgccctggaacaggacgctgtatttggcctggaatcactacttgttctctgtagccaggatgactcccctggtgcccaggctactcttaagatcgcccttaactgcatggtgaaactggccaaagggcggccacacctgagccagtccgtggtggagaccctcttgacccagttgcatagcgcccaggatgcggccagaatcctcatgtgtcattgcctagccgcaatagccatgcaactgcctgtgttaggggatggaatgctgggagatttaatggagctttacaaggttattggcagaagcgctacagacaagcaacaggagcttcttgtcagccttgctactgtgatcttcgtggctagtcagaaggccctgagtgtcgaatctaaggctgtcatcaagcagcagctcgaatccgtgagcaatgggtggacggtgtacaggattgctcggcaggcaagccgtatgggcaatcacgatatggcaaaggaactttatcagtccctgttaacccaggtcgcttctgagcacttctacttctggctcaactcattgaaggagttcagccatgcagaacaatgtctgacaggattacaggaagagaactactcctctgctctttcctgcatcgcggaatcgcttaaattctaccacaaaggcattgcgagcctgacggccgcaagtaccccactgaaccccctgtcctttcaatgtgaatttgtcaaactgagaattgatctgttgcaggccttcagccagctgatctgtacatgtaacagcctaaaaacgagccctcctcccgcgatcgcaacgaccatagccatgaccctgggcaatgatctccagagatgtggccggatatccaatcagatgaaacagtccatggaggaatttcggtccctggcctcgcgctatggagacctgtaccaggcctcttttgacgctgactccgctacccttagaaacgtggagttgcaacagcagagctgcctgctcatttctcacgctatcgaggcattaatcctggatccagagagcgccagctttcaggaatacggaagtactggtacagcacatgccgattcagagtatgaacggcgcatgatgagcgtctataatcatgttcttgaggaggtggagtcgctgaacaggaaatatacaccagtctcatatatgcacaccgcctgtctgtgtaatgcgataatcgcgttacttaaagtacccctgagctttcagcgatattttttccagaaactccagtcaacttccattaaattagctctgagccctagccctcggaacccagcagaacctatcgccgttcagaataatcaacagctggccctgaaggtggagggcgtggtgcagcacggcagcaaacccgggttgtttaggaagattcagtctgtctgcctgaacgtgtcatcgacactgcaaagcaagagtggacaggactataagatccctattgacaacatgactaacgagatggagcagagggtggaaccacacaacgattatttttctacacaatttctgcttaactttgctatactggggacacataacatcaccgttgagagctctgtgaaggacgcaaatggaatcgtctggaaaactggcccgagaaccacaatatttgtcaaaagcctggaggatccgtactctcagcagatacgcctgcaacagcaacaagcgcagcaacctttgcagcagcaacagcaacggaacgcctatacccggttttag

SEQ ID NO: 19548 - DNA, 2742 bp, Artificial Sequence
  Description of Artificial Sequence: Synthetic coding sequence
atggccagcaacagcaccaagagcttcctggccgacgccggctacggtgagcaggaactggatgctaattctgctctgatggagctggacaaaggactccgcagcggcaagcttggcgagcagtgtgaggccgtcgttagatttccaaggctgttccaaaagtacccatttcccatcctcatcaacagcgcctttctaaagcttgctgatgtgtttcgagtgggaatgctgggcagcttggccagtattatccccgaaaggaaaaacgctcatcacagcattaggcaaagtctagacagccatgataatgtagaggttgaagcagctgtcttcgcagcggccaattttagcgcccaatccaaagacttcgcagttggcatctgtaataagatcagtgaaatgatccagggtctggcaactcctgtggacttaaagctgaaactgatccccattttgcagcacatgcaccacgacgccatactggctagctcagcacgccaattactgcaacagctggtgacgagctaccccagcacaaaaatggtgatagtgtctctacatacgttcaccctgttggctgcttcatcattagtggacactcctaaacagattcaactgttattacagtaccttaaaaatgatcccaggaaggctgtgaagaggctggccattcaggacctgaagctgctagctaacaaaacacctcatacatggtccagagaaaatatccaagctctgtgcgaatgcgcactgcagacgccatacgactcgttgaaactgggcatgctcagcgttctaagcaccctaagcggaaccattgcgattaagcattatttctccattgttcccggaaacgtgtcttcttcacctagatcctccgatctagtgaaactggcacaagagtgctgttatcataataatcgcgggatcgctgcgcacggcgtccgcgtgttgacaaacataactgtctcatgtcaggagaaggacctgctggcactcgagcaggacgcagtgttcggtttagagagcctgttagtgctgtgtagccaggacgattccccaggggcgcaggcaactcttaaaattgcccttaactgcatggtgaaactcgcaaaaggccgtccgcacctctctcagagtgttgttgaaacactgcttacccagttacactccgcccaggacgcagcacgaatcttgatgtgccactgtttggccgccatcgccatgcagttgcccgtgttgggggacgggatgttaggggacctgatggaactgtacaaggttattggtcggagcgcaactgataaacagcaggagctcctggtatcactggccaccgtgatattcgtggcgagccagaaagccctgtccgtggagtccaaggcagtgatcaagcagcagctggaatccgtttcgaacgggtggacggtttaccgcatcgcgaggcaggcatcgcggatgggaaaccacgacatggccaaggaactgtaccagagcctgctgacgcaggtcgcaagtgaacacttttacttctggcttaattcactgaaggaattctctcacgcagaacagtgtctgactggcttgcaagaggaaaactattcttctgctttatcttgcatcgcagaatcgctaaagttttatcacaaagggatagccagtctcacggctgctagtactccactaaatcccctctcttttcaatgtgagttcgtgaaacttcgaattgacctgctgcaagcattttcacagctgatatgcacttgtaattccctcaaaacttcacctcccccagcaattgccaccacgatcgccatgacgctcggaaacgatctccagcgttgcgggaggatcagtaaccagatgaaacagtccatggaggaatttagatccttagcatcaagatacggcgatctgtaccaggcgtcgtttgacgcagactctgctacactgcgaaatgtcgagctccagcaacagagctgcctcctcattagtcacgccattgaagcccttatcctagatcctgaatcggcgagctttcaggagtacggctctacagggaccgctcacgctgattccgagtacgagaggaggatgatgtctgtgtataatcatgttcttgaagaagttgagagcctgaaccgtaaatacacaccagtaagttatatgcacaccgcatgcctctgtaacgccattatcgccctactcaaggtgcccctgagcttccaacggtatttctttcaaaagctccagagcactagtattaagctggcccttagtcctagcccacgaaatccagcagaaccaatcgctgtccaaaataatcagcagctcgcgttaaaagtggagggagttgtacagcatggctccaagccaggcctgttccgaaaaattcagtccgtgtgcctgaatgtctcatccaccctgcagtcaaagtcagggcaggactacaagatccccattgataacatgactaatgagatggaacagcgggtcgaaccacataacgattatttttccacacagttcctgctgaatttcgcaatcctgggaactcacaatatcaccgtggaatcctccgtgaaggacgccaacggtattgtctggaagacaggtcccagaacaaccattttcgtcaagtctctcgaagacccttactcccagcagattcgtcttcagcagcagcaggcccagcagccattgcagcagcagcagcagcgaaatgcatacacacgcttttag

SEQ ID NO: 19549 - DNA, 2937 bp, Artificial Sequence
  Description of Artificial Sequence: Synthetic coding sequence
atgagcgccgaggccgccgaccgggaggccgccaccagcagccggccatgtacaccccctcagacttgctggttcgagttcctactcgaggagtctctcctggaaaagcatctccgcaaaccctgcccagaccccgcccccgtgcagctaatagtccagttcctagaacaggcaagcaaaccctcggtgaatgaacagaatcaggtgcagccacctccggacaacaaacgtaaccggatcctgaagctgctggcccttaaagttgccgcccatctcaagtgggacctggatattttagaaaaatctctctcggtcccagtcttgaacatgctcctcaacgaactgctgtgcatcagtaaagtgccaccaggcacaaagcacgtagacatggacttagctactcttccaccaacaaccgccatggctgtattgctttacaatcgctgggccatacggactattgtgcaaagtagcttcccagtgaaacaggcaaagccagggccacctcagctgagcgtcatgaatcagatgcagcaggaaaaagagctgacagaaaatatactgaaagttctgaaggagcaggccgccgacagcatcctcgtcctggaagctgccctaaaattaaacaaagacctctacgtgcatacaatgcggaccctagatctgctggccatggagccgggcatggtgaatggagaaactgagtcatcaactgctggcttaaaggtaaagacagaagaaatgcaatgtcaggtctgttatgacttgggagcagcttatttccaacagggaagtactaatagtgccgtatacgaaaacgcccgggagaaattttttcgcaccaaggaacttatagccgaaataggtagtctatctcttcactgcaccattgacgagaaacggctcgcggggtactgccaagcttgtgatgtgcttgtcccatcctccgattcgactagccagcagctgaccccttactcccaggtccacatatgccttagatccggcaattaccaggaggtcatccagatcttcattgaggataacttaacattaagcctgcccgtccagttccggcagtccgtcttgcgcgaactgtttaagaaagcacagcagggaaacgaggcactggatgaaatatgttttaaggtctgcgcctgtaataccgtgagagatatcctggagggaagaacgattagcgtgcagttcaatcagctttttctgagacccaataaggagaagattgatttcttactggaagtttgcagccggtcagtgaatctggaaaaagcaagcgaatccttaaagggtaatatggccgcatttctaaagaatgtttgtttgggcctcgaagatctgcagtacgtgttcatgatcagttcacacgagttgtttatcactctgctgaaggatgaggaaagaaaactcctggtggatcagatgcgaaaaagatcccctagggtcaatctatgcatcaagcccgtgacttcattctacgacattcccgcgtcagcttctgtgaacattggtcagcttgagcatcagttaattctgagcgtcgacccttggcggatccgccaaattctgattgagctgcacggcatgactagcgagaggcagttttggactgtctcaaataagtgggaagttccatcagtgtactcaggcgtgatcctgggtatcaaggataatcttacccgcgatctcgtttatatcttgatggctaaggggctgcactgttctacagtgaaggacttctcccatgctaagcagctattcgcagcttgcctggagcttgtaaccgagttcagccctaagctgaggcaggttatgttgaatgagatgctccttctggacatacacactcacgaagccggcaccggtcaggctggcgaacggccgccgtctgacctgatttcaagggtccgcgggtacctggaaatgcggctccctgacatccccctgcgccaagttatcgccgaggagtgcgtggccttcatgctgaattggagggaaaatgagtacctcactctgcaggtacccgcatttctcctccagagtaatccttatgtcaaacttggacaattgctcgctgccacatgcaaggagttgcccgggcctaaagagtccagaaggactgctaaggacctttgggaagtggttgtccagatttgctccgtgtcatcccagcataaaagagggaatgatgggcgcgtctcactcatcaagcagcgcgaaagcactctggggatcatgtaccgctcagaactgttgagttttatcaaaaaactgcgcgagccgctcgtcctcaccattatactgtccctttttgttaaactgcacaacgtcagggaagacatcgtcaatgacatcacggccgaacatatatccatctggccatccagtatccctaatctgcagagcgtggacttcgaggccgttgccatcaccgtgaaagaactcgtaaggtacacactgagtataaacccgaacaaccactcttggcttatcatccaggcagacatttacttcgcaaccaaccagtactcagccgcattacactactatcttcaggccggagcagtatgctccgacttttttaacaaagccgtgcctccggacgtgtacaccgaccaagttgcaattctttgccagttcttaagagagattgactacaaaactgcattcaagtctctgcaggagcagaatagccatgacgctatggatagctactacgattacatttgggacgtcacaattctcgaatatttgacttacctccaccataaacggggtgagactgataagcgccaaattgctattaaagctattggccaaaccgagcttaacgcctcaaaccctgaagaggtgctgcagttggccgcgcaacggcggaaaaaaaaattcctgcaggccatggccaagctatacttctag

SEQ ID NO: 19550 - DNA, 2988 bp, Artificial Sequence
  Description of Artificial Sequence: Synthetic coding sequence
atgagcgccgaggccgccgaccgggaggccgccaccagcagccggccctgtacacccccacagacctgttggtttgaatttctgctggaagaaagcctgctggaaaaacatcttcgaaaaccttgcccagacccggcacccgtccagcttatcgtgcaatttctagagcaggcttctaaaccatcggtgaatgagcagaatcaggtgcagccccccccagacaacaagcggaatcggattttaaaactactcgctctcaaggtcgcagcccacctgaagtgggacctggatatcctcgaaaagtccttgagtgtgcctgtgcttaatatgcttttaaacgaactcctgtgcataagcaaggtgccacccgggactaagcacgtcgatatggatctggccacactaccgccaacaaccgccatggccgtcctgctgtataacagatgggccattcggaccatagtacagagctcttttcctgtgaaacaggccaagccagggccaccacaacttagtgtcatgaaccaaatgcagcaggaaaaggagttgaccgagaatattttgaaggtgctgaaggagcaggctgctgacagcatcctggtgctcgaggcggccctcaagttaaataaggacttgtatgttcatactatgcgaactctggatctactcgctatggagcccggcatggttaacggagagactgagagcagtacggcaggcctgaaagtgaaaaccgaggaaatgcagtgtcaggtgtgttatgacctgggggccgcctacttccagcaaggcagtacaaactccgccgtttatgaaaatgcaagggaaaagtttttccggaccaaagaacttattgccgaaattggcagcctttctttacattgtactattgatgaaaaaagattggcagggtactgtcaggcatgcgatgtgctggtcccctctagcgatagcaccagtcaacagctcaccccctatagccaggtacacatctgcttgcgctcaggcaactatcaggaggttatacagatcttcatcgaagataacctgacactcagcctccccgtgcagttccggcagtctgtcctcagggagctattcaagaaagcgcaacagggaaatgaggcccttgatgaaatttgttttaaagtatgcgcgtgcaataccgttcgggacatacttgagggtaggactatttctgtccaattcaatcaactgtttctacgacccaacaaagaaaaaattgattttctgttggaagtgtgttcacggtcagttaacctcgaaaaggcctctgagtcactgaaggggaacatggccgcttttctgaaaaacgtatgtttaggtcttgaagacctgcagtatgttttcatgatctcctcacatgaactttttatcactctgctcaaggacgaggaacggaagcttctggttgatcaaatgagaaagcgatccccgcgtgtgaacctgtgcattaaacccgttacatccttttacgacatccctgcaagcgcgtccgtcaacatcgggcaactggaacaccagctgatcctatccgtggatccttggcgaattagacagattctgatcgaattgcacggaatgacaagcgaaagacaattctggacagtgtccaacaagtgggaggttccctccgtatattcgggcgtgattctcgggataaaagacaacctcacccgcgaccttgtttacatcctaatggccaagggccttcactgttccaccgtcaaggacttcagccacgctaagcagcttttcgccgcatgcctagagttggtcacagagttttcacctaagctccgccaggttatgctcaacgagatgcttctgctggatatccacacccacgaagccggcactgggcaggcaggcgagcgccctccttccgacctcatcagtagagttagaggatacctcgagatgagactaccagacatcccactgcgccaggtgattgcggaagagtgcgtcgcgtttatgctcaactggcgcgaaaatgagtatttgaccttacaagtgcctgcattcctgttgcaatccaacccttacgtaaaactgggtcagttgctggccgctacatgtaaagagcttccaggaccaaaggagagtagaaggaccgctaaagatctgtgggaagtggtcgtacaaatctgtagcgtcagcagccagcacaagagaggcaacgatggacgagtgtcacttattaagcaacgcgaaagcacacttggtatcatgtaccgatccgagcttctttctttcattaagaaactgagggaaccgctggtgttaaccatcatcttaagtctctttgtcaagttacacaacgtccgcgaagacatagtcaacgatattacagcagagcacatttctatctggccttctagcataccaaatctgcagtcggttgacttcgaggccgtagcgattactgtgaaggagcttgtgagatacaccctatctatcaacccaaataatcatagttggctgataattcaggccgacatctactttgcgaccaatcagtactcggccgctctccattattatctgcaggcaggcgccgtgtgctctgactttttcaacaaagcagtccccccagatgtgtacaccgaccaggtaataaaaagaatgataaagtgctgcagcctgctgaactgccatacccaagtggctattctttgtcagttcctgcgtgagatcgattacaagacggcttttaagtcacttcaggagcagaacagccatgacgcaatggatagttattatgactacatttgggatgttacaatcctggagtatctgacctaccttcaccataaacgaggagagacagacaagcgtcagattgccatcaaagccatagggcaaactgagttgaacgcctcaaatcccgaggaagtcttacaattagcagcacagcggcgcaaaaaaaaattcctacaggccatggctaagctgtatttctag

SEQ ID NO: 19551 - DNA, 1659 bp, Artificial Sequence
  Description of Artificial Sequence: Synthetic coding sequence
atgatggccctgccctacatcaccgagcacaccggcttcaccggcacagtgtatgctactgagcctactgttcagatcggcagactccttatggaggaacttgtgaattttattgagagggtgccgaaggcccaaagcgctagcttgtggaaaaacaaggacattcagcgcctgctgccgtctcccttgaaggatgccgtcgaagtcagtacgtggaggcgatgttacacaatgcaggaagtgaatagcgccttatccaaaatccaattggttgggtattctcagaagattgagctattcggagccgtccaggtgactcccctctcaagtggttacgctttggggtcctccaactggattatccagtctcactacgagaaggtttcatatgtgagcggtagttcgttactcacgacgcatcctcagccaatggatcaggccagtctgaaaaattccgacgtgctcgtgttgaccggactgacgcagatcccaactgcaaaccccgacggaatggtgggtgagttctgcagcaatctggctttaactgtgcgcaacggggggaatgtgctggttccgtgctacccgtccggcgttatatatgacctgcttgaatgtctgtatcagtacatcgattctgccggccttagctccgtgcccctgtacttcatctcaccagtggccaattcaagtctggagttttcccagatctttgctgaatggctctgccacaacaagcagtccaaggtttatcttcccgagccacccttcccacatgccgaactgatccagaccaataaactgaagcactaccctagtatccacggagatttttcaaatgattttcggcagccctgcgtggtgttcactgggcatccttctctgaggtttggggatgttgtgcactttatggagttgtggggaaagtcctccctgaacacagtcatctttacagagccggacttttcctacttggaagccctcgcaccctatcagcctctagcaatgaaatgcatctactgtccgattgacaccagactcaacttcatacaggtgagcaagctcctgaaggaggttcagccactgcacgtggtgtgccctgagcagtatacccaaccccccccagcacagtcccataggatggatctgatgattgactgtcagcctcctgcgatgagctacagacgggccgaggtgcttgcgctaccatttaaacggaggtatgagaaaattgaaataatgccagagcttgctgatagtttagttcccatggagatcaagcccggcatttccctggcaaccgttagcgcagtgttacacaccaaagacaataagcacctgctccaaccgccgccaagaccagcccaaccaaccagcgggaaaaagcggaagcgggtttcagatgacgtgccggattgtaaggtacttaagccccttctttccggttcgatccctgtggaacagtttgtgcagactctggagaagcacggcttttccgatatcaaggtcgaggacaccgccaaaggacacatcgtgctgctgcaagaggcagagactctgattcagatcgaggaagattctacacacatcatctgtgacaacgatgaaatgctgcgggtcagactgcgcgacttagtgttaaagttcctccagaagttttag

SEQ ID NO: 19552 - DNA, 1977 bp, Artificial Sequence
  Description of Artificial Sequence: Synthetic coding sequence
atgaagctgtactgcctgagcggccaccccaccctgccctgcaacgttttgaagttcaagagcactaccattatgctcgattgtggacttgatatgacttccaccctgaactttcttccacttcccctggtacagtcgcccagactgagcaacctgcccggctggtctctaaaagatgggaatgccttcctggacaaggagctgaaggaatgcagtgggcatgttttcgtggattcagtccctgaattttgtttgccggaaaccgagcttatagacctgagtaccgtcgatgtgatcctaatatctaattatcattgcatgatggcactgccatatatcaccgagcacaccggattcactgggacagtgtatgctacagaacccacagttcagataggccgcttgctgatggaagagctggtgaatttcattgagcgggtgcctaaggcacagtcagcgagcctctggaagaataaagatatccagcggctcctgccatctcctctaaaggacgccgtcgaagtgagcacatggaggcgatgctacaccatgcaggaagtgaactccgccctcagtaaaatccagcttgtagggtacagccagaagatcgagctttttggtgccgttcaggttactccattgagcagcggctatgctctgggttctagtaattggatcattcagtctcactacgaaaaggtatcttatgtttctggcagctcgctgctgactacacacccccaacctatggatcaggcttcactgaagaatagtgatgtgctggtgctcaccgggctgacccagataccaacggcaaatccggatggaatggttggggagttctgtagtaatttggcattaaccgtccgcaacgggggcaacgtgcttgttccctgctatcccagcggcgtgatctatgacctcctggagtgcttgtaccaatacattgattctgcagggttgagtagtgttcctctttacttcatctcaccggtcgcaaattcgagcctggagtttagccagattttcgctgagtggctgtgccacaacaagcagtctaaggtatatttgcccgagcccccctttccgcacgctgaactcatacagaccaataaactgaagcattacccctccattcacggagattttagtaacgacttccgccagccttgcgtcgttttcactggtcacccatctttgaggtttggagacgtcgtccacttcatggagctatggggaaaatccagtctgaacactgtcatttttacggagccagatttcagctatcttgaagctttggccccatatcagcccctcgctatgaaatgtatttactgtccgattgatacaaggctcaactttatacaggtttccaaactcctcaaggaagtccaacccctgcatgtagtctgccctgagcagtatacacagcctccaccagctcaatctcatcgcatggatctcatgatcgattgccagccccctgccatgagctacaggcgggccgaagttctggcattgcctttcaaacgccgatacgagaaaattgagatcatgcctgagcttgcagattctctggtgcccatggagatcaagcctggcataagtctggctaccgtgtcggctgtgctacataccaaggacaataagcatttgctacagccaccccccagaccggctcagcctactagcggaaagaagcggaaacgggtatccgacgacgtaccagactgcaaggtgcttaaaccccttctgtctggtagtattcctgtggagcagtttgtgcaaaccttagagaagcatggcttcagtgatatcaaagtggaagacacagccaaaggccacatagtccttctacaggaagcagagaccttgattcaaattgaagaggactcaacacatatcatatgcgataacgacgaaatgctgagggtgaggctgagagatcttgtgctgaagtttctacagaagttctag

SEQ ID NO: 19553 - DNA, 1509 bp, Artificial Sequence
  Description of Artificial Sequence: Synthetic coding sequence
aagatctactgcctgagcggccaccccaccctgccctgcaacgtgctaaaatttaagtccacctggcggcgctgttacactatgcaggaggtaaactctgctctcagtaaaattcagctggtgggctactcacaaaagatcgaactgttcggagctgttcaggtcacacccctttcttctggctacgcgctcggctcgtcaaattggattattcagtcccactacgagaaagtttcttatgtgtccggatcatctctgcttaccacccacccccaacctatggatcaggcctctctgaaaaacagtgatgtcttggtgcttactgggctgacacaaatacctaccgctaaccctgatgggatggtaggcgagttctgtagtaatctggcccttactgtgcggaatgggggcaacgtgctcgtgccatgttaccctagtggcgtgatttatgatttgctcgaatgcctttatcagtatatcgatagtgccggcctgagtagcgtccctttatacttcatttcgccagttgccaatagctccttggaattttctcaaatctttgctgagtggctgtgccacaataagcagagcaaagtgtatctgcccgagcctccgtttccacacgcagagctcatccagacgaataaattgaagcactatccttccatccacggcgacttttctaacgacttccgccagccttgcgtagtattcaccgggcaccctagtctccgcttcggagatgtcgtccatttcatggagctttgggggaagagtagtctgaacactgttattttcactgaacccgacttcagctacttagaagcactggccccataccagcctctggccatgaagtgcatttactgccccatcgacacccgtctaaacttcatacaagtttctaagttattaaaagaagtgcagccgctacacgtcgtgtgccccgagcagtatacgcagcccccgcccgcccagagtcatcgcatggatttgatgatcgattgtcaacctcctgcgatgagctacagaagggccgaagtcctagctcttccgttcaaacgccggtatgagaagatcgagatcatgcccgaacttgccgactctctggtcccgatggagattaaacccgggatcagtctcgctactgtcagtgcggtgctacataccaaagataataagcatttgctgcagccgccccccaggccagcccagcctacatccggcaaaaaaagaaagcgagtgagcgatgacgtgccagattgcaaagtgctgaaaccactgctgagcggatctattcccgtggaacaattcgttcagactctggaaaagcacggcttctccgacatcaaggtggaagatactgccaaggggcacatcgtgctcctccaagaggcagagacactgatacagatagaagaggactctactcacattatttgcgataacgatgaaatgctgcgggtgcgtctccgagatctcgtgcttaagttcctgcagaagttctag

SEQ ID NO: 19554 - DNA, 1914 bp, Artificial Sequence
  Description of Artificial Sequence: Synthetic coding sequence
atgaagctgtactgcctgagcggccaccccaccctgccctgcaacgtgcttaagttcaaatctaccacaatcatgcttgactgcggcctcgatatgacctccacactcaacttcctgccgctcccccttgtgcagtctccacgtctcagcaaccttcctgggtggagcctcaaagatggtaacgcctttctagataaaaccgagctaattgacctctccaccgtagatgtcattctaattagtaattaccattgtatgatggctctcccttacattaccgagcatacaggattcaccgggactgtgtacgctaccgagccaactgtgcagatcggacgtctcctgatggaggagttggttaatttcatcgagagggtcccgaaggctcagagtgcaagtctgtggaagaacaaggatatccagagactgctcccttcacccctgaaggatgcagtggaagtgagcacatggcggcggtgctacactatgcaggaagtcaactccgccctctctaagattcagttagtaggctacagccagaaaatcgagcttttcggtgccgtgcaggtgactccgctgagtagtggttacgccctcggaagcagtaactggattattcagagtcactacgaaaaggtgtcttatgtgtcaggcagttccctgttgacgacccatcctcagcctatggatcaggcttctttgaagaacagcgatgttttagtcttgaccggcctgacacagatcccaactgcaaaccctgacggaatggtgggcgagttctgctcgaatttggctctgacggtgagaaacgggggcaatgttctggtgccctgttatccttctggtgtgatatacgacctcctggaatgtctctaccaatacatcgacagcgccggcctgtccagcgtgcccctatattttattagccctgtcgccaattcttccttagagtttagccagatttttgcagaatggctttgccacaataaacagagcaaggtctatctccccgagccgcctttccctcacgccgagctcatccaaactaataaactcaaacactacccaagtatacacggcgacttcagcaacgacttcaggcagccctgcgtggtgtttactggccatccatctctccgattcggcgatgtcgtgcactttatggagctgtgggggaaaagtagcctcaatacagttatatttacagagccagatttcagctatctggaggcacttgctccttaccaaccgcttgccatgaagtgcatctattgccctattgataccagactgaattttattcaggtgtccaagctactcaaggaagtacaaccattgcatgtggtgtgcccagaacagtacacccagcctccaccagctcagtcccaccggatggacctcatgatagattgccagcctcctgctatgagttatcggagggcagaagtactggcactccccttcaaacgccgctacgaaaaaatcgagataatgcctgagctcgcagattctctggtaccaatggaaatcaagccgggcataagtctggctaccgtgtccgctgttctccacaccaaagataataaacatcttctgcagcccccgcctcgacctgcccagccaacatcagggaagaagaggaaacgggtttcagacgatgtgcctgactgcaaagtgttgaaaccactcctgagcgggagcataccagttgaacagtttgtgcaaaccttggagaagcatggttttagtgacatcaaggttgaggacacagccaagggacatatcgttcttctccaggaagccgagacactgatccagattgaggaggattctactcacatcatttgtgataacgacgagatgctaagagtcagactgcgggatctggtgcttaagttcctccagaagttttag

SEQ ID NO: 19555 - DNA, 1905 bp, Artificial Sequence
  Description of Artificial Sequence: Synthetic coding sequence
atgctggactgcggcctggacatgaccagcaccctgaacttcctgcccctgccccttgtgcagtcaccccgcctgagcaacctacccggctggagtctgaaagacggcaatgcatttctggacaaggagctgaaggagtgtagcggtcatgtatttgtagactctgtacctgagttctgcctgcctgagactgagcttattgatctgagcaccgttgacgtgatcctgatttccaactatcattgcatgatggcacttccttatatcacagaacacacaggattcactggaacagtgtacgcaaccgagcccacagttcaaattggacgcctacttatggaggaactcgttaatttcattgagcgtgttcccaaggctcagtccgcttctctgtggaagaacaaagacatacaacgcttgctccctagtcctctcaaagatgctgtggaggtgagtacatggcggaggtgctatacgatgcaggaggtgaactcagccctcagcaaaatccagctcgtgggatattcccaaaagatagagctgttcggggcagtgcaggttacaccattaagctccggctatgcactaggcagttccaactggatcatccagagccactatgagaaggtaagctatgtctccggcagttcgctgttaaccacccaccctcagcctatggatcaggcctcactaaagaacagcgacgttttagttctgacaggcctcacacaaatccctaccgcaaacccagacggcatggtgggagaattctgttccaacctcgcactgaccgtccggaatggcggtaatgtcctagtgccttgctacccatcaggtgtgatatatgacctgctggagtgcctgtatcagtacattgacagtgctgggctgagcagcgtccctctgtatttcattagtccagttgctaatagcagtctggagttcagccaaattttcgcagagtggctttgtcataataaacaatcaaaggtgtatctacccgagcctccattccctcacgctgagctgattcagaccaataaactgaaacactaccccagcatccacggtgacttttccaacgactttcggcagccttgtgtggtgttcacaggccaccccagtcttaggttcggtgatgtggttcatttcatggaactatggggcaagagctctctgaacacagtgatttttactgagccagactttagctatctagaagcgctggcgccataccagcccctagctatgaagtgcatctactgtcctattgacaccaggctcaactttatacaagtaagcaagctcctcaaagaagtgcaaccgctgcacgtggtatgtccagaacagtatacccaaccccctcctgcacagagccaccgtatggatcttatgatcgattgccagcctcccgccatgagctaccggcgggccgaggtgcttgccttgccctttaaacgtagatacgaaaaaattgagataatgcccgagctggccgattccctcgtgcccatggagattaaacctggcatttcattagccactgtaagcgcagtactccacactaaggacaataaacatctattacaacccccccccagacccgctcagccgactagtggcaagaaaagaaagagggtcagcgacgatgtacccgactgcaaggttcttaagcccctcctgtctggcagtatccccgttgagcaattcgttcagacactggaaaaacatggcttttccgacattaaagtggaggacactgctaaaggccacattgtactgctccaggaggcggagactctcatccagattgaggaggactccacacatattatctgtgataatgatgaaatgcttagggtaaggttaagagatctcgtgttaaagtttcttcagaagttctag

SEQ ID NO: 19556 - DNA, 1755 bp, Artificial Sequence
  Description of Artificial Sequence: Synthetic coding sequence
atggccagcgtgcaggccagccggcggcagtggtgctacctgtgcgaccttccaaagatgccttgggctatggtttgggatttttcagaggcagtctgtagaggttgtgttaacttcgagggcgcagatagaattgagttattgatcgatgccgcccgccagctcaaacgaagccacgtgcttcccgagggcagaagccccggtcccccagccttgaaacatcccgccactaaagaccttgctgctgcagcagcccaagggccacagctgccccctccacaagcccaaccccagccctccggcactgggggcggcgtaagtggccaagatcggtatgaccgggctacgagctccggccgtctgccactcccttcccctgccctcgaatacactctcgggtccagacttgccaacggtctcggacgcgaggaggccgttgccgaaggcgcccgtcgtgcactccttggttcaatgcctgggttgatgccccctggccttctggccgcagcagtatccggtttgggatcaaggggcctcaccttggcacccggtttgtcgcccgcgcggccccttttcggctcggatttcgaaaaagagaagcagcagaggaatgcagactgcctggccgaactgaatgaggctatgcgtggacgagcagaggaatggcatggtagaccaaaagccgtaagagagcagctattggcactgagtgcctgcgcacccttcaacgtgaggttcaaaaaggaccacgggctagttggcagagtctttgcgttcgacgccacagcgcggcctccaggatatgaatttgaattgaagttgtttaccgagtacccttgtggctccggcaacgtatacgctggtgtgcttgctgtcgcccgccagatgtttcacgatgccctcagagagccaggaaaggcgctggcctcttctggctttaaatatcttgaatacgagcgaaggcatggttcaggagagtggagacagctcggagagctgctgacagacggagtcaggtcctttcgggagcctgccccagcagaggctttgccccaacaatatccagaacctgctcctgccgctctttgcggtccacccccgagagccccctcgagaaacctggcccccacacctagaagacgtaaagcttcaccagagcctgagggtgaggcagccggcaaaatgacaacggaggaacagcagcaacgtcattgggtggcccccggaggtccttattcggccgaaacccctggagttccctcacccatcgccgccctgaaaaatgtcgctgaagcactcggtcattctcctaaagacccagggggaggcgggggtccagtccgggcaggcggggcatctcctgctgcctcctctactgcgcagccacctacccaacatcggctagtagctcgaaatggcgaggctgaggtgtccccaacggcaggagcggaggccgtgagtggaggaggatctggtaccggagctactcccggagctccactctgttgcaccctttgtagagagcggcttgaggatacacacttcgtccagtgtccatccgttccaggacacaagttctgcttcccctgtagccgggagttcatcaaagcccaaggacccgcgggcgaagtgtattgtccgagcggtgacaagtgtcccctggtaggttcatctgtgccctgggcttttatgcaaggcgaaattgctacaatactcgcaggagacatcaaggtcaagaaggagagagatccgtag

SEQ ID NO: 19557 - DNA, 1764 bp, Artificial Sequence
  Description of Artificial Sequence: Synthetic coding sequence
atggccgccgccgtggccgtggccgccgccagccggcggcagagctgctacctctgcgacttgcccaggatgccttgggccatgatctgggactttaccgagcctgtctgccgtgggtgcgtcaattatgagggtgccgacagggtggaattcgtcatcgagacagcaagacagctcaaaagggcccacggctgttttcctgaaggccgctcgccaccaggcgctgcggcctcagcggccgctaaaccgcccccgctaagtgctaaggacatcctgctacagcagcaacagcagctgggccacggggggccggaagccgctccccgcgccccacaggccctggagcgctatccacttgcagctgcggcagaacggcctccacgtctgggtagtgacttcgggtcttctcgtcccgcggccagcttagcccagccccccactccccaacccccacctgtgaacgggatacttgttcccaacgggttcagtaagctagaggaaccaccagagctgaacagacagagcccaaatcctcgccgaggccatgcagtcccacccaccttggttcctctcatgaatggctccgctaccccactacccactgccctgggtcttggagggcgggcggcagccagcttggcggcagtgtctggcacggcggcagcctccctggggtccgcccagccgacagacctgggggcacacaagcggccagcttcggtctctagctctgcggcagttgaacatgagcagcgtgaagccgcagcaaaggagaaacagcccccccctcccgctcaccgaggtcctgccgactcactgtccaccgctgctggggccgcggaactgagcgcagagggcgcagggaaatctcgtgggtccggagaacaggactgggtcaatcgaccaaaaactgtgcgggacactctgctcgcccttcaccagcacggccacagtggcccattcgagtcaaagttcaagaaggagccagcgctcacagctggacgcttgttgggcttcgaagctaacggcgccaacggatccaaggccgtcgccaggacagcgaggaagaggaagccttcgccagaacctgagggcgaggtggggccaccgaaaatcaatggcgaggcccagccatggctatccacgtcaacagagggcttgaagattcctatgactccaacaagctctttcgtgtcgcccccacctccaactgcctcgccccacagcaatagaaccaccccaccagaggctgcccagaacggacaatcccctatggccgccctgattctggtggccgacaacgcgggtggtagccatgcttcaaaggacgctaaccaagtccactctaccacacggcggaactcaaattcccccccttccccgagttctatgaaccagcgccggttgggccctagagaggtgggggggcaaggggcaggcaacacagggggcctggaacctgtgcaccctgcatccttgcccgattcatctttagctactagcgcccctttgtgctgcacactgtgccatgaaaggctcgaggacactcatttcgtccaatgcccaagcgtgcctagtcataaattctgtttcccttgcagtagacagtctatcaaacagcagggggccagcggcgaggtctattgtccatcgggggaaaaatgcccactggtaggaagcaacgtcccctgggcattcatgcaaggggaaatcgccaccattttagctggggatgtcaaggtgaaaaaagagagagattcgtag

SEQ ID NO: 19558 - DNA, 1716 bp, Artificial Sequence
  Description of Artificial Sequence: Synthetic coding sequence
atggccgccgccgtggccgtggccgccgccagccggcggcagagctgttatctctgcgatctgcccagaatgccttgggccatgatctgggactttaccgaacctgtctgccgcggctgtgtgaactatgagggagccgacagggtggagttcgtaatcgaaaccgcacggcagttaaaaagggcgcacgggtgctttcccgagggcaggtcccctcctggggccgccgctagtgccgctgcaaagccgcccccgctgtcggccaaagacatactcttgcagcagcaacagcaattaggacatggaggccccgaagccgcccctagggctccgcaagcattggagcggtatcctctcgcagccgctgcagaaagacccccacgcctgggttctgattttgggagctcccgcccggccgcctctctcgcacaaccgccaacaccgcagcctcctcctgttaatggaatcctcgtccccaacggattctccaaactggaagaaccacctgaactcaataggcaaagccctaatccccggcgtggacacgccgtccccccaactcttgttcccctgatgaatgggtctgcaacccccctacctacagccctggggctaggcggacgggccgccgcttcacttgctgctgttagcggaaccgcagctgcatccctggggtccgctcagcctacggatcttggagcccacaaaaggccagcttctgtgagctcttccgccgccgtggagcatgaacagcgagaggctgccgccaaagagaagcagccgcctccaccggcacataggggccccgctgacagtctctctacggccgctggtgccgccgagctgtctgctgaaggcgctggcaagagccgcggctctggggagcaggattgggtgaacaggccaaagactgtaagggatacgctgcttgcactccaccagcatgggcactcaggtccgtttgagagcaaatttaagaaagagccagctttgactgctgtggctcgcaccgcccgcaagaggaagcctagcccggaaccagaaggagaggtggggccaccaaagattaacggggaggctcagccgtggttgtccacttccacagagggcttaaagatccccatgacccccacctcttcattcgtgtcccctccccccccaaccgcgtcccctcattccaatagaaccacgccaccagaggccgctcagaatggccagagtcccatggctgccctgattctggtggcggataacgctggagggtcccacgccagtaaagacgccaatcaggttcattccactactagacggaactcaaacagccctccaagccccagtagcatgaaccagagaaggttggggccacgtgaggtcggcggacagggggcaggcaatacaggaggactggagccggtgcaccctgcctccctgcctgattcttcactggcaaccagcgcccccctatgctgtaccttgtgccatgagagactagaagatacccacttcgtgcagtgtcctagtgtgccatcccacaagttctgcttcccgtgctcacgccaatccataaagcagcaaggcgcttcaggggaggtttactgcccgtccggagaaaaatgccctctggtgggttcaaatgttccgtgggctttcatgcagggagaaatcgcgactattctcgctggagatgtaaaggtgaagaaagagcgagacagctag

SEQ ID NO: 19559 - DNA, 2391 bp, Artificial Sequence
  Description of Artificial Sequence: Synthetic coding sequence
atgagcgccgcccaggtgagcagcagccggcggcagagctgctacctctgcgacctacccagaatgccctgggccatgatctgggatttttccgagcccgtgtgcagaggctgtgtaaactacgagggagcagatcgcatcgaattcgtgatcgaaacagcacggcagctcaaacgcgcccacggctgtttccaagatggaaggtcgcccggacctcctccacccgttggtgtgaagaccgtggctctttccgccaaggaggccgctgcagctgccgctgccgctgcggcggccgccgccgccgcgcaacagcagcagcagcagcagcagcaacaacagcaacagcagcagcagcagcagcaacaacagcaacagcaacagctcaatcacgtcgacggaagctctaagccggctgtcttagcagctcctagcgggctggagcggtatggactgtcagcagctgctgcagcggcagctgcagctgccgctgctgtcgagcagagatccagatttgagtacccacccccaccagtgagcctcggatcgagctcccataccgctcgcctccctaacgggctggggggacccaatggattcccaaagccaacacctgaggaaggcccacccgagctgaatcgacaatctccgaattctagttctgccgcagcttccgtggcttcacggcgagggacccacggaggtctggtaaccggcctcccaaatccggggggcggcggtggcccacagctcaccgtgcctcccaacctgctcccgcagacactgctgaacggtcccgccagcgcagccgtcctgccaccgcctccaccacatgctctgggtagcagaggccctcctacacccgccccaccgggagcccctggagggcccgcttgcctgggcgggacacccggagtttccgctacgtcctcttctgcatcatcatcaacttcatccagcgtagccgaggttggcgtgggcgccggcgggaaacggcccgggtcggtctcttcgactgaccaggaacgtgagttgaaagaaaagcagagaaatgccgaagccctggccgaactttcagagagcctcaggaatcgagccgaggaatgggcgagcaaaccaaaaatggtccgcgatacactgctcaccctggccggatgcaccccttacgaggttaggttcaaaaaggaccatagcttattaggccgcgtttttgcgttcgacgctgtctcaaaacccggcatggactatgaactcaagttgttcatcgagtaccccacgggatctggaaatgtctactcatctgcaagtggtgtagcgaagcaaatgtaccaggactgtatgaaagactttggaagaggcctcagctccgggtttaaatacctggaatatgaaaagaagcatggatccggcgactggagactgctgggcgatctgcttccggaagccgtaaggttctttaaagagggggttcccggcgctgacatgcttccgcagccatatctggatgcaagttgtcccatgctgccgacggctctggtttctctctccagagccccctcagccccgcctgggacgggtgccctcccgccggctgccccctctggcagaggagccgctgcctcattgagaaagcggaaggcttcgccggagcctcccgatagtgccgaaggggcactgaagctgggggaggaacagcagagacagcagtggatggctaatcagagcgaggcgctcaagctgactatgagcgccgggggattcgctgccccaggccacgctgctggggggccgccccctcccccgccacccctggggccacacagtaataggacaacaccgccggaaagcgctccacagaacggacccagtcccatggccgccctgatgagtgtcgctgacacattaggaacagcccacagccccaaggatggttcctcggtccattccacaactgcttcagctcgaaggaactccagtagccccgtgagtccagctagcgttccgggtcagagaagactggcaagtaggaacggagaccttaaccttcaggtcgcacccccccccccaagcgcgcaccctggcatggatcaagtccaccctcaaaatatccctgacagtccaatggcaaacagcggcccgctgtgctgcacgatctgtcatgagaggctagaagatacacattttgtgcagtgtccaagcgtgccttcacacaagttctgtttcccgtgctcacgcgagtcgatcaaggctcagggcgctactggcgaagtatattgtccaagcggagaaaaatgcccattagtgggctcaaacgtgccctgggctttcatgcagggtgagattgcgactatcctagctggggatgtgaaggtaaagaaggagagagacccttag

SEQ ID NO: 19560 - DNA, 1341 bp, Artificial Sequence
  Description of Artificial Sequence: Synthetic coding sequence
atgagcttcccccacttcggccacccctaccggggcgccagccagtttttggcttccgcctcatccagtacgacttgttgcgaaagcacccagagatcggtctcagatgtggcctctggaagcacacctgccccagcactatgctgcgcgccctacgatagccggcttctaggttcagcccgacccgaactgggggccgctctgggaatttacggcgcgccttacgcagccgccgcggcagcgcaatcctatcccgggtacctgccatattcaccggaaccccctagcctctacggagcacttaatccccaatatgagtttaaggaagccgcaggaagtttcacctctagcctagcacaacccggtgcttactatccatatgagagaacgctcgggcaataccagtacgagcgctacggagccgtggagctcagtggggcgggaaggagaaagaatgctaccagagaaacaacatccaccctcaaagcgtggctgaatgagcacaggaaaaacccttatcctaccaagggtgagaagatcatgttggcgatcattacaaaaatgaccctgacacaagttagtacatggttcgccaatgccaggcgccggctgaagaaagagaacaaaatgacttgggctcctaagaacaaaggtggtgaggagcgtaaagctgaaggcggcgaagaagactccctgggttgtctgactgcagacactaaggaggtcactgcctctcaggaagccagaggattacggctcagtgatctggaagacctagaggaggaagaggaagaggaagaagaggctgaggatgaagaggtggtggccacagctggcgaccgactaaccgagttcaggaagggcgctcagagtctaccgggcccgtgtgcggccgctagagaaggacggctggagagacgcgaatgcggtctcgcggctccccgattctcatttaacgatccctctggctccgaggaagctgactttctgtcagccgagaccggttccccccgattaacaatgcactacccatgtctcgagaagccacgaatatggtctttagcacacactgccaccgcaagcgcagtggagggcgccccacccgcccgcccaaggccacgctcacctgagtgccgaatgatccccggccagcctcccgcctccgcacgtcgcttgagtgtgccacgggatagtgcctgtgacgaatccagctgtattccaaaggcgttcggaaaccccaaattcgccctgcaagggcttccgctcaactgtgcaccgtgccctcgccggagcgagccagttgtccagtgtcagtaccccagtggcgcagaggcaggttag

SEQ ID NO: 19561 - DNA, 1080 bp, Artificial Sequence
  Description of Artificial Sequence: Synthetic coding sequence
atggtggacatcatcttccactaccccttcctgggcgccatgggcgaccatagcaagaagaagccgggtaccgccatgtgcgtgggctgtggatcccagattcatgatcaattcattctaagagtatccccagatctggaatggcacgccgcttgcttaaaatgcgccgagtgttcacagtacctcgacgagacctgtacctgtttcgtgagggatggcaagacttattgtaagcgtgactacgtgcggctgttcggaatcaagtgcgcaaaatgtcaggtggggttttccagttccgatcttgtcatgagggcacgggattcggtgtatcacatagaatgtttcaggtgttcagtgtgctcccggcagctgctccctggcgacgagttttccctgagagagcatgaactgctgtgtagagcagatcacggtctactcctcgaacgagcagccgctgggtctcccaggtctccgggacctcttcctggggcccggggcctgcatctgccggatgccggatccggcaggcaaccagctttgaggcctcatgttcacaagcaaacggagaagacaaccagagtgcgtacagtactgaacgaaaagcaattgcacaccctccgaacctgttatgctgcgaatccacgccctgacgccctgatgaaagaacagctggtggaaatgaccgggcttagcccaagagtcattcgggtgtggttccagaacaaacgctgcaaggacaagaaaaagtctatacttatgaaacagctgcagcagcagcagcactcagataaaacgtctctgcagggactgaccgggactccacttgttgccggttcccctattcggcacgagaacgcagtccaggggagcgctgtggaagttcagacttatcagcccccgtggaaggcactgtcagagtttgctctgcagagcgatctggaccaacctgcctttcagcaattggtttcattttccgagagcggctccctcggcaattcttcggggtctgacgtgacgagcttgtcaagccaactccccgacactccaaatagcatggtgccgtctcccgttgaaacgtag

SEQ ID NO: 19562 - DNA, 2460 bp, Artificial Sequence
  Description of Artificial Sequence: Synthetic coding sequence
atggacagcgagtactacagcggcgaccagagcgacgacggcggcgccacgccggtgcaggatgagcgtgatagtgggagcgacggtgaagacgacgttaatgagcaacattcagggtccgatactggttcggtggagaggcattcagagaacgaaacctcagacagagaagatggcctgccgaagggacatcatgtcaccgactcggaaaacgacgagccattaaacctcaacgcctccgattccgagtcggaggaattacacagacagaaggatagcgatagcgaaagtgaagagagagcagagcccccagcctccgatagtgagaacgaggatgtcaaccagcacgggtctgacagcgaatccgaggagactaggaagctgcctggaagcgactctgagaacgaggagcttctgaacgggcacgcttcagattcagagaatgaggacgtaggcaagcatccagcatccgacagtgagatcgaagagctgcagaaatcacccgcatctgattctgagacagaggacgcactgaagccacagatcagcgactctgagtctgaagagccaccccgccaccaggcctctgatagtgagaatgaagaacctcccaagccaagaatgtcggactctgaatccgaagagcttccaaagccacaagtgtctgattctgaaagtgaggaacctccccgtcaccaagctagcgactccgagaatgaagagctgccaaaacccagaatttcagactcagaatctgaagaccccccgaggcaccaagcttccgacagcgagaacgaagaattaccgaaaccacgcataagcgattccgagtcggaggaccctccacgcaatcaggcctccgatagcgaaaacgaagaactgcccaagccgcgggtcagtgattccgaatctgaagggccgcaaaaggggcctgcatcggactccgagactgaggacgcatcccggcacaaacagaaaccagaatccgatgacgattctgatagagaaaataagggcgaggatactgagatgcaaaatgactccttccattctgactcccatatggatcgcaagaaattccactctagcgacagcgaggaggaggagcacaaaaagcaaaaaatggatagcgacgaggacgagaaggaaggagaagaggagaaggtggcgaagaggaaggctgcagtgctgtccgacagcgaagatgaggagaaggcctctgccaagaagtctagagtagtaagcgacgctgatgattccgattccgacgctgtgtctgataaatctgggaaacgcgagaaaaccatagcttccgactccgaagaggaagcaggcaaagagctcagcgataagaagaatgaggagaaggacctcttcggttccgattccgagtcaggcaacgaggaggaaaacttgattgccgatatattcggggagtcaggcgacgaggaggaggaagagtttacgggttttaatcaagaggatcttgaagaggaaaagggggagacccaagtaaaggaagccgaggatagtgactcggatgacaacattaagagagggaaacacatggatttcctatccgatttcgaaatgatgttacagcgcaaaaagtcgatgtctggaaaacggaggcgcaaccgtgatggcggtacgtttatttcggacgccgatgacgtggtgtccgcaatgatcgtgaaaatgaacgaagccgcagaggaagatcggcaactgaacaaccaaaaaaagccagccttaaagaagctgacactgctgccagcagttgtgatgcacttgaagaagcaggatttgaaggaaacatttatagactccggagtaatgtcagcaataaaggagtggctgagtcccctaccggacaggtcgctaccggcgctgaagattagagaagagctgctgaaaatcctgcaggaattacccagtgtatcccaggagaccttaaagcactcaggaattggcagagccgtgatgtatttgtataaacacccgaaggaatcacggagtaacaaagatatggctgggaagctgataaacgagtggtcccggccgatctttgggctcacatctaattataaggggatgaccagagaagaacgtgagcagcgcgatcttgagcagatgccacagcgccgcaggatgaattctacggggggccagacacctcgacgggacctggagaaagtgttgacaggagaggaaaaggcacttagacctggtgatcccggtttttgtgccagagcaagggtgcctatgccaagcaacaaagattacgtggtaagacccaagtggaatgttgaaatggaatcttccaggtttcaggctacttctaaaaaaggcatctcacggctggacaaacagatgcgaaaattcacggacattcggaagaaatctaggtctgcccacgctgtgaagatttccattgagggtaacaagatgcctctctag

SEQ ID NO: 19563 - DNA, 2319 bp, Artificial Sequence
  Description of Artificial Sequence: Synthetic coding sequence
atggacagcgagtactacagcggcgaccagagcgacgacggcggcgccactccggtgcaggacgaacgagatagtgggagcgatggggaggatgatgtgaatgagcagcattctggctccgacacgggcagcgtggagaggcactccgaaaacgagaccagcgacagggaagatggactcccgaagggacatcacgtaactgatagtgagaacgattcagagagcgaagaaactcgaaagttgcctggctccgatagcgagaacgaggagctgctgaacgggcatgcatccgacagtgagaatgaagatgtaggaaaacaccctgcttccgactccgagatcgaggagttgcagaaatctcccgcctctgattccgagaccgaggacgccctgaaaccacagatcagcgactctgagagcgaagaaccgccaagacaccaggcttctgactccgaaaacgaggaaccccctaagcctcggatgagcgactcggagagtgaagagctgccaaagccgcaagtgtcagactcagagtctgaagaaccacctcgacaccaggcgagtgattctgaaaacgaggagctgcctaagccgcgcatatccgactctgagtccgaggatccaccccgtcaccaggcaagcgacagcgagaacgaggagcttccaaaacccagaatatccgacagcgagtctgaggatccgccaagaaaccaggcatccgattctgagaatgaagagctacctaagccgagagtgagtgactcagagtcagaggggccacaaaagggcccagcttcagattctgagacagaggatgcttctaggcacaaacagaaacctgagtctgatgatgactctgatagggagaataagggcgaggacacagaaatgcagaatgactcctttcacagcgactcacatatggatcgcaaaaaattccactcttctgactctgaggaggaggagcacaaaaagcagaaaatggactctgacgaagacgaaaaggaaggcgaagaggaaaaagtcgcaaagagaaaggccgcagtgctgagcgattcagaggacgaggagaaagcctctgctaagaaaagccgcgtagtgtcggacgctgatgattctgatagtgacgccgtgagcgataagagcggaaagagggagaagactattgcttctgattccgaagaggaagccggcaaagaattgtccgataagaaaaatgaagaaaaagacctttttgggagcgattctgaatccggtaatgaagaggagaacttaatcgcagacatctttggcgaatccggcgacgaagaagaagaagaatttactgggttcaaccaagaggaccttgaggaggagaagggagaaactcaagtaaaggaagccgaagacagcgactcagatgataatattaaacgcggaaaacacatggactttctatctgatttcgagatgatgctgcaacggaaaaagtctatgtccggcaaaaggcgccggaatagagatggcgggacttttatttctgacgccgacgatgtggtgtctgcaatgattgtcaagatgaacgaggccgctgaggaggaccggcagcttaacaatcagaagaagccagccctcaagaagttgacattattgcccgccgtcgtcatgcacttaaaaaaacaggacctgaaggagacctttattgacagcggcgtcatgagtgctatcaaggagtggctctccccattgcccgatagaagcctgcctgccttaaagattcgggaagagcttttaaaaatcttgcaggagttacctagtgtttctcaggagacactcaagcactcaggtatcgggagggccgtgatgtacctgtataagcacccgaaagagtcaaggtccaacaaggacatggctggtaaactcatcaacgagtggtctaggccaatattcggtctgacatctaattacaaaggaatgacccgcgaggaaagggagcagagggatctggaacaaatgccccagcggcggaggatgaacagcaccgggggccagaccccccgccgcgatctggagaaagttctgaccggtgaagagaaggccttgaggccaggtgatcccggcttctgtgctcgggccagggtgcccatgccgagcaataaagattacgtggtccggcctaagtggaacgtggaaatggagtcaagccgctttcaggcaacctcaaagaagggcattagccggctcgacaagcaaatgagaaaattcaccgatattcgaaagaagtcccggagtgcacacgctgtgaagatttcaatcgagggcaacaagatgcccctgtag

SEQ ID NO: 19564 - DNA, 1512 bp, Artificial Sequence
  Description of Artificial Sequence: Synthetic coding sequence
atgcccgcccggccccccgcctgccgggtgcggcccttcccccccgggctgcctgatgatggaggggcaacccctgtccaagacgaacgggactctggcagcgatggggaagacgacgtgaatgagcaacattccggttctgacaccggcagcgtcgaacgccacagcgagaatgaaacctcggatcgggaggatgggctgcccaaaggccaccacgttaccgacagtgagaatgatgaaccactgaaccttaatgcctcagattcggagtctgaggagttgcatagacagaaggattctgactccgagagtgaagagcgcgccgaaccacctgcctcagatagcgaaaatgaagatgtgaatcagcatggcagcgacagcgagtcggaggaaaccagaaagctgccgggcagcgattcggagaatgaagagctacttaatggtcatgccagcgacagcgaaaatgaggacgtggggaaacatccagcctctgactccgagattgaagagctccaaaagtcaccagcatctgattccgaaaccgaggatgccttaaagccgcagatttccgactccgagtctgaagaaccgccaaggcatcaagcctctgactccgagaatgaagagccccccaaacctaggatgagcgatagtgagtcagaggaactaccgaagccccaagtgagtgatagcgagagcgaggagccgccccgtcaccaggcttctgactccgagaacgaggaactgcccaaaccgaggattagtgacagtgagtcagaggaccctccgcgccatcaggcttcggattccgagaatgaagaactcccaaaaccgagaatcagcgatagcgagtcagaagaccccccgaggaatcaagccagtgattctgagaacgaggaactgcctaagcccagggttagcgacagtgaatcagaaggccctcagaaagggccagcttctgattcagagactgaggacgcaagccgccacaagcagaagcccgaaagtgatgacgatagcgatcgtgaaaacaaaggcgaggacactgaaatgcagaatgactcattccactcggattctcacatggatcgcaagaaattccacagcagtgattccgaagaggaggaacacaagaaacaaaagatggacagcgatgaggacgaaaaagagggggaggaggaaaaggtcgcgaagcggaaagctgctgttctcagtgatagtgaggacgaggaaaaagcaagcgccaaaaagtctcgtgtggtctccgacgccgacgactctgactccgacgcagtgtccgataaatcagggaagagagagaagaccattgcatccgattcagaagaggaggcagggaaggagctgtcagataagaaaaacgaggaaaaggatcttttcggctctgactctgagtccgggaacgaggaggagaacctgatcgccgatatctttggagagtcaggcgacgaggaagaagaagagttcacatatggcctttccgtgcgcttctag

SEQ ID NO: 19565 - DNA, 2430 bp, Artificial Sequence
  Description of Artificial Sequence: Synthetic coding sequence
atggccggcgccgccgccgccgtggccgccggcgccgccgccggcgcggccgccgcggccgttagcgtggccgctccaggaagggctagcgcccctccaccccccccgcctgtatattgcgtgtgcaggcaaccttacgacgtgaaccgatttatgatcgaatgcgatatctgcaaagactggtttcacgggtcttgtgtgggagtggaggaacaccatgctgtggacatcgatctctatcactgcccgaactgcgctgttctccatggctcctcccttatgaaaaagcggcgcaactggcatagacacgactacactgagattgatgacggatcgaagccagtgcaggcagggactaggactttcatcaaagagctcaggtctcgcgtatttccatcggccgacgaaataattataaagatgcatgggagtcagctgacccaacgatatctggagaaacacggcttcgatgtaccgattatggtcccaaaattagatgacctgggactgcggttgccaagccccacattcagcgttatggatgtggagcggtatgtgggcggagataaggtgatcgatgtgattgacgtcgcccgccaagctgatagtaagatgacactgcataattacgttaaatattttatgaacccaaatcgccctaaagtgttaaatgtgatatctttagagttctctgatactaagatgtctgagctggtggaggtcccagatattgccaaaaaactttcatgggttgaaaactactggcccgacgatagtgtgttccccaaaccatttgtgcagaagtattgccttatgggggtgcaggactcatataccgacttccatatcgattttgggggtactagtgtgtggtaccatgtgctgtggggtgagaaaatcttctatctgattaagccaaccgacgagaacttagcgcgttacgagagctggtcctcaagtgtaacgcagtccgaggtcttctttggagacaaggtagacaaatgttacaaatgtgtggttaaacaaggccacactcttttcgtacctacgggttggatccatgctgtcctcacctcccaggattgcatggctttcggtggcaatttcttacataacctaaatattggcatgcagcttcgctgctatgagatggaaaaacgcttgaaaactccggacctgtttaaattccctttttttgaggccatatgctggttcgtggcgaaaaacctactggagactctgaaagagctgagggaggatggctttcagccccagacgtacctggtccagggcgtgaaggctctgcacaccgccctaaaactgtggatgaagaaagaactggtctccgaacatgccttcgaaatccctgacaacgtacgtcctggacatctaattaaggagcttagcaaggtcattcgagccatcgaagaagagaatgggaaaccagtgaagtcccaggggataccaatcgtatgcccagtatcacggagttcgaatgaagccaccagcccctatcattcaaggaggaagatgaggaaattgagggaccataacgtgagaacacctagcaacctcgatatcttagagttacatactcgagaagtgttgaagagactggagatgtgtccttgggaggaggatattttgtcaagcaagcttaacgggaagttcaacaagcacctgcagccctcttcaacagtcccagagtggagagctaaagacaacgacctgagactgcttctgaccaacggcagaatcatcaaggacgaacggcagccttttgctgaccagtccctttacaccgcggactctgagaatgaagaagataagcgcagaactaagaaagctaaaatgaagatagaagaaagctcgggcgtcgagggcgtggagcatgaggagtcccagaagcctctgaatgggtttttcacgcgtgttaaatccgagctgaggtcaagaagcagtggctattcagatatctccgagagcgaggactccggtcccgaatgcacagcactcaagtccatcttcaccacggaggaaagcgaatccagtggcgatgagaagaagcaagaaataacatctaacttcaaggaggagtctaatgtcatgcgcaacttcttgcagaagtcccagaaaccaagtagatcagagatccctattaagcgcgaatgcccgaccagcactagtacagaagaggaagctatccaaggaatgctttccatggctgggctacactactctacctgcctccagagacagattcaaagcaccgattgtagcggtgagcgaaactccctgcaggacccgtccagctgccacggttcaaatcacgaggttagacaactatatcggtacgataaacccgtagagtgcgagactcggagtcatctgtgttgtcccgattggagtcctactcctgaactgaaatag

SEQ ID NO: 19566 - DNA, 2826 bp, Artificial Sequence
  Description of Artificial Sequence: Synthetic coding sequence
atggccggcgccgccgccgccgtggccgccggcgccgccgccggcgcggccgctgctgcggtctccgtcgcggccccgggccgcgcatctgccccaccaccacctccaccagtgtactgcgtgtgtcgtcagccatacgacgtgaaccgtttcatgattgagtgtgatatctgtaaagactggttccatggcagctgtgtcggcgttgaagaacaccacgctgtagacatcgacttgtaccactgccctaattgcgcagtcctgcatgggtcgtcactgatgaagaaacgtcggaattggcaccgccacgattataccgaaattgacgacggaagcaagccagtgcaggctggtacgcgaactttcattaaggagttgcggagccgggtgtttcctagcgccgacgaaatcatcattaagatgcacggctcccagctgactcagcgttacctcgagaaacatggtttcgatgttcccattatggtgcctaaactggatgatctcggccttcgtctgcctagccccacattttccgtcatggacgttgagcgctatgtggggggggacaaggtgatagatgtgatcgacgtggccagacaggcagattcaaagatgaccctgcacaattacgttaagtactttatgaacccgaacaggcctaaggtgttaaacgtgatcagtctggagtttagcgacacaaagatgtctgagttagttgaagtgccggacatagctaaaaaactcagctgggtggaaaactattggccagatgattctgtctttcctaaacctttcgttcaaaaatactgcctgatgggggtccaggatagctacacggacttccacatcgatttcggtggaacaagcgtctggtaccatgtgctctggggcgagaaaatcttttacctgatcaagcctacagatgaaaaccttgcgcgctacgagtcctggagttccagcgtgacccagtcggaggtgttcttcggtgataaggtcgacaagtgctacaagtgcgtagttaagcagggtcatacgctgttcgtgcctaccggatggattcacgccgtgctgacctctcaggactgcatggcatttggggggaacttcctccacaacttaaacattgggatgcagctacggtgctacgagatggagaagaggctcaaaactcctgatctcttcaagtttccctttttcgaggctatctgttggtttgtcgcaaaaaacctactggaaaccttaaaagagcttagggaggacggttttcagccgcaaacatacctggtgcaaggtgtcaaggccctgcataccgccctgaaactgtggatgaagaaagagctagtgagcgagcacgccttcgaaatccccgacaacgtaaggccaggccatctgattaaagaactctcgaaagtcatccgtgctatcgaggaagagaacgggaagcccgttaaatcgcagggaattccgattgtgtgcccggtgtctcgctcttccaacgaggccacatccccttaccactctcgaaggaaaatgaggaagctccgggaccataatgttcggacaccttctaaccttgacatcctcgagctgcacacgagagaggttttgaaaaggcttgagatgtgtccttgggaagaggacatactttcctccaagttgaacggcaagtttaacaaacacctacaaccgtcctccactgtgccagaatggcgagccaaggacaatgatctgcggctgctgttaactaacggaaggattatcaaggacgaacgtcagcccttcgcggatcagtctctgtacactgccgacagtgagaacgaagaggataaacggcggaccaagaaggccaaaatgaaaattgaggaatcttcaggtgtcgagggcgtggaacacgaggaatcccagaaacccctcaatggtttcttcactagagtcaaatcagaactcagaagtagatcttctgggtactccgatatctcggagagcgaagacagcggcccggaatgcacggctttgaagagcatctttaccaccgaggagagcgagagctccggagatgagaagaaacaggagataaccagcaattttaaagaggagtcaaacgtgatgaggaatttcctgcagaaatcccaaaaacccagcaggagcgagattcccattaagcgcgaatgcccaaccagtacaagcacggaagaagaagccatccagggaatgctatccatggcaggtcttcactacagtacctgtctacagaggcagattcaaagtacagactgcagtggtgagcgaaattcactccaggatcccagctcctgccatggaagtaatcatgaagtgcgccagttatacaggtatgataagccggtcgagtgcggatatcacgtgaaaacagaggaccctgatctccggacctctagttggatcaagcaattcgacactagccgatttcacccccaggatttgagtcggtcgcagaaatgcattcgtaaagagggtagttccgagatttcacagagggtgcaaagtcgaaattacgtggattcctcgggatctagcctgcaaaatggcaaatatatgcagaatagcaacctcacatctggggcttgtcagatctcaaatgggagcttgagcccagaacgcccagtaggtgagacctctttttctgtacctctccacccgacaaaacgtcccgcctccaaccccccccctatatccaatcaggctacgaagggcaagcgacctaagaaaggcatggcgaccgctaagcagagactgggtaaaatcctgaagctgaatagaaacgggcacgcccgcttctttgtatag

SEQ ID NO: 19567 - DNA, 4443 bp, Artificial Sequence
  Description of Artificial Sequence: Synthetic coding sequence
atgatcgtgatgaacgaccaggtgctggagccccagaacgtggaccccagcatggtccagatgactttcctcgacgatgtggttcacagcctgctgaagggtgaaaacattggaataacctcacgcagaagatccagagccaaccaaaatgttaatgccgtccactctcattacacgagagcccaggctaactcccccaggcccgctatgaatagtcaagctgcggtgccaaaacaaaacactcatcagcagcagcagcagcgctcaatccggccgaacaagagaaaaggcagcgacagtagcatcccagacgaggaaaaaatgaaggaagagaaatacgattacatttccaggggcgaaaacccaaagggcaagaacaaacatcttatgaataaaagaagaaaacctgaggaagacgagaagaaactaaacatgaaaagattacgaacagataacgtcagtgatttcagtgaatcatcagattcagaaaactccaataagaggatcatcgataattcctccgagcaaaagcccgagaacgagcttaagaacaagaacacctctaagatcaatggggaagagggcaaaccacataataacgagaaggctggcgaagagacactcaaaaacagccagcccccatgggatcagattcaggaggataaaaagcacgaggaggctgagaagcgtaagtcggttgatacgcagctgcaggaggatatgatcatccactcttccgaacagtccaccgtttccgatcacaatagtaacgatctgctgcctcaggagtgtaacatggacaaaacacacacaatggagctgctgcccaaagagaagtttgtgagccgaccacctactcctaaatgcgtgattgacattacgaatgacaccaacttagaaaaggttgctcaggagaacagttctacctttggtttacaaacattgcagaagatggaccctaacgttagcgactccaagcactccattgccaacgctaaattcttggagaccgccaagaaagattcggaccagtcttgggtatccgacgtggtcaaagtcgatttgacgcaatcgtccgttacaaacgcctcctccggtaatgaccatcttaatatggaaaaagaaaaatatgtttcttacatttcaccattaagcgctgtttccgtgatggaggataagctgcataaacgttcccctccacccgaaacaatcaagtcgaagctcaatacgtcagtggacacacacaagatcaagagctctccctccccagaggtcgtgaaacctaaaatcacccactctcccgacagcgtgaaaagcaaggcaacgtatgtgaactcccaagccaccggagaaagaagattggcaaacaaaatcgaacacgagttgagcagatgcagttttcatcctatcccaactcgatcctccacactggagacaacaaaaagcccactgattattgacaaaaacgaacatttcacagtttaccgcgatcccgcattgatcggctctgagacaggggcaaatcacatttccccatttctgagtcagcaccctttcccgctgcactctagctcccaccggacctgtttgaacccaggaacccaccaccccgccttgacgccggcaccacacttactcgccgggagttctagtcaaacacccctacccactattaatacccacccactgacctccgggccccatcacgccgtacaccacccccacctgttgcctactgtgcttcccggagtccctaccgcctcccttttaggaggccatcctcggctcgagagcgcacatgcgtcaagtctgtcccatctggctctggcacatcaacagcagcagcagttactgcaacaccagtccccacatcttttaggtcaggcacacccctccgcttcttacaaccagcttggactttatccaataatttggcagtatccaaacggtactcacgcttactctggcttggggttgcccagcagcaagtgggtgcaccccgaaaatgcagtgaacgccgaagctagtcttaggagaaatagccccagcccatggctgcatcaacccaccccagtgaccagcgccgatgggatcggcctcttgagtcatatcccagtgagaccgtccagcgccgagcctcacaggccactcaaaataacagcacatagctcgccccccctgaccaaaaccctggtggaccatcataaagaggaactagaacggaaggcctttatggagcccctacgctctgttgcctcaacttcagctaaaaacgatttagacttgaatcgaagccagacgggaaaagactgtcatctacatcgacatttcgtcgaccccgtgctcaaccagctacagcgcccgccccaagaaacaggtgaacgattaaataagtataaggaggagcacaggagaatccttcaagaatctattgatgtcgccccattcacgacaaaaatcaagggtctggaaggagagcgggaaaattatagcagagttgcctcatcctcaagctcacctaaatcacatatcatcaaacaggacatggacgtcgaacggtccgtgtctgacctctacaagatgaagcactctgtaccccagtcactcccacagtctaattactttacaactctgagtaacagtgtggtcaatgaaccccccagatcttacccttccaaggaggtttctaacatttatggagataaacaatcaaatgctttagccgctgccgcagcaaaccctcagacactcacatcttttattaccagccttagcaaacctcctcccctgataaaacaccagcccgaatcggagggcctcgttggaaagatacccgaacacctccctcaccagatagccagtcatagcgtgacaacttttaggaacgactgtcggtccccaactcacttgaccgttagcagtaccaatacgctgcggagtatgcccgcactgcatagggcccccgttttccacccaccaatccaccacagtctggaacggaaggaaggctcatattcctccctgagccccccaacgttgacgccagtgatgccggtgaacgctggggggaaagtccaggaatcccagaaaccgcctaccctgattcccgaacccaaagatagccaggccaactttaagagctccagtgagcagtcccttaccgaaatgtggcggcctaataacaacctgagcaaagagaagaccgagtggcatgtggaaaagtcgagtggaaagcttcaggccgctatggccagcgtgattgtgcgtccaagcagttcaacaaagaccgactccatgcctgcaatgcagctagcttccaaagatagggtgagtgagcgctcaagcgcaggggcccacaagacagattgcctgaagttagcagaggctggggaaaccggccgtattatcctgcctaacgtgaatagtgacagcgtgcacaccaagtctgagaagaacttccaggctgtaagtcagggaagcgtgccttctagcgtgatgtccgcagtgaataccatgtgtaataccaagacagatgtcattacgtctgcggctgacacgaccagcgttagcagttggggggggtccgaggtcatcagttcactgtctaacactattctagcctctactagcagtgagtgcgtgagttcaaaaagtgtgtcccaaccagtcgcccagaaacaggaatgcaaggtgagtaccaccgccccagtgacccttgcatcctcaaagactggatccgtcgtgcagcctagttctggattcagtggaaccaccgactttatacatctgaaaaaacataaagctgcattggcggccgcgcagtacaaatctagcaacgctagcgagactgagccaaacgccattaaaaatcagactttatctgccagtctgcccctcgattccactgtaatttgttccacaattaacaaggcaaactcggtgggtaatggacaagcctcccagacaagtcaacccaactaccataccaaattgaagaaagcctggttgacaagacactcagaggaagacaagaacaccaacaaaatggaaaatagtggaaatagcgtaagcgaaattataaaaccttgtagcgtgaatctaatcgcctcgacatcctcagatatccagaatagcgttgactctaaaataatcgtcgacaagtatgtcaaagacgataaagtgaaccggcggaaggcaaagcgcacttatgaatccggtagcgagtctggagactccgatgagagcgagagcaaatctgagcaacggacaaagaggcagcctaagcctacctacaaaaagaaacagaacgacctccagaaacggaaaggagaaattgaagaggatctcaagcctaatggtgtcctgtcgaggtccgcgaaggagcgaagcaagctgaaattacagtcaaactctaactcatgtcacctcgtcaagaccgagtag

SEQ ID NO: 19568 - DNA, 7623 bp, Artificial Sequence
  Description of Artificial Sequence: Synthetic coding sequence
atggccgtggagacccgggccgagctggtgggcaagcggttcctgtgtgtcgccgttggtgacgaggcgagaagtgaacggtgggaatcaggacgcggctggcgttcatggcgagcgggcgtaatcagagctgtgtcacatagagacagcagaaacccagatcttgcggtctatgtggaattcgacgatcttgaatgggataagagggagtgggtcaaggtgtacgaagacttttcgactttccttgttgagtatcatctcatttgggccaaaagaaacgatccatcccagactcagggatctaaatctaagcaaatccagtggccagctctgaccttcaagcctcttgtggaacgcaacatcccttcatcagtaaccgcggttgagtttttagttgacaagcagctcgacttccttacagaagactccgccttccaaccatatcaggacgacattgattcgctgaatcccgtcttgagagataatccccaactccacgaagaggtgaaagtttgggtcaaagagcagaaagtgcaggagattttcatgcagggtccatactccctgaacgggtaccgggtgcgagtgtatcgccaggatagtgcaacacagtggtttacaggaatcatcacccaccatgacctgtttacccgcactatgatcgttatgaacgaccaagtgttagagccccagaatgtggaccccagcatggtgcagatgacttttcttgatgatgtggttcactccctcttaaagggcgaaaacattgggatcacctctagacgacggagtcgagctaaccaaaacgtgaatgccgtgcactctcattacacacgtgctcaggccaacagtcccaggcccgcaatgaattctcaagccgccgttcccaagcagaacacccatcaacaacaacaacagcggagcatccggcctaacaagcgaaagggcagcgacagctccatcccagatgaggagaaaatgaaggaggaaaaatatgactacatctccagaggagaaaatcctaaaggaaagaataagcatctgatgaacaaaaggagaaagccagaggaggacgagaaaaaactgaacatgaagcggctgcgaactgacaacgtgtcagacttcagtgagagttccgattctgagaattccaataaacggatcattgataatagcagcgaacagaagccggagaatgaactcaagaataaaaacacatccaaaataaatggcgaagaagggaaaccacacaacaatgaaaaggccggagaggagacactaaagaacagtcaacccccttgggaccagattcaggaagataagaagcacgaggaagcggagaaaagaaaaagcgtggatacacagctgcaagaagatatgatcatccatagcagcgaacaatccactgtgagtgatcataactccaatgacctgctgccacaggaatgtaatatggataagacacacaccatggagctcctacctaaagagaagttcgtgagtaggcctcctacccctaagtgcgtgatcgacattaccaatgataccaacctggagaaggtggctcaagagaacagcagtacatttgggcttcagaccctgcagaaaatggatcctaatgtctccgatagcaagcacagcatagccaacgccaaatttctggaaacagcgaaaaaagatagtgaccagtcttgggtgagcgatgtcgttaaagtggacctgacacagtcatccgtgaccaacgctagctccgggaatgatcatctgaacatggaaaaggagaagtacgtatcctacatctctcccttgtcggcagtatcagtgatggaagacaaactccacaaacgttcacctcctccggaaactattaaatctaaactcaataccagcgtggacacccataagataaagagtagcccctctccagaggtggtgaagcccaagataacacattcacccgactcagtgaagtccaaagcgacatacgtgaacagccaggcaacaggcgagagacggctagcaaacaaaatagagcacgagcttagcagatgctccttccatcccatccctacgcgctcttcaacgctggagactacaaagagccctctaattatcgacaagaacgagcacttcaccgtctaccgcgaccccgctctgatcggttccgaaacgggcgctaatcatattagcccattccttagtcagcatcctttccccctgcactcctcatcacaccgaacctgtctgaatcccgggacacaccatcccgcattgacccccgcaccacatctccttgctggatccagtagccagaccccgctgcccactatcaatacgcatccactcactagcggacctcaccatgctgtgcaccacccccacctgctcccaacggtgctgcccggcgtccctacagcatcactgctgggtggccaccccaggctggagtctgcgcacgcgtcaagcctctcacatctagctcttgctcatcagcagcaacagcagctcttgcagcaccagtcaccacatctgttaggtcaagcccacccgagtgcatcttacaatcagttaggactctatccgatcatctggcagtaccctaacggcacgcacgcatatagcggtttagggttgccttcttccaagtgggttcatcctgaaaacgcagtcaacgccgaggcatcactgagaagaaattccccatcgccctggctgcaccaaccgacccccgtcaccagcgctgacggtatcggattgctcagtcatattccagtgcgaccaagtagcgccgagcctcaccgacctctgaagattacagcacattcaagcccacccttgacgaagaccttggtggaccaccacaaggaggaattagagcgcaaggcgtttatggagcccctgcgttccgtggcttccacaagtgcaaagaacgacctcgatctaaatagaagccaaacaggcaaagactgtcatctgcaccgccatttcgtggacccggttctgaatcagcttcagaggccacctcaggagaccggtgagcggttgaataagtacaaggaggagcacaggcgaatccttcaagaaagcatagatgtggccccatttacaacaaagattaaaggattggagggcgagcgggagaattactctcgagtggcatccagttccagcagtcccaagagccacatcattaaacaggacatggatgtcgaaagatcagtatcagacctgtacaagatgaagcactccgttccccagtcactgcctcagagtaactactttactactctgagcaactccgtggtcaatgaacctccaaggagctacccgtccaaagaagtcagcaatatatatggtgataaacagtccaacgcgctggctgcagccgcagcaaaccctcagacactcacaagtttcataacttcattgtccaagccccctccattgatcaagcatcagcccgaatctgaaggattggtcggaaagattcccgaacacctgccacaccagattgcatcgcactctgttaccacattccgtaacgactgtcgtagtccaacacacctgacggtgagctctactaacacattacggagtatgcctgcactgcacagagcccctgtgtttcacccccccattcaccattcactggagagaaaggagggatcatactctagcctgtccccccctacgctgaccccagttatgcccgtgaacgcaggaggcaaggtgcaggaatctcagaagcctccaacgctgatcccagagcctaaagattcacaagccaatttcaagagctctagcgaacagagcctgaccgagatgtggcggccaaataataatctgtcaaaagagaagaccgaatggcacgtggagaaatcatccggcaagttgcaggcggctatggctagcgtgatagttcgcccaagttctagcaccaagactgattccatgcccgcgatgcagcttgcttccaaggaccgcgtgtccgaacggagttccgccggtgcccacaaaactgattgcctgaagctggcagaggcaggcgaaaccggacgtatcatcctgccaaatgtaaattcagactcggtgcacacaaagagtgaaaaaaatttccaagcagtgagccagggcagcgtgcccagctcagtgatgtctgctgtgaacactatgtgtaacaccaagactgatgtgattacctctgccgctgacacaacaagcgtgtcatcatggggcggctcggaagttatcagcagtctgtccaacaccatcctggctagcacaagcagcgagtgtgtgtcatcaaaaagcgtcagccagcccgtggcccaaaagcaggagtgtaaggtgtcgacgactgctccagtcaccctcgccagttctaaaactggttccgtggtgcagcctagctccggattcagtggaacaaccgacttcatccatttgaagaagcacaaggcagcactcgcagccgcacaatataaatcctctaacgcttctgaaaccgagcctaacgccatcaaaaatcagactctgagtgcgagcctgcccctggactccaccgtgatatgtagcacaattaacaaggcaaattcggtgggcaacggccaggctagccagacttctcagcctaactatcataccaaactgaaaaaagcttggctgacacgacattccgaggaggacaaaaataccaacaagatggaaaactcaggcaactcagtcagcgaaattatcaagccttgttccgtcaatctgattgctagtacttcctctgatatacagaactccgtcgactccaaaatcatcgtcgacaagtatgttaaggacgacaaagttaaccggcgcaaggccaagcgtacatatgaatccggtagtgaatcaggcgattcagatgagtcagagtctaaaagcgaacagcgcaccaagagacagcccaagccaacttacaaaaagaaacaaaatgacctacagaagaggaaaggagagatagaggaagacctgaaaccaaatggtgtcctctccaggagcgccaaagaaaggtcaaagttaaaactccagtccaactcaaacaccggtatcccaaggtcagtactgaaagactggaggaaagtcaagaaactgaaacaaacgggtgaaagcttccttcaggacgatagctgttgtgaaatcgggcctaacttacagaaatgcagagaatgcagactcattcgctccaaaaagggcgaagagcctgcacattctcctgtgttctgccgtttttactattttcgccgcttaagcttttccaagaacggcgtggtcagaatcgacgggttctcgtctcctgaccaatacgatgatgaggctatgtcgctgtggacccacgagaactttgaggacgacgaattggacatcgagactagcaaatacatcctggatatcattggcgacaagttttgtcaactagtgacatccgagaaaactgccctgagctgggtaaaaaaagatgcgaagattgcctggaagcgcgcagtgaggggcgttagagagatgtgcgacgcatgcgaagcaaccctgttcaatattcactgggtttgccagaagtgtggattcgtagtgtgtcttgattgctacaaagcaaaagagaggaaaagctccagagataaggaactgtacgcttggatgaaatgcgtgaagggtcaacctcacgaccacaaacacctgatgccgacacaaattatccctgggagcgtcctaactgacctgctggatgccatgcatactctgagagagaaatatgggatcaaatctcactgtcattgtactaacaagcaaaacctgcaagtcgggaactttcccaccatgaacggggtttcacaagttctccagaatgtactaaaccatagcaataaaatctccctgtgcatgccagaaagccaacaacagaacacccctccgaagtctgagaaaaatggaggctcctcaccggagtccgatgtcggtaccgacaacaagcttactccacctgaatcacaatcccccctgcactggcttgcagaccttgctgagcaaaaggcccgagaagagaagaaggagaacaaagagctcacgctggagaatcagatcaaagaggaacgagaacaagataactctgagtctccaaacgggagaacttcacctttggtgtcacagaacaacgaacagggatcaaccttaagagacctactaaccactaccgctggcaaactgcgagtaggcagcacagatgccggcattgcctttgcacccgtgtatagtatgggagccccttcctctaagtcagggcggacaatgccaaacatcctagacgatataattgcttctgttgtggagaacaagatccccccctccaagacctcaaagattaatgtgaagcctgagctcaaggaggagcccgaagagagtattatcagcgcagttgatgaaaacaacaagctgtattccgacattccccacagttggatctgcgagaagcacatactctggctgaaagactacaaaaactcctccaactggaagctgtttaaggaatgttggaagcagggacagcctgccgtcgtgagcggcgtgcacaaaaaaatgaacatctctctgtggaaggccgagtccatatcgctggacttcggcgatcaccaggccgacctgctgaattgcaaggatagcattatttctaatgccaatgtaaaagagttttgggatgggttcgaggaggtgagtaagcgtcagaaaaacaaatcaggtgaaactgtcgtgctcaagctgaaggattggccgtcgggggaggacttcaagaccatgatgccggcacgctacgaagatttgctgaaatctctgcctctacctgagtactgcaatcccgaaggaaaattcaatctggcaagtcacctgccgggcttcttcgtgagacctgacctcggacccaggctctgttctgcttatggggttgtggcagcaaaggatcacgacattggaactactaacctccacatcgaggtgtcagacgtggtgaatatcctggtatacgtcggaattgctaagggcaatggaatcctctcaaaggccgggattcttaagaagtttgaagaagaggatctcgatgacattttgaggaagcgcttaaaggactcctctgaaattcctggtgccctgtggcacatttacgccgggaaggacgttgataaaattcgggagttcctgcagaagatcagcaaggagcaagggctggaagtcttgccagagcacgaccccataagagaccagtcctggtacgtgaacaaaaagctccggcagagactcctggaggagtacggggtccgcacatgtacgctaattcagttcctcggagacgctatagtgttgcctgcaggtgcgttgcaccaggtgcagaactttcacagttgcatacaggtgacagaagacttcgttagccccgagcacctagtcgagagtttccatttgactcaggagttgcgactgctgaaggaagagattaactatgacgacaagttgcaggtgaagaacatactgtatcatgctgtcaaagagatggtgagggctcttaaaatacatgaagacgaggtggaagacatggaagagaattag

SEQ ID NO: 19569 - DNA, 6912 bp, Artificial Sequence
  Description of Artificial Sequence: Synthetic coding sequence
atgatcgtgatgaacgaccaggtgctggagccccagaacgtggacccgagcatggtccagatgacattcctggacgatgttgtccacagtctgttgaaaggagagaatattgggattacctctcgtcgcagaagtagggcgaaccaaaatgtgaacgccgtgcactcccattacacaagggctcaagccaatagtccccggcccgccatgaactcccaagctgctgtacctaaacaaaacactcaccagcaacaacagcagagaagcatccgtccaaataaacgcaagggatccgatagtagcattccagatgaagagaagatgaaggaagaaaaatacgactatattagccgcggagagaaccctaaaggtaagaacaaacacctgatgaataagcgacgcaagccagaggaagacgaaaagaagttgaacatgaagagactgcgaactgacaatgtctctgacttctctgagagctccgactccgagaattccaacaagaggatcattgacaatagcagtgagcagaaacctgagaatgaactcaagaacaaaaataccagcaagattaacggcgaggaggggaagccccacaataacgaaaaagccggagaggaaaccctgaaaaattcccagcccccatgggaccagatccaggaggacaagaagcatgaagaagccgagaagcgcaaaagcgtggatacccagctgcaggaggatatgatcatccactctagcgagcagtcaaccgtatctgaccataattctaatgatcttcttccccaggagtgtaacatggataagacccacactatggagctgttgccaaaagagaagtttgtctcccgccccccaacccctaagtgcgtgatcgatataaccaatgatacgaacctggagaaagtagcccaagagaacagcagtacgtttgggttgcaaactctccagaagatggatccaaacgtgtcagacagcaaacactccatcgccaacgctaagttcctggagacagccaaaaaagacagtgaccagagttgggtgagcgatgtggtcaaggtggacctgacgcaaagtagcgtgacaaacgcatcctctggcaatgatcacttgaacatggagaaggaaaagtacgtgtcttacattagtccactgagcgcagtgtccgtgatggaggataaactgcacaaacgcagtccacctcctgagacaatcaagtcaaagctcaatacgagtgtagacacccacaagattaagtcctcccctagcccagaggtagtcaaaccaaagataacccattcacccgattcggtcaaatccaaagctacatatgttaatagccaagcgaccggagagagacggctggctaataaaatagaacatgaactttcgcggtgctccttccaccctatacctaccaggagttctactcttgagactacgaaatcacccctcatcatagataagaacgagcatttcaccgtgtaccgagatccagctctgatcggctctgagacaggggccaaccacatctcacccttcctttcgcagcaccccttccctttacattcttctagtcacaggacgtgcctgaacccaggtacacatcacccagctcttacacctgcacctcacttgctggcaggatcttctagccagacccctctccccacgataaacacccatcctctgacgtctggcccacatcacgctgtgcatcatccacacctcttgcccaccgtgttgccaggtgttccgacagcgtctctgttaggaggacacccgcgcctggagagcgctcatgcatcgtcactctctcaccttgctctcgcccaccagcagcagcagcagttgttgcagcaccaatcacctcatttgctcggccaggcacacccctcggcttcatacaatcagttgggcctttacccaatcatctggcagtatcctaatggaacccatgcttactccggacttggcctgccaagctcgaaatgggtgcacccagagaacgctgtgaatgctgaggcttcactgcgacgtaactcacctagtccctggctgcatcaaccaacccctgtgacgagcgctgatggtatcggtctgctctcccatataccagtgcggcccagttccgctgaaccccaccgccctcttaagattaccgcccactcatcgcctcctttaaccaagacccttgtggaccatcacaaggaggagctagaaaggaaggcctttatggagccactgaggtcagtggcttccacgtccgccaaaaacgaccttgatctgaaccgcagtcagactgggaaggattgccacctccatcggcactttgtggaccccgtgctgaatcaactgcagaggccaccccaggagaccggcgagcgcctgaataagtataaggaagaacaccgtaggatcctgcaggagtctatcgacgtggcaccattcaccactaaaataaaggggctcgaaggggagagagagaattacagtcgagtggcttcctccagtagttcccccaagagtcatatcattaaacaggacatggatgtcgagaggtctgtaagcgatttgtataaaatgaagcattcggtgccccaatccctgccacagagcaattattttaccaccctatccaatagcgtagtaaatgagccgccccgttcttatccttctaaggaagtgagtaacatctatggggacaagcaaagtaatgccctagcagcagctgcggctaatccccagacactaacttcttttattacgtcactctccaagcctccccctctcatcaagcaccagccggaatcagagggcctggtgggtaagatcccagagcatctgccccaccagatcgccagtcacagcgttactacttttcgaaacgactgtcggagccctacccacttgactgtgagcagcaccaacactctgaggagcatgcctgcgcttcaccgggcccccgtgttccacccacccatccatcactccctggaacgcaaggaaggatcctacagctctcttagtccccccacactgaccccagttatgcctgttaacgcaggtggcaaagtgcaagagtcgcaaaaaccaccaacgctcattcccgagcctaaggattcacaggcgaacttcaagtcctcctcggaacaatccctgacagagatgtggaggcccaataataacttgagcaaggagaaaaccgaatggcatgtggaaaaaagttcaggcaagctgcaggccgccatggccagtgtaatcgtccggccaagctcttctacaaagacagattcaatgcctgcaatgcagctggcgtcaaaagaccgtgtgtctgagaggagctccgcaggagcacacaagaccgactgtctgaagctggcagaggccggggagacaggccgcattatcctgcccaatgttaactctgattccgtccacactaaatccgagaaaaatttccaagccgtgagtcaggggagcgtcccttcctccgtaatgtccgccgtgaacaccatgtgcaacaccaaaacagatgtcatcacttcagctgcggacactacgagcgtgagttcctggggcgggtccgaagtgatcagctccctgtctaacactatcctcgcatccacaagttctgagtgcgtctcatcaaagtccgtgtcacagcctgtcgctcagaagcaggagtgtaaggtctctaccaccgctccggtgacattagcgtcaagtaaaacaggctccgtggtgcagccttcttccggattcagcgggactacagactttatccacctgaagaaacacaaggctgccttagccgccgctcagtacaagagctcaaacgcctccgaaactgaaccaaatgccattaagaatcagacactgtctgcctctctcccactggacagcactgttatttgctccacgattaacaaggccaattcagtgggcaacggccaggcctcccagacctctcagcccaactaccataccaagttgaagaaagcctggttaacccggcattccgaagaagataaaaacactaacaaaatggaaaacagtgggaactctgtctccgaaattattaagccttgtagcgttaacttgatcgcgtctacaagttcggatatccagaacagcgtagactctaagatcattgtagataaatatgttaaggacgataaagtcaacagacgaaaggccaagagaacctatgagagtggatcagagagcggcgatagcgacgaatcagaatccaaatccgagcagcgcacaaagcgccagcctaagcccacttacaaaaagaaacagaacgatctccagaaaagaaagggggaaatcgaggaggatttgaaacccaatggcgtcctgagccgcagcgccaaagagaggagcaaattaaagttgcaatcaaattcaaacaccggcattcccaggtctgttctcaaagattggaggaaggtgaaaaagcttaagcagactggtgaatcattccttcaggatgacagttgctgtgagatcggtccaaacctgcagaagtgccgcgaatgcagattgataagatcaaaaaagggcgaagaacccgcgcacagcccagttttctgtcggttttattattttcgccgcctcagctttagcaagaacggagtggtaagaattgatgggttttcaagccccgatcaatatgacgacgaggcaatgagtctctggacgcatgaaaattttgaggacgacgagctggacatagagacaagtaaatacatactggatattattggcgataaattttgccaactggtgacaagcgagaaaaccgcactttcttgggtcaaaaaggatgcgaagatagcctggaagagagccgtgcgcggagtgagggagatgtgcgacgcatgtgaagcgactctttttaatatccactgggtatgccaaaagtgtggtttcgtggtatgcttagattgctacaaggctaaagagcgcaagtccagcagagataaggagctctatgcatggatgaaatgcgtaaagggacaaccccacgatcacaagcacttgatgcccacccagatcattcccggtagtgtactgaccgatctgcttgatgccatgcatacattacgggagaagtatggaattaaatcacactgccactgcactaataaacaaaaccttcaggtcggtaattttccaactatgaacggagtttcccaatcacaacagcagaatacgccccctaaaagtgaaaagaacggcgggagctctccagaatccgatgttgggaccgataataagcttacgcctcccgagagccagtctccactgcattggctagctgacctggcagaacagaaggcacgggaggaaaaaaaggaaaataaagaacttaccctggagaaccagattaaggaggaaagggaacaggacaatagcgagtccccaaacggtaggacatcccctctggtatcccaaaacaacgagcagggcagtacactcagggacttgctgaccaccactgcgggaaagctaagagtgggctctactgacgccggcattgctttcgccccagtctacagcatgggcgctccgagcagcaagagcggccggacaatgccaaatattctcgatgacattatagccagcgtggtggaaaataaaatcccaccatcgaagactagcaagattaacgtgaaaccagaacttaaggaagaacctgaagagtctattattagtgctgtagatgagaataacaaactctattcagatatccctcatagctggatttgtgaaaagcatattttatggttgaaagactacaaaaactcctccaactggaaactctttaaagagtgctggaaacaggggcaacctgctgtcgtgagcggggtgcataagaagatgaacatctctctatggaaggccgaatcaatatctctagatttcggggatcaccaggccgacctgctgaactgcaaagattctatcataagcaatgcaaacgttaaggaattctgggatggcttcgaggaagtgtcaaaacgccagaagaacaagagcggcgaaactgtcgtgttaaagctgaaagactggccatctggagaggacttcaagaccatgatgcccgcaaggtacgaagacctgctcaagtccctgcccctgcctgagtattgcaacccagagggcaaatttaacctcgcatcacaccttccagggttctttgtgaggccagacctggggcctaggctgtgctctgcctacggcgtcgtcgctgccaaggatcatgacattggtacaacgaacctgcatatcgaggttagcgatgtggtcaacatactggtgtacgtgggtatagcaaaaggcaacggaatactgtcaaaggctggaattttaaaaaagttcgaagaagaagatctcgatgatattctccgcaagcggcttaaggattctagtgagatacccggggccctgtggcatatctacgcgggcaaggacgtcgacaagattagagagttcctccagaaaatcagcaaggagcaaggcctggaggtgttgcctgaacacgaccccatcagagatcagagctggtacgtaaataagaaacttagacagagactgcttgaggaatatggagttcgcacatgtactctgattcagttcctgggagacgctatcgtgctgccagccggcgctctccaccaggtccaaaattttcacagttgcatccaagtaactgaagatttcgtcagcccggagcatctcgttgagtctttccaccttactcaggaactcagactcctgaaggaagaaatcaactatgatgacaagctacaggtcaagaacatactgtaccatgcagtgaaagagatggtccgtgctttgaagattcacgaagacgaggttgaggacatggaagaaaactag

SEQ ID NO: 19570 - DNA, 7077 bp, Artificial Sequence
  Description of Artificial Sequence: Synthetic coding sequence
atgcagggcccctacagcctgaacggctaccgggtgcgggtgtaccgccaggacagcgctacccaatggttcaccggtataattacccaccacgatctcttcactagaacaatgatcgtcatgaacgatcaggtccttgagccacagaatgtggatccttctatggtgcagatgaccttcctggatgacgtcgtgcactcattactcaagggagaaaacataggcatcacctccagaagacgatctagagccaaccagaacgtcaatgctgtccatagtcactacaccagagcccaagcaaactccccccgccccgcaatgaactcccaagcggctgttccgaaacaaaatacccaccagcagcagcagcagcggtccatccggccaaacaagagaaaaggatctgactccagcattccagatgaagaaaagatgaaggaagaaaagtacgattatatttcgagaggtgagaaccccaaaggcaaaaataagcacctaatgaataaacgacgtaagccagaggaggacgaaaagaaactcaatatgaagaggttgagaaccgataacgttagcgacttttctgagtcctccgattccgaaaactccaataaacgcatcatcgacaacagtagcgagcagaagcccgaaaatgagctgaagaacaagaatacatccaaaataaacggcgaagagggtaagccacacaataatgaaaaggctggggaagaaaccctgaagaactcccagccgccatgggatcagatccaagaagacaaaaagcacgaagaggctgagaagcgcaagtccgtggatactcagctgcaggaggacatgatcatacattcctctgaacagtcaacagtgagcgatcacaatagcaatgacctgctaccacaggagtgcaacatggataaaacacataccatggagctgctgcctaaagagaagttcgtgtcacgtcccccaacaccaaagtgcgttatagacataacaaacgacacgaatctcgagaaagtggcgcaggagaactcaagtacttttggtcttcagactctgcaaaagatggaccctaacgtgagcgattctaagcacagcatcgcaaatgccaaattcttggaaaccgccaagaaagactctgaccagagctgggttagcgatgtagtaaaggtggacctgacacaatcctcagtgaccaacgccagcagcgggaatgatcacctgaacatggaaaaggagaaatatgtcagctatattagccctctgagcgcagtttcagtgatggaggataagctgcacaagaggagcccgcctcctgaaacaatcaagtcaaaactcaacacatctgtggacactcataagatcaaatcgtcaccgtctcccgaggtggtcaaacccaagatcactcacagcccggatagcgtgaagtccaaggcgacgtacgttaactctcaggcaacaggggagcgccgtctggcgaacaagatagaacacgagctctccaggtgctcattccaccccatccctactcgcagctccaccctcgaaactacaaagagtcccctgatcattgataaaaacgagcactttactgtctacagagatcccgccttgatcgggagcgagacgggcgcaaatcatatctcacccttcctgtcccagcatcctttcccattgcattcttcatctcatcgtacttgcctgaatcccggaacccaccacccagctctaacacccgccccccacctgctggccggaagctcctctcagacacctctgcccaccattaacacccatcccctaacatccggccctcaccacgctgtgcatcatccgcatctgctgcccaccgtgttacccggcgtgcccaccgccagcctacttggcgggcatcccagactcgaatcagcccatgctagctcattgagtcacctggctctggcccatcaacagcaacaacaactcctccagcaccagtctccccacctcctcgggcaagcgcacccctcagccagctataaccaactaggactgtatccaattatctggcaatatcctaacggcacccacgcctatagcgggcttggcttgccatcgagtaagtgggtccaccctgagaacgccgtaaacgcggaggccagcctgagacggaatagccccagcccctggcttcaccagcccacacccgtaacttcggccgatgggattggacttctgagtcacatcccagttcggccttcttcggccgaaccccaccgaccactgaagattactgcccactcatccccgcctttgacaaagaccctggtggaccaccataaagaagaattggaacggaaggcattcatggagccactgcgctctgtggcaagcaccagtgcaaagaacgatctggatttgaaccgatcacagaccggcaaagattgccacctgcacagacatttcgtagaccccgtgctaaatcagctacagagacctcctcaggagaccggtgagcgccttaataaatacaaggaggagcatagacgaatccttcaggagagcatcgacgtggccccctttactactaagatcaaaggccttgagggggagcgcgaaaattacagccgcgtcgcatccagctcatctagccccaaatcacatatcattaaacaggatatggacgtggagaggtccgtctcagacctttataagatgaagcatagtgtgccgcagtccttgccacagtcaaactactttaccaccctttctaattccgtggtaaatgagccccccaggagttacccgagcaaagaggtcagcaacatatatggcgacaaacaaagcaatgccctggctgctgctgccgctaacccccagacactcacatcctttatcacaagccttagtaaaccccccccactgattaaacatcagccagagtccgaagggctggtgggaaagatcccagagcacttgccccaccagattgcaagtcacagcgttactacattcagaaacgactgccgcagtcctacccacctgacagtgtccagcacaaatacgctgcgaagtatgcctgccctgcatcgagcaccagtgttccaccctcctattcaccactccctcgagcgcaaggagggctcttactctagcctgtctccacctacattaaccccagtgatgcccgtgaacgcgggaggaaaagtccaagaaagccaaaagccgcccaccctcattccagagcctaaagattcccaagctaatttcaaatcttcatctgagcagtccttgacagagatgtggcgccccaacaataatctgagtaaggaaaagactgaatggcatgtcgagaaaagcagtggcaaattgcaggccgctatggcctcagtgattgtgcgtccttcttcttccactaaaactgacagcatgcctgccatgcaactcgcctcgaaagaccgagtgtccgaaaggtccagcgctggagctcataagacagactgtctcaagctggccgaggcgggtgagaccgggcgcattatattgcctaatgttaattctgacagtgttcacaccaagagcgaaaagaattttcaagccgtaagccaaggctctgtccctagctcagtgatgtcagcggtgaacaccatgtgcaacacaaaaaccgatgttatcacgagcgccgccgacaccacctctgtcagcagctggggaggctcagaggtgattagtagtcttagcaatactatactggctagtacgagttccgaatgcgtaagttcaaaaagcgtttcccagccagtggcacaaaaacaggaatgtaaggttagtactaccgcccctgtcacgcttgcttcttctaagactggatctgtggtgcagccatcttccgggttttcagggacgaccgactttatacacttgaaaaaacacaaggccgccctggctgcagcccagtataagtcgagcaatgcttctgagacagaacccaacgccatcaagaaccagacactgagtgccagcctcccactggacagcactgtgatctgctccaccatcaacaaggcaaacagtgtgggcaacggccaggccagtcagacgagtcagcctaactatcacaccaagcttaagaaggcatggctgaccaggcattccgaggaggataagaatacaaataaaatggaaaattccggcaattctgtgagcgagatcattaaaccctgtagcgttaacctgattgcctctacatcatctgacattcagaactccgtcgactctaagattatcgtggataaatacgtgaaagatgataaagtgaacagacgcaaagccaaacggacatatgagtccggctccgagagtggcgactcagacgagagcgagtctaaatccgagcagcgcacgaaaaggcagccaaaacccacgtacaagaaaaaacagaacgacttgcaaaaacgcaaaggcgaaatcgaagaggacctcaagcccaatggcgtactctcaaggtcagccaaagagcgctccaaactgaaattgcagagcaattctaacactggcattcctcgctcagtgctgaaggactggaggaaggtgaagaaactgaagcaaaccggagagagctttctgcaggacgactcatgctgcgagatcggtcctaacctgcagaagtgcagagagtgtaggttgattcgctctaaaaaaggggaagaacccgcccactctcccgtgttctgtaggttttactacttccgaagattgtctttttctaagaatggtgtagtgagaatcgacggcttctctagcccggatcagtatgacgacgaagcaatgagtctatggacccatgagaatttcgaggacgacgagctggatattgaaacaagcaagtacatactggacataatcggagacaaattctgccaacttgtgaccagcgaaaagacggctctgagctgggttaaaaaggacgccaagatcgcttggaaaagagcagtccggggcgtgcgggaaatgtgcgacgcctgcgaagcaaccctgttcaacatccactgggtatgccaaaaatgtggcttcgtagtgtgcctggactgctataaggccaaggaaagaaaaagttccagagacaaggagctctacgcctggatgaaatgcgtgaagggtcagcctcacgaccataaacatcttatgcctacccaaattattcccggctctgtccttactgatttgctggacgctatgcacacactcagagagaaatacggaatcaagtcacactgccactgtactaataaacagaacctccaggtcggcaattttcccacaatgaacggggtgagccaggttctgcagaatgtgctcaatcattcaaataagatctccctgtgtatgcccgaatctcaacagcagaacacaccccctaagtccgagaaaaatggaggaagttctcccgagtctgacgtaggcaccgacaacaagctgaccccccccgagagtcagagccctctgcattggcttgctgatctggccgaacagaaggcccgcgaagaaaagaaggagaacaaagagctgaccctggagaatcagattaaggaggaaagggagcaggacaactccgagagtccgaatggccgaacttcccccctcgtctcccagaacaatgaacaggggtcgacgctgagagacctgctcactaccacagctggaaaactgcgcgttggatcaacagatgccggtatcgccttcgctcctgtctacagcatgggcgctccatcttctaagtcaggcagaacaatgcctaacatcctcgatgacattatcgcgagcgttgttgagaataaaatccccccatcaaaaacatctaaaattaacgttaagcctgagctcaaagaggagcctgaagaatcgattatctcagcagttgacgagaataacaagctgtattctgatataccacatagctggatttgcgaaaagcacattttgtggctcaaggattataagaacagtagtaactggaaactgttcaaggagtgttggaagcagggtcaacccgctgtggtaagtggcgtacacaagaaaatgaatataagtctctggaaggctgaatccatctcactggattttggggaccaccaggcagacctgttgaattgtaaggattccatcattagcaacgcgaacgtgaaagaattctgggacggtttcgaggaggtaagcaaacgccaaaaaaataagtcaggggaaaccgtggttcttaagctgaaggattggccgtccggcgaggatttcaaaacgatgatgcctgctagatatgaggatctgcttaaaagtctacctctgcctgagtattgtaaccccgaggggaaatttaatttggcttcacacttgcccggtttcttcgtccgccccgacctcggccctcggctctgttcagcctacggcgttgtggcggccaaagaccatgatattggtacaaccaatctgcatattgaggtatctgatgtcgtcaatattcttgtctacgtgggaatagcgaaaggcaatgggattctttctaaggcaggtatcctgaagaagttcgaagaggaagatctagatgatatcttgagaaaaaggctgaaggactccagtgagatcccaggcgcgctatggcatatctacgcgggtaaagacgtcgacaaaatccgagaatttctccagaagattagcaaagagcagggattggaagtgctgccagagcatgacccaatccgagaccagtcttggtatgtcaataagaaactgaggcaaaggctgctggaagagtacggcgtgcgaacctgcaccctcatccaatttctcggcgatgccatcgtgctccctgccggagcactgcatcaggtgcagaatttccactcttgcatccaagttacggaagacttcgtaagtcccgagcatttggtggagtcatttcatctcactcaggagctcaggctccttaaggaggaaatcaattatgacgataagttgcaggtcaaaaacattctgtaccacgcggtcaaggagatggttagggcactgaaaatccacgaagatgaagtagaagacatggaagagaattag

SEQ ID NO: 19571 - DNA, 3741 bp, Artificial Sequence
  Description of Artificial Sequence: Synthetic coding sequence
atgagcaaggagcggcccaagcggaacatcatccagaagaagtacgacgattcagacggtattccatggtccgaggaacgcgtggtccgcaaagtgctgtatctgtctttaaaagaattcaagaactcacagaagcggcagcatgccgaggggattgccgggagcctgaagactgtcaatgggctcttaggtaatgatcagtctaaaggcctgggccctgccagcgagcaatcagaaaatgagaaagacgacgctagtcaagtctctagtacctccaatgacgtgtcatccagtgacttcgaggaaggaccgtcacggaagcggcctaggctgcaggcccagcggaagtttgcacaatcccagcccaatagtccttccaccactccagttaagatcgtcgagcccctattacctcccccggctactcagatttcagatctatcaaagagaaagcctaagacggaggattttttgactttcctatgcctgcgcgggagccccgctctgccaaacagcatggtatatttcggaagttctcaggatgaggaggaagtcgaggaagaagatgacgagacggaagatgttaagaccgcgactaacaacgccagctcttcttgccagtctaccccccgaaagggcaagacccataaacatgtgcataatggccacgttttcaatggttcgtcccgaagcacaagagagaaggagccggtgcagaaacacaaaagcaaagaggccacgcctgcaaaagagaagcattcagatcacagggctgacagccgccgggaacaggctagcgccaaccacccggccgccgcaccctccacaggctctagtgctaagggattagccgccacccaccaccaccccccactgcaccgatctgcccaggatctgcgcaaacaggtgagcaaggtaaacggagtaacccgcatgagctcactcggcgccggcgtcacttccgccaaaaagatgagagaagtccggccctcgccttctaaaactgtgaagtacacagccaccgttacaaagggcgccgtcacctatacgaaggctaagcgggaactcgtgaaggatactaaacctaatcaccacaaacctagttcggcggtgaaccacacaatttcaggtaaaacagaatcatctaacgctaaaacacgaaagcaggtgctctctctcggaggcgctagcaagagcacaggtccagccgtgaatggattaaaggtgagcggacggctaaatccgaagtcatgtacaaaagaggtaggaggtcgtcagctcagggaagggctccagctgcgagagggcctcaggaattccaaacgcagactggaagaggcccaccaggccgagaagccacagagccctcctaagaaaatgaaaggtgctgcaggccctgccgagggcccgggcaaaaaagcgccagcagagcgtggtctgttgaatggtcacgtgaagaaggaagtccctgaacggtccctggaacggaaccgccctaagcgcgccacagctggcaagagcacacctgggcgccaggcacatggtaaggccgacagcgcctcctgcgagaaccggtctacttcccagcccgaaagcgttcacaagcctcaagattcgggcaaagcggagaaaggcggagggaaagccggatgggccgccatggatgagattccagtgctccgccctagtgcgaaggagttccatgaccccctcatatatatcgaatcagtccgggcgcaggtcgaaaagtttggtatgtgcagagtgatccccccgcccgactggcgccctgaatgtaagctgaatgacgagatgcggttcgtgacgcagatacagcacattcataaactgggaagacgatgggggccaaatgtgcagaggctcgcctgcatcaagaagcacctgaagtcccagggtatcacaatggatgagctgccgttgattggaggctgcgaattggatttagcctgcttctttcgacttattaacgaaatgggtgggatgcagcaagtgacagacctcaagaaatggaataaacttgccgacatgctccgtattccacgaactgcccaggaccgactcgccaaattgcaggaagcttattgccagtacctattgtcatacgattctctgtcgcccgaagagcatagaagactggaaaaggaggtgctgatggagaaggagatcctggaaaagcgaaaaggcccactggaaggacacacagagaatgaccatcataagtttcacccgctgccaagattcgaacccaaaaatggactcatccatggggtggctccccgtaacggatttcggtcaaaactgaaggaagtggggcaggctcagctaaaaaccggccgtcgacgtcttttcgctcaggagaaagaggtggtgaaggaagaagaagaggataaaggtgtgctgaacgatttccataaatgtatctacaaggggagatcagtcagcttgaccacgttctaccgaactgccagaaacattatgtctatgtgcttcagcaaggagcctgcccctgccgaaatcgaacaggaatactggaggctggtggaagaaaaagactgccatgtggccgtgcattgtgggaaggtcgacactaacacacatggatctgggttccccgtcggaaaatcagagccattctcacgtcatgggtggaacctcaccgtgcttcctaacaataccgggagcatcctcagacatcttggcgcagtcccaggggtcacgataccttggttgaatattggcatggtgtttagcacatcttgttggagccgcgaccagaatcacctcccctatatcgattacttacacacaggcgcggattgtatttggtactgcatccctgcagaggaagaaaataaattggaggacgtagtgcacacattactccaggcaaatgggacacccggcctgcagatgctcgaatccaatgtgatgatttctcctgaagttctttgtaaagagggtatcaaagtccatcggaccgtccagcagtcaggtcagtttgtggtttgtttcccgggatcctttgtaagtaaagtgtgttgtgggtactctgtctctgaaacggttcacttcgccactactcagtggacctctatgggattcgagaccgccaaggaaatgaaacggcgccacatagcgaagcctttcagtatggaaaaactgctgtaccagatcgcccaggccgaggccaagaaagaaaacggacccacactatctacgatttccgccctcctcgatgagctacgagacaccgagctgagacagagacgccagctcttcgaggccggtctgcattcctctgcgcggtatgggtctcatgacgggtcgagtactgtggcagatggcaaaaagaaaccaagaaagtggctgcagttggaaacatcggaacggaggtgtcagatctgtcagcacctttgctatctttcaatggtagtgcaagagaacgagaacgtcgtattttgcctagagtgtgcgctgcggcacgtggaaaagcagaaatcctgtaggggactgaagctaatgtaccgctatgacgaagaacagattatcagcttggtgaatcagatttgcggaaaggtgtcgggaaagaacggttctattgagaattgcctgagtaagccaacgccaaaaaggggacccaggaagagagccacggttgatgtgcctcccagccgactgagtgcaagtagcagtagcaagagtgcgtcttcttcttcatag

SEQ ID NO: 19572 - DNA, 3225 bp, Artificial Sequence
  Description of Artificial Sequence: Synthetic coding sequence
atggtgtacttcggcagcagccaggacgaggaggaggtggaggaggaggacgacgaaacggaggacgtgaaaaccgccactaataacgcatctagctcatgtcagtctaccccacgaaagggcaaaactcacaaacacgtgcacaatggacacgtatttaacggtagctccagaagtaccagagaaaaggagcccgtccagaagcacaaatcaaaggaagcaaccccagccaaggagaagcactccgatcaccgggcagactcccggcgggagcaggcaagcgccaatcatccagctgccgctcccagcaccggttcaagcgcaaaggggctggctgcaacccatcatcatcctcctctgcatcggtccgcacaggatctccgcaaacaggtgtctaaggtgaacggtgtgaccagaatgagttccctgggcgccggcgtaacctcggcaaaaaaaatgcgcgaagtccgcccctccccctctaaaactgttaaatataccgcaactgtgaccaagggggccgtgacgtataccaaggctaagagagaactggtgaaggacactaagcccaaccaccataaaccgtcgtcagctgtcaaccacaccatctccggcaagacagaatcctccaatgcaaagactcgtaagcaggtgctgtccctgggcggggcatctaaatccacaggtcccgcggtcaacggactgaaggtcagcggccggctaaatcctaaaagttgcaccaaagaggtgggcggccgacagttaagggaaggtttgcagctacgcgagggtttaaggaattccaaaaggagattagaggaagcgcatcaggccgaaaagccacagtccccaccaaagaagatgaagggggccgctggccctgccgaaggcccaggcaagaaagctcctgccgaacgggggctgctgaacggacatgttaaaaaggaggtgcccgagcgcagcctggaacggaaccgcccaaagcgggctactgcaggaaagtcaacgcccgggagacaggctcatggaaaagctgacagcgctagttgtgaaaacaggtctaccagtcaacctgagagcgtccataaaccacaagatagcggtaaagcagaaaaggggggcggcaaggccgggtgggctgcaatggacgaaatcccggtgctgaggccttctgcaaaggagtttcacgatcctctcatctacatagagtcggtgagggcgcaggtggagaagttcggcatgtgcagggttatacccccccccgattggcggcctgaatgcaagctgaatgacgaaatgcgcttcgtaacccagatacaacacattcacaaactcggacggagatggggaccaaacgtgcagagacttgcttgcatcaaaaagcacttaaagtctcaaggaatcacaatggatgagttacctctcatcggcggctgcgagctcgatctggcatgcttctttcggctgattaatgagatgggcggaatgcagcaggtgaccgacttaaagaagtggaataaactggccgacatgctgcgaattccccggaccgcccaagatcgtctggctaagttacaggaggcctactgccagtacctgctcagttacgacagccttagccccgaagagcatagacggctcgagaaagaggtgctgatggaaaaagaaatactggagaaacggaagggccctctagaggggcacacagagaatgatcatcataaattccacccattgccgcgatttgaacccaaaaacggcctgatccatggagtggcaccgcgcaatgggttcaggtctaaactgaaagaggtcggacaggctcagctcaaaactggacgcaggagattattcgcccaagagaaagaggtggtcaaggaggaagaagaagacaagggagtgctgaatgattttcataagtgtatatataagggcaggtcagtctcactcaccacattttacaggaccgcaaggaatatcatgtcgatgtgcttttctaaggaacctgcacctgctgagatcgaacaggagtactggaggctggtggaggagaaggattgtcatgttgcagttcactgcggcaaggtcgatacaaacacccacggctcaggctttcccgtaggcaaaagcgagccttttagcaggcatggctggaacctaaccgtcctgcccaacaacaccggatcgatactccggcatctgggagccgtccccggcgtgactattccatggctgaacattggaatggtctttagtacatcctgctggtctagagaccagaaccacctgccttacattgattacctgcatactggggctgactgtatctggtactgtatcccagccgaagaggagaacaagctagaagacgtcgttcacactctgttacaggccaacggtaccccaggcctgcagatgctcgaatccaacgtcatgatctcacccgaagtgttgtgtaaagagggtataaaagttcatcggacagtgcagcagtcaggacagttcgtagtgtgttttcccggctccttcgtatcaaaagtctgctgtggatactctgtatccgagacagtgcattttgctaccacgcagtggacttccatgggcttcgagactgccaaggaaatgaagcgccgacatatcgcgaagcctttctccatggaaaagctcctttatcaaattgcgcaggccgaggccaaaaaggaaaacggccccacattaagcacaatcagcgccctactggatgaactccgcgataccgagctccgtcagcggaggcaattgttcgaggccgggcttcattcttctgcacggtacggctctcacgatggttcatcgaccgtcgcggacgggaaaaagaagcctaggaagtggctgcagctcgagacatcggaaaggcgatgtcagatttgccagcatctctgctacttatcgatggtcgtgcaggagaatgagaacgtcgtgttttgcttggaatgcgctctacgacacgtggagaaacagaaatcatgcaggggtctgaaactgatgtaccgctacgacgaggaacagatcattagcttagtgaaccaaatttgcggcaaggtgtcaggcaagaacggcagcatcgaaaactgtctgagcaagcctacccccaagaggggcccacgaaaacgcgctactgtggacgtgccaccgagtcgcctgtctgccagcagctcgtctaaaagcgcaagttcttcctcgtag

SEQ ID NO: 19573 - DNA, 1524 bp, Artificial Sequence
  Description of Artificial Sequence: Synthetic coding sequence
atgaagcggaccatgcaccccaagtgcccccccctggccaccatgttggtccttcaaattttgaaaaaaggccgacgaggaaagggctctcccgccttacctaattccatggtctattttggaagctcacaggatgaggaggaagtcgaggaagaagacgatgagaccgaggatgtcaaaaccgctactaacaacgcgagttcgagctgtcagtccaccccccggaaggggaaaacccacaagcacgtccataacggacacgtctttaatgggtcatctcgtagcactcgggaaaaagagcctgtacagaagcataagtcaaaagaagccacacctgccaaggagaagcattccgatcacagagcagatagccggagggaacaggcctctgccaatcacccggcagctgcgccatctaccgggtcatcagccaagggattagcagccacccaccaccacccaccccttcataggtctgctcaggatctgcgaaagcaggtaagtaaggtgaacggtgtcactcggatgtcatcactgggggcaggggttactagcgccaagaaaatgcgcgaagtcagaccatctccgtctaaaacagtgaagtacacagctaccgtgactaaaggtgcagtgacctacaccaaggcaaagcgcgaattagtgaaagacacaaaaccaaaccaccacaagcctagctccgctgttaaccatactatctctggaaagacagaatcctctaatgccaagactcggaaacaggtgctcagtctgggtggagcctctaagtcaaccggcccagccgtgaatggtttgaaggtttcaggccgcctcaatccaaaatcatgcactaaggaggtgggaggtcggcaactacgtgaagggctgcagctaagagagggtttgcggaactctaaacgccgcttagaagaggcccaccaggccgaaaaacctcagagtccccctaagaaaatgaaaggagcggctggacccgccgaaggacccggaaaaaaggcgccagcagagagggggctgcttaacggccacgttaagaaggaagtgcccgaaagatcattggagcgtaaccgccccaagagagcaacggctggcaaaagcacccccggccggcaggcacacgggaaagccgatagcgcatcttgcgagaatagaagcacctctcagccggagagcgtacacaaaccccaggactccggaaaggccgagaagggaggtggaaaggccggttgggcagccatggacgagatccctgtgctgcgtccctccgccaaggagttccacgaccccttgatttatattgagagcgtgcgcgcccaggtggaaaagtttggaatgtgcagggttattcctccacctgactggcggcctgaatgcaagctaaatgatgagatgagatttgtgacccagatccagcacatccataagttgggccggagatggggtccaaatgttcagaggctcgcctgcatcaagaagcacctgaaaagtctaggagggtgcggcagctag

SEQ ID NO: 19574 - DNA, 2883 bp, Artificial Sequence
  Description of Artificial Sequence: Synthetic coding sequence
atggccgccccccgggtgtgccaggtgcagttcctggtggcctaccttgaggaaccaggtattgagggcctgctgggaaatgaccagagcaagggcctggggcccgcatccgagcagagtgaaaacgagaaagacgacgccagtcaagtaagtagcacctctaatgacgtgtccagctctgacttcgaagaaggtccatcgagaaagcggccccggctccaggctcagcggaagtttgcccaaagtcaacctaattctccaagtaccactcccgtcaaaatagttgagccgttacttcctcctccagcaacacaaatctcagatctctctaagagaaagcccaagacggaggatttcctgacatttctatgtttgagaggatcacctgcattaccgaactcaatggtatatttcggaagcagtcaggatgaggaggaggttgaagaggaggacgacgaaaccgaagacgtcaaaacagctactaacaatgctagtagcagctgtcaaagtacgccccgcaaaggaaagacccataagcacgtccacaatggacacgttttcaatggatcaagtcggtccacccgcgagaaagaaccagttcaaaaacataaaagtaaagaggctacccccgcgaaagagaagcactccgaccatagggcagactctaggcgggaacaagcttccgccaatcaccctgccgctgccccttccacagggtccagcgctaagggactggctgctactcatcaccatcccccactacacagatcagcccaggacctgaggaagcaggtctccaaggtcaacggagtgacaagaatgagctctctcggtgccggggtaacgtcagctaagaaaatgagggaggtaaggccaagcccgtccaaaactgtcaagtacactgcgactgtaacaaaaggagctgttacctacaccaaggcaaaacgcgaacttgtgaaagatactaaacctaaccaccacaaaccttcttcggcagtgaaccataccatttcaggcaaaactgagtcctccaacgccaaaaccagaaaacaggtgctgtctctgggcggcgcttcaaagtctacaggacctgccgtaaatggtctaaaggtgagtggccgcctgaacccaaagagttgtactaaagaggtcgggggtcggcagctgcgcgaggggctgcagttgcgggaaggtctaagaaactccaagcgtaggcttgaggaagcacaccaggctgaaaagcctcaaagtccgccgaaaaagatgaagggtgcagctgggccagcagaggggccaggcaaaaaagccccggctgaacggggacttctgaatggacacgtgaagaaagaggtaccggagcgctctctggagcgcaatcgtcccaaacgcgctaccgctggcaagtctacaccaggccgtcaagcccacggcaaagccgacagcgctagttgcgagaacagatctacctcccagcccgaaagcgtgcataagccacaggacagtggaaaggcggaaaagggcgggggaaaagccggctgggcagctatggacgagattcccgtgctacgtccctcagccaaggaatttcatgaccccctgatctatatcgagagcgtcagagctcaggtggagaagtttggaatgtgccgagtcatccctccaccagattggcggcctgaatgtaagctgaatgatgaaatgcggtttgtcacccaaatccaacacatacacaaactgggcagaaggtggggtccaaatgtacagagactcgcctgcatcaaaaagcacctgaagtcgcaaggcattaccatggacgagctccctctcatcggcgggtgcgagctggacctcgcttgcttcttccgattgataaacgagatgggcggtatgcagcaagtaactgacctcaagaagtggaacaagctggccgacatgctacgcattccccgcacagcccaggacaggcttgctaaattacaggaggcttactgccagtacctactgagctacgatagtctttcccctgaggagcacagacggctggaaaaagaggttctgatggaaaaggaaatactggaaaagcggaaggggcctctggaagggcatacggagaacgaccaccacaagtttcatccgcttccacgattcgaaccaaagaatggattgatccacggagtggccccaagaaatgggttcagatcgaaactgaaagaggtgggccaggcccaactcaagaccggcagaagacgcttgttcgcccaggagaaagaggttgtcaaggaggaggaagaggataaaggggtcttaaacgacttccacaaatgtatatacaaaggaagatcagtgtccctgaccacattttataggacagccaggaatattatgagcatgtgcttcagtaaagagcccgctccggccgagatagaacaggagtattggcgcctggttgaggagaaagattgccatgtggcagtgcattgcggcaaagttgatactaacactcatggaagtggatttcctgtcggtaaaagcgagcctttcagcaggcacggttggaacctgaccgtgctgccaaataatacagggagtatcctgcggcatctgggcgcagtgccaggcgtgacaattccctggctgaatatcggaatggtatttagtacgtcgtgctggtctagagaccagaatcatctcccctatatcgactatctgcacaccggcgccgattgtatttgcctgagtgtggagccggtgtttccgcacctctccgtggccgtggggagcagagtggacctgggaatctcttttctcccttgcggagacactcgggtgatgtaccctgtggaatcggtcgcatggcgcggcgtgttagggcctcggctgtag

SEQ ID NO: 19575 - DNA, 525 bp, Artificial Sequence
  Description of Artificial Sequence: Synthetic coding sequence
atggtggccggctggcccgccaccccccccgccatgatgcccggccagatccctgatccttctgtgactacaggcagccttccagggctggggccactcacaggcttgccgagcagtgccctgaccgtggaggaattgaagtacgcagacatccgcaacttaggcgccatgatcgccccccttcactttctggaagtgaaattaggaaagcggcctcagcccgtgaagtccgagctcgacgaagaggaagaacgtaggaaacggcgtcgcgaaaagaacaaggtagctgcggcacggtgccggaacaaaaagaaggaacgaaccgaattcctgcaaagagagtctgagcgactggagctaatgaatgctgaactaaagacgcaaatagaagagctgaagcaggagcggcagcagctgatcttgatgctcaataggcacagacctacatgtatcgtcagaaccgacagcgtgaagacgcctgaaagtgagggcaatccgctcttggagcaacttgaaaagaagtag

SEQ ID NO: 19576 - DNA, 492 bp, Artificial Sequence
  Description of Artificial Sequence: Synthetic coding sequence
atgatgcccggccagatccccgaccccagcgtgaccaccggcagcctgcccggactgggacccctaactggactacctagcagtgcccttaccgttgaggaactgaagtacgcagatattcgaaatttgggcgctatgattgcgccgcttcatttcctcgaagtgaagctggggaaacggccccagcccgtgaaatccgagctggatgaagaagaagaaagacggaagagaagaagagaaaagaataaagtagccgccgcaaggtgccgcaacaagaagaaagaacggacggagtttctgcagagggaatcagaacgcctcgaactgatgaacgccgaactgaagacccaaatcgaagagcttaagcaagaacgccagcagctaatcttaatgctcaatcggcacagacctacttgtatcgtccggactgatagcgtaaagactcctgagagcgaagggaatcccctgttagagcaactcgaaaagaagtag

SEQ ID NO: 19577 - DNA, 492 bp, Artificial Sequence
  Description of Artificial Sequence: Synthetic coding sequence
atgatgcccggccagatccccgaccccagcgtgaccaccggcagccttccgggtttaggccctttgacgggcctgccaagttcagctttgactgtggaggaacttaagtacgccgacatacgtaacttgggagcaatgattgcacctctccatttcttagaagttaaactcggaaagcggccccagccagtgaaatctgagctggacgaggaggaagagcgccggaaacggcggagggaaaagaacaaagtggccgccgcgcggtgccgcaacaagaaaaaggagaggaccgagtttctgcaaagggagtccgaacgactggagttgatgaacgccgaattaaagacccagattgaggagttaaaacaggaacgccagcagcttatccttatgctcaatagacataggccaacctgcatcgtgaggacagactctgtaaaaacaccggaatctgaggggaacccactgctggagcagctagagaaaaagtag

SEQ ID NO: 19578 - DNA, 492 bp, Artificial Sequence
  Description of Artificial Sequence: Synthetic coding sequence
atgatgcccggccagatccccgaccccagcgtgaccaccggcagccttcccggtctggggcccctgaccggactgccctctagcgcgttgaccgtggaggagcttaaatatgccgacatcagaaacttgggcgccatgatcgctccactgcattttttagaggtgaagctgggtaagagaccacagccagtgaagtccgaactggacgaagaggaggaacgcaggaagcgcaggcgagaaaaaaataaggtggctgctgcccgctgcaggaacaagaaaaaggagcgtacagaattcctccaaagagagtccgaacggcttgaattgatgaacgctgagctgaagactcagatcgaggagcttaagcaggaaagacagcagctcattctgatgctaaaccgtcaccgcccaacatgtatcgtccgaaccgattctgtgaagaccccagaatcggagggtaatcccctgctggagcagttggaaaagaagtag

SEQ ID NO: 19579 - DNA, 405 bp, Artificial Sequence
  Description of Artificial Sequence: Synthetic coding sequence
atgatgcccggccagatccccgaccccagcgtgaccaccggcagcctgcccgggttggggcccttgacaggcctcccatcatcggcattaaccgtagaggagctgaagtacgcagatatacggaacctcggggctatgatcgcacctttgcattttcttgaggttaagctagggaagcgtcctcaaccagtgaaaagcgagttggatgaagaggaagagcggaggaagcgtcgacgcgagaagaacaaggtcgcagccgcccgctgtaggaacaagaaaaaggaacgaaccgaatttctacagcgagaatccgaacgactggaactgatgaatgcagaactaaagacacagatagaagagctgaaacaggagcggcagcagctcattttgatgctgaacagatag

SEQ ID NO: 19580 - DNA, 6015 bp, Artificial Sequence
  Description of Artificial Sequence: Synthetic coding sequence
atggtgaagctggccaaccccctgtacaccgagtggatcctggaggccatcaaaaaagtcaaaaaacagaagcagcgtccgtccgaggaacgtatttgtaacgcagtctccagctcacacggactggaccgaaagacagtgctagagcaactggagctatcggtcaaagatggcacaatcctgaaggtcagtaacaaaggcctgaacagctacaaggatccagataacccagggcggatcgccctgccgaaaccccgaaaccatggcaaactggataacaaacagaatgtcgactggaacaaactgattaagagagccgtcgaggggctggctgagtccggcggctccacactgaaatccattgagcgttttctcaagggacaaaaagacgtgtcggccctgttcggaggctcagccgcaagtgggttccatcaacaactgcgcttagccatcaagagagccatcggccatggacgtcttctgaaagatgggcccctgtacagacttaataccaaagcaactaatgttgatggcaaagagtcttgtgagtccctatcgtgtctgcctcccgtcagcttacttcctcacgagaaggacaagccagttgccgaacccatacccatctgctcattttgccttggaactaaggaacagaaccgagaaaagaagccagaggaactgatcagttgtgcagattgcgggaacagtggtcatcctagttgcctgaagtttagtcctgagctgactgtgagagtgaaggccctgcgatggcagtgcatcgaatgtaagacatgctcctcttgtcgtgaccagggcaagaacgcagacaacatgctgttttgcgatagttgcgaccgagggttccatatggaatgttgcgatccccccctcacaagaatgcccaagggtatgtggatttgccagatctgccgaccccgaaaaaaaggacggaagctcctccagaagaaagccgcccagattaagcggcgctataccaatcccattggccgacctaaaaatagactcaaaaagcagaacactgtgtccaaggggcccttttcaaaagtgcggactgggcctggacggggccgcaagaggaagataaccctcagctctcagtcagcatcctctagttcagaggaggggtaccttgaacgaattgatggacttgatttttgccgggacagcaacgtcagcctcaagtttaacaaaaagaccaaaggactgattgatgggttgactaagttcttcacgccgtcccccgacggtcgcaaagctaggggggaagtggttgactactctgaacagtatagaatcagaaagcgtgggaacagaaagagcagtacttcagactggccaaccgataaccaggacggctgggacgggaagcaggagaacgaggagaggctcttcgggtcacaggagataatgactgaaaaggatatggagttgtttagagatatccaggagcaggccctacagaaggttggcgtgaccggtcctccagacccccaggtccggtgtccatcagtcatcgagttcggcaagtatgagatacatacttggtattcctcaccctacccccaggaatatagcaggttgccaaagttatatctatgcgaattctgtcttaagtatatgaaatcgaggacaatcctccagcaacacatgaaaaaatgtgggtggttccatcccccagctaatgagatttaccgcaagaacaatatatcagtgtttgaagttgacggaaatgtgtctacgatctactgccagaatctttgcctgctggcgaaattgtttctagatcacaaaaccctttactacgatgtggagcctttcttattctatgtacttacccagaacgacgtaaagggatgtcatctggtcgggtatttcagcaaggagaaacattgccagcagaagtataatgtttcttgtatcatgatccttcctcagtatcagagaaagggatacggacgatttctgattgacttctcatatctgctgtcaaagagggagggccaagctgggtcaccggagaagccgctgagtgacttaggcaggttgagctatatggcatactggaagagtgtgatccttgagtgcctctaccatcaaaacgataagcaaatctctatcaagaaattgtccaaactaacaggaatctgcccccaggacatcacttctactctgcaccacctgcgtatgcttgactttagatcagatcaattcgtaattattagaagggaaaagctgattcaagatcatatggccaaactgcaactaaacttgaggccggttgatgtcgatcccgagtgcctaaggtggacaccggtcattgtgtcaaacagtgtggtctccgaggaggaggaggaagaggcagaggagggcgaaaacgaggaaccacagtgccaggagcgagagttagagattagcgtggggaaaagcgtgagtcacgagaacaaagaacaagactcctacagcgtagagtcagagaaaaagccggaggtgatggctccagtgagtagcacacggctttcaaaacaggtactcccacatgattccctgcctgcgaattcacagcccagccgacgggggaggtgggggcgcaagaatcggaagactcaggagagatttggcgataaggatagtaaactgctgttagaggagacctccagtgcgccacaggagcagtatggagaatgcggcgagaagagcgaggccacacaggaacagtatactgagtcagaagaacaactggtcgcctcagaggaacagccgtcgcaggatggcaaacccgacctgcctaaacgtaggctgtctgagggcgtggaaccttggcgcgggcagttgaagaaaagtccggaagctcttaagtgcagactaactgagggctcagagcgtctcccccgcagatactctgaaggtgatagagctgtcctaaggggtttctccgaatcgagtgaagaggaggaagagcctgagtcacccaggtcctcatctccccctatcctgactaagcctactctgaaacggaaaaagccattcctgcataggcgcagacgcgtcagaaaacgaaagcatcacaattcttcagttgtgacagagactatttccgagaccacagaggtgctggatgagcctttcgaagatagtgattcagaacgacccatgccaagactcgaacccaccttcgaaatcgacgaggaggaagaggaggaggatgaaaatgagcttttcccacgcgaatacttccggaggctatcttcccaagacgtgcttcggtgccagagctcttccaagcgcaagtccaaagacgaggaggaagatgaggagagtgacgatgctgacgacacaccaatcctgaagcccgtatcattgctccggaaacgagatgtaaagaactccccgttggaacccgataccagtactcctctgaagaagaagaaagggtggcccaaagggaaatcccggaagccgattcattggaaaaaaagacctggccgcaaacccggcttcaaactgagcagggaaattatgccagtatccacacaggcctgcgtgatcgagcctattgtctcaatccccaaagccggaaggaaacctaaaattcaggaaagcgaggaaactgtagagcctaaggaagatatgcccctgcccgaggagcgaaaggaagaggaggagatgcaagccgaggctgaggaggcagaagaaggcgaagaggaagacgcagcctcgtctgaagtgcccgcagcttctcctgcagattcctctaacagccctgagactgagaccaaagaaccagaagtggaagaggaggaagagaagcctagggtttcagaggaacaacgccaatctgaggaggagcaacaggagctcgaagaaccagagccagaggaggaagaagatgccgctgccgaaactgcccagaatgatgaccatgatgccgatgacgaggatgacggccacctggagagtaccaaaaagaaagagctggaggagcagcctacaagagaagatgtcaaggaagagccgggcgtgcaggaatcattcctcgatgccaatatgcagaagagccgagaaaaaatcaaggataaggaagagaccgagttagattccgaagaggaacaaccctctcatgacaccagcgttgttagtgaacagatggctggctctgaagatgatcacgaggaggatagccatactaaagaagaactcatcgagttgaaagaggaggaggagattccccacagtgagctcgacctggaaacggtccaggctgtccagtcactgacgcaggaggaatcatcagagcacgagggggcgtatcaggattgcgaggagactctcgccgcttgccagaccctccagtcgtatacccaggcagatgaggacccgcagatgtcgatggtcgaggattgccacgcttccgaacacaatagtcctattagcagtgttcagtcccatccttcgcaaagcgttcgatccgtgtcatctcccaacgtgcccgccctggagtcaggatacacccaaatatctcctgagcagggttccttatctgctccctctatgcaaaatatggagacaagtcctatgatggacgtgccgtccgtgagcgaccattcccagcaggtcgtcgattctggcttctccgatctaggatcaattgaatctaccacagaaaattatgagaatccatcatcctacgactctacaatgggcggcagcatctgcggcaattcctcatctcaaagttcctgttcctacggcggcctgagctcaagttcctctttgacacagtcaagttgtgtggtcactcagcagatggccagtatgggttcctcatgctccatgatgcagcagtcttccgtgcaaccggccgcgaactgctccatcaagtcgcctcagagctgtgtggtggagagacctcccagcaaccagcagcagcaaccaccacccccaccaccgcagcagccacagcctcccccaccccagccccagcctgccccgcagccccctcctccgcaacagcagccccagcagcagccgcagcctcagccgcagcagcccccacctccccctccaccacagcagcagccgccactgtctcagtgttcaatgaataactccttcactcccgcaccaatgatcatggaaattccagaatccgggtctacaggtaacatttccatttacgaaaggataccgggagatttcggtgcggggtcatattcacagccttcagccacttttagccttgcgaaactccagcagctgacaaacaccatcatggacccccatgctatgccatatagccactccccagccgttacctcctacgcaacctcagtgagtctgtctaacacagggctggcccaacttgcccctagccatcccctggccggcacaccccaggctcaggctacgatgacgccacccccgaatctcgccagcactaccatgaatcttacgagtccactgttgcagtgcaatatgagtgccacgaacataggaatacctcacacacagagactccagggtcagatgcctgtgaagggtcacatctcgatacggtcaaagagcgcccctctgccctctgctgccgcacatcagcaacagctctacggacgtagcccctccgctgttgccatgcaggcaggaccacgggccctcgccgtgcagagagggatgaacatgggggttaacctgatgcctaccccagcctataacgtgaactctatgaatatgaatacactgaatgctatgaacagctacagaatgacgcaaccaatgatgaactctagctatcacagcaatcccgcctacatgaaccagacagcacaatatccaatgcagatgcagatgggcatgatgggcagtcaggcctacacgcagcagcccatgcagcccaacccacatgggaacatgatgtataccggacccagccaccacagttatatgaacgccgcaggcgtccccaagcagagcctgaacgggccgtatatgcggcgatag

SEQ ID NO: 19581 - DNA, 6015 bp, Artificial Sequence
  Description of Artificial Sequence: Synthetic coding sequence
atggtgaagctggccaaccccctgtacaccgagtggatcctggaggctattaaaaaggtgaagaaacaaaagcagagaccctctgaggagagaatatgtaatgctgtgagttctagccacggactggatagaaaaacggtgctcgagcagctcgaactatctgtcaaggatggaaccatcctgaaggtgagtaacaaaggtctcaatagctataaagatcctgacaaccctgggcgaatcgcccttccaaagccaaggaatcatgggaaacttgacaataagcagaatgtggattggaacaagctgatcaaacgcgcggtggaagggctcgccgagtccgggggcagtacactgaaatcaattgaacgcttcctgaaggggcaaaaggatgtgtccgctctcttcggcggatcagctgcaagcggatttcatcagcagcttaggttagctataaagcgagctattggacatggaaggctacttaaggacggccctttgtaccgccttaacacgaaagcaacaaacgtggacggaaaagaaagctgcgaatccttgtcctgcttacctccagtgagcctgctgccccatgagaaggacaagccagtggctgagcctattcctatctgcagcttctgcctaggaacaaaagagcagaatcgtgaaaaaaagcccgaagagttgatttcttgtgcggattgtggtaactctgggcacccctcgtgtcttaaattctcacccgagctgacggtccgcgtgaaggccctgaggtggcagtgcatagaatgcaagacctgttcatcttgtcgggatcaaggcaaaaacgcggacaacatgctgttctgtgacagttgtgatcggggattccacatggaatgctgtgatccccccctaacccgtatgccaaaaggtatgtggatctgccagatttgccgccctcggaagaagggcaggaaactcctccagaagaaggctgctcagatcaagaggcgctacacgaacccaatcggcaggccaaaaaatagactcaaaaagcagaacacagtcagcaagggcccgtttagcaaggtgcggacaggcccaggccgcgggagaaagcgcaagatcactctgtctagccaatccgcatctagttcatctgaagagggctacctggaaaggattgacggcctcgatttctgccgggatagcaacgtatctttaaagtttaacaaaaagaccaaaggcttgattgatggattgaccaaattcttcacaccatcccccgatggccgcaaggcacgaggagaggtggtggattactcagagcagtacaggattcggaagcgaggtaaccggaagtcatccaccagcgactggccaacagataaccaggatggctgggacggaaaacaggagaacgaggagcgactgttcggctctcaggagatcatgacggagaaggacatggagttatttcgggacattcaggagcaggcgttgcagaaagtaggcgtcaccggacccccagatccccaagtgcgttgtccttccgtaatcgaattcgggaagtatgagatccatacctggtacagctcgccataccctcaggagtacagccggctccctaaactgtatctgtgcgagttctgcctgaaatacatgaaatccagaactattctgcagcaacacatgaaaaagtgcggttggttccatccacccgcaaatgagatttacaggaagaataacatttctgtgttcgaagtggacggcaacgtgagcaccatctactgtcagaacctgtgtcttttggcaaaactgtttttggaccataaaaccctgtattacgacgtggaaccttttctattttatgtcctcactcagaatgatgtgaagggttgtcatctcgtgggatacttttccaaggagaaacactgccagcagaaatacaacgtcagttgcataatgattctgccccaataccagaggaaaggctatggtcggttccttattgatttctcctacctcttaagtaaacgcgaggggcaggccggctccccagagaagcccctctcagacctgggccggctatcatatatggcttactggaagtcggtcattttggagtgcctctaccaccagaatgacaaacagattagcatcaaaaaactgtctaaactgaccggtatatgcccacaagacatcacaagtacgctccaccacctccgcatgcttgattttcgcagtgatcagttcgtgattattaggagggagaagctaatccaggaccatatggcgaaactgcagctgaaccttcggcctgtcgatgtggaccccgaatgcctcaggtggacgccagtaatcgtcagtaatagcgtcgtatcagaggaggaggaggaagaagctgaagaaggtgagaacgaggagccccagtgtcaggagcgcgagttggaaataagcgtggggaagtctgtgtcccacgagaacaaagaacaggactcctatagcgtcgagtcagagaaaaagccagaggttatggcccctgtgagctccacccggctgtccaagcaggtgctgcctcatgacagcctgcccgctaactcccaacccagcagacgggggcgttggggcaggaaaaaccggaaaacacaggagcgtttcggcgacaaggactcaaaattgctgctggaggaaacctctagcgcccctcaggagcaatatggagagtgtggagagaaatccgaggcaactcaggaacagtataccgaaagcgaggaacagctggttgcctcggaagaacagcctagccaagacggcaagccagacttgcccaaacggcggctgtctgaaggcgtggaaccatggcgcgggcagttgaaaaaatccccggaagccctcaaatgcaggcttacagagggatcagaaagattgccgagaaggtactctgagggggatagggccgtcctgcgagggttcagcgaatcaagcgaggaagaggaagagcctgagtccccacgtagcagctcccccccgatattgactaaacctacactgaaacggaaaaagccatttctccaccggagacgccgcgtccgaaagcggaaacaccataatagctcagtcgttaccgagacgatcagcgagaccacagaggtgcttgacgaacctttcgaagactccgactcggaacggccgatgccgcggcttgaaccgaccttcgaaatagacgaagaggaagaagaagaggatgagaacgagcttttcccccgggagtacttcaggcgcctaagttctcaggacgtgctccgatgtcaatcctcctcgaaaaggaagagtaaagacgaggaagaagacgaggaaagcgacgacgctgacgacacccccatcctcaaacctgtgtcacttttacgcaaacgagatgtgaaaaacagtcccttagaacctgatacatctacccctttaaagaagaagaaaggctggcccaaaggtaaatcgagaaagcctattcactggaaaaaacggccaggtcgcaaacctgggtttaagctgagtagggagattatgcccgtgtcaacccaggcctgtgtaatcgagcccattgtatctataccaaaagcaggtcgcaaacccaagatccaggaaagtgaagaaaccgtagagcccaaggaggatatgcctcttcccgaagagaggaaggaagaggaggaaatgcaggccgaagctgaagaggcagaagaaggggaagaggaggacgctgcctcttctgaggtacctgcagcctcaccagccgattcttcaaacagccctgaaaccgagacgaaagagcctgaagttgaggaggaagaggaaaaaccgcgggtgtctgaggagcagcgtcagtctgaggaagaacagcaggaattggaggagccagaacccgaggaggaggaggatgccgccgccgagaccgcacagaatgacgaccacgacgcagacgacgaggacgacggtcatctggaatccacaaagaagaaggagctggaggagcagcctacccgcgaggatgtcaaagaggaaccgggcgtccaggagagtttcctggatgctaacatgcaaaagtcacgcgaaaagatcaaggataaggaagagactgagctcgattcagaggaggaacagccctctcacgacacaagtgtcgtgtcagagcagatggcgggcagcgaggacgaccacgaagaggatagccatactaaagaggaattgatcgagcttaaagaggaggaagaaatcccacattcggaactagacctggaaacagtgcaagctgtgcaatctttaactcaggaagaatcttccgaacacgaaggcgcatatcaggactgcgaagagacccttgcagcatgtcagacactgcagagttacacacaggccgatgaagaccctcagatgtcaatggttgaagattgtcatgcgtctgagcacaactcccccattagttccgtgcaatctcatcccagtcagagcgtgagaagcgtcagttctccaaacgtgccagcacttgagtcaggctacacccagataagtcctgaacagggctcactctctgctccttcaatgcaaaatatggaaacttctccaatgatggatgtcccatctgtgtccgaccatagccaacaggtggtcgattctggattctcagaccttggcagcattgaatctaccaccgaaaattacgagaatccttcctcatacgatagcaccatgggcggatccatatgcggaaattcatcaagtcagtcatcttgtagttatgggggactgagttcatcaagttctctgacccagtccagctgtgtggtgacacagcaaatggcttcaatgggcagcagctgctccatgatgcaacagtcttccgtgcagccagcggcaaactgtagcattaaatctccacagtcttgcgtggtggagaggcctcctagcaatcagcagcagcagcctccgcccccccccccccagcagccccaacccccgcctccgcaaccccagcctgctcctcagcccccacccccacagcagcagccacagcaacagccccagcctcaaccacaacaaccaccccctccaccaccaccacagcagcaaccacctttgagccaatgtagcatgaataacagctttacacctgcaccgatgatcatggagatacccgagtcagggtccacaggaaatatttccatatacgagcgcatccccggtgacttcggggcaggtagctattcccagcctagcgccaccttcagtttagcaaaactgcaacaattgaccaacaccattatggatccccacgcaatgccatactcccattctccagcagtgacgtcttacgcaacctctgtgtcactaagtaataccggcttggcacagctggctccttcacatcctttggccggcaccccccaagcccaggctaccatgacacctcctccaaatctggcaagtacgaccatgaacctaacgtcacccctgttgcaatgcaacatgtcggctacgaacatcggaataccacacactcagcgcctgcagggccaaatgcctgttaaggggcatatctcgataaggtcaaagtctgcccccctccctagcgctgccgctcaccaacagcagctgtacggacgatcgccttctgccgtggccatgcaggccggacctcgggccctggctgtgcagcggggtatgaacatgggagtgaacttgatgccaacccctgcctataacgtcaatagcatgaacatgaatactctgaacgcaatgaacagctataggatgacccagcctatgatgaattcatcttaccactctaatcctgcctacatgaatcagacagcacagtaccccatgcaaatgcagatggggatgatgggaagccaagcctacacgcagcagccaatgcaaccaaacccgcatgggaatatgatgtatacaggcccgtcacaccattcttacatgaatgctgcaggggttccaaaacagagcctcaacggcccctacatgaggcggtag

SEQ ID NO: 19582 - DNA, 6015 bp, Artificial Sequence
  Description of Artificial Sequence: Synthetic coding sequence
atggtgaagctggccaaccccctgtacaccgagtggatcctggaggccatcaaaaaggtgaagaagcaaaagcagcggccctccgaggaacgcatctgtaacgccgtctcgtccagccacggcttggataggaagaccgtgctcgaacagttggagttatctgtcaaggacggcacaattcttaaggttagcaacaaaggcctgaatagttacaaagatcctgataatccgggtcggattgcactgccaaagcctcggaatcacggcaagcttgacaacaaacagaatgtggactggaacaagttaataaagcgggcagtcgaagggttggcggagtcgggagggagcacgctgaaatccatcgagaggtttctgaaaggacagaaggacgtaagcgccctgtttggcggatccgcagcctccggcttccaccagcaactgcgcctagccataaagcgggctatcggacatggaagactcctaaaagacggcccgctgtacagactgaataccaaagcaacgaatgtagacggtaaggagtcctgcgagtccctgagctgtttgccgcccgtatccctgctgcctcacgaaaaggacaagcctgttgccgaaccgattcctatttgtagtttttgtctgggtacgaaggagcagaaccgcgagaagaaaccggaggagctcatctcctgcgccgattgcggcaattcaggtcatccttcatgtctgaagttctcacctgagttgacagtgagagttaaggctctgaggtggcagtgtatcgaatgtaagacttgttctagctgccgtgaccaggggaagaacgcggacaatatgctgttttgtgacagctgcgatagaggatttcatatggaatgttgcgatccgccactcacacggatgcctaaagggatgtggatctgccagatttgcagaccacgcaaaaaaggacgcaagctgctgcaaaagaaagcagcccagataaagcgcaggtacacgaatcctatagggaggccgaaaaacaggctgaagaagcaaaatactgtgtctaagggtccattctctaaagtccggaccggccctggtcggggccgtaaaaggaagataacgctttcaagccagagtgcaagttcatcatctgaggagggatatctggaacgaatcgacggactggatttctgtcgcgatagtaatgtgtccctgaaattcaataagaagactaaggggctcattgatggattaaccaaattcttcacaccgagcccggatgggagaaaggcccgaggagaggtggtggattactctgagcaatacaggatcaggaaacgcggcaatcgtaaaagttctacttccgactggcctaccgataatcaggatggctgggatggcaagcaggaaaatgaggaaaggctgtttggaagccaggaaattatgacagaaaaagacatggaactttttcgggatatccaggaacaagcactacagaaggttggggtgacagggccacccgatcctcaggtgcgctgcccctcagtcattgaattcggcaaatacgagatccatacctggtattcctcaccgtatccccaagagtatagtagactgcccaagctgtatttatgtgaattttgcttgaagtacatgaagagtaggactatcttgcaacagcacatgaaaaagtgtggctggttccaccctccagctaacgagatttatcgtaaaaataatattagtgtgtttgaggtggatggaaacgtgtccaccatttactgtcaaaacctgtgcctcctggccaagctgttccttgaccacaagaccctgtactatgacgtcgagccatttctgttctacgtgctaacacagaatgacgtaaaaggatgccatctcgtggggtatttttccaaggagaaacattgtcagcagaagtacaacgtcagctgcatcatgatcctgcctcagtaccagaggaaaggatacggcagattccttatagacttctcttacttactgtctaaacgggagggacaggccggcagtcctgaaaagcccctgtctgacctgggccgacttagctacatggcatattggaagtctgtgatcctggagtgtttgtaccatcagaatgacaaacagatctctatcaaaaagctgtctaagctcactggcatatgcccacaagacatcacgtcaacactccaccaccttagaatgctcgattttcggagcgaccagtttgtgattatccggagagaaaagctcattcaggatcatatggctaagctgcagttgaatttgaggcccgtggacgtcgacccagaatgtctgcgatggacccccgtaatagtatctaattccgtggtgagtgaagaggaggaggaagaggctgaggaaggagaaaatgaggagccccaatgccaggaaagggagcttgagattagtgtgggaaagagcgtgtctcatgagaacaaagagcaggattcatattcagtggagtccgagaagaaacccgaagttatggccccagtgtcaagcaccagactcagcaagcaagtgttgccccacgacagcctgcctgccaacagtcagccgagccggcgtggtaggtgggggaggaaaaatcgcaagacccaggaacgctttggcgacaaagattctaaacttctgttagaggagacttcctctgctccacaagaacagtatggcgagtgtggagagaaatccgaggcgactcaggaacaatatactgaatccgaagagcagctggtcgcatcagaggagcagccaagtcaggatggcaagcccgaccttcctaagcggcgcctgagcgagggggtggagccctggagggggcagctgaaaaagtccccggaggcattaaaatgtcgacttacagaaggaagcgagaggttaccccggagatatagtgaaggtgaccgagccgtactccgtgggttttctgagagctccgaagaagaagaggagccggaatccccgcggagcagctcccctccgattttaacaaaacctactctgaagaggaagaagccttttctccataggagaagacgtgttcgaaagcgcaagcatcataactcgtcagtagtaactgaaacaatctccgagaccactgaagtactcgacgaaccgttcgaagacagcgactctgagcgacctatgccaaggctggaacctacattcgaaattgatgaagaggaagaagaagaggacgagaatgagctatttcctcgcgaatacttccgacggctgtcttcacaggatgtactcaggtgccaatcaagctctaagaggaagagtaaggatgaagaggaggacgaagagtccgatgatgccgacgatacacctatcctgaaacctgtgtctctgctgcggaaacgtgacgtgaagaactccccattggaaccagacacttctactccgctgaagaagaagaaaggttggcccaaaggtaagtcccgcaagcccatacactggaaaaaaaggcccgggagaaaacccggctttaagttatcacgggaaattatgccagtctccacacaagcttgtgtgattgagccaatagtctctatacctaaagcgggacgaaagcctaaaatccaggaaagcgaggagacagtcgagcccaaagaagatatgccactgcccgaggagagaaaagaagaggaggagatgcaggctgaggccgaagaggcagaggaaggagaagaagaggacgctgcctccagcgaggtgcctgccgccagccccgccgactcctccaactcacctgaaaccgagacaaaggaacccgaggtggaagaagaagaggagaaacctagagtctctgaagaacaacggcagtccgaagaagagcagcaggagctggaggagcctgaacctgaggaagaagaggacgccgccgcagagacagcacagaatgacgaccacgacgccgacgatgaggacgacgggcatctagaaagcacaaaaaaaaaagagctggaggagcaaccgactcgcgaggatgtgaaggaggaacctggcgtacaggaaagcttcctggatgcaaatatgcagaagtctcgggagaagataaaggataaagaggaaaccgagctagactcagaagaggaacagccttctcacgacacctccgtggtttccgagcagatggctggctctgaggacgaccatgaggaagacagccacactaaggaggagctgattgaactgaaggaggaagaagagataccacactctgagctggatctcgaaaccgtccaggctgtgcagagcctaacgcaggaggagtcaagcgaacacgagggggcataccaggactgcgaagagactttggcggcctgccagactctgcagtcgtatacgcaagccgatgaggaccctcaaatgtctatggtggaagactgtcatgcaagcgagcacaactctccgatcagctctgtgcaaagtcatccaagccaatcagtcaggtctgtgtcgagccccaacgtccccgccctggaaagcgggtacacacaaatctcccccgagcagggctccctctcggcccccagcatgcaaaacatggagacgagccctatgatggatgtgccttctgtttccgaccatagtcagcaagttgtggattccggcttctccgatctcggaagcatcgaatcgactacagagaattacgaaaatccctcaagctacgatagcactatgggcggtagcatctgcgggaattcatctagtcaatcatcgtgcagttatggcggactgtcctctagctcatctttaactcaaagtagttgtgtcgtcacacagcagatggcttcaatggggtctagttgttctatgatgcagcagtccagcgtacagccggcagcgaattgttcaattaaaagcccacagagctgtgtagtggaaaggccaccgagcaaccagcaacagcaaccgcctccccctccaccgcagcaaccacagccaccgcccccacaaccacagcctgccccccagccaccccccccccagcagcagcctcagcagcagccccaaccacagccacagcagcccccaccccctcccccgccgcagcagcaaccacccctctctcagtgcagtatgaataattccttcactccagctcccatgatcatggagattccagagagcgggtctactggcaacatcagcatctacgaacgcattcctggtgattttggcgctggcagctatagccaacccagcgccacattttctctcgcgaaactccaacaactgacaaacactatcatggatccacacgcaatgccgtacagccactctcccgcggtgacaagctacgctacatctgtcagcctgtcaaacaccggtctggcccaacttgctccatcacaccctcttgcaggaactccccaggctcaggctacaatgacccctcctccaaatttagcatcgaccaccatgaacctaacatccccgttactgcagtgcaatatgagtgcaacaaatatcgggatcccacacacacagcgactccaagggcagatgcctgtgaaagggcacataagcattcgttccaagagcgcccctctgcctagcgctgcggcccaccagcagcaattgtacggacggtcgccctctgccgtggccatgcaggcgggccctcgcgccctcgcggtacagagagggatgaatatgggcgtcaatcttatgccaacccccgcctataacgtgaacagcatgaacatgaacactctgaacgctatgaattcttaccgtatgacacagccaatgatgaactcatcctatcatagtaatcccgcttacatgaatcagacagcacagtatcccatgcagatgcagatgggcatgatggggtcccaggcttatacccagcagcccatgcagcctaatcctcacggcaacatgatgtacaccggcccaagccatcatagttatatgaatgccgcaggagttcccaagcagtcactgaacggtccttatatgcgtaggtag

SEQ ID NO: 19583 - DNA, 42 bp, Artificial Sequence; identical to SEQ ID NO: 8477
  Description of Artificial Sequence: Synthetic coding sequence

SEQ ID NO: 19584 - DNA, 2448 bp, Artificial Sequence
  Description of Artificial Sequence: Synthetic coding sequence
atggtgaagctggccaaccccctgtacaccgagtggatcctggaggcgattaagaaagttaagaaacagaagcagaggccgtccgaggaacgcatttgtaacgccgtgtcttcctctcatggactggacagaaagaccgtgctcgagcagttggagttgagcgtcaaagacggaaccatcctaaaagtgagcaacaaggggttgaatagctacaaggatcccgataatcctggcagaatcgcactccccaaaccaagaaaccatggcaagctggacaacaagcagaatgtggattggaataagttaataaagagagctgtcgaagggttagccgagagtgggggttccactcttaagagtatcgagcgctttctgaagggccagaaggatgtgtccgccctattcggcggttcggcggcttcaggatttcatcaacagctgagattggcgattaaacgtgccattggacatgggagactgttaaaagatgggcccctgtacaggctgaatacgaaggccactaatgtagacggcaaggaatcctgcgagtctctgagctgcctccccccagtgtctctcctgccccacgagaaggataaaccagttgcagaacctataccgatttgctctttttgtctgggaacaaaagagcagaatagagagaagaagcctgaggagttgatcagttgtgctgattgcgggaattctggccacccttcctgtcttaagttctccccggaattgactgtgagggtaaaggccttgcgctggcagtgcatcgagtgcaagacatgttccagttgcagggatcagggcaagaatgccgataacatgttattttgtgatagttgtgataggggattccatatggaatgctgtgaccctccccttactagaatgccgaaaggtatgtggatttgtcagatttgccggccgaggaaaaaaggtcggaaactgctgcagaaaaaagccgcgcaaattaagagacggtatacaaaccccattggtagacccaaaaaccgactgaaaaagcaaaatactgtcagtaagggtccattttccaaggttcggaccgggcctgggagagggagaaagcgcaagatcacattgtcctcacagtcagcgtcctcatcaagcgaagaaggttacttggagcgaatcgacggcctggacttttgccgggacagcaacgtgagcctgaaattcaataaaaagacaaaggggcttatcgatgggctcaccaaattttttactccttccccagacggtcgaaaggcgcgcggcgaggtagtggattactctgagcaatatagaattaggaagcgcgggaacaggaagagctccacttcagattggccaactgacaaccaggatggctgggatggaaaacaggaaaacgaggaaaggctttttggcagccaagaaattatgactgaaaaagatatggagctctttcgagacatacaggagcaggctttacaaaaggttggcgtgacgggccctcctgatccacaagtgagatgcccatcagtcatagaattcggaaagtatgagatacacacttggtattcctctccatatccccaggagtattcgcgtcttccgaagctatacctgtgcgaattttgtctgaaatacatgaaaagccggactatcctgcagcagcatatgaagaaatgcggctggtttcacccacctgccaatgagatatatcgaaagaacaacatttccgtgtttgaggttgatggaaatgtgtccacaatctattgtcagaacttatgcctcctagcgaagctctttctggaccacaagacactgtattacgatgtggagcccttcctgttttacgttttaacgcagaacgacgttaagggatgtcatctagttggttacttttctaaggaaaaacactgtcagcaaaagtacaacgtcagctgcatcatgatccttcctcagtaccagcgaaagggttacgggagatttctgatcgactttagctacctcttgtccaaacgagaggggcaggcaggctcccccgaaaagcctctgtctgacctcggccgtttgtcatacatggcctattggaaaagtgtcatcctggaatgtctgtatcaccagaacgataaacagatatcaataaagaagttaagcaagctgaccggtatctgtccccaggacattacttctacactgcaccaccttaggatgttggactttagatcagaccagttcgtcatcattagacgagaaaaacttatccaggaccacatggccaaattacagctgaatctgcggcccgtagacgttgatccagagtgtctccggtggacccccgtaattgtttccaacagcgtagttagcgaggaagaagaagaggaagctgaggaaggagagaatgaagagccacagtgccaggaacgtgagctggagattagtgtcagggcctag

SEQ ID NO: 19585 - DNA, 1836 bp, Artificial Sequence
  Description of Artificial Sequence: Synthetic coding sequence
atgccccggcggaagcggaacgccggcagcagcagcgacggcaccgaggacagtgacttctctacagatcttgaacataccgacagctcagagagtgatggaacatcccgtcgaagtgcgagggtgactaggtctagtgccagactcagtcagtccagccaagattctagcccagtccgtaatctccagagctttggcactgaggagccagcttattccactagacgcgtcacccgaagtcagcagcagccaactcccgtgacaccaaaaaagtatccactgaggcagacacgttcgtccggcagtgagacagaacaagtcgtggacttttccgacagagaaactaagaataccgctgaccatgacgaaagccccccgaggaccccgaccgggaatgcgcctagcagtgagagcgacatcgacatttctagccctaacgtctcccacgatgaatctatagcaaaggatatgtccctcaaagactccggaagcgacctttcccacaggcccaaaaggcggcggttccacgaaagctacaacttcaacatgaaatgtcctactccaggctgcaactccttgggtcacctgaccggcaagcatgagagacatttcagtattagtggatgccccctgtaccataacctgagcgccgacgaatgcaaggttcgggcccaaagcagggacaagcagattgaagaacgcatgctatcccatcgccaagacgataacaaccgtcatgccacccgccaccaggcacctaccgaacgccagctccgatacaaggagaaagtggctgaactacggaagaaaaggaactccggcctgagtaaagagcagaaggaaaagtatatggagcatagacagacatatggaaacacacgtgagcctctgttggaaaacctcacatcagagtacgatctggacttatttcgcagggcccaagcaagggcttcggaggatcttgagaaattgcgactgcagggtcagataacagaaggaagcaacatgatcaaaaccattgcctttggtcggtatgaactggacacgtggtaccactcgccctacccagaagaatacgcccgcctggggcgtttatacatgtgcgagttctgcctcaaatacatgaaaagtcaaacaatcctccggcgacatatggctaagtgtgtgtggaaacatccgcccggcgatgaaatttatcgcaagggatctatctctgtctttgaagttgacggaaagaagaacaaaatttactgtcagaatctgtgcctgctcgcaaagctcttcctggatcataaaactctgtattacgatgttgaaccatttctgttctacgtgatgacggaggctgacaatactgggtgtcacctaatcggttatttctcgaaagaaaagaacagctttttaaactacaatgtgtcttgtatcctgaccatgccgcagtacatgcggcagggttacggcaaaatgctcatagacttctcttatttgctctccaaagtcgaggaaaaggtaggcagtcctgagcgacccctgtctgacctgggtctgatcagctaccgttcatactggaaggaggtcttgctgcggtatctgcataatttccagggaaaggaaattagcatcaaggagatctctcaggagacggccgtcaacccggttgatatcgtctccaccctgcaggccctgcagatgttaaagtattggaagggaaagcacctggtgttgaagcgacaggacttaatcgatgagtggattgcaaaagaagctaagagatccaactccaataagacaatggatcccagctgcctgaaatggaccccacccaagggcacctag

SEQ ID NO: 19586 - DNA, 1746 bp, Artificial Sequence
  Description of Artificial Sequence: Synthetic coding sequence
atgccccggcggaagcggaacgccggcagcagcagcgacggcaccgaagatagcgattttagcaccgatttggagcatacagatagcagtgaaagcgatgggacatccaggcggtcggccagagtgacgcgcagctctgcccgcctctcccagtctagtcaagatagcagtcccgtgcgcaacctgcaaagtttcggcaccgaggaacctgcgtattccacaagacgagtgaccaggtcacagcagcagccgaccccagtcaccccgaagaagtatcctctgcgccaaacccgttctagtggatccgagactgagcaagtcgttgatttctccgaccgcgaaacaaaaaatacagcagaccacgacgagtcacccccccgcactcctaccggaaatgctccctcatcagagtccgacatagacattagtagtccaaacgtatcccacgatgagagtatcgcaaaagacatgtctcttaaagattcagggtctgacctttcgcaccggcctaagcgcaggcgctttcacgagagttataatttcaatatgaagtgccctactcctggatgtaactccttggggcatcttacaggtaaacatgagcgccatttctccatttccggctgccccctttatcataacctgtccgcagacgaatgtaaagcaccaactgaacgtcagcttcgctacaaggagaaagtcgctgaactcaggaagaaaagaaacagcgggctatctaaggaacagaaggagaagtacatggaacatagacagacatatgggaataccagagagcccctgctagaaaatctgaccagcgagtatgacttagatctgttccgtcgagcccaagctagggcctccgaggacctcgagaaattgagactgcagggacaaataactgaaggtagcaatatgatcaagacgatcgcatttggaaggtacgagctggatacttggtaccattcaccttaccccgaagaatatgcccggctaggtaggctttacatgtgcgaattttgtctgaagtacatgaagagtcagactatactgcggcgacacatggcaaagtgcgtatggaagcacccccctggtgacgaaatctaccggaaaggatcaatctccgttttcgaggtggacggaaagaagaacaaaatttactgccagaacctctgtctgctggcgaaattattcctcgatcataagactttatactacgacgttgaaccgttcctattttacgttatgactgaggccgacaataccggctgccacttaatcggttattttagcaaagagaagaattcttttctgaactataacgtgtcctgcatcctcacaatgcctcagtacatgaggcaaggctacggcaagatgttaatagacttttcatacctcttatcaaaggtggaggagaaggtggggagtccagagagacctctctccgacctgggactcatcagctaccgctcttactggaaggaggtgctgctgaggtacctccacaactttcaggggaaggaaatctcgataaaggagatctctcaggagacagctgtgaacccagtggacatcgtgtcaacactccaagctcttcaaatgctcaagtattggaagggaaaacatctggtgctgaagcgccaagacctcatcgacgaatggatagctaaggaggccaagagaagcaatagtaataagactatggatcccagctgcctgaaatggactcccccgaaaggtacttag

SEQ ID NO: 19587 - DNA, 1278 bp, Artificial Sequence
  Description of Artificial Sequence: Synthetic coding sequence
atgagcctgaaggacagcggcagcgacctgagccaccggcccaagcgcagaaggtttcacgaaagctacaatttcaatatgaaatgtcctaccccaggatgtaattcactggggcatctgacggggaaacacgagaggcacttctcgatcagcggctgccccctgtaccataatctgtcagccgatgagtgtaaggctcccactgaacgccaactgagatacaaggaaaaggtcgcggaactgaggaagaagaggaatagcggcctgtccaaggagcaaaaagagaagtatatggagcaccggcagacctatggcaacaccagagagcctctgctggagaatttaacatccgagtacgacctagacctgttcagaagagcacaggctcgggccagtgaggacttagagaaactcaggcttcagggacagatcaccgaagggtctaacatgatcaagaccattgcattcggacgttatgagttggacacttggtaccacagtccttaccccgaggagtacgcgcgtcttggcaggctctacatgtgtgagttttgcttaaagtatatgaagtctcagaccatcctgcgccggcacatggctaagtgcgtgtggaaacaccctccaggggacgaaatctatcgtaagggatcaattagtgtgttcgaagtggacggaaagaaaaacaaaatttattgccagaatctgtgtctgctggccaaactttttttggaccacaaaacgctgtactacgacgttgagccctttctgttttatgtgatgacagaagcagataataccggctgccatctgatcggatatttttcaaaggagaagaatagtttcctgaattataacgtgtcttgcattctgaccatgccccaatatatgcggcagggctatggcaagatgcttatagatttttcctatctcctgagcaaagttgaagagaaagtaggatcccctgagagaccactgtccgacctgggactcatttcgtatcgatcgtactggaaagaggtgctgttaaggtacctgcacaatttccagggcaaggagatctcaattaaggaaatctcacaggaaactgcagtaaatccagtggacatcgtctctacccttcaggccctgcagatgcttaaatattggaagggaaaacatctggtcctcaagcgacaagacctgatcgacgagtggattgccaaggaggctaagcgcagcaattccaacaagaccatggaccccagctgcctaaaatggactccccccaaagggacatag

SEQ ID NO: 19588 - DNA, 1419 bp, Artificial Sequence
  Description of Artificial Sequence: Synthetic coding sequence
atgccccggcggaagcggaacgccggcagcagcagcgacggcaccgaggacagtgacttcagcacagatctggagcataccgatagctccgagagcgacggaacttcaaggaggagcgcaagagtcacacggagtagtgcccgtctgtcacaaagctcccaagggcatctgactggaaagcacgagaggcactttagtatttcaggctgtccattgtaccacaatctcagcgcagatgagtgcaaggttcgggcccagagtcgtgataagcaaatcgaagaacggatgctgagtcaccgacaggacgataacaatcgtcatgccacaagacaccaggcccctaccgagaggcaacttcgctacaaggagaaggtggccgaacttcggaaaaaaaggaattctggcctgtcgaaggagcagaaagagaagtacatggaacacagacagacttacggtaatacccgggagccactcctcgagaatctgacctctgagtatgatcttgatctgtttaggcgggctcaggcacgcgcgagcgaggatctcgaaaagttacgcctgcaggggcagatcaccgagggttcaaatatgattaagaccattgccttcggacgatatgaactggacacgtggtaccactctccataccccgaagaatatgcacggttgggacggttgtacatgtgtgaattctgccttaaatatatgaaatctcagactatcttgcgccgccacatggcgaaatgtgtctggaagcaccctcccggggacgagatttaccggaaaggcagtatctctgttttcgaagtcgacgggaagaagaataagatctattgccaaaatctgtgtctccttgctaagctgtttctggatcataaaaccctatactacgacgtggaaccgttcttgttctacgtgatgacagaggctgacaacactggttgccatcttattggatattttagcaaagagaagaattcctttcttaattataatgtgagctgtatcctgactatgccacagtacatgaggcagggttacggcaagatgcttatagactttagctatctgctctctaaagtcgaggaaaaggtgggcagtcctgaacgacctctctccgacctaggattgatttcctaccgaagctattggaaggaggttctactccgctatctgcataactttcagggtaaagagatcagtattaaagagatctctcaggaaacagcggttaaccccgtcgacatcgtttctacgctccaggcccttcagatgctaaagtactggaaaggaaagcacctggtcctgaaacgtcaggacctcattgatgagtggattgccaaggaggctaaacgaagtaattcaaacaagaccatggatccaagctgtctgaagtggaccccaccaaagggcacctag

SEQ ID NO: 19589 - DNA, 1368 bp, Artificial Sequence
  Description of Artificial Sequence: Synthetic coding sequence
atgagcctgaaggacagcggcagcgacctgagccaccggcccaagaggcgccgctttcacgagagctataattttaacatgaagtgcccaacacctggttgtaatagcctcggtcacttgacagggaaacatgaacgccatttctctatttccggctgtcccctgtatcataatttgagcgccgatgaatgtaaggtgcgggctcaatctcgtgacaagcagatagaggagcgaatgctgtcgcatagacaggatgacaacaatcgacatgcaacccgacatcaggcaccgaccgagaggcagctccggtataaagagaaggtggcggagctgcgtaaaaaaagaaactctggtttgtccaaggaacagaaagaaaagtatatggaacataggcagacctacggaaacaccagggagccactcttagagaatttgactagcgaatatgatctggacctatttagaagggcgcaggctcgggcgtcagaagatctcgagaaactccggttgcagggacaaatcacagagggatcaaatatgatcaagactatcgcattcggacgatacgaactcgacacgtggtatcacagtccttatcccgaagaatatgcgaggctgggccgattgtatatgtgtgaattttgcctcaagtacatgaagagccagacaatattgaggaggcatatggcgaagtgtgtgtggaagcacccccccggggatgagatctataggaaaggctcgatctcagtgttcgaggtggacggtaagaagaacaaaatttattgtcagaatctctgcttactcgccaagctgttcctggatcataaaacactgtactatgatgttgaaccattcctattttatgttatgacagaggcagacaatactggctgccacctgattggctatttcagcaaggaaaagaattcattccttaactataacgttagttgtatcctcaccatgccgcagtacatgcgacaaggttacgggaaaatgcttattgatttttcttacctcctctctaaagttgaggaaaaagttggctctcctgagcgtccgctgagcgatctggggctgataagctacagatcttactggaaagaggtgttattgaggtatctccacaacttccagggtaaggagatttcaattaaagagatctctcaggagactgcagtgaacccagtggacatcgtatccacactgcaggccctacagatgctgaaatattggaaaggcaagcatctggtgcttaaacggcaagaccttatcgatgagtggatagccaaagaagccaaaaggtctaacagcaacaaaacaatggacccatcctgcctcaaatggactcctccaaaaggaacttag

SEQ ID NO: 19590 - DNA, 1506 bp, Artificial Sequence
  Description of Artificial Sequence: Synthetic coding sequence
atgccccggcggaagcggaacgccggcagcagcagcgacggcaccgaggattcagatttcagcacagatctcgagcataccgactcctcagaatctgatgggacttccaggaggagtgcccgtgtgaccagaagctctgcccggcttagtcaaagttcacaggattcatcccctgtccggaatttgcaatccttcgggaccgaggagcctgcctattctacgaggagggtgacgcggagtcagcaacagccaacccccgtcactcctaaaaagtaccccttgcgacagactaggtcatccgggtccgaaacagagcaggtggtggattttagcgatcgtggacatctgaccggtaaacacgaacgacacttttccatcagtggctgcccactctaccacaacttgagcgcagacgagtgtaaagcccccacggagcgacagctgcgttacaaggaaaaggtcgctgaattgaggaagaagcggaattcaggcctgtctaaagaacagaaggagaagtatatggaacatcggcagacctatggcaacactcgagaaccactgctggagaaccttaccagtgagtacgacctagacctgttccggcgagctcaggcccgggcctcggaggacctggaaaagctccggttgcaaggacagatcactgaaggatcaaacatgatcaaaactattgcctttggacggtatgaactggacacatggtaccactctccctaccctgaagaatacgcgagactgggccggctttacatgtgtgaattttgcctgaaatatatgaagagccagacaatcctcagaaggcacatggctaagtgtgtctggaaacacccacctggggacgagatctatagaaagggctctatctctgtgtttgaggtggacggaaaaaagaataagatttattgtcaaaacctctgtctcctcgcaaagctgttcctggaccacaagacactatactatgatgtggaaccatttctcttttacgtgatgacagaagccgacaatacaggctgccatctaattggttattttagtaaagaaaaaaactctttcttaaattacaatgtctcttgtattctgacaatgccgcaatatatgaggcagggctatggaaagatgctgatcgacttctcgtaccttctgtctaaggtagaagagaaggtgggctcacccgaacgcccactctcagatctgggtctgatctcctaccggagctattggaaggaggtactccttcggtatctacataacttccagggaaaggagattagtatcaaagaaatctcacaggaaaccgcggtgaaccccgtcgatattgtctcaactttacaagctctccagatgctcaagtattggaagggcaaacatctagtattaaagcggcaggatctcatcgatgagtggattgccaaggaggcgaagagaagcaactctaacaagaccatggacccttcgtgcctcaagtggacaccccctaaaggaacatag

SEQ ID NO: 19591 - DNA, 1329 bp, Artificial Sequence
  Description of Artificial Sequence: Synthetic coding sequence
atgccccggcggaagcggaacgccggcagcagcagcgacggcaccgaggactctgatttcagtacagacctggaacacactgattcttccgagagtgacggtactagccgccggtccgctcgagtgacaaggagctccgctagactcagtcagagtagccagggacacttgacaggcaaacatgaacggcacttttcaattagtggctgccccctttaccacaatctcagtgcagatgagtgcaaagccccaacggagcgccagttgcgatacaaagagaaagtggctgaactccggaaaaagaggaacagcgggctatccaaagaacaaaaagaaaagtacatggaacacagacagacatatggcaatactagggaaccgctgctggagaacctgacctccgaatatgatctggacttgttccgccgggcgcaggcaagggctagcgaggatttggagaagctgcgccttcagggacagatcacggaggggtccaacatgataaagaccattgcattcggcaggtacgaattggatacctggtatcacagcccttatcctgaagagtacgcccggctgggccgcctgtacatgtgcgagttttgtctgaagtatatgaagtcccaaaccatcctcagacggcatatggcgaagtgcgtgtggaagcacccacctggggacgagatttaccgaaaaggcagtatatccgtcttcgaggtagacggcaagaagaacaagatttactgccagaatttgtgtcttcttgctaagttatttctagaccacaaaacactttattatgacgtagaaccctttctcttttatgtgatgactgaagctgataacactggatgccatttgataggctacttcagcaaagagaaaaactcctttcttaactacaacgtgagctgcatccttacgatgccccagtacatgcgccagggctatggtaagatgctcatagatttctcatatctgttgagcaaagtcgaagagaaagtcggctcgccagagcggccccttagcgacctgggcctcatctcctaccgctcctattggaaagaagtgctgctgcggtacctgcataactttcagggtaaagaaatctccattaaggaaatctctcaagagacagccgtaaaccccgtagatatcgtgagtacactgcaggccttgcagatgttgaaatattggaaaggaaagcacctggttctgaaaagacaggatctgattgatgaatggatcgctaaggaagccaaacgctccaactccaataagaccatggatcctagttgtctcaagtggactcctccaaagggaacctag

SEQ ID NO: 19592 - DNA, 1239 bp, Artificial Sequence
  Description of Artificial Sequence: Synthetic coding sequence
atgatcctggccagcgtgctgcggagcggccccggcggcggcctgcccctacgcccgcttctcggccccgcattggcactcagggccaggtctacatctgccaccgacactcatcacgttgagatggcccgggaaagaagcaagaccgtcactagcttttataatcagagtgccatcgacgctgcggctgagaagccgtcggtgcgccttacccctacaatgatgctgtacgccgggaggtcacaagatggatctcacttacttaagagtgctaggtacctgcaacaggagcttcccgtgcggatagctcacaggataaaagggtttaggtgcctgccatttatcattggctgtaatcctacaatcctccatgtgcacgaattgtatatcagagcctttcagaaactgactgattttccacctatcaaagaccaagccgacgaagctcaatactgccaattggtgagacagttactggacgaccataaagatgtcgtaaccctgcttgcagaaggactcagagaatccagaaaacatatcgaagatgagaaattggtgcgatatttccttgataagactctgacctctaggctggggattagaatgctagccacccatcatttggcattgcacgaagataagccggactttgttggtatcatctgtacccgtctgtcccccaaaaaaataatagagaagtgggttgatttcgccaggcggctttgcgagcacaaatacggtaacgcaccaagagtacgcataaacgggcacgtcgccgccaggtttcccttcattcccatgccactcgattacatattgcccgaactgctcaagaacgccatgagagcaacgatggaatctcacctggacactccatataatgtgccagacgttgttatcactatcgccaataacgacgtcgaccttatcatccggatctcggaccggggcggaggcattgcacataaggatttggatagggtcatggattatcacttcaccacagcggaggcctccacgcaggacccgcggatctcccccctgtttggccacctggatatgcattcaggagcccaatcagggccaatgcatgggtttggcttcggactgccgacaagtagggcctacgccgaatacctgggaggttccctccaactacagtctcttcagggaattggcaccgatgtctatttgaggctacgccacattgacggacgcgaagaaagcttccgaatttag

SEQ ID NO: 19593 - DNA, 1404 bp, Artificial Sequence
  Description of Artificial Sequence: Synthetic coding sequence
atggccgcccagggcgccgccgccgccgtggccgccggcaccagcggcgtagccggcgagggtgagccaggacctggcgaaaacgccgctgctgagggcactgccccaagtcccggtcgcgtatctccacccacacctgcaaggggcgagcccgaagttaccgtggagataggtgagacctatctttgtcggagaccggatagcacgtggcactctgcagaagtgattcagtcccgagtgaacgaccaggaaggccgcgaagaattttacgtgcactacgttggattcaaccggcgattggatgaatgggttgacaaaaatagactcgcattgacgaagacggttaaggatgctgtgcagaagaattcagagaaatacctatctgaacttgctgaacagcccgaaaggaaaatcacccgcaaccagaaacgaaaacacgacgaaatcaaccacgtgcagaaaacgtatgccgaaatggacccaaccaccgccgccctggagaaggagcatgaggccattactaaagtgaaatatgttgacaagatccatattggtaattatgagattgatgcttggtacttcagtcctttccctgaggactacgggaagcagccaaaactttggctctgtgaatactgtttgaaatacatgaaatacgaaaagagttacaggttccatctgggtcaatgccaatggagacagcctcctggtaaagagatttatcgcaagtctaacatcagtgtgtatgaagttgatggcaaagaccacaaaatctactgccagaatctgtgcctgctcgcgaaactgttcctggaccataagactttgtactttgatgtcgaacccttcgtgttttacatacttactgaggtcgatcgacaaggtgcccacattgtagggtacttttcaaaggagaaagagtctcctgatgggaataacgttgcttgtatcctgactcttccaccctatcagaggcgtggctacgggaagttcctgattgccttttcttacgagttgagtaaactagaatccactgtgggttctcctgaaaaacccctgtccgatctgggaaaactttcataccggagctactggagttgggtgctgctggagattctgagggatttccggggaacgctgtcaattaaagacctgtcccagatgacaagtatcactcaaaacgacatcatcagtactctccagtcactcaacatggtgaaatattggaaagggcagcacgtgatttgcgttactcctaagctcgtggaggagcatttgaagtccgctcagtataaaaagccccctataacggggggatggggagccgcggtgtgcagaggtagatggggatcagtgtctatctggacaggtcgcagtcagggtctcctcatcgctgtgacttag

SEQ ID NO: 19594 - DNA, 1221 bp, Artificial Sequence
  Description of Artificial Sequence: Synthetic coding sequence
atggccgacggcaacgaggacctgcgggccgacgacctgcccggccccgcgtttgagtcctacgagtctatggaactggcatgccccgcagagaggtctggacacgtggcagtgtccgatggcagacatatgtttgtctggggaggatacaagtcgaaccaggttaggggactgtacgatttttatctgccccgagaggagctctggatctacaacatggaaacgggtcgctggaaaaagatcaataccgagggagatgtccccccgagcatgagcggctcctgcgccgtgtgcgttgaccgcgtgctgtaccttttcgggggtcaccacagtagaggaaataccaataagttctatatgctggactcccgtagcacagacagagttcttcagtgggagaggattgactgccaggggatccccccgagctctaaggacaaactgggcgtgtgggtgtataagaataaattgatctttttcggcggctacgggtacctgcccgaggacaaggtgctgggaaccttcgaatttgatgagacctcattttggaactcatcccatcctcggggatggaatgatcatgtgcatattctcgatacagagacctttacttggagccaacctattaccacaggcaaggcccctagcccccgagccgcacatgcctgcgccactgtcggaaaccgaggctttgtgttcggagggcggtaccgagatgcccggatgaacgacttgcactatctcaatcttgacacctgggaatggaatgaactcattcctcaagggatctgtcccgtggggcgctcatggcactctttgacacccgtgagtagtgatcacttattcctgttcgggggcttcacaacagacaaacagccgctgtccgacgcttggacatattgtatttccaagaatgagtggattcagttcaaccatccatataccgaaaaacctaggttgtggcacaccgcctgtgcctccgacgagggcgaagttatcgtatttggagggtgtgcaaacaatctcctcgtgcatcacagagctgcccacagcaacgaaatattgattttctctgttcagcctaaatctctggtgcgattgagcctagaagctgtgatctgcttcaaagagatgttggcaaatagctggaattgtttacctaagcatttattgcattcggtgaaccagagatttggttctaacaataccagcgggagctag

SEQ ID NO: 19595 - DNA, 411 bp, Artificial Sequence
  Description of Artificial Sequence: Synthetic coding sequence
atggtgaacagctgctgcggcagcgtgtgcagcgaccagggctgcgggttggaaaattgttgtcggcccagctgctgccagacgacatgttgcaggacaacatgctgccgacccagttgttgtgtctctagttgctgtcgaccccagtgttgccaaagcgtgtgctgtcagcccacctgctgtagtccatcctgctgtcagacaacttgttgccgcaccacatgctgtagaccctcgtgctgcgtgtcttcatgcttcagaccccagtgttgtcagtctgtgtactgtcagcccacttgctgtaggccgtcttgcggacagacaacctgctgcagaacgacttgctacaggccgagttgctgtgtgtccacctgctgtcgtccgacatgtagctccggatcatgctgttag

SEQ ID NO: 19596 - DNA, 762 bp, Artificial Sequence
  Description of Artificial Sequence: Synthetic coding sequence
tgctgccaccccagctgctgccagaccacctgctgcaagaccgcctgctgctgccggagtttcttaaccactgccccccagactacttgttgctgccccagctgtgtagtcagctcctgttgtaggccctcttgtagtcagacaacatgctgccagactacctgttgtcgtccctcatgctgccatccagtgtgctgtcagacgacatgccgtccaagctgtggagtgagttcctgttgccgcccactttgctgtcagacaacatgccacccaagctgtggcatgtcttcctgttgtcggcccctctgctgccaaaccacatgcagacctagttgcggagtcagcagttgctgcagacctctgtgctgccagacgacttgctgtcgtgctacatgttgcaggccaaactgctgtcggccatcctgctgccagaccacctgctgtaggacaacctgttgccgccctagctgttgcgtctcttcgtgttgccgtccgcagtgctgccagagtgtgtgctgccagcctacatgctgttccccttcatgctgccagaccacttgctgtcgtacaacttgctgcaggccgtcatgttgcgtaagttcttgcttccgcccccagtgttgccagtcagtctactgccaaccgacgtgctgcaggcctagttgtggtcagactacctgctgccgcacaacttgttatcgtccctcgtgttgtgttagcacttgttgcagacccacttgtagttccggctcctgctgttag

SEQ ID NO: 19597 - DNA, 1332 bp, Artificial Sequence
  Description of Artificial Sequence: Synthetic coding sequence
atgcagcggcgggacgaccccgccgcccggatgagccggagcagcggccgctccggctctatggatcccagcggcgcacacccttccgtgaggcaaacaccctccaggcagccaccactcccacacagatccaggggggggggaggagggtcacgcggcggcgctcgcgccagccccgccactcagccccccccccttctgcctccgagtgcgacggggcctgatgctactgtagggggccccgccccgacccccctgctgcccccttcagccacggctagcgtcaaaatggagcctgaaaataaatatctgccggagttaatggccgagaaagacagtttggatccaagctttactcatgctatgcaacttctgaccgccgagattgagaagattcagaaaggagactccaagaaagacgatgaggaaaactacctggacctgtttagccacaaaaacatgaagctgaaggagagagtactgattcccgtgaagcagtaccccaaattcaactttgtgggaaaaattcttggcccccagggcaatacgattaaacggctgcaggaggagacaggagcaaaaatttcagtgctgggcaagggctccatgagggataaagccaaagaggaggaactgagaaaaggaggcgatcccaaatatgcccacttaaatatggacctgcacgtattcattgaggtgttcggcccgccttgtgaagcatacgccctcatggctcacgcaatggaagaagtgaaaaaattcctagtgcccgatatgatggacgacatttgtcaggagcaattcctagaattatcatatctcaatggcgtccctgaaccctctcggggccgcggcgtcccggtgagaggcaggggcgccgcacctccaccgcctcctgtcccgcgaggtaggggggtcggtccgcctaggggcgcgctggttcggggcacccccgtgcgaggcgcgatcacccgaggcgccacggtgacacgcggcgtgccaccgcctcctaccgtgcggggagcccctgcgccacgggctagaaccgccggaatccagagaataccattgccccccccccctgccccagaaacttacgaggagtacggctacgatgatacctatgccgagcagtcttatgaaggctacgagggttattactcacagtcccagggtgacagcgagtattacgactatggtcatggcgaagtgcaggattcctacgaagcctatggacaagacgactggaacggtactcgacctagcttaaaggccccaccggcaaggccagtgaagggagcttaccgagagcacccttatggccgatattag

SEQ ID NO: 19598 - DNA, 1260 bp, Artificial Sequence
  Description of Artificial Sequence: Synthetic coding sequence
atgcagcggcgggacgaccccgccgcccggatgagccggagcagcggaaggtctgggagcatggacccaagcggcgcccatccctccgtgagacagacaccatctcgccaaccccctccgccccttctgccaccatcagctacaggaccagatgccacggtgggcgggccagcgcctactccactgttgccgcccagcgccaccgcctcagtgaaaatggaacccgaaaacaaatacttgcccgaactgatggcagagaaggattccttggacccctcttttactcacgcaatgcagctgctcacagctgaaatagaaaagattcagaagggggatagcaagaaggatgatgaggagaactacctcgacctgtttagccataagaacatgaagctcaaggaaagggtgctaatccccgtcaagcagtaccccaagtttaactttgtgggtaaaatcctgggaccacagggcaataccatcaagcggttgcaggaggaaacgggagcgaaaattagtgtgcttggaaaaggcagcatgcgcgacaaagctaaagaggaggagctgagaaaagggggtgaccccaagtatgctcacctgaatatggatctgcacgtgtttatcgaggtcttcggtcctccatgtgaggcatacgccctcatggcacacgccatggaggaagtgaagaaattcctggtgccagatatgatggatgacatctgtcaggagcagtttcttgaactgtcatatctgaatggcgtgcctgagccttctcggggccgcggggtgccagtccgcgggagaggagcagctcccccacctcctccggtcccccgcggacggggtgtcggtccaccccgcggggccttggtgaggggcactcccgtgcggggcgctatcaccaggggggctacagtcacgcgcggcgtgccaccaccgccaaccgtgagaggagcaccggccccccgggcacggactgcgggaattcagagaattccactgcctcctcctccagctcctgaaacatacgaggagtacgggtacgacgacacttacgctgagcagagttatgaggggtatgaagggtactactcacagagccagggagattctgaatactatgactatggtcacggggaggttcaagatagctacgaggcttacgggcaggacgattggaatgggaccaggcccagcctgaaggctccacccgccagaccagtgaagggcgcttatcgcgagcacccatacggcaggtactag

SEQ ID NO: 19599 - DNA, 1215 bp, Artificial Sequence
  Description of Artificial Sequence: Synthetic coding sequence
atgcagcggcgggacgaccccgccgcccggatgagccggagcagcggacgtagcggctctatggatccgtctggggcccatccatcagttaggcaaactccgtcacgtcagcctccgctgccacacagatcaaggggcggcggaggtggctccaggggaggtgctagagccagccccgcaactcaaccaccacccctgctgcctcctagcgccacgggcccagacgctacagtaggcggacccgcccctacccccctgttgccgcctagcgccactgcctcagtgaaaatggaacctgaaaacaagtatctcccagagctgatggccgaaaaagattcgttggatccttcttttacacatgcgatgcagctactgacagcggaaatcgaaaagatccaaaagggggatagtaagaaggacgatgaggaaaattacctggacctgttttcccataagaatatgaagcttaaagaaagggtgttgatacctgtgaagcaatacccaaaagaggaggagctccgaaagggtggcgaccccaaatacgcccacctaaatatggacctgcacgtattcatagaagtatttggcccaccatgcgaagcttatgccctgatggcacacgctatggaagaagttaaaaagttcctagtgcctgatatgatggacgatatctgccaggaacagttcctggagctaagctaccttaacggggtgcccgaaccctcccgtggaaggggcgttcctgtgagaggacgcggagccgccccacccccacccccagtcccccgcggtagaggggtcggcccacctaggggtgcacttgtacgaggcaccccagtacgcggagcgatcaccaggggcgcaaccgtgactcgaggtgtgccacctccaccaacagtacgcggggcgccagctcccagggcgcgtaccgcaggaatacagcgtattccattgccaccccctcctgccccggaaacttacgaggaatacggctacgatgatacatatgctgagcaatcttacgaaggatacgaaggctattacagccagtctcagggcgacagcgaatattacgattacggtcatggggaagttcaggatagttatgaagcctacggacaagatgattggaacggaacccggccttctctgaaagctccccctgctcgccctgttaaaggagcctacagggaacatccctatgggcgatattag

SEQ ID NO: 19600 - DNA, 1050 bp, Artificial Sequence
  Description of Artificial Sequence: Synthetic coding sequence
atggaggaggagaagtacctgcccgagctgatggccgagaaggactctctggacccatccttcgtacatgcatcccgattgttggccgaggaaatagaaaaatttcagggatctgatggaaagaaggaggacgaggaaaaaaagtacttagacgtcatttctaacaagaacatcaaactatccgaacgtgttctcatccccgttaaacaataccccaaatttaacttcgtcggtaagctgcttggtcctcgcggtaattctcttaaacgcctgcaagaggaaaccggcgccaaaatgtcaattctgggaaagggttctatgcgcgacaaagccaaagaggaggaactgcggaaaagcggggaggcaaagtatgcccacctttccgatgagttacacgttctgatagaggttttcgccccacctggggaagcgtacagccgcatgtctcatgctttagaggaaattaagaagtttctggtccccgactacaatgatgaaatcaggcaggaacagctaagagaactgtcatatctgaacggaagtgaggatagtggtcgcgggcgaggaatccgagggcgtgggattagaatcgctccaacggcccctagcagaggcagaggcggcgctatcccacctccgccgccccctggcagaggagtgcttacaccgagaggatccaccgtgactaggggggcccttcctgtacctcctgtggctcgcggcgtccctactccgcgggctcgcggagctccaactgtgcctggatatagagcaccacctcccccagctcacgaagcgtacgaagaatacgggtacgatgatggatatggcggtgaatacgatgaccagacgtatgaaacttacgacaactcatacgccactcagacacagtccgtccccgaatattatgattatgggcacggcgtgtccgaagatgcctacgattcttacgcccccgaggagtgggccaccactcggtcctctctgaaagccccacctcagagaagtgctaggggaggctacagagaacatccatacggccggtactag

SEQ ID NO: 19601 - DNA, 951 bp, Artificial Sequence
  Description of Artificial Sequence: Synthetic coding sequence
atggaggaggagaagtacctgcccgagctgatggccgagaaggactccctggatccaagtttcgtgcatgcgtctaggctgttggcagaggagatagagaaatttcaggggagcgatggtaagaaagaagatgaggaaaagaagtatctggacgttatcagcaacaaaaatatcaagctcagtgaaagagtgctaattcccgtgaaacagtatccgaagttcaactttgttgggaaactgctcggcccgcgagggaactccctcaaacggcttcaggaagaaaccggtgcaaaaatgtccattctgggaaaaggttccatgagggacaaggctaaagaagaggaactcagaaaatctggtgaggcaaagtatgcccacttatctgatgaactgcacgtgctgattgaagtctttgccccccctggcgaagcctactcccgtatgagtcatgcgctggaagagattaaaaaattcctggtgcctgactacaacgacgaaatacgccaggaacagctgagagaattaagttatttgaacgggagcgaagacagtgggcgcgggagggggatacgaggcagaggcattcgcattgctcccaccgccccatcccgggggagagggggcgcgattccccctcctcccccgcccgggcgaggggtactgactccccgcggcagcactgtcacccgtggggccctcccagtgccccccgtggcgagaggggttcctactcccagggccagaggcgctcccactgtaccaggctacagggcaccacctccccctgcacacgaggcttatgaggagtaccccagtctcccccttagtcttttttttgataccgtggccaagagtcatcagcactgcgataatgaggtcccccaaacagggtcgactcgtttgaatcctgggaggagcttttttctcgcgtggcgctgggagtgggactag

SEQ ID NO: 19602 - DNA, 1905 bp, Artificial Sequence
  Description of Artificial Sequence: Synthetic coding sequence
atggccagcgcccggatcggcgacgagtacgccgaggacagcagcgacgaagaggatattagaaataccgtgggcaacgtccccctggaatggtatgatgacttccctcacgtgggatatgacctcgacggcagacggatatacaaacctctgcgtacccgagacgaactggaccaattcctggacaagatggacgaccctgactactggcggactgtccaggatccaatgacaggaagagacctgagacttacagatgagcaggtcgccctggtgaggagactgcagagcggacagtttggcgatgtgggatttaacccatacgaacccgcggtagatttcttctctggcgatgtcatgattcacccagtaacaaaccggccagccgataaaaggtcattcattcccagcctcgtggagaaagagaaggtgagccggatggtgcacgccatcaaaatggggtggattcaaccacgccgcccacgggacccaacaccctcattctacgacctctgggcccaggaagatcctaacgccgtgttgggtcggcataaaatgcacgtgccggcacctaaactagccttacctggacacgcagagtcctataatccacccccagagtacctcctcagtgaggaggaacgactcgcctgggagcagcaggagcccggagaacggaagttatccttcctcccgcggaaatttccctctctccgggctgtgcctgcttacggccgtttcatccaggaacgtttcgagcgctgtctggatctatatctgtgccctaggcagagaaagatgagagtgaatgttgatccagaggaccttattcctaaattacctcggccacgtgacctgcagccctttcctacgtgtcaagcactggtgtatcgaggtcactctgacctcgtacgatgtctgagtgttagccctggcggccagtggctggtgtctggaagcgatgacggatccttgagactctgggaggtggctactgccaggtgtgtgcgaacagtgcccgtagggggggtggtgaaatcagtcgcatggaatccttcccccgccgtgtgtctcgtggccgctgccgttgaagactctgtgctgctgttgaatccagcactcggggaccgcctcgtggcgggatccactgatcaactcttgtctgcctttgtgccaccagaggaacctcccttgcagccagcccgctggttggaagcctccgaagaagagaggcaggtaggtctgcgcctgcgtatctgtcacggcaagccagtgacgcaggtgacctggcacggccgcggcgactacctggcggtggttctggcgacacagggacacacacaggtacttattcaccaattgtcaagaagacggtctcagtcacccttcaggagatcacatgggcaggtgcagcgcgttgcgttccaccccgcccgcccctttctgctggtggcgagccaacggagcgtccgcctgtaccacctgctgaggcaggagctgactaaaaaattgatgccaaactgtaagtgggtcagtagcctcgccgtccatccagcaggggataacgtgatctgcggatcctacgactctaaattagtatggttcgatcttgatcttagcaccaaaccctatcggatgctgcgacaccacaagaaagctctgcgggccgttgccttccatcctagatatcccttattcgccagcggtagcgatgatggctccgtgattgtctgtcatggaatggtctacaatgatctcctccaaaaccctctgctggtccccgtgaaggtgttgaaagggcacgtgctcaccagggacttgggagtgctggatgtcatcttccaccccacacagccttgggtattttcaagtggggcagacgggaccgtcagacttttcacttag

SEQ ID NO: 19603 - DNA, 1443 bp, Artificial Sequence
  Description of Artificial Sequence: Synthetic coding sequence
atgctgaacttcggcgccagcctgcagcagaccgccgaggagcggatggagatgataagcgaacgacctaaagagagtatgtacagttggaacaaaaccgccgagaagagcgacttcgaggcggtggaagcccttatgtctatgtcttgtagttggaagtccgacttcaagaaatacgtggagaatcgtcccgtgaccccagtttccgatctttcagaggaggagaatttgctccccggtacccccgattttcatacaatcccagcattttgtttaacgcctccatactccccatctgatttcgaacccagccaggtttcaaacttaatggcgccagcaccctcaactgtacactttaagagtctgtcagacaccgccaagcctcatatagctgcccctttcaaggaggaggaaaagtccccagtcagcgccccaaagttacctaaggcccaggctacaagcgtgatcagacatacagcagacgcccagctgtgtaatcaccaaacctgtcctatgaaggcggcctctatcctcaactatcagaataacagtttccgccggagaacgcacctcaacgttgaggcagcaagaaagaacatcccctgcgcggccgtcagccctaatagatcaaagtgcgaacggaacactgttgccgacgtggatgagaaagcctccgctgccctctacgacttctccgttccatccagcgaaacggttatatgccggtcccaaccagccccagtgagcccccagcagaaaagcgtgctggtgagtcccccggccgtgtcggccggaggggtgcccccaatgcccgtaatatgccaaatggttcccctccctgcgaacaaccccgtagtcacaaccgtggtcccatctacccccccttcccaaccacctgcagtgtgcccgcccgtcgtgttcatgggcacacaggtgccaaagggtgccgtgatgtttgtagtgcctcagcctgtagttcaatcttctaagcctccagtggtgtcacctaatggcactaggctaagcccaatagcccccgctcctggcttctcccctagcgccgccaaggttaccccacagattgattcatcaaggatccgaagtcatatctgcagtcacccaggttgtgggaaaacctacttcaaatcatcccacctgaaggctcatacccggactcacaccggcgaaaaacctttttcgtgcagctggaagggatgcgaaagaaggttcgcaaggtcagacgaacttagccggcacagacggacccataccggtgaaaagaaattcgcttgtccaatgtgcgatagaaggttcatgcgctccgatcacctcacaaagcacgcgcgacgtcacctgagcgcaaagaaactgccaaactggcagatggaggtctccaagctgaacgacatcgcgctcccgccaactcccgcaccaacacagtag

SEQ ID NO: 19604 - DNA, 1410 bp, Artificial Sequence
  Description of Artificial Sequence: Synthetic coding sequence
atggaggagcggatggagatgatcagcgagcggcccaaggagagcatgtacagctggaacaagactgctgagaagtcagacttcgaagcagtggaggccttgatgtcaatgtcttgttcctggaaatcagacttcaaaaagtatgtggagaacaggcccgtgacccctgtgtccgatctgtcagaagaggagaatctactgcctggcacccccgactttcacacaatcccagccttttgcctgactcccccctattcgccttcagattttgagccttcgcaggtctcaaatttgatggctccagccccttccaccgtgcatttcaagagtttatcagacacagctaagccacacatcgcggccccatttaaagaagaggagaagagtcccgttagtgcaccaaaactgcccaaagcacaggccacctctgtcattcggcacacggccgatgctcagctgtgcaaccatcagacatgtccgatgaaagcagccagtattttaaattatcaaaataactcatttcgtaggcgtacccatctgaatgttgaggccgcccgcaagaacattccatgcgcagcggtgtcccctaacaggtccaagtgtgagaggaataccgtggctgatgttgacgagaaggcctctgcagccctgtacgattttagcgttcctagtagcgaaacggttatctgcagaagccagcctgctccagtgtctcctcagcagaagtccgtcctcgtgtccccccctgctgtgtctgctggaggtgtgccccccatgccagtcatctgtcagatggtgcctctgcccgcaaataaccccgtcgttaccacagtcgtcccaagtacaccaccgtctcagcctcccgcagtgtgcccgccagtggtttttatgggcacacaggtacctaagggtgccgtgatgttcgtggttccccagcctgtggttcaaagttcaaagccacctgtggtgtcccccaatggaacaagactatcccccatcgcaccagcaccaggtttttccccatcagctgctaaggttactccacagatcgacagttcgagaatcagatctcatatatgctcccacccaggctgcggcaagacatactttaagagctctcaccttaaagcacatactaggacccacacaggggagaaacccttctcttgtagctggaagggctgcgagagacggttcgcaaggtccgatgagctgagtaggcaccggcgaacccacacgggcgagaaaaagttcgcctgtccaatgtgtgacagacgctttatgcgaagcgatcacctcaccaagcacgcaaggcggcacctgtccgccaagaagctccctaattggcaaatggaagtgagcaaactcaatgatatagcgcttcctccaactccggcccccacccagtag

SEQ ID NO: 19605 - DNA, 972 bp, Artificial Sequence
  Description of Artificial Sequence: Synthetic coding sequence
atgagcgccgccgtggcctgcctggactacttcgccgccgagtgcttggtttccatgagtgctggcgccgtggtacatagacgccctcctgatccggagggggcaggaggtgccgcggggtcagaagtcggcgccgctcacccggagagcgcactgccaggccccggaccaagtggtccggctagtgtgcctcagctgccccaggtgcccgcacctagcccaggggccggaggcgctgcgccacacctccttgcagcgagcgtgtgggcggatttgagaggaagcagcggcgaagggagctgggaaaatagtggcgaggctccgagagcttcatcggggttctctgatcctataccctgttctgtccagaccccgtgtagcgagctagcccccgcctcgggtgccgccgcagtatgcgctcccgaatcctcatccgatgctccggcagtcccctcagcaccagctgctcccggagctcccgccgccagcggaggattttctggcggggctctgggggccggacctgcgccagcggcagaccaggcccctcgcaggagaagtgtcacccccgccgctaaacgccatcagtgccctttccccggttgtaccaaagcatattacaaatcttcacatttgaaaagccatcagaggacacacaccggtgagagaccattctcctgcgactggctggactgtgataagaaattcaccaggagtgacgaacttgcccgccactaccggacccacacaggtgagaagaggttctcttgcccgttatgcccaaaacagttctcccgatccgaccatctgacaaaacacgccagacgccaccctacctatcatccagatatgatcgaataccgtggtagacggagaactccgcgcatcgaccctccattgacatctgaagtcgagagttccgcatcaggttcaggccctggacccgccccaagtttcacgacctgtttgtag

SEQ ID NO: 19606 - DNA, 759 bp, Artificial Sequence
  Description of Artificial Sequence: Synthetic coding sequence
atgagcgccgccgtggcctgcgtggactacttcgccgccgacgtgctgatggctatcagcagcggtgctgttgtgcacagaggtcgtcccggtcctgaaggggctggccccgctgctggcttggatgttcgcgccgcgaggcgcgaggccgcatcaccaggcacaccggggcccccacctccacctccagcagcctccggacccgggcctggggcagccgcagctcctcatctgctggcagcaagcattctagccgacctgcggggcggccctggggccgcccctggcggcgcgtcacccgcctccagctcatcggcagccagctcaccaagctctggcagggctccaggtgcggctccttccgccgctgcgaaaagccatcgttgtcccttcccagactgtgctaaagcctattacaagtccagccaccttaagagccaccttaggacccacaccggtgaaaggcctttcgcttgtgattggcagggctgcgataagaaattcgctagatctgacgaactggcaaggcaccataggacccatacaggagagaaacgcttctcttgtcccctctgctctaagcgctttacccgaagcgatcatctagctaagcatgcccggagacatccagggtttcaccctgatctgctgcgccgcccaggcgccaggtcaacaagtccatcagactctttaccatgcagcctggccgggtcgccggctcccagtcccgcaccctctcccgcacctgccggcctgtag

SEQ ID NO: 19607 - DNA, 759 bp, Artificial Sequence
  Description of Artificial Sequence: Synthetic coding sequence
atgagcgccgccgtggcctgcgtggactacttcgccgccgacgtgctcatggccatcagctcaggtgccgtggtgcacaggggccgtcctggccccgagggtgctggcccagcagccggacttgatgttcgtgcagcaaggagggaggccgcatcacctgggactccaggcccccctccacctccccctgcggcgagtggccctggcccaggtgcagcggccgcaccacacctgctcgccgccagtatcctcgcagatcttcgaggcgggccaggggctgcccctggcggggcatctcctgccagttcctcaagcgcggccagtagcccttcttccggtagggcaccgggcgccgcacctagcgctgccgctaaaagtcacagatgcccattccctgactgcgcgaaggcctattataagagctcgcacctgaaaagtcacctgcgaacacacacaggtgagcgacctttcgcctgcgactggcaggggtgtgataagaagtttgctaggagtgacgaacttgcacggcatcacaggacccacaccggtgagaagcgattctcctgtcctttatgcagtaagaggtttacccgatcagaccaccttgccaagcacgccaggcgtcaccctggctttcacccggatctgttaagaagacctggcgctcgatctacttccccatcagacagcttgccatgctctctggctggatcccccgcgccctcccccgcacccagtccagcccccgccggcctctag

SEQ ID NO: 19608 - DNA, 1170 bp, Artificial Sequence
  Description of Artificial Sequence: Synthetic coding sequence
atgtacggccggccccaggccgagatggagcaggaggccggcgagctctctagatggcaggctgcacatcaggctgctcaggataatgagaatagtgcgccaatactgaacatgagtagctcctccggtagctctggcgtgcacacctcttggaaccaggggttgccatctatccagcacttcccacacagcgccgagatgctgggtagcccccttgtaagcgtcgaagctccgggccagaatgtcaatgaagggggccctcaattctccatgcccctccccgagagaggaatgtcctattgcccacaggccacactgacccctagcaggatgatatactgccaaaggatgtctcccccacagcaagagatgacgatctttagcggaccccagttgatgccagttggcgaaccaaacattcctagggtcgccagaccctttggtggcaacctgcgcatgccacctaatggtctcccggtgtctgctagtacgggtattcctattatgtcacatacaggcaaccccccagtgccttacccgggtctttctaccgtgccttcagatgagaccctgttgggtcccacggtcccctctacagaagcccaggccgtgctccctagcatggcccagatgttgcccccgcaggatgcccatgacctgggcatgcccccagctgagtcccagtctctgttagtgttgggctcccaagattcactggtttcacagccggactcacaggagggacccttcctgcctgagcagccaggcccggccccccagactgtggaaaagaattcaagacctcaggaggggactggaagacgcgggagcagcgaggcgcggccctattgctgcaactatgaaaactgcgggaaagcatataccaaacgcagtcaccttgtgtcccaccaacggaaacacacaggggagcgtccttacagttgtaactgggagtcctgttcttggagcttttttcgatccgatgagctgcgtcgccatatgagagtccatacgagatacagaccttataagtgtgatcagtgctcccgtgagtttatgcgatctgatcacttaaagcagcatcaaaaaactcatcgccccggcccaagcgatccgcaggcaaacaataataacggagagcaggactcgccgccagccgcgggcccctag

SEQ ID NO: 19609 - DNA, 1038 bp, Artificial Sequence
  Description of Artificial Sequence: Synthetic coding sequence
atgctgatgttcgaccccgtgcccgtgaagcaggaggccatggaccccgtgagcgttagttacccttctaattatatggagtccatgaagccgaacaagtatggagtaatttatagtaccccactgcctgagaaattctttcaaaccccggaggggctgagccatgggattcagatggagccagtggacctcaccgtgaataagaggtcaagtccaccttccgccggcaatagcccttcttccttgaaatttccgagctcacacaggagagcctcccccggcctcagcatgccgtccagttcccccccgattaagaaatactctccccccagtcccggtgtgcaaccattcggtgtcccactctctatgccacccgttatggcagctgcactcagccgacatggcatcagatcacctgggatcctaccagtgatccagcccgtcgttgtccagccggtcccctttatgtatacctctcatcttcagcagcctttgatggtgtctctgagtgaagagatggagaattcatcatcatcgatgcaagtgcccgttattgaaagttacgaaaaacctatttctcagaagaagatcaaaattgaacctggaattgagccccagcggacagattattacccagaggaaatgtctcctccgcttatgaactcggtttctccgccacaagcattgcttcaggagaaccatccatccgttatcgtccaacccggaaagcggcccctacctgtggaaagccccgacacccaacggaagcgtcgcattcacagatgtgactacgacggctgtaacaaggtctatacgaaatcaagccacctaaaggcccataggcgcacacacacaggagagaagccatataagtgtacttgggagggatgtacctggaagttcgctcggagtgacgagcttacccgccactttaggaagcataccggcatcaaacccttccaatgcccagactgcgatcgctctttctctcgttccgaccacttagcccttcatcgtaaaagacacatgctcgtctag

SEQ ID NO: 19610 - DNA, 1374 bp, Artificial Sequence
  Description of Artificial Sequence: Synthetic coding sequence
atggccacccgggtgctgagcatgagcgcccggctgggccccgtgccacagccacctgctccacaggatgagcctgtgttcgcacaattaaagccagtgctaggcgccgccaacccagctagggacgctgcactgttccccggcgaggaattgaaacatgcccaccaccgacctcaggcacaacctgcgccagcccaagccccacagccagcccagcctccagctactgggccaagactgccacctgaagatttagtgcaaactcgctgtgagatggagaagtacctgacaccccagctacctcccgtgccaatcatcccagaacataagaagtatcgcagagacagcgcatcggtggtggatcagttctttactgacacggaaggcctgccctatagtatcaatatgaacgtgttccttcctgatattacacacctcagaaccggtctctacaagtctcagcgtccatgtgtgacacacatcaaaaccgagcccgtcgcgatttttagccatcagtcagagacaactgcacccccaccggcgccaacacaagcactgcctgagtttactagcatttttagcagtcatcagaccgctgcaccggaggtaaataacatttttatcaaacaggagttacctaccccagatcttcatctaagcgtacccacccagcagggccatctctaccagctgttgaacactcctgacctagatatgcctagctccacaaatcaaaccgcagccatggataccctgaacgtgtctatgtcagctgctatggccggattaaacacccatactagtgccgttccccaaaccgctgtgaaacagttccagggtatgccgccgtgcacgtacactatgccctcgcagttcttgcctcagcaggccacctatttccccccttcacccccaagctctgaaccaggctcacccgaccgtcaagccgaaatgcttcagaatctgacaccccctccgagttacgccgccaccattgcgtcaaaactggctatccacaatccaaacttaccgacaactcttcccgtgaacagccagaacatacagcccgttagatacaataggaggtcaaatccggatttggagaagcggcgcattcattattgtgactatcctggctgtacaaaggtctatactaagtcaagccacctgaaggcccacttgcggacccacactggagaaaagccttacaagtgcacctgggaaggttgtgattggagatttgcacgaagcgacgagctaactagacactaccgtaaacatactggggccaaacctttccagtgcggcgtgtgcaaccgatcattctcccggtccgaccacctggcgctgcatatgaaacggcatcaaaattag

SEQ ID NO: 19611 - DNA, 1101 bp, Artificial Sequence
  Description of Artificial Sequence: Synthetic coding sequence
atggagaagtacctgaccccccagctgccccccgtgcccatcatccccgagcataagaagtacaggagagattcagccagcgttgtggatcaattcttcacagacaccgagggacttccgtattccattaatatgaatgtcttcctccctgacataactcatcttcgtactggcctgtacaaaagtcagcgtccgtgcgtcacacacatcaaaaccgaacccgttgctatcttttcgcaccaatcagaaaccactgccccccccccggcgccaacacaggccctcccagaatttacaagcattttctcgtctcaccagaccgctgcccccgaggtcaataatattttcataaaacaggaattgccaaccccagatctgcatctgtcggtgccgacccaacaaggtcacctatatcagttgctcaacacgcctgacttggacatgccctcttccaccaaccagaccgcagccatggacacactgaacgtctccatgtcagcagctatggctggcctgaacacccacacatccgccgtcccccagacagctgtgaagcagtttcagggaatgccgccgtgtacttacaccatgccctctcaatttctgccccaacaggcaacttacttcccgcctagcccgcccagctcggagccgggatcccccgatcgccaggcagaaatgctccagaacctcacaccacctcccagttatgccgccactattgcaagtaaattagcaatacacaacccaaatctacccaccactctgcccgtcaacagccagaatattcagccggtgagatataatcggcgctcaaacccggacctagagaaaagaagaattcactattgcgattacccagggtgcacgaaggtgtacaccaaatcgtctcaccttaaggcccacctccgaacccacacaggcgagaaaccctacaaatgcacctgggagggatgcgactggcggttcgccaggagcgacgaactgacacggcattaccgcaagcacactggagctaagcccttccaatgcggagtgtgtaaccgaagctttagccgcagcgatcacctggccctacatatgaagagacaccagaattag

SEQ ID NO: 19612 - DNA, 1314 bp, Artificial Sequence
  Description of Artificial Sequence: Synthetic coding sequence
atggccacccgggtgctgagcatgagcgcccggctgggccccgtgccgcaaccgcccgctcctcaagacgaacccgtcttcgcgcagctaaaacccgtcctgggggctgccaaccctgctcgcgacgcagccctctttccaggcgaagagctgaagcacgcacaccaccggccaagacttcccccggaggacttagttcagacccgctgcgagatggagaagtacctgactccccagctgccccctgttccaataattcccgagcataagaagtaccgacgggattctgcatctgtcgtggatcagttctttacagacaccgagggattaccatattccattaatatgaacgtattccttcctgacattacccatctgagaacaggactttataagtcccaaagaccctgcgtgacccacatcaaaaccgagccagtcgcaatcttcagtcaccagtcagagacgacggcccccccgcctgcccctactcaagcactacctgaatttactagtattttctcctcacatcagacagcggcacccgaggtcaataatatcttcataaagcaggaattgccgacgccggatctgcacctcagtgttccaacacagcagggtcatctctaccagctgctgaatacacccgacttggatatgccaagctccacaaaccagacagcagcaatggatactctcaacgtgagtatgtcagcggctatggccggattgaacacccacaccagcgccgttcctcagactgcagttaagcagttccaggggatgcctccgtgtacttatacgatgccttcccagttcctcccacagcaggcgacctactttcctccatctccgccctcctctgagcccgggtcccctgatcggcaagccgagatgctccagaatcttacacccccaccgtcatatgctgctacaatagccagtaagctagctatccacaaccctaatttgcctaccactctgccagtcaattcacagaatatccagccggtgaggtacaacaggagatctaacccggacctggagaaacgacggattcactactgcgactacccaggatgcactaaggtgtatacaaaatcttcgcacctgaaagcacacctccggacacacacaggggagaagccttataagtgtacctgggagggctgtgattggcgtttcgcccgcagcgatgagctgaccaggcattatagaaaacataccggcgctaaacctttccagtgcggtgtatgtaatcggtcgttttcacgcagcgatcatctggctttgcatatgaagcggcatcagaactag

SEQ ID NO: 19613 - DNA, 735 bp, Artificial Sequence
  Description of Artificial Sequence: Synthetic coding sequence
atgagcgccgccgcctacatggacttcgtggccgcccagtgcctggtaagcatcagtaatagagcagccgtaccggagcatggggtagcccccgacgcggaacgtctacgattgccggaaagagaagttactaaagaacacggtgatcccggcgacacttggaaagattactgtactcttgtaacgatagcgaagtctttgttggatttgaacaagtataggccaattcaaaccccctctgtctgttccgacagcctcgagtcccctgacgaggacatggggtctgacagtgatgtcacgaccgagtccggttccagcccatctcattcgcctgaggagcggcaagatcccggaagcgctcccagccccctgtcacttctccaccccggagtcgcagccaagggtaaacatgctagtgagaagcgtcacaaatgtccctactccgggtgcgggaaagtatacggaaaaagctcccatctcaaggcgcattacagagtccacaccggtgaacgtccattcccttgcacctggcccgattgtctgaaaaagttcagtcgctccgacgagcttacacgacattaccgtacacatacaggagaaaaacaatttaggtgccctctgtgtgaaaagaggttcatgcgatctgatcatctcaccaaacacgctcgaagacatacagaattccacccaagcatgatcaagcgaagcaaaaaggctctggcaaacgcactgtag

SEQ ID NO: 19614 - DNA, 2343 bp, Artificial Sequence
  Description of Artificial Sequence: Synthetic coding sequence
atgaccgagagcgccagcagcaccagcggccaggagttcgacgtgttctctgtgatggattggaaagatggggtggggacattgcctggatctgacttgaagtttagggtaaatgagttcggcgctctagaggtgataacagatgaaaacgaaatggagaacgtaaagaaagcgactgcaaccactacctggatggttcctacagcccaagaagcaccaaccagccccccttcttcaagacctgtattcccacctgcttattggaccagtcctcccggctgccctacggttttcagcgagaagacagggatgccgttccggctgaaagaccctgtaaaggtggaaggcctgcagttctgcgagaattgttgccagtatggcaacgtggatgagtgcctgagtggaggtaattactgctcccagaattgtgctcggcatataaaagacaaagaccagaaagaggagcgggacgtggaggaggacaacgaggaggaggacccgaagtgttctagaaagaagaaacccaaactgtccctaaaggcggacaccaaagaggatggcgaggaacgggacgacgagatggaaaacaagcaggacgtgagaattctgcgaggtagtcagagagccaggcgcaagcgcaggggcgacagtgcggtcctgaaacaggggttgccgcccaagggaaaaaaggcatggtgttgggcatcctacctggaggaggaaaaggctgtggccgttcccgctaaactgtttaaggaacaccagtcatttccctacaacaaaaacgggttcaaagttggtatgaaactggagggcgtggatcctgagcatcaaagcgtctactgtgtgctaactgtagccgaagtttgcgggtatcgtataaagctccattttgatggctattccgactgttacgatttctgggtgaacgccgacgcgctggacatccatcccgttggatggtgtgagaagactggccataagcttcaccccccaaaggggtacaaggaagaggaatttaattggcagacatatcttaagacctgtaaagcccaggccgctccaaaaagcctctttgagaaccagaacataaccgtgatcccctcagggtttagggtgggcatgaagttggaagccgtggataagaagaatccctcttttatctgtgtggccacagtgaccgatatggttgataatagattcttggtccattttgacaattgggacgaaagctacgattattggtgtgaggcatcctctccacacattcatcctgtgggctggtgtaaggagcacaggagaacgctgataacccctccaggatatccaaatgtgaagcacttttcctgggataagtatctagaagaaaccaatagtctaccggccccggcgcgcgcattcaaggtaaaacctcctcatggattccagaaaaagatgaagctcgaagttgtcgacaagcgcaaccccatgttcatacgagttgcaacagtggccgataccgacgaccatcgggttaaagtgcacttcgatgggtggaacaactgttacgactactggatcgacgccgattctcctgatatccatcctgtcggatggtgcagcaagacaggtcatccccttcagcctccgttgtccccactagagcttatggaggccagtgagcatggtggctgctcaaccccaggatgcaaagggataggacacttcaaaagggcccgccacctcggaccacacagtgcggctaactgtccgtattctgaaatcaatctgaataaggaccgaattttccccgatagactctcaggggagatgccacctgcgagcccatcattccctcgcaataagcgcacagacgccaatgagtcgtcttcgtctcccgaaatcagagaccagcacgccgatgatgtgaaagaagacttcgaggagcgtaccgaatctgagatgcggaccagccacgaagcccgaggggcccgggaagagccaacagtgcaacaggcccagcggaggagcgccgtctttctttcatttaaatctccgattccatgtctccccctgcgatgggaacagcaatctaagcttttgccgaccgtggccgggatcccggccagcaaagtgagtaaatggtcgactgatgaagtgagcgaatttattcagtctctacccgggtgcgaggagcatggcaaggttttcaaggacgagcaaatcgatggcgaggccttcttactgatgactcagaccgatattgtcaagataatgtcaattaaacttggtcctgcgttaaaaatctttaattccattcttatgtttaaggccgccgaaaaaaactctcataatgagttgtag

SEQ ID NO: 19615 - DNA, 2343 bp, Artificial Sequence
  Description of Artificial Sequence: Synthetic coding sequence
atgaccgagagcgccagcagcaccagcggccaggagttcgacgtgtttagcgttatggattggaaagatggtgtgggcacactgcccgggagtgacctaaagtttcgcgtcaatgagttcggagccctggaggtcattactgacgagaacgagatggagaacgtaaagaaggctacagctactactacatggatggtgcccactgcccaggaggcacctacatcacccccaagctcccgccctgtgtttcctccagcctactggacatcgccaccaggctgccctacagtgttttccgagaagactggtatgcccttccgcttgaaagaccctgttaaggtagagggactccagttctgcgaaaactgttgccagtacggaaacgtggacgagtgtttaagtggtggaaactattgtagtcagaattgcgcccggcatatcaaagacaaggatcaaaaggaagagcgtgacgtggaagaggacaacgaagaggaggatcccaaatgctccaggaagaagaaaccaaagctgagtttgaaggcagataccaaagaggatggcgaggaacgggatgatgaaatggaaaacaagcaggacgttaggatcctccggggatctcagcgggcccggcgaaaaaggagaggcgacagcgctgttctgaaacaggggcttcctccaaaaggtaaaaaggcatggtgttgggcgtcataccttgaggaagagaaggcggtagcagtcccggcaaagctgttcaaagaacaccagtcctttccatacaacaaaaatgggtttaaagtaggcatgaagctcgagggcgtcgaccccgagcaccagagcgtatattgcgtgttgacagtcgcggaggtctgtggatacaggatcaagttgcattttgatggttattcggactgttatgatttttgggtgaatgcagatgcacttgacatacacccagtcgggtggtgtgaaaagacagggcataagttgcacccgccgaagggatacaaagaggaagagttcaattggcagacatatctcaaaacatgtaaagctcaggcagccccgaagagtctgttcgaaaaccagaacattactgtaatcccgtcgggtttcagagtgggcatgaagctggaagcagtagacaaaaagaacccctcatttatctgtgtggccactgtgactgacatggtagataatcgatttctagtccatttcgacaactgggacgagtcctacgattactggtgtgaggccagcagtcctcacatccatcccgtcggatggtgtaaagaacaccgcagaaccctgattacacccccaggttacccgaacgtgaagcacttctcatgggataagtacttagaggagacgaacagtttacctgccccggctagggccttcaaagtgaagccaccacacgggttccaaaaaaagatgaaactcgaggtagtcgataagagaaatcccatgtttatcagagtggccactgtcgctgataccgacgatcatcgcgtgaaagtgcattttgatggctggaataattgctatgattactggatcgacgctgactcccccgatattcaccctgtggggtggtgttccaaaaccggacaccccctgcagcctcctctctctcccctggagctcatggaggcgtccgaacatggtggatgcagcaccccagggtgcaaagggatcggccacttcaaacgggcgaggcacctaggcccccatagcgctgccaattgcccttacagcgagattaatttaaataaggaccgcatatttcccgatcggttatctggagagatgcccccagccagcccctcattccctagaaataagcgtactgatgccaatgaatccagcagtagtcctgaaattagagaccagcacgccgatgacgtcaaggaggattttgaagagcgaacagagtcggagatgcggaccagccatgaggctcggggtgcccgcgaagagcctacagtgcaacaggcccagaggaggtccgctgtgttccttagtttcaagtctcctatcccatgtctgcctttacgctgggaacagcaatcgaagctactgccaactgttgctggtattcccgcgtctaaagtgtccaaatggtccactgacgaggtgagtgaattcatacaaagcctgcccggctgcgaagagcacgggaaggtgtttaaggatgaacagatcgacggagaagcattcctgctgatgacccagaccgatattgttaaaataatgtctatcaagctaggcccagccctgaaaatcttcaacagcatattaatgtttaaagccgctgaaaagaattcccacaacgaattatag

SEQ ID NO: 19616 - DNA, 2268 bp, Artificial Sequence
  Description of Artificial Sequence: Synthetic coding sequence
atgaccgagagcgccagcagcaccagcggccaggagttcgacgtgttttccgttatggactggaaagatggagtaggaaccctgccaggctcggacctgaagttccgcgtcaatgaattcggagcactcgaggtcatcactgatgaaaacgagatggaaaacgtgaagaaagcgaccgcaactacaacttggatggtgccgaccgctcaggaggttttttctgagaagacaggcatgcctttccgtctgaaggaccccgtgaaagtggaagggttacagttttgcgaaaactgttgccaatacggaaatgtggacgaatgtctgagcggcggcaattactgtagccagaattgcgcgcgccatattaaggataaggaccaaaaggaagaacgtgacgtcgaggaagacaatgaggaagaagatccgaaatgttcacgaaaaaaaaaaccaaaactaagcttgaaagctgatactaaagaagatggagaggaaagggatgatgaaatggagaacaaacaggatgtgcggattctgcggggatctcagagagcaaggcggaagaggaggggagatagcgctgtcttgaaacaaggccttcctccaaagggcaagaaggcatggtgttgggcttcctacctcgaagaggagaaagcggtggccgtgccagccaaactttttaaggaacatcagtcttttccttataataagaacggcttcaaagtaggtatgaaattggagggcgtggaccctgagcatcagagtgtgtactgtgtgcttactgtggcagaggtttgtggctatagaattaagcttcactttgatggatactccgactgctatgatttttgggtcaacgcagatgcactggatatccacccagtaggctggtgtgaaaaaactggccacaagttgcaccctcctaaaggctacaaagaggaagagttcaactggcagacatatctgaaaacatgcaaagcacaggcagccccaaaaagcctgttcgaaaatcagaacatcaccgtaattccaagtggcttccgagttggtatgaaactggaagccgttgataaaaaaaatccgagcttcatttgtgttgccacagtgaccgacatggtggataaccggtttcttgtgcattttgacaattgggatgagtcttatgattactggtgtgaagcaagtagcccacacatccacccagtgggttggtgcaaggagcatagacgtacgctcatcacaccaccagggtaccctaacgttaagcacttctcgtgggataagtacctggaagaaactaactccctccctgctcctgcacgcgcatttaaggttaagcccccccatggattccagaagaagatgaaattggaggtcgtcgataagaggaatcccatgttcattcgagtggcaaccgtcgcagatacagacgatcatagggtgaaggttcatttcgacggatggaataactgctacgattactggatcgacgcggatagcccggacattcaccctgtcggctggtgcagtaagacagggcacccattgcagccacccctctcacccctcgaactgatggaagcctccgaacatgggggatgttctacacctgggtgtaagggcataggtcacttcaagagagccagacaccttgggccacatagtgccgctaattgcccttactctgagattaatctgaataaggaccgcatctttcccgatcgtctctccggcgagatgcctcctgcgtctccctctttcccccgtaataaaaggactgatgccaacgagtcatcatcttctcccgagatccgggaccagcacgccgacgacgtgaaggaagacttcgaagaacgcactgagtccgagatgcggacaagccacgaggcccgcggtgccagggaagagccgaccgtccagcaagcacagaggagaagcgccgtgtttctctcatttaagagcccgatcccatgcctcccactgagatgggagcagcaatccaaactgctgccaactgtggcaggaatccccgctagtaaggtgtctaagtggagtactgacgaagtgagcgaatttattcaaagtctgccaggatgtgaagaacatggcaaagtctttaaagacgagcagatcgacggagaagctttcttgttaatgacccaaactgacattgtgaaaattatgtccattaaactcggtcctgccttgaaaatttttaatagtattcttatgtttaaggccgcagagaaaaactcccacaatgagctctag

SEQ ID NO: 19617 - DNA, 2268 bp, Artificial Sequence
  Description of Artificial Sequence: Synthetic coding sequence
atgaccgagagcgccagcagcaccagcggccaggagttcgacgtgttttcggtgatggactggaaagatggagtggggacattgcctggatctgacttgaagtttagggtaaatgagttcggagccctggaagtgatcacagatgagaacgagatggagaatgtcaagaaggccacagctactacaacttggatggtccccaccgctcaggaagtcttctctgagaagaccggaatgcccttcagactgaaggatccagtgaaggtggaagggttgcagttctgcgaaaactgttgtcaatatggtaatgtggacgaatgtttatccggcggcaactattgtagccagaattgtgcacgacatattaaagacaaagatcagaaagaagagagggatgttgaggaagataacgaggaggaagaccccaaatgttccagaaagaagaagccgaaactgagcctaaaggctgacaccaaagaggacggagaggaacgcgatgatgagatggaaaataaacaagacgtgaggattcttagagggtcgcagagagcaaggagaaagcggaggggtgattccgcagtactcaaacagggccttcctcccaaaggcaagaaagcctggtgctgggccagttacctggaagaagagaaagccgtagccgtacccgccaaactgttcaaagaacaccaatcctttccatacaacaagaacggtttcaaagtgggaatgaaactcgagggcgtcgaccccgaacaccagagcgtgtactgtgtgctcacagtggcagaggtctgtggctataggatcaaacttcactttgatggttatagtgattgctacgatttctgggtgaacgctgacgccttggacatccatccggtggggtggtgcgaaaaaaccggacataagctccatcctcctaagggctacaaggaagaagagtttaactggcaaacatatctcaaaacatgtaaggcccaggccgctccaaagagcctttttgagaatcagaatatcacagtgattccttcgggtttccgggtgggcatgaaattagaggcagttgataagaagaacccttccttcatttgcgtggctacagtgacggacatggtggataaccgcttcctggttcacttcgacaattgggacgagagctacgactactggtgtgaggcttcaagcccccacattcatccggtcgggtggtgtaaggagcatcggcgcacactgattactcctcctggctacccaaatgttaaacacttttcctgggacaagtacctcgaagaaactaattctctgcccgcacccgccagagcctttaaagtgaaaccgccacatgggttccagaagaaaatgaaactggaagtcgtggataaaaggaatccaatgtttatacgtgttgcaactgtggcggataccgatgaccatagagttaaggtccattttgatggatggaacaactgctacgattattggatcgatgctgatagcccggacatacatcctgtgggatggtgcagcaaaacaggccaccctctgcaaccccccctgtccccactggagttgatggaagcaagcgaacatgggggctgctccactcctgggtgcaaaggcattggccactttaagagagcaaggcacctggggccacactcagcggctaattgcccttacagcgagatcaacttaaacaaggaccgcatctttccagaccggctgagcggagagatgccccctgcctcgccctcgtttcccagaaacaagcgcacggacgccaacgagtcaagttcctcgccggagatcagagatcagcacgctgacgacgttaaggaagatttcgaggagagaacggagagtgagatgagaacatcacacgaggctagaggcgcacgggaagaacctaccgtacagcaggcacagcggcgatctgccgtgttcctgagctttaaatcgccaatcccgtgcctaccactgcgttgggaacaacagagcaaactgcttccaactgtcgctggcattcccgcatccaaagtgagtaaatggtctactgatgaggtgtcagagtttatccagagtctgcccggttgtgaggaacacggaaaagtgttcaaagatgagcagatagacggtgaggccttcttgttgatgactcagactgacattgtgaagataatgagtattaagctgggccccgcacttaagatcttcaacagcatacttatgttcaaagccgccgaaaagaactctcacaacgagttatag

SEQ ID NO: 19618 - DNA, 573 bp, Artificial Sequence
  Description of Artificial Sequence: Synthetic coding sequence
atgaccgagagcgccagcagcaccagcggccaggagttcgacgtgttttcagtaatggattggaaggatggggtcgggaccctgccaggatcagacctcaagttccgcgtcaacgagttcggtgccctcgaagtcatcaccgatgaaaacgaaatggagaacgtgaagaaagctacagccacaaccacctggatggtgcctactgcccaggaggcaccaactagcccaccttcctcccgtcccgtctttcctcctgcctactggacttctcccccgggatgtccaaccgttttctcggagaagacaggcatgccctttcggctgaaggacccagtgaaggtggaaggtttgcaattttgcgaaaattgctgtcaatacggaaatgttgatgaatgcttgtctggtggcaactactgcagtcagaattgtgctagacatatcaaggacaaggaccagaaagaagaacgggacgtcgaagaggataatgaggaggaagatcctaagtgttccaggaagaaaaaacccaagctcagcctgaaggctgatacaaaagaagacggagaagaacgttag

SEQ ID NO: 19619 - DNA, 2343 bp, Artificial Sequence
  Description of Artificial Sequence: Synthetic coding sequence
atgaccgagagcgccagcagcaccagcggccaggagttcgacgtgttctccgtaatggactggaaggacggagtcggcaccttgccgggttctgatttgaagtttcgggtgaatgagtttggggcactggaagtgattacagacgaaaacgagatggaaaatgtcaagaaagccaccgcgacgactacctggatggtcccaaccgcgcaggaggctccgaccagcccaccaagtagcaggcctgtcttccccccagcttattggacatctccccccggctgccccacagtgtttagcgagaaaactggcatgccttttcggctcaaggacccagtcaaggtagaaggcttgcaattttgcgaaaactgctgccagtacgggaatgtagacgagtgtttatcgggcggaaactactgctcacagaattgtgccagacacatcaaagataaggaccagaaagaggagagagacgtggaggaggacaatgaagaggaggacccaaagtgcagtcgtaagaagaaaccgaagttgagtctcaaagctgatacaaaggaggatggggaggagcgggatgatgaaatggaaaataaacaggatgtgcggatcttaagggggagccagcgggctagacgcaaacgaagaggcgattcggcagtcctcaagcagggccttcctcccaagggcaaaaaggcctggtgctgggctagctacttagaggaggagaaagccgtggctgttcccgctaagttgtttaaggagcaccagtcttttccatataacaaaaacgggttcaaagtgggcatgaagcttgaaggggtggacccagaacatcaaagtgtgtactgcgtcctgacagtagccgaagtgtgtggctaccgtattaaactccactttgatggctatagcgattgctacgacttttgggtgaatgctgacgcattagacatccatccagtgggatggtgcgagaagacaggacacaaactgcatcctccaaagggctataaggaggaggagttcaactggcagacttatttaaagacatgtaaggcccaggcagcgcctaagagcctatttgaaaatcagaatatcaccgtcatcccctctggctttcgagtgggcatgaaactggaagccgtagataaaaagaatccaagctttatctgtgttgccactgtcaccgacatggtggataaccggttcctggttcactttgacaactgggatgaaagttacgattactggtgtgaggccagcagccctcatatccatcccgttggttggtgtaaagaacatcgcaggacactgattactccccctggctaccctaatgtaaaacattttagttgggataagtacctggaagagaccaactcattgcctgctccagctagggcattcaaggtgaagccccctcatggctttcagaagaaaatgaagctggaagttgttgacaagcgaaatccgatgtttattcgggttgccaccgtggctgacactgacgaccatagggtaaaagttcactttgatgggtggaacaattgttatgattactggattgatgccgatagtcccgacatccacccagtaggctggtgctcaaaaacgggccatccactgcagcctcctttgtctccgctggaattaatggaggcttcggagcacggaggttgctcgacacccggctgcaaaggcatcggacatttcaaaagggccagacacctgggccctcacagcgccgcgaactgcccatatagcgagattaatctcaataaagacagaattttccctgatagactgagtggggagatgccacccgcttcaccgtcttttccccggaataagcgaaccgacgcgaatgaatccagtagcagtcccgagattagggaccagcacgctgatgatgtgaaggaggattttgaggagcgcactgagtctgaaatgagaaccagccacgaggctaggggggcgagggaggaaccaaccgtgcagcaggctcaacggcggtccgctgtcttcttgtcattcaagagcccaatcccttgcctgccgcttcgctgggaacagcagtcgaaattacttccaactgtcgctggaattccagcctctaaggtgagtaagtggtccacagacgaagtaagcgagttcatccaatcgctgcctggttgcgaggagcatggtaaagtctttaaagatgagcagatcgatggcgaagcctttctgcttatgacacagactgacattgttaaaatcatgtccataaaactcggtccagccctgaagattttcaattctatcctgatgtttaaggctgccgagaagaactcacacaatgaactgtag

SEQ ID NO: 19620 - DNA, 2268 bp, Artificial Sequence
  Description of Artificial Sequence: Synthetic coding sequence
atgaccgagagcgccagcagcaccagcggccaggagttcgacgtgttcagcgtgatggattggaaagacggtgtcggaactctaccaggcagcgacctgaagtttcgcgtgaacgagttcggagccctggaagtgataacagatgaaaatgagatggaaaacgttaaaaaagcaaccgccacaaccacatggatggttcctaccgcgcaggaagtcttcagtgaaaaaaccgggatgccatttagactcaaggaccccgtgaaggtagaagggctgcagttttgtgagaattgctgtcagtatggaaacgtggatgagtgcctgtcaggagggaattattgctcccagaactgcgctaggcatatcaaagacaaggaccagaaagaagagcgcgacgtcgaggaggataatgaggaagaagacccaaagtgtagccggaaaaaaaaaccaaagctgtctctgaaagctgatacgaaagaagatggcgaagaacgggacgatgagatggagaacaaacaggacgtgcgcatcctccgcggaagccagcgagcacggcggaagcgccgcggtgattctgcggttctgaagcaggggctgcctccaaagggtaagaaagcttggtgttgggcatcatatctagaggaagaaaaagcggttgccgttcctgcaaaactgtttaaagagcaccaaagcttcccgtacaacaaaaacgggtttaaggtgggaatgaaactcgagggagtagatcccgagcatcaatctgtctattgcgtgctgacagtcgccgaggtatgcggctaccggattaaactgcactttgacggttactccgattgctacgacttctgggtcaacgcagatgctctcgatattcaccccgtggggtggtgcgagaagactgggcacaaactgcaccccccgaagggctacaaagaagaggagtttaactggcagacctatttaaagacttgcaaggcccaggcagctcccaagtctctttttgagaaccaaaacatcactgtgataccttcgggttttcgagtgggcatgaagctggaagccgttgacaagaaaaaccccagttttatctgcgtcgcaacagtgaccgatatggttgacaatcggttcctcgtccactttgacaattgggatgagtcgtacgattactggtgcgaagccagctccccgcacattcatcccgttggttggtgtaaggagcatagaaggacactcatcacgcctccaggatatcccaacgtaaaacacttcagctgggataaatacttggaggagacaaattccctgccagccccagcacgcgccttcaaggttaagcctccccacggattccagaaaaaaatgaaactggaggtggtggacaagagaaacccgatgttcattcgcgtcgccacagttgcggatacagacgatcaccgtgttaaggtacattttgacgggtggaataattgctacgactattggatcgacgctgattcccccgatattcatccggttgggtggtgctctaagacagggcaccccctgcagccgccactctccccactggagctcatggaagccagtgagcatgggggctgctcaactcctggctgtaagggcattggtcatttcaagcgggcaagacatctgggccctcactcagcagctaactgcccctattctgaaatcaacttaaacaaggacagaattttccccgaccgcctcagcggtgagatgccaccagcatctcctagcttcccaaggaacaagcgcaccgacgcgaatgagtcctctagctctcctgaaattagggaccagcacgccgacgacgttaaggaggattttgaagaacgcacagaatccgaaatgaggacctctcacgaagcacgcggagcgcgcgaagagcctactgtgcaacaagcacagcggaggagtgccgtgtttttgtctttcaaatcaccgatcccctgcctgccccttagatgggaacagcagtccaagttattgcctacagtcgctggcataccagcctccaaagtctcaaaatggtccactgacgaggtatccgagtttatccagagtctccctggatgcgaggaacacggtaaggtctttaaggacgaacaaattgacggtgaggcgtttttgcttatgacccaaacagatattgttaagatcatgagcataaaactgggacctgctctgaaaattttcaattccattctcatgttcaaagcagccgagaagaactcccacaacgaactgtag

SEQ ID NO: 19621 - DNA, 1872 bp, Artificial Sequence
  Description of Artificial Sequence: Synthetic coding sequence
atgaagcagcccaaccggaagcggaagctgaacatggacagcaaggaaagactggatcaggacgggagactcgaacaggcggaagaggaaaagaagcccaaggattcaaccacacccttaagtcacgtcccatccgcagcggcccagggagcttggagttgggagtggtatctgaaagaacaaaaagctgtcgcagctccagtggagctgttctccaaagaccaatccttccccgagcatgaaaatggttttcagatcggaatgaggctggaggggattgacccccgacacccatcagtgttctgcgtattgtctgtcgctgaggtgtgcggctaccggcttcgactgcatttcgatgggtatttgagctgttatgatttctggacgaatgcaggctctccggacattcatcctgttggttggtgcgaaaagaccaagcacgaacttcacattccaaaagggtatcgcaaggacaagtttgtttggatggactacctgaaagcctgtaagttacagaacgcgcccaagaagctgttcagaaacagatcaccaaatgggcccatgagcaaggagttccaggtggggatgaagttggaagctgtggatcgcaaaaacccttctcttgtatgcgtcgctaccatcgccgatatcgtcgaggatagactgctcgtccactttgacaactgggacgactcttatgactactggtgcgatgtgaactctccttacgtgcagcccgttggctggtgccaggagaatggacgaactctgattgcccctcaggggtatcctaaccccgagaatttctcctggacagagtatctcgaggccacccagacaaacgcagtgcctgcaaaagttttcaagatgaggctccctcatggttttctgccgaacatgaaactggaagtcgtggacaaaaggaacccgcgcttgattcgggtggccacaattgttgacgtcgacgatcagagggtgaaggtgcattttgatggatgggatcataagtatgattattgggtcgaggctgactcccctgacatccatccaatcggctggtgtgacgtgaccggacatccgttagaggttcctcaacgcacaaatgatttgaagatcctccccggtcaagcggtctgtcccactcctggctgtcggggtattggacacattcggggcccaagatattcagggcatcacagtgccttcggatgcccctattcagacatgaatctgaagaaggaggccactctccatgaccgacttcgagaacaaacacaagccaacttggagtctgactcatctcattccaaatccaagagcctctgttcgctaaacttcaatggaaagcatgagaaggtaaacagccagccccggctggtgcagcaggctaaatgcttgaagatcaagggcaaagaagatatagaccttgacaacttatttagagtccttgtgctccacccaaggggattagagtattcagtggagcaggctcaacaggttcttcatcagtccgtgtcgatgagtactgtgtcagctcatccgttcagagacctgccgctggggagagagcagcactgtaaacttctacctggcgtcgcagatattagggcttcccaggttgcgcgttggactgtggacgaggtggcggaatttgtccagagtctgttggggtgcgaggagcacgccaagtgttttaaaaaggagcaaatcgatggaaaggcattcctccttctgacccagaccgatatcgtgaaggtgatgaaaatcaaactcggaccagccctgaagatctataacagtattttgatgttccgacattcccaggagctgccagaggaggatatcgcaagtggtcaggaggtgagaggctag

SEQ ID NO: 19622 - DNA, 1872 bp, Artificial Sequence
  Description of Artificial Sequence: Synthetic coding sequence
atgaagcagcccaaccggaagcggaagctgaacatggacagcaaggaacgattggaccaggatggccgcctggaacaggccgaggaggagaagaagccaaaagattcaacaacccccctgtcccatgtcccttcagcagcagctcaaggggcttggtcttgggagtggtacctgaaagagcagaaagctgttgcggcacctgtcgaactgttctccaaggaccagtcatttcctgagcacgagaacggcttccagatcgggatgcgacttgaaggtatcgacccacggcacccatccgtgttctgcgtactgtctgtcgcagaggtgtgcgggtacagattacgcctccatttcgatggttatctctcatgctatgacttctggactaacgctggaagccccgacattcacccggtgggctggtgtgagaagactaagcacgagctccacatccccaagggctatcggaaagacaaatttgtctggatggactacttgaaggcctgtaagcttcagaatgcgccaaaaaaacttttcaggaacaggtcaccaaatggccccatgagtaaagagttccaagtgggaatgaagcttgaagcggtggaccggaagaatcctagtctggtttgcgtcgccacaatcgccgacattgtggaggaccggctgcttgtgcacttcgataattgggatgactcctacgactactggtgcgacgtgaattctccctacgttcagccggtgggatggtgtcaagagaacggcagaacactcattgccccacaggggtaccccaaccccgaaaattttagctggaccgaatatcttgaagccacccagaccaacgccgtccccgcaaaagtctttaagatgcgcttgcctcatgggttcttgccaaatatgaagctggaagtagtcgataagcgtaatcccaggctgattagggttgccaccattgtcgatgtggatgaccagcgcgtgaaggtacacttcgatgggtgggatcacaaatatgattattgggttgaggctgacagtcccgatatccaccctataggctggtgcgacgtgactggacatccacttgaggtcccacagcgcactaatgatttgaaaatccttcccgggcaggcagtgtgtccaacacctggatgccggggaattggtcatatacggggtccccgctatagtggccatcactccgccttcggctgtccttattccgatatgaacctcaaaaaggaggctacattacacgatagactgcgtgagcagacacaggccaacctggagagtgacagttcacatagtaagtccaaatctctctgtagtttgaattttaatgggaagcatgagaaggtaaacagtcagcctaggctagtccagcaggcaaagtgcctgaagatcaaagggaaggaagatatagacctggacaatctttttagagtgctcgtcttgcatccacggggactcgaatattccgtcgagcaggctcagcaagtgctccaccagtcagtgtctatgagtacagtttctgcccatccatttcgcgatctgccgctcggtagggaacaacactgtaaactattgcctggggtggcggacattagggcgtcgcaggtcgcccggtggaccgtcgatgaagtggcagagttcgtgcaatcgttgctgggatgcgaggagcacgctaagtgttttaaaaaagaacagatcgacggaaaagcctttctgctattgacccagaccgatatcgtgaaagtcatgaagatcaagttgggtcccgcacttaagatatataactcaatcctaatgttccggcactctcaggagctgccggaggaggatatagcctccgggcaagaagtccgaggctag

SEQ ID NO: 19623 - DNA, 1284 bp, Artificial Sequence
  Description of Artificial Sequence: Synthetic coding sequence
atgagcaaggagttccaggtgggcatgaagctggaggccgtggaccgaaagaatccatctctggtgtgcgtggccactatcgcagacatcgtcgaggataggctcctggtgcattttgacaattgggacgatagctacgactactggtgcgacgttaactccccgtacgtccagcccgtaggctggtgccaggagaacggacgcactctcatcgctccacagggttaccctaatcccgagaacttctcgtggacagagtacttggaagccacccagacaaacgcggtgccagccaaggtgttcaagatgcgactcccgcacggttttcttcccaacatgaaactggaggtggtcgataagcggaacccaagactaatccgtgtcgccacaatcgtcgatgtcgacgaccaaagggtgaaggtccatttcgatggctgggatcacaagtacgactactgggtggaggccgatagcccagatatacatcctattggctggtgtgacgtcaccggacaccccctggaggtgccacagcggaccaatgatctgaagatcttaccgggacaggcagtatgtcctacaccaggctgccggggcatcggccatattagaggccctcgttattctggccaccattccgcattcggctgtccctatagcgacatgaatctgaaaaaagaggccacactgcacgatcggcttcgagaacagacacaggctaacctggaatcggacagttcccattcaaagagcaaatccctgtgttctttgaattttaacgggaaacacgagaaagtcaactcgcagcccaggttagtgcagcaagcaaagtgcctgaaaatcaaagggaaggaggacatcgatctggataacctcttccgggagtatagcgtcgaacaggcccagcaggtgctccatcaatcggtctcaatgtctaccgtttctgcccatccgttcagagatctcccactggggcgtgaacagcattgtaagctgttacccggggttgccgacattagggcatcccaggtcgcccggtggacggtggacgaagtggctgaattcgtgcagtccttgctggggtgtgaagagcacgccaaatgctttaagaaagagcagattgatggcaaagcctttctgctcctgactcagaccgatattgttaaagtgatgaaaataaagctcggaccggccttgaagatttataactcgatactgatgttccgacacagccaggaactaccagaagaagatattgcctctgggcaggaggtccggggatag

SEQ ID NO: 19624 - DNA, 876 bp, Artificial Sequence
  Description of Artificial Sequence: Synthetic coding sequence
atgagctgggagagcggcgccggccccggcctgggcagccagggcatggatctggtttggtctgcctggtatgggaagtgcgtcaaggggaaaggctctcttcccctgtctgcacacgggatagtagtcgcctggctttcccgcgccgagtgggatcaggtcacagtgtatctgttttgtgacgatcacaagttgcaaagatatgccctcaataggattaccgtgtggcgctctcgtagtgggaatgagctacccctggctgtggcgagcaccgctgacctgatccgttgtaagcttctcgacgtaaccggcggccttggaacagacgaactgcgactgctatacggtatggctctcgtcagatttgtgaatctcatctcagagagaaagaccaagttcgctaaggtgcctttaaagtgcctggcacaggaggtgaatatacccgactggattgtcgacctgcggcacgagttgacacacaaaaagatgccacatatcaacgactgcaggcgaggctgctacttcgtcctcgattggcttcagaaaacttactggtgccgacagcttgagaactccctgcgggagacctgggaactggaggagttcagggagggaatcgaagaggaagaccaggaggaagacaaaaacattgttgtggatgatattacagaacagaagcctgagccccaggacgacggcaaatccacagaaagtgatgtgaaggctgatggggatagcaaaggtagtgaggaggtcgatagtcattgtaaaaaagctctctcccacaaggaactctatgagagggctcgggaactgttggtgtcatatgaggaggagcaattcaccggggggtgtgcgggctgtttcagtggatag

SEQ ID NO: 19625 - DNA, 2028 bp, Artificial Sequence
  Description of Artificial Sequence: Synthetic coding sequence
atgagctgggagagcggcgccggccccggcctgggcagccagggcatggacctggtgtggagcgcttggtacggaaagtgtgtcaagggtaagggcagcctgcctctgagtgcacacggaattgtagttgcatggctatcaagagctgagtgggaccaggtgaccgtatatttgttctgcgacgatcataaactgcagcgatatgctctgaataggatcaccgtttggaggagccgctttgtgaaccttatctccgagcgcaagaccaagttcgcgaaggtccctctgaagtgtttagcgcaggaagtcaacattccggattggatcgtcgacttgcgacacgagcttacccataagaaaatgccccatataaacgactgcaggcgcgggtgttacttcgtgctcgactggctccagaagacgtattggtgtagacagctcgaaaatagcctccgcgaaacatgggaactggaagaatttcgggaagggattgaggaggaagaccaagaggaagataagaacattgtggtcgatgatataacagaacagaaaccggaaccccaggatgatggcaagagtacagagagcgatgtcaaggctgatggagactccaaggggagtgaggaagtcgacagccactgcaagaaagcactgagccacaaagagttgtacgagcgggcaagagagctgcttgtatcctacgaagaagaacaattcaccgtgctagagaagttccgctacttgccaaaggccattaaagcttggaacaacccaagccctcgcgttgagtgcgtgttagccgaactgaaaggagtcacatgcgagaaccgggaggccgttctggatgcatttctggatgatggcttcttggtgcctaccttcgagcagctggcagctctccaaatagagtatgaagagaatgtggatcttaacgacgtccttgtgcctaaaccattctcccagttttggcagcctcttctgagaggtctgcacagccagaactttacgcaggccctgctagagaggatgctaagcgagttgccggccctgggaatttcaggcatcaggccgacctacattttaagatggacggttgagctcattgtggcaaacaccaagactgggcgcaatgcccggcgcttcagcgccggacagtgggaggccaggcgcggctggagactctttaactgctctgcctcactggactggccgagaatggtggagtcctgtctagggagtccatgctgggccagcccccagctcctcaggattattttcaaagctatggggcagggcctccctgacgaggagcaggagaagctccttaggatttgtagcatttacacccaaagcggggagaattctttagttcaggaagggagcgaagctagcccaattggaaagagcccttatacacttgactctctctattggagtgtaaagcccgcctctagttcttttggctctgaagcaaaagcccagcagcaggaagaacagggcagtgtgaatgacgtcaaggaggaggagaaagaggaaaaagaagtactgccggaccaagtggaagaagaagaggagaacgacgaccaagaggaggaagaagaggacgaggatgatgaggacgacgaagaggaagataggatggaagttggaccattcagtaccggacaggagagccccaccgctgaaaatgctagattgctcgcacagaaacggggcgctttgcagggctccgcatggcaggtttcctcagaagatgtgcgatgggacacgtttccgctcgggcgcatgccaggtcagacggaagaccctgcagaactgatgttggagaattatgacacaatgtacctgctggatcagccagtgctggagcagaggctggagccttcaacttgcaaaaccgatacgttaggcctctcctgtggcgtaggcagcggcaactgctccaacagctcttcgagcaatttcgaaggcctgctttggagccaaggccaactccacggcttaaagacaggccttcaactgttctag

SEQ ID NO: 19626 - DNA, 2154 bp, Artificial Sequence
  Description of Artificial Sequence: Synthetic coding sequence
atgagctgggagagcggcgccggccccggcctgggcagccagggcatggatctggtctggagtgcatggtacggtaagtgcgttaagggaaagggcagcttacccctcagcgcccacggtatcgtggtcgcctggctgagccgggccgaatgggaccaggtgaccgtttatttattttgtgacgatcataagttgcagcggtatgctctgaaccgcattacagtgtggcgtagtagatctggcaatgagctcccgctggccgtcgcgtctacagctgacctcattaggtgtaaactccttgatgtcacaggcggactgggcacagacgaactccgcttgctgtatgggatggccctggtgcggttcgttaatcttatcagcgaacgaaagaccaagtttgctaaagtgccccttaaatgcctcgctcaagaggtcaatatccctgactggattgtagacttacgccatgagctgacccacaagaagatgccacatatcaatgactgccgacggggctgttacttcgtgctcgattggttgcagaaaacatactggtgccggcagctcgagaatagtctcagagagacctgggaattggaggaattccgagaggggatagaagaggaggaccaggaagaggacaagaatatcgttgtcgatgatattactgagcaaaaacctgagccccaggacgatggcaaaagtacagagtcagacgtgaaggccgatggagactccaaaggcagcgaggaggtggattcccactgtaaaaaggcactgtcccacaaagaactgtacgaacgcgcccgggaactcttggtctcttacgaggaggaacagttcacagtgctggaaaaattccgctacctgccaaaggccattaaggcatggaacaatccatcgccgagggtggagtgcgtgctagcagaactgaagggagttacctgcgagaacagggaggcagtgctcgacgcattcctggatgacggattcttagtgcctacttttgagcagctagctgctcttcagattgaatatgaggaaaatgtggacctcaacgatgtgttggtgcctaagccattttcccaattctggcaaccactgctcagaggactgcactcacagaatttcacacaagccctactggaaagaatgctctcagaacttcctgcgctggggatctccggaatcaggcctacgtacatactccgatggacggtcgagctgatcgtcgccaatacaaagaccggcaggaacgcccgccgcttcagcgccggtcagtgggaagccagaaggggatggcggctctttaattgttccgcttccctggactggccgcgcatggttgaatcatgcctcggatccccctgttgggcctctcctcaactcctgcggattatctttaaggcaatgggccagggtctgccagacgaggaacaggaaaagctgctgcgcatctgctcaatctacactcagagtggggagaacagcctggttcaggaaggctcggaggcctccccaatcgggaaatccccttatacactggatagcctgtattggagtgtcaaacccgcaagcagcagctttggatccgaagccaaggcccaacagcaggaggaacagggctccgtgaacgacgtaaaggaagaggagaaggaggagaaagaggtgttgcctgaccaggtagaggaagaggaggaaaacgatgatcaggaggaggaggaagaagatgaagacgatgaagacgatgaagaagaggatcggatggaggtaggccctttctctaccggccaggaaagtcccacggctgaaaacgcccgcctgctggcgcagaaaaggggagcgctccagggctctgcctggcaagtgagctcagaggacgtgaggtgggacactttccccctcggccgtatgcccggccagaccgaggaccccgccgaactgatgcttgagaattacgacactatgtatttactggaccagccggttctggagcagcggctggagccttctacttgcaagacagatactctcgggttgtcgtgtggggtgggatcggggaactgtagtaattcatccagttccaacttcgaggggctgctgtggtctcagggtcaattacatggtctgaaaacagggctgcagttgttttag

SEQ ID NO: 19627 - DNA, 2205 bp, Artificial Sequence
  Description of Artificial Sequence: Synthetic coding sequence
atgagctgggagagcggcgccggccccggcctgggcagccagggcatggacttggtatggtctgcatggtatggtaagtgcgtgaagggcaaaggaagcctgcctctgtctgcccatgggatcgtggtggcatggctgagccgagctgagtgggatcaggtcacggtctatctattctgcgatgatcacaaactccaacgttatgctctgaaccgcatcaccgtctggagaagtcggtcagggaacgagcttccactcgctgtcgcatccacagcagatcttatcaggtgtaagctgctagacgttactggcggcctgggcacggatgagctccggctgctctacggtatggcgcttgtgcgctttgtaaatttgattagtgaaaggaagaccaagtttgctaaagtccccttaaagtgcttagcccaggaggtaaatatccccgactggattgttgacctgcggcacgaactcactcataaaaaaatgccccacatcaatgactgtcgtagaggatgttatttcgtcctggactggcttcaaaaaacatactggtgtcgacagctggaaaattctttgcgcgaaacctgggagcttgaggagttccgagaaggcattgaagaagaggaccaggaggaagacaagaacattgttgttgacgatataaccgaacagaagcccgaacctcaggacgatggaaagtccacagagtctgacgtcaaagctgatggcgactccaaaggatctgaggaagtagactctcactgtaaaaaagctctgagtcacaaggagttgtacgagcgcgcaagggagctgttagtgagctacgaggaagaacagttcacagttctggaaaaattccggtatctacccaaagccataaaagcttggaataacccgtcccccagggtggagtgcgttctcgccgagctgaaaggggtcacatgcgagaatcgggaggccgtactggacgcttttctcgacgacggcttcctggtgcccacctttgaacagctggccgcactgcaaattgagtacgaggacggccagactgaagtgcagcgtggcgagggtactgacccaaaatcgcacaagaacgtcgatttaaatgatgtgctcgtccccaagccattttcacaattctggcagccgttgctgcgcgggttgcattcccagaattttacgcaggccctcttggagcgcatgttgagcgaactgcccgctctcggaatttcggggattcgtcccacttacatcttaagatggaccgtggagcttatcgttgcaaacaccaaaaccggaaggaacgctagacgcttcagcgccggtcagtgggaggcacggcgtggttggagactctttaattgtagtgcttccctggactggccccggatggtggagagctgtctagggtccccgtgctgggcctcgccgcagctcttgaggatcatttttaaggctatgggacaggggctgcccgatgaggaacaggaaaagctgctgagaatctgcagcatttatacacagtctggtgaaaattcattggtccaggaaggtagtgaagctagcccaatcggaaaaagcccttatacgttggactctttgtattggtccgtgaagcccgcctctagctctttcggttccgaagcaaaagcacagcagcaggaggagcagggaagtgtgaatgatgtcaaagaagaggagaaggaggagaaagaggtactaccagatcaagtagaagaagaagaggagaatgacgatcaggaggaagaggaggaggacgaggacgatgaagacgacgaggaggaggacaggatggaggttggaccattctctaccggacaagagagtcctactgccgaaaacgcaagactgctcgctcagaaaagaggcgcccttcaggggtccgcatggcaggtgtcgtccgaggacgtgaggtgggacacgttcccattagggcggatgccaggtcagaccgaggaccctgcagaactcatgctggagaactatgatacaatgtacctgctcgaccagccagtcttggagcagcgacttgaaccctctacctgcaagacggatacactgggcttgtcctgtggggtgggctctggtaattgttctaactcttcctcaagcaatttcgagggcctgctctggagtcagggacagctacacggcctgaagactgggctgcagctgttttag

SEQ ID NO: 19628 - DNA, 507 bp, Artificial Sequence
  Description of Artificial Sequence: Synthetic coding sequence
atgagcctgacccaccggctgcacctgtgcaagtactggggctgcgcagttagtaacgtgtgcaggttctgggagggacgtcctctgcctctgatgatcgtggtgccatacacactgcccgtctccctgccagtagggtcctgcgttattatcacagggacaccaatcctaacattcgtcaaagatccccagctggaggtgaacttctacaccgggatggatgaggattccgacatcgcgtttcagttccgcctgcacttcggtcaccctgccatcatgaatagctgtgtattcgggatttggagatacgaagagaaatgttactatctgccgtttgaagacggtaagccgtttgagctgtgcatttacgtgagacacaaagaatacaaggtgatggtgaacggtcagcgaatctacaatttcgcgcatagattccctcccgcctccgtaaagatgcttcaggtcttcagagacatttctttaaccagggtgcttatcagtgattag

SEQ ID NO: 19629 - DNA, 420 bp, Artificial Sequence
  Description of Artificial Sequence: Synthetic coding sequence
atgagcagcctgcccgtgccctacaccctgcccgtgagcctgcccgtgggcagttgtgttatcattactggcacgcccattctgacattcgtgaaggacccacagttagaagtcaatttttacaccgggatggacgaggactctgacatcgccttccagttcaggctgcacttcggccatcccgcaatcatgaactcatgcgtcttcggaatttggcgctacgaagaaaaatgttattatctgccttttgaagacggaaagccttttgagttatgtatctatgtgcgtcataaagaatataaagtgatggtgaatgggcagaggatctataattttgctcaccgctttcccccagcgagcgttaagatgctccaagtgtttagagatattagcctgacccgggtgctgatctcagattag

SEQ ID NO: 19630 - DNA, 1314 bp, Artificial Sequence
  Description of Artificial Sequence: Synthetic coding sequence
atggcccgggtggcctggggcctgctgtggctgctgctgggcagcgcaggtgctcagtacgagaaatatagcttcaggggtttccctccggaagatctcatgccattagctgcagcttacggccacgctctggaacagtacgagggcgaatcctggagagaatctgcccgctacctggaagccgctctcaggctgcacagactgctgagggattccgaggcgttttgtcacgccaactgctcaggcccagcccccgcagctaaacctgatccagatggaggccgcgcagatgaatgggcttgcgagctgagactctttggccgagtcttagagcgggctgcgtgcctgcgccggtgcaaacgcacactgccagctttccaggtaccctaccccccccggcagctgctgcgcgatttccagtcccgactcccctatcagtatctgcattacgcattattcaaggccaaccgtctggaaaaagctgtggccgcggcgtacaccttccttcaacgaaaccccaaacacgagttaaccgcaaagtatctcaactactatcaaggaatgcttgatgtcgccgacgagtccttgacagacctagaggcccagccatacgaggctgtgttcctgagagctgtaaagctgtacaactctggagatttcagaagctctactgaggacatggaacgcgccctgtctgagtacttggctgtgtttgcccgatgcctcgccggctgtgaaggcgcgcatgagcaggttgatttcaaggatttttatcccgccattgccgatttgtttgccgaaagtttgcagtgtaaggtggactgcgaagcaaacctgacacctaacgtgggcggctactttgtggataagttcgtggcaactatgtatcactatctgcaattcgcttactataaacttaatgacgtccggcaggcggcacgcagtgccgccagctatatgctcttcgatcccaaggatagcgtcatgcagcagaacctcgtgtactatcggtttcacagggcacgctggggtcttgaagaggaggactttcagccccgggaggaagctatgctataccataaccagacagcagaactgcgagagttgctggagttcactcatatgtacctgcagagtgatgatgagatggagttagaggagaccgagccaccactcgagcccgaagacgccttgtcggacgccgagttcgagggcgagggggactacgaggaaggtatgtacgcagattggtggcaggaacctgacgcgaagggcgacgaagcagaggctgaacctgaaccagaacttgcctag

SEQ ID NO: 19631 - DNA, 1314 bp, Artificial Sequence
  Description of Artificial Sequence: Synthetic coding sequence
atggcccgggtggcctggggcctgctgtggctgctgctgggcagcgctggagcccagtacgaaaagtatagtttcagaggattcccccccgaagaccttatgccactcgccgctgcctacggccacgctctggagcagtacgagggcgagtcttggagggagtctgcccgctatctcgaggctgcccttcggctgcatcgcttactgcgcgactctgaagcgttttgccatgccaattgctctggccctgcacctgcagccaaacctgatcccgatggcggaagagccgacgagtgggcctgcgagctccggcttttcggtagagtactggagcgggccgcctgcctgagacgatgtaagcgcactctgccggcattccaggtaccctacccgccaagacagttgctacgcgactttcagagccgactgccatatcagtacctgcactacgccctgtttaaggccaaccggctggaaaaggccgtggcggccgcatatacgttcctacaacggaaccccaagcacgaactgaccgcgaagtacctcaactactatcaggggatgctagacgtagccgacgaatcgctgaccgatctggaggcgcaaccatacgaagctgtgtttttacgagctgttaaactgtacaacagcggtgacttccggagctctaccgaagatatggagcgagccctctctgagtatctggctgtattcgctagatgtctggccgggtgcgagggcgcgcacgaacaggtagacttcaaagacttttaccctgccattgctgatctttttgcagagtcgctgcagtgcaaagtggactgtgaagccaacctaacgcctaacgtaggaggatatttcgtggacaagtttgtggcgacaatgtaccactacctgcaatttgcttattataaactgaatgatgttcgacaggctgcccgctccgccgcgtcatatatgctgttcgatcctaaagacagcgttatgcagcagaacctggtgtattacaggttccatagggctcgttggggccttgaggaagaagatttccagccacgtgaggaggccatgctgtatcataaccagaccgctgagttgcgagagctcctggagtttactcacatgtacctgcaaagcgatgatgagatggaactggaggagacagagccccctttggagcccgaggacgccctctcagatgccgagttcgaaggcgagggagattatgaagaaggtatgtacgccgactggtggcaagagcccgacgctaaaggcgacgaggccgaggccgaacctgaaccagaactagcttag

SEQ ID NO: 19632 - DNA, 1281 bp, Artificial Sequence
  Description of Artificial Sequence: Synthetic coding sequence
atggcccgggtggcctggggcctgctgtggctgctgctgggcagcgcaggtgctcagtatgaaaagtattcttttcgcgggttcccgcccgaggacctgatgcccctggccgccgcgtatgggcatgcacttgagcagtatgagggggagagctggagggaaagcgctcgttacctggaagccgcactgagactgcaccgtctcctgagagactcggaggcattttgtcacgcaaactgctccggtcctgctcccgctgcgaagcctgaccctgacggcggtagagcggatgaatgggcgtgcgagctacggctgttcggccgcgttttggagcgagccgcattccaggtgccctatccacctaggcagctccttagagattttcagtcaaggctgccttaccagtatcttcactatgccctgttcaaggcaaataggctggaaaaagcagtggccgcagcctatactttcctgcaacgcaaccccaaacacgagctgaccgcaaaatacttaaactattaccaggggatgttagatgtagccgacgagtccctcactgatttagaagcccagccttatgaggccgtgtttctcagggctgttaaactgtataacagcggtgacttcagatcgtctacagaggatatggagcgcgcactgtccgagtacctggccgtctttgcccgatgcctcgcaggctgcgaaggcgctcacgagcaggtagactttaaggatttttatcccgcaatagccgacctgttcgctgaatctttgcagtgcaaggttgattgtgaggcaaatctcacacccaatgtcggtggatactttgtagacaagttcgtcgctacaatgtatcattaccttcagttcgcatattataagctgaatgatgtgaggcaagccgcacggtccgctgcttcgtacatgttgtttgaccctaaggatagcgtgatgcaacagaatttagtgtactatcgcttccacagggccagatggggcctcgaggaagaagactttcaacctagagaggaggctatgctgtaccacaaccagaccgccgagctccgggagctcttggaattcacccacatgtacctgcaatctgacgatgagatggaactggaggagacagagcccccgttagaaccggaagatgccctgtctgatgccgagtttgagggcgagggggactacgaagaagggatgtacgccgactggtggcaggaacccgacgctaagggcgacgaagcggaggctgaacctgaaccggagctggcttag

SEQ ID NO: 19633 - DNA, 942 bp, Artificial Sequence
  Description of Artificial Sequence: Synthetic coding sequence
atggccagcttccggaagctgaccctgagcgagaaggtgccccccaaccatccttcccgcaaaaaggtgaatttcctggacatgtctcttgatgacatcattatctataaggagttggaaggcactaatgcagaggaagaaaaaaacaagaggcagaaccacagtaagaaagagtccccatccaggcagcagtcaaaggctcacaggcatcgacataggaggggctattcccggtgcaggtctaatagtgaagaagggaaccacgataaaaagcccagccagaaaccctcggggttcaagagcgggcagcaccccttaaacggacagccactgattgaacaggagaaatgctccgacaactacgaagcgcaggctgaaaaaaaccaaggtcagagtgagggaaaccagcatcagagtgaggggaaccccgataagtcagaggaaagccaggggcagcctgaggaaaatcatcattcggagcgatctagaaatcacctcgaacggtccttatcccagagcgatcggtcacagggccagctgaagcggcaccaccctcagtatgaacggagccatgggcaatacaagcgttctcatggacaatctgagaggtcacacggacactcagagagatcacatggccacagcgagagaagccatgggcactccgagaggtctcacggtcactccaagcggagccgttcacagggggatctggtggatacccagagcgacctgatagccactcagagggatttaatcgctacacagaaagatctcattgcgacccagcgggatctcatagcgacgcagcgagaccttatagtgacacagagagatctggttgctaccgagcgtgatcttattaaccaatccgggcgctcacatgggcagtccgagcggcatcagagatattcgacggggaaaaataccatcaccacttag

SEQ ID NO: 19634 - DNA, 237 bp, Artificial Sequence
  Description of Artificial Sequence: Synthetic coding sequence
atggccagcttccggaagctgaccctgagcgagaaggtgccccccaatcacccttctcggaaaaaggtgaatttcctggatatgagtctggatgacattataatctataaggaactcgaaggaactaacgccgaagaggagaaaaataaaaggcaaaatcactccaagaaggagagtccctccaggcaacagtctaaggctcacaggcacaggcaccggaggggagaggtgcaatag

SEQ ID NO: 19635 - DNA, 696 bp, Artificial Sequence
  Description of Artificial Sequence: Synthetic coding sequence
atgctgaagaagaagcggatcaaggaccggaccatcgtgaagcggaatcgcctgcaagatagcaaccagaaattaatcgacatcgccataggtgaggagaaatgttctgacaattacgaagctcaggcagaaaagaatcaggggcagagcgaggggaaccagcaccagtcagaggggaacccggataaatccgaggagtcccagggacagcctgaagaaaatcatcatagcgaacgctcacggaaccacctggagcgaagtttgagccagagtgataggagtcagggacagctgaagcgacaccacccacagtacgaaagatcccacggtcagtataagaggtcgcacggacagtcggagcgctcacatggacattccgaaagatcccacggccacagcgagcgatctcacggccatagtgagcggtcccacggacactccaaacggagtcgctcacagggtgacctcgtcgatacccagagtgacctgatagcgacacagcgggatcttatcgcaactcaaaaagatctgatcgccacccagagagacctcatcgcaacccaacgcgatctgatcgtaacccagcgggatttggtcgcgactgaaagagatctgatcaatcagtctggccggtcccacggtcagtcagagcggcatcagaggtacagcacaggcaagaataccatcacaacatag

SEQ ID NO: 19636 - DNA, 1944 bp, Artificial Sequence
  Description of Artificial Sequence: Synthetic coding sequence
atgggccccctgagcgcccggctgctgatgcagcggggccggcccaaatctgatcggttaggcaagatccgatccttggacctgagtggtctggagcttctaagcgaacacctggatcccaagctcttgtgccggctaacgcagttgcaggaactagacctgagtaataaccacttagagacacttcctgataacctgggcttgtctcacctgagagtgttgagatgtgccaataatcagctgggcgatgtgactgccttatgccagttcccaaaacttgaggaactgtccctggagggaaatccattcttaaccgtgaacgacaacttgaaagtgtcatttctgctgcccactttgcgcaaagtgaacgggaaagacgcatcttcaacctactctcaggtggagaacttgaacagggagttgacctcaagggttacagcacattgggaaaagtttatggccaccctaggaccagaggaagaggccgaaaaagcccaggcggattttgttaaatccgctgtacgggatgtgaggtatggtcccgaatccctctctgagttcacacagtggcgagtccgcatgatcagcgaggagctggtagctgcctcccggacccaggtccagaaagcaaactctcctgaaaagcctcctgaagcaggggccgctcacaaaccccgagctcgcctagcagccttgaagcgacccgacgatgtgcctctctccctgtccccctccaaaagggcctgcgcctcaccctcggctcaagttgagggatcgcctgtcgccggttctgacggatcccaacctgccgtgaaattagaacctctccattttttgcaatgtcactccaagaataatagccctcaggacctcgagacacagctctgggcttgtgcttttgagccagcatgggaagagggggctactagccaaactgtcgccacctgcgggggcgaggcggtttgtgtgatcgactgccagacaggaatagtgctccacaagtacaaggccccaggagaggagttcttctcggtagcctggaccgccctcatggtagtcacccaggccggacacaaaaagcgttggtctgttttagcagcggccgggctgagggggctggtgcgcctgctgcacgtgcgggctggcttttgctgcggggtcataagagctcataaaaaagccattgctaccctgtgcttctcccctgcgcatgagacacacctctttacagccagctacgacaaacggataattctttgggacattggagtgcctaaccaggactatgaattccaggccagtcagcttctcactctggataccacctcaatcccattaagactgtgtccggttgccagctgcccagacgctcggcttctcgccggatgtgaaggaggctgctgttgttgggatgtgcgactggaccagccacagaagcgcagagtttgtgaggttgagtttgtgtttagcgagggaagcgaggccagcggcaggcgggtagatggactcgcatttgtgaacgaggacatagtggcctcaaaggggtcaggtctgggtacaatctgtctgtggtcatggaggcaaacctggggggggcggggcagtcagtctaccgtggccgtcgtggttcttgcccgcttacagtggtcgtctaccgaacttgcttatttttcactttccgcttgccccgataaaggaattgtgctgtgcggggatgaagaaggtaacgtctggttgtatgatgtgagcaacattctaaagcaaccgcctctgctccccgctgctttgcaggcaccaacgcagatcctgaagtggccgcagccctgggccctcggacaggtagtgaccaagaccatggtcaacactgtagtcgcaaatgcttcgtttacctacctcactgctctcaccgactcgaatatcgtcgcaatctggggcaggatgtag

SEQ ID NO: 19637 - DNA, 2310 bp, Artificial Sequence
  Description of Artificial Sequence: Synthetic coding sequence
atgagcaacaacctgcggcgggtgttcctgaagcccgccgaggagaactccgggaacgcttcaaggtgcgtctcaggatgtatgtatcaggtcgttcagacaatagggagcgacgggaaaaacctgctccagctgctgccaatccctaagtcctccggtaacctgatcccactggtacaatcttctgtgatgagtgacgccttaaagggaaataccgggaaacccgtacaggtgaccttccagacgcaaatttccagcagctccacaagcgccagcgtgcagctgcccatcttccagccagccagctcttctaactattttctgaccaggactgttgatacctccgagaagggtcgtgtgacttctgttggcacaggcaactttagctcgtctgtgtcgaaagttcagtctcacggggttaagattgacggactgacaatgcagacctttgctgtgcctccatcgacacagaaggacagttcctttattgtggtgaacacccagtccctgccagttactgtgaaatcccccgtgcttccgtctgggcaccacttacaaatccccgctcacgccgaggtgaagagcgtccctgcctccagcctacctccctctgttcagcagaaaattctggcgaccgccaccacaagtacaagtggaatggtcgaggctagccagatgcccactgtcatatatgttagccccgtcaacacagttaagaacgtggtgaccaaaaactttcagaatatttatcccaagcctgtgacagagatagcaaaaccagtgatcctgaacacgacgcagatccctaaaaacgtagccactgagacccagctcaaaggaggccagcattcccaggctgcaccagtgaagtggattttccaagataatctccagccatttacaccaagcctggtccccgtaaagtcatccaataatgtggccagcaagatcctgaaaacctttgttgatagaaaaaatctgggcgataacactatcaatatgccccctcttagtactatcgaccccagtggcactcgttcaaagaacatgccgattaaggacaacgccttagtcatgttcaatggtaaagtctatctccttgctaagaagggaaccgacgttctacccagccagatagaccaacaaaactccgtgagccctgacactcccgtgagaaaagatactctgcaaaccgtcagttcttcacccgtcacagaaatctctcgcgaggtcgtcaatatcgtcctcgcgaaatcaaagagtagtcagatggagactaagtcactgagtaacactcaactggctagcatggccaatctgcgcgccgagaagaataaggtcgagaaaccatcaccatctaccactaacccccatatgaaccagtcttctaactatctgaaacagtcaaaaaccttgtttaccaacccaatattccctgtcggtttttccaccggccacaacgcccctaggaaagtgactgctgtcatctatgccagaaagggctccgttctgcagagcattgaaaaaatctcctccagtgtggacgcaaccacagtaactagccagcaatgtgtgtttagagaccaggaacccaagatccacaatgaaatggcgagcacatcagataagggggctcagggaaggaacgataagaaggattcacagggtaggtcgaacaaggctctgcacttgaagagcgatgctgagttcaagaagatcttcggtctcactaaggacctccgggtatgtctaaccagaatcccggatcacctgacgagtggtgaggggttcgactctttctcctctctcgtgaaatcgggcacctacaaggagactgaattcatggtgaaggaaggtgaaagaaaacagcaaaacttcgacaaaaaacgtaaagcgaagaccaataaaaaaatggaccacataaagaagcgaaagacggaaaacgcttacaatgcaattatcaacggggaggctaatgtgaccggcagccaactcttatcaagcattctgccaacctccgacgtgtcgcagcacaacatcctcacctcccacagtaagacccggcaggaaaaacgcaccgagatggaatactatactcatgaaaaacaggagaaagggactctcaattctaatgccgcatatgagcaatctcattttttcaacaaaaactatactgaggatatttttccggttacaccaccggagctcgaggagactattcgggacgagaagatccgcaggcttaagcaggtcttacgggaaaaagaagccgccttggaggaaatgaggaaaaagatgcaccagaagtag

SEQ ID NO: 19638 - DNA, 702 bp, Artificial Sequence
  Description of Artificial Sequence: Synthetic coding sequence
atggccagcaccagcgacaagggcgcccagggccggaacgacaagaaggatagccagggccgcagcaacaaagctctccatctgaaaagcgatgccgaatttaaaaagattttcgggctcactaaggatctcagggtgtgccttactaggatccccgaccacctgaccagtggtgaaggattcgatagtttctcctccttggtgaagtcagggacatataaggagaccgaattcatggtcaaggaaggcgaaaggaagcagcagaactttgacaaaaagcggaaggccaagaccaacaagaaaatggatcacatcaagaagaggaagaccgaaaacgcttataatgcgatcataaacggcgaggcaaacgtgacaggtagccaacttctgtcttcaattctaccaacatctgacgtgtcccaacataacattttgacatcccactccaaaaccaggcaggagaaacgaactgagatggagtattacacccacgaaaaacaagagaaaggcacactgaatagtaacgctgcttatgagcagagccacttcttcaacaagaactacactgaggacattttccctgtgacccccccggagttagaggaaactatccgtgacgagaaaatccggaggctgaaacaggtgctgagagaaaaggaggctgctctcgaggaaatgagaaaaaaaatgcatcaaaaatag

SEQ ID NO: 19639 - DNA, 702 bp, Artificial Sequence
  Description of Artificial Sequence: Synthetic coding sequence
atggccagcaccagcgacaagggcgcccagggccggaacgacaagaaggacagtcaggggcgaagcaacaaagctctgcacctgaaatctgatgcagaattcaagaagatcttcggcctgacgaaggatttaagggtctgcttaacaaggattcccgaccacctgaccagcggcgaagggttcgatagcttcagcagccttgtaaagtctgggacttacaaagagacagagttcatggtaaaggagggagagcgaaaacaacagaatttcgataagaaacggaaggcaaagaccaacaagaaaatggaccatattaagaaacggaaaaccgaaaacgcgtacaacgctatcatcaatggcgaagctaatgtcacaggatcccagctcctaagcagcatcttgcctacatcagatgtgagtcaacacaacattctgacttcccatagcaagacccggcaggagaagcgaaccgagatggagtattacacccatgagaaacaggaaaaaggcaccctcaactccaatgcagcatacgagcagagccacttcttcaacaagaattacaccgaggatatttttcccgtgactccgccagaactggaagagacaattcgagatgagaaaattcgccggctcaagcaggtgttgcgcgagaaagaggctgctctggaggagatgcgcaagaagatgcaccagaagtag

SEQ ID NO: 19640 - DNA, 1134 bp, Artificial Sequence
  Description of Artificial Sequence: Synthetic coding sequence
atgtactggaagcacgagaacgccgcccccgccctgcccgagggctgtagactaccagctgaggggggcccagcaactgaccaggtaatggctcagccagggagtggctgtaaggccactactcgttgcttagaaggtactgcgccgccggcgatggctcagtcagacgctgaggccttggccggagcgcttgataaagatgagggtcaagcatcaccatgcaccccctccaccccaagtgtgtgttcccccccttctgctgcctcttcagttccgtcagcagggaagaatatttgctcatcctgtggactcgagatcctcgataggtatttgctgaaggttaacaatttgatttggcacgtgaggtgcttagaatgtagtgtgtgtcggacatccctcaggcagcagaactcttgttacatcaagaacaaagaaatattttgcaagatggattatttctcgagattcggaacgaagtgtgctcgatgcgggcggcagatctacgctagtgattgggtgagaagggcgagaggcaatgcatatcacctggcctgttttgcctgcttcagctgtaagcgccagctgagtaccggagaggagtttggtctggttgaagaaaaagtgctctgtcgcatacactacgacaccatgatcgaaaacttgaaacgcgcggccgagaatggtaacgggctaacgttggagggagcagtgcccagcgagcaggattcccagcccaagcctgccaaaagagccaggacttcctttacagcagagcagctgcaggtaatgcaggcccaattcgcacaggacaataatcctgacgcccagacattacagaagctggccgacatgacagggttgagcaggcgcgtcattcaggtgtggtttcaaaactgcagagcgcgacataaaaagcataccccacagcaccctgtgcctcccagcggcgctccacctagcagactacccagcgcactcagtgacgatattcattacacaccattcagctccccagagcgcgcacgaatggttactctacatggctacatcgaaagccacccgttctccgtcctcacgcttccagctttacctcaccttccagtgggggcaccccaattgcctctttctagatag

SEQ ID NO: 19641 - DNA, 1092 bp, Artificial Sequence
  Description of Artificial Sequence: Synthetic coding sequence
atggcccagcccggcagcggctgcaaggccaccacccggtgcctggaggggaccgcaccgccggcaatggcccagtctgacgccgaggctctagccggcgccctggacaaggatgaagggcaggcttccccctgcacccctagcacccctagcgtatgttccccacctagtgccgcatctagtgtgccatctgcaggcaagaatatctgtagtagttgcgggctggagatcctcgaccgttatctgctgaaggtgaataacctaatctggcatgtgcgctgtctggagtgcagtgtgtgcagaacttcactgcggcagcaaaacagctgctatatcaaaaataaggagattttctgtaaaatggactacttttctagattcggcacaaagtgtgcccgctgcggacgccaaatctatgcgtccgactgggtgagacgagcacgaggaaacgcttaccatctggcttgtttcgcctgcttcagctgtaaacgccagctatcaaccggagaggaattcggtctcgtggaagagaaagtcctctgcagaattcattacgacaccatgatcgagaacctgaagcgcgcggccgagaatggtaacggtctgactcttgagggagcggtaccttcagaacaagactcccaaccgaagcctgctaagcgggccagaaccagctttacagctgagcaactgcaggtcatgcaggctcagttcgcgcaggacaataaccccgatgctcagactctgcaaaagttagcagacatgacaggcctcagcagaagagtcatacaagtttggtttcagaattgccgggcccggcacaagaaacacacaccacaacatcccgtgcctcctagcggcgccccaccaagtcggctgcccagcgccctgtcagatgacatccactatacgccatttagctctcccgaacgggcgagaatggtaactcttcatggctacatcgagtcccaggtgcaatgtggccaggtgcattgccgattaccctataccgccccacctgtacacctcaaagcggacatggacggccccctctccaacagaggggaaaaagtcatcctattccagtattag

SEQ ID NO: 19642 - DNA, 1179 bp, Artificial Sequence
  Description of Artificial Sequence: Synthetic coding sequence
atgtactggaagcacgagaacgccgcccccgccctgcccgagggctgccggctgcccgcagagggcggccctgccacggatcaagtgatggcccaacccggctcaggttgtaaggctaccacccggtgtctcgaagggactgctccccccgcgatggcccagtccgacgctgaagcgctggccggagctctcgacaaagacgaagggcaagcttctccctgtacacccagcacccccagcgtgtgttcacccccatccgctgcgtccagcgtgccctcagctgggaagaatatctgttcatcatgtggcctggagattttggatcggtatctcctgaaagttaataatctaatctggcacgtcaggtgtctggagtgcagcgtgtgtagaactagcttgaggcagcagaatagctgctacattaaaaacaaggaaattttctgcaaaatggattatttttctagatttggaaccaagtgcgcgcggtgtggaaggcagatttacgcttccgattgggtacgcagagcccgcgggaacgcttatcacctggcttgtttcgcttgcttttcatgtaagagacagctcagcacaggggaggagtttgggctggtggaagagaaggtgctctgtcggattcattatgacacgatgattgagaatctaaagagagccgccgagaatggcaatgggctcactctcgagggggctgtaccctctgagcaagattctcagcccaagccagccaagcgggccagaaccagcttcactgcagagcaacttcaagtcatgcaagcacaattcgcacaggataacaacccggacgctcagacgctgcagaagttggccgacatgacagggctgtcgcgaagagtgatacaggtctggttccagaactgccgcgcccggcacaagaagcatactccacaacatcctgtgcctccatcaggagccccccctagtcggttaccctctgctctgtcagacgacatccactatacacccttttcatcccccgagcgggcaagaatggtcaccttgcacggctatattgaaagccaggtccagtgcgggcaggtacattgccgtttaccatacacggccccgcccgttcatctcaaggccgacatggacggcccactgtcaaatcggggtgaaaaggtgattctgttccagtactag

SEQ ID NO: 19643 - DNA, 1101 bp, Artificial Sequence
  Description of Artificial Sequence: Synthetic coding sequence
atgcggcggggcctgtgccggcggagcgccgagaaccccgacgccggacccgtaatggcccagccagggagtgggtgtaaggccaccacaaggtgtcttgaaggcactgctccccctgcgatggcacaaagcgatgcagaagctctcgccggagcattggacaaagacgagggacaggccagtccttgtacgccctccacgccctcagtgtgtagtccacccagcgctgcgagcagcgttccttctgccggcaaaaacatctgctctagttgtggtctggagatactggaccgatacctgcttaaggtgaataacctgatatggcatgttcggtgcctggaatgctctgtctgtcgcaccagccttagacagcaaaactcttgctatattaagaacaaagaaatattctgcaagatggattacttcagtagatttggcacaaaatgtgcgagatgtggaaggcagatctacgcaagcgattgggtgcgccgtgctaggggcaacgcgtatcacttggcctgtttcgcttgtttttcttgtaagcgccagctgagtacaggcgaggagtttggactagtggaggagaaggtgctctgcagaatccattacgacaccatgatcgaaaacctgaaacgggcagccgagaatggcaacggactgaccctggaaggcgctgtgccaagcgagcaggactcgcagcctaagccagccaagagggcacgaacctctttcacagcggaacagttgcaggtgatgcaggcacagtttgctcaggacaataaccccgacgcacaaacattacaaaaacttgcggatatgaccggcctgtcgagacgcgtcatccaggtgtggtttcaaaactgtagagcaagacataagaaacacacaccccagcaccctgtgcccccaagtggcgctccgccatctcgccttccatctgcgctctcagacgacattcattacacccccttctcttctcctgagcgggccagaatggtgacattacatggctacatagaaagccacccgttttcagtgctaacccttcctgcgcttccccacttacctgtgggggcaccgcagctgcctttaagccggtag

SEQ ID NO: 19644 - DNA, 66 bp, Artificial Sequence
  Description of Artificial Sequence: Synthetic coding sequence
atggcccagcccggcagcggctgcaaggccaccacccggtgcctggaaggcacggctccgccatag

SEQ ID NO: 19645 - DNA, 105 bp, Artificial Sequence
  Description of Artificial Sequence: Synthetic coding sequence
atggcccagcccggcagcggctgcaaggccaccacccggtgcctggagggtaccgctccaccagctatggcgcagtccgatgcggaagcactggccggggcatag

SEQ ID NO: 19646 - DNA, 531 bp, Artificial Sequence
  Description of Artificial Sequence: Synthetic coding sequence
atgatcgagaacctgaagcgggccgccgagaacggcaacggcctgacactcgagggcgcagtgccatcagagcaggatagccaacctaagcccgcaaagcgcgccaggacctccttcacagctgagcagctccaggtaatgcaggcgcagttcgcacaggacaataatcccgatgcccagaccttgcagaagttggccgatatgactggtctgagtagaagagttatccaagtgtggtttcagaactgtcgggcccggcacaagaagcacaccccccagcacccggtgcccccttctggtgccccaccctctcggctgcccagcgccctgtccgatgacattcattacactcctttctcaagcccggaacgggccagaatggtgaccttacacggctatatcgaatcacaggtacagtgcgggcaggtccactgtcgcctgccgtatacagcccccccggtacacctgaaggctgacatggacggtcccctaagtaaccggggtgaaaaagtcattctcttccagtactag

SEQ ID NO: 19647 - DNA, 372 bp, Artificial Sequence
  Description of Artificial Sequence: Synthetic coding sequence
atggccgtgagccacagcgtgaaggagcggaccatcagcgagaactcactgatcatattgttgcagggtcttcagggacgggtgacaacagtggatctgagggatgaatccgttgcacatgggagaatcgataatgtcgatgcgtttatgaacattcgactggccaaagtgacctacactgataggtggggccaccaggttaaactggatgacctgttcgtcacagggcggaatgttcgatatgttcacataccagacgacgtgaacattacatccactatcgagcaacaacttcagattatccatagagtgcgcaacttcggtggcaaaggtcagggccgatgggagttcccgcctaagaactgcaagtag

SEQ ID NO: 19648 - DNA, 1083 bp, Artificial Sequence
  Description of Artificial Sequence: Synthetic coding sequence
atggaggagcgggagcggggcgcccggagcgccggcgccggcagccctgccagaccacctagcccccgtctagatgtatcaagtgactcgttcgatccattgctggctctgtacgctccgaggctccctcccatcccctatcctaatgccccttgtttcaataacgttgctgaatacgaaagctttcttaggacaggggtacggggaggaggacggggcagaggccgggctcggggcgcggcagccggcagcggggtccctgccgctccagggccatcgggtaggacccggaggaggccagacgctcccgcgcctgaccctgagcgaatccagcgactccggcggctaatggtggctaaagaggaaggtgacggcgccgcaggcgccggcaggaggggccctgggcggtctaggaaggcaccacgcaacgtgttgactaggatgccgttgcatgaggggagtccccttggtgagttacatcgctgcatcagggagggtgtgaaggtgaatgtgcatattagaacttttaaaggattgaggggagtctgcacgggtttcctagtggcctttgataagttctggaacatggccctcacagatgtggacgaaacgtacaggaaacctgtgctggggaaggcctacgagcgggattcctcgctgacactgaccaggctgttcgatcgtttgaagctacaggacagttccaaaaaggaagctgattccaaatctgcagtcgaggattccacactgagtcgctattcacagacctccacatggaaattggcctccgtgtggggaagagcggatacgggcagggggagccataaaagaagccggagtgtccccagttctctccaggcttctgcacgcgaggaatccaggagcgaactttccggacggaccacccggactgacgggagcagcgtgggtggcactttctccagagctaccactctttcacgaggccagtccagaaaaaagaaaaggaaaccaaaggtagattatcagcaggtctttacacggcacataaatcagatattcataagaggagaaaatgtcctgctggtgcatctggcacaatag

SEQ ID NO: 19649 - DNA, 1140 bp, Artificial Sequence
  Description of Artificial Sequence: Synthetic coding sequence
atggtgttcttcacctgcaacgcctgcggcgagagcgtgaagaagattcaagttgaaaagcacgtctcagtctgtaggaattgcgaatgcctatcttgtatcgattgtgggaaggatttttggggcgacgattacaagaatcacgtgaagtgtatttccgaggaccagaaatacggaggcaagggttacgaggggaagacacacaagggcgacataaagcagcaggcctggatccagaaaatctccgagctgatcaaaagacccaacgtctctcctaaagtgagagagttactcgaacagatcagcgcctttgataacgtgccacgcaagaaggccaagttccaaaattggatgaagaattctttgaaggtgcataacgagagtattctggaccaggtgtggaatattttctccgaagcctctaatagtgagcccgtgaacaaagaacaagatcagcgtcctttgcacccagtagctaatccacacgccgagatatccaccaaagttcccgcatcaaaggtcaaagacgccgtcgaacagcagggggaagtaaagaaaaataagcgcgagaggaaggaggagcggcaaaaaaagcgtaaacgggagaagaaggagctgaagctcgagaaccatcaagaaaattctagaaatcagaaacccaagaagagaaagaaaggtcaagaggccgacctggaggccggcggcgaggaagtacccgaagccaatggctctgcagggaagagatcaaagaagaagaagcagagaaaagactcagcgtcagaagaggaggcccatgtcggcgccggaaaaaggaagcgacggcactcagaagtggagacagactccaaaaagaaaaagatgaaactgcccgaacatcccgagggaggcgaaccagaagacgacgaagccccagcaaaaggtaagttcaattggaaaggcaccattaaagctattctcaaacaggcccccgacaacgagataactattaaaaagctacgtaagaaggtgttggctcagtactacacggtgaccgatgaacatcatagaagcgaggaggagctgcttgtcatattcaataagaagatttctaagaatcccacattcaaacttctcaaggacaaggtgaagctagtgaaatag

SEQ ID NO: 19650 - DNA, 1140 bp, Artificial Sequence
  Description of Artificial Sequence: Synthetic coding sequence
atggtgttcttcacctgcaacgcctgcggcgagagcgtgaagaagatccaggtagagaagcatgttagcgtctgtcgaaactgcgaatgcttgagttgcatagattgcggcaaggacttctggggtgacgattataaaaaccacgtcaagtgtatttccgaggaccagaagtacggcgggaagggttatgagggaaaaacccacaagggtgatattaagcaacaggcttggatccaaaagatatcagagctaatcaagcgccctaatgtgtctcctaaagtgcgcgaacttctggaacaaatatcagcatttgacaacgtgccccgtaaaaaagccaaattccagaactggatgaaaaatagcttgaaagtgcacaacgaatcgatcttggatcaggtctggaatatattttccgaagctagcaactccgaaccagtgaataaagagcaggaccagagacctctccaccctgtggctaatccccacgccgagatcagtacaaaggtacccgcatccaaagtgaaggatgcggtggaacaacagggcgaagtaaaaaaaaataagcgcgagcggaaagaggaacgacagaagaaaaggaagcgggaaaagaaggagttaaagctggagaaccatcaggaaaactcgcgaaaccagaagccaaagaaacggaaaaagggacaagaagccgacctggaggccggaggagaagaggtgccagaagctaatggttctgccggcaagcggagcaagaagaaaaaacagcgtaaagacagcgccagcgaggaggaggcccacgtgggcgccggcaaacggaaaaggcgtcattcggaggttgaaactgactcaaagaagaaaaaaatgaaactgccagagcaccctgagggaggcgagccagaagacgacgaggctcctgctaaggggaagttcaactggaaagggactattaaagctatcctcaaacaagctcctgacaacgaaatcaccataaaaaaattgaggaaaaaggttctcgcccaatattacaccgtgacagacgagcatcaccgtagcgaggaggagctactagtgattttcaacaagaaaatctcgaagaatccgacctttaaactgctgaaggacaaggttaaactggttaaatag

SEQ ID NO: 19651 - DNA, 240 bp, Artificial Sequence
  Description of Artificial Sequence: Synthetic coding sequence
atggtgttcttcacctgcaacgcctgcggcgagagcgtgaagaagatacaggttgaaaagcacgtgagcgtgtgtaggaattgcgagtgcctgtcctgtatcgattgtggcaaagatttttggggggacgactataaaaaccatgtcaagtgtatttccgaagatcagaaatacggaggaaaaggctacgagggtaaaacccacaagggcgacatcaaacaacaagcttggattcagtag

SEQ ID NO: 19652 - DNA, 1863 bp, Artificial Sequence
  Description of Artificial Sequence: Synthetic coding sequence
atgaagcccgccccccggctgacccccgtgcggcccgccgccgccagccctattgtgtcaggagccaggcggcggagagtccgctgcaggaaatgtaaggcatgtgtgcagggtgaatgtggagtgtgtcactactgccgcgacatgaagaaatttggtggccctggacgcatgaagcagtcatgcgtacttcggcaatgtctcgcaccccggctcccacactccgtgacttgctctctgtgtggtgaggtcgaccagaacgaagagactcaggacttcgagaaaaagctgatggagtgctgcatttgtaatgaaattgtccacccgggctgcctgcagatggatggggagggcctgttgaatgaggagctgcctaattgctgggagtgtcccaaatgctaccaggaggattctagcgagaaagctcagaagagaaaaatggaggaaagcgatgaagaagccgtccaggccaaggtgctgaggcccctgcgctcctgcgatgagccccttaccccaccaccgcattcgcccacgtccatgctccagctgatccatgatccagtttcgcccagaggcatggtcacccggtcttccccaggcgccggcccttcagatcaccactcggcttctcgggacgaacgtttcaaacgaagacagcttctccggctgcaagcaaccgagaggacaatggtgagggagaaggagaataacccttccggcaagaaagagctaagcgaagtagaaaaggccaaaattcgggggtcctatctgacggtgactttacaacggcccacaaaagagctccatgggacctcaatcgtaccgaagctccaagccataaccgctagcagcgccaatcttagacattctccaagagtcctggtgcagcactgccctgcccgaacacctcaacggggtgacgaggaggggctgggcggcgaggaagaggaggaagaggaggaagaggaggaagacgattcagccgaagaagggggggcagcccggctgaacggtcgaggaagttgggctcaagacggcgatgagagctggatgcagcgggaggtgtggatgtccgtcttccgatatctgtccaggagggaactttgcgagtgcatgagggtgtgtaagacctggtacaagtggtgttgtgacaagagactgtggacaaagattgacctgtcgcggtgtaaggccatcgtgccgcaggctctgtcagggatcataaagagacagccagtgtctttggatctcagttggactaatataagtaagaagcagctgacctggctagtgaatcgtctgccagggttaaaggacctcctgcttgccggctgttcctggagtgccgttagtgctttatccaccagttcttgtcccttgttgagaaccctggacctgaggtgggctgtgggtatcaaggacccccagatcagagacctgttaacccctcctgcagataagcctggccaggacaatagatctaagttacggaacatgacagattttagactggccggcctcgacattacagacgccacactgcggttgatcatcagacacatgcctctgctgtccaggcttgatctgtcacactgttctcacctgaccgatcagtcctctaatctgcttaccgccgtgggatcttctacacgttacagtttgacagagctaaatatggccggctgcaataaattgactgatcaaaccctaatatacttgaggcggattgcaaacgtcaccctcatcgacttaagggggtgcaaacagatcacccggaaggcctgtgaacacttcatctcagatctgtcaatcaacagtttgtattgcctgtcagatgaaaaactgattcagaaaatcagctag

SEQ ID NO: 19653 - DNA, 2349 bp, Artificial Sequence
  Description of Artificial Sequence: Synthetic coding sequence
atggagcccgaggaggagcggatccggtacagccagcggctgcggggcaccatgaggagacgatacgaggatgatgggatctcagatgatgagattgaagggaaaaggacctttgacctcgaggagaagctccataccaacaaatacaacgccaactttgtgacctttatggagggaaaggattttaatgtcgagtatatacagagaggcggactcagggatcccctgattttcaagaattcagatggattagggatcaaaatgcccgacccagattttacagtgaacgacgtgaaaatgtgcgtaggctccagacgtatggtcgacgtaatggacgtcaacacacagaaggggattgagatgacaatggctcagtggacacgatattacgaaacccctgaggaggaaagggagaaactttacaatgtgatctctctggagttctcacacaccaggctggagaacatggttcagcggccttccaccgtggattttattgactgggttgataatatgtggcctcgacacttaaaagaaagtcagactgaatcaactaatgctatactggagatgcagtatcccaaggtccagaaatactgtctgatgtcagtacgaggctgctacactgacttccatgtggactttgggggcaccagcgtctggtaccacattcatcagggcggaaaagtcttttggttgattccccctaccgcccacaatctcgagctttatgagaattggctcctgagtggcaagcagggagacatattcctcggtgaccgcgtgtcggattgtcaaagaatcgagctgaagcagggatacacctttgtcattccttcagggtggatccatgccgtgtataccccaaccgatactttagtcttcggaggcaattttttgcactctttcaacatccccatgcagttgaaaatctacaatattgaagaccgcacccgtgtaccaaataagtttcggtatcctttctattacgaaatgtgttggtacgtgctggaaagatacgtgtattgcatcaccaatcgatctcatttaactaaagagttccaaaaagaatcactcagcatggacctggagctgaatggcctagagtcaggtaatggtgatgaagaggccgttgatcgcgaaccacgaagactttcatcccgaaggtcggtacttacatcaccagtagcaaacggggttaatctcgattacgacggactgggcaagacatgccgttctctcccgagtctgaaaaaaacgctggcgggtgacagctccagtgactgcagcaggggttcgcacaacgggcaagtgtgggacccccagtgcgcacccagaaaagatcggcaggttcacctcacccacttcgaactcgaaggcttacggtgcctggtggacaagttagaatctctgcctcttcacaagaaatgcgtgccaactggtattgaggatgaggatgccctcattgccgacgtgaagatactgttggaggaacttgcaaatagcgaccccaaactagccttgaccggcgtgcccatcgtccaatggccaaagagagataagcttaaattcccaacgaggccaaaagtccgggtccccacaatccctatcaccaaacctcacactatgaagcctgcgcccaggttaaccccagtgagaccagccgcagccagtccaatcgtctctggcgctagaagacggcgagtcaggtgccgaaaatgcaaagcttgcgttcagggagaatgcggagtttgtcattactgcagagacatgaagaagtttggcggccctggacggatgaaacaatcatgtgttcttaggcagtgccttgcacctcgcctcccgcactcagtgacttgttcattatgtggcgaggtcgatcagaacgaagagactcaggattttgagaagaaactgatggagtgctgcatttgcaacgagatagtccacccagggtgcctgcaaatggatggtgaaggcttgctgaacgaagaactcccgaactgttgggaatgcccgaagtgctatcaagaagacagctctgaaaaggcacagaagaggaaaatggaggagagcgacgaggaggcagtgcaagcgaaggtacttcgcccgcttcggagctgcgacgagcccctcacaccccctccccatagccccactagcatgctccagcttatccacgatcccgtgagtccgcgggggatggttacccggtccagtcctggcgctggcccgagcgatcaccattctgcaagcagggacgaaaggttcaaacgacggcagttgctgaggctacaggccacagaacggaccatggtcctacgacaggaaacactcgataaaaattag

SEQ ID NO: 19654 - DNA, 1263 bp, Artificial Sequence
  Description of Artificial Sequence: Synthetic coding sequence
atgtgcagcggccggttccagaacatccaggtgaaccccgacttcccaagggggcgcatctctaattcttttaggcgaacctctagcacagaaaataagaccaagactctgggcaagctgcatcaagagcctcgccagctgcagagcgatggaaaacggaagatcctgctggaggaattggcaaattctgacccaaaactagccctaaccggagtcccgatagttcagtggccaaaaagagacaagctgaaatttcccacccggcctaaagtcagagtccccactattccaatcaccaagcctcacaccatgaagcctgcacctcgcctaaccccagtccggccagctgctgcatctcccatcgtgtctggcgctaggcgacgccgcgtgcgatgcaggaaatgtaaagcctgtgtgcagggggagtgcggggtatgccattattgcagagacatgaagaagttcggcggcccaggtaggatgaaacagagctgcgtccttagacagtgtctagcccccaggctgcctcactccgtcacttgttctctatgcggtgaagttgatcagaacgaagagacccaggattttgagaagaagctgatggaatgttgtatctgtaacgagatcgtacacccaggctgcctccagatggacggcgagggcctcctgaacgaagaactgcctaattgttgggagtgcccaaagtgctaccaggaggatagctccgaaaaagctcagaaacggaaaatggaagagtcagacgaagaggctgttcaggccaaagttcttcgcccactgcggagctgtgatgagccgctcacgccccccccccatagccctaccagcatgcttcaacttatccacgaccctgtgtctccaagaggtatggtaactagatcttcccccggagcaggcccatcagatcaccattccgcctcaagggacgagaggttcaaacgcaggcaactgcttcgcctgcaggcgaccgaacgaaccatggtgcgggagaaggagaataacccatccggcaaaaaagagctcagtgaggttgagaaggccaaaatacgcggatcctatctgacagttactttgcagcggccaaccaaagagttacacggaacgtcgatcgtgcctaagctgcacggacaggtgctggtggtcagtagtgctcggctgagcagcatcaccctgtcacgactggctcaggaagggccagctgctccaggtgtgcctgacccatgccgatctcactggtgctgctag

SEQ ID NO: 19655 - DNA, 3489 bp, Artificial Sequence
  Description of Artificial Sequence: Synthetic coding sequence
atggagcccgaggaggagcggatccggtacagccagcggctgcggggaacaatgcgacggagatacgaggacgacggcattagcgatgacgaaattgaaggcaaaagaacattcgatctggaagagaaattacatactaacaagtacaacgcaaactttgtcactttcatggaggggaaggattttaatgtcgagtatatacagcggggcgggctaagggaccccctcatctttaaaaactcggacggtctgggtatcaaaatgcctgatcctgacttcactgtaaacgacgtgaagatgtgcgtggggtcccggcgtatggtggacgttatggacgtcaatacccaaaagggaattgagatgactatggcccaatggacgcggtactatgaaacgcccgaagaggagcgagagaaactgtataatgtaatttctctggagttttcacatacgaggttggagaacatggtacagcgcccctccaccgtcgattttattgattgggtcgacaatatgtggccaaggcatctcaaggaatcccagacagagagcaccaacgctatcctcgagatgcaatacccaaaggtgcagaagtattgtttgatgtctgtgaggggatgttacaccgactttcacgtggactttggggggactagcgtgtggtatcatatacatcaggggggcaaggtcttttggctaattccaccaactgctcacaatctggagctctacgagaactggttgctatctggaaagcagggcgatatcttcctgggtgatcgcgtgtccgattgccaaagaatcgaattgaagcaaggttatacctttgttattccttctggttggatccatgcggtatatacacccaccgatacgctcgtgttcgggggcaacttccttcacagttttaatatcccaatgcagctcaagatctataatatcgaagatcggaccagggtccccaacaagtttcgctatcccttctactatgagatgtgctggtacgtcctagagagatacgtgtattgcatcacaaatcgaagccacctgactaaggaatttcagaaggagtctctgagcatggacttggaactgaatgggctcgaatctggaaatggagacgaggaggccgtggacagggagccaaggaggctctccagccgcagatccgtccttacaagccccgtcgccaacggcgttaatctggactacgacggtctgggtaagacatgcagaagtctgccttccttaaaaaaaactttggcaggggacagttcctccgattgtagtagaggatcccacaatggccaggtatgggacccccagtgcgccccccgcaaagatcggcaagtccacctgactcattttgaattagaaggcctgcggtgtctggtggacaaattagaatctctaccactgcacaaaaagtgcgtgcctacaggaatcgaggatgaggatgctctgattgcagatgtaaagatcctactcgaggaactggctaacagtgatcccaaactggctctgacgggagtgccaatcgtccaatggcctaaacgcgacaagctgaagtttccaactcgccctaaagtaagggtccctactatccccattacgaaaccccacacaatgaaaccagcccctaggttgacaccagtgagaccggctgcagcatctccaatcgtgagcggggctcgacgaagaagggtgcgctgtaggaagtgtaaggcttgcgtgcagggcgaatgcggagtatgtcactattgtcgtgacatgaagaagtttggtggccctggtaggatgaaacagagctgtgttttgagacaatgtctcgcaccccgtcttccacactctgtcacctgttcactatgcggagaggtggaccagaacgaagaaacccaagacttcgaaaagaagctgatggagtgctgcatttgtaatgaaatcgttcaccccggatgcctgcagatggatggtgagggtctgctcaatgaggagctgcccaactgttgggagtgtccaaagtgttatcaagaggattccagtgaaaaggctcagaaacgcaagatggaagagagcgatgaagaggcagttcaagcaaaggttctgcgacccttacggagctgcgatgagccgttgactcctccccctcactcacctacatctatgctgcagctaatccacgacccggtgtctccccgagggatggtgaccaggtcatctccaggtgcaggcccttcagaccatcactcagcctccagggacgagaggttcaagcgccgacaactcctcaggctgcaggcaaccgaaaggactatggtaagagagaaggagaacaacccctccggaaagaaagagttaagtgaggtggaaaaagcaaaaatcagagggtcctatcttacagtgaccctgcagcggcccaccaaggagcttcatggtacctccattgttcctaagctgcaggcaatcaccgctagttcagcgaaccttcgtcattctccccgggttttggtgcagcattgcccagcccggaccccccagcggggtgacgaggagggattgggaggcgaagaagaagaggaggaggaagaggaggaggaggacgattcagccgaggagggcggcgccgcgaggctgaacggccgcggctcctgggctcaggatggggatgagtcctggatgcagagagaggtgtggatgtcggtttttagatacttgtcccgtcgagaattgtgcgaatgcatgagagtctgtaaaacatggtacaagtggtgttgcgacaagagactatggacaaagattgatctgtcaagatgcaaagccatagtgcctcaggccttgtctggaattattaaacgtcagccagtctctcttgacctgagctggactaacatctccaaaaaacagttgacttggcttgtgaatcgtctgcctgggctgaaagatctgctgctagccggttgttcctggagcgccgtctccgcactttccacctcctcctgcccactgctccgtaccctggaccttaggtgggccgtgggcattaaggacccacaaatccgagacctattgacacctcctgccgacaagcctggccaggacaatcgttctaaactgcgcaacatgactgatttccgtcttgccggcctggacatcacagacgccacccttcgcctgattattagacacatgcccttgctttctaggctcgacctgtcacactgctctcatctcaccgaccagagttccaacctgctgaccgccgtcggcagctccacacgctactctctgacagagcttaacatggcaggatgcaataagctgacagaccaaactctgatttacttacggagaatagccaacgtgacactaatcgatttgcggggttgcaagcagataacaagaaaagcttgtgagcacttcatttccgacttgtccatcaactccctctattgtctaagcgatgagaagttgatacagaagatatcttag

SEQ ID NO: 19656 - DNA, 2172 bp, Artificial Sequence
  Description of Artificial Sequence: Synthetic coding sequence
atgtgcagcggccggttccagaacatccaggtgaaccccgacttccccaggggacggatcagcaactcttttagaaggactagctccactgagaacaaaaccaagactttggggaaactccaccaagagccacgacaactccagtctgacggcaaaagaaagatactcctggaagagttggccaactctgacccaaagctggctctgacaggcgtccctatcgttcaatggcctaaaagagataagctgaaattccccacccggccgaaagtcagagtgccaacaattcctatcactaagcctcacactatgaaacccgcccctcggctgacaccagtgcggccagcagctgctagcccaattgtgtccggggcccgaaggagacgtgttcgttgtcgtaagtgcaaggcctgtgtgcaaggagagtgtggcgtgtgccactactgccgggatatgaagaagttcggcggcccagggagaatgaagcaaagctgcgtcctgcgccagtgcctagctcccagattaccgcacagcgtgacctgctctctgtgcggagaggtggatcagaacgaagagacccaggacttcgaaaaaaaactgatggagtgttgtatttgtaacgagatagtgcacccagggtgtcttcagatggatggtgagggtcttctgaatgaggagctgccaaattgttgggaatgccccaaatgctatcaggaggattcctcggagaaagcgcagaagcgcaaaatggaggagtcagacgaagaggccgtgcaagccaaggtccttagacctctgaggtcatgtgacgaacccctgacccccccaccccatagccccacttccatgctgcagctaatccacgacccagtctctcctagaggaatggttacgaggagcagtccaggcgcaggtccatctgaccatcatagcgccagccgcgatgaaaggtttaaaagaagacagttgctgcgtttgcaagctactgagcggacgatggtgagagaaaaggagaataatcctagcggcaagaaggaactttcagaggtggagaaagctaagatacggggcagttatctgaccgtgaccttgcagcggccaactaaggagcttcatggaacctctattgttccaaaactgcaagccatcaccgctagctcagccaaccttagacatagccccagggtgctggtccagcactgccccgctagaacaccacagaggggcgatgaggaaggactcgggggcgaagaggaggaggaggaggaagaagaagaggaagatgacagcgcagaagaaggtggtgccgcaaggcttaatggacgagggagctgggcccaggatggtgacgaaagctggatgcagagggaggtctggatgagcgtgtttcggtacctgagccggcgtgagctgtgtgaatgcatgcgcgtgtgtaaaacatggtataaatggtgctgtgacaagcggctatggactaagatcgacttatcaagatgcaaagccattgtcccacaggccctgtccggcattattaagagacagccagtaagcctggacttatcctggaccaatattagtaaaaagcagctcacatggcttgtaaacaggctgcccgggctgaaggacttactgttagccggttgctcctggtccgccgtttccgccctgagcacctcatcttgtcctcttctacgcacacttgatctgcgatgggcagtaggtatcaaggacccacagatacgggacctgctgacccccccagctgataagcccggacaagacaaccggtctaagttacggaatatgaccgactttcgactggcaggcttagatattacagatgccaccttgaggctgatcattcgccatatgcccctgctctctcggctggatctgagccactgctcccacctgacggaccaatcttccaacctgctgactgcggttggtagctcgactcgatactcactgactgaactgaacatggctggctgtaacaaacttaccgatcagaccctgatttatctccgaagaatagcaaacgtcacattgatcgacttaagagggtgcaaacagatcacacgcaaagcatgcgaacacttcatctctgatctgagcataaactctctatactgcctttctgacgagaagctgattcagaagattagctag

SEQ ID NO: 19657 - DNA, 3921 bp, Artificial Sequence
  Description of Artificial Sequence: Synthetic coding sequence
atggccggcccccagatgggcggcagcgccgaggaccaccccccccgaaaaaggcacgcagccgaaaagcagaaaaagaagacagttatctatacaaaatgtttcgagtttgaatccgcgacccagaggcctatcgaccgccagcggtatgacgagaacgaagatttgtctgacgttgaagagatcgtgagtgtacgcggtttttctctcgaggagaaacttaggtcccagctatatcagggggatttcgtacatgctatggagggcaaggattttaactatgaatacgtccaaagagaggctcttagagtgccattgatttttagagagaaagacggccttggcatcaaaatgcctgacccagattttaccgttagagatgtcaagcttttggttggttctcggaggttagtggacgtgatggacgttaatactcagaagggcacagaaatgtctatgagccaattcgtgaggtactatgaaacaccagaagcccagagggacaagttatataacgtaatctctctggagttttcccatactaagttggaacatttggtgaaaaggccaactgttgtcgatctcgtggattgggttgataacatgtggccccagcatttaaaggaaaagcagactgaagctacaaatgcaatagcagaaatgaaataccccaaagttaaaaagtactgcttgatgtctgtgaaaggatgcttcactgatttccatatcgacttcggaggaacctccgtgtggtaccacgtcttcagaggtggcaaaattttctggctcataccccccacactgcacaacctggctctgtacgaggagtgggtcctgtccggcaagcagtctgatatcttccttggagatcgtgttgaaagatgccagcggatcgagctgaagcaggggtacactttcttcattcccagcggttggatccacgctgtttataccccggtagattcgctggtgttcgggggcaacatcttgcactcttttaatgtgcctatgcagctgaggatctatgagattgaagaccgcactagggtacaaccaaaatttcggtacccattctactacgagatgtgttggtacgttttggaacggtacgtatactgtgtcacacaacgcagccacttgactcaagagtaccagcgagaaagtatgctgatcgatgcaccccgaaaacctagcatcgacggatttagtagcgactcttggctcgagatggaggaggaggcatgcgatcagcaaccccaggaagaggaggaaaaggatgaggaaggagaaggcagagaccgggcccccaagcctcctaccgacggctctacctcccctactagtaccccttccgaggatcaggaggccctgggaaaaaaaccaaaagcacctgctctgcgtttcctgaagcgtaccctctccaacgaatctgaagaaagcgtcaaatctacgacactggcagtggactatccgaaaacacctacagggtcccccgcaacagaagtgtccgctaagtggactcacctgactgaattcgagctgaaggggctcaaagcgctagtcgagaagctcgaatctctgcccgagaacaagaagtgcgtgccagaagggattgaagaccctcaggcactcctagaaggcgtcaaaaatgtgctgaaagagcatgcggacgacgacccctccctagccattaccggtgtgcccgtcgtgacctggcctaaaaaaacgcccaagaatagggctgtcggaagaccaaagggtaagctgggaccagcaagtgccgtaaaactggctgccaatcggacaaccgctggagctagaaggcggcggacacggtgccgtaaatgcgaggcatgtctgcgaacagaatgtggggagtgtcatttctgtaaagacatgaaaaaatttggagggcccggaaggatgaaacagtcatgtattatgcggcaatgcatcgcccccgttctaccgcacacagcggtttgtctggtttgtggggaggctggtaaggaggacacggtggaggaagaggaaggtaaatttaatttgatgctcatggagtgcagtatttgcaacgaaatcatccacccgggttgcctaaaaattaaggaatccgagggcgtagttaacgacgaactgcccaactgctgggaatgtcccaaatgtaaccacgccggtaaaaccggcaaggcctataagcaaaaaaggggccccggctttaaatatgcgtctaacctccccggttctctgctcaaagaacagaagatgaaccgggataacaaagagggacaggaaccggcaaagaggcgctcagaatgtgaagaggctccgcgcagacgaagcgatgagcacagtaagaaggttccccccgacggactgctgaggagaaaaagtgacgatgtgcatctccgcaagaaacgcaaatatgagaagcctcaagaactaagcggacgcaagagagcctcatccttacagacctcgccaggctcttccagccatctgagcccccgccctcccctgggctcctcactgtctccatggtggagatcctctcttacctacttccagcagcagttaaagccaggaaaggaagataaactcttcagaaagaagagaaggtcttggaagaacgcagaggatcgcatggccttggcaaataaacctctccgacgctttaagcaagaacccgaggatgagttaccagaagccccacccaagacgagagagtctgaccacagtagaagtagctcacctacagccgggcccagcaccgagggagcagaaggacctgaggagaaaaaaaaggttaagatgcgacgaaagcggcgactaccaaacaaagaattgtcacgggagctatccaaggaactcaaccacgaaattcagcggactgaaaactccttagctaatgagaaccagcagccaatcaaatctgagccggaatcagagggcgaagagcccaaaagaccccctgggatatgtgaaagacctcatagattttctaaaggactgaacggtacacctcgcgagctgaggcaccagcttggcccctcgttgcggtcacccccaagggtcatctcacgaccccccccttccgtgtcaccaccaaagtgtattcagatggagcggcatgtcattaggccaccccccatctctcctcctcctgactctctgccactcgacgatggagcagcccacgtcatgcaccgagaagtttggatggctgtcttcagctacctgagccaccaggacttatgtgtatgcatgagagtttgcaggacttggaatagatggtgttgcgacaagaggctgtggactcggatcgatttgaaccactgtaaaagtatcactcccctgatgctgtctggcatcatccggagacaacccgtgagcctggatttatcttggacaaacatctccaagaaacagctgtcctggctcattaacaggctgccgggcctgcgcgatttggtccttagcggatgttcttggattgccgtctctgctctgtgtagctcttcttgccccctcctgaggacccttgacgtacaatgggtcgaaggccttaaggatgcccaaatgcgagacctgctatcccctccgaccgacaacaggcctggccagatggacaataggtcgaaactacggaacatcgtcgagctgcgattagccggcctggacatcactgacgcatcactgcgtttaataatccgtcacatgcccctattatcgaagctgcacctgtcatattgcaaccacgtcacggatcaatccataaatttactaactgcggtgggtacgacgacccgggatagtctcaccgaaatcaatctttctggctttttcgttggacgggtgtttggcctgcagttctgggggatatgcgagccccaggcgcgcaagaatgcggggtgggcctag

SEQ ID NO: 19658 - DNA, 3798 bp, Artificial Sequence
  Description of Artificial Sequence: Synthetic coding sequence
atggaggccgagaaggacagcggccggcggctgcggcccatcgacaggcaacggtacgacgagaatgaagatctctctgatgtggaggaaattgtttctgtgcgcgggttctctctggaggagaaattgcgatcccagctgtaccagggagattttgttcacgccatggaaggcaaagattttaactacgagtatgtgcagcgcgaggccttgagggttccactgattttccgggaaaaagacggactgggaattaagatgcccgaccccgattttacagtgagagatgtgaaactccttgtaggctcacgcaggctggttgacgtaatggacgttaacacccagaagggaaccgagatgagcatgtcacaattcgtgaggtactatgaaacacctgaggcacagagggataagctctataatgtgattagtctcgagttcagtcacacaaagctggagcacttggtgaaacgcccgaccgtcgtcgacttagttgattgggtcgataacatgtggcctcagcatcttaaagaaaagcagactgaggcaacaaatgccatcgcagagatgaaatacccaaaagtcaagaaatactgcctgatgtccgtgaaggggtgcttcaccgacttccatattgatttcggcggaaccagcgtctggtaccatgtgttccgcgggggcaaaattttctggctgatcccaccaactttgcacaatttagctttgtacgaagagtgggttctgtcgggcaagcagtccgatatcttccttggcgatagagtcgagcgttgtcagagaattgagctcaaacaaggttacaccttttttatcccctctggatggatccacgcggtctatacccctgttgattccttggtgtttggagggaatatacttcacagtttcaatgtgccaatgcaactaaggatttacgagatcgaagatcgcacccgcgtgcaaccgaaattccggtacccattctactacgagatgtgttggtacgtgctggaaagatacgtctactgcgtgacccaaagatcacatctgacacaggaatatcaacgggaatccatgctgattgacgctccacggaaaccttctatagacgggtttagctccgatagctggctcgagatggaagaagaagcatgtgaccaacagccccaggaagaagaagagaaggacgaagaaggcgaagggcgggacagggccccaaaaccacccacggacggttctacctcccctacttcaactccttccgaggaccaggaggccctcggcaagaaaccaaaggcacctgctttacgtttcctcaaacgcacactgagcaacgagtctgaagagtcggtgaagtctaccacactggcagtggactaccccaagacacccacgggtagtccagcaactgaagtcagcgctaagtggacccacctgactgaattcgagctgaaagggttaaaagccctagtagagaagctagagagcctgcctgagaacaagaaatgcgtacctgagggtattgaagatccgcaggccctgctcgaaggagtcaagaatgtcctcaaagaacacgccgatgacgacccgagtctcgcaattaccggggtgcctgtggtcacatggcccaagaagacacccaagaaccgcgccgtcggaagacccaaagggaagctgggccccgcctctgcggtgaaattggctgctaaccggaccacagccggagctaggcgcaggcggacgagatgtaggaagtgcgaagcttgtcttcggacggagtgcggagaatgtcatttttgcaaagacatgaagaagttcggcggtcccgggcgcatgaagcagagctgtatcatgcgccaatgcatagctcccgtccttccccacactgctgtttgcctcgtgtgcggggaggctggcaaggaagatacggtcgaggaagaagagggcaaattcaacctgatgctcatggagtgttctatttgcaatgagatcatccatcctggatgcctcaagattaaggagtccgagggggttgttaacgatgaactgccaaattgttgggagtgccccaagtgcaatcacgccggtaaaaccgggaagcagaagcggggacccggtttcaaatacgcatcaaaccttcccggctcactgctgaaagaacagaagatgaaccgggacaataaagaaggacaggaacctgcgaagagaaggagcgaatgtgaagaggctccacgccgccgctccgatgaacatagtaagaaggtgccgccagacggcttgctccgaagaaaatctgatgacgttcacctgcgaaagaagaggaagtacgagaaaccgcaggaactgtccggaagaaaaagactgaagcctggaaaggaggataaactttttcgaaaaaagagacgtagttggaagaacgctgaggaccggatggccctggcaaataagcccctgcgccgttttaaacaagagcctgaagacgaactgcccgaagccccacctaagacaagggagtccgatcactccaggtctagctcacctacagcgggcccgtctacagagggagccgaagggcctgaagagaaaaaaaaggtaaagatgagaagaaaacgcagactgcccaataaggagttgagcagagagttgagcaaagagttgaaccacgagatacagcgcacagagaactccttggccaatgagaatcaacagccaattaagtccgagcctgagtcagagggggaggaacctaaaaggcctccggggatttgcgagcggccccataggtttagtaaaggcctgaatggtaccccccgggaactacggcatcagctcggcccgtccctgagatctccaccccgtgtgatttctcggccacctccatccgtctctcctcctaagtgcattcaaatggaacggcatgtgattcggcccccacctattagccccccacctgacagcctcccactggacgacggcgccgcacacgttatgcatagggaagtttggatggccgtcttcagctatttatcacaccaagacctctgcgtgtgcatgcgcgtgtgtagaacctggaaccgttggtgctgtgataaaaggctgtggacccgaattgacctaaaccattgcaaatcaatcacgccgctgatgcttagcggaatcatcaggcgccagccagtcagcctagatctttcttggactaatatcagcaaaaaacagctgtcctggctcattaatcgtctgcccggccttagagatctcgttctttcaggctgctcttggattgcagtttcagccctgtgtagctcaagctgccccctgctgaggacgctcgacgtgcaatgggtggagggtctcaaagatgcacagatgcgcgacttgttgtcgccccctactgacaatcgacccgggcaaatggacaaccgttccaagctgcgcaacatcgtggagctgcgtctggcgggtttagacatcacagacgcgagcctgagactcatcattcgccacatgcccctattatctaaactccatttgtcctactgtaatcacgtgacagaccagtctatcaatttacttacagccgtggggaccaccactagggattccctgactgaaataaatctgtccgactgcaacaaggtgaccgatcagtgcctgagtttctttaagaggtgtggcaatatatgtcacattgacctccgttactgcaaacaggtgacaaaagagggttgtgagcagtttatcgcggaaatgagttcatttcaggggcgctcatgttctaccacacgcctcggcgatgagtag

SEQ ID NO: 19659 - DNA, 4011 bp, Artificial Sequence
  Description of Artificial Sequence: Synthetic coding sequence
atggccggcccccagatgggcggcagcgccgaggaccaccccccccggaaacgacacgctgcagaaaaacaaaagaaaaagactgtgatctatacaaaatgttttgagttcgagtctgccactcaacggcctattgacaggcagagatacgacgagaacgaggacttgtccgacgttgaagaaattgtgtcagtgaggggatttagcttagaggagaaactacggagccaactctaccagggggacttcgtccatgccatggaagggaaggactttaattatgagtacgtccagagagaggccctcagggtgcctctgatcttccgtgaaaaggatggtctggggatcaagatgcccgatcctgattttacggtgcgggacgtaaagctgctcgtgggcagcagaaggctggtagacgtcatggatgtgaatacacagaaggggactgaaatgtcgatgtcccaatttgtgcgttattatgaaactcctgaagcgcagcgagataagctttacaatgtgatcagtctagagtttagtcacactaaactagagcacttggtgaaaaggcctactgtagtagatctggtcgattgggttgacaatatgtggccacagcacttgaaggaaaaacagactgaagctacaaatgccatcgctgaaatgaaatacccaaaggtgaaaaaatactgtctaatgagcgttaaagggtgcttcaccgatttccatattgacttcggggggacatcagtatggtatcatgtgtttcgcggcggcaaaatcttttggctcatccccccaacactacataacttagccctatatgaggaatgggttctgtccggtaaacagtccgatatctttttaggtgatcgggtggaacggtgtcagcgcattgagctgaaacagggttacacgttcttcatcccttccggctggatccacgcggtatatacccctgtggatagtttggtcttcggagggaatattcttcactctttcaatgttcccatgcaacttcggatttatgaaattgaggaccggacacgggtgcagcctaagtttcgctatcctttctactatgagatgtgctggtacgtgctagagaggtatgtgtattgcgtgacacagcgctcccatctgactcaagagtaccagagagagagcatgctgattgatgcacccaggaaacccagtatagatggcttctcatctgactcatggctcgagatggaagaagaggcttgtgaccaacagccgcaggaggaggaagagaaagacgaggaaggtgaaggccgggatcgagcccctaagccccccaccgacgggtccacatcacccacttcgaccccatctgaggaccaagaggcgcttggcaagaaacccaaagcgcccgctcttaggttcctaaaaaggaccctctctaacgaatctgaagaatctgtcaagagcactactctagccgtcgactatccaaagaccccgacaggtagccccgcaacagaggtctcagctaagtggacacatctcacggaatttgagctcaagggtcttaaggccctggtggagaagctagaatctttgcctgagaataagaagtgcgttcccgaggggatcgaggaccctcaggccctgctcgagggagtgaagaatgtgctgaaagagcacgcagacgacgaccctagcctggcaatcacaggcgtccccgttgtcacttggcctaagaagacacctaaaaatagggctgtgggacggccaaaagggaaacttgggccagcctccgcggttaaactggccgcaaatagaaccaccgccggagctagaagacgacgcaccagatgtcgaaaatgcgaggcctgcttgcgcaccgagtgtggggagtgccacttctgcaaggatatgaaaaaatttggcgggccagggcggatgaaacagtcctgcatcatgcggcagtgcatcgctcccgtgctgccccatactgctgtttgcctcgtgtgtggcgaggcaggaaaggaagatacagttgaggaagaggaagggaagtttaacctgatgctgatggagtgctcaatctgcaatgagatcattcaccctggttgcctgaaaatcaaagagagcgaaggggtggtgaatgacgaattgcccaactgctgggagtgcccgaaatgcaatcacgccggcaagaccggcaaacaaaagcgggggcccggatttaaatatgccagtaaccttcctgggtccctgctcaaagagcagaagatgaatcgagataacaaggaggggcaggaacctgctaagcgtcggtccgagtgcgaggaagcccctcggcgccgttctgatgagcatagcaaaaaggtaccacccgatggattgctgcggcgcaagagcgatgacgtgcacctgaggaaaaagcgcaagtatgagaagccccaggagttatcaggtagaaagagggctagttctctgcagacctctcctggatcaagctcacatttgagcccacgcccccctctgggatcttccctaagtccatggtggagatcttcactcacatacttccagcaacagctgaagcctggtaaggaagataagttatttagaaagaagaggaggagttggaaaaacgcagaggacaggatggcattagctaacaaacccctcagaagattcaagcaggagcctgaggatgagctgcccgaagccccccccaaaacaagggagagtgatcattctaggtcatcttcgccgacggctggtcctagcacggagggtgctgagggtccagaagagaagaaaaaagtgaagatgcgcaggaagcgacgactgcccaataaggagttaagccgggagcttagcaaagagctaaatcatgaaatacagaggactgaaaacagtctggctaatgagaatcagcagcctatcaagagtgaaccggagtctgaaggcgaggagcctaaacgtccgccaggaatctgcgagcgccctcaccggttttccaagggtcttaacggaacaccgcgggagctgcggcaccagctgggcccgtccctccgaagcccccctcgggttatatctcggccaccgccttccgtgtcacccccaaagtgcattcaaatggagcggcacgtgataagaccaccacccatctccccaccgcccgatagtctgcccctggacgacggagcggctcacgtcatgcacagggaagtttggatggccgtgttttcctacctatctcaccaggatctgtgcgtatgtatgagggtctgccgcacatggaatcgctggtgctgcgataagagactgtggacaagaatagatctgaaccactgcaaatctatcaccccgctgatgctcagcggcatcatcagaagacaacccgtgtccctggatttgtcctggacgaacatatctaaaaaacaactaagctggcttattaataggctccctggattgagggacttggtcctcagtggctgtagctggatagcagtgtccgcactctgcagttccagctgccctttgctgaggaccttagatgtgcagtgggtggaaggcctaaaagacgcgcagatgagggatctgctgagtccacctaccgataaccgacctggtcagatggataatcgaagtaaactccgcaacatcgtggagctccgtcttgctggattggacatcacagatgctagtttgcgattaatcattcggcatatgccattgctgtccaagctgcatctctcatactgtaaccacgttacagaccagagtatcaacctcctgactgctgtcggcacaaccacccgagacagcctcacggagatcaatctgagtgactgtaacaaagtgacggatcagtgcctctctttcttcaagcggtgtggcaacatttgtcacatcgatcttcgatactgcaagcaggtcaccaaggagggctgcgagcagttcatcgcagagatgtccgtgagcgtgcagtttggacaggttgaggaaaagttactccagaagttgagctag

SEQ ID NO: 19660 - DNA, 2121 bp, Artificial Sequence
  Description of Artificial Sequence: Synthetic coding sequence
atggccggcccccagatgggcggcagcgccgaggaccaccccccccgaaagcgccacgcagccgagaagcagaaaaaaaagaccgtaatttacaccaagtgtttcgagttcgagagcgcaacccagcgacctattgatcgtcagcggtacgatgaaaacgaggatctaagcgatgtcgaggagatagtgagcgtcagagggttctccctcgaagagaaactgagatcccagctgtaccagggagacttcgtgcacgccatggagggcaaagactttaactatgaatacgttcagcgggaggctcttcgggtgccgttaatttttcgggaaaaggacggtctcggcatcaaaatgcctgacccagacttcaccgtgcgggatgttaagctacttgtaggaagtagaagactagtggacgtgatggatgtgaatactcaaaagggtacagagatgtcgatgagtcagtttgtacggtactatgaaaccccggaggcccagagagataaactgtacaatgttattagcctcgagtttagccatacaaagctggaacacctggtgaaaagaccgaccgtggttgatctggtggattgggtggacaatatgtggcctcaacatttgaaggagaagcaaaccgaagcgacaaacgccattgccgagatgaagtacccaaaggtaaagaagtactgtctcatgagtgtgaaggggtgctttaccgacttccatatcgattttggcggaaccagcgtatggtaccacgtatttcggggcggcaagatcttctggcttatcccacccacactacataatttagctctgtacgaggagtgggtcctcagcggtaagcagtccgatatctttctcggcgatcgtgttgagaggtgtcagaggattgagctgaaacagggttacacatttttcatcccctctggatggatccacgccgtgtacactcccgtcgactccctggtgtttggtggtaacatcttgcactcgtttaatgtccctatgcaactccgaatttatgaaattgaggaccggacgcgtgtacaaccaaagtttcgttaccctttctattacgagatgtgctggtacgtgcttgaacggtacgtctactgcgtcactcaacggtcccacctaactcaggagtaccagcgggaaagtatgttaattgacgctccaaggaagccctcaattgacggattctcaagcgacagctggctcgagatggaagaggaagcatgcgaccagcaaccccaggaagaagaggaaaaggatgaagagggggagggtcgtgaccgggctcctaaaccacccactgatggttccacgtcacctacgtccacacccagtgaggaccaggaggctttaggcaagaagccgaaagcacccgccctccggttcctgaagcggacactgtctaacgagtctgaagaaagcgtcaaatccacgaccctggccgtggactacccaaagacccctacaggttcacccgccaccgaggttagtgccaagtggacacacctcactgagtttgaactaaagggcttaaaggctctggtggaaaaactagagagtctgccggagaacaaaaaatgcgttcctgagggaatcgaagacccacaggccctgctcgaaggcgtgaagaatgtgctgaaagagcacgctgatgacgaccccagcctagcgattacaggggtcccagtggtgacctggcctaaaaagactcccaagaaccgggcagtcggacgcccaaagggcaaactgggccctgcatcggcggttaaactcgcagcgaatcggacaaccgcaggagcaaggcgtcgaagaactcgctgcagaaaatgcgaagcttgcctgcggaccgagtgtggagagtgtcacttttgtaaggatatgaaaaaatttggtggtccggggcgcatgaaacagtcctgcattatgcgccagtgtatcgcgcctgtcctgccgcacacagccgtgtgcctcgtttgcggcgaggccgggaaggaagacactgtggaagaggaggagggtaagttcaacctaatgctgatggagtgctctatctgcaacgaaatcatccatcccggctgcctgaagcgcgatcaacctgtctag

SEQ ID NO: 19661 - DNA, 3981 bp, Artificial Sequence
  Description of Artificial Sequence: Synthetic coding sequence
atggccggcccccagatgggcggcagcgccgaggaccaccccccccgaaagcggcacgccgccgaaaagcaaaaaaagaagaccgtgatttacactaagtgttttgagtttgagtcggccacgcagcggcccatcgaccggcagcgctatgatgagaacgaggatctgagtgacgttgaggagattgtttccgtccgtggattctcccttgaggagaaacttaggagccagctgtatcagggggatttcgtacatgctatggaaggcaaagactttaactacgaatacgtgcagagagaagccctgagggtgccccttatatttagggaaaaggatgggctgggcattaaaatgccagatccagatttcaccgtgagagatgttaagttgctagtgggaagtaggcgactcgttgatgtgatggatgtgaacactcaaaagggcacagagatgtcgatgagtcaattcgtccgatattacgagacacccgaggcacaacgcgataaactttacaacgtgatcagcctagagttttcccacaccaagctcgaacacctggttaagcggccaaccgttgtggacttagtggactgggtcgataacatgtggcctcagcacctcaaagaaaagcagacagaggctacaaacgcgattgccgaaatgaagtatcctaaagtgaagaagtactgtctgatgtcggtgaaaggatgctttacagattttcacattgacttcggaggcactagcgtgtggtaccatgtgtttaggggagggaagatattctggttgattccgcctacattgcacaacctggcactgtacgaagaatgggtgctttctggcaaacagagtgacatcttcctgggggacagagtggagcgttgtcaacggatcgagctgaagcagggctacacctttttcatcccgagcggatggatacatgccgtatatactcctgtcgacagtctggtgtttgggggtaacatcctgcacagttttaacgtgcctatgcagctccggatatacgagatagaagatcggactcgggtgcaaccaaagttccgctatcccttctattatgaaatgtgctggtacgttcttgagagatatgtctattgtgttacacagcgctcccatctgacccaggagtatcaaagagagagcatgctgatcgatgcaccaaggaagccctccatagacggcttttccagcgacagttggctggagatggaagaagaggcctgcgaccagcaaccccaggaggaggaagagaaagatgaagagggcgaaggaagggacagagcaccaaaaccccccacagacgggtccactagccccaccagcaccccttctgaggaccaggaggcactgggtaagaagcccaaagcccctgcactgcgctttctgaaacggacactttctaatgaatctgaagagtctgttaagtccaccacactggcggtggactacccaaaaacaccaaccggcagtccagctacagaggtgtccgccaaatggacgcatttaacagagtttgagttgaagggactgaaggcactagtagaaaagttggagagtcttcccgaaaacaagaaatgcgtgccagagggcatcgaagacccacaggcattactggagggggtgaaaaacgtactcaaagagcacgcggatgatgatccatcgctcgcgatcaccggagtccctgtagtaacctggccaaagaagacacccaagaaccgagcagtgggccgacccaagggaaaattgggacccgccagcgctgtgaaactggccgccaaccgcaccacggcaggagcgagacgccgcaggacgagatgtcgaaagtgtgaagcatgcctgcgaacagaatgtggtgagtgtcacttctgtaaagacatgaagaaatttgggggcccagggcgcatgaaacaaagctgcatcatgcgccagtgcatcgctcccgtgcttccccacacggccgtttgccttgtttgcggagaggccgggaaagaggacactgtggaagaagaagagggtaaattcaatctcatgctgatggaatgctctatctgcaatgaaatcattcaccccgggtgtctcaaaattaaagagtccgaaggcgttgtgaatgatgaactacctaactgctgggagtgtcctaagtgcaatcatgcaggcaagaccggcaaacagaagagaggacccggcttcaagtatgcatccaaccttccagggagcctccttaaggagcagaagatgaacagggataacaaggagggccaggagcccgctaaaaggagatccgaatgtgaagaggccccgagacgtcgcagcgacgaacacagcaagaaggtgcctccagatggactacttagaagaaagtcggacgatgtccacctcagaaagaaacgtaagtacgagaagccccaggaattgtccggacgtaaacgtgcttcatccttacagacatcccctggctccagtagtcacctgagtccaaggccccccctcggtagtagcctttcgccatggtggcgaagtagcctaacgtattttcagcagcagcaaaggagatcatggaaaaacgccgaggatcggatggcgctcgcgaacaaacccctgaggagattcaagcaggagccggaagacgaacttcccgaggccccccctaagacaagggagtctgatcactctcgatcaagctctccaacggctggtccttccacagaaggggctgagggacctgaggagaaaaagaaggtgaagatgcgtaggaaaagacgcctgccaaacaaagagttatcacgcgaactgtctaaggagctcaaccacgagatccagcggacagagaattctttggctaatgaaaaccagcagcccattaagtccgagcccgaatctgagggggaagaacccaaacgacctcccggaatctgtgagagaccccaccggttttccaaagggctcaatggtacaccgcgtgagctgcgtcatcagctcgggccctcgctgcgttcacctcccagagtgatctcccgcccacctcccagcgtgagccccccgaagtgcatccagatggagcgccacgtcatccgcccaccaccgatatcacctccccccgattctttacctcttgacgatggagccgctcacgttatgcaccgggaggtgtggatggccgtgttcagttacctcagtcatcaggacctgtgcgtttgcatgcgcgtgtgccgcacctggaatcgctggtgctgtgacaagcgcctgtggactagaatagacttgaaccattgtaagagcattaccccactgatgttatcgggaattattagacgccagcccgtgtccctcgaccttagctggacaaatattagcaagaagcagctttcctggctaattaacaggctccctggcctgcgcgacttggttttgtctgggtgtagctggatcgccgtctctgctctctgcagttcctcttgcccactgctgagaaccttagatgtgcaatgggtggagggactgaaagatgcacagatgagagacctgctgtcaccgcccactgacaaccggccagccccgggccaaatggataacagaagcaagctcagaaatatcgtcgaattaagactggccggactggatatcacagacgccagtttgcggctgatcatcagacacatgcctctgctgtccaagcttcacctgtcatactgcaaccatgtgactgaccagagtattaatctcctgactgctgtgggtactaccaccagggattccctcacagaaatcaacttgtctgactgtaacaaagtgaccgaccaatgtctcagcttcttcaaacggtgcggtaacatctgccacatcgatctacggtactgcaaacaggtaacaaaggagggttgtgaacagttcatagcagagatgagtgtgtctgtccaatttggtcaggtcgaggaaaagctgttacaaaagctctcatag

SEQ ID NO: 19662 - DNA, 1680 bp, Artificial Sequence
  Description of Artificial Sequence: Synthetic coding sequence
atgcccgaccccgacttcaccgtgcgggacgtgaagctgctggtgggtagccgccgactggttgacgtcatggatgtgaatacacagaaaggcacagagatgagcatgagccagttcgtacgctactacgaaactcctgaggcccagcgggataaactctataacgtgatctcacttgagttctcccacaccaagttggagcacctggtaaagaggccaaccgtggtcgatttggtcgactgggtggacaatatgtggccgcagcacctcaaggagaaacagactgaggctactaatgctatcgcggaaatgaaatatccaaaagtgaagaaatactgcctcatgtcggtaaaaggctgcttcactgatttccatatcgacttcggtggcacttccgtgtggtaccacgtgttccggggcggcaagatcttttggctgattccaccaacattacacaacctcgccctgtacgaagaatgggttctgagcggtaaacagtctgatatttttctcggggaccgagttgaacgatgccagaggatcgagcttaaacaaggttacaccttctttattccttccgggtggatacatgcagtctatacgccagtggatagcctggtgttcggcgggaacatcctgcactcctttaacgtcccaatgcaactgcgcatttatgaaatagaggaccgaacacgggtacagcccaagttccgctacccattttattacgaaatgtgctggtatgtcttggagcggtatgtgtactgcgtgacacagcgctcccacctcacccaggagtaccagagagaaagcatgttaatagatgccccacgcaaaccatcaatcgatggtttcagttccgatagttggctggagatggaagaagaggcttgtgatcagcaacctcaggaggaagaggagaaggacgaagagggtgagggacgcgatcgcgctcccaaacctcctacagacggatctacctcccccactagcaccccaagcgaagaccaagaggcactgggaaaaaaacccaaagctccggctctccgattcctgaaaaggaccctctccaatgagtccgaggagtctgtgaaatctacgacactggctgtcgactatcccaaaacccccacgggctcccccgccaccgaggtttccgcaaagtggacacatctcaccgagttcgagctgaaaggtctgaaggcgctcgttgaaaagctcgaatcactgccagagaacaagaagtgtgttccagaagggattgaagaccctcaagctctactggagggagtgaagaacgtcttaaaagagcacgcagacgacgacccatctctcgccattactggtgtcccagtcgttacctggcctaaaaagacacccaagaatcgcgcggtggggcggccgaaagggaagctgggtccggcttccgccgtcaagctggcggctaatagaactactgcaggcgcacgcagaagacgcacacgttgtcgcaaatgcgaagcctgtttgaggactgaatgtggggaatgtcacttctgcaaggacatgaagaagttcggtggacctgggagaatgaaacagagctgtataatgcggcagtgtattgcgaccgccattcggtcacttatatctgcctgcccgtcctcgaatgcagtcgaaactagcgtgatcctcacctag

SEQ ID NO: 19663 - DNA, 2340 bp, Artificial Sequence
  Description of Artificial Sequence: Synthetic coding sequence
atggccatgagcgtgagcgccgaggacgacgactacgagagcgagcccgaccagaacagggccgtgggccgccccaaggggaagttaggccctgcatccgcagtgaagctcgccgctaaccggacgaccgctggcgcaagacggagacgtacaaggtgccggaagtgtgaggcttgcctgaggacggagtgcggagagtgtcatttctgtaaagacatgaaaaaatttggcggacctggtcggatgaagcagtcttgtattatgcgccaatgcatagctcccgtgctgccacatacggctgtttgcctcgtctgtggcgaggctggtaaggaggacaccgtggaagaggaagaaggaaagttcaacctgatgctcatggagtgcagcatttgcaacgaaatcatccacccaggttgcctgaagatcaaggagtcagaaggggtggttaacgacgaactcccgaattgttgggagtgtccaaagtgcaatcatgctggaaagaccgggaaagcgtataagcagaagaggggtccggggttcaaatatgcgtcaaacctgcccggttctctactcaaggaacagaaaatgaatcgcgataacaaggaaggacaggagcccgcaaagagaaggtcagagtgcgaggaagctcccaggagaaggtcagacgagcattctaagaaagtaccgccagatggactgctgaggcggaaatctgacgacgtccacctccgaaagaagcggaagtacgagaaacctcaggagctctctggccgcaagagagccagctcattacagactagccccggaagctcaagtcacctcagccctcggccacccttaggctcttcgctgtcaccctggtggaggtcttccctgacctatttccagcagcagttgaagccaggaaaggaagataagttgtttcgcaagaagcggagaagctggaagaacgccgaggaccggatggcattagctaacaaacctttacgccgattcaagcaagaacctgaggatgagctgcccgaggctccgcccaagacacgtgagagcgatcactctagatcgagttcccccactgctgggccctccaccgagggcgctgagggcccagaagaaaaaaagaaagtgaagatgcggcgcaaaagacgtctgccgaacaaggaacttagccgtgagctgtccaaggaactcaatcacgagattcagaggacagagaacagtttggccaatgagaaccagcagccaattaaaagtgaaccagagtctgagggtgaggagccaaagaggcctcctggcatctgcgagaggcctcaccgcttcagtaagggactcaacggcacaccaagggagcttagacatcagctggggccgagcctgaggagccctcctagagttatatctcggccacctccctctgtgagcccaccaaaatgcattcaaatggagaggcatgtaatccgcccccctccaatctcccctcctcccgacagcctgcccctggatgacggggcggctcacgtgatgcacagggaggtctggatggccgtttttagctacctgtcccaccaggatctttgcgtgtgcatgcgcgtgtgtagaacgtggaaccgttggtgctgcgataaacgactctggaccagaatcgacctgaaccactgtaaaagtattactcccctcatgctctcagggataatcaggagacaacctgtgtctctcgatctgtcctggactaacatttctaaaaagcaactgtcttggctgatcaatcggctaccaggcctgagggacttggttctaagtggctgtagctggatcgctgtgtctgccctttgtagctccagttgccctctgctcaggactcttgatgttcagtgggtagaaggactgaaggacgctcagatgcgcgacctgctgagccccccgacagataatcgtccagggcaaatggacaatcgcagcaagctgcgcaatattgttgaactaagactggctggtttggatataactgacgcaagccttaggttaatcatacgacatatgccactgcttagcaaactccacctttcctactgcaaccatgtcaccgaccaaagcatcaatctcctgaccgccgtgggcacgaccaccagagatagtctgacagagataaatttgtcagactgcaacaaggtcaccgaccagtgcctgtcattctttaagcggtgtggaaacatctgccacatagacttaagatattgcaaacaggtcacgaaggagggttgtgaacagtttatagctgaaatgtcagtttcagttcagtttggccaggtagaggagaaactattgcaaaagctgtcttag

SEQ ID NO: 19664 - DNA, 3291 bp, Artificial Sequence
  Description of Artificial Sequence: Synthetic coding sequence
atgggcagcgaggaccacggcgcccagaaccccagctgcaagatcatgacattccgtcctacaatggaagaatttaaagacttcaacaagtatgtagcatatatcgaatcacagggtgcccatcgcgctggtctcgccaagatcattcctcctaaggaatggaagccccgacagacatacgacgacattgatgatgttgtgatcccagctcccatccagcaggtagttactggacaatctggtctattcactcagtacaacattcagaagaaagccatgactgttggagaataccggcggctagccaactcagaaaaatactgcacgcccaggcatcaggacttcgatgacctggagcggaaatactggaaaaacctgactttcgtatcgcccatctacggcgccgacatctccggcagtttgtacgacgacgatgtggcacaatggaatatcggctccttgagaacgatactggacatggtggagcgagagtgcgggactataattgaaggtgtgaacactccctatctatattttggaatgtggaaaacgacctttgcctggcacactgaggatatggacctctattctatcaattacctccactttggcgagccaaagagttggtacgctattcctcctgagcacgggaaaagactcgagcgcctggccatcggcttcttccctggttcctcacagggttgtgacgcatttctcaggcacaagatgaccctgatctcacccatcattcttaagaaatatgggatcccattttcccgcattacacaggaagcgggcgaatttatgatcactttcccttacgggtatcatgccggctttaaccacggcttcaattgcgctgagtccaccaactttgcaactctccggtggatcgactatgggaaggttgctacgcagtgcacctgccgcaaggacatggtgaagattagcatggacgtattcgtccggatcctccaacccgagaggtatgaactgtggaagcaaggaaaagacctgaccgtgttagaccacactcggccaaccgccctgacttctcccgaactatcctcgtggtcagcctcccgggccagcctgaaggccaagctcttgcgccgaagtcacagaaagagatctcagcctaaaaaacccaagcctgaggatcccaagttccctggtgaggggactgcaggtgcagcattactcgaagaagccggcgggagcgtcaaggaggaagcaggaccagaagtagatcctgaggaggaagaagaggaacctcagcccctgccacatggacgagaggctgagggagccgaagaggacgggcgggggaagctcagacctactaaggcaaagagtgagagaaaaaagaagtcttttggactcctcccgccacagctcccccccccacccgctcacttccctagtgaggaggctctgtggctgccatctccactggaacctcctgtgctcgggcctggacccgctgccatggaggagtcccccctaccagccccgctgaacgtggtcccacccgaagtgccttctgaggagcttgaggccaagcccaggcctattattcctatgttgtacgtggtgccccgacctggaaaagccgcctttaaccaggagcatgtcagctgccaacaggcctttgaacactttgcccagaagggaccaacctggaaagaaccagtttctcccatggaacttaccggacccgaggacggggccgccagctccggagctggtagaatggaaaccaaggcacgcgcaggtgaaggccaggccccctcaacctttagcaaactcaagatggaaattaaaaagtctcggcggcatcctcttggcaggcctcctactcggagcccactatcggttgtgaaacaggaggcctcaagcgacgaggaggctagcccattcagcggtgaggaagacgtgagcgatccggatgccctgagaccactgctgtccctacagtggaagaatagggccgcttcatttcaggccgagaggaaattcaacgcagctgccgctagaaccgagccttattgtgccatttgcacacttttctatccatattgccaagctcttcagacagagaaggaggctcctatagcctcactcggcaagggctgccccgcaaccctaccatccaagagccggcaaaaaacacgcccactgatacctgaaatgtgtttcacgtccggcggagaaaataccgagcctctgcccgcaaactcatacatcggcgacgacgggacatcacctttgatcgcctgtggaaagtgctgtctgcaagtgcatgccagttgttatggaatcagacctgaactggtcaatgaaggatggacctgtagtcgctgcgccgcacatgcatggaccgctgagtgctgtctatgtaatctcaggggtggggctctgcagatgactaccgacagacggtggattcacgtcatttgtgctattgccgttccggaggcccgatttctgaacgtgattgagaggcaccctgtcgatataagcgcgatccctgagcagcgctggaagttaaagtgtgtctattgtcggaagcgcatgaaaaaggtgtctggcgcctgcattcagtgttcatatgagcactgctcgaccagtttccatgttacttgtgcccatgcggccggggtcttaatggagcctgacgattggccatatgtcgtgtccattacttgtctgaagcataaatcaggcgggcatgcggtccagctgttgcgagcagtctccttaggccaagtggtcatcaccaaaaacaggaatggcttatattacaggtgtcgcgtgatcggtgctgctagtcagacatgttacgaggtcaactttgacgatgggagctacagtgataatctttatccagaaagtatcactagtagagattgcgtgcagttagggcctccctctgaaggtgagctcgtcgaacttagatggactgatggtaacttgtataaagcaaaatttatctcttcggttacgtcgcatatttatcaagtggaattcgaagacggctcccaacttactgtcaagaggggggacattttcacactagaggaagagctgccaaaaagggtgcgatcgcgactttccctctccaccggcgctcctcaagaacccgccttctcaggcgaagaggccaaggccgcaaaacgtcctagggtgggcacccccctcgccaccgaggatagcgggcgctctcaggactacgtagccttcgtggagagtttgttgcaagtgcaggggcgtccaggtgctcccttttag

SEQ ID NO: 19665 - DNA, 1347 bp, Artificial Sequence
  Description of Artificial Sequence: Synthetic coding sequence
atgggcagcgaggaccacggcgcccagaaccccagctgcaagatcatgacctttcgccctacaatggaggagttcaaggattttaataagtacgtcgcttatattgaatcccagggcgctcacagagcaggtctggccaagatcattcctccaaaggagtggaagcccaggcagacctacgatgacattgatgacgtggtcatcccggccccgattcaacaagtggtcacagggcagtccggcttgttcactcagtataatatccagaagaaagccatgacggtgggcgaatatagacggctcgccaacagcgagaagtattgtacaccgaggcaccaggacttcgatgatctcgaaagaaaatattggaaaaatctgaccttcgtgagccccatttatggggctgacatctctggatccctgtacgacgacgatgtggctcagtggaatattgggagccttaggaccatactcgatatggtcgagagggagtgcggtaccattattgagggcgtgaacacaccatatctctacttcggaatgtggaaaactacatttgcttggcacactgaagacatggacttgtactcgattaactatctgcacttcggggagcctaaatcttggtacgctattccccctgagcatggcaagagactcgaacggctggcgattggttttttccccggttcaagccaggggtgcgacgccttcctgcgccacaagatgactcttatctcaccaatcatcctgaaaaagtacggaataccctttagtcggattactcaggaagccggagaattcatgatcactttcccctatggataccacgctggatttaaccatggctttaactgtgcagaaagcaccaattttgctacactgcgttggatcgattacggaaaggtcgccacgcagtgtacctgccgtaaagacatggtcaagatctctatggatgtgtttgttcgcatactacagccggaaaggtatgagctgtggaaacagggcaaggacttaaccgtcttagaccatacacgcccaaccgcacttacttcccctgaactgtcaagttggtctgcctcacgcgcctcactgaaggctaaactccttcgccgcacaccaccatgcgtctcgccacatcgaccatctcagcctgggatctggtgtccccccggcggggaagcgaaggcatccgccgcctcatggctgctgactacccgcggccacggcgataccgaagcaggtcctggtctgggtggggatccattgcatgcacagagtgaagggcaggcgtcctgtgtctcaacgtcaaggttgaggatggccacgcaggatccttgtagatag

SEQ ID NO: 19666 - DNA, 3393 bp, Artificial Sequence
  Description of Artificial Sequence: Synthetic coding sequence
atgggcagcgaggaccacggcgcccagaaccccagctgcaagatcatgacatttcgtccaacgatggaagaatttaaggacttcaataagtacgtggcatacattgaaagtcagggggcacacagggcaggacttgctaagatcatacctccgaaggaatggaagccacgccagacctatgacgatatagacgacgtagtgatcccagctccaatacagcaggttgttacaggccaatcaggacttttcacccagtacaatatccagaagaaagccatgaccgtcggggagtaccggagactagccaatagcgaaaaatattgtactcctcgtcatcaggactttgatgacctagagcgaaaatactggaagaaccttacgttcgtgtcccccatctatggtgctgatatctctggttcactttatgacgatgatgtcgcccagtggaatatcggctctctgcgcaccatcctggacatggtggagcgggagtgcgggaccattattgagggggtgaacacaccatacctgtattttggcatgtggaagacaacattcgcgtggcacactgaggacatggacttgtatagcataaactacctgcactttggagagccaaagagctggtacgccattccgcctgagcacgggaagaggctcgagcgtctggccataggatttttcccaggttcctctcagggctgcgatgcattcctccggcacaagatgacattgatttcacccattatactgaagaaatacggcattcctttttcaagaattacccaagaggctggcgagtttatgatcacattcccctatggataccacgcggggttcaaccacggatttaactgcgctgaatccaccaactttgccacacttaggtggatcgactacgggaaagtggctactcaatgcacctgtcgaaaagacatggttaagatttcaatggacgtcttcgtgagaatcctccagcccgagaggtacgagttatggaaacaaggcaaagatctgaccgtgctcgaccacacccgaccaacggccctcacaagccccgaactgagctcatggtctgcttcccgggcaagcctgaaagcaaaactgctgcgccgacagattagcttaaaagagaaccggcattggagaaagactgaagaggagcgcaagcctagtttggaacggaaaaaagagcagaccaagaggccagggctgagttcgcacaggaaaagaagccagccaaaaaaaccaaagccagaggatcccaaattcccgggcgaagggaccgctggggcagcactcttggaagaggcaggaggcagtgtgaaagaggaagctggccctgaggtggacccagaagaggaggaggaggaaccccaaccgctcccacacggaagggaagcagaaggtgccgaggaagatgggagaggaaaactgcgcccaactaaggctaaatctgaaaggaagaagaaaagtttcggcctgttaccaccgcaactcccaccccctccagcacacttcccaagtgaggaagctctttggctcccaagccccctggagccaccagtactggggcctggcccggctgcgatggaagaatctcctctgccggccccgctcaatgtagtgcctcccgaggtgccatctgaagagctggaggcgaagccccggcccatcattccaatgctgtacgtagtcccgcgcccgggcaaagcagcctttaaccaagaacatgtgtcttgtcaacaggcattcgagcactttgcccagaaaggcccaacatggaaggagccggtaagcccaatggagctcactggccccgaagacggcgctgcctccagcggtgctggacgcatggaaacgaaggctagggccggggagggtcaggctcctagcacctttagcaaactgaagatggagataaaaaaaagcaggcgacatcctctagggcgccctccaactcggtctccgctctccgtagtgaaacaggaggccagttctgacgaagaggctagtcctttctctggcgaggaagacgtctccgacccagacgctcttcgtccgctcctctcattgcagtggaaaaaccgggccgcctccttccaggccgaaaggaaattcaacgcggcagctgcgagaacggagccctattgtgccatctgcaccctattctatccctattgccaggccctgcaaactgagaaggaggcacccattgccagcctcggcaaggggtgtcccgctactctaccttccaagtcccggcagaaaacaagacctttaatcccagagatgtgtttcacgtccggtggggaaaacacagagcccctcccggctaatagctacatcggggacgatggcacatcaccgcttattgcatgtggaaagtgttgtttgcaggtccatgcctcttgttacggaattagaccagagcttgtgaacgaaggatggacgtgctctcggtgcgccgcacatgcttggaccgcagagtgttgcttgtgcaatctgaggggaggtgcgctgcagatgacaaccgatagacgatggatccatgtgatctgcgcaatagcagttcctgaggcccggttcctgaatgtgattgaacgtcacccagtggacattagcgccattcccgaacagcggtggaagcttaaatgtgtatactgtcggaaaagaatgaagaaagtgtcaggagcgtgcattcagtgcagctacgaacattgctcaactagctttcacgttacttgcgcgcacgccgcaggggtattaatggagccagatgactggccctacgttgttagtattacatgcctgaaacacaagtccggtggccatgccgtccaattgctgagggccgtgtccttggggcaagtggttatcaccaaaaacaggaacggtctatattatcgttgccgagtgattggggccgcaagccagacctgctatgaggtgaacttcgatgatggctcttattctgacaatctgtaccctgaatcaattaccagccgtgactgtgtacagctgggaccccccagcgagggagagctggtggaactgcggtggaccgatggcaacctgtacaaggccaaattcatcagctctgtgacctcccatatctatcaggtggagttcgaggacggatctcaacttactgtgaagcgtggcgacatcttcacactggaagaagagctgccaaagagggtgcggtcaaggctttccctgtctaccggcgctccacaggaaccagcctttagcggggaggaggccaaggcagccaagcgtcccagggtgggtacgcccctcgcaaccgaggacagtggccggtcccaggattacgtagcattcgtggagtctcttctgcaggttcaggggcgtcccggtgctcctttttag

SEQ ID NO: 19667 - DNA, 3144 bp, Artificial Sequence
  Description of Artificial Sequence: Synthetic coding sequence
atggaggtggccgaggtggagagccccctgaaccccagctgcaagattatgacttttagaccaagcatggaggaatttagagagttcaataagtaccttgcttacatggagagcaagggagcccatagggccgggctcgcgaaggtaattccaccaaaggagtggaaacctcggcagtgctatgatgatatcgacaatctgttaatcccagctccaattcaacaaatggtcacaggacaatccggcctgttcacccagtacaatattcagaaaaaggctatgactgtgaaggaattccggcagctcgctaatagcgggaagtattgcacccctcgctacctagattatgaggatctggaacggaaatattggaagaatctgacttttgtagcccctatttacggagcggatattaacgggagcatttacgacgagggagtagatgagtggaacatagcgcgcctgaatactgttcttgacgtagtcgaggaggaatgcgggatttcaatcgagggggttaacacaccgtatctatattttggaatgtggaaaaccaccttcgcgtggcacactgaggacatggatctgtattccatcaattacctccatttcggggaacccaagagctggtacgccatcccccccgagcacggtaagcggttggagagattagcgcagggcttcttccccagctccagtcaagggtgcgacgcttttctgaggcataaaatgactttgatcagcccttcagtcctgaaaaagtatggaattccattcgacaagattacgcaagaggctggcgagttcatgatcacttttccatacggctatcacgctggcttcaatcacggattcaattgcgccgaatccaccaacttcgccaccgtcaggtggatcgactatggcaaagtggctaaactctgcacgtgccggaaagacatggtcaaaatctcaatggatatatttgtgcgaaagttccaacctgaccgctaccagctttggaagcagggcaaggatatttacacgattgaccatacaaaacccacccccgccagcaccccggaagtcaaagcctggctgcagagacggcgaaaggtccgaaaagcaagcaggagcttccagtgtgcccgcagcacaagtaaacggcccaaagcagatgaggaagaggaagtctcagatgaagtggacggggcagaggtgcctaatcccgacagtgtgacagacgacttaaaggtgagtgaaaagtccgaggctgctgtgaagcttagaaatacagaggcttcttcggaagaggaatcatccgctagcagaatgcaagtcgaacaaaatctgagcgatcacatcaagttgagtggtaactcctgcctgagcactagcgtcactgaggatataaaaacagaggatgacaaagcatacgcctacagatctgtcccgagtattagcagtgaagccgacgattctatccccctctcaagtggctatgaaaaacccgaaaaatcagacccctccgaactttcatggcccaagtctcccgaaagttgctcttcagtggcagaaagcaacggagtccttacagagggagaggagagcgatgtggaatcccacggaaacggccttgaacccggtgagatacccgccgtcccctccggagaacgcaactcatttaaagtgccaagcattgctgagggggagaacaagacctcaaagtcttggcggcaccctctgtcccgacctccagctcgctctcccatgactctggtcaagcagcaggccccatccgatgaggagctgccagaggtgctgagcatcgaggaggaggtggaggagacagagagttgggcaaagcccctgatacatctgtggcagaccaaaagccctaatttcgccgccgagcaggaatataatgccaccgtggctcgaatgaaaccccactgtgccatttgcaccttgctgatgccctatcataaaccggactcatcaaatgaggaaaatgacgcacggtgggagacgaagctcgacgaagtggtgacctccgaaggaaagaccaagcccttgattccggagatgtgttttatatattctgaagagaacatagaatactctccgcctaacgcctttctagaggaagatggaacctctctgctaatcagctgcgctaaatgttgcgtccgggtacacgcttcctgctacggcattcctagccatgagatctgtgatggctggctgtgcgccaggtgcaaaagaaacgcctggactgccgaatgttgcttgtgcaatctgcgcgggggagcactgaaacagactaaaaacaataagtgggctcacgttatgtgtgcggttgcagtgcctgaggtccgatttaccaacgttcctgaacgaacccagatcgacgtcggaagaatccctcttcagagactgaagctcaagtgcattttctgcaggcaccgcgtgaaacgcgtcagcggtgcatgcattcagtgtagctacggacggtgtccagccagcttccacgtcacctgtgcgcatgccgcgggggttctcatggagcctgacgattggccctacgtcgtgaacattacctgcttccggcacaaagttaatccaaacgtgaaatcgaaggcttgcgagaaggtgattagcgttgggcagacagtgatcacaaagcaccggaacacccggtactacagttgccgcgtgatggcggtgacctcccagaccttttacgaggtcatgtttgacgatggctccttcagcagagatacattccccgaggacatagtgagtcgtgactgtctgaaacttggtccacctgcagagggagaggtggtacaagttaagtggccagacggcaagctgtatggggccaagtatttcggctctaatattgcgcacatgtatcaggtggagtttgaggacggttctcagatcgccatgaagcgagaggatatctacactctggacgaggaactacccaaacgcgtcaaagctcgtttcgtatctgccggacgatgtcacctgggtacctgccaggtaaactcgcttagttccccccacgtatctcaggcgcaacaagagacctatcttgggttctggatcaactctaagaaatcacagtgtaatattttcctttccggaacctattag

SEQ ID NO: 19668 - DNA, 3171 bp, Artificial Sequence
  Description of Artificial Sequence: Synthetic coding sequence
atggaggtggccgaggtggagagccccctgaaccccagctgcaagatcatgaccttcagaccttctatggaagaattccgggagtttaataagtatttagcttacatggagagcaagggtgcccacagagccggcttagcaaaggtaatacctcccaaggagtggaagccacggcagtgctacgatgatatcgataacctgctaatacccgctcccatacagcagatggttacaggacagtctggcttatttacccagtacaatattcagaaaaaggctatgacagtgaaagagtttcggcagcttgccaactcaggaaagtattgcaccccacgttatctggactacgaggatctggaacggaagtattggaagaacctgacattcgtggcgcccatctatggggccgatatcaatggcagtatatacgatgagggcgtggatgagtggaacatcgctcgactgaacactgttctggacgtggttgaagaagagtgcggcattagtatcgaaggggtgaataccccatatttgtatttcggaatgtggaaaacaacgttcgcgtggcacacggaagacatggacctgtatagcatcaattatctgcacttcggcgagccaaaaagctggtacgctatccccccggagcatggcaagcggcttgaaaggcttgcccagggattcttccctagttctagccaaggatgcgacgcatttttacgccacaaaatgactctgatttctcctagtgtgcttaaaaagtacggtattccctttgataagattacacaggaggctggagagttcatgattaccttcccgtatggataccacgctggattcaaccacggattcaattgcgccgaaagtactaacttcgccacggtccgctggattgactacggcaaggttgccaagttgtgcacctgccggaaagatatggtcaaaattagcatggacatctttgtccgaaagtttcaaccggatagataccaactgtggaagcaaggaaaagatatttacacaatcgatcacactaaaccgacaccagcttcgacacctgaggtgaaggcgtggctgcagaggcgccggaaggtgaggaaggcttccagatccttccagtgcgcaagaagtaccagcaagaggccaaaagctgatgaggaggaggaagtatctgacgaagtcgacggagctgaagttccaaacccagactcagtgacagacgacctgaaggtgagcgaaaagtcagaagctgcagtcaagttgaggaacacagaggcctcttcagaggaggagtcctcagcctcgcgcatgcaggtcgagcaaaatctctccgaccacataaaactatcaggcaattcttgccttagtacttcggttaccgaggacatcaaaactgaggacgacaaagcgtatgcctaccgtagtgttccatcaatctccagcgaagccgacgattccatccctctctcttctggatacgaaaaacctgagaagagcgacccgtcagagctgagctggcctaaaagtccagagtcctgttcatcagtggccgagtctaacggagtgctgacagagggcgaggagtctgatgttgaatcccatggcaatggattggagcccggcgagattcccgcggttcccagcggggagaggaattccttcaaagtgcccagcatcgcagagggcgagaacaaaacttctaagagttggcgccaccctctgagtcgccctcccgcaagaagtcccatgactctcgtgaaacaacaggcgccaagcgatgaagaacttcctgaggtcctttctattgaggaggaggtggaggaaaccgagagctgggccaaaccgctcattcatctctggcaaacgaagtcccccaattttgcagccgagcaggaatataatgcgacagtagcgaggatgaaaccacactgtgccatctgtaccttgttgatgccctatcacaaacccgattccagcaacgaggaaaatgatgctaggtgggagacgaagctcgacgaggtagtgacttctgagggcaagacaaagccacttattcctgagatgtgtttcatttacagtgaagaaaacatcgagtattcaccccccaacgcctttctcgaagaagatggaaccagcctactcataagctgcgctaaatgttgcgtgcgggttcatgcatcctgttatggaattccaagccacgagatctgcgacggatggctctgtgctaggtgcaaacggaacgcttggacagccgagtgctgcctgtgtaacctgcgggggggggcgcttaaacagactaagaataacaagtgggctcacgtgatgtgcgccgttgccgttcccgaagttaggtttaccaacgtgcccgagagaacgcagatcgatgtcggccggatccccctgcagcggctcaagctcaagtgcatcttctgtcgccacagggtaaaacgcgtctcaggcgcttgtattcagtgcagctatggaaggtgcccagcctcctttcacgtgacatgcgcgcatgcggcaggagtcctgatggagccagatgactggccttatgtggtgaatatcacgtgttttaggcacaaagtgaatcccaatgtgaagtctaaggcctgcgagaaagttattagcgtaggtcagaccgtgatcacgaagcataggaatactagatattatagctgtcgagtcatggcggtaacaagccagacattctacgaggttatgttcgatgacgggagctttagcagagatacttttcctgaggatatcgtgtccagggactgcttgaagctcggaccacccgctgaaggcgaagtcgtgcaggtgaagtggccagatgggaaactgtacggcgccaagtattttggatccaacattgctcatatgtatcaggtcgagttcgaggatggctcacaaatagccatgaaacgcgaagatatttacacactggacgaggagcttcctaagagagtcaaagcacgctttagtacagcatccgatatgcgttttgaggataccttctatggagctgatattattcagggggagcggaagcggcagcgggtcctgagctcccggtttaagaacgagtatgtggcagacccagtgtacaggacattccttaagtctagctttcagaagaagtgccaaaagcgacagtag

SEQ ID NO: 19669 - DNA, 1065 bp, Artificial Sequence
  Description of Artificial Sequence: Synthetic coding sequence
cccgacagcagcaacgaggagaacgacgcccggtgggagaccaagctggatgaggtggtcacatcagaagggaaaacgaagccacttattccggagatgtgcttcatatatagcgaagaaaacattgagtacagcccacctaatgcctttttggaagaagatggtacttcactcctgatttcttgtgccaagtgctgcgtgagggtgcatgccagctgctacggaattccatcccacgagatttgtgacgggtggttgtgcgccagatgcaaacggaatgcctggactgctgagtgctgcttatgtaacctgcgtggaggagctctgaaacaaaccaaaaataacaaatgggctcatgtgatgtgtgccgttgcggttccagaggtgcggtttactaacgtgcccgagcgcactcaaattgatgtgggtagaataccactgcagaggctcaagctgaaatgtattttctgcagacacagagtaaagagggtctccggcgcctgcattcaatgctcctacgggcgctgtcccgctagcttccatgtcacatgcgctcacgccgccggtgtcctcatggagccagacgactggccctatgtggttaacatcacttgctttcgtcacaaagtgaaccctaatgtgtttaccgctcaatcaaagcattccaagaatgaatcctgtattgctactaccaccagcgcagctgccgccggcgctaccatcttatgtgaacttggccacaaatcaaaggcttgcgaaaaagtgatatcagtgggtcagacggttataaccaaacaccgaaacacccggtactacagttgccgcgtgatggcagtgacatcccagaccttctatgaggtgatgttcgacgacgggagcttctctagagacacttttcctgaagacatcgtgtccagggattgtctaaagctcggccccccagctgagggagaagtcgtacaggtgaaatggcccgatggaaaactgtatggcgcgaaatacttcgggagcaatatcgcccatatgtaccaagtcgagtttgaagatggaagccagatcgcttag

SEQ ID NO: 19670 - DNA, 2232 bp, Artificial Sequence
  Description of Artificial Sequence: Synthetic coding sequence
atggtgaagatcagcatggacatcttcgtgcggaagttccagcccgatagataccagctgtggaaacagggcaaagacatctatacaattgatcacactaagcccacccctgcaagcactcctgaagtgaaagcatggctccagcgtcgccgcaaggtgcggaaggcctcccgcagttttcaatgcgcacgctctacaagcaagcgacccaaagcggacgaagaggaggaggtatccgacgaggtggacggtgccgaagttccaaatcccgattccgttacggacgacctcaaggtctccgagaaaagcgaagctgctgtcaaactgcggaacacggaggcaagctcagaggaggagtcttccgcctctcgcatgcaggtggaacagaacctgtctgatcatatcaaactttctggtaactcgtgcctgtctacctctgtgacagaggacatcaagaccgaggatgacaaggcatacgcttatagaagtgtgccatccatttcgtccgaggctgacgacagtatcccgctgtccagcggctacgaaaagccagaaaagagcgatccgtccgagctgtcttggcccaagtctcccgagagctgtagttctgtggctgaatccaacggtgttctcaccgagggggaagagtcggatgttgagagccacggaaatggactcgaaccgggtgaaatccccgctgtccccagcggagagaggaattctttcaaggtaccaagcatcgccgaaggggagaacaagaccagcaagtcatggcgacatccactttccaggcctccagccaggtctcctatgaccttagtcaaacagcaagccccatccgacgaggagttacccgaggtcttgagtatagaggaggaggtcgaggagacagagtcttgggcgaaaccattgatccatttgtggcagacaaaatctcctaattttgcggcggaacaggaatataatgccacagtcgccagaatgaagccccactgtgccatatgcacacttctcatgccgtaccacaagccagactcctccaacgaggagaatgatgcgcgatgggagactaaattggatgaggtagtcacaagtgaggggaagacaaagccactcattccagagatgtgctttatttattcagaagagaatatcgagtacagcccgccgaacgccttcttggaggaagatggtacatctctgcttatcagctgtgcaaaatgctgcgttagagtccacgcctcgtgctacggaattccttcccacgagatctgcgacgggtggctctgcgctcggtgtaagcgtaacgcctggaccgctgaatgctgcctctgcaatttacgcgggggagcgctcaagcagacaaagaataataagtgggcccatgtcatgtgtgctgtcgccgttcccgaagtgcgttttacaaacgtgccagagcgaacacagattgacgtgggtagaatccccctccagaggttaaaactgaagtgcatcttttgtcgccatagggttaagcgagtgtcgggggcctgcatacaatgctcttacggtagatgtcccgcaagcttccatgtaacttgcgcccatgctgccggagtgttgatggaaccggacgattggccgtacgtggtgaatatcacctgctttagacataaggttaatccgaacgtgaaatctaaggcctgcgaaaaggtgatctccgtagggcagacagtcattactaaacacagaaacactaggtactactcatgccgggtgatggctgtcacatctcagactttctacgaggtcatgtttgacgatgggtcattcagccgggacacattcccagaggacatcgtgagccgagactgcctgaagctcggacctcccgctgagggcgaagtagtacaggtgaagtggcccgatggaaagctttatggagccaagtacttcggaagcaatatcgcccatatgtatcaggtagaattcgaagatggcagccagatagccatgaagcgagaggacatctataccctggatgaggagctacccaagcgagtgaaggcccgtttcagtaccgcttccgacatgcgattcgaagacacattttacggtgccgacatcatacagggcgagcggaaacggcaaagagtgctgtcatcgcgcttcaaaaacgagtatgttgcagacccagtgtatcgaacgttcctgaagtcatcgtttcagaaaaagtgtcaaaaacgccagtag

SEQ ID NO: 19671 - DNA, 2406 bp, Artificial Sequence
  Description of Artificial Sequence: Synthetic coding sequence
atgtggaagaccaccttcgcctggcacaccgaggacatggacctgtactctattaactacctgcactttggcgagccaaagagttggtacgccatccccccggaacacggaaagcgcctggagcgactggctcaaggtttcttcccctcttccagccaggggtgtgacgcttttttgagacataaaatgacactcattagtccctccgtgcttaagaaatatggtatcccattcgataagatcactcaggaagccggcgagtttatgattaccttcccttatggttaccatgcagggtttaaccacggatttaattgcgctgagagtaccaacttcgcgacagtgcgatggatcgactacggtaaagtggccaaactttgcacatgccgcaaggatatggtgaagatttcgatggatatctttgtgagaaagttccagcctgataggtaccagctatggaagcagggcaaggatatctataccattgaccacacgaaacccacacctgcctcgactcctgaggttaaggcttggctgcagagaagaagaaaagtgaggaaggctagtcgttcgttccagtgcgcccgttcaacatctaaacggccaaaggccgacgaggaggaggaagtatccgatgaagtggacggcgcagaggtgcctaaccctgacagcgtgactgacgatctcaaagtgtctgagaaaagcgaggcagccgtgaagctgaggaatactgaagcgagttcagaagaagagtcctcggcctcacgcatgcaagtggagcaaaacctgtccgaccacattaaactatcaggtaattcctgcttgagtacttctgtgaccgaagacattaaaactgaagatgataaagcttacgcttaccggtccgtgcccagtattagctcagaggcagacgattctatccccctcagctccggctatgagaaacctgaaaaatctgacccgagtgaactgtcctggccgaagtcccccgagtcttgttccagcgtcgcagaatccaacgaactgccagaagtccttagcatcgaggaggaagttgaggaaacagagtcttgggccaagcctctcatccacctctggcagacaaagtctccaaatttcgccgcggagcaagagtacaacgctactgtcgcccgcatgaaaccacattgcgcgatttgtacattactgatgccttaccataaaccagatagctccaatgaggaaaatgacgcaagatgggagactaaactcgacgaagtagttacgagtgagggcaagacaaagcccctcatccccgagatgtgctttatctactccgaggaaaatatcgaatatagcccacccaatgcttttctggaagaggatgggacatcactgctcatatcatgcgcaaagtgctgtgtcagggttcatgcatcctgctacggtattccctcccacgagatctgtgacggctggctttgtgctcggtgcaaacggaatgcttggacagccgaatgttgtctctgcaacttgaggggtggggctttgaagcagactaaaaataacaagtgggctcacgttatgtgtgctgtggcagtccctgaagtccgctttacaaatgtgcccgagaggacgcagatcgacgtgggccgcatcccactccagagactgaagctgaagtgcattttttgtcggcaccgtgtaaagagggtgagcggggcctgcatacaatgttcttatggccgctgccctgcttcgttccacgttacttgcgcccacgctgccggggtgcttatggaacccgacgattggccttatgttgtgaatatcacatgcttcaggcataaggtgaaccctaacgtgaagtccaaggcgtgcgaaaaagtgatctcagtggggcaaacagtgatcactaagcacagaaataccaggtattactcctgccgggtaatggcagttactagccaaacattctatgaggttatgttcgatgacggcagcttcagtcgagatacatttccagaggacatcgtgagcagggattgtctcaaactggggccaccagctgaaggggaagtggtacaggtcaagtggccagatggcaagctttatggagccaagtacttcggctctaacattgcccatatgtatcaggttgagttcgaggacggttctcaaatcgctatgaagagggaggacatctataccctcgacgaagagcttcctaagagggtaaaagccaggttctccaccgccagcgatatgcgattcgaggataccttctacggggccgatattatacagggcgaacgcaaaagacagcgcgtgctgtccagcaggtttaagaatgaatatgtggctgaccccgtataccgtactttcctgaaatcgagttttcaaaaaaaatgtcagaagagacaatag

SEQ ID NO: 19672 - DNA, 2508 bp, Artificial Sequence
  Description of Artificial Sequence: Synthetic coding sequence
atgaagcactacggcctgccctggaagcggaccgaggaggccgccgcggatactgcccttacgatcatggaagtggccgaagtggaaagcccattgaatcccagctgcaagatcatgactttccggccctcaatggaagagtttagggagttcaataaatatttggcctatatggagtctaaaggggcccaccgggcgggtttggctaaggttatccccccaaaagaatggaagccaagacagtgctacgacgacattgacaatttgttgattcccgcccctattcagcaaatggtgaccggccagtctgggctttttacccagtataacatccaaaaaaaggctatgaccgttaaggagtttcggcagctagccaactctgggaaatattgtacgccacgctatcttgactacgaggatctggaacgtaagtactggaagaatctgactttcgtcgccccaatctatggggctgatataaatggatccatctacgacgagggcgtggatgagtggaacattgcccggttgaataccgtcctagacgtggtggaggaggagtgtggaatcagcatcgaaggggtaaatactccttacctatacttcgggatgtggaagacaacgttcgcatggcacaccgaagacatggacctgtattccatcaactatctgcattttggagaaccaaagtcgtggtacgccatcccaccagagcacggcaagcgactcgagcgcctggcccagggcttttttccttcaagttcccaaggctgtgacgccttcctccggcacaaaatgacactgatctccccatccgttttgaagaagtatggaattcctttcgacaaaatcactcaggaagctggcgagtttatgataacttttccctatgggtaccatgccggctttaaccatggtttcaactgtgccgagagcactaattttgccacagtaaggtggattgattatgggaaggtcgcaaaactgtgtacatgccgaaaagatatggtgaagatttctatggatattttcgtcaggaagttccaacccgaccgctatcaactgtggaaacagggtaaagacatatacacaatcgaccacacaaagcccactcctgcaagcacacctgaggtaaaggcctggctccagcggcggcggaaggtgcgaaaggcttcccgcagctttcagtgcgcgcggtcaacctccaagaggcccaaagctgatgaggaggaggaagtcagcgatgaagtcgatggcgcggaagtgcccaacccagactctgtcacggacgacctcaaagtgagtgagaaatcagaagccgccgtcaagttaaggaatactgaggcatcgtccgaggaagaatcatcggcctctcgtatgcaggttgagcagaacctgtccgatcacattaagttgtccggcaatagctgcctgtcaacgtccgtgaccgaggatatcaagaccgaggacgacaaagcatacgcctaccgatctgttcccagtatcagctccgaagctgatgactcgatacccctttccagcggatacgagaagcctgagaaatcagatcctagcgagttgagttggcctaaaagcccagaatcatgttcatccgtcgccgaaagcaacggggtcttgacagagggcgaggaaagcgatgtggagagccacggaaacggcttagagcccggggaaatcccagccgttcctagtggtgagcgcaactctttcaaagtgccttcgattgccgaaggagaaaacaagacttcgaagagttggcgacatccattgagccggccaccggcacggagccccatgactcttgttaagcagcaggccccctccgacgaagagctgccagaggtcctgtcaatcgaagaggaagtggaggagacagaatcctgggccaagcctctgatccacctgtggcagaccaaatcccccaatttcgcagcagaacaggaatacaatgcaacagtggccagaatgaaaccccactgcgcaatttgcacgttgctgatgccctatcataagcccgattcttcaaacgaggaaaacgacgctagatgggagaccaagcttgacgaggttgtgacctctgagggaaagacgaagcccctgatccccgagatgtgtttcatctactcagaggaaaatatcgaatacagcccccctaacgccttccttgaggaagacggaacaagtttactgatctcttgcgctaagtgttgcgtgcgagtacacgcatcttgttatggaatcccctctcacgaaatctgcgacggatggctttgcgcacgctgtaagcgaaacgcatggacggccgaatgttgcttgtgcaacttgaggggcggagcgctcaagcagactaagaataataaatgggctcacgttatgtgtgcagtggctgtcccagaggtccgcttcactaacgtgccagagcgaacacagattgacgttggtagaattccccttcaacgcttgaaactggggaggctcggaatctag

SEQ ID NO: 19673 - DNA, 1890 bp, Artificial Sequence
  Description of Artificial Sequence: Synthetic coding sequence
atgtggaagaccaccttcgcctggcacaccgaggacatggacctgtacagcatcaactacttgcacttcggcgaacccaaaagctggtacgccatcccaccggaacatggcaaaaggcttgagcggttggcgcaggggtttttcccttcatcaagccagggttgcgatgcctttctgaggcacaaaatgaccttaatctctccttctgtgcttaaaaagtatggtattccgttcgacaagataactcaggaagccggcgagtttatgatcacctttccgtacggatatcatgccgggttcaatcacgggtttaactgcgccgaaagtaccaattttgcgaccgtgcgttggatagattacggcaaggtggccaagctttgtacctgcaggaaagacatggtgaagatctctatggatatctttgtacggaagttccaacctgataggtatcaactctggaaacaggggaaagacatttatacaatcgatcataccaaacctaccccagcatccacccctgaggtgaaggcctggctgcagcgaaggagaaaggtaaggaaggcatccagatcctttcagtgcgccagaagcactagtaagcgcccaaaagctgacgaggaagaagaggttagcgacgaggtggacggcgcagaggtgccgaatcccgattccgtgacagacgatctaaaggtgtctgagaagagtgaggcagcagtaaagctgagaaatacagaggcgagcagcgaagaagaatcatccgccagccgcatgcaggtcgagcagaacctcagtgatcacatcaaattaagtggcaattcctgcctgtcaactagcgtcaccgaggatataaagactgaggatgataaggcatacgcatataggagcgtgcccagtatctcctcagaggccgatgattccattcccctttcgagtggatatgaaaaacccgagaagtccgacccatctgaactgtcttggcctaagagtccggaatcatgttcatctgtggcggaatccaatggtgtgctaactgaaggggaggagtcagatgtggagtcccacggaaacggactggaaccaggagagattcctgctgtacccagtggagagcgaaatagtttcaaagtgccaagcatcgcagagggtgagaacaagacctctaagagctggcggcacccccttagccggccccccgcaagatctcctatgactcttgtgaaacagcaggctccctcggacgaggaactcccagaggtgttgagtatagaagaagaagtcgaggaaaccgagagttgggctaagcccttaatccatctctggcaaaccaagtcacctaacttcgcggctgagcaggagtacaacgcgaccgtcgcaaggatgaaacctcactgtgcgatttgcactctgctcatgccctatcacaagccagactcttctaatgaggagaacgacgctagatgggagacgaagcttgatgaggttgtaacttcagagggtaagaccaaaccgctaataccagagatgtgctttatctactcggaggagaacatcgagtacagtccgcccaatgcgtttctggaggaggatggaacctccctgctgatttcctgcgcaaagtgttgcgtcagggtgcacgcctcgtgttacggaatcccgtcacatgagatctgcgatggatggctgtgcgccagatgcaaacgaaacgcctggacagccgagtgttgtttgtgtaacctcagggggggagctctgaagcagactaagaacaataagaacgcaagctccgcggacaccgggttgagggggtccttggagcctgccagctccgttccgaccgtcgctgctcgcccaccaagcatgtccctggtcccaatgttgcttgggtattag

SEQ ID NO: 19674 - DNA, 2442 bp, Artificial Sequence
  Description of Artificial Sequence: Synthetic coding sequence
atggaggtggccgaggtggagagccccctgaaccccagctgcaagatcatgaccttcagaccatcaatggaggaatttagggagtttaacaagtacctggcctacatggaatcgaaaggagcgcacagggcaggtttagcaaaggtcattccaccaaaggagtggaagccccggcagtgttatgatgatattgacaacctactgatcccagctccgattcagcaaatggtgaccggtcagagtggtctgtttacccaatataatattcagaagaaggcaatgacagtcaaagagtttcggcaacttgcaaactcgggcaagtactgcactccaaggtacttggattacgaggatctggagagaaaatattggaagaacctgacctttgtagcgccgatctacggggccgacatcaacggctccatctacgacgagggcgtcgatgagtggaacattgccagactcaatacagttttagacgtggtcgaggaagagtgcggcattagcatagaaggggtgaatacaccctatctgtacttcgggatgtggaagacgaccttcgcttggcacaccgaagacatggacctttactcgattaactacctccattttggagaacctaagtcatggtatgcaatcccccccgagcatggaaaaagactggagcggcttgctcagggcttcttcccgagctcctcacagggatgcgatgccttcctacggcacaaaatgacgctgatctctccgtctgtgctgaaaaagtatggcataccatttgacaaaatcacccaggaggccggggagttcatgattactttcccatacggctatcatgcaggatttaatcatgggtttaactgtgccgagtctacaaatttcgccactgtaaggtggatcgattatggaaaggtggccaagctgtgcacctgccgcaaagatatggtcaaaatttcgatggacatttttgtcaggaagttccagccagatagataccagctgtggaaacaggggaaagatatctatacaatcgatcacaccaaaccaaccccagcatcaacacccgaagtcaaggcctggttacagaggaggaggaaagtgcgtaaagcctcccgatcgtttcaatgcgcacggagcaccagcaagcgcccgaaggccgacgaggaggaagaagtgtccgatgaggttgatggcgccgaggtgcctaaccctgattctgtcaccgatgacctcaaggtgagtgaaaagagtgaggccgccgttaagcttagaaacaccgaggcctccagcgaggaggaatcttctgccagccgtatgcaggtggaacagaacctctctgaccatatcaaactgagcggaaacagctgcctaagtaccagcgtgactgaagacatcaagacggaggacgacaaggcttacgcctaccgatccgtgccatccatatcctctgaggctgacgactccattcccctcagttcaggctacgaaaagcctgagaaatccgatccatccgagcttagctggcccaaaagccctgaatcctgtagtagtgtggcggaatccaacggcgtcttgaccgaaggcgaggaatcagacgtagaatcacatggtaatggattagaacctggggagatcccggccgtaccttcaggcgaaagaaattccttcaaggtgcctagcatcgccgagggagagaacaagaccagcaagagttggagacatccactcagccggcctcccgccagatcgcccatgacactggttaagcagcaggcgccttctgatgaagaactgccagaagtcttgagtatcgaggaagaggtggaggaaactgaatcctgggcgaagcctcttatacacctgtggcagacaaaatcccccaactttgccgcggaacaggagtataatgctacagtggcacgaatgaagccacactgcgccatttgtacattactcatgccataccacaaacccgactcatcaaacgaagagaatgacgcccgttgggaaactaagttagacgaagtagtgacaagtgagggaaagacaaaacccctgatccctgaaatgtgtttcatttactcagaggaaaatattgaatactcccccccaaacgcttttctggaggaagacgggacatccctgctgatcagttgcgcaaaatgctgtgtgcgcgttcacgcttcctgttatgggatcccctcacacgagatctgtgatggctggctgtgtgcccgctgcaaacgcaatgcctggacagcagaatgttgcctctgcaatcttcgtgggggcgccctgaagcaaacgaaaaataataagtgggcccatgtgatgtgtgctgtggccgtgccggaagttagatttacaaatgtccctgaacggacccaaatcgacgtcggcaggatccccctgcagaggttaaaacttggcagactcggaatctag

SEQ ID NO: 19675 - DNA, 1572 bp, Artificial Sequence
  Description of Artificial Sequence: Synthetic coding sequence
atggagaccatgaagagcaaggccaactgcgcccagaaccccaactgtaatatcatgatctttcatcccacaaaggaggagttcaacgattttgataaatacattgcatatatggaatctcagggagcccatcgagccggcctggctaagatcatcccacccaaagagtggaaggctcgagaaacatatgataatataagcgaaatcttgatcgcaacaccgttgcagcaggtggccagcggacgcgcaggggtattcacccaataccacaagaagaaaaaggcaatgaccgtaggggaatacaggcacctagccaactccaaaaaatatcagacacctccccatcagaactttgaggatctagagcgaaaatactggaaaaaccggatttataactcccccatttatggtgccgatatttccggtagcctgttcgacgagaacaccaagcagtggaatctcggccacttaggaaccatccaggatctattagagaaagaatgcggcgtggtgatagaaggcgtcaacacaccttatttgtatttcgggatgtggaagacaactttcgcttggcacaccgaggatatggatctctattcaattaattacctccatctgggcgagcccaagacctggtacgtggtgcctcccgagcacggccagcgtctggaaaggctggctcgggagctgtttcccggatccagcaggggttgcggagctttcctgcgacacaaagtggctctaatctcccccactgtgttgaaggagaacggaattcctttcaatcgaattactcaggaggcgggcgagttcatggttaccttcccttatggctaccatgcgggttttaatcacggcttcaattgtgccgaggcaattaacttcgccacccccaggtggatagattacggaaagatggctagtcagtgttcctgcggcgaggcccgggtaaccttttcaatggatgcctttgtccggatcctgcagcccgagcggtacgacctgtggaagcgcggacaggatcgagccgtcgtggatcatatggagccccgggtcccagccagtcaagaactgtcgacacagaaagaggtgcaacttccgagaagagcagcccttggcctacggcagctgcccagccactgggctcgtcactcaccttggcctatggccgcgcgctctggcactcggtgtcacaccctggtgtgttctagcctgcccagacgtagcgcagtgtctggaacagcaacccagccacgtgccgccgcagtgcattcttcgaaaaaaccatcttcaacaccttctagcactcctgggccctccgctcagataattcatccgagcaatggacggaggggccggggcaggcctccgcaaaaactgcgtgcacaggagcttacccttcaaacaccagccaagcgccctctgctagcagggaccacctgtactgcctctggaccggagcccgagcctttaccagaggacggtgccctcatggataagcctgtcccactcagtcctgggttgcagcaccccgtcaaggcctccggatgtagttgggcacctgttccttag

SEQ ID NO: 19676 - DNA, 1521 bp, Artificial Sequence
  Description of Artificial Sequence: Synthetic coding sequence
atgaagagcgtgcacagcagcccccagaacaccagccacaccatcatgactttctatccaacaatggaggaattcgccgattttaatacttacgtggcctacatggaatcacagggggcccaccaggccgggctcgctaaggtcataccccctaaggagtggaaggcgaggcaaatgtacgatgacatcgaagatatcctcatagccacacccctgcagcaagtcacctctgggcagggtggagtgttcacacagtatcacaagaagaaaaaggccatgagggtaggccaatatcggcgtctcgctaacagtaagaagtaccagacacctccacaccagaatttcgctgacttggagcagcgttattggaagagccacccagggaacccgcctatatacggtgccgatataagtggcagtctgtttgaggagagcacgaagcagtggaacctgggccacctggggaccatcttggaccttttggagcaggagtgtggagtagtgatcgagggggttaacactccctatttgtactttggtatgtggaagacaacatttgcttggcatacagaagacatggatctgtactccatcaactatttacacttcggagagccaaaaacctggtacgtggtgccgccagaacacgggcagcatctggaacgtctggcccgggaattattccccgatatcagtcgtggatgcgaggcctttctgaggcacaaagtcgccttgattagcccgacagtactcaaagagaatggaatccctttcaactgtatgacccaagaggccggcgaattcatggttacattcccctacgggtaccacgccggcttcaaccatggattcaactgtgccgaagcaatcaatttcgcaacgcctcggtggatcgactatgggaaaatggcctcgcaatgcagttgcggagaatcaaccgtcaccttttctatggatccatttgttcggattgttcagcccgagtcctatgaactgtggaaacataggcaggacttggctattgttgaacataccgagccacgtgtcgccgaaagccaagaactgtccaattggagggacgacatagtgttaaggcgggccgctttgggcctgcggctgttaccgaacctcaccgcacaatgccccacacagcctgtgtcatcaggccactgctataatccaaaagggtgcggaaccgatgcagtcccagggagcgcattccagtctagcgcatatcacactcagacgcaatcgcttactcttggaatgtcagcccgagtgttactcccatccacagggtcttggggatccggcagggggcggggccggggtcagggccagggccgaggctgtagcaggggtaggggccacggatgttgcacgagagagctcggtactgaggagcctacagtccagcccgccagcaaaagacggctgctcatggggaccagatctcgggctcagggacacaggcctcagttaccgttggctaacgacttgatgactaacctttcattatag

SEQ ID NO: 19677 - DNA, 1080 bp, Artificial Sequence
  Description of Artificial Sequence: Synthetic coding sequence
atgatcgccgcccaggccaagctggtgtaccagctgaacaagtactacacagagcgctgccaggcccgaaaggctgcgattgctaaaacgattagagaagtgtgtaaggtggtttctgacgttctgaaggaagtggaggtccaggaaccgagatttataagtagcctgtccgagatagatgcaaggtacgaagggctcgaggtgatctctcctacagagttcgaggttgtgctatacctgaaccagatgggcgtttttaattttgtggacgacgggagcctcccaggctgcgccgttttaaaattatcagacgggcgcaaaagatctatgtcactgtgggtcgaattcataaccgccagtggctatttatcggctaggaaaatccgatcacggttccagacgctggtggcccaggccgtggacaagtgttcttatcgggacgtcgtgaagatgatcgccgacaccagtgaagttaagctgaggattcgtgagcggtatgtggttcaaatcacgccagcatttaagtgtaccggcatctggcctcgaagtgccgcccagtggccaatgccccacatcccttggccgggccctaatcgggttgccgaagttaaggcagaggggttcaacctgctaagcaaagagtgttatagtctcactgggaaacagagctctgccgagtccgatgcatgggtgttgcagttcggtgaggcagaaaaccgcctgctaatgggcggatgccggaataaatgcctttcagtcctgaaaactctccgggataggcacctggagctcccagggcagcctttaaataattatcatatgaaaacgctcttgttgtacgaatgcgaaaaacacccacgagagactgactgggatgaaagctgtctgggtgacagattgaatgggatcctgttgcagctgattagctgtctgcaatgcagacgctgccctcattacttcctccccaatttagatctgtttcaaggcaaacctcactcagctttggagagtgctgctaagcagacctggaggctcgccagagaaatcctgaccaatcccaaatcactcgacaagttgtag

SEQ ID NO: 19678 - DNA, 447 bp, Artificial Sequence
  Description of Artificial Sequence: Synthetic coding sequence
atggccgtggccagcgacttctacctgcggtactacgtgggccacaaggggaaatttggacatgaatttctggaattcgaatttagacctgatggtaaactgcggtacgcgaataactctaattacaaaaacgacgtaatgattcggaaggaggcctacgtccacaagtccgttatggaagagcttaagcgcatcatagacgattctgagattacgaaggaagacgacgccctctggccccctccggaccgcgtggggcggcaggaactcgagattgtcataggcgacgaacacattagctttactacaagcaaaattgggagcctcatcgacgtgaatcagtctaaggacccagaaggtctgcgcgtcttttattatctggtgcaggacctaaagtgcctagtattcagtctgatcggccttcatttcaagattaagccaatctag

SEQ ID NO: 19679 - DNA, 336 bp, Artificial Sequence
  Description of Artificial Sequence: Synthetic coding sequence
atggccgtggccagcgacttctacctgcggtactacgtgggccacaagggcaagtttggacacgagtttctggaatttgaattccgccctgacggaaagctgcggtatgccaacaactctaattataagaacgatgtgatgattcggaaggaagagttggagatcgtgatcggcgatgagcacatttctttcacaacatccaagattggctcactcattgacgtgaatcagagcaaggaccctgaaggtctcagggtgttctactatcttgtgcaggatcttaagtgtcttgtgttctcattgatcggactacactttaaaatcaagccgatctag

SEQ ID NO: 19680 - DNA, 1041 bp, Artificial Sequence
  Description of Artificial Sequence: Synthetic coding sequence
atggccccccggagcctgctgctgctgctgagcggcgccctggccctcaccgatacctgggccgggtctcattcgttaaggtacttttccaccgccgtgagtaggccagggaggggtgagccgaggtatatcgcagtggaatacgtagatgacactcagtttttaagattcgatagcgacgctgcaatcccaaggatggaaccaagagagccatgggtagaacaggaaggtccgcagtactgggagtggaccacaggatacgccaaggctaatgctcagaccgaccgggtcgcgctccggaacctcttgcggcgatataatcagagcgaagccgggagccacacattgcagggcatgaacggctgtgacatggggccggatggcagactactgcgaggttatcaccagcatgcgtacgatggaaaggactacatcagcctcaacgaagatctccggtcttggactgctgcggataccgtcgcccagatcacccagaggttctatgaggccgaggaatacgccgaggagttcaggacctacctcgaaggtgagtgtctcgagctgcttcgcagatatttggagaatggcaaagagacgctgcagcgcgctgacccgccaaaagcacacgtcgcgcatcatcccatatcggaccacgaggccactttgcggtgttgggccctgggcttttatccagccgagataaccctcacttggcagcgtgacggggaagaacagacccaggacaccgaactggttgagacgcgacccgccggggacggcaccttccaaaagtgggccgctgtcgtcgtgccttccggagaagagcaacgatacacatgccacgttcagcatgaaggattaccccaaccactgattttgagatgggagcagtctccccagccgaccatacccattgtgggcattgtggcaggattagtggtactgggcgcagttgtgacgggagcggtagttgcagccgttatgtggcggaagaaaagctccgaccggaaccgcggatcttattctcaggccgccgtgtag

SEQ ID NO: 19681 - DNA, 903 bp, Artificial Sequence
  Description of Artificial Sequence: Synthetic coding sequence
atgcagagcgacgacgtgatctgggacaccctgggcaacaagcagttttgtagcttcaaaatccgaactaagactcagagtttttgcaggaacgagtattccctcaccggcctgtgcaacagatcgagctgccctctggcaaatagccagtatgctacaatcaaggaggagaaaggccaatgctatctgtacatgaaagttatagagagagcggcattccctcgccggctctgggaaagggtgagactgtctaagaattacgaaaaggcactcgagcagatcgacgagaatttaatatattggccgagattcattaggcacaaatgtaaacagcgctttaccaaaatcacccagtacctgatacgcattcgcaagctcaccctaaaaagacagcgcaagttggtgcccctgtccaagaaagtagaacgaagagagaaaagacgggaggagaaggcactgattgccgcacaactggataatgcaatagagaaagaacttctggaacgattaaaacaggacacatatggcgatatctacaactttccgatccatgccttcgacaaggcactggagcagcaagaagctgagtcagattcctccgacaccgaggaaaaggacgatgacgacgacgacgaggaggatgtggggaagcgggagtttgtagaagatggagaagtggatgaatccgacattagcgatttcgaggacatggataaactcgacgcctcgagcgacgaagatcaagatgggaagtcctcctccgaggaggaagaagagaaagcattgtccgcaaagcataagggaaagatgcctcttaggggccccttacagcgcaagcgcgcatatgtggaaatagagtatgagcaagagactgagcccgtggctaaggctaagactacttag

SEQ ID NO: 19682 - DNA, 1056 bp, Artificial Sequence
  Description of Artificial Sequence: Synthetic coding sequence
atggagcggcggatgcagctggtgaagaaggacaacgagaaggagcggcataaattgttccagggatatgagacagaagaacgggaggaaactgaattatctgagaagataaaattagagtgtcaacctgagctttcagaaacctcccagaccctcccacctaaacccttttcctgcggccgaagcggaaagggtcacaagcgtaagtccccattcggatccacagagaggaaaacacctgttaagaaactggccccggagttctcaaaagttaagacaaagactcccaaacacagtcccatcaaagaggagccttgtggatccctgtcagaaacagtatgcaaaagagagctgaggagtcaggaaactcctgaaaaacccaggagttccgttgatacaccacctcggttatcaactccacaaaaggggccatctactcaccccaaagaaaaagcctttagctctgagatcgaagatctgccatacctctcaaccacagagatgtatctgtgtcgttggcatcagcctcctcctagcccattgcccttacgcgagagtagtcctaaaaaagaggaaacagtcgcacgttgtttaatgccatcctccgtcgctggagagacatctgtcctggcagtcccctcctggcgggaccatagcgtggagccccttcgggacccaaacccaagcgatctacttgagaatcttgacgattctgtgtttagcaaacgacacgccaaattggaactcgacgaaaaaaggcgcaagcgctgggacattcaaagaattagagaacagcggatcctacaaaggctgcagcttcgtatgtataagaagaaagggatacaagagtccgagcccgaggtgacttccttttttcctgaacccgatgacgttgagtccctgatgattaccccctttctgcccgtcgtcgctttcggcaggcctttgcctaagcttacccctcagaatttcgaactgccttggcttgatgagcgctcccggtgcagacttgaaatacaaaagaagcagactcctcaccggacttgcaggaaatag

SEQ ID NO: 19683 - DNA, 1845 bp, Artificial Sequence
  Description of Artificial Sequence: Synthetic coding sequence
atgaccatgcggagcgccgtgttcaaggccgccgccgcccccgccggaggtaatcccgagcagcggctggactacgaaagagccgcagccctgggagggcccgaggatgagccgggggcggctgaggcacattttctacctagacaccgcaaactgaaagagcccggcccaccacttgcaagttctcagggagggagtccagcaccttccccggccgggtgtggggggaagggccgggggcttctgctgccggccggtgccgcccccggtcagcaggaggaatcttggggaggaagtgtccctttaccctgtccacctcctgctaccaaacaggccgggatcgggggggagcccgccgccgcgggagccggttgctctcctcgaccaaagtatcaagcagtgctccctatacagactggatccttggtggctgcagcgaaagagccaactccgtgggccggtgacaaaggcggagccgcctcaccggccgctaccgcgagcgacccagccggtcctccaccattacccctgcccggacctcctcccctcgcgcccaccgctactgctggcactctagcagcctccgaaggtcggtggaagtccatgcggaaaagccctctgggagggggggggggtagtggcgcgagtagccaggccgcgtgtctgaaacagattctattactgcagttagacctcattgagcagcagcagcagcaactgcaggccaaggagaaagagatagaagagcttaaaagcgaaagagatactctcctcgccaggattgagcgcatggaacgaaggatgcaactggttaaaaaggacaatgagaaagaacgccataaactatttcagggttacgagacagaagagcgagaagagactgagctgtccgaaaagatcaagctggagtgccagcccgagttgtcagagacatcccagacactccctcctaagcctttttcttgcgggaggagcggaaagggacacaagcgcaaatcccccttcggttccaccgaaaggaagacacctgtgaagaagcttgcaccggagttctctaaagttaagaccaaaaccccaaaacattcgcccataaaggaagagccatgcggtagcctgagcgagaccgtgtgtaagagagaactccgaagccaggagacgcccgaaaagccaaggtcatccgtagatacgcccccacggttatctacacctcagaagggcccaagtacccacccaaaggaaaaggcattttcctcagaaatcgaggatttaccctatctgagcactaccgagatgtatctgtgtcgctggcaccagccaccacccagccccttacctctcagggaaagcagtccaaaaaaagaggagacggtcgcccggtgcttgatgcctagcagcgtcgctggcgagacgtccgtgcttgccgtgcccagctggagagaccacagcgtcgagcccttacgtgatcctaatccttcggacctcctcgaaaacctcgatgacagcgtgttctcaaagcgccacgccaagctggagctggacgagaagaggcgaaaacggtgggatatccagcggatccgggaacagagaatactgcaaagactgcagctacggatgtacaaaaagaaaggcatccaggaatcagagccagaggtgacttccttcttccctgagcccgatgacgtggaatctttgatgataacacccttcctccccgtcgtggccttcgggcgccctttaccaaagctcaccccccagaattttgagctgccgtggctagacgaacgtagcagatgtcggctggaaatccagaagaagcagaccccacaccgaacgtgccgcaagtag

SEQ ID NO: 19684 - DNA, 1056 bp, Artificial Sequence
  Description of Artificial Sequence: Synthetic coding sequence
atggagcggcggatgcagctggtgaagaaggacaacgagaaggagcgccacaagctttttcaaggatatgaaacggaggagcgggaagagactgagctgtccgaaaagatcaaactcgagtgccagcctgagctgagcgagacttcacagacgctcccaccgaagccattctcgtgtggtagatccgggaaggggcacaaaaggaagagcccttttggatccacagaacgaaagacccccgtaaaaaaacttgcccccgagttctccaaagtaaagaccaaaacccctaaacacagtccaataaaagaggagccctgcggctccctctcggaaaccgtatgtaagcgggaactgcggagccaggagacccctgagaagccccggtcctctgtggatacacccccccggttgtccacaccccagaaaggccccagcacacatcccaaggaaaaagcatttagcagtgagatagaagatttgccttacttgagtacaacagagatgtacttatgtagatggcaccagccaccgccgtcaccattgcctttaagagagtcctctccaaagaaggaagaaacagtggcccggtgccttatgccttctagcgtggcgggagagacaagcgtactcgcagtgccgtcatggcgcgatcactccgtggaacccttaagggacccgaacccctcggatcttctggagaaccttgatgattctgtcttcagcaaacggcatgccaagctggaactggatgaaaagcggcgcaaacgctgggacatccagcggatccgggagcagagaattctgcagcgcctgcagttgcgcatgtacaagaaaaaggggattcaggagagtgagcctgaagtgacttcttttttcccagagcccgacgacgttgaatctcttatgataactccatttttgcctgtagttgctttcggacggcccctgcctaaactgactccacagaactttgagctgccttggctggacgaacgaagccgctgcagattagagattcagaaaaaacagactccccatagaacctgtcggaagtag

SEQ ID NO: 19685 - DNA, 1734 bp, Artificial Sequence
  Description of Artificial Sequence: Synthetic coding sequence
atgaaccccgtgaacgccaccgccctgtacatcagcgccagccggctcgtcctgaactacgacccaggtgacccaaaggcctttaccgagataaatcggttgctgccttattttagacagagcctctcctgttgcgtctgtgggcatcttctgcaggacccaattgcgcccacaaattctacctgccaacattacgtatgcaagacatgcaagggaaaaaagatgatgatgaaacctagctgttcatggtgcaaagattatgagcagttcgaggagaataaacagctgtctatccttgttaattgctataagaagctctgtgagtatatcacccagacaacactggccagggacatcatcgaagccgtcgactgctcaagcgacatactcgctttgcttaatgacgggtctttattctgcgaagagacggagaaaccttccgatagctcttttacgctgtgtctaactcattcccccctgccatccaccagtgagccgacaactgacccacaggccagcctctcccccatgagcgaaagtaccctgagcatagctataggttccagtgttatcaacggcctgcccacatacaacgggctctcaatcgacaggttcgggattaacattcccagccctgagcactctaataccatagatgtttgcaacactgtcgacataaagactgaggacctctccgactcccttcctcccgtgtgtgacaccgtcgcgaccgacctttgctccactggaatcgatatttgttccttctcggaagacatcaagcccggtgacagtttgctgctatcagtcgaagaggtgctgcggtcattggagaccgtctctaatacggaggtctgttgcccaaacctccagccaaacctggaggccaccgtgtctaatggccccttcttgcagttaagtagccagtccttaagccacaacgtcttcatgtccacatcccccgccctccatggcctgagctgcacagcggctacacccaaaattgccaaactcaaccgcaaacggagccggagtgagtctgacagtgagaaggttcagccccttccgataagcactatcattagaggccccacacttggggcatccgctccggtgactgtcaaacgggaatcaaaaatctctcttcagcctatagcaactgtgcctaatgggggcaccactcccaaaatatccaaaaccgtgcttctgtcaacgaaatcaatgaaaaagagccatgaacatggatcaaaaaagagccattcaaaaacaaagcctggaattctgaagaaggataaagcagtgaaggagaaaatcccctcgcaccatttcatgcccggatctcctactaagaccgtatataagaaaccacaggagaaaaaaggatgcaagtgcggccgcgccacccagaacccttccgtgctaacttgcagggggcaacgatgcccatgctactcgaatcgaaaggcatgcctggattgtatttgtcggggatgtcaaaattcgtacatggcaaatggagagaagaaattggaagccttcgccgtacctgaaaaagcattagagcaaactaggctgactctcgggataaacgtcacgtccattgccgtcaggaacgcctcaacttccaccagcgttattaatgtcacagggtcccctgtcaccacattcctggccgctagcacacacgacgacaagagcctggacgaagccattgatatgcgtttcgattgctag

SEQ ID NO: 19686 - DNA, 1512 bp, Artificial Sequence
  Description of Artificial Sequence: Synthetic coding sequence
atgatgatgaagcccagctgcagctggtgcaaggactacgagcagttcgaggaaaataaacagttgagcattctggtgaattgttacaagaaactgtgtgagtacatcacacagacaacgttggcccgggacattattgaggcggtcgactgttcatccgatatcctcgctttactgaacgacgggtctctgttttgcgaagaaaccgagaagccgtccgatagtagctttacactgtgcttgacccacagtcccctaccgtctacatccgaaccaacgacggatccccaggcctctttgtccccaatgagcgagagtactctaagcatcgccatcggatcatctgtgatcaacggactgccaacatataatggcctatccattgataggtttggcatcaacatcccatcacctgaacactctaacaccatcgatgtctgcaataccgttgatatcaagacggaagacttgtctgacagcctcccccccgtttgcgataccgtggccactgatctttgcagcacaggcatcgacatttgctcattctccgaggacattaagcctggagattccctcctactgtcagtggaggaggtgctgcgctccctcgagaccgtgtccaatacagaggtttgctgtcctaaccttcagcctaacctggaggcgactgtcagtaatgggccctttctacagctttctagtcagagcctaagccacaacgtgtttatgagcaccagtcccgccctgcacggcctcagctgcacggctgccacacctaagattgcgaagctcaacaggaaacgatcacggtcggagtcagattccgagaaagtgcagcctctgcccatttccactatcatccgaggccccactctcggcgcaagcgctcctgtaaccgtcaaacgggaaagcaaaatcagcctccagcccatcgctaccgtacccaacgggggtaccactccgaaaattagcaaaaccgtcctgttgtctaccaagagtatgaaaaagtctcacgagcatggttccaaaaaatcccattctaaaacaaagccagggattctcaaaaaggacaaggcggttaaggaaaaaattccaagccatcactttatgccagggtctcccacgaagacagtgtacaaaaagcctcaggagaagaaaggctgtaaatgcgggcgcgccactcagaacccatctgttttaacttgtagagggcaaaggtgtccctgctattctaatcgcaaagcttgcctggattgcatctgcagggggtgtcagaattcctacatggccaatggcgagaagaagctggaagcgtttgctgtgcccgagaaagccttagaacagactaggctgacactgggtatcaatgtcacttccatcgccgtgcggaacgcttctaccagcacgagtgtgattaacgtgactggttctccggtcacaacttttcttgccgcttctactcatgacgataaaagcctcgatgaggccattgatatgcgctttgactgttag

SEQ ID NO: 19687 - DNA, 1566 bp, Artificial Sequence
  Description of Artificial Sequence: Synthetic coding sequence
atgagcgccagcgagggcatgaagttcaagttccacagcggcgagaaggtgttgtgtttcgagcccgaccctaccaaggcacgagtattatacgacgctaagatcgtcgacgtcattgtaggaaaagacgagaagggacggaagatcccggagtacctcatccacttcaatgggtggaaccggtcgtgggaccggtgggctgccgaggaccacgtcctgcgcgacactgacgagaatcgcagactgcagcgcaagctcgcacgtaaagctgtcgcgaggttgcggtccactggcagaaagaagaagcggtgccgactccccggtgtagacagcgtgctgaaggggttgcccacagaagagaaagatgagaacgatgagaattcgctgtcttcctcaagtgactgttcggagaataaggatgaggaaatctcagaagaaagcgacattgaggagaaaacggaggtcaaagaggagcctgagctgcagacaagacgcgagatggaagagagaacaatcacaatagagatccctgaagtgctgaagaagcagcttgaagatgactgctattacattaacaggaggaagcgactcgtgaagctcccttgccaaaccaatataataactatcctggaatcctatgtgaagcactttgcgatcaacgccgcgttcagtgccaatgagagaccaaggcaccaccacgtaatgccccatgccaacatgaatgtacactacatcccagccgagaaaaacgtagatctgtgtaaagagatggttgacggtcttcgtattactttcgattatacccttcctctggttttgttgtacccatatgagcaggcccaatataaaaaggtcactagtagcaaatttttcctccctattaaagaatccgcaacatcaactaacaggtctcaagaggaactctccccctcaccccctctccttaacccatccacgcctcagagcactgaatctcagccaaccactggcgaaccagccaccccgaaacgccgcaaagccgagccagaggcattacagtcattaaggagatccacacgccacagtgctaattgcgaccgcctctcggagagtagcgcctcccctcagcctaaaaggcggcagcaggacacctccgcgtctatgcccaaactctttctgcaccttgagaagaagacccctgttcactcgcggagctcctcgccaatcccactgacgcccagcaaagaaggctccgctgtgtttgccggctttgagggaaggcggacgaacgagattaacgaggtgttgagttggaagcttgtgcctgacaactatccccctggggatcagcctccacctccttcctatatctatggagcccagcatctgttacgtttgttcgttaaattacccgagatcttgggaaagatgagtttttctgagaaaaatttgaaggccctgctgaagcatttcgacctgttcttgcgttttctcgccgagtatcacgatgatttctttccggaatccgcctacgtggccgcatgcgaagcacattatagcacgaagaaccctcgcgctatatattag

SEQ ID NO: 19688 - DNA, 1251 bp, Artificial Sequence
  Description of Artificial Sequence: Synthetic coding sequence
atgagcgccagcgagggcatgaagttcaagttccacagcggcgagaaagtactttgttttgagcccgacccgacgaaagcccgggtcctttacgatgccaaaatagtcgatgttatcgtgggcaaggatgagaagggaaggaaaatacccgagtacctgatccatttcaacgggtggaatcgctcttgggaccggtgggccgcagaagatcacgtactcagagacaccgatgagaatcgacgccttcagcgtaaactcgccagaaaagcggtagcaagactgagaagcaccggcaggaagaaaaagagatgtaggctgcccggcgtggatagcgtattgaaagggctcccgaccgaggagaaagacgagaacgacgagaactctctctcaagtagcagtgattgctctgagaataaggatgaagagatctccgaggaatccgacattgaggagaagacggaagtgaaagaggagcctgaactgcaaacgagaagggaaatggaagaacgcactatcacaatcgaaatccccgaagtgctcaaaaaacagctggaagacgactgctactacatcaacaggcgaaagcgattagtgaaactgccttgccagaccaacatcatcactatactggaaagttacgtcaagcactttgccatcaatgccgcttttagtgctaatgagcgcccacgccaccaccacgtcatgccacacgccaacatgaacgttcattatatccctgccgaaaagaacgttgatctctgcaaggagatggtcgacggccttcgcatcaccttcgattacacactgcccctggtcctcttgtatccctacgagcaggctcagtacaaaaaggtgacgtcatccaagttttttctgcctattaaagaaagcgctactagcacaaacaggagtcaggaggaacttagcccctcaccacccctgttaaacccttccacaccacagtcgacggagagtcagcctactacaggcgagcctgccacgcccaaacggcgcaaggctgaaccagaagctctacaaagccttcggagatctacacgtcactctgccaactgtgatcggttgagtgagagcagcgcctctcctcagcctaagcggcgacagcaggacaccagcgcgtccatgcctaaacttttcctgcatttggagaagtctaggttcatccttggttgcccccggcccggccgggcaagcgtgtacttcgtcttctctcagtgccaagcctggtgttag

SEQ ID NO: 19689 - DNA, 1119 bp, Artificial Sequence
  Description of Artificial Sequence: Synthetic coding sequence
atgaagatgatgaagaccaaggaggagcccgagctgcagacccggcgcgagatggaagaaagaactatcactatcgaaattcctgaggtcttaaagaaacaacttgaggatgactgctactacattaatcgtcgcaagcgccttgtgaaactgccctgtcaaactaacatcattacgattctggagtcctatgtcaaacatttcgcgatcaatgcagcgttcagcgccaacgaacgcccgcggcaccaccatgtgatgccccacgctaacatgaatgtccattacatcccggccgagaagaacgtcgacctgtgcaaagaaatggtggatgggcttaggatcactttcgactacaccctgcccctcgttctattatacccctatgagcaggcccagtataagaaagttacaagctcgaaattcttcctgcccattaaggagagtgctacctccaccaacaggagccaggaggaactctccccgtcccccccacttttgaatcccagcacacctcagagtacagaaagccagcccacaacaggtgaacccgccaccccaaagcgcaggaaggccgagccagaggctttgcagtctctgcgtcggtccacaaggcactcagcaaactgcgatagacttagcgaaagttcggcttcaccccaaccaaagagaagacagcaagatacgagtgccagcatgccaaagctgttcctgcacctggagaagaagacacctgtacactctcggagctcctcccctatccccctcactccttctaaagaagggagcgccgtgttcgcaggattcgagggcaggcgcaccaatgagataaatgaggttctgtcttggaaactagtcccagacaactatccacctggcgaccagccaccacctccatcttacatttacggtgcccagcatctgcttaggctcttcgttaaattgccagagatcctgggcaagatgtcattttctgagaagaatctgaaagcactgttaaagcatttcgatctctttctcagattcctggcagagtatcacgatgatttttttcctgaatctgcttatgtggctgcctgcgaggcgcactatagtactaagaacccaagggctatctactag

SEQ ID NO: 19690 - DNA, 591 bp, Artificial Sequence
  Description of Artificial Sequence: Synthetic coding sequence
atggaggagcggaccatcaccatcgagatccccgaggtgctgaagaagcagctggaagatgattgctactatatcaacagaaggaaacgcctggtaaaactaccctgccagaccaatataatcaccatactggaatcatacgttaaacacttcgcgatcaacgcagcattttctgcaaatgaaaggccacggcaccaccatgtgatgcctcatgcgaacatgaacgttcactacattcccgccgagaagaatgtagacttgtgtaaagaaatggttgatggactgcggataacttttgattacactctcccactggtcctgctgtacccttatgagcaggctcagtataagaaggtcacaagcagcaagtttttcctgcctattaaagagtccgcaacctccactaatcgctcccaggaagagttaagtccctccccgccactgctgaacccaagcactcctcagtctacagaaagccagcccacaacaggagagcccgcgacaccaaaaaggcgaaaagctgagccagaagcactgcagtccctccggcgatccaccagacattctgctaactgcgatcgccttagctag

SEQ ID NO: 19691 - DNA, 1068 bp, Artificial Sequence
  Description of Artificial Sequence: Synthetic coding sequence
atggaggagcggaccatcaccatcgagatccccgaggtgctgaagaagcaacttgaggatgactgctattatattaaccgaaggaaaaggctagtgaagttgccatgtcagacaaatatcatcaccattctcgagtcctacgtgaagcatttcgcgattaacgcagccttcagcgcaaacgaacgaccccggcaccaccacgttatgccgcacgcgaacatgaatgtccactacataccggcggagaagaacgtggatctctgtaaggaaatggttgatggcctgcgtataaccttcgattacacacttcccttagtgctgctgtatccctatgagcaggctcagtacaagaaagtgacctcgtctaaattctttttgcccatcaaggaatctgccacaagtacgaaccgttcccaggaggagctgagtcccagccctcctctgcttaatcccagcactccccaaagtactgaatctcaacccacaacaggagagcctgcaacccctaagcgaaggaaagcagaacccgaagcccttcaatcactgcgccggtccaccaggcactcggccaattgtgataggctgagtgaatctagcgcatccccacagcctaagaggcgccagcaagacacttctgcatcaatgccaaagctattcctacatctagaaaagaagacaccggtgcattcaaggtcctcttccccaatccctctgactccctcgaaagaagggtccgccgtgttcgcagggttcgaaggcaggcgcaccaacgaaattaacgaggtgctctcttggaaactcgtgcccgacaactacccacctggagatcagccccctccccccagttacatctatggggctcagcacctgctgcgcctgttcgtcaagctgccagaaatcctcggaaagatgtctttttctgagaagaacctcaaagcactgctcaaacatttcgacctgttccttcgcttcttagctgaatatcacgacgacttttttcccgagtccgcatatgtggctgcatgcgaggcgcattacagtacaaagaatccgcgcgcaatctactag

SEQ ID NO: 19692 - DNA, 1530 bp, Artificial Sequence
  Description of Artificial Sequence: Synthetic coding sequence
atgagccccagcgtgcggcccggcgccggctgggcccccgtgggcaggccaggtcgccccatccagatcgtggatgtgattgtcgggaaagatgagaaagggcgtaaaattccagagtacttgatacacttcaacggctggaaccgcagttgggacagatgggccgccgaggaccatgtgctgagggatactgatgagaatcggcggcttcagagaaagttggcccgaaaggccgtagccagattaaggtcgacaggccgaaagaagaaacgctgccgattgccaggcgtggattcagtgttgaaagggttgcccacagaggagaaggatgaaaacgacgaaaattcactgtcctcaagtagcgactgtagcgagaacaaggacgaagagatctctgaagagagcgacattgaagagaaaacagaagtgaaggaagaacccgaactgcagacacggcgggaaatggaagagcgaacgatcactatcgaaattccagaggtgctgaaaaagcagctcgaggacgactgctactatattaataggagaaaacgtctagtgaaactcccatgccagacgaatatcataaccattctggaaagctatgttaaacacttcgctatcaatgccgccttttctgccaatgagaggccacgtcaccaccacgtgatgccacacgctaacatgaatgtgcactatattccagccgaaaaaaacgtggacctgtgcaaggagatggtggatggcctgaggatcacctttgactacaccttgccactggtgctgctatacccatatgaacaagcacagtacaaaaaggtgaccagtagcaaattctttttacctatcaaggagtctgctacatctactaatcgcagccaggaagagctgtccccatcccctcccctgcttaacccttccactccccagtcgaccgaatcccagcctactacgggagagcccgccacgcctaaaaggaggaaggcagaaccagaagccttgcagagcctgcgcaggagtaccaggcattcagctaactgtgatcgcctgtctgaatcatcagcttcccctcagcccaaacgtaggcagcaggatacttctgctagcatgcccaaattattcctgcacctagaaaaaaagacaccagtgcactctcgctctagctcccctatacctctgacaccatccaaggagggttcagcagtcttcgctggttttgaaggacgccgcacaaatgagattaatgaagtcctgagctggaagttagttcctgacaattatcccccgggagatcagcctccccctccatcatacatatatggagcgcagcacctgttgcgcttgttcgttaaacttcctgagatcctgggcaaaatgtcattctccgagaagaacctcaaagccttactcaagcatttcgacctgttccttcgcttcctggccgagtaccatgatgatttctttccagagtccgcatacgtggcagcatgtgaagcccactactctacaaagaatcctagggcaatttattag

SEQ ID NO: 19693 - DNA, 60 bp, Artificial Sequence
  Description of Artificial Sequence: Synthetic coding sequence
atggaggagcggaccatcaccatcgagatccccgaggtgctgaagaagcagctggaatag

SEQ ID NO: 19694 - DNA, 1842 bp, Artificial Sequence
  Description of Artificial Sequence: Synthetic coding sequence
atggccgcccaggccgccgccgccgcccaggccgccgccgcccaggcagcccaggcggaggcagcagattcatggtacctggcgctgcttggctttgctgagcacttccggacctcgtctccacccaaaatacgattatgcgtccactgtcttcaagcggtgttccctttcaagcctcctcagcgcatagaggcacgtacccatctgcagctgggttccgtcctataccaccataccaaaaacagtgagcaggctcgtagccatctggagaaagccgggtcactaagccagcagatcccccagttcgaggatgtgaagttcgaagccgcgtcactgctgagtgaattgtactgccaggagaattccgtggacgctgctaagcccttgctaaggaaggccattcagatatcacagcagaccccctactggcactgccgcctgttattccagctggcccaactccatacgcttgaaaaggatctcgtcagcgcatgtgacctactgggcgtaggagctgaatacgcgagagttgtaggttccgagtacacccgagccctttttcttctgagtaagggaatgctgcttttgatggaaaggaaactgcaagaggtgcatccgctattgaccttatgcgggcagatagtggaaaattggcaggggaatccaatccagaaggagtctctgagagtgtttttcttagtgcttcaagtgacccattacctcgatgccggacaagtgaaatcagtgaagccttgcttaaagcagctgcagcagtgcattcagaccatctcaactctccatgacgacgaaatccttcctagtaaccccgctgacctcttccactggctgccgaaagaacatatgtgcgttttagtatatctggtaactgtgatgcatagcatgcaggcaggctacctcgagaaggctcaaaagtacactgataaggcccttatgcagcttgagaagctaaaaatgttggactgcagtcccattctgtctagcttccaggtgatcctgttggagcatattataatgtgcaggctggtcactgggcataaagcaaccgccctgcaggagatctctcaggtgtgccagttgtgccagcagtcgccgaggctgttctctaaccatgcagctcagcttcacacgctgctggggctttattgcgtgtcggtaaattgtatggacaatgccgaagctcagtttactaccgctctgaggttgacaaaccaccaggagttatgggcatttatagtcacaaatttggctagcgtgtatattagagagggaaaccgccaccaggaggtgctatactccctgctggagcggattaaccccgaccattctttcccagtgagctcacactgcctgcgagctgcggcattctacgtccggggattgttctcattcttccagggacggtacaacgaggcaaagaggtttctgcgagagacactgaaaatgagtaatgccgaagatcttaaccgcctaacagcttgctctcttgtgctcctaggccatatattttacgttctgggaaatcatagggagtctaataacatggtggttcctgccatgcagttggctagcaaaatacctgatatgtcagttcagctttggtcatctgccctacttagagacttaaacaaggcgtgcggaaacgccatggatgctcacgaggcagcccagatgcaccagaatttcagtcagcagctgctgcaggaccacattgaagcatgctctctgcctgagcacaatctgatcacatggacggatggcccaccacccgtgcaattccaagctcaaaacgggcctaatacatctctagctagtctgctctag

SEQ ID NO: 19695 - DNA, 504 bp, Artificial Sequence
  Description of Artificial Sequence: Synthetic coding sequence
atgcccatgaagcccccccggtgcacccggaccagccggagcagctgctccaggacgacactacgaccagctgcctcccctaacacaacatctagtcggggccagacagtgcaccctccgtgctcatccaagttgagaatggaccctaccccagcctggcccgcctcttgcgaagcacttatgggtccaagctctagcgctggtccggctcgactcagacttcctccccgacgccattcctccctgccacccaggcgggcctcctttcttattgtgagcagagcctccaagagttgggagtgtgctggtcctgtgccagcactaccaggcggcgttgtcgccgtgcctacaagtcaacaggatcctcagtgtaggggcagccaggttgcccatcgccgctgtctttctcgggcgatcctgcagtccggaccgcagtgccagtcatgcctgtcaatctgggtaacctctgcccgctcgcgcgtgcaggcctcctctcgttcatag

SEQ ID NO: 19696 - DNA, 1842 bp, Artificial Sequence
  Description of Artificial Sequence: Synthetic coding sequence
atggccgcccaggccgccgccgccgcccaggccgccgccgcccaggccgcccaggctgaggccgcagatagctggtacctggccctgctcgggtttgccgagcacttccgtacctcttcaccgccgaagatccggctctgtgttcactgccttcaggccgtctttcctttcaaaccgccacagcgtatagaggcccgcactcacttgcagctgggcagcgtgctgtatcaccacactaagaatagtgagcaggcccggagtcacttagagaaagcatggctaatctcccagcagattccccaattcgaagacgttaaattcgaggcagcctcgctgctgagcgagctctactgccaggaaaattccgtagatgcggcgaaacccctcttgagaaaagcgattcagattagtcagcagaccccttattggcactgtcgactgctctttcagttggcacagttgcacactttggagaaggacctggtgagtgcctgtgacttgctgggcgtcggggctgaatatgctagggtggtgggttctgagtatactcgggctcttttccttctgtctaagggtatgctcctcttgatggagagaaagctgcaggaggtgcacccactgctcactctgtgtggccagattgtcgagaactggcaggggaatccgattcagaaggagtcccttcgcgttttttttctggtactgcaggtgacacattatctcgatgccggccaggtcaaatcagtcaagccctgtctcaaacagttacagcagtgtattcagacaatctcaacgttgcacgatgacgaaattcttccctccaatcccgctgatctgtttcattggctccctaaagagcacatgtgtgttctggtttacctggtgactgttatgcactccatgcaggctggatacctggagaaggcgcagaagtataccgataaagcgctgatgcagttggagaagctgaaaatgctggactgcagcccaattctgtcctcattccaggtcatcctcttggagcacattatcatgtgtaggctggtgactggtcacaaagcaaccgcactgcaggaaatctcacaggtctgccaactgtgccagcagtcacctaggctgttttccaatcatgctgcacagctgcatactctgctgggcctctactgtgtatccgtcaactgcatggacaacgcggaggcacagtttaccaccgctttgcgcctgacgaatcaccaagaattgtgggccttcatcgtcacgaatctcgccagcgtgtacatccgcgagggcaatcgtcaccaggaagtcctgtattcactgctggagagaattaatccagatcactcgttccctgtgtctagccactgtctcagggctgccgccttttacgtgcgcggattgtttagcttcttccagggccgctataacgaagccaagcgctttctgcgcgagaccctgaaaatgagcaatgccgaggatttaaacaggctcacagcatgtagcctggtgttactaggacacatcttctacgtattaggcaatcatagagagtcaaacaacatggtggtgcccgcaatgcagctagcttcgaagatccccgacatgtctgtgcagctctggagttcagccctgttgcgcgacttgaacaaagcctgtgggaacgccatggacgcgcacgaggcagctcagatgcaccagaacttctctcagcagctccttcaggaccatatcgaggcctgttccctcccggaacacaatcttataacttggaccgacggtcccccccccgtccagtttcaggcccagaatggccccaacacctcactggcgtcactgctctag

SEQ ID NO: 19697 - DNA, 504 bp, Artificial Sequence
  Description of Artificial Sequence: Synthetic coding sequence
atgcccatgaagcccccccggtgcacccggaccagccggagcagctgctccagaacgaccctccgcccagctgcttccccgaacactaccagctctaggggacagaccgtgcaccctccctgctcctcaaagcttcgcatggaccccactccagcctggcctgctagttgcgaggctctgatggggccatccagttccgccggccctgcccgccttaggctccctccaagaagacatagctcacttcctcctagaagggcaagctttctcatcgtgtctcgcgccagtaagagctgggagtgcgcaggccccgtgccagctctcccaggtggagttgtcgcagttcctacctcacaacaggatccccagtgccggggctcacaggttgctcaccggcgatgtttatcaagggctattcttcagagtgggcctcaatgtcaatcctgtctgtctatttgggtgacttcagcccgttcacgggtgcaggcctcctcccgttcatag

SEQ ID NO: 19698 - DNA, 426 bp, Artificial Sequence
  Description of Artificial Sequence: Synthetic coding sequence
atgagcagccccccccacagcggccagaccgtgcaccccccctgctcttctaagctccgaatggaccccactccagcctggcctgcatcctgtgaggcgttgatgggccccagctcttctgccggacccgcaaggctgcgtctgcctcccagaaggcactcaagcctgccgccacggagggcatcgtttctaatcgtaagtcgggccagtaaaagttgggaatgtgccggccccgtgcctgccctgcccggcggcgtggtggcagtccctacctcacagcaggaccctcagtgtaggggctctcaagtcgctcatagacgctgtctgagccgcgccatattgcagtctggaccccagtgtcagagctgcctttctatttgggtgactagtgcccggagccgcgtgcaagcaagcagcaggtcatag

SEQ ID NO: 19699 - DNA, 666 bp, Artificial Sequence
  Description of Artificial Sequence: Synthetic coding sequence
atggccgccgccgtgcggatgaacatccagatgctgctggaggccgctgactacttagagcgccgggaacgggaggcagagcatgggtatgctagtatgctgccctacaacaacaaagatcgagatgccctgaaacgccgaaacaagagcaagaagaacaactcatcctcacgctcaacccataatgagatggagaagaatagacgtgcgcacctgaggttgtgtctggaaaagctgaaagggcttgtgccattgggtcccgaatccagtcgacatacaactctctccttgctgaccaaagctaagctgcacattaagaagctggaggattgtgaccgaaaggcggtccatcagatcgatcagctgcagcgagaacagcgccatctgaagaggcaactggagaaactgggcatagagcgtattagaatggatagcatcgggtccaccgtgtccagcgagcgatcggattccgaccgggaggagattgatgtggacgtggagagtacagactatctgactggtgacctggactggagcagctcttcagtctcagactctgatgaaagaggtagcatgcagagcctcggaagcgatgaagggtacagttctacaagtatcaagcggatcaagttgcaggacagccacaaggcgtgtctcgggctgtag

SEQ ID NO: 19700 - DNA, 636 bp, Artificial Sequence
  Description of Artificial Sequence: Synthetic coding sequence
atggccgccgccgtgcggatgaacatccagatgctgctggaggccgccgactacctggaacgcagggagagggaagccgagcacggatatgcctctatgctgccctacaacaacaaagatagggacgccttaaagagacgaaataagagtaaaaagaacaattctagctcaaggcgggcgcaccttcgcctgtgtctcgagaaactgaaggggcttgtgccgttagggcccgagtcaagtcggcacaccacactctccctgcttacgaaggctaagctccacattaagaaactcgaagattgcgacaggaaggcagtgcatcagatcgatcagctccagcgggagcaacggcacctaaagcgccagttggagaaactcggcatcgagagaatcaggatggattctatcgggtctaccgtgtccagcgagcgaagcgactccgaccgagaagagattgacgtcgacgtcgagtcaacagattacctcactggtgacttagactggtcttcatcttcagtgagcgacagtgacgagagagggagcatgcaaagcctcggttcagatgagggttattccagcaccagtatcaagagaatcaagctacaagactcacataaagcctgcctgggcctctag

SEQ ID NO: 19701 - DNA, 630 bp, Artificial Sequence
  Description of Artificial Sequence: Synthetic coding sequence
atggagctgaacagcctgctgatcctgctggaggccgccgagtacctggagagacgcgaccgggaggccgagcatgggtacgctagcgtgcttccctttgacggagacttcgcacgcgagaagacaaaagccgccggactcgttcggaaagcccccaataataggtccagtcacaacgagcttgaaaaacacaggagagcaaagcttcgtctatacttggagcagctcaaacaacttgtcccactaggccccgatagcacccgccatacaactctatcactgctgaaacgcgccaaggtccatatcaagaaactggaggagcaagatcggcgcgccctgtcaatcaaggaacagctccagcaagagcatagatttcttaagcgcagacttgagcaactgtctgtgcaatccgttgagagagtccgaacagacagcacagggtctgccgtttccaccgacgattctgagcaagaggtcgacattgagggaatggaatttggcccaggggaactggattctgtcgggtcctcctcggatgccgatgatcactattcattacagagcggcaccggcggcgactccgggtttggccctcactgtcggcggctgggaagacccgctctatcatag

SEQ ID NO: 19702 - DNA, 177 bp, Artificial Sequence
  Description of Artificial Sequence: Synthetic coding sequence
atggagctgaacagcctgctgatcctgctggaggccgccgagtacctggagcgtcgggaccgcgaggcagagcacgggtatgctagcgtgcttcctttcgatggcgattttgcaagggaaaaaacaaaggccgcagggcttgtacgcaaggcacctaacaatcggccaccacagtag

SEQ ID NO: 19703 - DNA, 1293 bp, Artificial Sequence
  Description of Artificial Sequence: Synthetic coding sequence
atgttcgacggctacgacagctgcagcgaggacaccagcagcagctcatccagtgaagaatctgaggaggaagtggcaccccttccttcaaatctgccaataatcaagaacaatggccaggtttacacctaccccgacggaaagtcggggatggcaacttgtgagatgtgtggcatggtgggggtacgggacgccttttactccaaaactaagcgcttttgtagtgtgtcatgttcccgatcttattcctctaactccaaaaaggcttcaatactggcgcgtctccagggcaaacctcccacgaagaaagcaaaagtgctgcagaaacagcctctcgtcgctaaactggcagcctatgcacagtaccaagcaactctgcagaaccaagcgaaaacaaaggcggcagtaagcatggagggattcagctggggcaattatatcaattccaattcatttatcgctgcgccagttacctgctttaaacacgccccaatggggacatgttggggagatatatctgagaatgtgcgggtggaagtgccgaataccgattgttccctccctacaaaggtcttttggattgcgggaatcgttaagctcgctggctacaacgctctcctccgctacgaggggttcgagaatgatagcggacttgacttttggtgtaatatatgcggcagcgacatccacccagtgggctggtgcgcggcctctggaaagccattggtgccaccccgcaccattcaacacaagtacacgaactggaaagcttttctagtgaaaaggttgacaggcgcgaagaccctgccccccgacttttctcaaaaggtgagtgaatcaatgcagtacccctttaaaccttgtatgagagtggaggtggtggataaacgccacctttgtagaaccagggtcgccgtggtggagtcagttatcggggggcggcttcggctggtctacgaagaatcggaagaccgaaccgacgacttctggtgccacatgcactctcccttaatccaccacattggttggagccgatctattggacacagatttaaacggtcagatattactaaaaagcaggatgggcactttgacacgccaccacatctgttcgcaaaggtgaaagaggtagaccagagcggggagtggtttaaggaggggatgaagctggaggccatcgacccattgaatctgtccaccatttgtgtcgccaccattagaaaagtgactcagaattttctcctcaacggtctcaccactagcggcaaactcgccccactacagcaccaatag

SEQ ID NO: 19704 - DNA, 1887 bp, Artificial Sequence
  Description of Artificial Sequence: Synthetic coding sequence
atgttcgacggctacgacagctgcagcgaggacaccagcagcagcagttcatctgaggagagcgaggaggaggtagctcccctcccaagcaatctgcccatcatcaaaaataacggccaggtgtatacttaccccgacggcaaaagcggaatggccacctgcgaaatgtgcggaatggttggagtgagagacgcattctacagtaagacaaagaggttctgcagtgtttcttgttcccgatcatacagcagtaatagcaagaaagcgagtatcctggcacgccttcagggcaagccacctacaaaaaaggccaaagttctgcagaagcagcctctagtggctaaactggctgcctatgcgcaatatcaagcgactctgcagaatcaagcgaaaacaaaagcagcagtgtcgatggagggattctcttggggaaattatatcaactcaaacagtttcattgcagcacccgtcacgtgttttaagcacgccccaatgggaacctgctggggagacatctccgaaaatgtgcgggtggaggtcccaaacacagattgctccctgcctacgaaggttttttggattgcaggcatagtcaaacttgccgggtataacgcgctccttagatacgaagggttcgagaatgattcaggactggatttctggtgtaatatttgtggatcggacatccatccagtgggctggtgcgccgccagtgggaagcccttggtgccccctcggacgatccagcacaagtataccaattggaaggcttttctcgttaaacgactcacaggggccaaaaccctgccacctgacttttcgcagaaggtatccgaatctatgcagtacccctttaaaccttgcatgcgagtggaggtggtggataagcgacatctctgccgcacccgagtggcagtggtggagtcggtgattggagggaggttgcgtctcgtctatgaggagtcagaggatcgcaccgacgacttttggtgccatatgcacagcccacttatccaccacattggatggtctaggagcatcggacatcggtttaagcgcagcgatataactaagaagcaggatggccacttcgacactccaccgcacctgtttgcaaaagtgaaagaagtggaccagagtggcgaatggttcaaagagggcatgaagctggaagctatcgatcctttgaacctctcaaccatctgtgtggccaccatccgcaaagtgctagcagacggcttcctgatgattggcatagatggctccgaagccgccgacggttccgactggttttgttaccatgccacttctccgagtattttcccagtcgggttctgtgagattaatatgatcgagctcacgccaccacggggatataccaagctgcctttcaaatggttcgactaccttcgtgaaacggggagtatcgctgcccccgtcaagctcttcaacaaagatgtgcctaaccacggattccgagttggcatgaagctggaggctgtggacctcatggagccaagactcatttgcgtcgccaccgttactaggatcattcaccgactgctgcggatccacttcgatggatgggaggaggaatacgaccagtgggtagactgtgaatctcccgacctgtatcctgtgggatggtgccagctgacggggtaccagcttcagccccctgctagccagtcatccagagaaaaccagtccgcatctagtaaacaaaaaaagaaagccaaatctcagcaatacaaaggccataagaagatgacaacactacagctcaaggaggagttgcttgacggcgaggattataattttctgcagggggcctccgaccaggagagtaacggatcagccaacttctacataaagcaggagccttag

SEQ ID NO: 19705 - DNA, 1887 bp, Artificial Sequence
  Description of Artificial Sequence: Synthetic coding sequence
atgttcgacggctacgacagctgcagcgaggacaccagcagcagcagttcctcagaagagagcgaagaggaggtggcccccttgccaagcaacctgccgatcatcaagaacaacggacaggtgtacacctacccagacgggaagagtggcatggccacctgcgaaatgtgtgggatggtgggtgtgcgcgacgctttctatagcaaaacaaagcggttctgctccgttagctgttcccggtcatacagctctaatagcaaaaaagcatccatactcgcccgcctgcaagggaaacctcctactaagaaggctaaagtattgcagaaacaaccactcgtggccaagctggcagcttatgcacaatatcaggccacattacagaaccaagccaagacgaaggcagcagtgtccatggagggttttagctggggaaattatattaacagcaactctttcatcgcagcgcctgttacgtgttttaaacacgcccctatgggcacctgctggggagatatcagcgagaatgtgagggtggaagttcccaataccgattgcagcctgcccactaaggtgttctggatcgccggaattgtcaaactcgctggctacaacgcgttacttcgctatgaaggcttcgaaaatgactcaggtctggatttctggtgtaatatctgtggatctgacattcatccggtgggctggtgtgccgcttctggcaagcccctcgttcctcccaggacaattcagcacaagtacaccaactggaaggcgtttttggtcaagcggttaactggagctaagacgcttccacccgacttttcacagaaggtgtccgagagcatgcagtatccattcaagccatgtatgcgcgtagaagtcgtcgataagaggcacttgtgtagaacccgcgtggctgtggtcgagtcggtgatcggggggaggctgagactggtgtatgaagagtccgaggataggaccgacgacttttggtgccacatgcattctccactgatccaccacatcggctggagtagatcaatcgggcatcggttcaaacggagcgacatcactaaaaagcaagacggccacttcgatacccctccccacctcttcgccaaggtcaaggaggtagatcagagtggcgagtggtttaaagaaggaatgaaattagaggcaattgaccctcttaatctgtctaccatttgtgtggccacaataagaaaggtgctcgcagacggctttctcatgatcggaatcgatggatctgaagcagcggatggatccgactggttttgctatcatgccacctcaccctctatcttccccgtgggattttgcgaaattaacatgattgagcttaccccgcccagggggtacactaagctgccatttaaatggttcgactaccttcgcgaaactggcagtatcgctgcccccgtaaaactgtttaataaagatgtgcccaaccacggcttccgtgtggggatgaaacttgaggcagtggacctcatggagcccagactcatatgcgtggctaccgtcacaagaattattcacaggcttcttcgtatacacttcgacggatgggaagaagaatatgaccagtgggttgactgtgagtctcctgatctgtatccagtaggatggtgtcagcttactggctaccaactccagccaccggcctcgcaatctagtcgggagaaccagagcgcttccagcaaacagaagaaaaaagcgaagagccagcaatacaaggggcacaaaaagatgacaacactccagttgaaggaggagctcctggatggggaggactacaattttctccaaggagcgtcggaccaggagtcgaacggtagtgcgaatttttatatcaagcaggagccctag

SEQ ID NO: 19706 - DNA, 1887 bp, Artificial Sequence
  Description of Artificial Sequence: Synthetic coding sequence
atgttcgacggctacgacagctgcagcgaggacaccagcagcagcagctcatcagaggaatcagaagaagaggtagcaccactcccaagtaatttgccaattattaagaataatggccaggtgtacacctatccagacggcaaaagtggaatggccacttgtgaaatgtgtggcatggtcggggtacgagatgctttctacagcaagaccaaacgattctgttccgtttcatgcagccgatcttattcctcaaacagcaaaaaggctagtatactagctaggctccagggcaaacctccaaccaaaaaggcgaaggtccttcagaaacaacctctggtagccaagctggcggcttatgcccagtatcaggccacactccaaaaccaggcaaagacgaaggctgctgtgagcatggaaggattttcttggggtaattatattaactccaactcattcattgctgccccagtgacatgtttcaaacatgcccctatggggacctgttggggtgatatcagtgagaacgtgcgggtagaagttcctaacaccgactgcagtttacccaccaaggttttctggatcgctggaatcgtgaagctagctggttacaatgcactcctccgctacgagggtttcgaaaacgattcaggtctcgacttctggtgcaacatttgcggcagtgacattcaccccgtggggtggtgtgccgctagcggcaaacctctcgtcccaccgaggacgattcaacataaatatactaattggaaggcgttcctcgtaaagcggctgaccggagctaaaacactccccccggatttttcccagaaggtcagcgagagtatgcagtacccctttaaaccatgtatgagggttgaggtggtcgacaaacgccacctctgtaggacccgggtggccgttgtggagtcagtgatcggcggtcggcttcgactcgtgtatgaagagtctgaggacagaacagatgacttctggtgtcacatgcatagcccactgatccatcatattggatggtccaggagcatcggccaccggttcaagagaagcgacatcacaaaaaaacaggacggtcattttgacacacctcctcaccttttcgctaaagttaaggaggtggaccaaagcggagaatggttcaaggaggggatgaagttggaagcaatcgacccgctcaatctgagcaccatctgcgtcgcaacaatccggaaggtgctcgctgatggctttctgatgatcggaatcgacgggtctgaagccgcagacggtagcgactggttctgttatcatgccacaagtccatctatattcccggttggcttctgcgaaattaacatgatcgagctcaccccccctaggggttacacgaaacttcctttcaaatggtttgattatttgcgggaaactggctccattgcagctccagtcaagctgtttaataaagacgtcccgaaccatggctttcgagtgggcatgaagctggaggctgtggacttaatggaaccccggctaatatgcgtggcgacagttactcggatcatacaccgactgctgagaattcactttgacgggtgggaggaggaatacgaccaatgggttgattgcgaatcaccggacctctatccagtaggttggtgtcagttgaccggttaccagttacagccccccgcctcacagtcatcccgggagaaccagagtgcatctagcaagcagaagaaaaaggctaagagccaacagtataagggacacaagaagatgactacactgcagctaaaggaagaactgctggatggtgaggactacaacttcctccaaggcgcctctgatcaggagtccaatgggagcgccaatttctacatcaagcaggagccctag

SEQ ID NO: 19707 - DNA, 16791 bp, Artificial Sequence
  Description of Artificial Sequence: Synthetic coding sequence
atggagcacttcctgctggaggtggccgccgcccccctgcggctgatcgctgcaaaaaatgagaagagtcgaagtgagcttggacggttcctagcgaagcaggtctggacacctcaggaccgtcaatgcgtgttaagtaccctcgcacagcttcttctggataaagactgcaccgtgttggttgggcgccagctgagaccacttctgctggacctgcttgagaggaatgccgaggcgatcaaggcagggggtcagatcaatcatgatctgcacgagagactgtgtgtgtctatgagcaaactgataggcaaccaccctgacgtgttgcctttcgctctgcgctactttaaagacaccagcccagtgtttcaacgactttttctagagtcatcggatgcaaaccccgtaagatacgggcgacggcgaatgaagctcagggacctgatggaggccgcgtttaagtttctccagcaggaacagtctgtcttcagggagctctgggactggagcgtttgtgtgcccttgctgcgcagccacgacactctggtgagatggtacactgcaaactgtctggcactggttacctgtatgaacgaggaacacaaactcagcttcctgaagaaaatattcaattctgacgagcttatacattttaggttgcggttactggaggaggcccagctgcaggacttggaaaaggctctcgtgttggcaaaccccgaggtgtccctatggcgcaagcagaaggaattacaatacctccaaggccacctggtttcctctgacctctctccccgggtcaccgcggtatgtggggttgtgctcccggggcaactacctgcaccaggagaactggggggcaaccgaagcagttcgagggagcaagagctcgctcttagatcatatgtgttggttgaatccgtgtgcaaatcactacagaccttggctatggccgtcgcgagccagaatgccgtgctcctggagggccccatcgggtgtggcaagacaagccttgttgagtacctcgctgctgtcacgggtcgaactaaacccccacagctcctgaaggtgcagttgggcgatcagacagacagcaagatgctgttgggaatgtacaggtgtactgacgtccctggggagtttgtgtggcagccggggacccttacccaggcagcaacgatgggccactggatccttttggaggacatcgattatgccccactggacgtcgtgtctgtgctcatccccctgctggagaacggagaactgcttatccctggcaggggcgactgccttaaagtcgccccaggctttcagttctttgcgactcggcgactcctctcatgtggcggtaactggtacaggccgctcaactcccacgcaactctcctggacaagtattggaccaaaatacacctggataacctagacaaacgggagctgaacgaagtgttgcagtcaaggtacccctctctattggcagtcgtggatcacctgctcgacatttatatccagttaacaggcgaaaagcaccactcttggagcgatagtagtgtgggctgcgaacaggcgcctgaagaggtgtctgaggctcggcgggaaaataaacgtccaacactcgaaggccgtgagctctctttacgcgatctgctgaactggtgtaatagaattgcgcatagtttcgacagcagttcccttagcgctagtttgaacattttccaagaagccctcgattgttttaccgccatgctttctgagcatacttcgaagcttaagatggccgaagtcattgggtcaaagttgaacattagccgcaagaaagccgagttcttctgtcagctttataaacccgagatcgttatcaatgagctggacctgcaggtggggagggtcaggttgctgcgcaaacagagtgaggctgttcatctacagcgcgagaaatttacattcgcagccaccaggccatcctccgtgttaattgagcagctggccgtgtgtgtaagtaaaggcgagcctgtgctgctggtaggcgagacaggcactggaaaaacgagcaccattcagtatctcgcacatattactggccatagactgcgagtggtcaacatgaaccagcagtctgacaccgctgatttgctcggtggctataaacccgtggatcataaactgatctggcttccacttcgcgaggccttcgaagagctgtttgcacaaactttctccaagaagcagaattttacattcctgggacacatccaaacctgttatcgccagaagcggtggcacgatctgctaaggcttatgcagcatgtgcacaagagtgcagtgaataaagacgggaaagacagcgaaaccggactactcatcaaggaaaaatgggaagcattcggcttacggctgaaccacgcgcagcagcagatgaagatgactgaaaacaccttgcttttcgcgttcgtggaaggcacacttgcccaagctgttaagaagggtgagtggatccttttggatgagatcaatctggctgctcctgaaattcttgagtgtctgagcggccttcttgagggtagctccgggtctctggtcctactcgataggggagatactgaaccactcgttcgtcaccccgatttcagactattcgcctgtatgaatccggcaaccgatgtcggtaagaggaatctcccgccaggaatacgtaacagattcacagagttgtatgtcgaggagctcgagagcaaggaagacctgcaggtgctgattgtcgactacctgaaaggcctcagcgtgaacaaaaacactgttcagggcattattaacttttacacggccctgagaaaggagtctgggacaaaattagtagatgggactggccacaggccgcattatagcctgaggacactatgtagggccctgcgcttcgccgcgtccaatccatgtgggaatatacagcggtccctatacgaggggttctgcctggggtttctgactcagctggatcgggcctcacaccctatcgtccaaaaactgatctgtcagcatattgtacccggcaacgtaaagagccttctgaagcagcccatccccgagccaaagggggggcggctgattcaggtggagggatattggatcgctgttggagataaagagcccaccatcgatgaaacatacatcttaacctcaagcgtcaagctgaacttgcgagatatcgtgcgagtcgtctccgcagggacataccctgtcctaatccagggggagacctcagtgggcaaaacgagtcttatccagtggttggccgccgccacaggcaaccattgcgtacgaatcaataaccatgagcatacagacatacaagagtacattggctgttatacgtctgactctagtgggaagctcgtgtttaaggaaggtgtactgattgacgctatgaggaagggttactggatcattctcgacgaactgaacctggctcccaccgacgtgctggaggctttgaatagactgttggacgacaatcgggagcttcttgtaaccgagactcaggaggtggttaaagcccatcccagatttatgcttttcgctacccagaatccaccgggcctgtatgggggtaggaaggtcttaagccgcgcttttcgcaatcgctttgtggagctgcacttcgacgagctcccttcttctgaactggaaactattttgcacaaaagatgttccctgccaccctcttactgctctaaattagtcaaagtgatgttggacctgcaaagctaccgcagatcatcatctgtgtttgctggaaagcagggctttataactttaagggatctgtttagatgggctgagcggtaccggttggccgaacctaccgaaaaagagtacgactggctccaacacctggcgaacgatggctacatgctgctggccggcagagtgaggaaacaagaagaaattgatgtcattcaggaagtgttagagaagcattttaagaaaaaactgtgcccccagtccctgttttctaaagaaaacgtactcaagttactggggaaattgagtacccagatttccacgctggagtgcaattttggccatattgtctggaccgagggcatgcgacgcctggcaatgctcgtcggccgcgcactggagttcggggaaccggtgctgctcgtcggtgatactggctgcggcaaaacgacaatttgccaggtgtttgctgccttggcgaaccagaaactttatagcgtatcatgccatttgcacatggaaacgtccgattttctcggcggactgcgtcctgtcagacagaaaccaaatgacaaagaagaaatcgatactagcaggctgtttgaatggcatgacggacctctggtccaagccatgaaggaagacggattttttctactggatgagatttccctggccgatgattctgttctggaaagactcaactctgtccttgaggtcgagaagtcattggtgctcgctgaaaaaggatctccagaggacaaggactccgagatcgagttgttgacagcaggtaagaagttccgcatcctcgccacaatgaatccgggcggagactttggcaaaaaagaattatcgccggccttacgcaaccggtttacagagatctggtgtcctcagtccacttccagagaggacctcatccagattatatctcacaacctaagacctggcctgtgtctgggcaggattgacccaaagggatccgacatcccggaagtgatgttggacttcattgattggttaacacaccaggagttcgggagaaagtgcgtggtgagtatacgagacattctcagctgggtgaactttatgaacaagatgggggaggaagctgcattgaagaggccagagattataagcacagtcacatcatttgtgcatgccgcgtgcttggtgtacatcgatgggattgggtccggtgtcacctctagtggctttggaaccgccttattggctcgcaaggaatgccttaaatttctaattaagcgcttggcgaagatagtccggctaacagagtaccagaaaaatgaattgaagatctacgatcggatgaaggccaaagaattcactggcatagacaacttgtggggcattcaccccttttttatccctcgtggaccagtgttgcacaggaacaacatcgccgattatgccctctccgctgggactacagccatgaacgcacagaggttactgagggcaacgaaactcaaaaaaccgattctgctggaggggtccccaggagtcgggaaaacatctttggtcggtgcacttgctaaagcctccggaaacacactcgtacgtatcaacctgtcagagcagactgacattacagacctgtttggcgcagacctgcccgttgagggagggaaaggtggcgagttcgcttggagggatgggccccttctcgcagctttaaaagccggtcactgggtcgtgttggatgagctgaacctggcgtcacagagtgttctggaaggcctgaatgcttgctttgaccataggggtgaaatctatgtccccgaactcggcatgagctttcaagttcagcatgagaagactaaaatttttggctgtcaaaaccccttccgtcagggaggaggcaggaaaggactcccaagaagctttctgaatcggtttacacaagtattcgttgaccctctgacagtgattgacatggaattcattgcttccacactctttcctgctattgagaaaaacatcgtgaaaaaaatggtggcctttaacaatcagatagaccatgaggtgacagtcgagaagaagtgggggcagaaaggtgggccctgggagttcaatctgcgcgatttgtttagatggtgtcagttgatgctagtggatcagagtccaggttgttatgacccaggccagcatgtgttcctggtgtatggcgaacgtatgaggacagaggaggacaagaagaaagtgattgctgtttttaaggacgtgtttggatccaactcaaatccatacatgggaacccgtctgttcaggataaccccatacgatgttcagctcggctactctgtgctgtcacgcgggagttgcgtgccccacccatcgaggcaccctcttttactattgcaccagagtttccagcctctcgaaagcatcatgaaatgcgtgcaaatgtcgtggatggtgatactcgtcggccccgcctctgtgggaaaaacctcgttggttcagctgctcgcccacctcacggggcacacactcaagattatggccatgaactccgcgatggataccacagaactgctagggggtttcgaacaggtggacttgatccggccatggcggcgccttctagaaaaggtagagggcaccgttagagccctgctaagggatagtctgttgatctcagcagacgatgcagaggtagtgctgagggcttggagccattttttgctgacgtacaaacctaagtgcctcggtgagggcgggaaagccattacaatggagattgttaataaactcgaggctgttttactgctgatgcaacggctgaacaacaagattaactcttattgcaaagccgagtttgctaagctcgtggaagaattccggagtttcggggtgaaacttactcagcttgcatccggtcacagtcacggtaccttcgaatgggtcgattccatgctggtccaggccctgaagagcggtgattggttactgatggacaatgttaacttctgcaacccctctgtgctggataggctcaacgctctgctggaacctggcggcgtgctgactatatcagaacggggcatgatcgatgggagtacacctacgataactcctaaccccaattttaggctgttcctgtctatggaccctgtgcacggggatatatctcgtgctatgaggaaccgaggcctggagatctacatttctggcgagggggatgcctctacccctgacaatctggacctaaaagtccttcttcattcactggggctcgtcggtaactcagtttgcgacattctcctggctcttcacactgagacaaggtcgaccgtggtgggatcccctactagcagcgtgtcaacgctgattcagactgccatccttattgtgcaataccttcaacggggattgtcactagacagggccttctccgaggcgtgttgggaggtgtacgtgtgctcacagcacagccctgctaaccggaagttagtacaggcactgcttgagaaacacgtgtcgagtttgagggctcacgaaacgtggggggattccatcctcggcatggggctatggccagacagcgtgccgtctgcgttgttcgctactgaagattcccacctgagtacagtcaggcgggacggccagatcttggtctattgcctgaacagaatgtccatgaagacctcaagctggacccggtcacagccatttactctccaagatctcgaaaaaatcatgcagtctccttccccagaaaacctgaagtttaacgctgtggaggttaatacttattggatcgatgaacctgacgttttagtgatggctgtaaagctgctgattgaacgcgcaactaaccaagactggatgttgagggtgaaatggttatatcatctcgccaagaacatcccccagggcctcgagtcaatccagattcacttggaggccagtgccgcctccttgcgcaacttttattctcacagcctcagtggagcggtttctaacgtttttaagattttgcagcctaacacgaccgacgagtttgtcataccgctcgacccaaggtggaatatgcaagcactggatatgattcggaacctcatggactttgaccctcaaacagatcagcccgatcaactgtttgcactgctcgagtctgccgcgaacaagacaattatttacctggatcgcgagaagcgggtgtttactgaagctaacctagtgagtgtcggctcgaagaagctgcgcgaaagtgtgcttcggatgagctttgagtttcaccaggatcctgagagctatcacactcttccacacgagatcgtcgtgaaccttgccgcattttttgaactttgtgacgccctagtacttctctgggtgcaatcatctcaggggatggtgtctgatgcctctgctaacgaaattctcggatcactgcgttggcgcgataggttctggactgtcgctgacacggtgaaggttgatgcccctggcttagccctgttagccctccactggcactgggtgctcaaacatttagtccatcagatacccaggctgctgatgaactacgaggacaagtattataaagaggtacagaccgtgtcagaacacattcagaactgcttgggctcccagacaggcgggtttgctggaatcaaaaaactccagaagtttcttggaagaccatttccgtttaaggacaaactggtagtcgaatgcttttcccaactcaaagtgctcaacaaagtccttgccattcgagagcaaatgagcgccttaggtgaatcagggtggcaggaagatatcaaccggcttcaggttgttgcaagccagtggaccctcaagaaaagcttgctccaggcctggggcctgatcctacgtgctaacatactggaggacgtgtccttagacgaactcaagaatttcgtacacgctcagtgccttgagctgaaagccaagggtctgagcctcgggtttcttgagaagaaacatgatgaagcttcttcacttagccatccagaccttacttctgtcatccatctgactagaagcgtccagctctggcccgccatggagtacctcgccatgctgtggcgctataaagttaccgccgatttcatggctcaggcttgcctgcgccgatgcagcaaaaatcagcaacctcagatcaacgaagaaatttctcacctcatatctttctgcctctaccatacccccgtgactcctcaggaattacgcgatctttggagcctgctgcatcatcagaaagtgtcccctgaggaaattacctcactgtggtcagaactgtttaattcaatgttcatgtcattttggagctccactgtcacgacaaatccagaatactggttgatgtggaatccactgcctggcatgcagcagcgggaagcccccaaatcagtgttggactctactctgaagggcccaggaaatttaaaccgtcctatttttagcaagtgctgcttcgaagtcctcacctcctcctggcgcgcatccccatgggacgtgagcgggctcccaatcctatcaagctcccatgtcaccctgggcgagtgggtagaacgcactcaacagctgcaggatatttcatctatgctgtggactaacatggccatttcgtctgtagcagaattccggaggaccgactctcaactccaaggccaagtcctgttcaggcacctggccggattagctgagctccttcccgaatcaaggaggcaagagtacatgcagaattgtgaacagcttttgttgggctcttcacaggcctttcagcatgtcggccagaccctgggggatatggccggtcaggaggtgctaccaaaggaattactctgtcagctgctgactagcctccaccactttgtaggcgagggcgagtcaaagcggagcctccccgaaccggcccagagaggcagcttatgggtaagtctgggtctgttacagatccagacctggttgccacaggccagattcgatccggcagtgaaacgcgagtataaacttaattatgtcaaagaagagctgcaccagctgcagtgtgagtggaaaactcgaaacttgtcttcccagctccaaacgggtcgggaccttgaggatgaggttgtggtgtcatacagtcaccctcacgtgcgactgctgcgtcaaaggatggatagactcgacaatctgacctgtcatctcctgaaaaaacaggcctttcggccacagctccccgcatacgagagtcttgtgcaggaaatccatcactatgtgactagcatcgccaaggctcctgctgtgcaggacctgctcacccgtctacttcaagcgctgcatattgatggaccccgcagcgcccaagtggcccagtccctacttaaggaagaggcctcctggcagcagagccatcatcagtttcgtaaaagactctcagaagagtataccttctacccagacgctgtttccccgctccaggcctcaatcctccaactgcagcacggaatgaggttggtggccagcgagctacacacttcgcttcactcaagcatggtcggggctgatagactggggacgctggccactgccttgctcgcgttcccatcagttggacccacatttccaacgtattatgcccatgccgatactctgtgtagcgtgaagtcggaggaggtgctgcgagggctaggaaagctgatcttgaagagatccggcggcaaggagctggaggggaagggacagaaggcctgccccacaagagaacaactgctgatgaatgctctcctttacctccggtctcacgtgctctgcaagggggagctggatcagagagcattgcagctgttcagacacgtctgtcaggagattattagcgagtgggatgaacaggagcggattgcacaggagaaggccgaacaggagtccggcctgtaccgctataggagcagaaactccagaactgctctgtccgaggaggaggaggaagagcgcgagtttagaaagcagtttccactgcacgaaaaggatttcgctgacattctggttcagcctaccttagaagaaaataagggcacctcagacgggcaggaagaggaggcaggcactaacccggccctgctcagccagaactccatgcaagccgttatgctgattcaccagcaactctgtctcaacttcgcacgctctctctggtatcagcagactctcccccctcacgaggcaaagcactacttgtctttgtttctgtcttgctaccagactggagcgtcattggtgacccatttttatccattaatgggggtcgagctgaacgaccgtctgctgggcagtcagctgctcgcttgtactctgtcccacaatacactgtttggtgaagctccaagcgacttaatggtaaagccggacggtccgtatgacttttaccaacacccaaacgtgcccgaggctcgccagtgccagcctgtcctgcagggcttttcggaagctgtctctcacctgctccaggattggcccgagcatccggcactagagcagctgctcgtagtgatggaccgcatacggtcttttccactaagttcaccaatttcaaaatttctgaatgggctcgagattttgctggctaaggcgcaggattgggaggaaaatgcctcacgggccctgagtcttagaaagcacctggatctcattagtcagatgatcattcggtggagaaaactcgagctcaattgttggagcatgtcgctggataatacaatgaaacgtcacacagagaagagcacgaagcactggttttctatttaccagatgctggaaaagcacatgcaagaacagaccgaggagcaggaggacgataaacagatgactctcatgctactcgtgagcacgctgcaggcctttatagaagggagctccctcggcgagttccatgtgaggctgcagatgctgctggtgttccactgccacgtcctgcttatgccccaggttgaggggaaggactccttgtgcagcgtcttgtggaatctatatcactattacaagcaattctttgatcgggttcaagcgaagatagtagagctacgcagccctttggagaaagagctaaaggagtttgtgaaaatctctaagtggaacgatgtgagtttctggagcataaagcagtccgtggaaaaaacccacaggaccctctttaaatttatgaagaagttcgaagctgtcctgtccgaaccctgccgatccagtctggtcgagtcagacaaggaggaacagccggactttctacctaggcccaccgacggggcagcctcagaactgagcagcatacagaatctgaatagagcactgagagaaacactgctggcgcagcccgccgccggacaggcaactatccccgaatggtgccaaggggcggccccctcagggcttgagggtgagctcttgagaagactgccaaaactgcgcaagcggatgcggaaaatgtgtttaaccttcatgaaggaaagccctctgccgcggctggttgaggggctagatcagttcaccggcgaggtcatttcaagtgtaagtgaactgcagagcctcaaagtcgagccgagcgcagagaaagagaagcaaaggagcgaggccaagcacatcctgatgcagaaacagagggctctctcagatttgtttaagcaccttgcgaagattggactgtcctatcgcaagggattggcgtgggccaggagtaagaacccgcaagaaatgctgcaccttcacccgctcgacctccagtctgctctctccatcgtcagctcaacgcaagaggccgactcccgcctgctgacagaaattagctctagttgggatgggtgccagaagtacttctaccggtcacttgctcggcatgctagactcaacgcagctcttgctacccctgccaaggaaatggggatgggtaacgtggaacggtgccgcggcttctctgcacacctgatgaagatgcttgtgcggcaacgcaggtccctgacaaccctgagcgaacagtggatcattctccgcaacctcctcagctgtgtccaggaaattcattcacgcctgatgggtccgcaggcttatccggtggcttttcccccccaggacggtgtgcagcagtggacggaacgactccagcatcttgccatgcagtgccagattctgctcgagcaattatcgtggcttctacagtgctgcccatcagtgggtccggctccaggccatgggaatgttcaagtcctcggccagccacctggcccctgtctggagggtcctgagctttcaaaaggccagctgtgtggcgtggttctcgatctgatcccttctaacctgagctacccgagccctattcccggatcccagctgccttctggatgtcggatgcgtaagcaagatcatctctggcagcaaagtacaacgcgcttgaccgaaatgctgaaaacaatcaagactgtgaaagcggatgttgacaagatacgccagcagtcttgcgaaaccttgttccactcctggaaagacttcgaggtttgctcctccgccctgtcctgtctgtctcaggtcagtgtgcacctgcagggattggagagcctattcatcttgcctggtatggaggtggagcaaagggatagtcaaatggcgctggtggagagtctcgagtatgtcagaggcgaaatcagtaaggcaatggccgacttcactacctggaaaacccatctcctgacctccgattctcaaggtggtaaccagatgctggacgagggcttcgttgaggatttttctgaacagatggaaatagcaatacgagctatactgtgtgcgatccagaacctcgaagagagaaagaacgaaaaggccgaagaaaacacagatcaggcctcaccgcaagaggactatgccgggttcgaacggctgcagtctggccacctgaccaaactgttagaagacgatttttgggctgacgtgtcaactctacatgtgcagaagatcatcagcgccatttccgagctgctggaaaggctgaaatcatatggagaagacggaaccgccgctaaacacctctttttctctcagtcttgcagtctcctagttaggctcgtccccgtgcttagctcctacagcgatcttgtcctgttcttcctaacaatgtctttggccacacatcggtctacagccaagttgttgagcgtactggctcaggtgttcacagagctcgcccaaaagggcttttgcctccccaaagagtttatggaggactccgcaggcgagggcgctacagagttccacgactatgaggggggcgggatcggggagggagagggaatgaaggatgtgtctgatcagatcggcaacgaagaacaggtggaggacacttttcagaagggccaggagaaggataaagaagacccagactcaaaaagcgatatcaaaggagaagataacgcgatcgaaatgtcagaagactttgacggaaagatgcacgacggagaattggaggagcaggaagaggacgatgaaaagtccgactctgaagggggcgatctggacaaacatatgggggatctgaacggcgaagaggcagataaactcgacgaacgcctgtggggagatgacgatgaagaggaggatgaggaagaggaggataacaagacagaggagaccggcccagggatggacgaggaagactctgagctcgtggccaaggacgataacctggacagtggcaattccaacaaggataagagccagcaggacaagaaagaggaaaaggaagaggccgaagccgacgacggtgggcagggcgaggacaaaataaatgagcagatcgacgaacgagactatgatgaaaacgaggtggacccctatcacggcaatcaggaaaaggttcccgaacccgaggcactggacctgccggatgatctcaacctcgattccgaggacaagaatgggggagaggacacagacaacgaagaaggggaggaggagaatccactggaaattaaggagaagcccgaagaggcaggccatgaagccgaggaacgtggcgagactgaaacagaccagaacgagtctcagagtccccaggaaccagaggagggtcccagtgaggatgataaggcggaaggagaagaggagatggatactggtgctgatgaccaggatggtgacgccgcccagcacccagaggagcactctgaggaacagcagcagtcagtagaggagaaggataaggaagctgatgaagagggcggcgagaatggtcccgccgatcaggggtttcagccccaggaagaggaggaacgggaagactccgacactgaggaacaagtacccgaggccttggaacgaaaggagcacgcttcttgtggacagactggcgtagagaacatgcagaacacccaagcaatggaactggctggtgctgcacctgagaaagaacaagggaaagaggagcatggaagtggcgctgccgacgccaatcaggcagagggccatgagtcgaattttatcgcccagctggcatcacagaagcacacccgcaagaatacccagtcgttcaaacgcaagccgggccaggctgacaatgaaagatcaatgggcgaccacaatgaaagagttcacaaacgcttgcgcaccgttgatactgatagtcacgctgaacagggaccagcacagcaacctcaagcccaggtagaggacgccgatgccttcgaacacataaagcaggggtcggatgcgtatgacgcccagacctacgatgtagccagtaaggagcaacagcagagcgcaaaggactccggcaaggatcaggaagaagaagagattgaagacacgctgatggatacagaggaacaggaagagttcaaagctgccgatgtcgagcagctcaaaccagaggaaattaaaagtggaactacagcgcccttggggttcgacgagatggaggtggagatacagacggtgaagactgaagaagaccaggaccctcgtaccgacaaggctcacaaagagaccgaaaatgagaaacccgagagaagtcgggaaagcaccatccacaccgctcaccagtttctgatggacactatctttcagccatttttaaaagatgtgaacgagcttcggcaggagctggagaggcagcttgagatgtggcaaccaagagagtccggtaatcccgaggaagagaaggtagccgccgagatgtggcagtcctaccttatcttaacagccccattgagccaacggttgtgtgaggaattacggctgatccttgagccaactcaggccgccaaactaaaaggtgattaccggaccggcaaaagactcaacatcagaaaggtaatcccctatatcgccagccagttcagaaaagataagatttggctgcgaagaacgaaacccagcaaaagacaatatcagatctgcctcgccatcgatgacagcagcagcatggtcgacaatcatactaaacaattggcctttgagtcccttgctgttattgggaatgccctgactctcctcgaggtcggccaaatagctgtgtgttctttcggagagtctgtgaagcttctgcatcctttccacgaacagttcagtgactactctgggtcgcaaatcctgagactgtgtaagttccagcagaaaaagactaaaatcgcccagttcctagaatccgtagcaaacatgttcgcagccgcccagcagctgtctcagaatatttcctctgaaacagcgcagttgctgctcgtcgtctcggacgggcggggcctgtttctagagggcaaagagagagtgttggcagccgtgcaggcggcgcgcaacgcaaacattttcgtcatttttgtagttttggataatccgtcttccagagatagcattttagacatcaaggtgcccattttcaaagggccaggggagatgcccgagatccgcagctatatggaagaattcccctttccttattatatcatccttcgggacgtgaatgccctgcctgaaacacttagcgacgcgttgcgccagtggtttgagctagtgacagcttccgaccatccatag

SEQ ID NO: 19708 - DNA, 16791 bp, Artificial Sequence
  Description of Artificial Sequence: Synthetic coding sequence
atggagcacttcctgctggaggtggccgccgcccccctgcggctgatagctgccaagaacgagaaaagccgctctgagctgggaaggttcctggctaagcaagtctggactcctcaagacagacaatgcgtcctcagcacactggcacagcttctactggataaagattgcacggtcttggttggccgccagctgcgtcctctgctcctagaccttctcgaacggaatgccgaagcaattaaggctggcggccaaattaaccatgacctccatgaaaggctgtgcgtaagtatgtctaaactcatcgggaatcatccagatgtacttccttttgcactcaggtatttcaaagacaccagcccggtgtttcaacggttgttcttagaaagttctgatgcaaaccctgtgaggtacggacgccggcgcatgaagttgagggacctaatggaggccgcctttaaattcctgcagcaggagcaaagtgtctttcgggagctatgggattggtccgtatgcgtgccgctgctgagaagccacgacactctcgtacgctggtacacagccaactgcctcgcactggtgacttgcatgaatgaggaacataaattatccttcctgaagaaaatttttaactcagacgaacttatccacttcaggttgcgattgttggaagaggcacagctgcaagacttggagaaggccctggtcctggctaacccagaggtgagcttgtggagaaaacaaaaagagctgcagtatctacaggggcatcttgtcagctcggatttaagccctagagtgaccgccgtgtgtggcgtggttctcccgggccaactgccagcaccaggggaactcggcggtaaccggagctctagtcgggagcaggagttagcactcaggagctacgtactggtagaatccgtgtgcaagagcctacagaccttggccatggcagtcgctagccagaatgccgtccttctggaaggccctatcggctgcggaaaaacatccctcgtcgagtatctggcggcggtgacgggcaggaccaagcccccacagctgctgaaggtgcagctcggagatcaaacagatagcaaaatgcttctggggatgtaccgctgcacagacgtcccgggtgaattcgtatggcagccaggcacccttacacaggcagccacaatgggccattggatcctattagaggatatcgactacgcccctctcgatgttgttagcgtgctgataccactacttgaaaatggcgaactgctgatcccaggcagaggcgactgtctgaaggtggcacccggctttcagttctttgctactcgcaggctcttaagttgtggtgggaattggtaccgacccctgaactctcatgctaccctgctggataagtactggaccaaaatccacctggacaacctggataagcgtgaacttaatgaggtgctgcagtcacgctacccgagcctgctcgccgttgttgaccatctcctggatatttatattcagctcactggagagaaacaccacagctggtcagattcctccgtcggttgtgagcaagcacctgaagaagtgagcgaggcacgacgggagaacaaaaggcccacgctggaggggcgcgagctctctcttcgagatctcttgaactggtgcaacaggattgcccacagtttcgactcatcctctctttctgcttccctcaatatctttcaggaagccctagattgcttcacggccatgctatccgagcatacgtctaagctcaaaatggcggaagtgattgggagcaaattgaacatctctcgtaagaaggccgagttcttctgccaactttacaaacctgaaattgttatcaatgaactcgacttgcaggtgggccgcgtgcgcctcctccgaaaacagtccgaagctgttcatctgcaacgggaaaagttcactttcgcagcaacccggccaagcagcgtcctgatcgagcagttggcagtttgcgtgagcaagggcgagcctgttttgttggttggtgaaacaggaaccggcaaaaccagtacaattcagtacctcgcccacatcacggggcatcggctgagggtggttaacatgaaccaacaatccgacaccgctgatttgctcgggggatacaagccggttgatcataagcttatctggttacctcttagagaggcctttgaagaactgtttgcgcaaactttttccaagaagcagaattttaccttcctaggccacattcagacatgttaccgccaaaaaagatggcacgacctgcttcgcctcatgcagcacgtccataagagtgccgtgaataaggatggaaaagactcagaaaccggtctgctaatcaaggagaagtgggaggctttcggcctgaggctgaaccatgcccagcaacagatgaagatgacagaaaacaccctgctcttcgccttcgtggaaggcacccttgcacaggctgtgaaaaagggggagtggatcctgctcgacgagataaatcttgcagccccagaaattttggagtgtctgagtggtttactggaagggtcaagtggtagcttggtgctgcttgacagaggtgacactgaaccactggtccgtcatcccgactttcggctgtttgcctgcatgaaccctgcgacagacgtagggaagcgaaacctgccgccagggatacgaaataggttcaccgagttgtacgtggaggagttagagagcaaagaggatttgcaggtccttatcgtggactacctgaagggccttagtgtgaataagaacactgttcagggcatcatcaacttttatactgccctgcgaaaagaatctggcacaaagttggtggatggtaccggtcaccgcccccattacagtctgcggaccctgtgcagagctctccgatttgcagcctctaatccttgtggcaatatccaacggtctctttacgaaggcttctgcctcggcttcctgacccagctcgatagagcaagccacccaatcgtccagaaactgatttgccaacacatcgtccccggcaacgtgaagtctttgcttaagcagcctataccggagcctaaaggaggccggcttattcaggttgagggatactggattgccgttggagataaggaacccacaatagatgaaacttacattcttacttcatcagtaaaactgaatttgcgagacatcgtgagggtggtgagtgctggaacctatcccgttttgattcagggtgagaccagcgttggtaagacttccctcattcagtggctggcagctgcaacaggcaaccactgcgttaggattaacaatcatgaacataccgacattcaggagtacatcggctgttacacatcagactcatccggcaagctcgtgttcaaggagggtgtactgattgatgccatgcgaaagggatattggatcatcttagacgaattgaatctggcacccaccgacgtcttagaagcactaaacaggcttcttgatgataacagggaactcctcgtgaccgaaacgcaagaggtggtgaaggcccatccccggttcatgctctttgcgacacagaaccctcccggattatatggcggtcgcaaagttctttcgcgggcctttcgtaaccgctttgtagaacttcactttgacgaactcccttcctccgagctggagacaattttgcacaagcggtgcagcctacctcctagctactgctctaagctggttaaggtcatgcttgatctgcagagctacaggcgtagttcaagcgtgtttgccgggaagcagggcttcatcacattgcgagatctgttccgctgggcagagaggtacaggttagccgagcccactgagaaagaatacgattggttacagcatctggccaacgacggatatatgctgctggcaggacgagtcaggaaacaggaggagatagatgtgattcaagaggtgctggagaaacatttcaaaaaaaaactgtgcccccagtctctattctccaaggaaaatgtcctgaaactgttggggaaactgtcaacccagatttctacactagagtgcaatttcggccacattgtgtggacagagggtatgagaaggttggcaatgttagtgggtagggctctcgaatttggggagcctgtgctgttggtaggggacacagggtgtggaaaaactacaatttgtcaggtgtttgctgccctggcgaaccaaaagctgtacagcgtctcttgtcatctgcacatggaaacatcagattttcttggaggtctcagacccgtaaggcagaaaccaaacgataaggaggagatcgataccagccggctctttgagtggcatgatggccccttggtgcaggcgatgaaggaggacggcttctttttgctcgacgaaatctccttagcagacgattccgtgcttgaaaggctgaactctgtactggaagttgagaagtcccttgtcttagccgagaaggggtctccagaagacaaggatagcgaaattgaacttctgaccgctggaaaaaagtttcgcatccttgcaactatgaatccggggggcgattttggaaaaaaggagttatctcctgccctaagaaatagattcactgagatctggtgtcctcagtctacatcccgcgaggacctcattcagattatctcccacaatctgcgcccgggactttgtcttggtaggatcgatcccaaggggagcgatatcccagaagtgatgctcgattttatcgactggctaacacaccaggaattcgggaggaagtgcgtggtctcaattcgcgacattctgagctgggtgaactttatgaacaaaatgggggaggaggcggccctcaaacgcccagaaataataagcacggttacaagttttgtccatgctgcatgcctggtgtacatcgacggaatcggaagcggtgtcacttccagtgggtttggtaccgcgctgctggcgcggaaggagtgcctcaagttcctaatcaaaagattagcgaagatcgtacgtttgacggagtaccaaaaaaacgaacttaaaatttatgacagaatgaaggccaaagaatttaccggcatcgataacttatggggaattcacccgttttttattccacggggacccgtcctgcatagaaataacatagctgattacgccctcagcgcagggaccaccgccatgaacgctcagagactgcttcgggccacaaagctgaagaagccaattctgctggaggggagtccaggggtcggaaagacctcactcgtgggggctctcgcaaaagcatctggcaacaccctggtgagaattaatttgtctgagcagactgacatcactgatctgtttggagccgacttgcctgtggaggggggaaaaggcggtgagttcgcttggagggacggcccgttgctggccgctttaaaggcgggccattgggtggtgctcgacgaattaaacctggcctctcagtccgttcttgagggcctgaacgcatgtttcgaccacagaggcgaaatttacgtccctgagctcggtatgtcattccaagtccagcacgaaaagacaaaaatcttcggttgtcagaatcctttccggcaggggggtggccggaagggcctgccacgctcctttctaaacagatttacacaggttttcgtagaccctctgacagtgatcgatatggaattcattgcatccactctgttccctgccatcgagaagaatattgtaaaaaaaatggtcgcttttaacaatcagattgaccacgaggtgaccgttgaaaaaaaatggggccagaagggcggaccctgggaatttaacctgagagacctgttccggtggtgccagctgatgttagtggaccagtcaccaggttgttacgatccagggcagcatgtttttctggtgtacggcgaaaggatgagaaccgaagaagacaagaagaaggtgatcgccgtgttcaaagatgtctttggctccaacagcaacccctacatgggcacaaggctgtttcgtatcacaccttacgatgtccaattgggatactcggtgctttcccgggggagctgtgtcccacaccccagccgccatccccttcttctgcttcaccaaagctttcagcccctggagtccatcatgaagtgcgttcaaatgtcctggatggtgattcttgtaggcccagctagtgttggaaaaactagcctcgtacaactactcgcacacctcacaggccataccctgaagattatggccatgaattcagctatggatactacggaattgctcggagggttcgagcaggtagacctcattcggccatggcgacggctactggagaaggtcgagggcaccgtgagagcgcttctacgggattctctgcttataagtgctgacgatgctgaggtggtattgagagcctggtctcattttctgctgacatataaaccaaagtgcctgggggaaggaggtaaggccatcacaatggagatcgtgaacaaacttgaagccgtattgctactgatgcagagattgaacaataaaataaatagctattgtaaggcagagttcgcgaagctggtggaggagtttagaagttttggggtgaagctcactcagctggcatcggggcatagccacgggactttcgagtgggtggattccatgctggttcaagccctcaaatcgggggattggcttctcatggataacgtgaacttttgcaacccgagcgtgctcgacaggctgaatgccctcctggagcctggcggagtgctgaccatttccgaaagggggatgattgacggttccacgcccacaattacacctaaccccaacttcaggctcttcctgagcatggatcctgttcacggagatatctctagagccatgaggaataggggcctggaaatatacatatccggtgaaggggacgcatcaaccccagataacctggatctcaaggttctactacattcgctaggcctggtgggaaattccgtctgtgacatccttctggccttgcatacagagaccagatccacggtggtgggctcacccacatcaagcgtgagcaccctcatacaaaccgcgatcctcatcgtgcaatacctgcagcgcggtcttagtctggacagggcgttttctgaggcatgttgggaggtatatgtgtgctcgcagcatagcccagcgaatagaaaactcgtgcaggcactgttggaaaaacacgtgtctagcttaagagcgcatgagacatggggagattctatccttgggatgggcctgtggccggacagtgtgccatcggccctgttcgctactgaggacagtcatttgtctacagtgcgccgtgacggccagatccttgtttattgcctgaatcggatgagtatgaagacttccagttggactaggtcccagccttttacgcttcaagacctggagaagattatgcagtctccatcaccagagaatcttaaattcaatgcggtggaggttaacacgtattggatcgacgagccggacgttctagtcatggcggtgaagttactgattgaacgtgcgaccaaccaagattggatgcttcgcgtgaagtggttataccacctggccaaaaacatccctcaaggcctggagagcatccagattcatctggaggctagtgctgcctctttacgtaacttttacagtcactccctgtccggcgctgtgtctaatgtgtttaagatcctgcaacccaatacaaccgatgaattcgtgatccctctggaccctcgttggaacatgcaggcactcgatatgattaggaatctgatggacttcgatccacagacagaccagccggaccagttatttgctctgctggaatccgcagctaacaaaaccataatttatctcgatagagagaaaagggtgtttacagaggccaatctggtgtccgtgggaagcaaaaaactgcgcgagagtgtgctgagaatgagcttcgagtttcaccaggaccccgaatcttatcacactctgccccacgaaattgtggtcaacttggcagctttttttgagctctgcgacgccctcgtattgttgtgggtgcagtcatcacagggcatggtgtccgacgccagcgccaatgagattttaggctcgcttcgatggcgggataggttctggaccgtggccgacactgtcaaagtggatgcaccgggcctcgccctgttggccctgcattggcactgggtgttgaaacacctggtacatcagattccacgactccttatgaattacgaggataaatactataaggaggtgcaaacagtgtctgaacacatacaaaattgtctaggctcacagaccggcggatttgctggaatcaagaaattgcaaaaatttctggggagaccctttcccttcaaggataaactggtggtggagtgttttagtcagctaaaggttttgaacaaggttttggctattcgcgaacagatgagcgctttgggtgagtctggctggcaggaggatattaatcggttacaggtggtagcgagtcagtggacactcaagaagtctcttcttcaggcctggggccttatactgagggccaatattctggaggacgtgtcccttgacgaacttaagaatttcgtgcatgcccagtgcctggagctcaaggcaaagggactgtctctgggttttctagagaaaaaacacgacgaagcatctagcctctctcatccagacctcacatctgttattcacctaaccaggtccgtacagctctggcccgctatggaatatctagctatgctgtggcggtacaaggtgaccgcagacttcatggcccaggcctgcctaagaagatgcagtaaaaatcaacagccacagattaatgaagagattagccacctaatcagtttttgcctgtaccatactccagtcaccccccaagaactccgtgacctctggagtttgctgcaccaccaaaaagtcagtccagaggagattacttcactgtggagtgaactgttcaattctatgttcatgtccttttggagctccaccgtcaccactaaccccgagtattggctgatgtggaaccctctgcctggtatgcaacaacgggaagcgcctaagagcgtgcttgactcgaccctgaagggtccaggcaacctgaaccgaccgatcttctcaaaatgctgctttgaagtgctgaccagttcatggagagcttcaccctgggatgtttcaggcctgcctatcctttcgagttctcacgtcaccctgggagagtgggtggaaaggacacagcagctgcaggacatcagctctatgctgtggacgaatatggccatttccagtgtcgcggagttcaggcggacagacagccagctacaaggacaagtgctgttcagacacctggccggcctggctgagttactaccagagtcacgacgtcaagagtatatgcagaattgtgagcagctactcctcggctctagccaagcgttccagcacgttggccagactctcggagacatggctggacaggaagtattgcccaaggaattgctgtgccagctgctgaccagccttcaccactttgtgggagagggagaatccaaacggagtctgcccgaaccagcacagagaggtagtctgtgggtgtcgttaggtctgcttcagatccagacctggctccctcaggcaagatttgatcctgcggttaagcgtgagtataaactaaattacgtcaaggaggaattacatcaattgcagtgcgagtggaagacacgaaatctgtcatcccagctgcaaactggccgggatctcgaggacgaagttgtggtatcttactcccatccacacgtaagactcttgcggcaaagaatggaccggctagacaatttgacctgtcacctgctgaagaagcaggcttttcggccccagcttccggcatacgaaagcctggtccaggagattcaccactacgtcaccagtattgctaaggccccagctgtgcaggacttgcttacaaggttactacaagctctgcacatagatggacctagaagtgcacaggtcgcccagagcttgctcaaggaggaggccagttggcaacagagtcatcaccaattcagaaagcgattgagtgaggagtataccttctacccagacgccgtgagtcctttgcaggcaagtattctgcaacttcaacatggaatgagacttgtggcatcggagctccacacttccctccattccagcatggtgggcgctgatcgcctggggactttggcgacagcgctcttagcctttccttcagttggccctacttttccaacttattatgcgcatgccgatactctatgctccgtaaaaagtgaggaagtgctgcggggacttgggaagctcattctcaaacggtccgggggtaaggaattggaaggcaagggacagaaggcctgtccaacgcgggagcagttacttatgaacgccttgctgtacctccgaagtcacgtcctgtgcaaaggtgaactcgatcaaagagctctgcaattgttccgacacgtgtgtcaagagatcatcagcgaatgggacgagcaggaacgtattgcccaagaaaaggccgagcaggagtcgggtttgtatagatatcggtctcgcaatagtcggacagccctgtcagaggaggaagaggaggaacgcgagttccgtaagcagttccccctccacgaaaaggatttcgctgatatcctcgtgcagcctacgctggaagaaaacaagggcaccagcgatgggcaggaggaagaagccgggaccaaccctgcactgctgtcacaaaatagtatgcaggctgtgatgctgattcaccagcaactgtgtctcaacttcgcgagatctctctggtatcagcagactcttcccccacatgaggctaagcactatctctctctctttctaagctgttaccaaactggtgcatccctagtcacgcacttttacccacttatgggcgtggagctgaacgaccggcttctaggttcacagctcctcgcgtgtaccctcagccacaacacactgttcggcgaggcgccatcagacttgatggtgaagccagacgggccctacgatttttatcagcaccccaacgtaccagaggccagacaatgccagcccgtgttgcagggattctcagaggcagtaagtcatcttctgcaggattggcccgagcaccctgctctcgagcaactgcttgtggtgatggatcggataaggagttttcctctctccagtccaattagcaagttcctgaacggtctggagattctgctcgcaaaggcgcaagactgggaggagaatgccagtcgtgccctctctctccgaaaacatctcgatctgatttcgcagatgattatccggtggagaaagttggagctgaattgctggtccatgagcctggacaataccatgaagagacacaccgagaagtcaaccaagcactggttttctatctaccagatgctggaaaaacacatgcaggagcagacggaagagcaggaagatgataagcagatgacactgatgctacttgtatcgactctccaagcctttatcgagggatcgtcactcggagagtttcacgtgcgcctgcagatgctgctcgtctttcattgtcacgtgttactgatgccacaggtcgaagggaaggacagtctgtgttcggtgctctggaacctctatcattactataagcaattctttgacagagtacaggccaagatcgtcgagctgcgctcaccactggagaaggaactcaaggagtttgtcaaaatttccaagtggaacgatgtcagcttttggtctatcaagcagagtgtcgagaaaacccataggactctgtttaaatttatgaaaaagttcgaagccgtgctgagcgaaccttgccgctcatcactggtagagagtgacaaggaagagcagccagacttcctgccccgcccgacagacggcgccgcttccgaactgagtagtatccagaatctcaatcgggccctaagggagacgctgttggcccaacccgcagccgggcaagccactatccctgagtggtgtcaaggggccgcgcccagcgggctggaaggcgaactgttgcgccgacttccgaagttgcggaaaaggatgcggaagatgtgtctgacttttatgaaagagagcccgctcccaaggctggtggaaggcttagaccagtttactggcgaggtgattagctcagtatcagagctccagtctctgaaagtggagccatctgcagaaaaagagaagcaaaggagtgaggcaaagcacatcctaatgcagaaacaaagggcgttgagcgacctgttcaagcatctggcgaagataggactctcctacaggaaaggcttagcctgggcaagatcaaagaaccctcaggagatgttacatctgcatcccctcgacttacagagtgcgctgagcatcgtgtcctcaacacaggaagccgatagcaggctcctgactgagatcagttctagttgggatgggtgccagaagtacttctataggtcactggccaggcacgcccgcctgaacgccgcattggctacccctgctaaggagatggggatgggaaacgtggagcgatgccgcggtttctctgcacacctgatgaagatgttggttcggcaacgaaggtctctgaccactctgtcagaacagtggatcatccttcggaaccttctaagttgcgttcaggagattcactcccgtctaatggggccccaggcctaccccgtcgcctttccccctcaggatggagtgcagcagtggacggagcgtctccagcatctcgccatgcagtgccagattctgctggagcagctatcatggttgctccagtgttgcccaagcgtgggtcctgcccccggccacggaaatgttcaagtgttaggccagcctcccgggccatgtctcgaaggtcccgagctctccaagggtcaattgtgcggagtggttttggatttgatacccagcaatctgtcttatccgtctcccatccccggctcccagctcccctccggatgcagaatgagaaaacaagatcacctgtggcagcagtcaacgactaggctgacagagatgttgaagacaataaaaaccgtcaaggcagacgtggacaagatccgccagcagagttgcgagacgctcttccacagctggaaagactttgaggtttgttccagcgcattatcatgcctgtctcaagtatccgtgcacctccagggactcgaatccttatttatactaccaggcatggaggttgagcagcgcgattcccagatggccctggttgagagcctggagtacgtgcgaggggagatttctaaggcaatggctgattttacaacttggaaaacacacctgctgacttcggactctcagggcgggaaccagatgcttgacgagggatttgtcgaagacttttccgagcaaatggagatagctattcgtgcgattctttgcgctattcagaacttggaggaaaggaagaacgaaaaggccgaggaaaatacagaccaggcatcaccccaagaggactacgcggggtttgagcggttacaatccggccatctgactaaactgttggaagatgacttttgggcggacgtgtctaccctccatgtgcagaaaatcattagcgccatcagcgaactgctcgaaagactgaagtcctatggtgaagacggaacagctgcaaagcatttatttttctctcagtcatgttcgcttctagtaaggcttgtgccggtcttaagttcttactcagacctggtattattcttcctgacaatgtctctagctacccacagaagcacagcaaaattgctgagcgtccttgcccaggttttcacagagctggcgcaaaaaggcttttgcctgcctaaggagttcatggaagattcagctggagaaggggctacagaattccatgactacgagggaggaggtataggagagggagaaggcatgaaggacgttagtgatcagatcggcaatgaagagcaggtcgaggacacatttcagaagggtcaggaaaaggataaagaggaccctgactcaaagtcggatattaagggcgaagacaatgctattgagatgagcgaggactttgacggaaaaatgcatgatggcgagctcgaagagcaggaggaagacgacgagaaatccgactccgaaggaggagatttagacaagcatatgggtgatttgaacggcgaggaggccgataaactggacgagcgtctgtggggtgatgatgatgaagaggaggatgaggaagaggaggacaacaagaccgaagaaactggacccggtatggacgaagaggactctgaactggtggcaaaagatgacaacttagattccgggaattcaaataaggataagtcccagcaagacaagaaagaggagaaagaggaagcggaggctgacgacgggggacagggggaggacaaaatcaacgaacagatcgacgaaagagattatgacgagaatgaagtggatccatatcacggcaaccaggaaaaggtccccgaacctgaggcacttgacctacctgacgacctgaacctcgactcagaggacaaaaatgggggcgaggataccgataacgaagagggagaagaggagaatccactggagatcaaagaaaaacccgaagaagctggccatgaagccgaagagaggggggagaccgagactgaccaaaatgaatcccagtcaccacaagagcccgaagagggcccctccgaggacgacaaggcagaaggcgaagaggagatggatactggagccgatgatcaggacggcgacgccgcccagcatcccgaagaacactcagaggagcagcagcagtcagtggaggaaaaagataaggaagctgatgaggaaggtggagagaacggccccgccgatcaaggcttccaaccccaggaagaagaagaaagggaagatagtgatacagaggaacaggtgcccgaagcactggaacgcaaggagcacgcatcctgtggacagacaggcgtggagaacatgcagaatacccaggctatggagttagcgggcgccgccccggagaaagagcaagggaaggaagagcatggaagcggcgctgctgacgcgaatcaagccgagggccatgaatcaaacttcatcgctcagctggcatcccagaagcatactaggaaaaatacccagtcgtttaagcggaagccaggacaagccgataatgaacgttcaatgggcgaccacaacgaacgggtccataagcggctgagaaccgtcgataccgactctcacgccgaacagggaccagctcagcaacctcaagctcaggttgaggacgcggacgcttttgaacatatcaagcagggcagtgatgcctacgacgcccagacctatgatgtggcctctaaggagcagcagcagtcagccaaggacagtggcaaagatcaggaagaggaggagattgaggataccttaatggacacggaagaacaagaggaatttaaagctgctgatgtcgagcaactaaaaccagaggagataaagtctgggaccactgcacccttgggatttgatgaaatggaagtggaaatccagactgttaagacagaagaggatcaggaccctcggaccgataaagcacacaaggagacagagaatgaaaaacccgaacgctccagagaatctacaatacacaccgcccaccaatttctgatggacaccattttccaacccttccttaaagatgttaacgaactgaggcaggagctggagaggcaactggaaatgtggcagccacgcgagtccggtaatcccgaggaagagaaggtggcagccgagatgtggcagtcatacctcattctgactgcccccctgagtcaaagactgtgcgaggagttgaggcttattctggagcccacgcaggccgcgaaactgaagggagattatcggactggcaaaaggctcaatatacgcaaggttatcccctacattgcaagtcaatttcggaaagacaaaatctggctcaggcggacgaaacctagtaaaaggcagtatcagatctgtttggccatcgacgactccagtagtatggtggataaccatacaaaacagctggcattcgagtctctggcagttatcgggaacgcactcaccctcttggaggtgggccagattgcggtgtgttcctttggggagtcagtgaaactgttgcatccatttcacgaacaattcagtgattactccggatcacagatactgcggttatgtaagttccagcagaaaaaaactaaaatagcccaattcctggagtcggtagctaacatgtttgccgcagctcaacaactatcgcagaacatcagctctgagacggcacagctgctgctcgtggtttctgacgggcgcggcctgtttctggagggtaaagagcgggtccttgcagccgtgcaggccgccaggaacgccaatatatttgtgatttttgtcgttctcgataacccatcatctcgagactctatccttgatataaaagtaccaatcttcaaggggcctggggagatgcccgaaatccggtcctatatggaggagtttcccttcccctattatatcatcctgagggatgtgaacgcactccctgagaccctttctgacgccctcagacagtggttcgagctggtcaccgcttcggaccatccatag

SEQ ID NO: 19709 - DNA, 3546 bp, Artificial Sequence
  Description of Artificial Sequence: Synthetic coding sequence
atggagcacttcctgctggaggtggccgccgcccccctgcggctgatcgcagccaaaaatgagaaatctaggtcggagcttggacgtttcttggctaaacaagtgtggactccccaggaccgacaatgcgtgctctccacattggctcagcttctactggacaaagattgtacggtcttagtgggacgacagctgagaccccttttgcttgatttattggaacgcaatgccgaagcaataaaagccggaggacaaataaaccacgacctacatgagcgcttgtgcgtcagtatgagcaagctgattgggaatcaccctgacgtgctaccgttcgcgctccgctactttaaagatacttccccagtgttccagcgcctattcctggaatcctccgatgccaatccagtacggtatggtcgcaggcgcatgaagctgcgggacctcatggaggcagcctttaagtttctccagcaggagcaaagcgtgtttcgggagctgtgggattggtccgtatgtgtcccgctgctaaggtcccacgatactctagtgcggtggtatacagcaaattgcctcgctctcgtgacctgtatgaatgaagagcacaagcttagtttcctgaagaagatcttcaacagcgacgaactcatccacttccgcctccggctcctcgaagaagctcagctccaggacctggagaaagctctcgtcttggcaaatccagaggttagtttgtggcgaaaacagaaggaacttcaatatttacagggacacttggtgtccagtgacctgtccccaagggtaaccgccgtgtgtggcgtggtgctgcctgggcaactccctgcccctggcgaacttggcggaaacagatcctcctcccgcgagcaggagttggcactgcggagttacgtattagttgagtctgtgtgcaaatctcttcagaccctggcaatggctgtagcaagtcagaacgccgtcctcctagagggcccaattggctgcggcaaaaccagccttgttgaataccttgccgcagtaacggggagaaccaagccaccacagctactgaaagtccagctgggcgaccagaccgactcaaagatgcttctcgggatgtacaggtgcaccgacgtgcccggagagtttgtatggcaacctgggaccttaactcaggcagcaacaatggggcattggatattactggaagacattgattatgccccgctcgacgtggtcctccagtccagataccccagtcttctggctgtagttgatcatcttttggacatttatatccagctgacaggggagaagcatcattcctggtccgattcatctgtggggtgcgagcaggcccctgaggaggtgtcagaagcaaggagggagaataagcggccgaccctggagggtagagagctcagcctgagagatttgctgaactggtgcaataggatcgcacactccttcgatagctctagcctcagcgcatcactaaacattttccaagaggctcttgattgttttaccgcaatgctctctgaacataccagcaagctcaaaatggcagaggtgattggcagcaagctgaatatttctcgtaagaaagcggagtttttctgtcagctttataagccagaaattgtgattaatgagctagacctgcaagtgggtcgggtgaggttgcttaggaagcagtcagaggcagtgcacctccaaagagaaaaatttaccttcgcggccacgagaccatcttctgttctcatcgagcagcttgcagtgtgtgtgtcaaaaggcgaacccgtcctgcttgtcggggagaccgggacaggcaaaacctcgacaattcagtatctagcacacataactgggcaccggctgcgagtggtgaacatgaatcagcagtccgacacagctgatctccttggagggtataaacccgtcgatcataaactaatctggctgccactgcgcgaggcattcgaggaactcttcgcccagacgtttagcaaaaaacagaatttcacctttctcgggcacatacagacctgttacagacagaagaggtggcatgacctgcttcgattgatgcagcatgtgcacaaatctgccgtgaacaaggatggcaaagatagcgagaccggtttactcattaaggagaagtgggaggccttcggcctgcgcctgaaccacgctcagcagcagatgaagatgaccgaaaatacactgttgttcgctttcgtggagggaacattagcccaggctgtcaaaaaaggcgagtggattttgctcgacgagatcaatctagccgcaccagagatcttagagtgtctcagtggactgctggaaggctcttctggtagcctggtgctgcttgatagaggcgacactgagcctttagtccgccaccccgactttcgcctgttcgcttgcatgaaccccgccactgatgttgggaagcggaatctccccccaggaattcgtaaccgctttactgagctgtacgtcgaggaactggaatcgaaggaagacctgcaagtgctgatcgtcgattacctgaaaggacttagcgtaaacaagaacaccgtgcagggcatcatcaacttctacacagctctgagaaaggagagtggaaccaaactggttgacgggacaggccacaggccacactattccctacgcacactatgtagagcactgcggttcgcagcgagtaacccttgcggaaacatacagaggagtctgtacgaaggtttttgcctgggcttcctcacccagctggaccgggcctcccatcccatcgtgcagaagctgatatgtcagcacatcgtgccaggcaatgtgaagtctttgttaaaacaacctatcccagaaccaaaagggggccgcctcattcaggtggagggctattggattgccgttggcgacaaagagcccactatagacgagacctacatcttgacctcgagcgtgaagttgaatctgagggatatcgtccgcgttgtgagtgccgggacatatccagttctcatccagggagaaacatccgtgggcaagacctctctgatccagtggttggcagccgccaccgggaatcattgtgtaagaattaataatcatgagcatacagatattcaggagtacattggatgctacacctccgacagctccgggaaactggttttcaaggaaggcgttctaattgatgcaatgcgcaaaggctactggatcattctcgatgagttgaatctcgcacctaccgacgtcttggaggccctgaaccgcctgttggacgacaatcgggaactattagtgactgaaacccaggaggtagttaaagcacaccctcggttcatgctgttcgcaacccaaaacccacctgggttatacgggggtcggaaagtgctgtcaagagccttccggaacaggttcgtagagcttcattttgacgaactcccctcatctgagcttgaaacaatcttgcacaagcggtgttcccttccaccaagctactgtagcaaactcgtgaaggtcatgctggatctccagtag

SEQ ID NO: 19710 - DNA, 3351 bp, Artificial Sequence
  Description of Artificial Sequence: Synthetic coding sequence
atgatcctggacgagttctacaacgtgaagttctgcatcgacgcctctcagccagacgtggggtcctggctgaagtacattcggttcgccggctgctacgaccagcacaacctggtggcatgtcaaattaatgaccaaattttttaccgggtcgtggctgacatcgctcctggggaggaattattgctcttcatgaagtccgaagattatcctcacgaaaccatggcaccagatattcacgaagagcggcagtaccggtgtgaggattgcgaccagctctttgagtctaaggccgaacttgcagaccaccagaagttcccgtgctcgactccccactcagcattctctatggtcgaagaagatttccaacaaaaactggagtccgagaacgatctgcaggaaatacacaccatacaggaatgtaaggaatgtgaccaggtcttcccagacctacaaagcctggaaaagcacatgctgtcacacaccgaagaacgggagtataaatgtgatcagtgccccaaagcctttaattggaaatctaacctgatccggcaccagatgtcacacgactcagggaaacactacgaatgtgagaactgcgctaagcaggtcttcactgacccctccaacctgcaacgacatatcaggagccaacacgtcggggcacgggcccacgcctgcccagagtgcggcaagacatttgccacaagcagtggactaaaacagcacaagcatatccacagttcagtcaaaccattcatctgcgaagtttgtcataaatcttatactcagttcagcaacctgtgccggcataagagaatgcacgcggactgccgtactcagataaaatgtaaggactgtggccagatgttttctactacaagctcacttaataagcacaggcgcttttgcgaagggaagaaccactttgccgccggagggttctttggccaggggatcagtttgcctggcacacccgccatggataagacgtctatggtaaatatgtcccacgcgaacccgggcttggcagattattttggtgctaacagacatccagctggattgacctttccgacggcacccggcttttccttctcattccctggattattcccgagcggactgtaccatcggccgccgctgataccagcaagtagcccagtcaagggactgtctagcactgaacagacaaacaaaagccagagcccattgatgacacatccacagatcttgcctgccacacaggatatccttaaagcactgagtaagcacccgtctgtgggcgacaacaagccagtggaactccagccagaacgctcctccgaggagcgccctttcgaaaaaattagcgaccaatccgagagttctgacctcgacgatgtatctactccttctgggtctgatttagaaaccacctcagggtccgacctcgagagcgacatcgagtcagacaaggagaagtttaaagagaacggaaagatgtttaaggataaggtctccccattacaaaatctggcttcgatcaacaataaaaaggagtactcaaatcattctatcttctctcctagtctggaagagcagacggcagtctcaggggcagttaatgactccattaaggcaatcgccagtatagccgaaaaatactttgggtccaccggattggtgggcctgcaggacaagaaagtcggtgccctgccctatccttctatgttcccactgcctttctttcctgccttcagccagtctatgtacccttttccagaccgcgatctgaggtcattacctcttaagatggagccccagagcccgggggaggtcaagaagttacaaaagggatcgagtgagagcccttttgacttaacaaccaaacggaaagatgagaaacccctgactccagttccctctaagccacccgtaacaccggccacctctcaagatcagcccttagatctgagcatggggagtaggtcaagggcctcgggtaccaagcttactgaaccccgcaagaaccacgtattcggcggtaagaaaggcagcaacgtcgagagtcgaccagcctcggacggctccctccagcacgctcgtcccactccgtttttcatggatccaatctatcgagttgagaagaggaagctcactgatcccctggaagctctcaaagaaaaatatcttcgcccctcgcctggcttccttttccacccacagttccagctgcctgatcaacgaacctggatgagcgccattgagaatatggcagagaagttagagtcgttcagcgccctaaaacccgaagctagcgaactgttgcagtctgtgccttctatgtttaactttagagcaccacctaatgctctgccggaaaatctgcttagaaagggcaaagaacgctatacctgtcggtattgtgggaaaatttttcctagatctgcaaatctgacacgtcacttgcggacacataccggggagcagccttacaggtgtaagtactgtgataggtccttttctatctcctccaatttgcagaggcacgttcggaatattcataacaaggagaaaccgttcaagtgccacttatgcgatcggtgtttcggccagcagaccaatctcgaccgtcacctgaaaaaacacgagaatgggaatatgtccggcacagcaacctcaagtcctcactctgaactagagagtaccggagccattctcgacgacaaggaagacgcctacttcaccgaaataaggaatttcatcgggaactccaatcatggctctcagagtccacggaacgtcgaagaaaggatgaatggttcacattttaaggacgagaaggccttagtaacttcccagaattccgacctgcttgacgatgaggaagttgaagacgaggtgctgctggacgaagaggatgaggacaacgatatcacaggaaaaacgggaaaggaacctgtgaccagcaatttacatgagggcaaccctgaggacgactacgaagagacaagcgcgttagaaatgagttgcaaaacctccccagtgcggtataaagaagaggaatacaagagcgggctgagcgcccttgaccacatccgtcattttacagatagcctcaagatgagaaaaatggaggacaaccagtactctgaagcggaactatctagtttctccacgagccacgtcccagaggaactgaagcagccactgcacagaaagtcaaaatcacaagcttatgcaatgatgctgtcgctttcagataaagagtccctccattccacctcacatagctcaagcaacgtttggcactcaatggccagggctgccgcagagagcagcgctatccagtcaatctcccacgtgtag

SEQ ID NO: 19711 - DNA, 3156 bp, Artificial Sequence
  Description of Artificial Sequence: Synthetic coding sequence
atgaagagcgaggactacccccacgagaccatggcccccgacatccatgaggaacgtcagtacaggtgcgaggactgcgaccagctgtttgaatctaaggcagaactagcggatcaccagaagttcccatgctctaccccacactcggccttctccatggtggaggaggacttccagcaaaagttggagtcggagaacgacttacaggagatccataccattcaagaatgtaaggaatgcgaccaggtcttcccggatttgcagtcgctggagaaacatatgttatctcacaccgaagagagggagtataagtgcgaccagtgtccaaaagcctttaattggaagtccaacttgattcggcatcagatgtcccacgattccggaaagcattacgaatgcgagaattgtgccaaggtgtttacggacccaagcaaccttcagcgacacattcggtctcagcatgttggagccagggcccacgcgtgccctgagtgcggcaagacttttgctacttccagtggcctgaaacaacacaaacacatacactcaagcgtgaaaccatttatttgcgaagtgtgccataaatcctacacacagttctccaatctgtgtcgccataagaggatgcacgccgactgtaggactcagatcaaatgcaaggactgcggccaaatgtttagtaccacttcttcccttaataagcacagaagattttgtgagggtaagaaccacttcgccgccggaggattcttcggccaagggatctccttaccaggcacacctgcaatggacaaaacaagcatggtgaacatgagtcacgccaatcctgggctcgcggactacttcggagctaataggcaccccgcaggccttacatttcctactgccccggggttcagttttagctttccaggcttgttcccatccggcctctatcaccgtccaccccttataccagcatcatctcccgtgaagggactgtcatcaaccgagcaaaccaacaagtcccagagccccctgatgactcatcctcagatcctgccagctacacaggatatattgaaggccctttcaaaacacccctccgtgggggataacaaacctgttgaattgcagcctgaaagatccagcgaggaaaggccatttgagaagatcagcgaccagtcagaaagtagcgatctagacgatgtatctacccccagtggctccgatctcgaaacgacatcaggtagcgacctggaaagcgatatcgaatcggacaaagagaaatttaaggagaatgggaagatgtttaaggataaagtcagtccgctccagaacctcgcttccatcaacaacaaaaaagagtacagcaaccacagtatcttcagcccgagtctggaggaacagaccgctgtgtctggggccgtgaacgactccatcaaggcgattgccagcatcgctgagaagtactttggcagtactggactggttggccttcaggataagaaggtgggcgctttgccgtacccgtcaatgttccccctgccgtttttccccgcattctcacagagtatgtacccattcccagatagggacctccgctctctgccacttaaaatggagccccaatcccccggggaggtgaagaagctccagaaaggtagttctgagtcaccattcgatttaactacgaagcgtaaagatgaaaagcctctcacccccgtcccttctaaacctccagttactcccgccacttcgcaagatcagcctctggatctttcaatgggaagtcgttccagggcaagtggcactaagctaactgagccacgcaagaaccatgtttttggtggcaaaaaaggaagtaacgtggagtcccgcccagcctcagacggatctttacagcacgcccggccgaccccgttttttatggatcccatctatcgcgtggaaaaaagaaagctaaccgatcccctggaggccctgaaggaaaaatacctgagaccatcacctgggttcctgtttcacccgcagtttcagcttcccgatcagcgtacttggatgagcgctattgaaaatatggccgaaaaacttgaatctttttccgccctgaagccagaagcatcggagctcctgcaatctgtgcccagtatgttcaatttccgtgccccccccaatgccctgcccgaaaacctcctccggaaaggaaaggagcgatacacctgtagatactgcgggaaaatcttccccagaagcgcaaatttgactcggcacctccgcacacatactggggagcagccatacagatgtaagtactgtgatcggtctttcagcattagcagcaacctccagagacacgtgagaaacatacacaataaggagaaacccttcaaatgtcacctgtgtgatcgttgttttggacagcagaccaatctcgatcgccaccttaaaaagcacgaaaacgggaatatgtccggcaccgccacctcgtcccctcattctgagctcgagtcaacaggggcgattcttgatgacaaggaggacgcttacttcaccgagattagaaattttataggcaattctaaccatggctcccaaagcccaagaaatgtggaagaacggatgaacggatcccactttaaagacgaaaaggctctcgtcactagccagaactccgatctgttggatgacgaggaggtggaggacgaggttctgctggacgaggaggacgaggacaatgacatcacagggaagactggcaaagaacccgtgaccagcaatttgcacgagggcaacccagaggatgactacgaggagacatcagcactagagatgtcctgtaagacctcacctgtgcgttataaagaagaggagtacaagtcagggctgagtgccctcgaccacattcgacattttaccgattctctgaaaatgcgcaaaatggaagacaaccagtatagcgaagccgagctgagcagcttcagcaccagtcacgtgccagaggagttgaagcagccgctgcatcggaagagcaagtctcaagcatatgccatgatgttgagtctatccgacaaagagtcgctgcacagcacaagccactcctctagtaatgtgtggcatagcatggctagagccgccgcggagagctcggctatccaaagcatttcccacgtctag

SEQ ID NO: 19712 - DNA, 3159 bp, Artificial Sequence
  Description of Artificial Sequence: Synthetic coding sequence
atgaagagcgaggactacccccacgagaccatggcccccgacatccatgaggaaaggcagtataggtgcgaagactgcgaccagctttttgagtcaaaagccgagctggccgatcaccaaaaatttccatgtagcacaccccacagtgccttttcaatggtggaggaagatttccaacagaagcttgagagtgagaacgacttgcaggaaatacacaccatccaagagtgcaaggagtgtgaccaagttttcccagaccttcagagcctcgagaaacacatgctgtcacatacggaagagcgcgagtacaaatgcgaccagtgcccaaaggcctttaactggaagagtaatttaattagacaccaaatgtctcacgatagcggcaagcactacgagtgcgaaaactgcgccaaacaagtctttactgatccttctaaccttcagcgccatatcagatctcagcacgtcggtgctcgagcccacgcctgtcctgaatgtggtaaaactttcgctacctcaagtggccttaaacagcataaacatattcatagcagtgtgaaaccctttatatgtgaggtgtgtcacaaatcgtacacccagtttagcaacctctgtcggcataaacgcatgcacgcagattgcaggacccaaattaagtgtaaagactgcggacaaatgtttagcactacttctagcctcaacaagcaccgtagattctgcgagggcaagaaccattttgccgctggcggcttcttcggccagggcatcagcttaccgggcacccctgccatggacaagacgtctatggtgaatatgtcacacgccaatcccggcctagccgactacttcggcgctaatcgccaccctgctggacttacattcccaactgctcccggattctcttttagttttccggggttgttcccatcaggtttgtatcatagacctccactgattcctgcttcatctcccgtcaagggactgagcagcacagagcaaactaacaagtctcaatcaccactgatgacccaccctcaaattttacccgctactcaggacattctgaaagctctaagcaagcacccctcggttggggacaataaacctgtggagcttcaacctgagcgcagctctgaggagaggcccttcgagaaaatttccgatcagagcgagagctcagatctggacgatgtgtctaccccatcaggatccgatttagaaacaaccagcgggtccgacttggagagtgacatcgaatctgacaaagaaaagttcaaggagaatggtaaaatgtttaaagacaaggtctcaccactgcagaatctggctagcataaacaataaaaaagagtattccaaccattcaatcttctcacctagtttggaagaacaaacagctgttagcggtgccgttaatgattccattaaagccatcgcatccatcgccgaaaagtatttcggtagcacaggacttgtcggtctgcaggacaagaaagtgggcgccctcccgtatccttctatgtttccactgcctttttttcctgccttttctcaaagtatgtatcccttccccgaccgggatttgaggagccttcctctgaaaatggagccgcagtctcccggggaagtcaaaaagctgcaaaagggatcgtccgagagtccttttgatttgactacgaagaggaaggacgagaaacctctcacgccagttccttccaaaccacctgtgacacccgctaccagtcaagaccagcccctggatttaagcatgggctcacggtcacgggcttctggcaccaaactcaccgaaccccggaagaatcacgtgttcggcgggaagaagggaagcaatgttgaaagcaggcccgcctctgatggttcattacagcatgcccgcccaaccccatttttcatggatcccatttatagagtggaaaaacgtaagttgactgatcccttggaagctctgaaagagaagtatctgaggcctagccccggcttcttattccatccccagtttcaactgcccgaccagagaacctggatgtctgcaatcgaaaatatggcagagaagcttgaaagcttttccgccctgaagcctgaagcctcggagctgctacagagtgtcccatctatgttcaactttcgagcaccgccaaatgccctacctgagaatctgctgcgcaagggcaaagaaagatacacatgccgatattgcggcaaaatcttccctagatcagccaacctaacaaggcacctcaggacacatactggagaacaaccatatagatgcaagtattgtgacaggtcttttagtatctcttcaaacctgcagaggcatgttagaaatattcataataaagaaaagcccttcaagtgccacctgtgcgatcggtgtttcggccaacaaacaaatcttgaccgccaccttaaaaagcacgaaaatggcaatatgagcgggactgctaccagttcaccacattctgagctcgaaagtacaggtgctatcctggacgacaaagaggacgcctactttacggagattagaaatttcattggcaacagcaaccatggctctcagagccccagaaacgtcgaggagagaatgaatggctcacactttaaggatgaaaaggctttggtgacttctcagaattcagatttgctggacgacgaagaagtagaggatgaagtgctcctcgacgaagaagatgaagataatgacatcacggggaaaacaggaaaggagcccgtgacaagtaatttgcacgagggtaatccagaggatgactacgaggagaccagtgctctggaaatgtcatgcaagacatcacctgtcagatataaggaggaagagtacaagagcgggctgagtgccctcgaccatatcagacatttcacagattccctgaaaatgaggaaaatggaggacaaccaatattcggaagctgagctgtctagcttctcaacttcgcacgtaccagaggagctgaaacagcccctgcacaggaaatcgaagagtcaggcctacgccatgatgctgtccttatccgataaagagagtctgcactccaccagtcatagctcctcgaatgtctggcactcgatggctcgggctgccgccgagtccagcgcaattcagagcatttctcacgtgtag

SEQ ID NO: 19713 - DNA, 3012 bp, Artificial Sequence
  Description of Artificial Sequence: Synthetic coding sequence
atgaagagcgaggactacccccacgagaccatggcccccgacatccatgaagagcgccagtacaggtgtgaggactgtgatcagctcttcgaatcaaaggctgagctggcggatcaccagaaatttccttgttctaccccacacagcgcctttagcatggttgaggaggacttccaacagaagctggagagtgagaacgacctgcaggaaatccacaccattcaggaatgcaaggagtgcgatcaggtattccccgacctgcaaagcctcgagaagcatatgttgagccacacagaagagcgcgaatataagtgtgatcagtgtccgaaagcatttaattggaagagtaatctgatccgacaccaaatgtcgcatgatagcggaaagcactatgagtgtgagaattgcgctaaggttttcacagaccccagtaaccttcagagacacatccggagccagcacgtcggcgctcgcgcgcatgcatgccccgagtgcgggaagactttcgccaccagttccgggctgaagcaacacaaacacatccacagcagtgtaaaaccatttatctgtgaggtatgtcataaaagctacacccagttctctaacttgtgcagacacaagaggatgcatgctgattgccgaactcaaatcaagtgtaaagattgcggtcagatgttttcaacaaccagtagtctcaataagcatcgtaggttctgtgagggcaagaatcattttgctgctgggggtttcttcggtcaaggaatctccctacctgggactcctgccatggacaagacaagtatggtcaatatgtcccacgcgaaccccgggctagctgactatttcggcgctaataggcaccccgcaggcctgacattcccaacagcccctgggtttagttttagcttcccggggctctttccaagcgggctctaccatagacctccactgatccccgccagctccccagtcaaagggttgtcctctaccgaacagaccaacaagtcccagtctcctctaatgactcacccccagattctgcctgccacgcaggatatcctgaaggcgttatctaagcatccctcagttggggataataagccggtggaactgcaaccagagcggagctctgaggagagacccttcgagaagattagcgatcagagcgaaagcagcgatttagacgacgttagcactcccagtggctccgacctagagactaccagtggctcagatctcgagagcgacatcgagtccgataaggaaaaattcaaggagaatggcaagatgttcaaggataaggtcagcccgttgcagaacctggcttcaattaacaataaaaaggaatacagtaatcattccatcttttcaccatcactcgaggagcagaccgcggtctcaggagccgttaacgattccattaaggctattgcctcgatcgccgagaaatactttggttctacgggactagttggccttcaggataagaaagtcggagctttaccatacccatccatgttccctctgcctttctttcccgctttcagccagtcaatgtacccctttcctgacagggacttgcggagtctgcctctcaaaatggaaccgcaatcaccgggggaagtaaagaaattgcagaagggaagctccgaaagcccctttgatctgacgaccaagcgcaaagacgagaaacctcttacaccagtgccttcaaagccccctgttacaccagccacctctcaggaccagcctctggatctgtcaatggggtcaagatcgcgtgcatctggcaccaaattgaccgagcctcgcaagaatcacgtctttgggggtaaaaaagggtccaatgtggaaagtcgccctgcctccgatggctcactgcagcatgccagacccactccgttcttcatggaccctatatatagagtggagaaacgcaaactcactgaccctctggaggctctcaaggagaagtacctcagaccatcacctggctttctgtttcatcctcagatgtctgccattgaaaacatggcggagaagttggagtcattcagtgccttgaagcccgaggcctctgaactgctgcaaagtgttccatctatgttcaacttcagggcacccccaaacgcccttcctgagaacttactgcgtaagggaaaagagaggtatacatgcagatattgcgggaagatattcccgcgatccgcgaacttaacccgtcaccttaggactcacactggggagcaaccttaccgatgcaagtactgcgacaggtccttctctatcagctcaaacctccagcgacacgtacggaatattcataacaaggagaagccttttaaatgccacttgtgcgacagatgcttcgggcagcagacaaatttggatagacacctcaagaagcacgaaaacggcaacatgtcaggaacagcgacaagtagcccccattcagagctggaatctacaggcgccatcctggacgacaaagaagatgcctatttcactgagattagaaacttcatcggaaacagcaatcacggaagccagtcgcctcgaaacgtagaggagcggatgaacggctcccacttcaaggacgaaaaggctctcgttacctctcagaacagcgacctgctggatgatgaggaggttgaagacgaggtgctgctcgacgaggaagatgaggataacgacattactgggaagaccgggaaagaacccgtgacaagcaatctgcacgagggaaacccggaggacgattatgaagaaacctccgcgctggagatgagttgcaagacaagtccagtacgctacaaagaggaggaatacaagagcggactcagcgccctggaccacatcaggcacttcacagactccctgaagatgagaaaaatggaggacaatcagtacagcgaggccgagctgagttcatttagcacaagccatgtgcctgaggagctcaaacaaccattacaccgtaagtcgaaatctcaggaagaatccaaagcttag

SEQ ID NO: 19714 - DNA, 312 bp, Artificial Sequence
  Description of Artificial Sequence: Synthetic coding sequence
atgaagagcgaggactacccccacgagaccatggcccccgacatccatgaggagcggcagtacaggtgcgaagattgtgatcagttgtttgagagcaaggcagagctggcggatcaccagaagtttccctgcagcacaccccattctgccttcagcatggtggaggaagacttccagcagaagctcgagagtgagaacgatctccaggagattcataccatccaagagtgtaaggaatgtgaccaggtgttcccagatctccaatcactagagaaacatatgctgtctcacacagaagagcgggaatactag

SEQ ID NO: 19715 - DNA, 3129 bp, Artificial Sequence
  Description of Artificial Sequence: Synthetic coding sequence
atgaagagcgaggactacccccacgagaccatggcccccgacatccatgaagagcggcagtataggtgcgaggactgcgatcagctcttcgagagcaaagcagagctggcagatcaccagaaatttccgtgcagcacaccccacagcgccttttctatggttgaagaggactttcagcagaagctggagtctgagaacgatctccaggagatccatacgatccaagagtgtaaagagtgtgaccaggttttcccagatctgcaaagccttgagaagcacatgctgagtcatacggaggagagagaatacaagtgcgaccagtgccctaaggcattcaactggaaatctaatcttattcgccaccagatgtctcatgacagcggtaagcattatgagtgcgagaactgtgccaaggtatttaccgacccgtctaacttacagaggcacattagatctcagcatgtcggagcaagagcgcatgcttgccccgagtgcggtaaaaccttcgcaacgtctagcggcctcaaacagcataaacacattcatagttccgtgaagccctttatctgtgaggtctgtcataagagctatacacaattctcaaatctatgtcggcacaaaaggatgcacgccgattgtcggacccaaatcaagtgtaaagattgtggacaaatgttttccaccacctcaagtcttaataagcaccggaggttttgtgagggaaaaaaccattttgccgctggtgggttctttggacaggggatcagtctcccgggaacacctgccatggacaaaacttccatggtcaacatgtctcatgcaaatccaggcttggccgattactttggcgctaaccggcaccctgctggcttaacatttcccacggcgcctggattctcattcagttttccaggcttatttccatcgggtttgtatcaccggccacccttgatacccgcctcctcgccagttaaagggctatctagcacagaacagaccaacaaaagccaaagcccactgatgactcacccgcaaatcctcccggccacccaagacatcctgaaggcactcagcaagcaccctagcgtgggagataacaagccagttgaactccagcctgaacgaagctccgaggagcggcctttcgagaaaatctccgatcagagcgaatctagtgacctggacgatgtgagcactccatccggctccgatctggagacaacctctggtagtgacctggagtccgacatcgaatcggataaggaaaaattcaaagaaaacggcaagatgttcaaggataaggtgtcgcctttgcagaatctcgcatctatcaacaacaagaaagagtactctaaccactcaatattttctccgtctctggaggagcagacggctgtcagcggggccgtgaatgattctatcaaggctatcgcatcaattgccgaaaagtacttcggcagtactggactggtgggtctgcaagataaaaaagtaggcgcgcttccatatccttccatgttccctctgccatttttccctgccttctcccagtcaatgtacccattcccagaccgtgatctccgatctctacccttgaagatggaaccccagagccctggtgaggtgaagaagctgcagaagggatcaagtgagagcccttttgacctgaccaccaaacggaaggacgaaaagcctctgactcccgtcccttcaaaaccccctgtgaccccggctacgtcccaggatcagccactcgaccttagcatgggaagcaggtcaagagcaagtggaaccaagctgacagagcctagaaagaaccacgtgtttggcggaaagaagggaagtaacgttgagagccgccccgcatccgatggcagtctccagcacgctcgccctacaccattctttatggacccgatatacagagttgaaaaacggaaattgaccgacccgctagaagcactgaaggaaaaatacctacggccatcccccgggtttctttttcacccccagatgtctgctattgagaacatggcagaaaaactcgaatcattctcagccctcaagcccgaggcttccgaattgcttcagtcggtcccctcaatgttcaattttcgagcgccacccaacgccctgcccgagaacttgttacggaaagggaaagagcggtatacatgccgctactgtggaaagatttttccaagatctgctaatctgactagacacctgagaactcacacaggcgagcagccttatcggtgtaagtactgtgatcgcagtttttctataagttccaatttacagcgccatgtgcgcaatatacacaacaaagagaagcccttcaagtgtcacctttgtgacaggtgtttcggccaacagaccaatcttgaccgtcatctgaaaaaacacgaaaatggaaatatgtccggcacagccacctcatctcctcactccgagttagaatctaccggggcaatcctcgacgataaagaggacgcctactttaccgagattaggaacttcattggaaacagtaaccacggttcccagtccccacgcaatgtcgaggagaggatgaacggatcccatttcaaagatgagaaggccctggtaacatcccaaaatagcgatctactggatgatgaggaggttgaggacgaggtattgctggatgaggaagatgaagataatgatataaccggtaagaccggcaaagaacctgtgaccagtaacctgcatgaaggtaaccccgaagacgactacgaggagacatccgccctggagatgagctgcaaaacctccccagtacgttacaaggaagaggagtataaatcaggtcttagcgcacttgaccatatccggcatttcacagactccctaaagatgagaaagatggaggataaccagtacagcgaggcagagctctcttctttttccacttctcacgtgccagaggaactaaagcagcccctgcaccgaaaatccaagtcccaggcatatgctatgatgctcagccttagcgacaaggagagcctgcatagcacctcacacagcagctctaatgtgtggcactctatggcacgagccgccgcagagtctagcgcgatacagagcatcagccatgtgtag

SEQ ID NO: 19716 - DNA, 69 bp, Artificial Sequence
  Description of Artificial Sequence: Synthetic coding sequence
atgaagagcgaggactacccccacgagaccatggcccccgacatccatgaagaacgccaatatcgctag

SEQ ID NO: 19717 - DNA, 3156 bp, Artificial Sequence
  Description of Artificial Sequence: Synthetic coding sequence
atgaagagcgaggactacccccacgagaccatggcccccgacatccacgaggaaagacagtatcggtgtgaagactgcgatcagttgtttgagtccaaggctgaattagccgaccaccagaaatttccgtgttccacaccacattcggcattctccatggtagaggaagacttccagcagaaactggaatccgagaacgatttacaggagatacacacaatccaagagtgtaaagagtgtgaccaggtgttcccggatctccagagccttgagaagcatatgctgtcacacactgaggaaagagaatacaagtgcgatcagtgccccaaggcctttaactggaagtcaaacctgattcgccaccagatgtcacacgattcagggaaacactacgagtgcgagaattgcgcaaaggtttttactgaccctagcaatttgcagcggcacattcgttcccagcacgtgggagctagagctcatgcttgccccgaatgcggtaagacatttgcaaccagctctggattaaaacagcataaacacatacatagctccgtaaagccttttatttgtgaggtttgccacaaatcttacacgcagttcagcaatctgtgtagacataagcgtatgcacgcagactgccgcacccaaataaaatgtaaggactgcggacaaatgtttagtactacttcctccctcaacaagcaccgccgcttttgcgaggggaagaaccactttgccgccggagggttctttggacagggcatcagcctccccggcacccccgctatggataagactagcatggtgaatatgtctcacgctaaccccgggcttgcggactatttcggggcaaaccgccatcccgccgggctcacgtttcctacagcaccagggtttagttttagctttccaggactgtttccatcgggactgtaccatcgccctcctctgatccccgcctctagccctgtgaaaggcctgtccagcaccgagcagaccaacaaatcacagtccccactcatgactcacccccagatattgcctgctacccaggacatcttgaaggctttgtcaaagcaccccagcgtaggagataataaaccggtagagctacagcccgagcgtagttcagaggaacggcccttcgaaaagattagtgatcagtcggaatccagtgatctggacgacgtcagcactcccagcgggtcggacttggaaaccacttcaggatcggatctagaaagtgatatcgaaagcgacaaggagaagtttaaagagaacggtaagatgtttaaagacaaagtcagcccactacagaacctcgcctcaattaacaacaagaaggaatattccaaccacagcatcttctcacctagtttggaggagcaaaccgcagtgagcggcgctgttaatgattcgataaaggctattgctagtatcgccgaaaagtacttcggcagtaccggactggtgggattacaggacaaaaaagtgggagccctgccatacccctccatgtttccattgccttttttccccgcattttcccagagcatgtatcctttccccgaccgcgacttgcggagtctgccactgaaaatggaaccccaatcccctggagaggtgaagaaactgcaaaagggctcaagcgagtctccatttgacctaacaactaagagaaaggacgaaaagcctctgacgcctgtaccctcaaagccccccgtgacccccgctacatctcaggatcagccccttgacctgagcatgggaagccggagccgcgcttcagggacgaagttgaccgagccccggaagaatcacgtgtttggcggaaagaaggggtccaatgtggagagtcgccctgctagtgacggctccttacagcacgcccgtcccacgccttttttcatggacccaatttaccgggttgagaaaaggaaactcacggatcctcttgaagctcttaaggagaaatacctcaggccatcacctggctttctgtttcatccgcagttccagctccccgaccagaggacatggatgtctgcaattgagaacatggcggaaaagctggaatctttcagcgcacttaaacctgaggcttccgagctgctgcagtccgtgccatcaatgtttaactttcgggctccacccaatgcccttcctgagaacctgctgcgcaagggtaaagagcgctacacatgtcgctactgtggaaaaatcttcccgcgtagtgccaatctgactcgccacctgcgcacccacaccggagaacaaccctacagatgtaagtactgcgatcgctctttctcaatctcttcaaacctccaaaggcatgtcagaaatattcacaacaaggaaaagccttttaaatgccacctgtgtgatcgctgttttggccagcaaaccaatctcgaccgccacctgaagaaacatgaaaatggcaatatgtccggtacagccacatcgagtccacactccgaactggaaagcacgggcgctatcctggacgataaggaggacgcttattttacagagattcgcaacttcataggaaacagtaatcacggatcccagagccctcgcaatgtagaggaaaggatgaatggttctcactttaaggatgagaaggctctggtaacatctcagaactccgacttactggacgacgaggaggtcgaggatgaggtgctcctggacgaggaggacgaggacaacgatatcacaggaaagactgggaaagagcccgtcacctccaaccttcatgaggggaaccccgaggatgactatgaagagaccagcgcactcgaaatgtcctgtaagacgagccccgtaagatacaaggaagaggaatacaagagcgggctgtctgctctggaccatatcaggcattttaccgactccctcaaaatgcgcaagatggaggacaaccagtacagcgaagccgagttaagcagtttcagcactagccatgtgcccgaagaacttaaacagcccctccacagaaagagtaaatctcaggcctacgccatgatgctttctctttccgataaggaatccctccatagcactagccattcgagtagcaacgtgtggcattctatggccagagccgctgctgaaagcagtgctattcaatccatatctcatgtctag

SEQ ID NO: 19718 - DNA, 3159 bp, Artificial Sequence
  Description of Artificial Sequence: Synthetic coding sequence
atgaagagcgaggactacccccacgagaccatggcccccgacatccatgaggagagacaataccgctgcgaggattgcgatcagctgttcgagagcaaagctgaactcgcagaccaccaaaagttcccctgttcaacaccccattctgcttttagcatggtggaggaagatttccagcaaaaactggagtcagagaatgatttacaagaaatccatacaatccaggagtgtaaagagtgtgaccaggtgttccctgatctgcagtctcttgagaagcacatgctatcccacacagaggaacgggagtacaagtgtgatcagtgcccgaaagcgtttaattggaagtctaatctgatccgtcaccagatgagtcacgacagcgggaaacactacgagtgcgagaactgcgcgaaacaggtttttactgatccctctaatcttcagcggcatatcaggtcccagcacgtgggggctcgagctcacgcgtgtcctgaatgtggaaaaactttcgcaacatcatccgggttaaaacagcataagcacatccacagtagtgtgaaaccgttcatttgcgaagtctgtcacaagagctatactcagtttagcaatctgtgccggcataaaagaatgcacgctgactgtagaacacagataaagtgtaaagactgtggccaaatgtttagcacgacatcttccctcaacaagcacagacgattttgcgagggcaaaaaccacttcgctgctgggggcttcttcggacaggggatttcattgcctggcacaccagcaatggacaagacatctatggttaatatgtctcacgctaatccaggcctggcggattatttcggagccaaccgccaccccgcagggctgacgtttcctacagccccgggatttagcttctcctttcctggactgttcccctctggcctgtaccacagacctcccctcatcccagcgtcaagccccgtgaagggcctgtcctccacagaacagaccaacaagagtcagtcacctctgatgacccatccacaaatacttccagctactcaagacatcctgaaggccctatccaagcatccctcagtgggggataacaagccagtggaactgcagcccgaaagatcatctgaagagcgcccatttgagaagatctctgaccagtcagagtcctctgacctggatgatgtcagtacacccagcggcagcgacctagaaacaacatccggcagcgacctggaatccgatatagagtctgataaagaaaaattcaaagaaaacggcaagatgttcaaggacaaagtcagccctctacagaatctggccagtataaataacaagaaggagtacagtaatcactcaatcttctctccttccctcgaagaacagacagctgtttccggagctgtcaacgatagcatcaaggccattgcctcaattgctgaaaagtactttgggtccacaggtctggtgggactccaggataaaaaggtgggcgcactcccttacccgagcatgtttcccctgcccttctttcccgcattttctcagtcaatgtaccctttccccgacagggatctcagatcactgccactgaaaatggagccccagtcccccggggaggtcaaaaagctccagaagggatcgtccgagtccccttttgacctcacaacgaagcgcaaagatgagaagcccctcacacccgtgcctagcaaacctcctgtgacccccgccacctctcaggaccagcctcttgatctgtccatgggcagtcgctcccgcgcatctggcacaaagctgaccgaacctcgaaaaaaccatgtgttcgggggtaaaaaaggcagtaacgtagaaagccggcccgcctcagatgggtccctccagcatgcccgcccaacaccgtttttcatggacccaatctacagggtggagaagagaaagctcaccgatcctctcgaggctctgaaggagaaatacttgcgaccttcccccggcttcttattccatcctcaattccagctgcccgaccagaggacttggatgagcgccatagagaacatggctgagaaactggaaagtttctctgccctcaagcctgaagccagcgagctgctgcagagcgtgccaagcatgtttaacttcagggcccccccaaacgctctcccagagaatctattgcgcaagggaaaggagagatacacgtgccgatattgcggcaagatcttccctagatcagcaaatctcaccaggcaccttaggactcacacaggagagcagccgtacagatgcaagtactgcgatcggagtttctcgatcagctcaaatctccagcgccatgttagaaatatccataacaaggagaagccctttaagtgccacctgtgcgacagatgcttcgggcagcagactaatctcgatcgtcaccttaaaaagcacgagaacggcaatatgtctggcacagcaaccagctcaccacactccgaactggaaagcacaggcgccatcctggatgataaggaagacgcctactttacagagatccgtaactttatcggtaactccaaccacggctcccagtcaccacgcaacgtggaagaacgcatgaacggcagtcattttaaagatgagaaagccctcgtgacctcacagaactctgatctgctggacgacgaagaggtcgaggatgaggtgctcctggatgaggaggacgaggataatgacatcacgggcaagacggggaaggagcctgtgacatctaacttgcatgaaggtaacccagaggacgactacgaggaaaccagcgcactcgaaatgtcatgtaagacttcgcctgtacggtacaaagaagaagagtacaaatccggcctaagcgcacttgaccacatacgtcatttcaccgattctctgaagatgcggaagatggaagacaatcagtactccgaggccgagctttcatcgttctccacgtcccacgttccggaggagttaaagcagccacttcatcgaaaaagtaagagccaggcatacgctatgatgttatcactgtcagataaggagagtctgcacagcacctcgcactcatcctccaatgtgtggcattctatggcgcgggcagccgctgaatcttctgctatacagtctatttcccacgtttag

SEQ ID NO: 19719 - DNA, 207 bp, Artificial Sequence
  Description of Artificial Sequence: Synthetic coding sequence
atgaagagcgaggactacccccacgagaccatggcccccgacatccacgaggagcgccagtataggtgtgaagactgcgatcagttatttgagtccaaggccgagctggctgatcaccagaagttcccctgtagcacgccacactccgctttttccatggtggaggaggatttccagcagaagcttgaatcggaaaatgacctgtag

SEQ ID NO: 19720 - DNA, 90 bp, Artificial Sequence
  Description of Artificial Sequence: Synthetic coding sequence
atgaagagcgaggactacccccacgagaccatggcccccgacatccatgaggagagacagtacagatgtgaagactgcgaccagctctag

SEQ ID NO: 19721 - DNA, 378 bp, Artificial Sequence
  Description of Artificial Sequence: Synthetic coding sequence
atgaagagcgaggactacccccacgagaccatggcccccgacatccacgaagaaagacagtaccgctgcgaagactgtgaccagttgttcgagagcaaagctgagttggctgatcaccagaagttcccttgctccaccccccatagcgcctttagcatggtagaagaagatttccagcaaaagcttgagagtgagaacgacctacaggaaatccacactattcaggagtgtaaagaatgtgaccaggtgtttcccgatctgcagtcgctggagaaacatatgctgagccacacagaagaaagggagtataagtgcgaccagtgccctaaggcttttaattggaaaagtaatcttatcagacaccagatgtcacattag

SEQ ID NO: 19722 - DNA, 312 bp, Artificial Sequence
  Description of Artificial Sequence: Synthetic coding sequence
atgaagagcgaggactacccccacgagaccatggcccccgacatccatgaggaacgccaatacagatgcgaggactgtgatcagttatttgagtccaaggcagagctcgccgaccaccagaaatttccttgttctacgccacattcagccttctccatggtggaggaagactttcagcagaaactggaatctgagaatgacctccaagagatacatacaatccaggaatgcaaagaatgtgatcaagttttccctgacctgcaaagtttggaaaaacacatgctcagccacacagaggagagggaatactag

SEQ ID NO: 19723 - DNA, 3693 bp, Artificial Sequence
  Description of Artificial Sequence: Synthetic coding sequence
atgcggagcaagggccgggcccggaagctggccaccaacaacgagtgtgtttatggcaattaccccgagatccctttagaagaaatgcccgacgctgatggagttgccagtacccctagtttaaacattcaggagccttgcagtcccgccacctcctcagaggcgtttacccccaaagaaggatcaccctacaaggcccctatctatatccctgatgacattccgatcccggccgagtttgaactcagagaaagtaacatgcctggcgcaggactagggatctggaccaaacgaaaaatcgaagtgggggagaagtttgggccttacgtgggtgaacagaggtccaacctaaaggacccgtcctacgggtgggagattcttgacgagttttacaacgttaagttttgtatagacgcgtcccaaccagatgtgggaagctggctcaaatatattcggttcgcagggtgctatgaccagcataacctggttgcatgccagattaatgaccagatcttctatcgggttgtggccgacattgcccctggggaggagctgctactttttatgaagagtgaggactaccctcacgaaactatggcccctgacattcatgaagagagacagtacaggtgcgaagactgcgatcagctgttcgagagcaaagccgagctcgcagaccaccagaaatttccgtgttccacgcctcattctgcattttcaatggtggaggaggactttcagcagaaactggagagcgaaaatgacctgcaggaaattcacaccatccaagagtgtaaagagtgcgaccaggtatttcccgatttgcagtccctggaaaagcacatgttatctcatacagaagagcgtgaatacaagtgcgaccagtgccccaaagccttcaactggaaaagcaacctcatccgtcaccagatgagccacgactcaggcaagcattacgaatgcgagaattgcgctaaagtcttcactgacccgtctaatctgcaacggcacatacgctcccagcacgtcggtgcccgcgctcacgcatgtcctgaatgcggcaagacgtttgcaacttcgagcggattgaaacagcataaacatatccatagtagtgtgaaaccttttatttgtgaggtatgtcataagtcatacacgcagttctctaatctgtgcaggcacaagcgtatgcatgccgactgccggacacagatcaagtgcaaagactgcgggcagatgtttagcaccacttcttctctaaacaaacaccgcaggttctgcgaggggaaaaaccacttcgcagccggagggttctttggtcaggggatttcacttcccgggactccagcaatggacaaaacctccatggttaatatgtcccacgcaaatcctgggctggcagattacttcggggccaaccggcaccctgctggactcactttcccaaccgcacccggcttttctttcagctttcctggcctattcccatcgggattatatcaccggccgcctctgataccagcttcctctcctgttaagggcctgagctccaccgagcagactaataagagccagtcaccccttatgacacacccacagatcctccccgccacgcaagacatcctcaaagcactttcgaaacacccgagcgttggggataacaagcccgtggagcttcagcccgagagatccagtgaggaacgccccttcgagaagatttccgatcaatcggagtcttccgaccttgatgacgtctctacaccgtctggatccgatctcgaaaccacctcaggttctgatcttgagagtgatatcgaaagtgacaaagagaaatttaaggaaaacggcaaaatgtttaaagacaaggtgtcacctctgcagaatctggcttctattaacaataagaaagagtactctaatcactctatttttagcccctcgctcgaagagcagactgccgttagcggagccgtcaatgacagcatcaaggccatcgcctccattgctgaaaaatacttcggcagcactggacttgtcggcctgcaagacaaaaaagtgggggccctcccgtacccttctatgttccccctgccgtttttccccgccttttctcagtctatgtaccctttccccgaccgcgatctgcgctctctccctcttaagatggagcctcagagtcctggagaggttaaaaaactgcagaaggggagcagcgagtcaccatttgatttgacgacaaaacggaaagacgagaagccactcacacctgtgccttccaaaccccccgttacacccgccaccagccaagatcagcccttggacctgagtatgggttcccgcagccgagcctccggcactaaactgacagaaccccggaaaaatcacgttttcggcggcaagaaaggctccaatgtggagtcccgtcctgccagtgatggaagcttacagcacgctcggcctacacctttcttcatggaccctatttatcgggtggagaaacgcaagctgaccgacccgctcgaagctctgaaagagaaatatttgcggccgtcgcctgggttcctttttcacccacagatgtccgccattgagaacatggctgagaagcttgagtcgttttccgcactgaaaccagaagcttctgagctcctgcaaagcgttccctctatgtttaatttcagagccccaccaaacgccctgccagaaaatctgctgcgaaagggcaaggaacggtacacatgcaggtactgcggtaagatctttccccgatcagccaacctgactaggcatttaagaacccataccggtgaacagccatatcgttgcaagtactgcgatcgttccttcagcatttctagtaacctgcagcgtcacgtgcgaaatattcacaacaaagaaaagccttttaagtgtcatctgtgtgatcgttgttttggccagcagaccaacctggacaggcatctcaagaagcatgagaacgggaacatgtccggcacagccacctcaagcccccattctgagctagagtcaactggtgctatactggacgacaaagaagacgcatactttactgaaatcagaaacttcattggcaacagcaaccacggtagccagtctcctagaaatgtggaagagagaatgaatgggtcacatttcaaagacgaaaaggcccttgtcacttctcagaactccgaccttctggacgacgaggaagtggaggacgaagtcctcctcgacgaggaggacgaggacaatgacatcactgggaagaccggaaaagagccagtgacttccaacctgcacgagggtaatcccgaggacgattacgaagaaacatctgcactcgagatgagctgcaaaacttctccagttcgctacaaggaggaagagtacaagtcgggactctcagccttggatcatatccggcacttcacggactcgttgaaaatgagaaagatggaagataatcagtactccgaagccgagttgtcaagcttcagcacgagccacgttccagaagagctaaaacaacccctgcatcgaaaaagcaagtcacaagcctacgccatgatgctgtcactatctgacaaagagagtctccacagtactagtcattcatcttccaatgtgtggcattccatggcccgggctgccgctgagagcagcgcaatccaaagtatcagccacgtgtag

SEQ ID NO: 19724 - DNA, 312 bp, Artificial Sequence
  Description of Artificial Sequence: Synthetic coding sequence
atgaagagcgaggactacccccacgagaccatggcccccgacatccatgaagaaagacagtatcggtgtgaggactgtgaccagctgttcgaatctaaggccgaactcgccgaccatcagaagtttccttgtagcacaccccacagcgcatttagtatggtggaggaggacttccagcagaaattagaaagcgagaatgatttacaggaaattcacaccattcaggagtgcaaagaatgtgaccaggtgttccctgaccttcagtcactcgaaaaacatatgctgtcccacacggaggaacgagagtattag

SEQ ID NO: 19725 - DNA, 2256 bp, Artificial Sequence
  Description of Artificial Sequence: Synthetic coding sequence
atgtgcgacctgcggcggcccgccgccggcggcatgatggacctggcgtatgtatgtgaatgggaaaaatggagcaaaagtacacactgcccctcagttccactggcctgcgcttggtcttgtaggaacctgatagcatttacaatggatctccggtctgatgatcaggatctgacaaggatgattcatatcctggacacagagcacccttgggatctgcacagcatcccaagcgagcatcacgaagcaattacctgtctggaatgggaccagtccgggagccgcctgctgtccgcggacgcagatggtcaaatcaaatgctggagcatggctgatcatctggcaaacagctgggaatcaagtgttggctctctcgtggaaggagacccgatagtggcactgtcctggctgcacaacggcgtcaagttggcgctccacgtggaaaagtccggagcttccagctttggagagaaattttctcgggtgaagttctccccatccctgactctgtttggcgggaagccgatggaaggttggattgccgtaactgtgtctggactcgtcactgtgtctttacttaaaccgagtggccaggtattaacatcaacagaatcactgtgtcggctaagaggaagggtggctctggccgacattgcattcaccggcggagggaacatcgtggtcgctacagccgatggctcaagtgcctcgccggttcagttttataaggtttgcgtttccgttgttagcgagaaatgtcgaatcgacaccgagatcctgccatccctgtttatgaggtgcaccacagatctgaaccgcaaggataagttcccagcgataacccatctgaagttcctggccagagatatgtcagaacaggtgctgctatgcgccagctcgcaaacttcatccattgtggagtgctggtctcttagaaaagaggggctgccagtgaacaatattttccagcagatcagccccgtggttggagacaaacaacccaccattctcaagtggcggattctttctgcaactaatgacctcgatcgcgtgtccgcagtggccctgccaaagctgcctatctcactgactaataccgacttgaaggtcgccagcgacacacaattctatccagggctgggattagccttggcttttcacgacggctccgtacacatagtgcacaggctgtccctccagactatggccgtgttctattcatcagccgccccgagaccagtcgatgaaccagcaatgaagaggccaagaacggctggacccgccgtgcaccttaaagccatgcagctatcctggacatcacttgctcttgtaggcatagacagtcatggaaagctctctgtgctgcgcctaagccccagtatggggcacccactggaggtcggactggcactacgtcatctgctcttcctgctggaatattgtatggtgaccggctacgattggtgggacattctgcttcacgtacagccatccatggtgcagtcccttgtggagaagctccatgaggagtacactaggcaaacagcagccctccaacaggtcctgtccactcgcattctggcgatgaaagcttcactttgcaagctctccccgtgtaccgtgaccagagtgtgcgattaccatacaaaacttttcctcatcgcaatcagtagtactctgaagtccctcttacggccgcactttttgaatacacccgacaaatcaccaggagatcgactgacagaaatatgcacaaaaattacagacgtggacattgataaagttatgatcaatctcaagacagaggaattcgtgctagatatgaacacattacaggcgctgcagcagctgcttcaatgggttggggatttcgtgctgtacctgttggcaagcctgcctaatcaagtggctatgagagcccagagagcaagtcggacacgccgatggtggatgaacgcggcctgttgtcctgcttcatgcttgagtcccgcgtggacaggatgccagccagccactgcctggcttgcagcttgctcacccagtagtccattcgtgtgtagcctggctggacggccaagatgcttggctgtgctgccaccgtgttccagcaccgccagtcctggcccccaagccagccccagaagcaccacatgcggaggttgtacgcttgccctggcccccagacgcaatgctcgaccggcacccggagccgctgtttccccttgcagttcgcggcccacagagcccaggaggtag

SEQ ID NO: 19726 - DNA, 2583 bp, Artificial Sequence
  Description of Artificial Sequence: Synthetic coding sequence
atgtgcgacctgcggcggcccgccgccggcggcatgatggacctggcttacgtatgcgagtgggaaaagtggagcaaatcaacccactgccccagcgtccctctcgcgtgtgcttggtcatgcagaaatcttatcgcattcaccatggacctgcgctctgacgaccaggaccttacgcgtatgatccacattctggatacagaacacccttgggacctccattccatcccatctgaacaccatgaagccatcacttgtctggaatgggaccagtctgggtctcggctgttaagcgcagatgccgacggccagattaagtgctggagcatggctgaccacttggctaactcctgggaaagcagcgtgggatccctggtcgaaggcgatcccatagtcgctctcagctggctgcacaatggggtgaaactggcattgcatgttgagaaatctggagcgagctcttttggggaaaaattttccagagtcaagttctctccaagcctcaccctcttcggcggaaaacccatggagggctggatagccgtcaccgtgagtggcctggtgactgtctctctgcttaagcccagtgggcaggttctgactagtaccgaatccttgtgtaggctccgcggtcgggtggctttagcagacattgcgtttactggcggtggaaacattgtcgtggcgaccgccgatgggtccagcgcatctccagtgcagttctacaaagtgtgcgtatccgtcgttagtgaaaagtgcagaattgacactgaaattttacccagcctatttatgaggtgtacaaccgacctgaaccggaaggacaaatttcctgcaattacacatctgaagttcctggctcgcgacatgtcagagcaagtgttactgtgtgcgagctctcagacgtcctcaatcgtggaatgttggtccctgcgcaaagagggccttcctgtgaataacatcttccagcagatttcccctgtcgttggcgataaacagcctaccattctgaagtggcgtatcctgtctgccaccaatgacctagatagggtgtcggccgttgccctgcccaaactgcctatcagtttaacaaatactgatctgaaggtggcttcagacacacagttttatcccgggcttggtctcgcgctcgcttttcacgacggatccgttcacattgtgcaccgtctttcgctgcagacaatggccgtgttttactccagcgctgcccccagacccgtggatgaaccagccatgaagcgcccgcgaaccgcaggcccagcagtgcacttgaaggcaatgcaactcagctggacctcactagcgctggtgggtatagatagccacgggaagctgagcgttctgagactgtctccaagcatgggccatccgcttgaggtgggtcttgcgctcaggcatctgctgtttttgctcgagtactgtatggtgacggggtatgattggtgggatatcttactgcacgtacagccttccatggttcagtcactagtcgaaaaacttcacgaagagtatacacgacagaccgccgccttgcagcaggtgctgtctacgcggatcctagctatgaaggcctccctttgcaaacttagcccctgcaccgtcacccgggtctgcgactaccatacaaaattattcctgattgcaatatccagcacgttaaagtcactgcttcggcctcatttccttaacaccccagacaagagccccggcgaccgccttaccgaaatctgtactaagatcactgacgttgacatagataaggtcatgattaatctgaaaactgaagaatttgtgttagatatgaacacccttcaggcgctccagcagctgctgcagtgggtgggggacttcgtgctctacctgctggcctccctgcccaatcaaggcagcctgctccgccccggccatagttttctccgcgatgggacttcacttggtatgctccgcgagttgatggtggtaattcgcatttggggactgctcaagccatcttgcctgcccgtgtatacggcaactagcgacacgcaggattccatgtccctgctatttaggctgttaacgaagctctggatctgtttcccttccaccgggccctgctctgtctgggtgcttttaggctggcaacccctaccggggcgagatgaggggcccgctagcgagcccgacgaggcactcgtggatgagtgctgcctgctaccatcacagctcctgattccatctcttgactggcttcctgccagcgacggactcgtgagccgactccaacctaaacagccgctacgtctgcagtttggccgagctcccacgctgccgggttccgccgccactctgcagctcgacggacttgcgcgagctcccggccaacctaagatcgaccatttacggcggctgcacttaggggcctgccccacagaagagtgtaaggcctgcactaggtgcggctgcgtgacaatgctgaagagtccaaacagaaccactgccgtaaaacagtgggagcaacgttggataaagaactgtttatgcgggggtctctggtggcgggttcccctgtcttacccctag

SEQ ID NO: 19727 - DNA, 2634 bp, Artificial Sequence
  Description of Artificial Sequence: Synthetic coding sequence
atgtgcgacctgcggcggcccgccgccggcggcatgatggacctggcctacgtgtgtgagtgggagaagtggagcaagtcaacgcactgccccagcgttccactagcttgcgcctggtcctgcaggaatctaatagccttcactatggatttgcgtagcgatgaccaggacctcacacggatgattcatattttggacaccgaacacccatgggatttacactccatcccgagcgaacatcatgaagccatcacctgcttggagtgggatcaatccggatctaggcttttatctgctgatgccgacgggcagatcaagtgctggtccatggccgaccacttggctaattcatgggagagttctgttggaagtcttgtggaaggcgatcccatcgttgcccttagttggctccataatggcgtcaaactggccttgcatgtggaaaagagcggcgcttcctccttcggcgagaagtttagtcgcgtcaaattctcgccgtctctgaccttgttcgggggcaagccaatggagggatggattgccgtaacagttagcggcttggtgaccgtttccttactcaaacccagcgggcaggtgcttacttccactgagagcctctgcagactccgggggcgggtcgccctggctgatattgcttttaccggcgggggaaatatcgttgtcgccactgccgacggttcaagcgcctcaccagtgcaattttacaaggtctgtgtctcagtcgtctccgaaaaatgtagaatagataccgaaattctacccagcttgtttatgcggtgcaccaccgaccttaaccgaaaggataaatttcctgccataactcacctgaagtttttagcacgcgatatgtctgaacaggtccttttatgtgcgtcttcccaaacttctagcatcgtggaatgctggagcctgagaaaagaagggctgcctgtgaacaacatttttcagcaaataagtcctgtggtgggtgataagcagcctactattcttaagtggagaatcctcagcgccactaacgatctggacagagtgtcagccgtcgctttacccaagctccccatatcccttacaaacacagaccttaaggtggcaagcgacacccaattttaccccggtctgggactggctctggcttttcacgacggcagcgtccacatagtgcatagactctccttgcaaacaatggcagttttttatagctctgccgccccgcggcctgtggatgagccggctatgaagaggcccagaaccgctggacccgcggttcatctgaaggcgatgcagttaagctggactagtctggctcttgtgggaatcgattcacatggcaagctcagtgttcttagactctctccctctatgggccatccattagaagttggccttgcgctccggcacctgctgttcctactggaatattgtatggtcacaggctacgattggtgggacattctgttgcatgtgcagccatcaatggtccagtctctcgtggagaagttgcacgaggaatacacccgccagactgcagccctgcaacaggtactgagcacgagaattctggcgatgaaagcttccctatgcaaactgagcccctgcacagtcaccagagtttgtgattaccataccaaactgttcttaattgcaattagctcaacactcaaatccctcctgcgaccccactttctcaacacaccagacaaatctcccggagatcgcctaacagaaatctgcaccaaaatcaccgatgtggatattgataaggtgatgattaatttgaagaccgaggaatttgttctggacatgaatactttacaggcccttcagcagttactccaatgggttggagactttgtactctacttactggcatcactccccaaccagggctctctcctaaggccggggcacagcttcctccgggacggaactagtttaggtatgctccgcgaactgatggtggtgattcgtatttggggtctgttgaagcctagttgccttcccgtctacaccgccactagcgacactcaggattcaatgagtctgctgttccggctgcttaccaaactgtggatctgctgccgggacgaaggtcccgcctctgagccagatgaagcattagtggatgaatgctgcctgctcccttctcagctgctcatcccttctctggactggctccctgcaagcgatggtctggtttcaaggttgcagcccaaacagccgctccggctgcaatttgggcgcgctccaactctccctggtagtgcggccacactccagcttgatggactcgccagagcgccaggacagcccaagatcgaccaccttcgcagactgcaccttggagcatgcccgactgaggaatgtaaggcttgcaccagatgtggctgtgttacaatgcttaagagtcctaacaggactaccgcagttaaacagtgggaacagcggtggatcaagaattgcctggcggtcgagggtcgcggtccggacgcctgcgtcacgtcaagagcaagcgaggaagctcccgcatttgttcagctcggaccccagtccactcaccattcaccgaggaccccgcgctctttggatcatctgcacccggaggaccgcccttag

SEQ ID NO: 19728 - DNA, 2526 bp, Artificial Sequence
  Description of Artificial Sequence: Synthetic coding sequence
atgtgcgacctgcggcggcccgccgccggcggcatgatggacctggcgtatgtgtgtgaatgggagaaatggtcgaaatcgacacactgcccatccgtcccactcgcatgcgcctggagttgccgtaacctgatcgcttttaccatggatctgagatctgatgaccaagatctaacccgaatgatccacatcctagacaccgagcacccgtgggacctgcattcaatcccctcggagcaccacgaggccatcacctgcttggaatgggatcagagcggttcaaggctactctctgccgacgctgatgggcagatcaaatgctggagcatggctgaccatctggccaacagctgggagtcctccgttggatcgcttgtggaaggcgaccctattgtcgccctgagttggctgcacaacggcgtaaaactcgcccttcatgtcgagaaatctggagcctcctccttcggagagaagttctctcgtgtgaaattcagtccatcactgacactatttggcgggaaaccgatggagggctggatcgccgtcactgtatccggcctggttacggtctcactacttaaaccgtcaggccaggtgctgacgagcaccgagtctctgtgtagactgcgaggccgagtagctctggccgacatcgcctttaccggcgggggcaatatcgtggtggcaacggccgatgggtcgtccgcctcaccagttcagttttataaggtgtgcgtttctgtggtctcggagaagtgtcgtattgacacagagatacttccctccttattcatgaggtgcacaaccgaccttaaccgaaaggacaaatttccagctattactcacctaaaatttctcgccagagacatgtcggaacaggtactgctttgtgcctcaagccaaactagttcgattgttgagtgttggagcttgagaaaagaggggttgcctgtgaacaatatcttccagcagatttcaccggtggtgggcgataaacagccaactatcttaaaatggcgcattctatccgctaccaacgacttggaccgcgtgtccgctgtggccctccctaagctcccaattagtctgacaaatacagatctgaaagtggctagcgacacacagttctacccaggcctgggcctcgccctggccttccatgatggctctgttcatatcgtgcatagactaagccttcaaacaatggctgtgttctactcctccgctgctccccggccagttgacgaaccggctatgaaacgacctaggactgcgggaccagctgtgcatctgaaagccatgcagctctcatggacctccctagcactggtcggaatcgattctcatggcaagctcagcgtgcttagactgagtccaagtatgggtcaccccctggaggtgggtttggccctcagacatctgttgtttctgctggaatactgtatggttactggctatgattggtgggacatactcctgcacgtgcagcctagcatggtccagtctctcgtagaaaaactgcacgaggagtacaccagacagaccgccgccctccagcaggtgctctctaccagaatcctcgctatgaaagcaagtctgtgcaaactttccccctgcacagtgactcgagtctgcgactatcatactaagctgtttttaatcgcaatctcatctacgctgaagtccttgttgcgccctcacttcctgaacactcccgataaatcccctggagaccgcctaaccgagatttgcactaaaataaccgatgttgacatcgacaaggtaatgattaatttaaagacggaggaattcgtattggatatgaacactttacaggctttacagcagctgctccagtgggtaggcgattttgtgctatacctgctggcttcactgcccaaccagggctcactgctacgcccaggacactcttttctccgggatggcacctctctaggtatgctgagagagttgatggttgtaatacgaatatggggactgctaaagccaagctgtctccctgtctatacagctacctctgatactcaggattcgatgtccttgctgtttagacttctcaccaagttatggatctgttgtagagatgaaggccctgcttccgaaccagacgaagccttggtggacgaatgttgccttctgccctcgcagctgctgattccaagcctcgactggctcccagcaagcgacggtttggtttcacgtctgcaacctaaacagcctctgcggctccagttcggaagggccccaactctgccaggatctgctgccactctgcagctcgacggacttgcacgtgcccccgggcagcccaagattgaccacttgagacggctgcatctcggtgcttgcccgacagaagagtgcaaggcctgtaccagatgcggttgtgtgactatgctaaaaagcccaaacagaaccactgccgttaagcaatgggagcagcgctggattaagaattgcctgtgtggcggactgtggtggagggtgccattgtcgtacccatag

SEQ ID NO: 19729 - DNA, 1992 bp, Artificial Sequence
  Description of Artificial Sequence: Synthetic coding sequence
atgtgcgacctgcggcggcccgccgccggcggcatgatggacctggcctatgtgtgcgagtgggagaagtggtctaagtcaacgcattgtccctctgtgcccctggcctgtgcctggtcatgccgtaatctgatcgcatttactatggacctgagaagcgatgaccaggacctgacccgcatgatccacatattagatactgaacatccatgggacctgcactcaatccccagtgaacaccacgaggccattacgtgtctggagtgggaccagtccgggtcacgtctgcttagtgcagacgcagacggtcaaattaaatgctggagcatggctgatcaccttgccaatagttgggagtcaagcgtcggctccctcgtcgaaggcgaccccattgtggccctttcttggctacacaatggggtgaaactcgcactgcacgtggaaaaaagcggtgcgagtagctttggcgaaaagttctccagggttaagttctctccctctctcactctttttggcgggaaacctatggaaggatggatcgcagtgacagtctccggtctggtaacggtgtcccttctgaaacctagcgggcaagttctcacttccactgagtccctgtgccgactgagaggcagggtggcgcttgccgacattgcttttacaggcggcggcaatattgtagtcgccaccgctgacggctctagcgcgtcccctgtgcagttttacaaagtgtgcgtctcagtcgtttctgaaaagtgccggatcgacactgaaatcctgcccagcctgtttatgaggtgcacaactgaccttaatcgcaaagacaaatttcctgctattacgcacctgaagttcctggccagagatatgtctgagcaggttctactctgcgcctcatcacaaacaagctcaatcgttgagtgctggtccttgaggaaggaagggttgcctgtgaacaatatcttccagcagatttcccccgtagtcggggacaagcagcctaccatcttaaagtggcgtatccttagcgctactaatgacctcgatagggtgtccgctgtcgcactgcctaaacttccgatatccctgacaaataccgaccttaaggtggccagtgatacgcagttctacccagggcttggattggccttggcatttcatgacggttccgtgcacatcgttcaccggttgagcctgcagaccatggcagtcttctattctagcgctgccccccgaccagttgatgagccagcaatgaagcgccctcggacggctggccctgcggtccatctcaaggccatgcagttaagctggacaagtctggcactggtggggatagatagtcatgggaagttatccgttctaagactctctccgtctatgggccaccccttggaagtggggctcgctctaagacacctactcttcctgcttgaatactgtatggttaccggctatgactggtgggatattctgctgcatgtgcagccctctatggtgcagtccctggtcgagaagctgcatgaagagtatacccggcagacggctgccctgcagcaagttctgagtacacgtatcttggccatgaaggcttccctgtgtaagctgagcccgtgtactgtcacccgggtgtgcgactaccatacaaaactgttcctcattgctatttcaagcacccttaaatcactgctcaggcctcatttcctgaatactcctgacaagagtcccggggataggttgacagaaatatgcactaagatcacggatgtggacatcgacaaagtgatgatcaacctgaaaacagaggaattcgtcctggatatgaacactctgcaggctcttcagcagctgttgcaatgggtcggtgatttcgtcctttacttgcttgcttcacttcctaaccaaccatgtccgacctcggaaccttgtcccacgagtgaaccatgtcctactagcgagcctagtcctacttcagaaccttcacccacttag

SEQ ID NO: 19730 - DNA, 1614 bp, Artificial Sequence
  Description of Artificial Sequence: Synthetic coding sequence
atgtgcgacctgcggcggcccgccgccggcggcatgatggacctggcatatgtatgtgaatgggagaagtggtctaaaagcacccactgcccctctgtaccactcgcgtgcgcctggtcctgcaggaatctcatcgcatttactatggacctgcgctccgatgaccaggacttgacccgaatgatccatattttggacacggagcacccatgggacctacatagcattcccagcgagcatcacgaggccattacctgtctcgagtgggaccagtctggaagtcggttattgagtgccgatgcggacgggcagattaagtgctggtcaatggctgatcatctagctaatagctgggagagttcggtgggttcactagtggagggcgacccgatcgtcgccttgtcttggcttcataatggggtcaagttggccctgcacgtcgaaaagagcggcgcctcaagtttcggtgaaaaattctccagggtaaagttttcaccttcactgacactctttggcggaaaaccaatggagggctggattgccgttacagtatcaggcctggtcactgtgagcttgctgaagccctctggccaggtgctaacgtccaccgagtctctttgtcgcctacggggaagggtggcgcttgccgatatcgcttttactggagggggaaacattgtggtggccactgccgatgggtcttctgcctcccctgtgcagttttataaagtctgcgtctccgttgtgtccgagaagtgccggatcgacaccgaaatcttaccctccctgtttatgcgctgtaccacggatctcaaccggaaagacaagtttcctgcaatcacgcatctaaaattcctcgccagagacatgtccgagcaggtgctgctgtgcgccagttcccagacgagcagtatcgtggagtgctggagcctgcggaaagagggcctccccgtcaataatatctttcaacagatttcacccgtggtgggcgataagcagcctaccattctcaaatggcggattctgtctgctaccaatgatctcgacagggtctctgcagttgccctacccaagttgccaatctcactcacaaacacagacctcaaggtcgccagtgacacacaattctatccaggtctgggcctcgcccttgcgtttcatgacggctcagtgcacatagttcatcgtcttagcctccagacaatggcagtgttttactcctctgcagcacctcgtcctgtcgacgaacccgctatgaagagacctcgaaccgccggccctgcagtgcatcttaaagccatgcagctgtcttggacttccttggccctcgttggaattgatagccacggtaaagtactttcaacaaggatacttgcgatgaaagcctctctgtgtaagctgtcgccgtgtacagttacaagagtgtgcgattaccatacgaagctgttcctcatcgcaatcagttctactcttaagtccttgctcaggcctcactttctgaatacccctgacaagtccccaggcgatcgacttacggagatctgcactaagatcaccgacgttgatattgacaaagtgatgatcaacctgaagactgaagaatttgtactgtag

SEQ ID NO: 19731 - DNA, 1389 bp, Artificial Sequence
  Description of Artificial Sequence: Synthetic coding sequence
atgtgcgacctgcggcggcccgccgccggcggcatgatggacctggcctacgtgtgcgagtgggaaaaatggagtaaatcaacacactgcccctctgtgcccctggcatgcgcttggagctgccggaatctgattgcctttaccatggatttgcgctcagatgatcaggacctgactaggatgatacatatcctggatacagaacacccttgggacctccactcgatccccagcgaacaccacgaggctataacctgcctggaatgggatcagagcggctccaggctgttaagcgcggatgcagatggccagataaaatgctggtccatggctgaccatcttgctaatagctgggagagctcagtgggcagcctggttgagggagatccgattgtggcactgtcttggctgcataacggggtaaagctagctttgcacgtggagaaagtgctgctgtgcgcgtctagtcagacatcctccatcgtggaatgttggtccctgaggaaagaggggctgcccgtgaacaatatctttcagcagattagtcccgtggtgggcgacaagcagcccacaatcctcaagtggcgcatcctgagtgcaaccaacgaccttgatcgggtgagtgccgtggctctgcccaaactgcctatcagcttaactaacactgacctaaaggtagctagtgacacgcagttttatcctggattaggactggccctggccttccacgacgggtccgtgcacatcgtgcataggctttccttgcagacaatggccgtgttttatagttccgctgcccccaggcccgtggacgagcctgctatgaagcgaccaagaacggcgggacctgcagtccatctgaaagccatgcagctgtcttggacaagcctggctctggtaggtattgatagccacggcaaactcagtgtgttacgcttgtccccaagcatgggccacccgctggaggtcgggttggctctcaggcatttgctgtttttactggagtattgtatggtcacgggatatgattggtgggacatcctgcttcacgtgcagccatccatggtgcaatccttggtagaaaagctccatgaggagtatacccgtcagaccgcggccctgcagcaggtgctgtccaccagaattttggctatgaaggcatctctatgcaagctgtcaccttgtacagtaacacgagtatgcgattaccacactaaactcttcctgattgccatctcgagcacactaaagtcactcttgagaccccactttttgaacactcctgataaaagccctggtgataggctaacagaaatttgtactaaaatcaccgacgtcgacatagataaggtcatgatcaacctgaagactgaagagtttgttctgtag

SEQ ID NO: 19732 - DNA, 1098 bp, Artificial Sequence
  Description of Artificial Sequence: Synthetic coding sequence
atgtgcgacctgcggcggcccgccgccggcggcatgatggacctggcctatgtttgtgagtgggaaaaatggtcgaagtctacgcattgcccgagcgtccctctcgcctgtgcctggtcatgtagaaatctcattgcgttcacaatggacctcaggtcagacgaccaggacttaactcgaatgatccatattctcgacacagagcatccttgggaccttcacagcattcctagcgagcatcatgaggcaatcacatgcctcgaatgggatcagtctgggtcccggcttctgagtgcagacgccgatggccagattaagtgctggagtatggcggatcatctggcaaattcttgggagagtagcgtggggtccctcgtagagggcgaccccatcgtggccctgtcatggcttcataacggattggcactggctttccatgacggctctgtgcatattgtgcacaggctgtcactgcagactatggccgtgttttactcttcggcagcgcccagacctgtggatgagcctgctatgaaacgacctcgaaccgcagggccagcagtccacctcaaagccatgcaattgtcctggacgtcactggccctggtgggcattgactcccatgggaaactttccgtattacgtttgagcccctctatgggtcatccattagaggttggtctggctctgcgacacctgctgttcctgcttgaatactgtatggttacaggctatgactggtgggacattttattacatgtccagccttcaatggtacagagcctggtggaaaaacttcatgaggaatatacaagacagacagccgctttacagcaagtcctcagcacaaggatactggctatgaaggcctctctgtgcaagctgtccccatgcacagtgactcgagtttgcgactatcatacgaagttattccttattgccattagctcaaccctgaaatccctgctcagaccacatttcttgaacactcccgacaagagtccaggcgaccgcctgacagagatctgcactaagatcactgacgtagacatcgacaaggttatgattaatttgaaaactgaagaatttgtgctgtag

SEQ ID NO: 19733 - DNA, 1104 bp, Artificial Sequence
  Description of Artificial Sequence: Synthetic coding sequence
atgtgcgacctgcggcggcccgccgccggcggcatgatggacctggcttacgtctgcgagtgggagaagtggagcaagagcacacattgccccagcgtacccttagcatgtgcctggtcctgtcggaacttaatcgcgttcaccatggatctcaggtccgacgatcaggatctcacccgtatgatccatattctggacacggagcatccttgggatctgcatagtattccaagcgagcatcacgaggccatcacttgtttggaatgggaccaaagcggcagccgcctgctctctgctgacgcagatggacagatcaagtgttggagtatggcagatcacctcgccaattcctgggagtcatcggtaggctctctggtggaaggcgaccctatcgtggccctgtcttggctccataacggcgtcaggctagcattggccttccatgacgggtcagttcatatcgtccaccggctgtcgctccagaccatggcagtgttctattcatctgccgcgcctaggcctgtggatgaacccgccatgaaacgcccccggactgcgggaccagcagtacacctcaaggctatgcaactgtcctggacgagcttggctctggtcggaatcgactcccatggaaagctatcagtcttgcggctgtctcccagtatgggacatcctttagaggtaggcctagctctgcgtcatctgttattcctcttggagtactgcatggtcacaggttacgattggtgggatattctgctacatgtacagccatccatggtgcagagcctggtggagaagctccatgaagagtatactagacagaccgcggcactgcagcaggtactgagcacccgcattctagccatgaaagcttcgctttgcaagttgagcccctgcacggtgacccgtgtgtgtgattatcacacgaagttatttctcattgccatctcttccacgcttaaatctctgctccggcctcattttttgaatacccctgacaagtctccgggagataggctgaccgagatctgtacaaaaatcactgacgtggatattgacaaggtaatgattaatctcaagactgaagagtttgttttgtag

SEQ ID NO: 19734 - DNA, 975 bp, Artificial Sequence
  Description of Artificial Sequence: Synthetic coding sequence
atgtgcgacctgcggcggcccgccgccggcggcatgatggacctggcctacgtttgtgagtgggaaaaatggtcgaagtcaactcactgtcccagcgtccccctcgcttgtgcctggtcttgccgtaacctgatcgccttcaccatggacctgaggagtgacgaccaggacctgacaaggatgatacacatcttggacactgagcatccatgggacctgcacagtataccatctgagcaccacgaggcaattacctgccttgaatgggaccaaagcgggagccggctgctcagcgccgatgccgacggacagattaaatgctggtcaatggcagaccacctggccaattcttgggaaagctccgtgggaagcctcgtggaaggggatccaatcgttgccctctcttggctgcacaacggcgtgaagctcgccctgcacgtggagaaatcaggagcatccagcttcggcgagaaattcagcagggtcaaattctctccctctttgactctgttcggaggcaaacctatggagggttggatcgccgtgaccgtgtccgggttagtgactgtatcgttactcttcctccttgaatattgcatggtaactggatacgactggtgggacatcctcctgcacgttcaaccttccatggtacaaagcctggtggaaaaattgcacgaggagtatacaagacagactgcggctcttcagcaggtgctgagcacaaggattttggcaatgaaagcctccctgtgcaagctatctccatgtaccgtaacaagagtgtgcgattatcacacaaagctatttctgatcgccatctcctcaaccctgaagtctcttctgcgaccccatttccttaacaccccagacaagagccctggcgacaggttaactgaaatttgcacaaagatcactgacgtagacatcgataaggtaatgatcaatcttaagactgaggagttcgttctttag

SEQ ID NO: 19735 - DNA, 603 bp, Artificial Sequence
  Description of Artificial Sequence: Synthetic coding sequence
atggcccagcagcgggccctgccccagagcaaggagaccctgctgcagtcctataataagcgcctgaaagatgatattaaatctatcatggataactttaccgaaataatcaagacggcgaagatcgaggatgaaactcaggtgagtagggctacacagggcgagcaagataattacgagatgcacgtgagagctgccaatattgtgagggctggggagagcctcatgaaacttgtctcagatctgaagcaatttttgatcctgaacgattttccctctgtgaatgaagcaatcgatcaacgcaatcagcaactcagaaccctgcaggaagaatgcgacagaaaactaatcacactgcgagatgagatatcaatcgacctgtacgagctggaagaagagtattactcttcaagtagctcactctgtgaggccaacgatctgcccctttgtgaggcttacggccggcttgatctcgacactgattccgcagatggccttagcgcccccctactcgccagtccggaaccttctgctggccctttgcaggtggccgcccctgcgcacagccatgccggaggacccggaccgaccgagcacgcctag

SEQ ID NO: 19736 - DNA, 423 bp, Artificial Sequence
  Description of Artificial Sequence: Synthetic coding sequence
atggcccagcagcgggccctgccccagagcaaggagaccctgctgcagtcatataacaagcggctcaaggacgacatcaaatcgataatggacaacttcacggaaattattaaaacagccaagattgaggatgaaactcaggtctcccgtgctacccagggcgagcaggacaattatgagatgcatgtgagggctgccaatattgtgcgagctggcgaaagtctgatgaagttggtcagcgacctaaaacagttccttatcctgaatgacttcccaagcgttaacgaagctatcgatcagaggaatcagcaactccgcaccttacaggaggaatgtgaccggaagctcatcacacttagagacgagatatccatagatctctatgagctcgaggaagagtactatagctccagatacaaatag

SEQ ID NO: 19737 - DNA, 405 bp, Artificial Sequence
  Description of Artificial Sequence: Synthetic coding sequence
atggcccagcagcgggccctgccccagagcaaggagaccctgctgcagtcctataataagcgtctcaaggacgatatcaagagcatcatggacaacttcacggagattattaaaacagccaagattgaagacgagacacaggtgagtcgcgcaactcagggcgagcaggataattatgagatgcatgtaagggccggagaaagcctcatgaagctggtctcagatttgaaacagtttctgatattaaatgattttccttcagtaaatgaagccatcgatcagcgaaatcagcagctgcgcacgctgcaggaagagtgcgaccgcaagctgattactctgagagacgaaatcagtattgatttatacgagctcgaagaggagtactacagcagtcgctacaaatag

SEQ ID NO: 19738 - DNA, 414 bp, Artificial Sequence
  Description of Artificial Sequence: Synthetic coding sequence
atggcccagcagcgggccctgccccagagcaaggagaccctgctgcagagttacaataaacggcttaaggacgatattaaatctattatggacaacttcaccgagatcattaagactgcgaaaatcgaagatgaaacacaagtctcaagggcaacgcagggggagcaggacaactatgaaatgcacgttcgggcagccaatatagtgcgggctggagagtcgctgatgaaacttgtaagcgacttgaagcagtttctgattctgaacgactttccatccgtgaatgaagccatcgaccagcgaaaccagcagctgcgaacacttcaagaggagtgcgatcggaagctgatcacccttcgggacgaaattagtattgacctgtacgagctcgaagaggagtactactcaagctag

SEQ ID NO: 19739 - DNA, 336 bp, Artificial Sequence
  Description of Artificial Sequence: Synthetic coding sequence
atggcccagcagcgggccctgccccagagcaaggagaccctgctgcagtcttacaacaaaaggctgaaggatgatattaagtcaattatggataatttcaccgaaattataaagacagccaagattgaggacgagactcaagtctcacgagccactcaaggcgagcaggataattacgaaatgcacgttcgggcagctaatattgtcagggccggggagtcactcatgaaattggtaagcgatttaaagcagtttctaatactcaatgacttccccagcgtcaacgaggcaattgatcagcgcaaccagcagttacgaacattacaggaggaatag

SEQ ID NO: 19740 - DNA, 423 bp, Artificial Sequence
  Description of Artificial Sequence: Synthetic coding sequence
atggcccagcagcgggccctgccccagagcaaggagaccctgctgcagtcgtacaataagagattgaaggacgatatcaaaagtatcatggataattttaccgaaataatcaagactgctaagatcgaagatgaaacacaggtgtcaagagccacccagggagagcaggataattatgagatgcacgtacgcgcagccaatattgtgcgagctggagaatcccttatgaaactggttagcgatcttaagcaattcctgattctgaatgacttcccttctgtgaacgaggctattgatcaaaggaaccaacagcttaggacccttcaagaggaatgtgataggaagcttatcactctgagggacgagatctctattgacctgtacgagcttgaggaggagtactactcttccagatataaatag

SEQ ID NO: 19741 - DNA, 423 bp, Artificial Sequence
  Description of Artificial Sequence: Synthetic coding sequence
atggcccagcagcgggccctgccccagagcaaggagaccctgctgcagtcatacaacaagcgcctaaaggacgacattaaatccatcatggataatttcactgaaattataaagaccgcgaagatcgaggacgagacacaggtttctcgcgcaacacagggcgagcaagacaactacgagatgcacgtgagagccgccaatattgtgcgggccggggagagtttgatgaagttagtatcagatctcaaacaatttttgatcctcaatgactttccaagcgtgaacgaggcgatcgaccagagaaaccaacaactgcgcactttacaggaggaatgcgaccgcaaactgatcactcttagagatgagatttccatcgacttgtatgaactcgaggaagaatactatagttcaaggtataagtag

SEQ ID NO: 19742 - DNA, 603 bp, Artificial Sequence
  Description of Artificial Sequence: Synthetic coding sequence
atggcccagcagcgggccctgccccagagcaaggagaccctgctgcaaagttacaacaagagactcaaggacgacataaaaagcattatggataactttacagagattattaaaacggccaagatcgaagacgagacccaggtgtcccgcgcaactcagggcgaacaggacaactacgagatgcacgtgcgcgccgccaacatcgtgcgggccggggagtctctcatgaagctggtgagcgacctaaaacagttcctgatactgaatgactttcctagcgtcaacgaagcaattgaccagaggaatcagcagctccgcaccctccaggaggaatgtgacagaaaactcattacactcagagatgaaatctctatcgacctttatgagctggaagaggagtactacagttcatcatcatcactatgcgaggcaaacgacttgcccttgtgcgaggcctacgggcgcctcgatctggatacggactccgccgatggcctctcggctcctttactggcatcaccggaaccatcagccggccccctccaggttgccgccccagctcatagccacgctgggggcccaggacctacagagcacgcatag

SEQ ID NO: 19743 - DNA, 408 bp, Artificial Sequence
  Description of Artificial Sequence: Synthetic coding sequence
atggcccagcagcgggccctgccccagagcaaggagaccctgctgcagagttacaacaagcgcctgaaggatgacataaagtctatcatggataattttactgagattattaagacggctaagatagaggatgagacacaggtctcccgcgccacccagggagagcaggataactacgagatgcacgtcagggcagctaatattgtcagggctggagaatctttaatgaagctggtgagcgaccttaagcagtttctcattctgaacgactttccttcagtgaacgaagccatagaccagcgaaaccagcagctccgcactctgcaagaagagtgcgaccgtaagctcattaccttgcgagatgagatcagcatcgatctctacgagcttgaagaggaatactattag

SEQ ID NO: 19744 - DNA, 1452 bp, Artificial Sequence
  Description of Artificial Sequence: Synthetic coding sequence
atgaaggccttccacaccttctgcgtggtgctgctggtgttcggctctgtgagcgaggccaagtttgatgatttcgaggacgaagaggatattgtcgagtacgacgacaacgacttcgcagaatttgaagacgttatggaggacagtgtcaccgaatcaccacagagagttatcatcacagaggacgacgaagacgagaccacagtggagttggagggccaggatgagaaccaggagggcgactttgaagatgccgacacccaagagggtgatacggaatccgagccttacgatgacgaagagttcgaagggtacgaggataaaccagacactagcagttcgaaaaataaggaccccattacgatagtggacgtgccagcccacctgcaaaactcttgggaatcgtactatctggaaatcctgatggttacagggctgctggcgtacatcatgaactatattattggaaaaaataagaatagcaggctcgcacaggcctggttcaacactcacagggaactactggaatctaatttcaccttagtcggtgacgacgggactaataaagaggcgactagcactggaaaactgaaccaggagaatgaacatatttacaatctatggtgttccggcagagtctgttgcgaagggatgctgatccagcttaggtttctgaaacgccaggaccttttgaatgtcctggcgcggatgatgaggcctgtctcagaccaggtccagattaaggtgacgatgaatgatgaagacatggatacgtatgtcttcgcagtgggtacccggaaggccctggttcggctgcagaaagagatgcaagacctctccgaattttgtagtgacaagccaaaaagcggggccaaatacggacttcccgatagcctggctattctgtcggaaatgggtgaagtcacagatgggatgatggatactaaaatggtccactttcttacacactacgctgataagattgagagcgtgcacttctccgaccaattttctggacccaagatcatgcaggaagagggccaaccactgaagctgcccgacacaaagcggacactcctgttcacttttaacgtgcccgggtctgggaatacctaccccaaggacatggaggcgcttctacccctcatgaacatggtaatctactccattgacaaagctaagaagtttcgccttaatagggaagggaagcaaaaggcagataagaatcgggctcgcgtagaagagaatttcctgaaactgacacatgtgcaacgccaggaagctgctcagagtaggagagaggagaagaaacgagcagaaaaggagcgaataatgaatgaggaagacccagagaaacagaggcggttagaggaagccgctttaagacgagaacagaaaaagcttgagaagaagcaaatgaaaatgaaacagataaaggtgaaggcaatgtag

SEQ ID NO: 19745 - DNA, 741 bp, Artificial Sequence
  Description of Artificial Sequence: Synthetic coding sequence
atggccgccgtggacatccgggacaacctgctgggcatcagctgggtggactcctcctggatcccgatacttaacagcgggagcgtgctcgactatttttcagagaggagcaatcccttctatgaccggacatgtaacaatgaggtcgtgaaaatgcaaagactgaccctggagcacctcaaccagatggtgggaatcgagtacattctgttgcatgctcaggaacctattctctttattattaggaaacagcaacggcagagccccgcccaggttattccactggccgactattatatcatagcgggcgtcatctaccaggctccggacttggggagcgtcatcaactctcgcgtcttaactgccgttcacgggatacagtccgctttcgatgaggccatgtcgtattgccggtatcacccctccaagggctactggtggcatttcaaagaccatgaagagcaggacaaggtccggcccaaagccaaacggaaggaagaaccctcctctattttccagaggcagagagtagacgccctgttattggatcttagacagaagtttccccccaagtttgtacagctgaagccaggagagaaaccggttcccgtcgaccagaccaagaaagaggccgagcccatcccagagacagtcaagcccgaggagaaggagacaacaaagaatgtccagcagaccgtgtccgctaagggccccccggaaaaaaggatgaggcttcaatag

SEQ ID NO: 19746 - DNA, 762 bp, Artificial Sequence
  Description of Artificial Sequence: Synthetic coding sequence
atggccgccgtggacatccgggacaacctgctgggcatcagctgggtggacagctcttggatccccattctgaactctggctccgtattggactatttctcggagcggtctaatcctttctacgatcgtacttgtaataacgaagtcgtaaaaatgcagcgcctgaccctggagcatctcaatcagatggtcggtatagaatacatactgctccatgctcaagaaccgatcctattcataataaggaaacagcagcgccagtctcccgcccaggtgattccgctggccgactactatatcattgcaggggtaatttatcaggcaccggacctgggctctgtgataaactctagagtgtcccttttctctttctataaactgaccgctgtccacggcattcagagcgcatttgacgaagcaatgtcatattgtaggtaccacccatctaaaggctattggtggcattttaaagaccatgaggaacaggacaaagtaagacctaaagcaaaaaggaaagaggaaccttcctccatcttccaacgtcaacgggtggatgcactgctgctggacctacgccagaagttccctcctaagttcgtgcagctgaagcccggagagaaacccgttccggtggaccaaacaaaaaaggaggccgagcctatacctgaaacagtgaaacccgaagagaaggagacaactaaaaatgtgcagcagacagtatcagctaaggggcccccggagaagcggatgcgcctccagtag

SEQ ID NO: 19747 - DNA, 546 bp, Artificial Sequence
  Description of Artificial Sequence: Synthetic coding sequence
atggccgccgtggacatccgggacaacctgctgggcatcagctgggtcgattccagttggatacccatccttaatagtggatccgttttagactacttcagcgaaaggtctaaccccttctacgatcggacttgcaacaacgaggtggttaaaatgcagaggctcaccctagagcacctaaaccagatggtaggtatagagtacatcctgctgcatgcacaagagcctattctttttattatcaggaaacaacaaagacagtccccggcacaggtcattccgctggcagactattatatcatcgcaggagtaatttatcaggcaccggacttgggctctgtgattaacagtagagtcctgaccgcagtacacggtattcagtcagcttttgatgaggccatgtcttactgccggtaccacccttccaagggttattggtggcattttaaggaccacgaagagcaggctaaagcttggaggaaggcctgctcctctggatcgaacaaagagcgcggcaggacatatactcggaactgtaaaacatag

SEQ ID NO: 19748 - DNA, 750 bp, Artificial Sequence
  Description of Artificial Sequence: Synthetic coding sequence
atggccgccgtggacatccgggacaacctgctgggcatcagctgggtggactccagttggatccccattctgaacagtggtagcgtactcgattacttctcagagagatcgaatccgttttacgatcggacttgtaacaatgaagtggtaaagatgcagagactcactctggagcatctgaaccagatggttggaatcgaatacatcctgctccacgcgcaggagccaatcctattcatcattcgcaagcagcagcgacaatctcctgcccaagtcatcccgcttgcagattattacatcattgccggtgttatttaccaggcgccagacctggggagtgtgatcaacagccgcgtcctgaccgccgtgcatgggatccaatctgccttcgacgaagccatgagttactgtcggtaccacccgtctaaggggtattggtggcacttcaaagatcacgaggaacaggataaagtcagaccgaaagccaaaagaaaggaagaacctagctccatcttccaaaggcagcgggtagacgcactgctgcttgatctacgacagaagtttccacctaagtttgtacagctgaagcccggggagaagcctgtccctgtggatcagactaaaaaggaggcagaaccgattcctgaaactgtgaaacccgaagagaaggagactactaaaaacgtgcagcaaactgtgagcgcgaagggtccaccagagaagcgaatgcggctgcagaaggcagtgtag

SEQ ID NO: 19749 - DNA, 906 bp, Artificial Sequence
  Description of Artificial Sequence: Synthetic coding sequence
atgcagcgggaggagaagcagctggaggccagcctggacgccctgctctcccaggtcgcggacctgaagaactctttgggaagcttcatctgcaaattagagaatgaatatggccgtcttacctggccctctgtgctggactctttcgccctgctttccggccaattaaataccctgaataaagttttaaaacacgagaagactcccctgttcaggaaccaggtcattattcctcttgtactgtctccagaccgagacgaggaccttatgagacagacagaggggcgggtgcccgtgttttcacacgaggttgtgcctgatcacctgcggactaaaccagacccggaagtcgaggaacaggagaagcagctgactaccgacgccgctcggatcggggctgatgcggcacagaaacagatacagtccctcaacaaaatgtgtagcaatctcctggaaaaaataagcaaagaagaaagagaatctgagtcaggaggattgagaccgaacaaacaaacattcaaccctactgatacgaatgctctggtagctgcagtggcctttgggaaaggattgagtaactggcgtcccagcgggtcctccggacccgggcaggcgggccaaccaggggcaggaacaattctagcgggcacctcaggtctccagcaggtccagatggcgggagccccatcccagcagcagcctatgctatctggcgtccaaatggcccaagcgggccagccgggcaaaatgccgagtggcattaagactaacattaaatctgcatcaatgcatccctatcagagacctagctgcctgggcttcatcctggctattcccctgagaaggaaagttaagaagctcctcgggcaggagggcaagaagaacgcacacctgcaactgtggtag

SEQ ID NO: 19750 - DNA, 807 bp, Artificial Sequence
  Description of Artificial Sequence: Synthetic coding sequence
atgcagcgggaggagaagcagctggaggccagcctggacgccctgctttcacaggttgcagatcttaagaattctttgggtagctttatctgtaagctggagaacgaatacgggcgtctgacctggccgtctgtccttgactccttcgctctgctgtcaggacagctgaataccctgaacaaagtgttaaaacacgaaaagacccctcttttccgcaatcaggttattatacctctagtactgtcccccgatagggacgaggacttaatgagacaaacggagggtcgggtcccagtgttctcacatgaagtcgtgccagatcacctgcggacaaaacccgaccccgaagtggaagaacaggaaaaacagctgactactgacgctgctcggatcggggccgatgcagctcagaaacagatccagagcctgaacaagatgtgcagcaatctgctggagaagatcagcaaggaggagcgcgaaagcgaaagcggtggtctgcggcccaacaaacagacatttaaccccaccgatactaacgcgctggtggccgccgttgccttcggcaaggggctgagtaactggcggcccagcggttctagcggccccggacaggcaggacaacctggggccgggaccatcctagcaggcacatcagggttgcaacaggtgcaaatggcaggggccccttcccaacagcagcccatgttatctggggtccagatggcccaggcaggccaacccggaaaaatgccgtcaggcattaaaacaaacattaaaagcgcaagcatgcacccatatcagaggtag

SEQ ID NO: 19751 - DNA, 1248 bp, Artificial Sequence
  Description of Artificial Sequence: Synthetic coding sequence
atgaccctggccgccagcagccagcggagccagatcatccggagcaagttcaggtccgtcttgcaactacgcattcataggcggaaccaggagcagatatcagaccctgatccttggataagcgctagtgaccctcctctggctcccgccctcccctcagggacggctcctttcttatttagccccggagtcctcctgcccgagcccgaatactgccccccttggcggtctcccaaaaaagaaagccccaaaattagccagcgctggcgtgaatctaagccccgcggtaaccttacctatcaccaatacatgccccccgaacctagacagggctccagggcggatcctcaagcggaaggcagcgccttgggaccaccagggccctcactctgggaggggaccgattcacagcagcctcacccgaggatgaagcccagccctctcactccatgtcccccaggtgtgccttctccgtcccctcccccgcacaagctggaactccagacgctgaagctggaagagctcactgtgtccgaacttcgtcagcagctgcgcctgagaggcttgcccgtgagtggaacgaagagcatgctactcgagcggatgcggggtggggctcccccaagagagaggcctaagccgcgcagagaggatagcccagctggcgccccatggcccagacttaaacctaaggcattggccgccgcccgacggcaagggagcgttaagcccagcgcagcgtctcacaggcctccactgcctcgggcggctgatacaccagggaccgcccccgccccaacccccacacccgcacctgctgccgcccccgctctgactccatcctcaggtccaggctccgcagctttgactcttgaagaagagcttcaggaggcaattagacgcgcccaactcttgcctaaccgggggatcgatgatatcttagaagatcaggtcgagccagacgatccactgccgcccattcctctggatttcccagggtccttcgacgtgctgtcccccagtcctgattccgaaggcctgtcaagcgttttctcatcctcattgccttcccccactaacagctcttcccctagcccgcgggatcctaccgattctttggactggctggaggccctctctggcggaccccctctcgggagcggccctcccccaccaagcattttctcagctgacctgtctgattcttcctccagccggctgtgggacctactggaagatccctggtag

SEQ ID NO: 19752 - DNA, 939 bp, Artificial Sequence
  Description of Artificial Sequence: Synthetic coding sequence
atgccccccgagccccggcagggcagccgggccgacccccaggccgagggcagtgccctgggcccccccggaccatcactctgggaagggaccgattcccagcagccccatccccggatgaagccgtctccccttacaccgtgtccacctggagtgccgagcccctccccccctcctcacaagctcgaactgcagacgctgaagctcgaagagctcaccgtgtctgaactgcggcaacagctgcggctgagaggtctccctgtaagtggcaccaaatctatgctcctggagaggatgagaggtggcgcccctcctcgagaacgcccgaaacctaggcgcgaagactctcctgctggggctccgtggccacgccttaagccaaaggctctggccgccgcaagaagacagggatccgtgaagccaagcgcggccagccacaggcccccactgccaagagcggctgacacccctggcaccgctccggcccctacccctacccctgccccagctgcagctcccgcgctgaccccaagtagcggcccagggagtgcagcccttacccttgaggaagagttacaagaggcaatcaggcgggctcagcttcttcccaaccgagggatcgatgacatcttggaggaccaggtggaacccgatgatcccctccccccgattcccctggactttcccggatcctttgatgttctgagcccatccccagattcagaggggctctcctcagtgttctccagttcacttccttcaccgacgaactcatctagtccttcacctagggatccgacagatagtcttgattggctagaagcactgtctggcggtccccctctggggagcggtcctcccccacctagtattttcagcgccgacctgagcgattcctcaagctcacgtctttgggacctgctcgaggatccttggtag

SEQ ID NO: 19753 - DNA, 744 bp, Artificial Sequence
  Description of Artificial Sequence: Synthetic coding sequence
atgccccccgagccccggcagggcagccgggccgacccccaggccgaaggtagcgcactgggacctcccgggccctctctttgggaaggcacagacagtcagcagccacacccccgcatgaagccaagccccctgaccccttgtccccccggcgtcccgtcgccgagccctccgcctcataagttagaattacaaacactgaaactggaggagctcactgtgaaaccttccgccgccagtcacagacctccgctcccacgtgctgctgatacacccggcacagcaccagcccctacacctacacctgctcctgccgccgcacccgccttgacccccagttctgggcccgggtctgccgctctcacactggaagaagaacttcaggaggctatccggcgggcccagttacttccaaacaggggcattgatgacatcttggaagaccaggtcgaacctgatgatcctctgccccctatacccctcgacttccccgggtctttcgacgtattatctccaagccctgactccgaaggcctctccagcgtgttttcaagtagccttcccagcccaaccaattcctcgtctcccagcccacgcgatcctactgatagtctcgactggctggaagctttgagcggtggcccacctctcggcagtggtcctccccccccatccattttttctgcagacctgtccgattcctcatcctctcgactgtgggatctgctggaggacccctggtag

SEQ ID NO: 19754 - DNA, 939 bp, Artificial Sequence
  Description of Artificial Sequence: Synthetic coding sequence
atgccccccgagccccggcagggcagccgggccgacccccaggccgaaggcagtgcccttggccccccaggaccatcattatgggagggtaccgactcacagcaaccgcaccctcggatgaaaccctcaccacttacgccctgcccaccaggcgtcccttcgcctagcccccctccacataaactggaactgcaaacccttaagctggaagagttgaccgtgagtgagctccgtcaacagctccgccttagaggattgcctgtgagcgggaccaagagtatgctcctcgagcggatgcgaggtggggccccaccaagggagcggcctaaacccagacgggaggactcacccgcgggtgctccgtggccgcggcttaaacccaaagctctcgccgcagcccgtaggcagggctcagtcaagccaagcgctgcttcccatcggcctcccttacctcgagccgccgacacccccgggacagctcctgcgcccactcctacccccgcccctgcggctgcaccggcgcttactccctcatcaggtcccgggagtgccgcgcttactctggaggaggagctacaggaagccatcaggcgggcccagctcctgcccaaccgcgggatagatgacattctcgaggaccaggtggagcctgacgatcccctgccccctattccccttgattttcctggctcttttgacgtgctctcaccatccccagacagcgaaggtctctcatctgttttcagcagcagcttgccctcccctactaacagttcctcgccgagccctcgcgaccccaccgactcactcgattggcttgaggcactaagcggcggcccccctctggggagcggaccacctccaccctccattttcagcgctgatttgagcgatagctcgtcttctagactgtgggatctgctggaagatccctggtag

SEQ ID NO: 19755 - DNA, 618 bp, Artificial Sequence
  Description of Artificial Sequence: Synthetic coding sequence
atgagcaagaagaagggcctgagcgccgaggagaagcggacccggatgatggagatcttttcagagactaaagacgtcttccagctgaaggaccttgaaaagattgcccctaaagaaaaggggatcaccgctatgtccgtgaaagaggttcttcagagtttggtagacgacggaatggtggactgcgaacggataggtacttccaattactactgggccttcccttctaaggctttgcatgccaggaaacataagctcgaagtccttgaatcccagctgagcgaagggagtcaaaagcacgcctcacttcagaaaagcatagaaaaggccaagattggccgttgtgagaccgaagaaaggacccgactggctaaagaattatcttccctcagagaccaacgtgagcaattgaaagcggaggtggaaaagtacaaagactgcgatccacaggtggttgaagagatcagacaggcaaacaaggtggccaaggaagcggcgaacaggtggaccgataatatttttgctatcaaaagctgggcaaaaagaaaatttggattcgaggagaacaaaatcgacaggactttcggtattccggaggacttcgattatatcgattag

SEQ ID NO: 19756 - DNA, 159 bp, Artificial Sequence
  Description of Artificial Sequence: Synthetic coding sequence
atgatcgaccagagcaaccggaccggccagggcgccgccttcagccccgagggccagcctatcggcggatatacagagacacagccccatgtcgcagtcaggcctcctgggagcgtaggtatgtcactgaatctcgagggagagtggcattacttatag

SEQ ID NO: 19757 - DNA, 1077 bp, Artificial Sequence
  Description of Artificial Sequence: Synthetic coding sequence
atggcccggcggtacgacgagctgccccactaccccggcatcgtggacggccccgccgcgctggccagctttcctgagacagtgcccgccgtgcccggtccttacgggccacacaggccccctcagcctttgcccccgggacttgactccgacgggctcaagcgggagaaggatgaaatctacgggcatcctctgttccccctgctcgcccttgtgttcgagaagtgtgagctcgcaacctgcagtcccagggatggcgccggtgccggactgggaacgcctcccggcggagatgtgtgttcgtctgacagcttcaacgaggacattgctgccttcgcaaaacaggtgaggagcgaacggcctttgttcagctccaatccagagctcgataatttaatgattcaagccatccaggttctccgtttccacctcctggaactagaaaagggaaagatgccaattgacttggtaatcgaggatcgagatggcgggtgtagggaagatttcgaagattatccagcttcctgtccatctctcccagaccagaacaacatgtggattagggatcacgaggattccgggagcgtgcaccttggaactccgggcccttctagtggcgggcttgcctcccagtccggcgataattcctccgaccagggggacggactcgatacaagtgttgcatcaccgtcttctggcggcgaagatgaagacctagaccaggagaggcgacgcaacaaaaagcgcgggatctttcctaaggttgctactaacattatgagagcatggttgttccagcatctatcacacccctaccctagtgaggaacaaaagaaacaacttgcccaagatacagggctgactatactgcaggtgaacaattggttcattaatgcgcgtcgaagaattgtgcagccgatgatcgatcaatctaataggaccgggcagggcgctgccttcagcccggagggccagcctatcgggggctatacggaaacgcagccccatgtcgcagtccgacctcccggaagcgtgggcatgtccctgaatttggaaggggagtggcactacctctag

SEQ ID NO: 19758 - DNA, 1128 bp, Artificial Sequence
  Description of Artificial Sequence: Synthetic coding sequence
atggcccggcggtacgacgagctgccccactaccccggcatcgtggacgggcctgccgctctggccagttttcctgaaaccgtccctgctgtgcccggtccctatggaccccatcggccaccacagcccctcccaccaggtctagactctgacggcctgaaacgggaaaaggacgaaatctatggtcaccctttgtttccactgcttgctttggtgtttgagaagtgtgaactggcaacctgctcacctagagatggcgccggagctggtctgggtacgcctccaggcggggatgtgtgttccagcgacagcttcaatgaagacattgccgcctttgctaaacaagtgcggagcgaacggcccctgttttcaagcaatccggagctggacaatctcatgattcaggccatccaggtgctccgattccatcttcttgagctggagaaagttcatgatctgtgcgacaatttttgtcatagatatatcacgtgtctcaaggggaaaatgcccatagacctggttatagaggaccgggatggaggatgccgtgaagacttcgaggattaccctgccagctgccctagtttgcccgaccagaataacatgtggattcgcgatcacgaggactctgggtctgtgcaccttggtaccccggggccatcttccgggggactggcctcgcagagcggcgacaattcctctgatcagggggatggccttgatacctctgtggcctcacccagttcaggtggggaagatgaggatctcgatcaagaacggcgtaggaacaaaaagcgcgggatcttcccgaaagtggccaccaacattatgcgggcctggctgttccagcacctttcacatccataccccagcgaggagcaaaagaagcagctcgcccaggatactggcctgaccatcttacaggtaaacaattggttcataaacgccagaaggcgaattgttcaacccatgatcgatcaaagtaaccgcacaggccagggagccgccttcagccctgaggggcaacctatcgggggatataccgagacacagcctcatgtcgccgttaggccccccgggagcgtcggcatgagccttaacctggagggtgagtggcattatctgtag

SEQ ID NO: 19759 - DNA, 1266 bp, Artificial Sequence
  Description of Artificial Sequence: Synthetic coding sequence
atggcccggcggtacgacgagctgccccactaccccggcatcgtggacggtcctgctgccctcgcttcctttccagagaccgtccctgccgtgcctgggccttacgggccccacaggccaccgcaacctctccctccggggctagatagcgatggcttgaaacgagaaaaagacgagatctacggtcacccgctattcccacttctcgccctggtttttgaaaaatgcgaattggcaacctgtagtccgagagatggagctggggctggcctcggaactccgccaggcggtgatgtttgctcaagcgactcattcaatgaagatatcgctgccttcgcaaagcaggtgcgatctgagcgtccactttttagctcaaatccagagctggacaatctgatgattcaggcgattcaggtcctcaggtttcacctgctggagctagagaaggtgcacgatctgtgtgacaacttttgccaccggtacattacatgtctaaagggcaaaatgcccatcgacttggtgatcgaggacagagatggcggctgcagggaagacttcgaagattacccagcctcttgcccatcactgccggaccaaaacaatatgtggattagagaccacgaggattctggctctgtacatctgggcacacccgggccttcttccggtggactggcatcccagtcaggcgataattcatcggaccagggagacggcctggacaccagtgtggcctctccctctagtgggggagaagacgaagacctggatcaggagcgtcgacgcaataaaaaacgtggaatcttccccaaagtcgcaacaaatattatgcgcgcctggctgtttcagcacctgtctagacgctcagaggccccagtgctaccagatgtttgtctgggtttgggatcacctagccctgggccacggtgggctcgcccttggggttccgactgcgggcgaccagggaggcagtccgacagttgttggtggctgcaacacccctaccctagcgaggagcagaaaaagcagctagcccaggatacgggattgacaattctccaggtaaataactggttcattaatgcccgacgccggatagttcagccgatgatcgaccagtccaacaggacagggcagggcgccgcattttctcctgagggccagccaatcggagggtacacagagacccagcctcatgtcgccgtcaggcctcctggcagcgtgggcatgagcctcaatctcgagggggaatggcattacctgtag

SEQ ID NO: 19760 - DNA, 1266 bp, Artificial Sequence
  Description of Artificial Sequence: Synthetic coding sequence
atggcccggcggtacgacgagctgccccactaccccggcatcgtggacggtcctgccgcacttgcttctttcccagagacagttcccgctgtacctggcccctatggaccgcacaggcctcctcagccactgcccccaggtctggactcggacggcctgaagcgagagaaggacgaaatttacggtcatccacttttccccttgctggctctagtttttgagaaatgcgagctggctacttgtagtcctagggatggggctggcgcaggtttggggacccccccaggaggagatgtgtgctcctccgactcgttcaacgaagacatcgctgccttcgcgaagcaagttagaagtgagcgcccgctattcagcagcaacccagaactggataatctgatgattcaggcaatacaggtcctgaggtttcatttgttagaactggagaaagttcatgacctctgcgacaacttctgtcaccgctacatcacgtgtctaaaaggcaaaatgccaattgacctggtgatcgaggatcgcgatggcggctgtcgcgaggacttcgaggactacccggcctcatgcccatctctacccgatcagaataacatgtggatcagagatcatgaggattcaggatccgtgcatctgggtacccctggcccctcatctgggggacttgcatctcagtctggcgataactcctcggatcagggtgacggtctcgataccagtgtggcgtctccttcttccggcggcgaggatgaggatctggatcaggagaggagaagaaataagaaacgtggaatttttccaaaggtagctacgaatatcatgagagcctggctctttcagcatctgtctaggcgttccgaggctccggtgctccccgacgtctgtctcggtctgggctcccctagccctggacctcggtgggcccggccctggggatctgattgcgggagaccgggcaggcagtccgatagctgctggtggcttcagcacccctatccaagtgaggagcagaaaaagcagctcgcccaggacactggcctgaccatattacaagtgaataattggttcattaacgctagacgccgcattgttcagccaatgatcgaccaatccaaccggacgggacagggcgccgccttctctccagaggggcaacccatcgggggttacaccgaaacccaaccccatgtggccgtgcgcccaccaggtagcgtcgggatgagcttaaacctggaaggtgaatggcactatctgtag

SEQ ID NO: 19761 - DNA, 1266 bp, Artificial Sequence
  Description of Artificial Sequence: Synthetic coding sequence
atggcccggcggtacgacgagctgccccactaccccggcatcgtggatggtcctgcagctctggccagcttccccgagactgttccagcagtccccggcccctacggacctcatcgccctcctcagcctctcccaccgggattagattctgatgggttgaagagagagaaggatgagatctacggacatcctctgttccccttgctcgcactggtgtttgagaagtgtgagcttgccacctgttctccccgtgatggagccggggccggactcggcactcctcctggcggagacgtatgctcttctgacagttttaacgaagacattgctgccttcgcaaagcaggtccggtcggaacggccactgtttagtagcaacccggaactggataacctcatgatccaggccatccaagtgctaagattccatttgctggaactagaaaaggtgcatgatctatgtgacaacttctgtcacagatacattacttgcctgaaaggaaagatgcccatagacctcgtgattgaagatcgggacggcggatgtcgggaggattttgaagactacccggccagctgcccttcgcttccagatcagaacaatatgtggatccgagatcacgaagattccggaagtgtgcatcttggcactccaggacctagctccgggggactggctagtcagtcaggagataatagctctgatcagggagatggtctcgatacatcagtggcatctccatcgtccgggggggaggacgaggacctagatcaggagcgtcggcgtaataaaaaacgtggaatttttccgaaggtggccaccaacattatgagggcatggctgttccagcatctgtcacgtcggagcgaagccccagttcttcccgacgtctgcttgggtctgggttccccatctccaggaccacgttgggcgagaccctggggttctgattgtgggcgacccggccggcagtccgacagctgctggtggctgcaacacccctacccgagcgaggaacagaaaaagcagctcgcccaggataccggcctcaccatccttcaggtgaataattggtttatcaacgccagaagacggatagtccagcctatgattgaccagtctaatcgtacaggacagggagctgctttcagtccagagggccaacctattggcgggtatacagagacccaacctcatgtggcggtgcgaccccccggctcagttggaatgagcctcaatttggagggagagtggcattacttatag

SEQ ID NO: 19762 - DNA, 1929 bp, Artificial Sequence
  Description of Artificial Sequence: Synthetic coding sequence
atggtgagcgccagccagaacgaggtgcccgccgcccccctggaggaactggcttaccgccgctccttacgcgtggctctggacgtcctgagcgagggctctatttggtcccaagaaagcagcgcaggaactgggagagccgacaggtctctgcgtggtaaacccatggaacatgtgagcagcccgtgtgactctaattccagcagcctcccacgcggtgacgttctggggagctcccggcctcacagacgtcgcccgtgtgtccagcagagcttaagcagctcattcacgtgcgaaaaggaccccgaatgtaaagttgatcacaagaagggcttacgaaaaagtgaaaacccacggggtccactggtgctccctgccggcgggggagctcaggatgagagcggtagccgcatacatcataaaaactggacgttggctagcaagcgcggcggcaacagtgcacaaaaagcatccctgtgcctaaatgggtcaagcctgtccgaggacgataccgagcgcgatatgggttcaaagggagggtcctgggctgcgcctagtctgcctagcggagtcagggaggacgacccatgcgccaacgccgaaggacacgaccccggtttgcctctcggctccctcacggccccacctgctcccgaaccctcagcatgcagcgaaccaggcgagtgccccgctaaaaaacggcctcgactggacggcagtcagcggccaccagccgtacaactagagccaatggctgccggggctgccccgtctcccggcccagggccgggacccagggagagcgtcacacctagatccacggcccgcctgggccctcctccgtctcatgcttcagctgacgcgacccgctgtctcccgtgcccggactcacaaaagttggagaaagaatgccagtcgtccgaggagtccatgggatctaactcgatgcgaagcattctggaggaggacgaggaagatgaggagccaccacgcgtcctgctttaccatgagccgagatcgtttgaagtgggaatgctggtctggcacaaacataagaagtatcctttctggcctgccgtggtcaaatccgtgagacagcgtgataagaaagcttccgtgttgtacattgaaggccatatgaatccaaaaatgaagggcttcacggtgagcctaaagtcactcaagcactttgattgcaaggaaaagcagacactcctaaatcaagcacgggaggattttaatcaggatatagggtggtgcgtttccctcattaccgactatagagtgaggctcgggtgcggaagtttcgccggtagttttctggaatactatgccgctgacatcagttaccccgtgagaaagagtattcagcaggacgtgctgggaacgaagctgccacaactgtccaagggcagtcctgaagaaccggttgtgggctgcccactgggacagcggcagccctgtcgcaaaatgcttccagatcggtctcgggccgctcgtgaccgggccaaccagaagttggtggaatacatcgtgaaagccaagggcgcagagagtcacctcagagccattctaaaaagtagaaaaccgagccgctggttgcaaacttttttaagttctagccaatacgtgacgtgtgtggagacatacctggaagacgaaggtcaactggatctcgtcgtgaaatatctgcaaggagtgtaccaggaagtcggcgccaaggtactgcaaaggaccaacggtgaccggatccgcttcattctcgacgtgctgctgcccgaggctatcatttgcgcaatctcggcagtggatgaagtggattataagactgctgaagagaaatatataaagggaccttcactctcgtaccgggagaaggagatatttgacaatcaactgctagaggagagaaaccggagaagaaggtag

SEQ ID NO: 19763 - DNA, 2136 bp, Artificial Sequence
  Description of Artificial Sequence: Synthetic coding sequence
atgatggccgacgccaagtacgtgctgtgccggtgggagaagcggttatggccggcaaaggtcctggctagaaccgctacatccacaaaaaataaacgtaggaaggagtactttctcgcagttcagattctctccttggaggagaaaatcaaagtgaagagtacagaggttgagatcctggaaaaaagccagatcgaggccatcgcctctagcctggcatctcagaatgaggtgccagctgctcctctagaggaattggcttataggaggagtctaagggtcgccctagacgttctctccgaaggctctatctggtcacaggagagctctgctggaacagggagggcggaccgatccctcagaggcaagcccatggaacatgtaagcagtccatgcgactccaacagctcgtccctcccgagaggagacgtgttgggctcttctcggccccatagacggcgtccttgcgttcaacagtcactttcctcttcgttcacatgcgagaaagaccccgagtgcaaagtcgaccacaaaaagggattacgtaagtccgagaaccctcggggacccctggtcctccccgccgggggaggcgcccaggatgagtcaggatcccggatccaccacaagaattggaccttggccagtaaacgcggtggcaactctgcccagaaagcaagcttatgcctaaacggatctagcttgagcgaggatgacaccgagagggacatgggttccaagggcggctcttgggcagccccaagtctacctagcggcgtgcgcgaggacgatccctgtgccaatgccgaagggcacgatcctgggctgccactgggttctctgaccgctccccctgcccccgaaccttcagcatgttcggagccgggtgagtgcccagctaagaagaggccacgacttgacggtagccagcgcccgcccgcagtgcagttggaacctatggctgcgggtgctgcgccatcacccggccccggacctgggccaagagaatccgtcactcctcggtcaactgctcggctgggccctccaccgtctcacgcctcggcagacgctacgcgctgcctgccgtgtcccgattcacagaagctggagaaagagtgtcagtcaagcgaggaaagcatggggtccaactcgatgaggagtattcttgaagaagacgaagaagacgaggagccgccgagggtgctcctgtatcacgaaccacgctccttcgaagtcggaatgctcgtgtggcacaaacacaagaaatatccattctggcccgccgttgttaagtctgtcaggcagagagataagaaagctagtgtgttgtatatagagggccacatgaaccccaagatgaaagggttcactgttagtttgaaatctctgaaacactttgattgtaaggaaaagcaaaccttattaaatcaggcacgagaagacttcaatcaggacattgggtggtgcgtgtccctgattaccgattatcgcgtcaggctcggctgcgggtcgttcgccggcagttttctggaatactacgctgccgatatatcatatcctgtccggaagagcatccagcaggatgtgttgggcaccaaacttccccagctctcaaaaggctcgccagaggagcctgtcgtgggctgtcctctaggtcaaagacagccttgtcgaaagatgttgccagacaggtccagagcagctagggatagagcaaaccagaaactcgtcgagtacatcgtgaaagccaaaggtgctgagtcacacctcagagccatactgaagagtcgtaagccctccaggtggctgcagaccttcctcagctctagtcaatacgtgacctgcgtggaaacatatctggaggatgagggccagcttgatctcgtcgtcaagtacctgcagggtgtataccaagaagtgggcgcgaaggtcttgcagaggacaaatggagatcgtataagatttattttggatgtcctcctacctgaggccatcatctgtgctatctcagccgtcgacgaagtggactacaagacagctgaagaaaaatacatcaaagggccttccctgtcatacagggagaaggagatatttgacaaccaattgcttgaggagagaaacaggagacggagatag

SEQ ID NO: 19764 - DNA, 225 bp, Artificial Sequence
  Description of Artificial Sequence: Synthetic coding sequence
ggcggcggcggcggcggccacatcggcgtgcggcccggcagcaccctatgtcagatcattgccacatgtcatatgtccgtgaacgacggcggatgctacgtgctgtgtcgctgggaaaaacgcctgtggcccgcgaaggtgttggctcgcacagctacatccacaaaaaacaaacggaggaaggaatactttttagcagtgcagatcctttcattggaagaatag

SEQ ID NO: 19765 - DNA, 2199 bp, Artificial Sequence
  Description of Artificial Sequence: Synthetic coding sequence
atgatggccgacgccaagtacgtgctgtgccggtgggagaagcggctgtggccggccaaagtactggccagaaccgccaccagtactaaaaataaacgcagaaaagagtatttcttggccgtgcagattctcagcctggaagagaagatcaaagttaagtccacggaagtggagatcctcgagaagtctcagatcgaagccatcgccagtagcttggcctcccagaacgaggtgcccgcggcccctttggaagagcttgcctatcgccggtctctgcgcgtcgcactggacgtcctgagcgaaggatctatatggagccaggagtctagtgccggcaccggtagggcagatagatctcttagggggaagccgatggagcatgtgtcaagtccatgcgattctaattcctcttcgctgccgcgcggcgacgttctcggttcctcaagacctcaccgccgacgtccatgtgttcagcagagccttagctcctccttcacctgcgagaaggatcctgaatgtaaggttgaccacaaaaaaggcctcagaaagagtgaaaaccctcgcgggcccttagtgctccctgctggggggggggcccaggacgaatcgggatctcgcattcaccataaaaattggaccctagcatccaagagggggggaaatagtgcccagaaagcaagcctgtgtttgaatggctcttcactgtcagaagatgatacagagcgggacatgggtagcaaaggagggtcttgggcagcaccctctctgccgtccggggttcgcgaagacgatccttgtgcaaatgcagaaggtcatgatccgggcctgcctttgggcagtttaactgctccacctgcgcctgaaccaagcgcttgctccgagcctggggagtgccctgccaaaaaacgacctaggctggacggaagtcagagaccacctgccgtgcagctggagcctatggctgccggcgctgccccaagtcctggtcccggccccggccccagggagtcagttacaccaaggtctaccgcccgcttaggcccaccacccagtcatgctagtgccgacgctacccgctgcttgccgtgcccagactctcagaagctggagaaggagtgtcagagtagtgaagagagcatgggaagtaactccatgagaagcattctggaggaggacgaggaggatgaggaaccccctagggtcttgctctaccatgagcccagatctttcgaagtgggcatgctggtgtggcacaagcacaagaaatacccgttctggccagccgtagttaagagcgtaagacagagagataagaaagcttcagtgctgtatattgagggacacatgaatcctaagatgaaagggtttacggtgtccctgaaaagcctgaaacattttgattgcaaggagaagcagacactgttgaaccaggctagagaagatttcaatcaggatatcggctggtgtgtaagtcttatcacagattaccgcgttcggctgggatgtgggagcttcgccgggtcgttcctggagtattatgcggctgacataagctacccggtgcggaaatcgatccaacaggatgttctcggaactaaactgccccagctgtccaagggttctcccgaagagccggtggttggctgcccactagggcaaaggcagccctgccggaagatgctgccagaccgtagccgggctgctcgggatagggcgaatcagaaactggtcgagtacatcgtgaaggccaagggagcagagagtcacttacgcgctattctgaagtcaagaaaaccctctaggtggttacaaacatttcttagcagctcccagtacgtgacttgtgttgaaacgtacttggaagatgaaggccagctcgatctggtcgttaagtacctccagggcgtttaccaggaggtaggcgccaaggtcctccaacgcaccaacggagatagaattaggttcatcctagatgttctgttacccgaatgctgggagatgcgcgttcgtgccctcgatcccgtccgaagacgatccaggctgctggatccatgcgccgagatggagctgctgaggtcctgccagcatcagggcgtacgaacaccaagtctattgcgagcacaccgatgctttcccgcctccgtgggacatcacctttgtgacctgtgtgggggtaggggcgggctgcaagacggctag

SEQ ID NO: 19766 - DNA, 501 bp, Artificial Sequence
  Description of Artificial Sequence: Synthetic coding sequence
gtgctggccgccagccagaacgaggtgcccgcccacccctggaagaactggcccacagatggacgggtggccctggatgtgctgagtgagggatccatttggtcacaggaaagttccgctggcaccggtcgggctgataggtccttgagagggaagccaatggaacacgtttcctctccatgcgatagcaattcatcaagcctcccgagaggcgatgtgctcggctccagcaggccgcataggcgccggccttgtgttcagcagtcactatccagctctttcacgtgtgaaaaggaccctgaatgtaaagtcgatcacaaaaagggcctccgtaagagcgagaatccccggggtccgcttgtactccctgccggcggtggcgcccaagatgagagcgggtcgcgtatccaccacaaaaactggactctggccagcaaacgcggaggcaactccgctcagaaggcatcgttgtgtctaaacgggagttcactgtctgagtag

SEQ ID NO: 19767 - DNA, 1539 bp, Artificial Sequence
  Description of Artificial Sequence: Synthetic coding sequence
atggccgagcccagcgtggagagcagcagccccggcggcagcgccacaagcgatgaccacgaatttgacccttccgccgacatgctggtccatgactttgatgacgagcgcaccctggaggaagaagagatgatggaaggagaaaccaacttctcttctgagatcgaggatttggcccgggagggtgatatgccgatccatgaactactgtcactctatggatacgggagcaccgtgagactacccgaagaagacgaggaagaggaagaggaggaagaagaaggcgaggacgacgaagatgctgacaatgatgacaattccggatgctcaggagaaaacaaggaagagaatatcaaagatagctccggacaagaggacgagacacaatcgtccaatgatgatccgtctcaaagcgttgcgtcgcaggacgctcaggaaattataagacccaggcggtgcaagtacttcgatactaactccgaggtggaggaggaaagtgaggaggatgaagattacatcccttctgaagactggaagaaagagattatggtgggaagcatgtttcaggccgaaattccagtgggcatttgtcgatataaggagaatgaaaaggtatacgaaaacgatgaccagctgctgtgggaccccgaatacctgcctgaagataaggtaattatttttttaaaggatgcaagccgacggactggggatgaaaaaggagttgaggcgatccctgagggtagccacatcaaagacaacgagcaggccctttacgaacttgtgaagtgcaatttcgatacggaagaagcactcaggcgcctaaggtttaatgtgaaggctgctagagaggagcttagcgtgtggaccgaagaagaatgtagaaacttcgagcaaggcttgaaggcgtacggaaaggattttcacctcattcaggccaacaaagttagaaccagaagcgtaggcgagtgcgtggctttttattatatgtggaaaaagtccgaacggtatgacttttttgcccagcagacccgatttggaaagaagaagtataatctgcatcctggcgttactgactacatggatcgcttgttagatgaatccgaaagtgccgcctcctcgcgggcacccagccctcctcccactgcttcgaactccagcaactcgcaatctgagaaagaggatggaactgtatcaaccgccaaccagaacggcgtttctagcaacgggcctggcgagattcttaataaggaggaggtgaaggtcgagggcctgcatatcaacgggccaacaggcggaaacaagaagccactccacgctgatatggacaccaatggctacgagactgataatctcaccacagaccctaagctcgcccacatgaccgcgagaaatgagaatgatttcgatgagaagtccgaacgtccagccaaaaggcgtagagttaattcaaacgggaaggagtcccccggtagctcagagtttttccaggaagcagtcagccacggtaaattcgaggagctcgaaaatacggacgactag

SEQ ID NO: 19768 - DNA, 1113 bp, Artificial Sequence
  Description of Artificial Sequence: Synthetic coding sequence
atgcccatccacgagctgctgagcctgtacggctacggcagcaccgtgaggttacctgaggaggacgaagaggaggaagaagaagaagaggagggcgaagatgatgaggacgccgacaacgatgacaactccgggtgttccggcgaaaataaagaggagaacatcaaggatagctccggacaagaggacgaaacccagagttctaacgacgacccttcccaatctgtggcaagccaggatgcgcaagagatcatcagaccccgtcgctgcaaatactttgacaccaattccgaggtggaggaggagagcgaagaggacgaggattacatcccgagcgaagactggaagaaagaaattatggtaggctccatgtttcaggcagagatcccagtgggcatctgtcgctataaagaaaatgaaaaagtgtatgagaatgacgaccagttactgtgggaccctgaatacctgccagaagataaagtgatcatcttcctaaaggacgccagccggcggactggcgacgagaagggggtcgaggctattccagaggggtcacacataaaagataacgaacaagccctttacgaactagtgaagtgcaacttcgatacagaagaggccctccggcgactgcggtttaatgttaaggctgctagggaggagctgtccgtgtggacggaagaggagtgtagaaactttgaacaaggattgaaagcttacggaaaagacttccatcttattcaggctaacaaagtaagaactcgaagcgtgggtgagtgtgtggcgttctactacatgtggaaaaagtccgaaagatatgacttttttgcccaacagacacgctttggcaagaagaagtacaatcttcatccaggggttaccgactacatggacaggctgttagatgaaagcgagtccgccgcttcaagccgcgctccttctccccccccaacagccagtaattcgagtaatagccagagtgagaaagaggacggtacagtgagtaccgctaatcaaaacggtgtaagctctaatggcccagggatcctgcaaatgctactgcccgtgcacttctcggctatatcctctcgggccaatgcctttctcaagtag

SEQ ID NO: 19769 - DNA, 1590 bp, Artificial Sequence
  Description of Artificial Sequence: Synthetic coding sequence
atgttcatgttcaactggttcaccgactgcctgtggaccctgttcctgtccaactatcagcctagcgttgaatcatcctcaccaggaggaagtgcgactagtgatgaccacgagtttgacccctccgccgacatgctcgtgcatgacttcgacgatgagagaaccttagaggaggaggaaatgatggagggggagactaactttagttctgaaatagaggatctggctcgcgagggcgatatgccaattcacgaattgctgtccctctacggatatggaagtaccgtcagactgccggaggaagacgaggaagaagaggaggaggaagaagagggagaagacgatgaagatgcagacaatgatgacaacagtggctgctcgggagagaacaaagaagagaacattaaggactcttcagggcaggaagacgaaacacaaagtagcaacgatgacccctcccagtcagtcgcgagccaggacgcgcaagagattattagaccacggaggtgtaagtacttcgacacaaacagtgaggtggaggaagagagcgaggaggatgaagattacatcccttcagaggattggaagaaagaaattatggtcgggtccatgttccaagccgagattccagtcggaatttgtagatataaggagaacgagaaggtctacgaaaatgacgatcaactactgtgggatcctgaatacctgccagaggataaggtaataatcttccttaaagatgccagcaggcgcactggagatgagaaaggcgtcgaggcaataccggaaggatcacatatcaaggataatgagcaggctttgtatgaactggttaagtgcaatttcgataccgaggaggccctgcgcaggctgcgcttcaacgtaaaagcagcccgagaagaattgtctgtgtggaccgaagaggagtgcaggaatttcgaacagggcctcaaagcgtacgggaaggattttcatctgatccaagcgaacaaagttcgaacacggagcgtgggagaatgcgtggctttttactacatgtggaagaaatcagaacggtatgatttctttgcccagcagactaggttcggcaagaagaagtataacctgcatccaggggtgacggactatatggatcgccttctcgacgaaagcgaatcggccgccagttccagagccccctcgcccccaccaacagcgtctaacagctccaatagtcaatcagaaaaagaggatggcactgtcagcaccgcgaaccagaacggtgtttcttccaacggacctggtgagattctaaacaaagaggaggtcaaggttgaggggttacacatcaacggtccgacaggggggaataaaaagcctctccacgccgacatggataccaacgggtatgagacagacaatctaacaacagacccaaaactggcacacatgacggcaaggaatgaaaatgacttcgacgagaagtcagagcgtcccgctaaaagaaggcgcgttaatagcaatggcaaggagagtcccggatccagtgagttcttccaggaagctgtgtcccatggcaaatttgaggaattggagaacacggacgattag

SEQ ID NO: 19770 - DNA, 1461 bp, Artificial Sequence
  Description of Artificial Sequence: Synthetic coding sequence
atggacggcgccagcagcggcggcggcggcagcagcgagggcggcggcggctccagtgggtcaggttatggcgtggtggccaggttcagtcagtgccttgccgaattcaggacatggctccggacaaactggcttcggttcaatgctgacaagactgatgtcatgctgccctcagttgaatcctcctccccgggcggaagcgcgactagtgatgatcacgagttcgatccgagtgccgacatgcttgtgcacgattttgacgacgagcgtaccttagaagaggaagagatgatggagggagaaaccaatttttcttctgagatagaggatttggccagggagggggacatgccaattcacgaactcttgtcgctgtacggctatgggtcgacagtgagactgccagaagaggacgaggaggaagaggaagaagaggaggaaggagaggatgacgaagacgctgacaacgatgacaattccggctgtagcggggaaaataaagaggagaacataaaggatagttctgggcaggaggacgagacacagagcagcaatgatgatccatcccagagcgtggcctcacaggatgcccaggaaatcatacgcccaagacgctgcaaatactttgacaccaacagtgaagtcgaagaggaaagcgaggaggacgaagactacattccaagtgaggattggaagaaggaaattatggtggggagcatgttccaggccgaaatacccgtcggaatttgcagatataaagagaatgaaaaggtctatgagaacgacgaccaactgctgtgggaccctgagtatctgccagaggacaaagtgatcatatttctgaaggacgcctctagaaggacaggtgatgaaaagggcgtggaagctatcccggagggtagtcacattaaagataacgaacaggctctttatgagttggtgaagtgcaatttcgatacagaggaagctctacgcaggctgcgctttaacgttaaagccgcccgcgaggagctgtctgtttggacagaagaagagtgtcgcaactttgagcaaggactgaaggcttacggaaaagattttcatctgattcaggcaaataaagtgcgcacgaggagcgtaggggaatgcgttgccttttactatatgtggaaaaaatcggaacggtatgacttctttgcgcagcagacccgctttgggaagaaaaaatacaatctgcaccccggggtcacagactatatggatagactgctggatgagtcagagtctgccgccagcagtagggcaccttcgcccccacccaccgcttctaacagcagtaactcacagtcagaaaaagaagacggtaccgtgtcaacggccaatcagaacggggtcagcagtaacggaccaggaatactccagatgttgctcccagtacatttcagtgcgatatcgtcacgcgccaacgcctttttgaaatag

SEQ ID NO: 19771 - DNA, 1353 bp, Artificial Sequence
  Description of Artificial Sequence: Synthetic coding sequence
atgttcatgttcaactggttcaccgactgcctgtggaccctgttcctgtcgaactaccagcccagcgtggaaagcagttccccaggcgggtctgcaacctccgacgaccacgagtttgatccatccgctgatatgctggtgcatgattttgacgatgagaggaccctggaagaggaggaaatgatggaaggagaaacaaatttcagcagcgaaatagaggatctggcacgcgaaggcgacatgccgatacacgaactgttatcactgtacggctatggctctaccgtgagactccctgaagaagacgaagaagaggaagaagaagaggaagaaggcgaagacgacgaggatgcagacaacgatgataacagcggctgctctggcgaaaacaaggaggagaatataaaagatagtagtgggcaggaggacgagacccagtccagcaacgacgatccgagtcagagcgtggcgtcgcaggacgcacaggagatcatacggcctcgccgctgtaagtacttcgataccaactccgaggtcgaggaggaatccgaggaagacgaggattacattccctctgaggactggaagaaggaaattatggtcggctccatgttccaggccgagattccggtggggatctgtagatacaaggaaaacgaaaaggtctacgaaaatgacgatcagctgctttgggacccagagtacctaccagaggacaaggtcataatcttcctcaaggacgcatccagacgtaccggggatgagaaaggcgtagaggctatcccagagggatcccatatcaaggacaacgagcaagcattgtacgagctggttaaatgcaacttcgatacagaggaggcccttcgccgtttgcgttttaacgtgaaggcagcgagggaggagcttagcgtatggacagaagaggagtgtcgtaactttgagcaagggctcaaggcatatggcaaagatttccacctgatccaagcaaataaggtaaggacccgctccgtgggcgagtgcgttgctttttactatatgtggaagaaatccgagcgatatgattttttcgcacagcagacgagattcgggaaaaagaagtacaacctgcatccaggcgttacagattacatggaccgactccttgatgaatctgaaagtgcagccagctcgcgggccccctcaccacctccaacagcctcgaacagtagcaactcgcagtcggaaaaggaggacggcacagttagcacagccaaccaaaatggcgttagctctaacggtcctggtattctgcaaatgttgttacctgtccatttctccgccatttctagcagagccaacgcgttcttgaagtag

SEQ ID NO: 19772 - DNA, 1602 bp, Artificial Sequence
  Description of Artificial Sequence: Synthetic coding sequence
atgtgcatccggtgcctgtgcctgatcggcctgcagaccgtgtgcgggcttttcagttgccaaatcactagacctagtgttgaaagtagctctcccgggggctcggccacttcagatgatcatgagttcgatccgagtgctgacatgctggtgcatgacttcgacgacgagcgtactctcgaagaggaagagatgatggagggggagacgaattttagctcggaaatcgaagacctggctcgagaaggtgacatgcccattcatgaactactatcactctacggatatggatctactgttcgtctgccagaggaggacgaggaggaagaagaagaggaggaggagggagaggatgacgaggatgcagacaatgatgataattctgggtgttctggtgaaaacaaggaggagaatatcaaggattcttctgggcaggaagatgaaactcaatctagtaacgacgatccgtcccaatccgtcgccagccaggatgctcaagaaatcattagaccgagacgctgcaagtatttcgacacaaatagcgaggtggaggaggagtctgaggaggatgaagactacatcccttcagaagattggaagaaagagatcatggtcgggagtatgttccaagctgaaattccagtgggaatttgccggtacaaggagaacgagaaggtatatgagaatgacgaccaactcctttgggacccagaatacttacctgaagataaggtaattatcttcctcaaagatgcctccaggcggacaggcgacgagaagggagtggaggccattcctgaaggctcccacatcaaggacaacgaacaggccctttatgagctcgtgaagtgcaatttcgacacagaagaggcacttaggcggttaaggttcaatgtcaaagccgcccgtgaagagttgagtgtctggacagaagaggagtgcaggaactttgaacaaggactgaaggcatatggcaaggacttccatctgatccaggcaaacaaagtgcgcacccggagtgtgggcgagtgtgtagccttttattacatgtggaagaaaagcgagcggtatgactttttcgcgcagcagacccgattcggaaagaagaagtacaatctgcacccaggtgtgaccgactacatggatcgtctgctggatgaaagcgaaagtgcggcttcctcccgggccccctctcccccgcccacagcttctaactcatctaacagtcaaagcgagaaggaggacggaacagtctcgactgcaaatcagaatggtgttagtagcaacggcccgggagaaatcctgaataaagaggaggtgaaagtagaaggcctacacatcaacggaccaaccggagggaacaagaaaccgctccacgcagacatggacaccaatggatatgaaacagataacctcaccacagaccctaagctagctcatatgactgcgcggaacgagaatgacttcgatgaaaagtctgaacgacccgccaaaaggcggagggtgaatagcaacggaaaggaaagccccgggtcctctgagttcttccaggaagcagtctcccacggaaaattcgaggagctcgagaataccgatgactag

SEQ ID NO: 19773 - DNA, 1413 bp, Artificial Sequence
  Description of Artificial Sequence: Synthetic coding sequence
atgttcatgttcaactggttcaccgactgcctgtggaccctgttcctcagtaactatcagccgtccgtggagtcaagcagtccgggtggctccgctacctctgatgatcacgaatttgatccaagcgccgatatgctcgtgcacgatttcgatgacgagagaacactcgaagaggaagagatgatggaaggcgaaaccaatttttctagcgaaatcgaggacctggcaagagaaggcgatatgcccattcatgagctgctgagcctatatggctacgggtctacggtgaggctgcccgaggaagacgaggaggaggaagaagaggaagaggagggagaagacgacgaggatgccgataatgatgataacagcgggtgctcaggggagaataaggaagagaatattaaagattcatccggccaggaagatgagacccagagcagcaacgacgatccctcacagtccgtcgctagccaagacgcccaggagataataagaccccggagatgcaagtacttcgatactaattcagaggtggaagaagagagcgaggaggacgaagattacatcccctctgaggactggaagaaagagatcatggtgggcagcatgttccaggccgagattcccgtcggcatttgtagatacaaagagaatgagaaagtttatgaaaacgatgaccaattgctatgggatcctgagtacttgccagaagacaaagttatcatctttcttaaggacgcaagccgaagaacgggggacgagaagggcgtggaagcaatacctgaaggtagccatatcaaagataacgagcaggcactgtacgagctggtcaagtgtaatttcgacaccgaagaggcacttcgcagactgcgatttaacgttaaagccgcgagagaagaacttagcgtttggactgaagaggaatgtcgcaatttcgagcaaggattaaaggcatatggtaaggatttccacctgatccaggcaaataaggttcgaaccaggagtgtgggtgagtgtgtggccttttactacatgtggaagaagtcagagagatacgatttcttcgcccagcaaacacgttttgggaagaaaaagtacaatctgcacccaggagtaaccgattatatggaccggctgttggacgagtcagagagcgctgcctcttcacgtgcaccctctccaccaccaaccgcttctaatagtagcaacagccagtcagagaaggaggacgggaccgtgtcgaccgccaatcaaaacggggtgtcttcaaacgggccaggggagattttaaataaggaggaagtgaaggtggaggggctgcatatcaacggtcccacaggtatactccagatgctgctgccggtgcatttcagcgctatcagtagccgtgctaatgctttcctaaaatag

SEQ ID NO: 19774 - DNA, 1698 bp, Artificial Sequence
  Description of Artificial Sequence: Synthetic coding sequence
atggacggcgccagcagcggcggcggcggcagcagcgagggcggcgggggctcatccggttcaggctacggggttgtagctcggtttagccaatgtctggctgaattcaggacatggcttagaacaaactggctacggtttaatgctgacaaaacagatgtcatgctgccaagtgtcgaaagctcttctcccggcggcagtgccacctcagatgaccacgaatttgaccccagcgctgacatgttagtccacgacttcgacgatgagaggacattggaagaagaagagatgatggagggcgagacaaacttttcctctgagattgaggatctggcacgcgagggtgatatgcccatccacgagctcctcagcttatatgggtacggctcgaccgtgcggctcccagaagaagacgaagaagaggaggaggaggaagaggaaggcgaggatgacgaagacgccgataacgacgacaatagtggatgcagtggggagaataaagaagaaaatattaaggacagctctggtcaagaagacgagactcagagtagcaacgacgatccgtcccagagcgtggcctctcaggacgcacaggaaattatccgccctcggcgttgcaaatattttgacaccaattctgaagtggaggaggaatccgaagaggatgaggactacataccgtccgaggactggaagaaagagattatggtcggctctatgttccaagccgagatacccgtcggcatctgtaggtacaaggagaacgaaaaggtttacgaaaacgatgatcagctcttatgggaccccgagtatctgccagaggataaagtgattatctttttgaaggatgctagccgccgcacaggggatgaaaagggggtggaggccatccccgaagggtcccacattaaggacaatgaacaggctttatatgaattagtgaaatgcaacttcgatacagaggaagcactgcgccgcctgcgtttcaacgtgaaggctgcccgggaggagctctctgtttggaccgaagaggaatgtcggaacttcgagcagggcttgaaggcttacggtaaggactttcacctgatacaagctaataaagtgcggactcgctctgttggggaatgtgtagctttctactacatgtggaagaaaagcgagcggtacgatttttttgcccagcagaccaggttcgggaagaaaaagtacaaccttcatccgggagtcaccgattatatggatcgcctgctcgatgagtccgagtcagcggcctcatcccgtgctccaagtcccccgcccaccgcaagtaattcaagcaactcacaatctgaaaaggaggatgggaccgtctccaccgcaaatcagaacggtgtatcctccaacgggcccggagagattctgaacaaagaggaagtcaaggtggagggcctccacattaatggacctacaggtggaaataaaaagccattgcacgccgacatggacactaatggctacgagaccgacaacctgactacggacccaaaattagcccacatgaccgcaaggaatgagaacgacttcgacgagaagtctgaacgcccagctaaacggagacgtgttaattccaacggtaaggagtcccctggctctagtgagtttttccaggaggccgttagtcacgggaaattcgaagagttggagaacaccgatgactag

SEQ ID NO: 19775 - DNA, 1302 bp, Artificial Sequence
  Description of Artificial Sequence: Synthetic coding sequence
atggccgagcccagcgtggagagcagcagccccggcggcagcgccacttctgacgatcacgaatttgatccaagtgccgacatgctggtgcacgatttcgatgacgagcgaactctggaggaagaggaaatgatggagggagagactaatttctcgtctgagatcgaggacttggcaagggaaggggatatgcccattcacgagcttctgagtctatatggatatgggagcacagttcgcctgcccgaagaggacgaagaagaagaagaggaggaggaggagggtgaggatgatgaagacgccgataatgatgacaattcaggctgttcaggtgagaacaaggaagagaatatcaaggatagttccgggcaggaggatgaaacccagtcaagtaacgacgacccttcccaatcagtggcctctcaggacgcacaggagatcatcagaccccggcggtgtaaatatttcgacacaaattctgaagtggaggaggagtccgaagaagacgaagactacattccctctgaggattggaagaaggagattatggttggatcaatgtttcaggcggaaatccctgttgggatttgccgctacaaagaaaacgagaaggtctatgagaacgatgaccaactgctctgggaccccgaatacctgcccgaagacaaagtgattatctttctcaaagacgcatcccggcgcaccggagacgaaaagggtgtggaagcaattcccgaaggttcacatataaaagataacgaacaggccctgtacgagctcgtgaaatgtaactttgatactgaggaagcgttgcgccgcctccgattcaacgtgaaggccgcacgcgaagagttgtctgtatggaccgaagaagaatgtcgcaactttgagcaaggactcaaggcgtatggcaaagactttcacctcatacaggcaaacaaagttcgcaccaggagcgtgggggagtgcgtggccttctactatatgtggaagaaaagtgagcgctatgatttctttgcacagcagacgcgatttggcaagaagaaatacaatttgcaccccggagttactgattatatggatcggctacttgatgaatctgagtcagccgcgtcctcacgcgcaccttccccacctcccactgcgtctaactcgtcaaactcacagtcggaaaaagaggacgggactgtgtccacagccaaccaaaatggagttagttcaaacggtccgggaatactgcagatgcttctcccagtgcatttcagtgcaatctctagtcgggccaacgcctttttgaagtag

SEQ ID NO: 19776 - DNA, 1638 bp, Artificial Sequence
  Description of Artificial Sequence: Synthetic coding sequence
atggccgaggccagcagcctgggccggcagagcccccgggtggtgagctgtttggagcactcactgtgtccgggtgagcccggcttgcagactaccgctgtggtctccatgggaagcggggatcaccagtttaatcttgcagagatcttgtcccagaactactccgtccgtggggaatgcgaggaggcctccaggtgccctgacaagcctaaggaagaactagaaaaagactttatcagccagagcaacgatatgccatttgacgagcttctggcgttgtatgggtatgaggcctccgatccaatatctgatagagaatcggaaggaggagacgtagccccaaatctgcctgatatgacactcgacaaggaacaaatcgccaaggatctgctgtcaggggaagaggaggaggaaacccagagcagcgccgatgacctgacaccgtcagtgacttcccacgaggctagtgacttgttccctaatcggtccggctcccgatttctggcagatgaagatagggaaccggggagttccgcttcctctgatacggaggaggatagcctgccagcaaataaatgtaagaaggagattatggtaggaccgcaatttcaggctgacctttccaacctgcatctgaatagacactgcgaaaagatttacgagaatgaggatcagttgttatgggatccttccgtgctcccggaaagggaggttgaggagtttctctatcgagccgtgaagcgccgatggcacgagatggcaggcccacagctgcctgagggtgaagctgtgaaggatagtgagcaggctttgtacgagttggtaaagtgcaactttaatgtcgaagaagctctgcgccggttgcggttcaatgttaaggtaataagagatggactttgtgcctggtcagaagaagagtgcaggaatttcgaacacggatttagagtccacggcaagaatttccacctgattcaggcaaataaagtgcgtacaaggtccgttggggagtgtgttgagtactactatctttggaaaaagtcggaacgttatgattacttcgctcagcaaacgaggctgggaaggaggaagtacgtgccttccggaacaacagatgccgatcaagatctggatggctctgatccggatgggcccggcaggccacgcccagaacaagatactctgaccgggatgcgaacggacccactgtccgtcgatgggaccgcgggagggcttgatgagccaggggtggcatccgacggcctcccatcatcagaaccaggcccttgctcctttcagcagctcgatgagtctccggccgtgcccttatcccataggccccccgcattggccgatcctgccagctatcaacccgcagtgaccgctccggaacctgatgcatctcccagactggccgttgattttgccctgcctaaagagttgcctctgatcagctcccatgtggacttaagtggcgatcctgaggaaaccgtggcccccgctcaggtcgctttgtccgtgactgagttcggcctgattggtattggagatgtgaatccatttttagctgcccaccctacctgccctgcgccaggactccactcagaacccctgagccattgtaacgtcatgacttgctag

SEQ ID NO: 19777 - DNA, 1653 bp, Artificial Sequence
  Description of Artificial Sequence: Synthetic coding sequence
atggccgaggccagcttcggcagcagcagccccgtgggcagcctgagcagcgaagatcacgatttcgaccctaccgccgagatgttggtgcacgactacgacgatgagcgcacgctggaagaggaggagatgatggacgagggtaaaaacttcagttccgagatagaggatctggaaaaagaggggactatgcctctagaggaccttctggcattctacggttacgagcctaccatcccagccgtggctaattcaagcgcaaattcttctccatccgagttagcagatgaactcccagatatgactctcgataaagaggaaattgctaaagatctgctgtccggtgacgacgaggaaactcagagctccgcagatgatctcacgccaagtgtgacctcacacgaaacctcggattttttcccacggccactgcgtagcaataccgcttgtgatggggataaagagtctgaggtcgaagacgtagagactgacagcggaaattcacccgaggatcttcggaaagagatcatgatcggcctgcaatatcaggcagagatccccccctatctgggagagtacgacgggaacgaaaaggtctatgagaacgaagaccagctgctctggtgtccagacgtcgtgctggaaagcaaggttaaggaatatctggtggagacaagtcttaggactgggtccgagaagattatggatcggatatctgctggaacccatacgcgcgataacgagcaggccctgtatgaactcttgaagtgtaaccacaacattaaagaggccattgagcgctattgctgcaatggcaaggcctcccaagagggtatgacagcctggacagaggaggaatgcagatctttcgaacacgcactcatgctgttcggtaaggactttcatctgattcaaaagaacaaagttcggacgcgcaccgtggctgagtgcgttgctttttactatatgtggaagaagagcgaaaggtatgattacttcgctcagcagacccggtttgggaagaaacgttacaaccaccatcccggggtgacagactacatggatagactggtggacgagacagaggccttaggagggaccgttaacgcctccgctttaacctccaacaggcccgagcctattcccgatcaacagcttaatattctcaatagtttcacggcaagtgacttaaccgcgctgacaaactctgtggccaccgtgtgcgatcccactgacgtgaactgtctggatgacagctttccacccctgggcaatacccctcgagggcaggttaaccacgtcccagtggtcaccgaggagctgctcacccttcctagtaatggagagagcgactgcttcaatttattcgagaccggtttttaccacagcgaactcaaccccatgaacatgtgttctgaagagagtgaacgtcccgctaaacgcctaaaaatggggattgcagtgcccgagtcttttatgaatgaggtgtcagtaaacaacctgggggtcgattttgagaaccacacccaccatatcacaagtgcaaaaatggcagtgagcgtggccgactttggcagcctgtctgcaaatgagacgaatggatttatatcagcccacgcattacaccaacatgcagcactgcactccgagtag

SEQ ID NO: 19778 - DNA, 1650 bp, Artificial Sequence
  Description of Artificial Sequence: Synthetic coding sequence
atggccgaggccagcttcggcagcagcagccccgtgggcagcctgagttctgaggaccacgactttgaccccactgcggagatgcttgtacacgactatgacgacgaacgaacattagaggaagaagagatgatggacgagggcaagaacttttcctctgagattgaggatttggaaaaagagggaaccatgccattggaggatctccttgccttctatggatacgaacccactatccccgccgtcgcaaactctagtgcaaatagctcaccctctgagcttgcagatgaacttcctgatatgactctggacaaggaggaaatagctaaagaccttctcagcggcgatgacgaggaaacacaatcatccgctgacgacctcacgccaagcgtgacatctcatgagacatctgacttctttccacggcccctacggtccaataccgcttgcgatggggataaggaaagcgaagtcgaggatgtggagacagatagcggtaattcccctgaagatcttcgaaaggaaattatgatcgggttacagtaccaagccgaaatacctccataccttggagagtacgatggcaatgaaaaagtttatgagaacgaggaccaactcctttggtgccctgatgtggttttggagagcaaagtgaaggagtacctggtggaaaccagcctgaggaccggttccgagaagataatggacaggatttccgccgggacacataccagggataacgagcaggccctgtacgagctgttgaagtgcaatcacaacatcaaggaggctatcgagaggtactgttgtaacggaaaggcatcacaggggatgactgcttggacagaggaagagtgccggagttttgaacatgccctgatgttgttcggcaaagacttccatctcatccagaaaaacaaggttaggacgcggactgtggccgaatgtgtcgcattttattacatgtggaagaaaagtgagcggtacgactatttcgcccagcaaacccggtttggtaagaaaaggtataaccatcatccgggtgttactgattacatggaccgcttggtggatgaaactgaggcactgggcggcactgtcaatgcttctgcgctcaccagcaacagaccagagcctattcccgatcagcagctgaacatcctcaatagctttaccgcgtccgacctcaccgcgcttactaattctgtggccaccgtgtgtgaccccacagacgtaaactgcctggacgactccttccctccactcggcaacacaccgagagggcaggtcaatcacgtgccagtagttactgaagaacttttaacgttgccaagcaatggggagtcagactgcttcaatctgttcgagactggtttttatcattcggagctgaacccaatgaatatgtgcagcgaagaatctgagagaccagccaagaggttaaagatgggaatcgctgtgcccgaatcatttatgaacgaggttagcgtcaacaatcttggcgtcgactttgaaaaccacactcaccacataacttctgctaagatggctgtgtctgttgctgattttggcagcctgagtgccaacgagacaaatgggtttatttctgcacatgcacttcaccagcatgcggccttacacagtgagtag

SEQ ID NO: 19779 - DNA, 807 bp, Artificial Sequence
  Description of Artificial Sequence: Synthetic coding sequence
atggcccagcccctgtgcccccccctgagcgagagctggatgctgtccgccgcttgggggcccaccagaagaccccctccaagcgacaaagactgcggccgaagcctggtgagttcccccgactcttggggtagtacacctgccgactctccggtggcctctccagcaaggccaggtacgcttagagatccacgagccccctctgtgggacgtaggggcgcccgctccagccgtttaggcagcgggcagaggcagtctgcctctgagcgggagaaattgcgcatgcgaacactcgcaagggctttacacgagctgcgccgtttcctgcctccaagtgtcgccccagcaggtcagagcctgacaaagattgagaccctgaggttggccatacgttacattggacacctgagcgcagttctgggtctgtcggaagagagtctgcagagacgttgccgccagagaggcgacgccggctcccctagaggatgtcccttgtgtcccgacgactgccccgcgcagatgcagacccggacccaggccgaaggccaggggcaggggaggggtctcgggcttgttagtgctgtgagggccggggcctcttggggatcccccccagcgtgccccggtgccagggccgcccccgagccgcgtgatccacccgccctcttcgctgaagcagcttgccccgagggccaagcaatggagcccagtcccccctctccactgctgcccggcgacgtattggccttgctcgagacctggatgcctctgagccccctggaatggttgccggaggagcccaagtag

SEQ ID NO: 19780 - DNA, 2007 bp, Artificial Sequence
  Description of Artificial Sequence: Synthetic coding sequence
atggccgccaacatgtaccgggtgggcgactacgtgtacttcgagaattcatcaagcaacccctatctggtacggagaatcgaagagttgaacaagacagcgaatgggaacgtggaagcaaaggtcgtatgtctgttcagacgcagagatatctccagcagtcttaattctttggccgactccaacgcacgcgagttcgaggaggagtctaagcagcctggggtcagcgagcagcaaaggcaccagctaaagcacagggagctgttcctttcgcgccagttcgagtcactgcccgcgacgcacattcgaggtaagtgtagtgtcaccttgctcaacgagactgatattctgtcccaatacctggagaaggaggattgttttttttacagcctggtgtttgatccggtacagaagaccctgctggcagatcagggggaaatcagagtggggtgcaaatatcaggccgaaatacccgaccgcttagtggagggtgagtccgataacagaaaccagcagaaaatggagatgaaggtctgggaccccgacaatcccctgactgataggcaaattgaccaatttctcgttgtggcgagagcggtcggtacttttgcaagagccctcgactgttcttcttctattcgtcagccaagtctacatatgtcagcagctgcagcatcacgagacatcactctctttcatgctatggacacacttcagcgcaatggctacgacctggccaaggctatgtccactcttgtccctcaaggcggtcctgtgctttgtcgcgacgaaatggaagaatggtcggcttcagaggctatgctttttgaggaggcactcgagaaatacgggaaagactttaatgacatccgccaagacttccttccttggaagagcctggctagcatcgttcagttctactatatgtggaaaactaccgatcggtacattcaacagaagcgcctcaaggctgccgaagctgactccaagctcaagcaggtgtatatccctacttacactaagccaaatcccaaccagatcattagcgttggatccaaacccgggatgaacggtgccggcttccagaaaggattgacctgcgagagctgccatactacgcagagtgctcaatggtacgcctgggggccccccaacatgcagtgtcggctctgcgccagttgctggatttactggaaaaagtatggcggcctgaagacacccacccaattggagggggcaacacgcggcaccacggagcctcactctcgaggccatctgtccagacctgaggcccagagtctgtccccttacacgacttcggcgaaccgagccaagcttctggccaagaatcggcaaacattcctgctgcagactaccaagctgacacggctggctcggcgcatgtgtagggatctgctgcagccccgccgcgcagccagaaggccttatgcgcctatcaacgccaatgccataaaggccgaatgtagcatcagactgcccaaagctgcaaagacccctctgaaaatccacccccttgttcgccttcctttagctacgatcgtgaaggacttagtggctcaagccccgcttaaacccaaaacaccccgcggcacaaaaactccaattaatagaaatcaactgtcgcagaacaggggcctgggggggatcatggtcaagcgtgcatatgaaactatggcaggtgctggcgtgccctttagtgccaacggaagacccctggcgtcaggcataagaagctcctcgcagcctgctgctaagagacagaaattaaatcctgccgatgccccaaaccctgtcgtgttcgtcgcaactaaggatactcgcgcactgaggaaggccctgacacaccttgagatgcggcgtgcggccagacggcccaacctacccttgaaagtgaaaccgacccttattgccgtcagacctcccgttcccttgcctgccccttcccaccccgccagcactaatgagcccattgtactggaagattag

SEQ ID NO: 19781 - DNA, 1488 bp, Artificial Sequence
  Description of Artificial Sequence: Synthetic coding sequence
atggagatgaaggtgtgggaccccgacaaccccctgaccgaccggcaaattgaccagtttctggtggtggccagagctgtgggcacctttgcccgcgcactggattgttcatcatcaatcaggcagcctagcctgcatatgagcgccgcagctgccagccgcgatatcaccctgttccacgcaatggacactctgcagcgcaatggatatgacctcgccaaggcaatgagtactcttgtgcctcaaggcggcccagtattatgtcgggatgagatggaggagtggagcgcttcagaggctatgctatttgaggaggcgctggagaagtacgggaaggattttaacgacatacgccaagatttccttccctggaagagcctggcatctatcgtgcagttctactacatgtggaaaaccaccgatcgctatatccagcagaagaggctgaaggctgccgaggcagacagcaaactcaagcaagtttatatccccacgtacactaagccaaacccaaaccaaattataagcgtgggcagtaagccaggaatgaatggcgccggttttcagaaagggctgacatgcgaatcatgccacacaacgcagagtgcccagtggtatgcatggggtccgcccaacatgcaatgccggctgtgtgctagctgttggatatactggaagaagtacggcgggctgaagacccctactcagctggaaggggcaactcgaggcaccaccgaaccacacagccgcgggcatttgagcagacctgaagcccagagcctgtccccttacactacctctgcaaatagagctaagcttttggccaagaatcgccaaacgtttttgctgcagaccaccaaattgaccagattagctcgccgcatgtgccgagatcttttgcagccaagacgggcggctagaagaccttacgcacccattaacgccaacgcaatcaaggccgaatgctccatacggctgccgaaagccgctaagacaccactgaagattcaccctctggtgcggctgccactcgctacgatcgtgaaggatctcgtcgcacaggctccacttaagcccaagaccccaagaggcacaaagacaccaatcaaccgaaaccaactgtcacagaatcggggactgggcggcattatggtcaagagagcgtacgagaccatggctggggctggagttcctttttccgccaatggaaggccactggcttcaggaatccggagttcgtcccaacccgcagcgaaaagacagaaactgaacccagccgatgcgccgaatccagtcgtgttcgtggcaacaaaggacacgagggcccttaggaaagccctgacacacctggagatgcgccgggccgctaggcgacctaacctgcctctcaaggtgaaaccaaccctgattgctgtgcggccacctgtacctttgccggccccgtcgcatccagcgtcaacaaacgaaccaatcgttctggaagattag

SEQ ID NO: 19782 - DNA, 1488 bp, Artificial Sequence
  Description of Artificial Sequence: Synthetic coding sequence
atggagatgaaggtgtgggaccccgacaaccccctgaccgaccggcaaattgatcaattcctggtggtggcccgcgccgttggtacttttgccagagccttagattgctccagcagcataagacagccttccttacatatgtcagccgccgccgcctcacgagacataacactgtttcacgcgatggacaccctgcagagaaatggttacgaccttgctaaggctatgagtacactggtgccacagggaggccccgttttgtgtagggacgagatggaggagtggtcagcttcagaagcgatgctgtttgaagaggcgctggagaagtacggaaaggatttcaacgatatcaggcaagacttcttgccctggaagtccctggcctctatagtgcagttctattatatgtggaagaccactgaccgctacattcagcagaagcggctcaaggccgctgaagctgatagcaaattgaagcaagtctatattccaacatacacgaagcccaatcctaaccaaatcatttccgtgggctcaaaaccaggcatgaatggggctggatttcagaagggcctcacctgtgagtcttgccacactacccaatctgcccagtggtacgcttggggacctcccaatatgcagtgtcgtttgtgcgcttcatgctggatatactggaagaagtatgggggattgaagacccccacgcaactggaaggcgccactagaggaaccaccgagcctcattccaggggccacctctcccggcctgaagcgcaatccctctctccctacaccactagtgccaatagagcaaagctgctcgcaaagaatcggcagactttcctgttgcagacaacaaagctgacccggctcgccaggaggatgtgccgcgatctgctgcagcctagaagagctgcccgacggccttatgcacctattaatgcaaacgcgattaaagcagagtgtagtattaggttgccaaaggccgcaaagacccctcttaagatacacccactggtcaggctgccccttgcaaccattgtgaaggacctagtggctcaagcacccctgaaaccaaagacccctaggggtacaaaaactcctatcaaccgcaaccagctatctcagaaccgtggcttgggaggtatcatggttaaacgggcctacgaaacaatggccggcgcaggggtcccattctcagccaatggacgccccctagccagcggcatcagatcaagcagccagcctgccgccaagcgccaaaaattgaatcccgcagatgctcccaatcccgttgtctttgttgcaaccaaggatacaagggcactcagaaaggctctaacccacttggagatgcggagagccgccaggcgacccaacctcccactgaaggtcaagcccacacttattgcagtgcgaccgcctgttccactgcccgctcccagtcatccagcctccaccaacgagcctatcgtgctcgaggattag

SEQ ID NO: 19783 - DNA, 1761 bp, Artificial Sequence
  Description of Artificial Sequence: Synthetic coding sequence
atggccgccaacatgtaccgggtgggcgactacgtgtacttcgagaacagcagcagcaatccctatctgatcagaagaatagaggaactgaataaaactgcttccggaaatgttgaagctaaagtggtgtgcttttataggcgtagagatatctccaatacgctaattatgctcgccgataaacacgcgaaggagatcgaagaggaaagcgaaacgactgttgaagcggacctaacagacaaacagaagcaccagctgaagcaccgggaattgtttctctcaagacagtacgaatctctgccggctacgcacatcagggggaagtgtagcgtcgccttgcttaatgaaaccgagtccgtgcttagttatttggataaagaagacacgtttttttactcactggtctacgacccctctctgaagactttgctcgccgacaagggagagatacgggttggtccgcgctatcaggcagacatacctgaaatgcttttagaaggcgagagtgacgaacgcgagcagtcaaagctggaggtgaaggtttgggatcctaatagtccactcactgaccgtcagattgatcagtttctggtcgtggcccgcgcggtgggcaccttcgccagagcactggactgttctagctccgttagacaaccgtccctccatatgagcgcggcggctgcctcacgagatatcaccctatttcacgctatggacaccttgtatcgccactcttacgacttaagctccgccatctccgtgctggttcccctgggaggtccagtgttgtgtagagatgagatggaggagtggagcgcctctgaggcatctttgttcgaagaggctttggagaagtacggcaaggacttcaatgatatccggcaggacttcctgccatggaagagtttgacatctatcatcgagtattattatatgtggaagactaccgacaggtatgttcagcagaaacgcctaaaggccgccgaggccgagagtaaactcaagcaggtgtatatacccacttactcaaagccaaaccccaaccaaatcagcacgagcaacggaaaaccgggcgcagtgaacggcgccgtgggtactacattccagccccaaaacccgttactcggacgtgcgtgtgaatcctgctatgcaacccaatctcaccagtggtactcttggggtcccccaaatatgcagtgtaggctgtgcgcaatctgttggctgtactggaagaagtatggaggactgaagatgccaactcagagcgaagaggagaagctcagtccttcgcccacaacggaagatcccagagttagatcacatgtgtcacgccaggcgatgcaggggatgcctgtgcgcaacacgggctcccccaagtccgcagtcaagacaaggcaggccttttttctccatactacgtacttcacaaaattcgctaggcaagtctgcaagaacactctgcgcctccgtcaggcggctagacgcccctttgttgctatcaattacgcggccatccgggccgagtacgctgatagacacgcagaacttagcggcagccctctcaagtcgaaatctacaaggaagcccctggcttgtattattggctacctggagatacatcctgccaaaaagcccaacgttatcaggagcactccatccctgcagacaccaactactaaaagaatgctcactactccaaatcatacatctttaagtatcctgggtaaacgtaattactctcaccataatggcttagactag

SEQ ID NO: 19784 - DNA, 1785 bp, Artificial Sequence
  Description of Artificial Sequence: Synthetic coding sequence
atggccgccaacatgtaccgggtgggcgactacgtgtacttcgagaacagctcttccaatccctatctcatacgaagaattgaagagctgaacaaaactgcaagcggaaatgtggaagcaaaggttgtttgcttctaccgaaggagagatatttctaatacactcatcatgttggctgataagcacgccaaggaaatagaggaggaatccgaaacgacagtagaggctgatctgacagacaaacagaagcaccagcttaaacatcgggagttgttcctgtctaggcagtacgagtccctccccgccacccatattaggggcaaatgttcggtggcattattaaacgagactgagtcggtcctatcatacctcgacaaagaggataccttcttctactcacttgtgtatgatccatctttaaagactctcctggccgacaaaggggagatccgagtagggcctaggtatcaagctgatatacccgagatgcttctggagggcgaatccgacgaaagagagcaatctaaacttgaggtcaaagtgtgggatcccaactcgcccttgactgaccgccagattgaccagtttctggttgttgccagggccgtaggtacctttgctagagccctggattgcagctcaagcgtgaggcaaccctcactccatatgtcggccgccgccgcctctcgggatatcacactgttccacgccatggacaccctgtacagacactcatacgatctgtccagcgctatctccgtgttagtgcccctcgggggtcctgtattgtgtcgggatgagatggaagaatggtcggctagcgaggcaagcttgttcgaagaggccctagaaaagtatgggaaggattttaacgacattaggcaggacttcctcccatggaagagtctcacatccatcatcgaatactactatatgtggaagaccaccgaccgatacgtgcagcagaagagactgaaggccgctgaggccgaatccaagctcaagcaggtgtacattcctacttactcaaagcccaatcctaatcagatcagtacaagcaacggaaaaccgggagcagtgaacggtgcagtcggaaccacattccagcctcagaaccctctcctgggacgagcttgtgaatcttgttatgctacccagtctcaccagtggtacagttggggacctcccaatatgcagtgtcgattgtgcgctatctgttggttgtattggaaaaaatacggcggattgaagatgcccactcaaagtgaggaggagaaactgagcccatcaccgactacagaggacccgcgcgtgcgatcccatgtctccaggcaagcaatgcaaggtatgcctgtccggaataccgggtcacctaaatccgccgtgaagactagacaggcttttttcctccacaccacctactttacgaaatttgcgaggcaggtgtgtaagaataccctccgattgaggcaggctgctcggaggccctttgtggccatcaactacgccgcaatcagagccgaatatgctgacaggcacgcagagttgtccggctctccgctaaaatccaagagcacacgaaagccactagcatgtatcatcgggtacctggagatacatcccgctaaaaagccgaatgtcatccgaagtacacctagcttgcagacaccaaccacaaaaagaatgctcaccacacccaaccatacgtcactttctatcctgggaaagagaaactacagccaccacaacggcctggatgagctgacatgttgcgtgtcagattag

SEQ ID NO: 19785 - DNA, 1548 bp, Artificial Sequence
  Description of Artificial Sequence: Synthetic coding sequence
atggccgccaacatgtaccgggtgggcgactacgtgtacttcgagaactctagtagcaacccctacctgatccggcggatcgaggaactgaacaagactgcttcaggaaacgtggaagccaaggttgtgtgtttttacaggcgccgggacatttcaaataccctcatcatgctggccgataaacacgccaaagagattgaggaggaatcagagaccacagtggaagccgacctgactgacaaacagaagcatcagcttaagcacagagaactgttcctcagcaggcagtatgagtctttgcctgccacgcacattagggggaagtgctccgtagcactgctgaatgagacagaaagcgtgctgtcttacctggataaagaggataccttcttctactccctcgtctacgacccttctctgaagacattgctcgccgacaagggcgagatccgcgtgggtccacgataccaggcggacattccagagatgctgcttgaaggggaatccgacgaacgcgagcagtcaaagcttgaagttaaggtttgggatcccaactcacctttgacagaccgccagattgatcagttcttggtggtggcaagagccgtgggaacgttcgccagggcactggactgtagtagctctgtgagacaaccatccctccacatgagcgccgcagcggcctcacgcgatataaccctctttcacgcgatggacaccttgtatcgccattcttatgatctgtcgagcgccatctctgttcttgtgcccctaggcggacccgtactttgtagagacgagatggaagaatggagtgcctctgaagcatctctgtttgaggaggctctggaaaaatatggaaaggactttaatgatataagacaggatttcttgccctggaaaagtttgacctctatcatcgagtactactacatgtggaaaactactgacaggtacgtgcagcagaagcggttaaaggccgctgaggcagagagtaaactcaagcaagtgtacatacctacatactccaaaccgaaccctaaccagatctctactagtaatggaaagccgggggccgtgaacggcgcagttgggaccacatttcagcctcagaatcctctgcttggccgtgcatgtgagtcatgctatgccactcagagtcatcagtggtacagctgggggccccccaacatgcagtgtcgtctttgcgccatctgttggctgtactggaagaaatatggcgggcttaagatgccaacccagagcgaagaagaaaagctaagcccctcaccaaccaccgaagacccccgggtgcggtcccatgtcagtagacaggccatgcagggtatgccagttagaaatacaggctcacccaagtccgccgtcaagacccgacaggcattcttcctccatactacatactttactaaattcgctcggcaggtttgcaagaacaccctgagactgcgacaggccgctaggcgcccattcgtcgccataaattatgccgccatccgggctgagtgcaagatgttactgaattcatag

SEQ ID NO: 19786 - DNA, 585 bp, Artificial Sequence
  Description of Artificial Sequence: Synthetic coding sequence
atggccaagagcagccagcggaagcagcgggactgcgtgaaccagtgcaagtcaaaaccaggtttgtcgacttctattccgctgaggatgtcaagctacacatttaaaaggcccgttacaaggataacccctcaccccggcaacgaggtgagatatcaccagtgggaagaaagcctcgagaaacctcagcaggtgtgttggcagcgcaggttacagggtcttcaggcttactcatcagccggcgagttgtcatctacccttgatctcgcaaatacactgcagaagctggtgcctagttataccgggggctctctgcttgaagatctggcttcaggattggagcactcctgcccaatgccacacctggcatgttcatccgatgctgtagaaataattccagctgaaggtgtcggaatttctcagttgttgtgcaaacaatttctggtcacagaagaggatattcgaaagcaagagggaaaagtcaagacagtgcgggagcggctcgccatagcgttaatcgccgatggtcttgcaaatgaagctgagaaggtgagggaccaagaaggtagaccagagaaacgctag

SEQ ID NO: 19787 - DNA, 1245 bp, Artificial Sequence
  Description of Artificial Sequence: Synthetic coding sequence
atgctgggcgccctgcccctgcccctgagcctgggccagccccccccgtcccctctacttaatcattctctgttcggcgtcttgacggggggggggggacaaccaccaccagaacctctcctgccgcccccggggggaccggggccacctctcgccccaggggaacccgaaggcccttctctgctcgtggcctccctgctgccccccccaccctctgatcttcttccccctccttctgctccaccatctaacctgctcgcaagctttctgcctctgttggccctcggccccactgcgggcgacggagaaggtagtgcggagggggctggcggaccctctggggaacctttctctgggcttggagacctgtctccgctgctgtttccacccctgtccgctccacccaccctgatcgccttaaactcggccttactcgctgcaaccttagatccaccttccggaaccccaccacagccttgcgtgctgtcagcgccgcagccgggaccccccacttctagcgtcactacagccactacagatcccggtgccagctctctcggaaaagctcctagtaattccgggcggccaccacagctccttagcccattgctgggggcctccctcctgggtgacctaagttccctcacctcctctcccggggccctcccctctctgctgcagcctccaggcccactgctgagcgggcaactcggactccaattgctgcccggtgggggggctccccctcccttgtccgaggcctccagtcctctggcttgccttttacagtccctacagatcccacccgaacagcctgaggcaccatgcctgccaccagagtcccctgcgagtgctctggagcccgagccagctcgaccgcctctcagcgctctggccccaccccacggatctccagacccacctgtccctgaactactgacgggtcggggctccggtaagcgagggcggcgcggaggcggcggactcagaggaatcaatggggaagcccggccggcaaggggccgaaaacccggatccagaagagagccgggccgtctggccctcaaatggggaacacgaggcgggttcaacgggcagatggaacggcaggaagaacctactatcgggtctatcatggggtcttggctgaaaggcgtcctgtctccaagaattcacccactaccaggtcccattctgagaacactgcgctgtccttcatcgcagaaagtctccagctggccttag

SEQ ID NO: 19788 - DNA, 3012 bp, Artificial Sequence
  Description of Artificial Sequence: Synthetic coding sequence
atgaacggcggcaacgagagcagcggcgccgaccgggccggcggccccgtggctacaagcgttccgatcgggtggcaacgctgcgtgagagaaggcgccgtgctctacatcagcccatcaggaactgagctgagcagtctggagcaaacgcggtcatacttgctcagtgacggtacctgcaagtgcggactggaatgtccactgaacgttccgaaagtcttcaactttgaccccctcgcgcctgtcaccccaggaggggccggcgtcggtcccgcgtcagaggaggacatgactaaactgtgtaaccacaggagaaaggccgtggccatggccacactgtaccgcagtatggagacaacctgttcacactctagccccggcgagggtgcatccccacagatgtttcatactgtgagccccgggcccccgtcagcccgtcccccttgccgcgtgccacccacgaccccccttaatggcggaccaggaagcctccccccagaaccgccaagcgtgtctcaggcattcccgactctggcggggccaggcgggctatttccccctcgactggccgatccagtgccctctggaggatcaagcagcccgaggttcctgccgaggggtaacgcccctagtccagcccctcctccccctcctgcaatctcgctgaacgccccgagctacaattggggtgctgcgttacgcagctctctggtcccgtccgacctcggcagtcctccagccccacatgcgtcatcttcaccccctagcgatcctcctctgtttcattgtagcgatgccctgacacccccacccttgcctccatcaaacaacctgcctgctcaccccggccctgcttcccagcctcccgtgagtagtgccaccatgcatctgccccttgtgcttggaccattaggcggagctcctaccgtggagggccccggtgcacctcccttcttagcatcttcacttctgagtgcagcagcaaaagcacagcatccacctctgcctcccccgtcaactctgcaaggtcgtaggccacgcgctcaagccccatccgccagccactcctcttcattaaggcccagtcaacggaggcctcggagaccccctactgtgtttagattactggagggaagggggccacagacacctcgcaggagccggccaagggcccctgcccctgtgccccagcccttttcccttccggaaccatcacagccaattctgcccagcgttctgtccttactgggacttcccacacccgggcccagccattctgacggatcctttaatttactgggatccgacgcacacctgcctcctccacccaccttgagttcagggtcacccccccagcctcggcacccaatccagccctcattaccaggtactacctccggctctcttagctctgtgcccggtgctcccgccccacctgctgccagtaaggcacccgtggtgccttcaccggtgctgcagtctcccagtgagggacttggcatgggtgctggaccagcatgccctctcccccccctggcagggggcgaagctttcccttttccgagccccgagcaaggactcgccctgtcaggggccggattcccaggcatgctgggtgccctgccactgccactgagcttgggccaaccacctccaagcccgcttctgaatcactccctcttcggggtcctgacaggcggcggcggccagcctccaccagagcctttactgccccctccaggcggcccagggccacctctagcacccggcgagcctgaaggtccaagcttgctggtggccagtctgctacctccacccccatctgatctgctgcctcccccatctgcccccccctctaatctgctggcttcctttcttcccctgctggcattagggcccacagcgggcgacggcgaaggcagtgccgagggcgctggcggacctagcggggaacccttcagcggcttaggtgacctgtcaccactactgttcccgcccctttcagccccaccaactctgatagcacttaattcagcgctcctggctgcaactttggatccacccagtggcacccccccccagccctgcgtgctatccgctcctcagcctggtccgcccacgagcagcgtgacaactgccacgaccgatcccggcgccagcagccttggcaaggctccttctaatagtggtcgcccaccgcaactcctatcacctctacttggagcgtccttactcggagacctgagtagcctaacctcgtcacctggtgccctgccaagtctgttacagccccccggacccttactgagtggtcagttaggcttgcagctcctccctgggggcggagcaccccccccattgtctgaggctagttcccccctcgcttgtctgctccaaagcttgcagattccccccgagcagccagaggccccttgccttccacccgagagcccagcctccgcactggaacctgagcctgcaaggcctccgctgtccgcattagcgcctccgcacggcagtcctgacccgcccgtgccagagctgctgaccggccgtggctcagggaagcggggaaggaggggcggaggtgggctccgtgggattaacggcgaggcacgcccggcccgtggaaggaaaccagggtcacgacgcgaacccgggcggctggcccttaaatgggggaccagaggggggtttaacggtcaaatggagcgcagtcccagaagaacacaccattggcaacataacggagaactggcggagggaggggccgagccaaaagatccccccccccccgggccccactctgaagacctcaaggttccccctggcgtcgtcagaaaaagcaggaggggccggaggcggaagtacaatccaacaaggaattcaaactctagcaggcaggacataaccctagaacctagccctaccgcaagggcagcggtgccgctcccaccacgtgcgagaccaggtcggcccgctaagaacaaaaggaggaagctggctccatag

SEQ ID NO: 19789 - DNA, 3012 bp, Artificial Sequence
  Description of Artificial Sequence: Synthetic coding sequence
atgaacggcggcaacgagagcagcggcgccgaccgggccggcggcccagtcgccacgtccgtgcccattggctggcagaggtgtgtgagagaaggggccgtcttgtacatctcgccaagcgggactgaactcagtagcctggaacagacaagaagctacctgctgagcgatggaacctgcaagtgcggacttgagtgccccctgaacgtccctaaagtgttcaatttcgatcctttagcacctgtcactcctggaggcgccggcgtagggcccgcttccgaagaggatatgaccaagctgtgtaatcatcggcggaaggccgtcgctatggctactctgtaccggtccatggaaacgacctgcagtcattccagtccaggtgagggagccagcccgcaaatgtttcatacagtgtcccccggacccccttctgctaggcccccctgccgcgtgccacctacaacccctttgaacggtggacccggcagtctgccgcctgaacccccgagcgtctcccaggccttcccaaccctggccggccccggaggcctattccctcctagactggcagatccggtcccctccggcgggagcagttccccacgctttttgccccgcggtaatgcgccttctcccgcaccgccgcccccgcccgccattagcctgaacgcgcccagctacaactggggcgcggctctccggagctctctcgtcccaagcgatcttggtagcccccccgctccacatgcttcctcttcccctccatcagacccgcctctgttccactgcagtgatgcgctgaccccacctccgttaccacctagtaacaacttaccagctcaccccggcccagcttctcagcctccagtgtcctcagccactatgcatcttcccctggtccttggccccttgggtggtgcaccaactgtggaaggtcccggcgcgccaccatttctcgcttccagcctgcttagtgctgccgcaaaggcgcagcacccacctcttccccctcctagcacgctgcagggaagaagacctagagcacaggccccaagcgcaagtcactcaagttctctccgccctagtcagaggagacctagacggcctcctaccgtttttaggctgttggagggacgtggcccccagactcccaggagatcccgtccccgagctccagcacccgtcccccaacctttcagccttccagagcccagccaacctatacttccatcagtgctttcactgctgggcctgcccacacccggcccatctcatagtgatgggtcctttaatttgctgggctccgatgctcatctgcccccccccccaactctctcttcaggcagccccccccagcccagacatcctattcagccttcccttcctggtaccaccagtggttcactctctagtgtgcccggcgctccggcacctccagctgcctcaaaagcgcctgtagttcccagtcccgtattgcagtctccatcagaaggattgggtatgggcgcaggtcccgcgtgccccttacctcccctcgcgggaggggaggctttccctttcccaagccctgaacagggattggccctgtcaggagctggatttcccggcatgctgggggcactgcccctccctttgtccctcggtcagccccctcctagtcccctgcttaaccactcattattcggggtactgaccgggggaggcgggcagcctccaccagaacctttattgcctccgcccgggggacccggccctcccctcgctccaggcgaaccagagggaccctccctgctggttgcatctctccttcctccacccccgtctgaccttctgcctcctccgagtgcccctccttctaacctgctggcctccttcttgcctctcctggcattagggcctaccgccggtgacggcgagggctctgcggaaggtgcaggtggaccaagcggtgaacctttctccggactgggagatctgagcccgctactgttcccccccctttctgcccctcctaccctcatcgccctgaactcggcattgctggcagccactctcgacccccccagcgggacaccgcctcaaccctgcgttctgtcagccccacagcctggtcctcctacaagttccgtgacaactgccactactgacccgggtgcctcgagtctaggcaaggcccccagcaacagcggtaggccgccccaattgctcagtcctctgttaggcgccagtctcctgggcgacctgagttcactgaccagtagccccggagctctgcccagcctcctgcagccgccaggtccactgctttcagggcagctgggcttgcagctgttaccaggggggggagcacccccacccctgtctgaggcttcctccccacttgcctgtttactgcaaagtctgcagatccctcccgaacaaccagaagcaccatgccttcctcctgagagcccagcatctgctctcgagcccgaacctgcccgccctccactgtccgccctggcaccccctcacggaagcccggatcccccagtccccgaactcttaaccggacgggggagtggtaaaagagggcgtcgtggaggcggggggctgcggggtattaatggcgaagcccgcccggcacggggccgaaagccagggagcaggcgggagccaggacgccttgccctgaaatggggcactagaggaggcttcaatggacagatggaacgctctccccggcgtacccaccattggcaacacaacggcgagcttgccgaaggcggcgctgaacctaaagatccacccccgcccggacctcactccgaagatttaaaggtgccaccgggtgtcgtaagaaagagccggagagggcggaggcgaaaatataacccaaccaggaacagcaatagcagccgtcaggacataactcttgagccctcacctaccgcccgcgcggcggtacctctgcctcctagggcccgtccgggcagacctgcgaagaacaagaggcgaaaactggctccatag

SEQ ID NO: 19790 - DNA, 162 bp, Artificial Sequence
  Description of Artificial Sequence: Synthetic coding sequence
atgaacggcggcaacgagagcagcggcgccgaccgggccggcggccctgtggccacatctgtgccgatcggttggcagagatgtgttcgggaaggcgcagtgctgtacatctctcctagtggtaccgaactaagctccctagagcagacccggagttattag

SEQ ID NO: 19791 - DNA, 222 bp, Artificial Sequence
  Description of Artificial Sequence: Synthetic coding sequence
atgaacggcggcaacgagagcagcggcgccgaccgggccggcggccccgtggcaacaagcgttcccattggttggcaacgctgcgtgcgggagggagctgtgttgtacatttcaccatcgggcacggaactttcttcactggagcagactcggtcttaccttctgtccgatgggacatgcaagtgcgggcttgagtgcccactgaacgtgcctaaggtctag

SEQ ID NO: 19792 - DNA, 447 bp, Artificial Sequence
  Description of Artificial Sequence: Synthetic coding sequence
atgaacggcggcaacgagagcagcggcgccgaccgggccggcggcccagtggctactagcgttccaatcggctggcagaggtgcgtgcgcgaaggcgctgtgctgtacatatctcctagcggaactgaactctcttccctggagcagacgaggtcttatcttctcagcgatggcacatgtaagtgtgggctggagtgcccgctgaatgttcccaaggtgtttaacttcgatccacttgcgccagtgacacctgggggtgctggagtcggacccgcaagcgaagaggacatgacaaagctgtgcaatcaccggaggaaggcagtcgccatggccactctgtacaggtctatggagaccacatgctcgcatagcagcccgggggagggcgcctcaccacagatgttccatactgtgtcccccggccctccaagcgcaaggccgccctag

SEQ ID NO: 19793 - DNA, 162 bp, Artificial Sequence
  Description of Artificial Sequence: Synthetic coding sequence
atgaacggcggcaacgagagcagcggcgccgaccgggccggcggccctgtggcaacatccgtccccatcggctggcaacgatgtgtacgtgagggagccgttctgtacattagccccagcggcactgaacttagttcccttgagcagactcgctcatattag

SEQ ID NO: 19794 - DNA, 138 bp, Artificial Sequence
  Description of Artificial Sequence: Synthetic coding sequence
atgaacggcggcaacgagagcagcggcgccgaccgggccggcggcccagtggccaccagtgtccctataggctggcaacggtgcgtcagagaaggggctgtcctctacattagtccaagcggcacagaattgtcctag

SEQ ID NO: 19795 - DNA, 672 bp, Artificial Sequence
  Description of Artificial Sequence: Synthetic coding sequence
atgaccagcgaggtgatcgaggacgagaagcagttctacagcaaggcaaaaacatactggaaacagataccccctacagtagacggcatgctggggggctatggacacatctcctctatcgatattaacagctctaggaagttccttcagaggttcctgagagagggccctaataaaacaggcacaagttgcgccctcgactgcggggcaggcatcggacgaattacgaagcggctgctattgccactttttcgcgaggtggatatggttgacatcaccgaggacttcctcgtgcaggcaaaaacctatctcggtgaggagggaaaaagggtccgtaactacttttgttgcgggttgcaggatttcactccagagccagacagctacgatgttatttggatccagtgggtcatcgggcacttgacggaccagcacctcgctgagtttttacggagatgtaagggatctctgagaccaaacgggattatcgtgattaaagacaatatggcacaggaaggggtaattctagatgatgtggattccagtgtgtgccgggatctggacgtagtgcgtaggatcatctgttccgccggcttatcgctacttgcggaggaaagacaagaaaatctacccgatgagatataccacgtctacagcttcgccctgcgctag

SEQ ID NO: 19796 - DNA, 438 bp, Artificial Sequence
  Description of Artificial Sequence: Synthetic coding sequence
atgaccagcgaggtgatcgaggacgagaagcagttctacagcaaggccaaaacctattggaaacaaatccctccgactgtagacggcatgctgggtgggtatggacatataagctccattgatataaactcctcccgtaaatttcttcaacgattcttgagagaggggcctaataagacaggaacctcttgcgcactagattgcggcgccggaattggacgaatcactaagcgccttctgctcccattgtttagagaagtagacatggtggatatcaccgaggattttctcgtgcaggcaaagacatacctgggcgaggagggtaaaagagccacaagccctatttccacctggcccagttcatgcggggctgcccgtgccgcatccgcgcctacggcctcatcatctagtaagacgacatggccgagacgagcttag

SEQ ID NO: 19797 - DNA, 672 bp, Artificial Sequence
  Description of Artificial Sequence: Synthetic coding sequence
atgaccagcgaggtgatcgaggacgagaagcagttctacagcaaggcaaagacttactggaaacagatcccacctaccgtagacggcatgctcggcgggtatggccatatctcctcaatcgacatcaattccagtagaaaatttctgcaacgttttctcagggagggtccaaacaaaaccggcacttcttgcgctctagattgcggggcgggcatcgggagaattaccaaaaggctgctcctaccattgtttagggaagttgatatggtagacattaccgaggacttccttgtgcaggcgaaaacctatctgggagaggaggggaaacgtgtccgcaactatttctgctgtggactccaggatttcactccagagcccgactcttacgacgtcatctggatccagtgggtaatcgggcacctcactgatcagcaccttgccgaatttttacggagatgtaagggctccctccgaccaaatgggatcattgtgatcaaagacaatatggcccaagaaggagtcatcctcgacgacgtggactcctcggtgtgtcgcgacttagacgtcgtgagacggatcatatgttcagccggtctgagcctgttggccgaggaacgacaggaaaacctcccagatgaaatataccacgtttacagcttcgcccttcgctag

SEQ ID NO: 19798 - DNA, 672 bp, Artificial Sequence
  Description of Artificial Sequence: Synthetic coding sequence
atgaccagcgaggtgatcgaggacgagaagcagttctacagcaaggccaagacctattggaaacagatcccacccaccgtggatggtatgctcgggggttacgggcacatctcgtccattgacattaacagttctcggaagttcctgcagcggtttctccgtgaaggtcccaataaaactggcaccagttgtgcgctcgactgcggtgccggaatcggccggatcaccaaaaggcttcttcttccgctttttagagaggtcgacatggtggacatcactgaagactttctggtgcaggccaagacatatttaggggaggagggcaagcgcgttcgtaattacttctgttgtggtctgcaagatttcacaccagagcctgattcttatgatgttatctggatccagtgggtgatcggacatttgaccgatcagcacctcgcagaatttctccggaggtgtaaaggcagcttacggcccaatggtattatcgtgattaaagacaatatggcgcaggagggcgtgatattagatgacgttgattcgtctgtctgccgggacctggatgtggttcgcagaatcatttgtagtgccggactatcattgctggctgaagaaagacaggagaacctgccagatgagatctatcatgtgtactcctttgctctgaggtag

SEQ ID NO: 19799 - DNA, 1371 bp, Artificial Sequence
  Description of Artificial Sequence: Synthetic coding sequence
atggacagccggctgcaggagatccgggagcggcagaagctgcggagacagctccttgctcagcagttaggtgcagaaagcgccgattcgatcggagcagtactgaatagcaaggacgaacagcgcgagattgcagagactagagagacctgtagagcaagttatgacactagtgcacccaatgctaagcgtaaatatttggatgagggggaaactgacgaagataaaatggaggagtataaggacgagctcgaaatgcaacaggacgaagaaaacttgccttacgaggaagaaatttataaggactctagcacatttctgaaggggacccagtcccttaatcctcacaacgactactgccaacacttcgtcgatacaggccaccggccgcaaaattttatccgcgatgtcggattggcagatcgttttgaggaatacccaaagctcagggagctcatcaggcttaaagacgaactgattgccaaatcaaataccccacctatgtatttacaggctgatattgaagccttcgacatcagagaacttaccccgaagtttgatgtaatacttctggagccacccttggaggaatattatagagagacaggtataaccgctaatgagaagtgctggacttgggatgacatcatgaaactagaaattgacgagatcgctgctccacgctcatttatctttctttggtgtggctccggggagggcttggacctggggagagtgtgtctgaggaaatggggctaccgacgctgtgaggacatctgttggattaaaaccaataagaacaatcccggaaaaacaaaaactctggaccccaaggcagtgttccagcggaccaaggaacactgtctgatgggtatcaagggtaccgtgaaacgttctacggacggcgattttatccacgccaatgtggacatcgatctcatcatcaccgaggagccagagatcgggaacattgagaagccagtagaaattttccacatcatcgaacacttctgcctcggcagaaggcgccttcacctgtttggccgtgattccaccatcagaccagggtggcttactgtggggcccacccttacaaattccaattataacgccgagacttatgccagctatttcagtgccccaaattcatatctgactggatgcacagaggaaatcgaaagacttagaccaaagtcaccaccacccaagagcaagtcagaccggggcgggggagctccacgaggaggcggacgtggtggtacgtctgcgggacggggtcgcgagaggaataggtcaaacttccggggcgagagaggcggatttcgggggggacgggggggggcacatagaggtggctttcctcctcgatag

SEQ ID NO: 19800 - DNA, 3399 bp, Artificial Sequence
  Description of Artificial Sequence: Synthetic coding sequence
atgatcgccacccccctgaagcacagccggatctacctgccccccgaggcatcctcacagcgccgcaatctacctatggatgcaatcttcttcgattccataccatctggtacattaactcccgtgaaagacctggtgaagtatcagaattcgtcactgaagctgaatgaccacaagaagaaccagttcttgaaaatgacaacttttaacaacaagaatatcttccaaagcacaatgctgacagaagcgaccacatcaaactcaagtctcgatataagcgcgataaaaccgaacaaagatgggttaaagaacaaagctaactacgaaagcccaggcaagatttttttgcgcatgaaggagaaggtactgagagataaacaagagcagccatcccggaattcttcattgctggaaccccaaaagtctggcaataatgagacatttacaccaaatcgagtggaaaagaagaaactacagcacacctacctatgcgaggaaaaagagaacaataagtcttttcaatctgacgactcatcactgagggcttctgttcagggcgttccactggaaagcagcaataatgatatctttctgcccgtcaagcagaaaatccagtgccagcaggagaagaaggctccactccacaaccttacttacgaattgcctacacttaaccaggagcaggaaaatttcctcgccgtcgaggctagaaacaaaacactgacacgcgctcagctcgcaaagcagatcttccattccaaggagtccattgtagcaacaacaaagtctaaaaaagacaccttcgttttagaaagcgtcgactctgccgacgaacagtttcaaaataccaacgcggaaactctgagcactaactgcatccccattaagaatggttcactgttgatggtgagcgatagtgagcggactacagagggtacttctcagcagaaagtaaaggaaggcaacggcaaaacggtacctggcgaaacagggctgcctggcagcatgaaagatacctgtaagattgtcctggccactccaaggcttcacattactatcccacgccgtagtaagcgcaatatctccaaactcagccctccgcgcattttccagaccgtgactaacggcctgaaaaaaaaccaagtggtgcagctacaggaatggatgattaaatcaattaacaacaacaccgccatctgcgtggaaggaaaactcatcgacgtgacaaatatctattggcacagcaatgtcatcatcgagcgcatcgagcataacaagctgcgcactatctcgggcaacgtttacatactgaaggggatgatcgaccagatctctatgaaggaggccggttaccccaattatcttatccggaagttcatgttcggttttcccgaaaactggaaggagcacatcgacaacttcctagagcaacttcgagctggagagaagaatcgcgagaaaaccaaacagaaacaaaaaaccgggaggtctgtgcgtgacatcagaaagtcaatgaaaaatgacgcaagggagaatcagacagatacagcccagcgagccaccaccacctatgacttcgactgcgataacctcgagctcaagtcaaacaagcactccgaatctcccggggccacggagctcaacatgtgccacagcaattgccaaaacaagcctacactgcgctttcccgacgatcaggtcaacaacacaatccagaatggcgggggcgacgacttgtctaaccaggagctcattgggaagaaggaatacaagatgtcctccaaaaagctgaaaattggcgagagaacaaacgagcgtatcatcaaatctcagaaacaggaaaccacagaagaactcgacgtgagtatcgatatcctgacttcacgtgagcagttcttctccgacgaggaaaggaaatatatggctataaatcaaaagaaggcatatattttagtgaccccactgaagagccgaaaggtcatcgagcaaaggtgcatgagatacaacctcagcgccgggacaataaaggccgtgacagactttgtaatacccgagtgtcagaaaaagtcaccaatcagcaagtcaatggggactctggagaacacatttgaaggccataagagcaagaacaaggaagattgcgatgagcgggatctccttacggttaatcggaaaatcaaaatatcaaaccttgaaaaagagcagatgctgacatccgattttaagaagaataccagactcctgcctaaattgaaaaagattgagaaccaggtcgctatgtcattctataaacaccaatcgagtcctgacctatctagcgaggaatccgaaaccgagaaagaaattaagcgaaaagccgaagtgaaaaaaacgaaggccggcaacaccaaggaggcagtggtccacctgcgcaaatcaacaaggaatacaagcaatatccccgtgattctggaacccgagacagaggaaagtgagaatgagttctacattaagcagaaaaaggcaaggccctccgtgaaggagacactgcagaaaagcggcgttagaaaggagtttcccattacggaagcagttggcagtgacaagaccaatcgccatcctctggagtgtctgccaggtctcattcaggacaaggaatggaacgagaaagagttgcaaaaactgcactgcgctttcgcttcccttccgaaacacaaaccagggttttggtccgaagtggcggcagctgttgggagcaggtcccccgaggaatgccaacgcaagtatatggaaaacccccgaggaaaaggaagccaaaagcacgtgactaaaaaaaagcccgccaactctaagggccagaatgggaagaggggtgacgcggaccagaagcagacgattaagattacagcgaaggtgggaactctaaagcggaagcagcaaatgcgagaattcctggaacagctgccaaaagacgatcacgacgatttcttttctactactcctttgcagcaccaacgaatactgcttccatccttccaggacagcgaagacgatgacgatatcctccctaacatggacaagaaccccaccaccccctccagcgtgattttccctctggtcaagactccccagtgtcagcacgtatctcccggcatgctcggttccatcaatcggaacgattgcgataaatatgtgtttcggatgcagaagtatcacaagtcaaatggtggaatcgtgtggggaaacatcaagaagaagctggttgagaccgacttcagcactcccactccacgacggaagacaccctttaacaccgacctgggcgaaaactccggaattggcaagctatttacgaacgcggtggagtcactcgatgaggaagagaaggattattatttcagtaacagcgacagtgcctag

SEQ ID NO: 19801 - DNA, 468 bp, Artificial Sequence
  Description of Artificial Sequence: Synthetic coding sequence
atgatcgccacccccctgaagcacagccggatctacctgccccccgaagcatccagtcagcgcaggaatcttcctatggatgccattttctttgactccattccatcgggtacacttactcctgtgaaggacctcgtaaagtatcagaattccagtctgaagctcaacgatcataagaagaaccagtttctcaagatgaccactttcaacaataagaacattttccaatcaactatgttgactgaggcaacaacaagcaatagttctttggacatctccgcgataaaacctaacaaagacggcctgaaaaacaaagccaactacgagtcaccagggaagatctttctcaggatgaaggagaaagttctgcgggataagcaggagcagccatcacgaaattctagcctgctggaacctcagaaatccgggaacaacgagacattcactcctaaccgcgtagaaaagtag

SEQ ID NO: 19802 - DNA, 702 bp, Artificial Sequence
  Description of Artificial Sequence: Synthetic coding sequence
atggccggcgtgcggagcctgcggtgcagccggggctgcgccggcgggtgcgagtgcggcgataaggggaagtgtagcgattcttcattactggggaagcgcctgtctgaggacagctctcggcaccagctgctgcaaaagtgggcctccatgtggagttccatgtctgaggatgcctcagtggccgacatggaacgggcccagttggaagaggaagccgcagcagccgaggaacgtccactggttttcctctgcagcgggtgtagaagaccactcggtgactctctctcctgggtcgctagtcaggaggatactaactgcatactgttgcgttgcgtctcttgcaatgtgtccgtcgacaaggaacaaaaactcagcaagcgggagaaagaaaatggatgtgttcttgaaacactctgttgcgcagggtgcagcttgaacttgggatacgtataccgctgcaccccgaagaacctcgattacaaacgcgatctattttgcttgtccgtggaggcgatcgaaagctatgtactcggatcttccgaaaagcagatcgtgagtgaagacaaagagctctttaacctagagtctcgggtggaaatcgaaaaatctctgacacagatggaagacgtgctcaaagccttacagatgaagctgtgggaagccgagtccaaactcagcttcgccacctgtaagagttag

SEQ ID NO: 19803 - DNA, 3150 bp, Artificial Sequence
  Description of Artificial Sequence: Synthetic coding sequence
atggaccacaccggcgccatcgacaccgaggacgaggtgggccccctggctcacttagccccatctccccagagtgaggccgtcgctcatgagttccaggagctgtccctgcagagttctcagaacctgcctcctcttaatgagaggaagaatgtgctacaactcaggctgcagcagcgccggactcgggagcaactcgtggatcaagggataatgccacctctcaagagtcccgccgcatttcatgaacagattaagagcctcgaacgagccagaaccgaaaacttccttaagcataagatacgctcacgccctgacagatcagagctcgtgcgcatgcatattctagaggagacattcgcggagccatcgctacaggctacgcagatgaagttgaagcgcgcacgcctcgccgatgatctcaacgagaaaatcgctcagcgacccggcccaatggaactggtggaaaagaacatcttgcccgttgactcttcagtcaaggaggcaataattggcgtgggcaaggaagactatccccacacccagggggattttagttttgacgaagactcatccgacgcattgagccccgatcagcctgcctctcaggagtcacaaggatccgccgcctcacctagcgaacccaaagttagcgagtcaccaagtccagttaccactaatacccccgcacagttcgctagcgtgtcacccacggtgccagaatttctcaagacacctccgacagccgatcagcctcctcccaggcccgctgcccctgtcctgcccaccaacaccgtgtcttccgctaagcctgggcccgctctcgtcaagcaatcgcatcctaagaacccaaacgataagcaccggtccaagaagtgtaaggatcctaagccacgcgtgaaaaaactcaaataccaccagtatattccacccgaccagaagggtgagaaaaacgagccacagatggactcaaattacgcgagattattgcaacagcagcagttgtttctccagctccaaattttatctcagcagaaacagcactacaattaccagactatcctgcccgcaccttttaagccgctaaacgacaaaaactctaatagtggcaactcagcactgaataacgctacacctaatacacctagacagaatacaagcacaccagtgaggaagcccgggccgctcccaagttccctcgacgatctgaaggtgagcgagctgaaaaccgaacttaaactgaggggattgcctgtcagtgggacaaaaccggatctcatagaacgcctgaagccgtaccaagaagttaactctagtggcctggcggcgggcggtatagtcgctgtttcaagttctgctatcgtcactagtaaccccgaagtgactgtggcccttcctgttacaacactgcataacactgttacctctagcgtgtctacactgaaggctgagctgcctcccacaggaacatctaatgcaacgagagtggagaacgttcactccccgttacctatctcacccagcccctctgaacagtcatccctctctacagatgatactaacatggctgacacatttacagagataatgactatgatgtctccaagccagtttctctctagttcgccattgagaatgactaataacgaggacagtctgtctcctacctccagcactctcagtaacctcgaactggacgctgccgagaaagaccgcaagctgcaggaaaaagagaaacagattgaagaactgaagcggaaactggagcaggagcagaagctggtggaagtgcttaagatgcagctggaggttgagaaaagaggacagcaacagcgcccgttagaagctcagcccagcgcccctggccattctgttaagtctgaccagaagcacgggtctctaggttcttccatcaaagatgaagccagtttgccagattgttccagttctcggcagcccatcccagtggcctctcacgcagtggggcaacccgtttctacaggaggccaaaccttggttgctaagaaagcggtggtgatcaaacaagaagtgcctgtaggacaggcagaacagcaatccgtggtgtcccaattctatacaagcccccaggcagggatgcaaacgcagccacagattgcaaccgccgctcagatcccaacagcggctctggcgtcaggtctggctccaaccgtgccacagacccaggacacctttccccagcacgtgctcagtcagccacagcaggttcgaaaagtttttaccaatagcgcctcgtccaacacagtgttgccataccaaaggcaccccgcacccgccgtgcagcagcccttcatcaataaggcgtccaattcagtcttacagagccggaatgccccgctcccatcacttcaaaacgggcccaacacaccaaataagccgagcagccctccaccaccccagcagttcgtggtacagcacagtctgttcggaagtccggttgctaaaacgaaggaccctcccaggtacgaagaggctatcaaacagactcggagcacacaggctcccctcccagaaatcagtaacgctcatagtcagcagatggatgacttgtttgacatcttgattaagtccggcgagatatctctccccataaaagaggagccatcccccatctccaagatgagacccgtgaccgcttctattacgacaatgcccgtgaataccgtcgtaagccgcccaccacctcaagtacagatggccccaccagtgagcttggagccaatgggaagccttagtgcatctctcgagaaccagctcgaggcattccttgacggcaccctgccctcagctaatgaaattccaccattgcagagctcctccgaggatagagaacccttttccctgatcgaggacctccagaacgatttactgtcacacagtggaatgctcgatcacagccacagccccatggagacaagtgagacacagttcgccgccggaacaccatgcctttccctcgacctgagtgattccaacttggataatatggagtggttagatatcactatgccaaattctagctctggcctgaccccactgtctactactgcgccttctatgttctccgccgatttcctggacccgcaggaccttccacttccctgggattag

SEQ ID NO: 19804 - DNA, 3267 bp, Artificial Sequence
  Description of Artificial Sequence: Synthetic coding sequence
atgatcgacagcagcaagaagcagcagcagggcttccccgagatcctgactgcgggagacttcgagccgctcaaagagaaggaatgcctggagggcagcaaccagaaatcgctgaaggaggtgcttcagctgcgcctacagcaaaggcggactagagaacagctggtagatcagggaatcatgccaccactgaagagcccagccgcgtttcacgaacagattaaaagcttagagcgggctcggactgaaaactttctgaagcacaaaattcgctctcgcccagatcgcagcgagctcgtgagaatgcacattctcgaagaaacctttgccgaaccctctctgcaagcaacacagatgaagttgaaacgggcccggttagccgacgatctcaacgaaaaaattgcgcagagacctgggccgatggaactggttgaaaagaacatcctacccgttgattcaagcgtcaaggaagcgattataggcgtaggaaaggaggactatccccacacacaaggggacttttcctttgacgaagactcctcagatgccctaagcccagaccagccagcttcacaagagagccaggggagcgccgcaagcccctccgagccgaaagtttctgaatcaccctcacccgtgactaccaacactcccgctcaattcgccagcgtgtcccctacggtgcccgaattcctgaaaactccacccacagctgatcagcctccccctaggcccgcagcacctgttcttccaactaatacagttagtagtgctaagccaggaccagctttggtgaagcagtcacatcctaaaaaccctaatgacaagcatcgctccaaaaaatgtaaggacccgaaacctagggtgaagaaactcaaataccaccagtacatccctcctgaccagaagggggagaagaatgaaccccagatggactccaactacgcccgcctgctacagcaacagcagcttttcctccagttgcaaattctatcacaacaaaagcaacactataactaccagacaatcctgccggccccctttaaacccttaaatgataaaaacagtaattccggtaacagtgctctgaataatgcaacaccgaacacacctcgacagaacacctctacgcctgtcaggaaacctggacctctcccaagctcactggatgacctcaaggtgtctgaactcaagactgagttaaaacttcgcgggctgcctgtgagcggaacaaagcccgacttaatagaacgtctgaagccgtaccaggaggtgaactcaagcggcctagccgctggaggcatcgtggccgtgagcagcagtgctatcgtgacttccaatccagaggtaactgtcgcccttcccgtcaccacactccacaacaccgtgacctccagtgttagcacactaaaggccgagctgcctcctaccggcacctctaatgccaccagggtcgagaacgtgcactcgcccttacctataagcccgtcccctagcgagcagtcttccctctcaaccgatgatactaacatggctgacacttttaccgaaattatgacaatgatgtcaccatctcagttcctgagttcatccccgctgcgaatgaccaacaatgaggactccctgagccccacatcttctacactgtcaaatttagaattagacgccgccgagaaagatagaaaacttcaggaaaaggaaaagcagatagaagagttaaaaaggaagctggaacaggaacaaaagctggttgaagtgcttaagatgcaacttgaagtcgagaagcgggggcaacagcagcggcccctggaagcccaaccttccgcgcctgggcactccgttaagtctgatcagaagcatggtagtctggggtctagtatcaaagacgaggctagcctgcccgactgctcatcctcccgccaaccaattcctgtggcatctcatgccgtgggtcaacccgtttccactggtggccaaacgcttgtcgcaaagaaggcggtggtgattaaacaggaagtccctgtagggcaggctgagcagcagagtgttgtgtctcagttctatgtgagctcgcagggccaacctcctcctgccgtggttgcacagccgcaagcactgttgaccacacagacagctcagttactgctgcccgtgagtatccagggatctagtgtgaccagcgttcagctgcccgtgggtagtctcaaactacagacatcacctcaggcaggaatgcagacccaaccacagatcgccactgccgctcagatcccaacagcagcccttgccagtggtctggcgcccacagttcctcagacccaagataccttcccacagcatgtgctgtcccagccacagcaagtccggaaagtgttcacgaacagtgcatcgagcaatacagtgctgccttatcaacgacacccagcccctgcagtgcagcagcccttcattaacaaggcttcgaattcagttctacagtcacgcaatgccccacttcctagtcttcagaatggtccaaatactcccaataaaccaagttcgcctccacctccccagcagttcgtggtgcagcatagcctgttcggcagccccgttgccaagacgaaggatccgccgaggtacgaagaagctatcaaacagactagatcgacacaagcacctctgcccgagattagtaacgcacacagccagcagatggacgacctgttcgatattctgatcaaaagtggagagatcagcctgcccatcaaggaggagccaagtcccatatccaaaatgcggcctgtcaccgcttctatcacaacaatgcctgtgaatacggtggtgagtcgccctcctccccaagtgcaaatggccccgcctgtgagcctcgaaccgatgggaagtctctctgctagcctcgaaaatcagttagaggcgttcctcgatggcaccctccctagcgcgaacgaaatccccccactccagtcatcgtcagaagatcgagagcccttcagcctaatcgaggacctgcagaatgatttgttgtcacacagcggcatgttggaccattcccatagccccatggaaacgtccgagacacagttcgcagcaggcacaccctgcctgtctctggacctgtccgattctaatctggataatatggagtggctggatataacaatgccgaactccagctccggactcaccccgctgtccacaaccgcccctagtatgttttccgctgacttcctggatccacaagatcttcccctcccttgggattag

SEQ ID NO: 19805 - DNA, 1383 bp, Artificial Sequence
  Description of Artificial Sequence: Synthetic coding sequence
atgatcgacagcagcaagaagcagcagcagggcttccccgagatcttaacagccggagacttcgagccactgaaggagaaagagtgtctggagggctctaaccagaaatctcttaaagaagtgctccagttgagattgcagcagcggcggacccgagagcagctggttgaccagggtatcatgccgcccctcaaatccccagccgccttccatgaacagattaagtccttggagagagccagaaccgaaaacttccttaagcataaaatccgctcccgccctgatagatcagaactagttcggatgcacattttagaggagacttttgctgagccaagtctacaggccacccaaatgaagctgaaaagggctcggctggccgacgatcttaatgagaaaatcgcacagcgtcccggtccaatggagctcgtggagaaaaatattttacccgtcgactcttcagtgaaagaagctatcattggagtcggcaaggaagactatccgcacacccaaggggacttcagcttcgacgaagactcaagtgacgcactgagtcccgatcagcccgcttcacaggaatctcagggctccgccgcctcgccctccgaacccaaggtttcagaaagtcctagtccagtgacaacaaacacacccgcccagtttgcatctgtgagccctacagtacccgagtttttaaaaaccccacccaccgctgaccagccaccaccaaggcccgcagcacccgttctcccaacaaacaccgtttcctctgcaaagcccgggccagctcttgtgaagcagagccacccgaaaaacccaaacgataagcatcggtccaagaaatgcaaagatcccaagccaagagtcaagaagctgaagtaccaccagtatattccacccgatcagaagggtgagaagaacgagccccagatggatagcaattatgctcggctgctgcagcagcagcagctctttctgcagcttcagattctgtcccaacagaagcagcactacaattaccagacaatcttacctgcgccctttaagtacggcggagctcacgccatcctgaatgctggcttcagcgtctttatgaggaactacaagttacctaaggtggagtgctgtcatcttttcgtgctttccaatgactttcacttctttgtaatccgagcctaccacacagtaagtgaagtgcacatggtgcgcgtcgcctgcattccgtttcagttcttgtcttcaaagattggttctgagttcttgcaggtcagaaacgcattcagtcaactattcattcagatatgcctcctgttagaacaccagaattccacacgatgttcggagaaatccgtatccagtatcattcccggaataaattcatag

SEQ ID NO: 19806 - DNA, 3732 bp, Artificial Sequence
  Description of Artificial Sequence: Synthetic coding sequence
atggagaactgcagcgccgccagcaccttcctgaccgacagcctggaactggaactggggaccgagtggtgtaagcctccctatttcagctgcgccgtggataaccggggcggagggaagcatttctctggcgagtcctacctgtgctctggtgctctgaagagacttatcctgaatttggacccgctgcccaccaacttcgaagaagacaccctggagatttttgggattcagtgggtcaccgaaactgcacttgttaattcctcccgtgagctatttcatctgttcagacaacagttatacaacctggagacattgctacagagctcatgtgattttggaaaggtgagcacgcttcattgcaaggcagataatattcggcaacagtgcgtcctctttctgcactatgtcaaggtttttatttttcggtatctgaaagtgcagaacgcagaatcccatgtgccggtgcacccgtacgaggccctggaggcccagctaccatctgttctgatcgatgagctccacggtttgctgctttatatcggccacctgtcggagctcccctcagtgaacattggagccttcgtaaaccagaaccagataaaactgttcccccccagctggcacctgttgcatctgcacctagatattcattggctggtactagaaatcctctatatgctcggagagaaacttaagcaggttgtctatgggcaccaatttatgaacttggccagtgataacctgaccaacattagtttgttcgaagagcattgtgagactctcctgtgcgaccttatctccctgtccctgaatcgatacgataaggtgcgctcctctgagagtctgatgtctgaccagtgtccttgtctatgcataaaggagctgtgggtcttgctgatccacctgctggatcaccggagcaagtggtttgttagcgagtccttttggaactggctcaacaagttgttgaaaactctgctggagaaatcatccgataggcgccgttcatctatgcctgtgattcagagcagagaccccctggggttctcttggtggatcattactcatgtggcttcattttacaaatttgaccgccacggtgtgcctgacgagatgcgtaaggtggagtctaactggaactttgtcgaggaacttctcaagaaaagcatctccgtccaaggagttattctggaggagcaacttcggatgtacctgcactgttgccttacgttatgcgatttctgggagcccaacatcgccattgtgacaattctctgggagtactattccaagaatttgaacagctctttcagcatctcctggctcccgttcaaagggttggctaataccatgaagtcgcctttgtccatgctggaaatggtcaaaacttgctgttgtgataaacaagatcaggaactgtacaaatctagcagttcctacacaattttcctgtgcattctagccaaagtggttaagaaagcgatgaagtccaacgggccacatccctggaaacaggtgaaaggtaggatttacagtaaattccaccaaaagagaatggaggagctgacagaagtgggcctccagaattttttctcactgtttctgctattggccgcggtagcagaggttgaggatgtcgcctcacacgtgctcgacctcttgaactttctgaagcccgcattcgtcacatcacagcgggcccttatttggaaggggcatatggcattcctgctgatgtacgcacagaaaaacttggatataggagtcctcgccgaaaagtttagctgcgcctttagggagaaagccaaagagttcttggtgtcaaagaatgaggagatggtgcaaagacaaaccatatggacattgctatcaatctacatcgacggagtgcaagaagtgtttgagacgtcctactgtctctacccatctcacgaaaagcttctcaatgatggattttcaatgctacttagagcctgcagagaaagcgagctgaggaccgtgctgagtttccttcaggccgtcctcgctcgcattcgatcgatgcatcagcaactgtgtcaggaactccagcgagacaacgtcgatctgttcgtgcagtcctcactatccgcaaaagagaggcacctggcggcggtggcatcagccttatggcgacacttctttagcttcctcaagagccaacgcatgtctcaggttgtcccttttagccagctcgcagatgctgccgccgactttacactgctggctatggacatgccatctacagcacctagcgactttcagccacagcctgttatcagcattatacagctgttcggctgggacgacataatctgtccgcaggtcgttgcccgctatctgtcacacgtattgcagaattccaccctctgtgaagccctgtcccatagcggttacgtgagtttccaggcactcacggtgaggtcgtggataaggtgtgtcctacagatgtatatcaagaatttgtccggccccgacgatctcctgatagacaaaaatctcgaagaggccgtcgagaaggagtacatgaaacagcttgtgaagttgactcgcctgttgtttaacctcagtgaggtgaaatcgatcttctccaaggcgcaggtagagtatctttcaatttccgaggatcccaagaaagctttagtgagattctttgaggcagtgggcgtcacatacggtaacgtgcaaacactgagcgataaatctgccatggttaccaaatcgctggagtacctcggggaggtgttaaagtatattaaaccatacctgggcaaaaaggtcttctcagctggcctgcagctgacttacgggatgatggggatcttagttaagagctgggcccagatctttgctacctcaaaagcccagaaactgctttttcgcataatcgactgtctgctgctaccgcacgccgtgctccagcaggaaaaggaactgcctgcgcccatgctctctgcaatccagaaatcattacctctgtatttgcagggaatgtgtatcgtttgctgtcaaagtcagaacccaaacgcctacctgaaccagttattgggaaacgttattgaacaatacataggtcgtttcctgcctgcttccccctatgtgtctgatctgggccagcaccctgtcctcttagccttgagaaatactgccactatcccgcccatatcaagtctaaagaaatgcatagtgcaggtgatcaggaaaagttacctggagtacaaaggctcgagcccccctcctcgactggcatctatcttggcttttattttacaactattcaaagagactaacaccgacatctatgaagttgaactcctcctgccaggtatattaaagtgcctggtcctggtaagcgagccccaagtgaagcgattagcaactgagaacctccagtatatggtaaaagcatgccaggtcggctcagaggaagagcccagttctcagctgaccagcgtctttcgccaatttatacaggattatggcatgaggtactattatcaggtgtactcaatccttgaaacggttgctactctggaccagcaagtcgtaatccatctgattagcactttaactcagtctcttaaggatagcgagcagaagtggggcttgggtcggaatatcgctcagcgcgaggcttattccaaattgctttctcaccttggtcagatggggcaggacgagatgcaaagactagaaaatgacaacacttag

SEQ ID NO: 19807 - DNA, 867 bp, Artificial Sequence
  Description of Artificial Sequence: Synthetic coding sequence
atgagcagccggaagcagggcagccagccccggggccagcagagcgctgaggaggaaaactttaaaaaacccactcggagcaacatgcaacgttccaaaatgcggggtgctagcagcggtaagaaaacagccggcccccagcagaaaaacctagaacccgctctacccggtcggtggggcggtcgaagtgctgagaacccaccctcgggatccgtgagaaaaacccgcaagaacaaacagaagacccccggtaatggtgatggagggtccacctctgaagcaccccagccgcctcgcaagaaaagagctcgcgcagacccgactgtggagtctgaagaggcctttaagaatcgcatggaggtgaaggtgaagataccagaagagctgaagccctggctggtggaagattgggacctggtcacacggcagaaacagctgtttcagctgcctgccaagaagaatgtagatgccatcttggaagagtacgctaactgcaagaagagccagggcaacgtggataacaaagagtatgcagtgaacgaggtcgtggcagggattaaagagtattttaatgtgatgctcggcactcaacttctctataagttcgagagaccacagtacgcggaaatactcctcgcacatcctgatgcccccatgagccaggtctacggagccccgcacctgctgaggttgttcgtacggatcggcgctatgttagcctacacccccctcgatgagaagtccctagccctccttttaggctacctgcatgactttctgaaatatctggccaagaattctgcaagcctgttcactgcctccgattataaagtcgcctccgccgagtaccaccggaaggcactgtag

SEQ ID NO: 19808 - DNA, 813 bp, Artificial Sequence
  Description of Artificial Sequence: Synthetic coding sequence
atgagcagccggaagcagggcagccagccccggggccagcagagcgcagaagaggagaactttaaaaagccaacacgctccaatatgcagaagaatctggagcccgcactccccgggcggtggggtggtcggtccgcagagaacccccccagcggcagtgtgcgcaagactcgcaaaaataagcagaagaccccaggaaatggcgacggggggtcaacgtccgaagctcctcagccgccccgcaaaaagagagcccgagccgatcccaccgttgaaagtgaggaagcatttaagaaccgcatggaagtaaaggtgaagattcccgaagagctcaaaccttggctagtcgaagattgggacctggtgactagacagaagcagctgttccaactgcccgccaagaaaaatgtggatgcaatactagaggagtacgctaattgcaagaagtcccaggggaatgttgacaacaaggagtacgccgttaatgaagtcgtggcaggtatcaaggagtatttcaatgttatgctaggtacccagctcctctataaattcgagagaccccagtatgcggagatcctgctggcgcatccagatgctcctatgagccaggtgtatggcgcccctcacctcctgagactgttcgtgaggatcggggctatgctcgcctatacccccttggatgaaaagtcccttgccctcctgcttgggtacctgcacgactttcttaaatacttagctaagaattctgcatctttgtttacggcctctgactacaaagtcgcttctgcagaatatcaccggaaggctctgtag

SEQ ID NO: 19809 - DNA, 513 bp, Artificial Sequence
  Description of Artificial Sequence: Synthetic coding sequence
atggaggtgaaggtgaagatccccgaggagctgaagccctggctggtcgaggattgggatctggttactaggcagaaacaactatttcagctccctgctaaaaagaacgtagacgccatactggaggaatatgccaattgcaaaaaatctcaaggcaacgtggacaataaggaatatgcggtcaatgaggtggttgccggtatcaaggagtacttcaacgtgatgctgggcactcaactgctgtataagttcgaacgcccccagtatgctgagatcctcctagcccaccctgacgcccctatgtctcaggtctatggcgctccacatctgctccggctgtttgtgaggatcggcgctatgctcgcgtatactcctctggatgaaaagtccctggccctcctgctcggatacctgcacgacttcctgaagtatctggctaagaattccgcaagcctctttaccgcctcagactacaaagtggcttcggccgagtaccacagaaaagccctgtag

SEQ ID NO: 19810 - DNA, 534 bp, Artificial Sequence
  Description of Artificial Sequence: Synthetic coding sequence
atgagcagccggaagcagggcagccagccccggggccagcagagcgctgaggaggagaatttcaaaaagcccacgcggtcaaatatgcaaaggagtaaaatgcgcggcgcttcttccggcaagaagaccgccgggccacagcagaagaatctagaacccgcccttcctggacggtggggcggcaggtcagcagaaaaccccccttctggctcagtccgcaaaactcggaagaataagcaaaagactcccggaaacggcgatggggggagtacaagtgaagccccccagccaccaagaaagaagcgggccagagcggaccccaccgtggaaagcgaagaagcattcaagaatagaatggaggtaaaggtcaaaattcccgaggagttaaaaccttggctggtagaagactgggatctggtgactaggcagaagcagctgttccagctgcccgctaaaaagaatgtcgatgccatacttgaagagtacgctaattgtaagaaatcccaggggaatgtggacaataaagaatactag

SEQ ID NO: 19811 - DNA, 867 bp, Artificial Sequence
  Description of Artificial Sequence: Synthetic coding sequence
atgagcagccggaagcagggcagccagccccggggccagcagagcgccgaggaggagaacttcaaaaagcccacccgttctaatatgcagcgttcaaagatgcgaggtgccagcagtggtaagaagacagcgggccctcagcagaaaaatttggaaccagcactgcctgggagatggggcggtaggtccgcagaaaacccaccatccggaagtgtgagaaaaacacgaaaaaacaaacagaaaacgccgggaaacggagacgggggctctacctcagaggccccccaaccccccaggaagaagagggctagggctgacccaaccgttgagagcgaagaggctttcaaaaacaggatggaagtcaaagtcaagatcccagaagaactgaagccttggttagtcgaggactgggacctggtcacgcggcagaaacaactgtttcaactgcctgcaaaaaaaaacgttgacgctattctggaggagtacgccaattgtaaaaagagtcagggtaacgtggataataaggagtacgcagtgaacgaggtcgtggcgggtatcaaggagtatttcaatgttatgttaggcactcagttgttatacaagtttgagcggcctcagtacgccgagattctgttggctcatccggatgccccaatgagtcaggtttacggtgctcctcatttgctgagactgttcgtgaggatcggcgccatgcttgcctatacccccctcgacgagaaatcactggcccttctcttgggttacctgcatgattttctcaaatatctcgcgaaaaattctgcctccctgtttacggccagcgactataaagttgcgtctgcagagtatcataggaaagccctctag

SEQ ID NO: 19812 - DNA, 204 bp, Artificial Sequence
  Description of Artificial Sequence: Synthetic coding sequence
atgagcagccggaagcagggcagccagccccggggccagcagagcgccgaggaggagaatttcaagaagcccaccaggagtaatatgcaacgcagcaagatgcgaggcgcgtctagcggaaaaaagactgccggcccccagcagaagaacttagaaccggccttaccaggccgatggggcgggagaagtgcggagaacccctag

SEQ ID NO: 19813 - DNA, 867 bp, Artificial Sequence
  Description of Artificial Sequence: Synthetic coding sequence
atgagcagccggaagcagggcagccagccccggggccagcagagcgcggaggaggagaactttaaaaagccaacacgaagcaacatgcaacggtccaaaatgagaggggcatcgagtggaaaaaagactgcgggaccgcagcaaaaaaacctcgaacccgctttgccaggtcgatggggcggacgctcagcagaaaaccccccctccggatccgtcagaaagactagaaaaaacaagcagaagaccccagggaacggcgacggcggatcaacaagcgaagcgcctcagccaccaagaaaaaagcgggcgcgggccgacccgactgtagagtctgaagaggcatttaagaacaggatggaggtgaaagttaaaattcctgaagaacttaaaccttggttagttgaggattgggatctggtgacacggcagaagcagttgttccaactgcctgctaaaaagaacgtcgacgccatcttggaagagtatgctaattgtaagaaatctcaggggaatgtcgacaataaggagtacgccgtgaatgaggtggtggccggaatcaaggagtattttaacgtgatgctcggaactcagctgctctacaagttcgagaggccccagtacgcagagattctgctggcgcatcctgatgccccaatgtcgcaagtttacggtgcaccgcatttactgcggctgttcgtgaggatcggagctatgttggcgtacacaccactagatgagaagtcgcttgctttgctgctgggttatctacatgacttccttaagtacttggcaaaaaacagcgcctccctttttacagctagtgactataaagtcgcttcggccgaatatcatcgcaaggcactgtag

SEQ ID NO: 19814 - DNA, 867 bp, Artificial Sequence
  Description of Artificial Sequence: Synthetic coding sequence
atgagcagccggaagcagggcagccagccccggggccagcagagcgcggaagaagagaattttaagaagccaacccgttcgaacatgcagcgaagcaaaatgcgtggagcttccagcgggaagaagactgctggcccgcagcagaagaaccttgagccagctctgcccggccgctggggcggaaggtccgccgagaacccgccttctggctctgtgagaaagacccggaagaacaaacaaaagactcctgggaatggagacggaggttcaaccagcgaggctccccagcctcctcggaagaaacgagctagggcagatcccactgtagagagtgaagaggctttcaagaatagaatggaggtcaaggtgaaaatccctgaagagttaaaaccatggctggtggaggactgggacttagtgactaggcagaaacagctgttccagctgcctgctaagaaaaacgtagatgccatcttagaggagtatgctaactgcaagaagtctcaggggaatgtggacaacaaagaatacgctgtgaacgaggtcgttgctggcattaaagagtacttcaatgtgatgctaggaacccagctgttgtataagttcgagaggccccaatatgctgagatcctgctggcccatcctgacgcacctatgagccaggtgtacggtgcccctcacctgctgcggctgttcgttagaatcggagccatgctcgcctacacgcctctggacgagaaatcattagccctcttgctcggctatcttcacgacttccttaagtacctcgccaagaacagcgccagccttttcactgcctcagattacaaagtggcatccgccgagtatcacagaaaagccctgtag

SEQ ID NO: 19815 - DNA, 537 bp, Artificial Sequence
  Description of Artificial Sequence: Synthetic coding sequence
atgagcagccggaagcagggcagccagccccggggccagcagagcgcggaggaggaaaatttcaagaagcccacccgttctaatatgcagagatcaaagatgcgcggggcaagcagtggtaagaagacggccggaccacaacagaaaaatctggagcctgcactccccggacgctggggaggccgcagtgccgaaaacccgccatcaggctctgtgaggaaaacacggaaaaacaagcagaaaactccaggcaacggcgacggcggtagtacctctgaggcaccccaacccccgagaaaaaagcgggcccgagcagacccaaccgtcgaatccgaggaggccttcaagaaccgcatggaagtgaaggtcaagatcccagaggagctgaaaccgtggctagtggaagattgggatctggtgacccgccagaaacagctttttcagttgcctgcgaagaaaaacgtcgatgccattctggaggagtacgcaaattgtaaaaagtctcagggcaatgtagataataaggagtatgcctag

SEQ ID NO: 19816 - DNA, 867 bp, Artificial Sequence
  Description of Artificial Sequence: Synthetic coding sequence
atgagcagccggaagcagggcagccagccccggggccagcagagcgctgaggaggagaacttcaagaagccaacacgttccaacatgcagaggagtaagatgcgcggggccagttccgggaagaagacggccgggccacagcagaagaaccttgaacctgccctccccgggcgctgggggggcaggtctgctgagaacccccccagtggctctgtgcgcaagaccagaaaaaataaacaaaagacgcctggcaatggagacggcggctccacaagtgaggcacctcagccaccaagaaagaaacgggctcgggctgatccaacagtggagtcagaggaagccttcaaaaacaggatggaggttaaagtgaaaatcccagaagaactgaaaccgtggctggtggaggactgggacttggtcacaaggcagaagcagctgtttcagctgcctgccaaaaagaacgtggacgccattctggaagagtacgctaattgcaagaagtcccagggtaacgtggacaacaaagagtatgctgtcaatgaagtggtggccggtatcaaagagtacttcaatgtgatgctgggcactcagttattatacaagtttgaacgcccacagtacgcggagatcctgctggcccaccctgacgcaccaatgtctcaagtttacggagccccccacctgctgcgcctgtttgttaggataggcgccatgctcgcatacacccccctagatgaaaaatcactggccctcctgctgggctacctgcacgacttccttaaatatctcgcgaaaaattctgcttctctctttaccgctagcgattataaagttgcatccgcggaataccatcgcaaagcactgtag

SEQ ID NO: 19817 - DNA, 477 bp, Artificial Sequence
  Description of Artificial Sequence: Synthetic coding sequence
atgagcagccggaagcagggcagccagccccggggccagcagagcgcagaggaagagaactttaagaagccaaccagatctaatatgcagaggagtaaaatgagaggggcctcatccggcaagaagaccgcaggtccccagcagaagaacctcgaacctgccttacccggaaggtgggggggcaggagtgcggagaatcctccatccggatctgtcaggaaaactcgtaagaacaagcagaaaacaccaggtaatggagacggggggagcacctccgaagctcctcagccacccaggaagaaaagggcccgagcggatcctacagttgagtcggaagaagctttcaagaatagaatggaggtgaaggtcaagatccccgaggagctgaagccttggctggtggaggactgggacttagtgactagacagaaacagctgttccagctcccagccaagaagaacgtcgacgcgatctag

SEQ ID NO: 19818 - DNA, 867 bp, Artificial Sequence
  Description of Artificial Sequence: Synthetic coding sequence
atgagcagccggaagcagggcagccagccccggggccagcagagcgccgaagaggagaactttaagaagcctacaagatcgaacatgcaaaggtctaaaatgaggggagcttccagcggcaaaaagaccgcgggcccacagcagaaaaatttggagcccgcactgccgggacgatggggaggcaggagcgcagagaatcctccaagcgggagtgtgagaaaaacacggaagaacaaacagaagactccaggtaacggcgacgggggctccactagcgaggctcctcaaccaccccgcaagaaacgggctagagcagatcctactgtggaaagtgaagaggcatttaaaaatagaatggaagtgaaagttaagattcccgaggagttgaaaccatggctggtcgaagattgggatctggttactcgccagaaacagctgtttcagttgcctgccaagaaaaacgtcgatgcaatcctcgaagagtacgcaaattgcaagaagagccagggcaatgtggataataaagagtacgcagtgaacgaagtggtggccggaattaaggagtactttaacgtgatgttaggaactcaacttctttacaagttcgagcggccacaatatgccgagatcttgctcgcccatcccgacgccccaatgagccaggtgtacggagctcctcatctgctcaggctattcgtgcggatcggggcaatgctggcatacacaccactggacgaaaagtcactggccctgctgcttggttacctgcatgacttcctgaagtatctagccaaaaactcagcctccctgttcacagcctctgactacaaagtggcctctgctgagtatcaccggaaagcattgtag

SEQ ID NO: 19819 - DNA, 2046 bp, Artificial Sequence
  Description of Artificial Sequence: Synthetic coding sequence
atggccccccaggtgtggcggcggcggaccctggagcggtgcctgactgaggttggcaaggcgaccggaagacctgaatgtttcctcactatccaggagggcctggcctccaagttcacatcactgacaaaggtgctttacgactttaataagattttggagaatggtaggatacatggctcaccgctgcaaaagctggtgatcgagaactttgatgatgaacaaatctggcaacaactggaactgcaaaatgagccaatcctccagtactttcagaacgcagtttccgaaacgatcaatgacgaagatatctccctgctgcccgaatccgaggaacaggagagagaagaggacggaagcgagatagaagccgatgataaggaagatctcgaggacctggaggaagaggaagtgtctgacatggggaatgatgaccctgaaatgggcgagagagctgagaactcttcaaaaagtgatctacgcaaaagccccgtgttctccgacgaagattccgatctggatttcgatatttcaaagctggagcagcagagtaaggtgcagaataagggccaaggcaaacctagagaaaagtccatcgtggatgacaaatttttcaagctttctgagatggaagcttaccttgaaaatatcgaaaaggaagaggaaagaaaggacgacaacgatgaggaggaagaagatattgactttttcgaggacatcgacagcgatgaggacgagggagggttgttcggatccaaaaaattgaagagtggcaagtcaagtcgcaacctgaaatacaaggacttctttgacccggtcgaaagcgacgaagacatcacgaacgtgcatgatgatgagttagactccaataaggaggacgatgagatcgcagaagaagaggctgaggaactttccatcagcgagaccgatgaagatgacgatttgcaggaaaacgaggacaacaaacagcacaaagagtcgcttaagagggtgacattcgcactgcccgacgacgctgagaccgaggatacgggggttctcaacgtcaaaaagaacagcgatgaggttaaatcttcatttgagaagagacaggaaaagatgaacgagaagattgccagccttgagaaggagttgttggagaagaagccctggcagttgcagggcgaggttacagcccagaaacggccggaaaatagcctcctggaggagacactacacttcgaccatgcagtccgcatggcaccagtcatcaccgaggaaaccacactgcagctagaggacattatcaaacagcgaattcgggatcaagcatgggatgacgtggtgcgcaaagagaaacccaaagaagacgcttacgaatataagaagaggctcacacttgatcacgagaagagcaagcttagcctggctgaaatttatgaacaagagtacattaaactcaatcagcagaagactgcggaagaggagaaccccgagcatgttgaaatacagaagatgatggactcactgtttctcaaactggacgcgctgtccaactttcacttcatcccgaaacctcccgtgcccgaaattaaggtcgtgtctaacctgccagccattactatggaggaagtggctcccgtatctgtgtcagatgccgctctgctggcccccgaagagatcaaggagaaaaataaggccggcgatattaagaccgctgcagagaaaactgcaaccgataagaaaagggagcgacgtaaaaaaaagtatcagaagagaatgaagatcaaagagaaggaaaaacgccgtaaactcctcgaaaaaagtagcgttgatcaagctggtaagtacagcaaaaccgtcgcttccgagaaactcaaacagttaacaaagaccggcaaagcctccttcatcaaagatgagggtaaggacaaggccctcaaatcctcgcaggctttcttttctaaacttcaagaccaggtaaagatgcagattaatgatgctaaaaaaaccgaaaagaaaaagaagaaaaggcaagacataagcgtccataaactcaagctgtag

SEQ ID NO: 19820 - DNA, 720 bp, Artificial Sequence
  Description of Artificial Sequence: Synthetic coding sequence
atgcccaagagcaagcgggacaagaaggtgagcctgaccaagaccgctaaaaagggcctcgagctcaagcagaatctcattgaggagctgagaaaatgcgtggatacttataagtatctattcattttctccgtggctaatatgcggaactcaaagctgaaggacatccggaatgcctggaaacactccagaatgttttttgggaaaaacaaggttatgatggtggccctggggagaagcccaagcgacgaatacaaagataatctacaccaagtgtccaagcggttgcgcggagaggtaggacttttgttcacaaatcgaaccaaggaagaggtaaatgagtggttcacaaagtacaccgaaatggactatgcacgcgctggaaacaaggccgctttcactgtctctctggatccaggacctctggagcagttcccccacagcatggaacctcagctgcgtcaactcgggctgccaacggcattgaagagaggcgtcgtcactctgctgtcagattacgaggtctgcaaggagggcgacgtactgacccccgagcaggcgagggtgttaaagctgtttgggtacgagatggctgagtttaaggtcactatcaaatacatgtgggatagccaatcaggtagattccagcagatgggggacgacctgcccgagtcagcaagcgaatctacagaggagagtgattcggaagacgatgattag

SEQ ID NO: 19821 - DNA, 621 bp, Artificial Sequence
  Description of Artificial Sequence: Synthetic coding sequence
atgagcaccggcagcgtgagcgaccccgaggagatggagctgcggggcttacagcgggagtaccccgtgccagcatctaagagacccccgctgcgcggagtggagcggtcctacgcgagcccatccgataactccagcgctgaggaggaagacccggacggtgaagaagaaaggtgcgcacttggaacagccggctcagcagaaggttgcaaacggaaacggccaagagtagctggtggggggggagcgggcgggagtgccggcggaggcggaaaaaagccgttaccagcaaaaggatctgccgccgaatgtaagcagtctcaacgcaacgcagcaaacgccagagagcgcgcccgtatgcgagtgctgagcaaggcattcagcagactcaaaacctctctaccatgggtgcccccggataccaagctcagcaagctggatacactcaggttggccagctcttatattgcccacctcaggcagctcctgcaagaagacaggtatgagaacgggtacgtgcatcccgtcaacttaacatggcctttcgtggtgagcggccgacctgacagcgatactaaggaggtcagtgcagccaaccggctctgtggtacaactgcttag

SEQ ID NO: 19822 - DNA, 249 bp, Artificial Sequence
  Description of Artificial Sequence: Synthetic coding sequence
atgagccaggccggcgcccaggaggcccccatcaagaagaagcggcctcctgtgaaagatgaggatctgaaaggggctagggggaatctcacgaaaaaccaagagattaaatccaagacttatcaagtaatgcgagaatgcgagcaggcgggcagcgctgccccctctgtgttctcaagaactcgaaccggaacagagacagtgtttgaaaagcccaaagcaggtccgaccaaaagtgtctttggctag

SEQ ID NO: 19823 - DNA, 2508 bp, Artificial Sequence
  Description of Artificial Sequence: Synthetic coding sequence
atggccagcctgggcgccaacccccggcggaccccccagggccccagaccaggggcggctagctctggttttccatcacccgcaccagtacccggaccgcgtgaggctgaagaggaggaggtcgaagaggaggaggaactggctgagatccatttatgtgtcctctggaatagtggatacctgggcattgcctactatgacacaagcgattcgaccatccactttatgccagacgcccccgatcatgagtctcttaaattgcttcaacgggtcctggacgaaattaaccctcaaagtgtcgtgacctcagccaagcaggatgaaaacatgacacgtttcttggggaaattagcgagccaggaacacagggaacctaaacggcccgagatcatttttctgccttctgtagatttcgggctcgagatctcaaagcaaagactcctctctggcaattactcctttattccagatgccatgaccgcaacggagaagatcctttttctgtcctctattatcccatttgattgtctgttgaccgtgcgagctctgggaggtctgctaaagtttctgggcaggcgacggattggggtggaactggaggattataacgtgtctgtaccaatactggggttcaagaaattcatgttaactcacctagtgaacattgatcaggatacctactctgtgctccagattttcaagagcgagagtcacccatcagtgtacaaggtcgcctccggcctcaaagaaggtctctctctctttgggattctcaacaggtgccattgcaagtggggagagaagcttctaagactgtggttcactagacccacccacgacctgggcgagctgtcgtcaagactagacgtaatccagttctttctgctcccccagaacctcgacatggctcaaatgctgcatagactgctgggccacataaagaacgtgcccttaatcctgaagcgaatgaagttgagccatactaaggtttctgattggcaggtcctatacaagacagtgtatagcgcactgggcttgcgcgatgcgtgtcgctccctcccccagtccattcagctgttccgagatatcgctcaagaattttcagatgaccttcaccatatagcctctctcatcggcaaggtggtggacttcgagggtagcttggcagagaataggttcacggttcttcctaatatcgacccagagattgatgaaaagaagaggcggttgatgggactgccctcattcctcacagaggtggcccgtaaggagcttgaaaaccttgatagtagaatcccatcatgcagcgtaatatatatcccactgattgggttcctcttgtccattccaagactgcctagcatggtggaggctagcgatttcgagatcaatgggctagattttatgttcctgtctgaggagaaattgcactaccggtcggccaggactaaggaattagatgcacttcttggggatcttcattgtgagatcagagaccaggagactcttctgatgtaccagctccagtgtcaggtgttggcaagagcggccgtgctcacaagggttttagatctggcgtcacgccttgacgtgctgttggctctggcgagcgcagcgcgggactacgggtactctcgaccacgctacagtccgcaggtgcttggtgtgaggatccaaaatgggcgccatcctctcatggagctgtgcgcacggacatttgtcccaaatagcactgaatgtgggggggacaaaggccgggttaaagtcattacaggtccgaactcctccggcaaatccatctatctcaaacaggttgggcttatcactttcatggcattggtcggtagtttcgttcctgctgaggaagcagagattggagcagtggatgccatttttacacgcatacatagctgcgagagcattagcctcggtttgagtactttcatgatcgatctcaaccagcaggtggcaaaagccgtgaacaatgctacggcacagagcctggtcctgattgacgagttcggaaaaggaactaacaccgtcgacggccttgctctcctcgctgccgtgcttagacattggctcgcacgcgggccaacttgtccacacatcttcgtggcaactaattttctatcacttgtgcagttgcagcttttgccccaaggtccactggtgcaatacctcaccatggaaacctgcgaggacggcaacgaccttgtgtttttttaccaggtatgtgaaggcgtggcgaaggcctctcatgcttcccatacagccgcacaggcgggtctaccagacaagctggtggcccgagggaaggaggtaagtgatctgattcggagcggtaaacctattaagcccgtgaaagacttgctgaagaagaatcagatggaaaattgtcagactctggtagacaaatttatgaaactggacctggaagaccccaacctcgacttgaatgtgttcatgagtcaagaggtccttcccgccgccacttccattctgtag

SEQ ID NO: 19824 - DNA, 2469 bp, Artificial Sequence
  Description of Artificial Sequence: Synthetic coding sequence
atggccagcctgggcgccaacccccggcggaccccccagggcccccgccccggcgccgcatcctcaggatttccctccccagcgcccgtgcctgggccccgagaagccgaggaagaggaggtggaggaggaagaagaactggccgagatacacctgtgtgttctgtggaattccggttacttgggaatagcatattacgacacgtctgattccactatccactttatgccagatgcccccgaccatgagtccttaaagctgcttcagcgcgtactggatgagatcaatccgcagagcgtagttactagtgccaaacaggacgagaatatgactcgctttctcgggaagcttgcatctcaggaacatcgggagcccaagagacctgaaatcatctttttgccatctgtagacttcgggctggagatctccaaacagaggctcctgtctgggaactatagtttcatcccagacgccatgacagccaccgaaaaaattctgttcttgtcttcaattatccccttcgattgcttgctgaccccccctggcgatttgcgctttaccccaatccctctcttgattccttcccaagttcgagcactgggcggacttctcaagttcctggggagaaggcgcattggagtggaattagaggactacaatgtctcagttcctatactggggttcaagaaattcatgttgactcacctggtgaatatcgaccaggatacgtacagtgtactgcagatcttcaaatcagagagtcacccaagtgtgtataaggtggccagcggcctgaaggaagggttgtcactgttcggaatattgaatcgttgccactgcaagtggggcgaaaaactgttgcggttatggttcactcggcctactcacgatctgggcgagctctcttcgcgactggatgttattcaattttttctgctgccccagaacttggatatggcgcaaatgctgcaccgtctgcttggtcacatcaaaaacgtccccctgattttgaagcgaatgaaattatcccacacgaaagtttccgactggcaagttctgtataagaccgtgtattcagccctcggtttacgtgatgcctgtagatcactgccacagagcatccagctctttcgcgacatcgcgcaagaattttccgacgatctgcaccacatagcttctttgattgggaaggtggtcgacttcgagggaagcctcgctgagaaccggttcaccgtcctaccaaacatagatccagaaattgatgaaaagaaaaggcggttaatgggattgccgagcttccttacagaagtcgcacggaaggagttggagaatttggacagcaggattccctcatgttccgtgatttatatcccacttatcgggtttttactcagcattcccaggttgccatccatggtcgaagcatcagactttgagatcaacggtctcgacttcatgttcttgagtgaggagaagttgcattacagatctgctcgcaccaaggagctggatgctctgttgggggacttgcattgtgagatcagagaccaggaaaccctgctcatgtatcaactgcagtgccaggtgctggcgagagccgccgtgctgacccgggtcctggacttggccagccgcctggacgtgctgctggcactcgcctctgctgctcgtgactacggatattctcgtccacggtatagccctcaggtccttggagtccgaatccagaacggcaggcaccctctgatggagctgtgcgccagaactttcgtgcccaatagcacggaatgcggtggagataagggcagagtgaaagttattacgggcccaaatagctcgggcaaaagtatttacctcaagcaggtggggctgattacgtttatggccctggtggggtctttcgtcccggctgaagaagccgagattggcgcagtggatgcaatctttaccagaatacacagctgtgaatcaatttctctcggtctgtcgactttcatgatcgatctgaaccagcaggtggcgaaggctgtaaacaatgctaccgcgcaatccctcgtgctgattgatgaattcggaaaaggcaccaatactgtggacggattggccctcctcgcagccgttctgcgacactggttggcccgcggacctacctgcccccatattttcgtcgcaaccaatttcctgtcgctggtgcagctccagctactcccacagggaccattggttcaatatcttacaatggagacctgtgaggatggcaatgacttagtctttttttaccaggtgtccgatcttattcgctccggcaagcctatcaaaccagtgaaggacctgttaaagaaaaaccagatggagaattgccagacactcgtcgataagttcatgaagctggatttggaagaccctaacctggatttaaacgtgtttatgtcccaggaagtactcccggccgctacttcaatcctgtag

SEQ ID NO: 19825 - DNA, 2556 bp, Artificial Sequence
  Description of Artificial Sequence: Synthetic coding sequence
atggccagcctgggcgccaacccccggcggaccccccagggccccagaccaggtgccgcatcctcagggttcccctcacccgctcccgtccctggccctagggaggccgaggaagaggaggttgaggaggaggaagagctggcagaaatccacctgtgtgtgctctggaacagcgggtaccttggtatcgcatactatgacactagcgactccacgattcacttcatgcctgacgcacccgaccatgagtccctgaaactactgcagagagtccttgacgagattaacccacaaagcgtggtgacaagcgccaagcaggacgaaaacatgacaaggtttctgggaaaactggcaagccaggaacaccgggagcctaaaaggcctgaaattatcttcctgccatctgtggactttggactagagatttcaaaacaaaggctcctatccggcaattattctttcatcccggatgcgatgacagcaactgagaaaattctttttctgagctccattattccctttgactgtctgttgacgccgcccggcgacctgcggtttacgccgattccactgttgattccctctcaggtacgcgccctgggaggactgctgaaatttcttggcaggaggaggatcggagttgaattggaggactataacgtttccgtgcccatacttgggtttaagaagtttatgttaactcacttagtaaatattgaccaggatacctattcagttctgcaaattttcaaatcagagtcccatccctccgtctataaagtagcaagcggcctgaaagagggtctctcactgttcgggatcttaaacagatgtcactgcaagtggggcgaaaagctgctccgcctgtggtttacaaggcctacacatgatttaggtgagttatccagcagactggatgtcatccagtttttcctgctgcctcagaatctcgacatggctcagatgcttcatcgcctgctcgggcacataaaaaatgtcccactcatccttaagcggatgaaactgagtcacacaaaggtgtccgactggcaggttctgtataaaactgtgtacagtgccttgggcttgcgggatgcatgccgcagcctcccgcagagtatccagctgtttcgagacatagctcaggagttctctgatgacctccatcacatagccagcctaatcgggaaggttgtagatttcgaaggcagtttggctgaaaatcgattcaccgtattgccgaacattgatcccgagatcgacgagaagaaacgccgacttatgggcctccccagtttcctaactgaggtcgcacgcaaagagctagaaaacttagactcccgcatcccgtcttgtagcgtgatttacattccccttataggtttcctgctcagtatacctagactgccaagcatggttgaggcttctgattttgagattaatggtctcgattttatgtttctctcagaggagaaactgcactaccgctcagctcggaccaaagagcttgatgctcttctcggggatctgcattgtgaaattcgtgaccaagaaaccctcttaatgtatcaattgcagtgtcaggtgctggcgcgggctgctgttctgacccgagtgctggatctcgccagtagactggacgtgctgttggcattagcctctgctgctcgcgattacgggtacagccgaccgaggtactcacctcaggttctcggcgtccggatccagaacggcaggcacccactcatggagttatgcgctaggaccttcgttccaaacagcactgaatgtggcggcgacaaaggtcgggtcaaagtgattactgggccgaatagttcagggaagtccatctacctgaaacaagtcggactgattaccttcatggccctggtaggcagcttcgttccggcagaagaggcagaaattggagccgttgatgccatttttactagaatccacagttgcgagagtatcagtctgggtttaagtaccttcatgattgatctaaatcaagtggctaaagctgtcaataatgcaactgcccagtccctggttttgattgatgaatttggtaaggggacgaacactgtagacggcctcgccctgctggctgctgtgctgaggcactggttggctcggggacctacctgtccccacatttttgtggcaactaattttctgagtctggtgcagctccaactactgccacagggacccctcgtccagtatctaaccatggagacatgtgaggacggtaatgatctggtgttcttctaccaggtgtgcgagggtgtggcgaaagcatcccatgccagccacaccgccgcgcaagccgggttaccagataagcttgtggcccggggcaaagaggtttctgacttaattcggtcaggaaagcccatcaagcccgtgaaggatctgctgaaaaagaaccagatggagaactgtcagacactggtggacaagttcatgaagctcgacctcgaagatccgaatcttgacctgaatgtctttatgtcccaggaggttctccctgcagccactagcattctgtag

SEQ ID NO: 19826 - DNA, 2505 bp, Artificial Sequence
  Description of Artificial Sequence: Synthetic coding sequence
atggccagcctgggcgccaacccccggcggaccccccagggccccaggcctggtgccgcttcctcgggttttcccagccccgcccctgtccctggccctagggaagccgaagaagaggaggtagaggaggaagaggagctggccgagattcacctttgtgtactgtggaactccgggtatctaggcattgcttattatgacaccagcgacagcacaattcactttatgccagatgcccccgaccatgagtcgctcaagttgctgcagcgcgtcctcgatgagattaaccctcagtcggttgtaacctcagccaagcaggacgagaacatgactcgatttctggggaagttggcaagtcaggaacatcgcgagccaaaaagaccagagattatcttcctaccgtccgttgatttcgggttagaaatctccaaacagagactactgtcaggaaattattcctttattcctgacgcaatgacggcaaccgaaaagatcctctttctgtcctccattatccctttcgactgccttctgacggtccgagcgcttggaggtttgctcaaattcctcggcagacgaaggatcggtgtggagctagaagattacaatgtgtctgtgcctatactcggatttaaaaaattcatgctgacgcacttggtgaatatcgaccaggacacatattcagtactccagatctttaagagtgaaagccatcctagcgtgtataaagtggccagcggtctgaaagaggggttgtcattgttcgggatcttgaataggtgccactgcaaatggggcgaaaagttactgcgcctctggtttactcggcctactcacgatctcggcgaactttcttccaggctcgatgtcatccaattctttttactgccacagaatttggacatggcccagatgctacatagactcctcggacacatcaaaaacgtcccgctgatcctgaagcgcatgaagctgtcacacacaaaagtttcagattggcaggtgctttacaaaaccgtgtattctgccctgggactgcgggatgcctgtcgtagtctccctcagtcaatccagctgttccgagatattgcccaggagttctcggacgacctacatcatattgcgtccctgatcggcaaggtggtggactttgagggctcgctggctgaaaaccgctttactgtgttgcctaacatagacccagagatagacgaaaagaaaagaagacttatgggcttaccaagttttctgacggaagtggctagaaaggagctggagaacttagattccagaattcccagctgctcggtgatttatatcccactgatcggcttcctcctgagtattccccggctgcctagcatggtggaggcctcagattttgaaattaatggtcttgatttcatgtttctgtctgaagaaaagctacattaccgcagcgcgcggacaaaggagctcgacgctctgctgggcgacctccactgcgagattcgagaccaggagacactgctcatgtaccaacttcaatgtcaggttctggctcgcgctgccgtcctcacacgagtcctggacctggcaagtcgcttggatgtacttttggcgctcgcatccgcggcgagggactacgggtatagtcggcctaggtactcacctcaagttctgggggttcggatacagaacggtaggcaccctcttatggaactctgcgctaggacgtttgtccctaatagtactgaatgtggcggggataaggggcgtgtgaaggtgattaccgggcccaactcttcaggtaagagcatctacctcaagcaggttggcttgatcacgtttatggccttagtggggagtttcgttcctgcagaagaagccgagattggcgccgtggatgcaatttttacacgcattcattcgtgtgagtctatctctctcgggctctcaacatttatgattgatcttaatcaggtcgccaaagccgttaacaacgccacagctcagtccctggttctgatcgacgaattcggaaaggggacaaatacagttgacgggttagccctcctcgccgcagtcctacgccactggctcgcaagaggcccaacctgcccccatatatttgtggccactaatttcctatctctggtacagctgcaactgcttccacaggggcctctagtgcagtacctgacaatggagacatgcgaagatggcaacgaccttgtgttcttttatcaggtttgtgaaggagttgcaaaagcaagccacgcgtcgcacacagccgcccaggccggtctgcctgacaagttagtggctagaggcaaggaagttagtgatctgatccgaagtggtaaacctatcaaacccgtgaaggatttgctgaagaagaatcaaatggagaactgtcaaacactggttgacaagttcatgaagttagacttggaggatcctaatctggacctcaatgtgttcatgagtcaggaagtgctgcctgctgctacctcaattctgtag

SEQ ID NO: 19827 - DNA, 2505 bp, Artificial Sequence
  Description of Artificial Sequence: Synthetic coding sequence
atggccagcctgggcgccaacccccggcggaccccccagggccccagaccgggagccgcatcatctggcttcccctctcccgcaccagtgcccggaccaagggaagccgaagaagaagaagtagaggaggaagaagaactagctgaaatccacctgtgcgtcctgtggaactcaggatacctgggcattgcttactatgatacctccgactctaccatacacttcatgccagacgcacctgatcatgagtcgctcaagctgctgcagcgcgtgctggacgaaatcaatccacagagcgtggtcacgtccgccaagcaggacgaaaatatgaccagattccttggcaaattggcttcacaggagcatagagagcccaaaagacctgaaattatttttttacccagcgtcgacttcggactggagatttctaagcagcgactactgtcaggcaattactccttcatccccgacgccatgacagccactgagaagattctttttctgagttctatcattcccttcgattgtctgctcactgtccgagccctaggagggcttctcaaattcctgggtcgtagaagaatcggagtggagctggaagactataacgtgtctgttcccatcctcgggttcaagaaatttatgctgactcaccttgtcaatattgaccaggatacgtactctgtgctgcagatcttcaagtctgagagccatcccagcgtgtataaagtggcgtccgggctgaaggaagggctttcattgttcggtattctaaatagatgccactgtaagtggggagagaaactacttaggctgtggttcacgcgccccactcacgatctaggcgagctaagttccagactggacgtgatacagttttttctcctcccccaaaacctggacatggcccagatgctgcacagactgctggggcatattaaaaacgttccactaatcctcaaacgaatgaaactgtcccatactaaggtgagtgactggcaagtcctttacaagacagtttactccgcactgggcctgcgtgacgcatgccgctcactgccccagagcatacagctattccgggacattgctcaggagttctccgatgacttgcatcatatcgcttccctgatagggaaagtagttgactttgaagggtcactggctgagaatagatttaccgtgttacctaacatagatccagagatcgacgaaaagaagcgacgattaatggggttgccttcattccttacggaagtggcaaggaaagagctggagaacttggattcccgtatcccaagttgctctgtgatttatatccctctcatcgggttccttctgtctatcccccggctccccagtatggtagaagcaagcgacttcgagattaatggcctggatttcatgtttctgagtgaggaaaaactccactatagatcagcaagaaccaaagagttggatgctctgctgggcgacctgcattgcgaaattagggaccaggagactctcttaatgtaccagttgcaatgccaggtcctggcacgcgcagccgtgcttacacgagtgctcgacctggcctcccgtcttgatgtgctccttgccctggccagtgcagcccgggactatggttactccaggcctcgctactcaccccaggtcttgggggttagaatccagaacggacggcatccgctcatggagctgtgtgcccggaccttcgttcccaactcaaccgagtgtggaggcgacaaagggcgcgtcaaggttattaccggacctaactccagcggaaagagcatttatctgaagcaggtgggcctgattaccttcatggcactggttggatccttcgtgcccgcagaggaagccgagataggtgcagtggatgccatcttcacaaggattcacagctgtgagagcattagccttggattgtcaacttttatgatcgacctcaatcaggtcgccaaagccgtgaacaacgccacggcacagtcactggtcctaattgacgagtttggcaaaggcacaaacacagtggacgggctcgcactgctggccgctgtgctaagacactggctggcaagggggccaacgtgcccgcacatttttgtagcaacaaacttcctatcccttgttcagctccagctgcttccacagggccctctggttcagtatctgaccatggagacctgtgaagatggcaatgacctggtatttttttaccaggtctgtgagggagttgctaaggctagtcacgctagtcatacagccgcgcaggccgggctcccagacaaactggtggctaggggcaaggaagtcagcgatttaattaggtccggcaagccgattaagccagtgaaggacctgttaaagaagaatcaaatggaaaactgccagaccctagtcgataagttcatgaagttggacctggaggatccaaacctggacctgaatgtctttatgtcccaagaagttctgcccgcagcgactagtatactgtag

SEQ ID NO: 19828 - DNA, 816 bp, Artificial Sequence
  Description of Artificial Sequence: Synthetic coding sequence
atgttcctgagcgaggagaagctgcactaccggagcgcccggaccaaagaactcgatgcactgctcggtgatctccattgcgagattcgagaccaagaaaccctcttgatgtaccaactccagtgccaggtcctggccagggcggccgtgctcacacgggtactcgatctggcgtcacggctggacgtgcttctcgcacttgcctctgcagctagagactatggatatagtcggccaaggtattctccacaagttcttggcgtgagaattcagaatgggaggcatcctctgatggaactttgcgctaggacctttgtccctaattctacagaatgtgggggagacaaaggccgggtaaaggtgataacgggacctaatagttctggcaagagcatttacctaaagcaggtcggtctgatcacattcatggccctagtgggatcattcgtccctgcagaagaagctgagattggggcggttgatgccatattcacccgcattcacagctgcgagtctatttctctaggtctatctacattcatgatcgacctgaaccaggtggctaaggcagtgaacaatgccacagctcagagcctcgttttgatcgacgaattcggcaaagggaccaatacagtggatggcttggcactgctcgcggctgtcctcagacactggcttgcaaggggccctacgtgcccacatatcttcgtcgctaccaactttctgagcctggtacagctacaattactcccacaggggccactcgttcagtacctggactggcctcgggttagcggccaggagggcggtgattag

SEQ ID NO: 19829 - DNA, 1002 bp, Artificial Sequence
  Description of Artificial Sequence: Synthetic coding sequence
aagatcctgttcctgagcagcatcatccccttcgactgcctgctgacagtgagggctttgggtgggctcctgaaattcctgggaagacgaaggataggagtcgaactagaggattataacgtgagtgtgccaatcctcggatttaaaaaatttatgcttacccacctggtcaacatagaccaggacacctattctgttctgcaaatttttaaatccgagagccaccccagtgtgtacaaagtggcatccggacttaaggaaggcctcagcctttttgggattttaaaccgatgtcactgtaagtggggtgaaaagctcctcagactctggttcacacggcccacccacgatctgggggagctgtcaagccggcttgacgtcattcaattcttccttctgccccagaacctggacatggcgcaaatgcttcacaggttattgggccacatcaaaaacgtcccgctcattctgaagcgcatgaagctgtcccacacaaaagtttctgattggcaagtgctgtataagaccgtatacagtgctctcgggctgcgcgatgcatgcaggtcccttccacagagtatacaacttttccgggatatagcacaggaattttcagatgacctacatcacatcgcatctctcatcggaaaagtttatctgtctccgcaggtggatttcgaaggctctctggcggaaaatcgattcaccgtcttacccaatatcgatcctgaaatagacgagaaaaagaggcgcctgatgggattgccgagtttcctcaccgaagtggctcggaaagaattggaaaaccttgactctaggatcccaagttgcagcgtcatctatattcctcttataggctttctgttgtctattcctcggctgccttcaatggtcgaagcctctgacttcgagattaatggcctggatttcatgttcctctccgaagagaagttgcactacaggtcagctcgaactaaggagctcgatgcactcctcggttag

SEQ ID NO: 19830 - DNA, 1527 bp, Artificial Sequence
  Description of Artificial Sequence: Synthetic coding sequence
atgtggcccgtgctgctgttcgtgttcctgagccagaccgtgtactccgccctgggccttcgcgatgcgtgccgatccctgccacagtccattcagctgtttagggatatagcccaagagttttcagacgatctgcatcatatcgccagcctgatcggcaaggtcgttgatttcgagggaagcttagcagaaaacagatttaccgtgctgccgaacatagatcccgaaatcgatgaaaaaaaacgacggttgatgggattacccagcttcctgacggaagtggctagaaaagagcttgagaatttagactcacggataccgtcctgttccgtaatctatattcctctgattggctttcttctctccatcccccgcctgcctagtatggtggaagctagcgatttcgaaattaatggcctcgattttatgtttttgagcgaggaaaaattacactaccgcagcgctagaactaaggagttggacgcccttctaggcgaccttcactgtgaaatacgggatcaggaaacacttttgatgtatcaattgcagtgtcaggtgctcgctagggccgccgtgctgacaagagtgttggacctggcctcccgcctcgatgtcctgcttgccctcgcatcagccgctcgcgactatggctatagtaggcctcgctactcccctcaggtgctgggcgttaggatccaaaatggacgccacccactgatggagttatgcgccaggactttcgtcccaaattccactgagtgtggaggcgataagggacgggtcaaggttatcactggccctaactcatccggcaaatccatctatctgaagcaggtgggcctgattacttttatggccctggtaggctctttcgtgccagcagaggaagctgagatcggggctgtagacgctatctttactcgcattcacagctgtgaaagcatctctttgggcctgagcacatttatgatcgacctaaatcaggtggctaaggcagttaacaatgcgacagctcagagcttagtgttgatcgatgaattcggtaaaggtaccaacacggtggacgggcttgctttactggctgccgtgctcaggcattggctagcccgcggacctacctgcccccacatttttgtggccactaactttctgtctctcgtgcagctccaactgctccctcagggtccgctggtgcagtacctgaccatggagacttgcgaggatggcaatgatctggttttcttctaccaggtgtgcgaaggcgtcgccaaagcaagccacgcatcacacacagccgcacaggcaggactcccagacaagctcgttgcaaggggcaaagaggtctcagatctgattaggtctggcaagccaataaaacccgtgaaggatcttctgaaaaagaaccagatggagaactgtcaaacacttgtagacaagtttatgaagctcgacctggaggatcctaacctggacttgaatgttttcatgtctcaggaagtgctgccggccgcaacctctattctgtag

SEQ ID NO: 19831 - DNA, 2505 bp, Artificial Sequence
  Description of Artificial Sequence: Synthetic coding sequence
atggccagcctgggcgccaacccccggcggaccccccagggccccaggccaggggctgcttcctcagggttccccagcccagcaccagtgcctgggccaagggaagctgaggaagaagaggtcgaggaagaggaggaactggctgaaatacatctgtgcgtgctctggaatagcggttacctgggcatcgcatactatgatacctccgatagtactattcatttcatgcccgacgcccccgaccacgagtcacttaagcttctccagagggtgctcgatgagattaatccccagagcgtcgtgacctcagccaaacaagatgaaaacatgaccaggttcttaggtaagctggcctcccaggaacatcgggagccaaagagaccagagatcatctttctcccctctgtggactttgggctcgaaatctccaagcagcggctgctgtcaggcaattatagcttcatcccagatgcgatgaccgcaactgagaaaattctgttcctgtcctctataataccctttgactgcctcctcacagtgcgcgcccttggagggcttctcaagttcctgggaagacgcagaatcggagtggagctggaggactacaacgtgagtgtccctattcttggttttaagaagtttatgttaacccatctcgttaacatcgatcaggatacttactccgttctgcaaatctttaagtcagagagtcatccgtctgtttacaaagtggcctccggcctcaaagagggactgtcattgtttggaattctaaatcgttgccactgcaagtggggcgagaaactcctgcgcctgtggttcacaaggcccacacatgacctcggggagttgtcgtctagactggacgtgattcagttctttctcttacctcaaaatctcgacatggcacaaatgctgcatcggctccttgggcacattaagaacgtaccactgatcctcaagcgaatgaaactgagccacacaaaggttagcgactggcaggtattgtataaaaccgtctattctgccctgggtctgcgcgacgcatgcaggagcctgcctcagagcattcagctgtttcgggacatcgcgcaggagtttagcgatgacttacaccacatcgcgtctctcattggtaaggtagtagactttgagggctcgctggcagaaaaccgttttactgtcttgccaaatatagaccctgaaattgatgaaaagaagaggcggctcatggggcttccaagctttctgacagaggtcgccagaaaggagttggaaaacctggacagtcgaatcccctcctgctctgtgatctatatccccctgattggtttcctccttagcatacccaggctcccatctatggtcgaagcttctgatttcgagatcaacggactagattttatgtttttatccgaagaaaagctgcactatcgcagcgccagaactaaggagctcgacgccctgctgggagatctacactgtgaaattagggatcaggagacccttctaatgtaccagttgcagtgtcaggtcctggcccgcgcggcagtactaacccgagttctcgacctggctagtagactcgatgtcctgctggctcttgcctctgccgctcgagactatggttactctcgcccccgctactctccacaggtcctgggagttagaatacaaaacgggagacacccattgatggagctttgtgctaggacctttgtgccgaattcaactgagtgtggcggcgataagggacgcgtgaaggtaatcaccggacctaatagcagcggtaagagtatttaccttaagcaggttggcctcatcacattcatggccttagtgggctctttcgtgcccgccgaggaggctgagatcggcgccgtggatgccattttcacacgaatacatagttgtgaatcaatcagtctagggctatctacgtttatgatagatctcaaccaggtagcaaaggcggtcaacaacgccactgcccagagtctggtattgatagacgagttcgggaaaggtaccaacactgtagatggcctggcgctgcttgctgccgtgctccgacactggttggccagagggcctacctgcccccacattttcgttgccacgaactttttatcattagtgcaactgcagctgctgccacaggggccgcttgtacagtaccttaccatggagacctgcgaggatgggaatgatctggtttttttctatcaagtgtgtgagggcgtcgccaaggcttcacacgcctctcataccgctgctcaggccgggctgccagacaaactggtggcacgcggcaaagaagtgtctgatctgattagatcaggaaaacccatcaagccagttaaggacctgctgaagaaaaaccaaatggagaactgccagactttagtagataaatttatgaaactggatctggaagatcccaatctggatctgaatgtgtttatgtcgcaagaggttcttcctgccgcaacgagcatattatag

SEQ ID NO: 19832 - DNA, 2508 bp, Artificial Sequence
  Description of Artificial Sequence: Synthetic coding sequence
atggccagcctgggcgccaacccccggcggaccccccagggccccaggccaggggctgcgagttccggctttccctcccctgcccccgtgcctgggccgcgcgaagccgaagaggaggaggtcgaggaggaagaggagttagccgagattcacttgtgtgttttgtggaacagcggttacctaggcatagcctactacgacaccagcgactccactatccactttatgcctgacgccccagaccacgaaagtctgaaactgttgcagcgggtcctggatgaaattaacccacagtctgtcgtgacttctgccaagcaggatgaaaacatgacaagattcctgggcaagctggcttcacaggaacaccgagagcccaagcggccggaaattatcttcctcccgtcagttgacttcggcctggagatatcgaaacagagattgttgtccggaaactattccttcatacctgacgccatgactgctactgagaaaattctgtttttgagctccataataccgttcgactgcttgctgacagttcgcgccctcggcggactgttaaaatttctcggacggcgccgaatcggagtggagctcgaggactataacgtttcagtgcctatccttggcttcaagaaattcatgctgacccatctcgtcaacatcgatcaggacacatacagcgttttgcagatatttaaatcagagagccacccgtcagtttacaaggtcgcctctggcttgaaggagggactgtccctgtttggaattctcaacaggtgccactgtaaatggggcgagaaactcctcaggctgtggttcacgcgtcccacacacgatctgggggagttgtcctcccgcttagacgttattcagttcttcctgctgccgcagaacctggacatggcacagatgctgcataggctcttgggccacataaaaaatgtgccattaattctgaagaggatgaagcttagccacacaaaggtgtctgattggcaggtcctctataagacagtctactctgcactgggcctcagggacgcttgtcgctcacttccccagagcattcagttgttccgcgatatcgcccaggaattctccgatgacctccaccatattgcctcacttatcggcaaggtggtggatttcgagggctccctcgccgagaacaggttcacagtcttaccaaatatagaccccgagatcgacgagaaaaagcggcgtctgatggggctgcctagtttccttactgaggtagcccggaaagagctggagaatctcgattctaggattccctcctgttctgttatttatattcctctgattgggttcctcctctcaatcccacgcttgccgtctatggtggaagcctctgacttcgagattaacggccttgactttatgttcctttccgaagagaaattgcattataggtctgcgcgaaccaaggagttggacgcactgctcggtgacttgcactgtgagatccgggaccaggagacgcttttgatgtatcaactgcagtgtcaagtcttggcaagagctgctgtcctcacaagggtgctggatctggctagcaggctggatgttttgctggcccttgctagtgctgcacgtgactacgggtacagccgacctcggtactcgccacaagtgctcggggttaggattcagaacggtagacatccccttatggagctgtgcgcccggacttttgtgccaaattctacagagtgcggtggcgataaggggagggtcaaggtcattactggaccaaactcttccggtaagagcatttatctgaaacaggttggactgatcacctttatggctctggtgggtagttttgtgcctgccgaagaggccgagattggggccgtcgatgccattttcacccgcattcactcttgtgagtccatctcacttggcttgtccaccttcatgatcgatcttaaccagcaggtggctaaggcggtcaataatgccaccgcccagtccttggtgctcattgatgaattcggaaagggtaccaacacagtggatggtctggccctactcgcggccgttctgcgacactggcttgccaggggacccacatgccctcatatctttgttgctactaattttttatcactggtgcaactacaattgctgccgcaggggcccctggtccagtatttgactatggaaacatgcgaggacggaaatgacttggtgtttttctaccaggtttgtgagggagttgctaaagcctcacacgcctcccatactgcggctcaggcgggtctgccggacaagcttgtagcaagaggtaaagaagttagcgatctcatacgctcaggcaagcctattaagcccgtgaaggatctcctgaaaaaaaatcaaatggaaaactgtcagacgctggttgataagtttatgaagctggatttggaggatcctaaccttgatctgaacgtgttcatgtcccaagaagtgctgccggccgccacctctatcctgtag

SEQ ID NO: 19833 - DNA, 585 bp, Artificial Sequence
  Description of Artificial Sequence: Synthetic coding sequence
atggccagcctgggcgccaacccccggcggaccccccagggcccccggcccggggccgcgtccagtgggtttccgtctcctgcccccgttccaggacctcgggaagcagaggaggaagaagtggaggaggaagaggagttggcggaaatccatctctgcgtcctgtggaacagtggttacctgggaattgcctactatgacaccagcgattctaccattcactttatgccagatgcgcctgaccatgaatccctcaaattgttgcagagggtgttggatgagataaacccccagagtgtggtgactagcgcaaagcaggatgagaacatgacgcggtttctggggaagctggcttcccaggagcacagagaacctaagagacccgagatcatctttcttccttccgtggacttcgggctggagattagcaaacagcggctcctgtccggcaattattccttcatccctgacgccatgacagccactgaaaagatcctcttcctatcctcaatcattcccttcgactgtctgttgaccgtcagggcactgggtggcctgttaaaattcctgggaaggaggagatag

SEQ ID NO: 19834 - DNA, 585 bp, Artificial Sequence
  Description of Artificial Sequence: Synthetic coding sequence
atggccagcctgggcgccaacccccggcggaccccccagggcccccgccccggagccgcttcttcaggcttccctagccccgcccccgtgcctggacctcgcgaagcggaagaggaggaagttgaagaggaggaagagcttgcagaaatccacctatgcgtcctgtggaactcagggtatctgggaattgcctattacgacacctctgactccactatacattttatgccagatgcccccgaccatgaatccttgaaactccttcagcgcgtgctcgatgaaattaacccgcagtctgtcgtcacttccgcgaagcaggatgagaatatgaccaggttccttggaaaattagcctcccaagagcatagagaaccaaaacggcctgagatcatctttttacctagtgtagattttggccttgagatatcaaaacagaggctattgtcagggaattactctttcataccagacgcgatgaccgctactgagaagatcctgttcctaagttccattatcccatttgactgtcttctgaccgtccgagccctgggagggctgctgaagtttttggggcgtcgccgatag

SEQ ID NO: 19835 - DNA, 2505 bp, Artificial Sequence
  Description of Artificial Sequence: Synthetic coding sequence
atggccagcctgggcgccaacccccggcggaccccccagggccccagacccggtgcagcatcttctgggtttccgagcccagccccagtgcctggaccacgggaagctgaagaggaggaagtcgaggaggaagaagaactagcggaaattcacctatgtgtcctttggaattccggctaccttgggatagcttattacgacacctccgattccacgattcacttcatgcctgatgcacccgatcacgagagtttaaagctgctccagagagttctggatgagatcaacccccagagcgtcgttaccagcgcaaagcaagacgaaaacatgactaggttccttgggaaactggcaagccaggaacatagggagccaaagaggccagaaataatattccttccaagtgtggatttcggcctcgagatttctaaacagcggctattgagtggtaactatagtttcattcccgatgctatgaccgccaccgaaaaaatcctgttcctgagcagcataattccattcgattgcttgcttacagtgcgggcactgggtggccttctaaagtttctgggaaggcggcgcataggcgttgaattagaagattacaacgttagcgtgcctatcctgggttttaaaaaatttatgctgacacacctggtcaatattgatcaggatacttactcagtgctccagatcttcaagtcagaatctcatccgtcagtatacaaagtagcttctggactgaaagaagggctgtccctcttcggaatcctgaatcggtgccattgcaagtggggggaaaagttgttacggctgtggtttacccggcctactcacgatctgggggaactcagttcccggctggacgtcatccaatttttcctgctgcctcagaacctggacatggctcaaatgctgcacagactgttgggccacataaaaaatgtacccctaatcctcaaacggatgaagctctcccacactaaggtttctgattggcaggtgttatacaaaaccgtgtactcggcattgggtctgagagatgcttgtcggtcgctcccacagtccattcagctgttccgagacatcgctcaagagtttagcgatgacttgcaccatatcgcttcattaatcggcaaagtggtggattttgaagggtccctggcagagaaccgatttactgttctgcctaacatagatccagaaattgatgagaagaagcggagactcatgggacttccttcgtttctgacggaagtagcccgcaaggaactcgagaacctggactcacgcatcccttcatgtagtgtgatctacattcctctgattggtttcttgctctccatcccgcgactcccctcgatggtagaggccagtgacttcgaaattaatgggttggacttcatgttcctgtctgaggaaaagttacactacagatcagcaaggaccaaggagctggatgcactcttgggggacctccattgtgaaatccgcgatcaggagactctcttgatgtatcaattacaatgccaggttcttgccagggccgcggttttaactcgcgtgctagacttggcgtctcgtttagatgtcctgttggcacttgcctctgccgccagggactacggctactctcggccacggtatagtccacaggtgttgggggtgcgcatccagaacggccgacacccactcatggaactgtgtgccaggaccttcgtacccaacagcacagagtgtgggggagacaagggcagagtcaaggttattaccggccctaacagctccggcaaaagcatttatttgaaacaggtaggcctcattacttttatggccctagttggaagctttgtcccagctgaggaagcagaaatcggcgcagtcgatgctattttcacccggattcattcttgtgagtcaatcagtctgggccttagcacgttcatgatcgatctcaaccaggtggctaaagctgtgaataacgccactgcccagtcactggtgctgattgatgagtttggaaagggaaccaacacggttgacggtttggcccttctggccgcggtgctaaggcactggctggcccgtggcccaacttgtccccatattttcgtcgctaccaattttctatctctcgtacagctacagctgctgccacaaggtcctctcgttcagtatctgaccatggagacttgcgaggacggcaacgacctcgtgtttttttaccaagtctgtgagggcgttgccaaggcttcccatgcctctcatacagcagctcaggccggtctgccggataaattggtagctcgtggaaaggaggtgtccgacctgattcgatccggtaagcctatcaagccggttaaggacctcctcaagaagaatcagatggaaaattgccaaacgctcgttgacaaatttatgaagctcgatttggaggatcccaatctggatctgaatgtctttatgtcccaggaagtactgcccgccgccacttccattctctag

SEQ ID NO: 19836 - DNA, 585 bp, Artificial Sequence
  Description of Artificial Sequence: Synthetic coding sequence
atggccagcctgggcgccaacccccggcggaccccccagggccccaggccaggtgccgcctcatcagggtttccgtcacccgcgcccgttcccgggcctagagaagccgaggaagaggaggtggaagaagaagaggaattggccgaaatccacctctgtgtgctgtggaatagtggttacctcggcattgcctattatgacacatcagactctactatccactttatgccggatgctccagatcatgaatcactcaagctcctgcagcgggtcctggatgaaatcaatccccagtctgtggtgacttctgcgaagcaggatgagaacatgactcggtttctgggtaagctcgcctcccaggaacacagagaacccaagcgtcctgagatcatcttcctgcctagcgtcgactttggcctggagatctctaagcagcggcttctgtccggcaactattcgtttattcctgatgcaatgaccgcaaccgaaaaaattttgttcctgtccagcattatccccttcgactgcttgctgaccgtgcgcgctctgggcgggcttctgaaatttctgggtagaagaaggtag

SEQ ID NO: 19837 - DNA, 1602 bp, Artificial Sequence
  Description of Artificial Sequence: Synthetic coding sequence
atggcccagatgctgcaccggctgctgggccacatcaagaacgtgccactgatcctaaagcggatgaagctatcacatacaaaggtgtctgattggcaagtgctttacaaaactgtttatagcgcactcggcctcagggacgcatgccgcagtttacctcagagtatacagctcttcagagatatcgcccaggaattctcagacgatttgcatcacattgctagcctcatcggtaaagtcgtagattttgagggaagtctggctgagaaccggtttacggtgctacccaatattgatccggagatcgacgaaaagaaacggagactcatgggcctgccttcattccttacggaggttgcccgcaaagagctggagaaccttgatagtcggatcccgagctgttccgtgatttacatcccactgattggattcttgctctcgatcccaagacttccgagcatggtcgaagcatcagattttgagattaacggactggacttcatgttcctgtcagaggagaagctgcattaccggagtgcgcgcaccaaagagctggatgcacttctgggggatctccattgtgagattcgggaccaagagacactgttaatgtatcagctacaatgccaggtcctagcacgggccgcagtcttgactagggtcctcgatcttgctagccgcctcgatgtactccttgccctagcttctgccgcccgcgactacgggtattcccggcctcgctacagccctcaggtgctgggcgtccgtatccagaatggtcggcaccctttaatggagctttgtgcaaggacgttcgtgcctaacagtacggagtgcggaggcgataaaggacgagtgaaggtgattaccggaccgaattcctcggggaagagtatctatctgaaacaggttgggctgatcacgtttatggcattagtgggatctttcgtcccggcagaggaggcggaaataggagccgtggacgcgatcttcacacggattcactcttgcgagagcatctcactcggcctcagcaccttcatgatcgatctcaaccaggtggcaaaggccgtcaacaacgcgactgcccagagcctcgtgttgatcgatgagtttggcaagggtaccaatactgtagatggactcgctttgctcgccgcagtactaaggcactggcttgcccggggacctacctgtccccacattttcgttgcgacaaattttctgagcctggtgcagctgcagctgcttcctcaggggccactggtccaatatctcaccatggagacatgtgaggacggtaatgatctggtcttcttttatcaagtgtgtgagggagtcgccaaagcatctcacgcaagccatacagccgcccaagccgggttgcccgataaactggtcgctcgcggaaaggaagtgtctgatctgattcggtctgggaaaccaattaagcccgtgaaggatttactcaagaaaaatcagatggaaaactgtcagactttggtggacaagttcatgaagctcgatctagaggaccccaatttggacctgaatgtcttcatgtcacaagaagtgcttccagccgcgaccagcatcctttag

SEQ ID NO: 19838 - DNA, 2508 bp, Artificial Sequence
  Description of Artificial Sequence: Synthetic coding sequence
atggccagcctgggcgccaacccccggcggaccccccagggccccaggccaggagctgcgtcgtccgggttcccttcccctgctccggtgcccggcccaagagaagcagaggaggaagaagttgaagaagaggaagaactggccgaaattcacttgtgtgtcctctggaatagtggctacttggggatcgcctactacgacacctccgacagcactattcatttcatgcctgatgccccagatcacgaatcactgaagctcttgcagcgtgtgctcgacgagatcaaccctcagtccgtcgttacgtctgcaaagcaggatgaaaacatgacgcggtttctagggaagctggcatctcaggagcatagagaaccgaaaagaccagagatcattttcctgcctagcgtggactttggcctggagatctcaaaacagcggctgttgtccggaaactactcatttatcccggacgcaatgacagccacggagaagatcctgttcctgagttctatcatcccctttgattgcctgttgaccgtgagagccctgggcggcctgctgaagttcttagggcgaagacgcatcggagtcgagctggaagactacaacgtgtctgtgccaatattggggtttaaaaaatttatgctgactcatctcgtgaacatagaccaagacacttacagcgttctccaaatttttaaatctgagtctcacccgtccgtgtacaaagtcgcatcggggttgaaggaagggctgagcctgttcggaattctgaatcgttgccattgtaaatggggggaaaaattgctgaggctgtggttcaccaggccaacacacgacctaggggagctctccagtaggttggatgtgatacagttcttccttctgcctcagaacctggatatggcacagatgctccacagattactcgggcacatcaagaatgtccctttgatcttgaagagaatgaagctatcccacacaaaagtcagtgattggcaagtgctatataagaccgtgtactcggcattggggttgcgcgatgcatgcaggtcactgccccaatcaatccaactgtttagagacattgctcaggaattttccgatgacctgcaccacatcgcttccctaatcgggaaggtcgtcgacttcgagggtagcctcgctgaaaatagatttaccgtgctgccaaatatagatcctgaaattgatgagaagaagcgtaggctgatgggtctcccaagctttcttactgaggtcgctcgcaaagaactggagaacctagactctcgtatcccatcctgtagcgtgatctacatcccactaattggcttcctcctgtccatcccgcgcctgccttccatggtcgaggcctctgatttcgagattaacggcctagacttcatgtttctgagtgaggagaaactgcactatcggtccgcccgaaccaaggagctcgacgccctgctgggagacctgcactgtgagatcagagaccaggagacactcctcatgtaccagctacaatgtcaagtcttagcaagagccgccgtgctgactcgggtcctggacctggcatcaaggctggacgtgttacttgcgctagcctcagcagcgagggattacggctattcacgaccgcgctactctccccaggtgcttggcgtccggatccagaatggtcggcatccccttatggagctctgtgccagaaccttcgtgccaaatagcacagaatgtggtggggacaagggtcgcgtgaaagtgattacaggacccaacagcagtggcaagtccatttacctcaaacaggtcggactcattacgtttatggctctcgtgggctctttcgtgcccgccgaggaagctgaaatcggcgccgttgacgccatctttacaaggattcatagctgcgaaagcattagtttaggtttgagcacgtttatgattgaccttaaccagcaggtggctaaagccgtaaataacgccaccgcccagtctctagttctgatcgacgagtttgggaaaggcacaaacacagttgatggtctcgccctgctcgctgcagtgttgagacactggctggctagagggcctacctgtcctcacatatttgtggctacgaacttcttgtcactagtccagctgcagttgctgcctcaggggcctctcgtgcagtaccttactatggagacttgcgaggatggtaatgatcttgtctttttttaccaggtctgcgagggagtcgccaaagcaagccatgcctcacatactgctgcccaggccggactacctgataagctcgtggcgagaggaaaggaggtaagtgatttgataaggtccggtaagcctattaagccagttaaagatctgcttaaaaagaaccagatggaaaattgccagacactggtggacaagtttatgaaacttgacctcgaggacccaaatttggacctgaatgttttcatgtcgcaggaggttctgccagccgctacttccatcctttag

SEQ ID NO: 19839 - DNA, 1002 bp, Artificial Sequence
  Description of Artificial Sequence: Synthetic coding sequence
aagatcctgttcctgagcagcatcatccccttcgactgcctgctgaccgttcgtgccctgggcggtttgctcaaatttctcggaagacggaggatcggggtcgagctggaagactataatgtgtcggtccctatcctgggtttcaagaaatttatgctcactcatctggtaaatatcgaccaggacacgtactccgtgctccagatcttcaaatctgaatcacacccttctgtctacaaagtagcttctggcttgaaagagggtttgtctctgttcggcattttgaacagatgtcactgtaaatggggcgagaaactcctcagactgtggttcacccgcccaacccatgatttgggggagctctcgtcccgactcgatgtgatccaattcttcctgctgcctcagaacctcgacatggcccagatgttgcacagactgttgggccatatcaagaatgtgccactgatactgaagaggatgaagttgtctcacactaaagtcagtgactggcaagtactgtataagactgtgtactccgcactaggcctgagagacgcttgtagaagcctcccgcagtcaatccaactgttcagggacattgcccaggagttctccgatgacctgcaccatatcgcctctctcataggtaaagtttacctgtcgccgcaagtcgactttgaaggcagcctggccgagaaccgcttcaccgtgctccctaacatcgatccagagatcgacgagaagaagcgccgcctgatgggcttgccgtcctttttaacggaagtggctcgcaaagaactagaaaacctcgatagccgcatcccttcttgctccgtgatctatatcccattgatcggttttctcctatctataccccgtctgccctcgatggtggaagcatccgactttgagatcaacggcttggatttcatgttcttgtccgaagaaaagttgcattacaggtccgctaggactaaagagcttgatgcactccttggatag

SEQ ID NO: 19840 - DNA, 2508 bp, Artificial Sequence
  Description of Artificial Sequence: Synthetic coding sequence
atggccagcctgggcgccaacccccggcggaccccccagggccccagacctggcgccgcttctagcggctttcccagccccgccccagtccccggaccaagggaagccgaggaagaggaggtagaggaagaagaggagctggctgaaattcacctgtgcgttctctggaatagtggatacttgggcatcgcttactacgacacttctgactcaaccattcatttcatgccggacgcccccgatcatgaatccctgaagcttctccagcgcgtcctagacgaaatcaatcctcagtctgtggttacaagtgccaaacaagatgagaacatgacccggttcctgggaaagctggccagccaggaacatcgcgaacccaagcggcccgaaattatatttctgccaagtgttgatttcgggctggagattagtaagcagaggctactgagcgggaactatagctttatccccgacgctatgactgccacagaaaagatcctcttcttatcttctatcatcccattcgattgtctgttgaccgtccgggctctaggtggcttactgaagttcctcggcagacgacgcataggagtggaactcgaggattataatgtctccgtgccaattctggggtttaagaaatttatgctgacccatttggtcaatatcgatcaggatacttatagtgtcctgcaaatatttaaaagcgaatcacatccttctgtctacaaggttgcatcgggtctgaaagaaggtctgagcctcttcgggatcttgaacagatgccattgtaaatggggtgagaagctcttgaggctctggttcactcggccaacacatgacctgggagaactaagtagcaggcttgacgtgatccagttcttccttcttccccaaaatttggatatggcacagatgctgcatcgcctgctgggacatattaagaacgttcctttgattctcaaaaggatgaagctttcccacaccaaagtttcggattggcaggttttatataaaactgtctatagcgcactaggcctaagggatgcctgccggtccctgccacagtccatacaattatttagggatattgcgcaggaattctcagacgatctacaccatattgccagcctgatcggcaaggtcgtggactttgaggggtccctggctgagaacagatttaccgtgctgcccaatattgaccctgagatagatgagaaaaaaaggagactgatgggactgccaagcttcctcaccgaggtcgctcggaaggagctggagaaccttgacagccgcatccctagttgctccgtcatctacatcccactgattggatttcttctgagtatacctcgtctcccctctatggtcgaggcatctgacttcgaaatcaacggattggattttatgttcctgagcgaagagaaattacattatagaagtgccaggacgaaggaacttgatgccctactgggcgatctgcactgcgaaatacgcgaccaagaaaccctcctgatgtaccaactccagtgccaagttctggcacgagctgccgtgcttacacgagtcctggacctcgcgagtcgcttggacgtcctccttgctttggcctcagcagcaagggattacggctacagcagacccaggtacagcccacaggttctgggtgttcgcatacaaaatgggcgtcacccactgatggagctatgcgctaggaccttcgtcccaaactccaccgagtgcggcggcgacaaaggccgggtcaaggttattacaggacccaactcaagcggtaagtctatctatctcaaacaggtcggtttgatcacctttatggctctcgtgggtagtttcgtgccagcagaagaagccgagataggcgccgttgacgcgatttttacaaggatccactcctgtgaatcaatctcactggggctgtctaccttcatgatcgatttgaatcagcaagtggccaaggctgtgaataatgcaaccgcacagtctctggtgttaatcgatgagttcggaaaaggcacaaacaccgtggatggtctggcactgctggcggctgttctgcgtcactggcttgcaagaggccctacctgtccacatatttttgttgccaccaatttcctgagccttgtgcaactgcaattgctgccccaagggcccctggtgcagtatcttaccatggaaacgtgtgaagatggaaacgacttggtgtttttttaccaggtgtgcgagggtgtggccaaggcttctcacgccagtcacaccgctgcacaggccgggctcccagacaagctcgtcgcgcggggcaaagaggtttccgacctcatacgctctggtaaacccataaagcctgtgaaggatcttcttaaaaaaaaccagatggaaaattgccaaactctcgtagacaagttcatgaagctcgaccttgaggatcccaatttggatctaaatgtgtttatgagccaggaggtgcttcccgctgccacaagcatattatag

SEQ ID NO: 19841 - DNA, 2466 bp, Artificial Sequence
  Description of Artificial Sequence: Synthetic coding sequence
atggccagcctgggcgccaacccccggcggaccccccagggccccaggcccggtgccgcaagctctggattcccttcgcctgctccagtcccaggccctcgagaggccgaggaggaggaggtggaagaagaagaggagcttgctgagattcacctctgcgtcctgtggaactcagggtacctaggcattgcttactacgacacttcagatagcacgatccactttatgcccgacgctcctgaccatgaaagcctgaaactgctccaaagggtcctggatgagataaacccacagtccgtcgtgaccagcgctaaacaggacgagaacatgacacgctttcttggaaaactcgcttctcaggaacaccgggagcccaagcgcccagagatcatttttctgcctagcgtagacttcggtctcgaaatctctaagcagcgcctcttgtctggcaactattctttcattcctgacgctatgaccgctacagagaagatactttttctgtcctctattattcccttcgattgccttctcacacccccaggcgacctcaggtttacgccaattccactgctgataccttcccaagtgagggccctgggcggacttctgaaattcctggggagaaggcgtatcggggtggaacttgaggattataatgtgtccgtgcccatactggggttcaagaagtttatgctgacccatcttgtgaatatagaccaggacacctactccgtcctgcaaattttcaaaagtgagagccaccccagcgtttataaggtagcaagcgggctcaaggaagggttatcgttatttggcatcctgaatcgctgccactgcaaatggggggaaaaactgctgcgactgtggtttacccgacctacacatgatctaggggagctaagtagccggctggacgtcatccaattcttcttactcccacagaatctggatatggcacagatgctgcaccgattacttggccacataaagaacgtacccctgattctgaagcgaatgaagctctctcataccaaagtgagcgactggcaggtgctgtacaaaacagtgtactccgccctgggtttaagggatgcgtgcagaagcttgcctcagagcatccaactttttcgggacattgcgcaggagtttagcgatgatcttcatcacatagcctccttgatcggtaaggtcgtggattttgaggggagcctggccgagaatcgcttcacggtgctgcccaatatagatccagagattgatgagaagaaaaggcggctgatgggcctgccaagtttcctgaccgaggttgctagaaaggagctggagaatttggattcacgaattccttcctgtagcgtgatctacatccctctgataggatttctgctgtctattccccgactgcccagtatggtcgaggcaagtgactttgagatcaacggtctcgatttcatgttcctctctgaagaaaaacttcactacaggtctgcaagaacaaaagagctggacgcgctgctcggggatctccattgcgaaattagggaccaggagacactcttaatgtaccagttgcagtgccaagtgctggctagagccgctgtgctgacccgagtgctagatctagcatcccggcttgacgttctgctggccttggctagcgccgctagagactacgggtactctagacctcgctacagtcctcaggttttaggggttcgaattcaaaatggtaggcacccactcatggaactgtgtgctcggacctttgtccccaattccactgaatgtggcggcgacaaagggagggtgaaagtcatcaccggccccaactcctcaggaaaatcgatatatctgaagcaggtgggactgattacattcatggctttggtgggctcgtttgtgcctgccgaggaagccgagatcggagcggtggacgcaatattcacgagaatccacagctgcgagtctattagcctgggcctgtccactttcatgatagaccttaatcaggtggccaaagctgtgaacaatgcaaccgcccaaagtctcgtcctgatcgacgagttcgggaaaggaaccaacacagtagatggactcgcccttttggctgccgttctgaggcactggcttgcaaggggcccgacatgcccccacatcttcgtcgccaccaactttctttctttggtccagcttcagctgttgccccagggccctctggttcagtatttaaccatggaaacctgcgaagacggaaacgacttggtatttttttatcaagtcagcgacctgatccggtcgggcaagccaattaaacccgtaaaagacctgttgaagaagaatcagatggagaactgtcaaacgctggtggataaatttatgaaactcgacctagaagatccaaatctggatctaaacgtcttcatgagccaggaggtcctccccgccgctacctcaattctatag

SEQ ID NO: 19842 - DNA, 1527 bp, Artificial Sequence
  Description of Artificial Sequence: Synthetic coding sequence
atgtggcccgtgctgctgttcgtgttcctgagccagaccgtgtactctgccctgggcttacgtgatgcctgtaggtctcttccccagtcaatccagctctttagggatatcgcccaagagttcagcgatgacctgcatcacatcgcaagtctgatcggaaaggtggtcgactttgaaggaagcttggccgagaatcgcttcactgtcctgcctaatatagaccctgaaatcgatgagaaaaagcgcagactgatggggttgccaagcttcctaaccgaagtggcccgaaaagaactggagaatctggacagtagaatccccagttgttccgtcatatatattccactgatagggttcctgttgtcaatcccccgtctcccatcaatggtggaggctagtgatttcgaaatcaacggactggactttatgtttcttagtgaagaaaagctgcactaccgctccgccagaaccaaggagctcgatgcattgctgggtgacctgcattgtgagatcagggaccaagaaacactcttgatgtaccagctgcaatgccaggtcctagctagagccgcagtactcaccagggttttagatctcgcatcccgactcgacgtgctactggctctcgcttctgccgctagagactatgggtacagcaggccaagatacagccctcaggtactcggcgtacggattcagaatggtcgccatccattaatggagctttgcgcaaggacctttgttcctaacagcactgaatgcggtggcgacaaaggaagggttaaagtcatcacaggaccaaacagctctggtaaaagtatttatctcaagcaggtgggtttaatcacctttatggcgcttgtcggtagcttcgtgcctgcagaggaagctgagattggcgcagtcgatgcaatcttcactcgcattcactcctgcgagtcaatctcccttggcctctctacgttcatgatcgatctgaatcaggtagcgaaagccgtcaataatgcgaccgcacagagcctagtgctcattgacgaattcggcaaaggtacgaacacggtagatggactggcgctgctggctgctgtgttacggcattggttggcacggggccccacgtgtccacatattttcgtggccaccaactttctgagcttggtccagctccagctgcttcctcagggtcccctagtccagtaccttacgatggagacttgcgaggatggcaacgatttagtattcttttatcaggtgtgcgaaggtgttgccaaagcgagccatgcttcccacaccgcagcacaagcaggcctccctgacaagctggttgccagagggaaggaggtcagtgacctcatcaggtctggtaaacctatcaaaccagtcaaagatctgctgaaaaagaaccaaatggaaaattgtcaaaccttagtggataaattcatgaagttggatcttgaggaccccaacttagacttgaatgtgttcatgtcccaggaagtgctgcccgccgcaactagcatcctttag

SEQ ID NO: 19843 - DNA, 2505 bp, Artificial Sequence
  Description of Artificial Sequence: Synthetic coding sequence
atggccagcctgggcgccaacccccggcggaccccccagggccccagacccggcgccgccagtagtggattcccaagtcccgctcctgtccctggccctagagaagcagaggaagaggaggtggaggaagaagaagagctcgccgaaattcacctgtgtgtgctttggaacagtgggtatctgggaatcgcttactacgatacaagcgacagtactatacatttcatgcctgatgcacccgatcatgagtcacttaaacttctgcagcgggtgctcgacgaaattaacccacagtcggtagttacttctgcgaaacaggacgagaatatgaccagatttctgggcaaattggctagccaggaacatcgggagcccaagcgaccagagatcatatttttgccatcagttgacttcgggctggaaatttccaagcagcgactcttgagtgggaactattcctttatccccgatgccatgacagccacggaaaagatcctgtttctgtctagcatcataccatttgattgtctactgaccgttagggcactgggcggactgctgaagtttctaggaagacgcagaatcggagtcgagcttgaagattacaatgtctctgtgcccatactgggttttaaaaaattcatgctaacacacctggtaaatattgaccaggacacctactcagtgctgcaaatctttaagtccgaatctcaccccagtgtgtataaagttgcatcaggacttaaggagggcctatccttgttcggaatcctgaatcggtgtcactgcaagtggggagagaagttactgcggctgtggttcacgagacctacacacgatctaggggagctcagctcacggcttgacgttatccaatttttccttctacctcaaaaccttgacatggcccaaatgttacaccggctgctaggccacatcaaaaacgtgcccctgattctgaagagaatgaagctgtcccacacaaaagtatctgactggcaagtcttgtataagaccgtatactcagcccttggattgcgagacgcatgtcgctcccttccacaatcaatccagttatttagggacatcgcccaagagttttccgatgacctgcatcacatcgcttctctgatcggcaaggtggtggattttgaaggatcgctcgccgaaaatagattcacagtgctgccaaatatagatcccgaaatagacgaaaaaaagaggaggcttatgggactgccctccttcttgaccgaggtggcaagaaaagaattggaaaacctggactccagaattcccagctgtagcgtcatttacatacccttgattggattccttctgagcattccccgcttgccctcaatggttgaggcttctgactttgagattaacgggctggattttatgttccttagcgaagaaaaactgcactataggagcgccaggaccaaagaactagacgccctccttggagacctgcactgtgagattagggatcaagagactttactgatgtatcagctccaatgtcaagtgctggccagggctgcggtgctgacaagagtcctagatcttgcctccagactggatgtcctgttagccctagcatccgcagctagggactatggctatagcagaccgcggtattcaccacaggtgcttggggtacgaatacagaatggacggcatcctctaatggaactgtgtgctcggacctttgttcctaactcgaccgagtgcggaggggacaaaggccgagtcaaggtaataaccggaccaaattcaagcggtaaaagcatctatttaaagcaggtcggcttaattacctttatggccctcgtgggctcattcgtgcccgctgaggaggccgaaattggcgctgtcgatgcgatatttacccgcatccactcatgcgaaagcattagcttgggacttagcactttcatgatcgaccttaatcaggtggcaaaggctgtgaataacgccactgcacaaagtctggtcctgatagatgagttcgggaagggcaccaacactgttgatgggctggctcttctcgcagccgtgctgcggcactggctggctagggggccaacgtgtcctcatattttcgtcgcaaccaatttcctctctctagtgcagctgcaactgttgcctcaaggccctctcgtgcagtacctgaccatggaaacttgcgaggatggaaatgatctggtgtttttctaccaggtctgtgagggcgtggctaaggcatcacacgctagccacacggcagcccaagcgggactccccgacaagcttgtggcacgagggaaggaggtttctgatttgatcagatctggtaaaccgatcaagccggttaaggatctgctgaagaaaaatcagatggaaaattgtcagactctcgtagataaatttatgaagctcgacttagaggaccctaatctagatctgaatgtcttcatgtcgcaggaagtattacccgctgccaccagcatcctctag

SEQ ID NO: 19844 - DNA, 2505 bp, Artificial Sequence
  Description of Artificial Sequence: Synthetic coding sequence
atggccagcctgggcgccaacccccggcggaccccccagggcccccgccccggagccgcttcaagcggatttccttccccggctcctgtgcccggtccaagggaggccgaagaagaggaagtggaggaggaagaggaactagcagaaattcacctctgtgtgctctggaattccggctatctgggcatcgcgtattatgataccagcgattccactatccacttcatgccagatgccccagatcacgagtctcttaaactactacagagggttctcgacgaaatcaacccccaaagtgtggtgacgtctgcaaagcaggatgagaatatgacccggttcttggggaagctggccagccaggagcaccgggagccaaaacgccctgagatcatttttctcccgagtgttgatttcggcctggaaatttcaaagcaaagattactaagcggcaattatagctttatccccgatgcgatgacggccactgagaagatcctctttctatcatccatcattccatttgattgccttctgacagtcagagctttagggggcttgttaaaatttctgggccggaggagaattggtgtagagttagaagactacaacgtttccgtgcctatcctaggatttaaaaagttcatgttgacacacctggtgaacatcgaccaggatacatatagtgtcctgcagatttttaagagtgaatcccacccctccgtctacaaggtggcttccggccttaaggagggtctctcactgtttggcattttgaatcggtgccactgcaaatggggggaaaagctgctgcggctatggtttaccaggcctacgcatgatctcggcgaattaagttctagactagatgtaatccagttcttcctgcttccccagaacttagacatggcacagatgttgcacagactgctgggccacattaagaacgttccacttatccttaaacgaatgaagctatcacacacaaaggtgtctgattggcaggtgctttataaaaccgtctactcggccctggggctccgggatgcctgcaggtcactacctcagtcaattcagttatttcgggacatcgcgcaggagttttcagatgatttgcaccatatcgcgagcctaattggcaaggtggtcgattttgaggggtccctggcagagaacaggtttaccgtgctgcccaatattgaccctgagattgatgaaaaaaaaaggcggctcatgggtttgcctagtttcctcaccgaggtggctcgtaaggagctcgagaacctagactctagaatcccatcttgtagcgtgatctatatcccactgattggtttcttgctatccataccacgactgccttcaatggtagaggcctccgactttgaaatcaacggactggactttatgttcttgagcgaggaaaaattacactacagaagcgcacggactaaggagttagatgccctgctgggagatttgcactgcgaaatacgggaccaggaaactctgctgatgtaccagctccaatgtcaagtgctcgccagggcggccgtcctgacccgtgtactcgatctcgcgagtcggctggacgtacttctagcgctggcatctgctgccagagactatggatacagcaggcctcggtattccccgcaggtgttaggtgtgcgcatccaaaatgggcggcaccccctgatggagctgtgtgctcggacttttgtgccaaattctacggagtgcggtggagataaaggccgcgtgaaagttatcaccggacccaacagttctgggaagtcaatatacctgaagcaggtggggctgattacgttcatggctctggtgggtagctttgtgccggccgaggaagctgagataggcgccgtggacgctatatttaccagaatccacagctgtgagtcaataagtttgggcctgagtaccttcatgatagacctgaatcaggtggccaaggcagtgaacaatgcaaccgctcagtcgctggttttaatcgacgagtttggtaagggaaccaacactgtcgacggtctggccctcttggccgccgtcctgcgccactggctcgctagaggacctacgtgtcctcatatcttcgttgccacaaatttcctgtcactcgtgcagctgcagcttttaccccaaggacccctggttcagtacctgacgatggagacttgcgaagatggcaatgaccttgtttttttctaccaggtgtgtgagggcgtggccaaggccagtcacgcttctcacacagcagcacaggcaggtctgcctgataagttggtagctcggggaaaggaggtgagcgatttaatccgaagcggcaagccgattaagcccgtgaaagacttgctaaaaaagaaccaaatggagaactgtcagacactggtagataagtttatgaagctggatctagaggatcctaatctggacctgaacgtattcatgagccaggaggtgttacccgcagctactagtatcttatag

SEQ ID NO: 19845 - DNA, 585 bp, Artificial Sequence
  Description of Artificial Sequence: Synthetic coding sequence
atggccagcctgggcgccaacccccggcggaccccccagggcccccgccccggcgctgctagctctggcttcccctctcccgctcccgtccccggcccaagggaggcagaagaagaggaagttgaggaagaagaagaactagctgagatacatttgtgcgtcctctggaattcggggtatctcggcattgcctactatgatacatctgatagcactatacactttatgcccgacgcaccagatcacgaaagtctaaagctgctgcagcgtgtgctagacgagattaaccctcaaagcgtagtaacatcagccaagcaggacgagaacatgactcgcttcttagggaagctggcctcgcaggagcaccgggaaccgaagcggcctgaaatcatatttctgccttcagtcgatttcgggctggaaatttctaagcagcggctactgtctggaaattactcatttattcccgacgccatgaccgccactgagaagatcctgtttctgtccagcattattcccttcgactgcctgctaacagttcgcgctcttggtgggctgttgaagttcttgggtaggaggcgctag

SEQ ID NO: 19846 - DNA, 2469 bp, Artificial Sequence
  Description of Artificial Sequence: Synthetic coding sequence
atggccagcctgggcgccaacccccggcggaccccccagggccccaggcctggcgccgctagctccgggttcccctctccggctcccgtacccggtccgcgcgaggctgaagaggaagaggtcgaggaagaagaagagttggccgagatccacctgtgcgtcctgtggaactcagggtacttagggatagcttactacgacacaagtgacagcaccattcactttatgcccgacgcccccgaccatgagagtctcaaactgctgcagcgcgtgctggacgaaatcaacccccaaagcgtggtcaccagtgccaagcaggatgaaaacatgactcggttcttagggaagctcgccagtcaggagcaccgcgagccaaagcggcccgaaattatctttttaccatctgtcgacttcggactcgaaatttctaagcagcggctattgtccggcaactacagctttatccctgatgcaatgacggccactgagaaaatactttttctgtcgtccataatcccctttgattgtcttctgactcctcctggggacctccgattcacacccatcccattattgattccatcacaggtccgagcactcggaggcttgttgaaattcctggggcgtcgaagaatcggggtggagctggaggattataatgtctccgtacccattctaggcttcaaaaaatttatgctcacgcatcttgtcaatatcgaccaggacacctacagtgtccttcagattttcaagagcgagagccacccctcggtgtacaaagtggcttcaggcttaaaagaaggcctctctctgtttggaatactcaataggtgtcactgcaaatggggtgaaaaactgctgcgcctgtggttcaccaggcccactcatgacttgggcgagctttcatcacggttggatgtgattcaatttttcctgcttccccagaatctggatatggcccagatgctccaccgtctgttgggacacattaagaacgtgccgttgatcctgaaacgtatgaaactttcacacactaaggtaagtgattggcaggttctgtataaaacagtctattctgccctggggctgcgcgatgcatgtcgatctctgccacagagtatacaactttttcgggatatagcccaagaattctctgacgatttgcaccacattgcttcactgataggaaaggtcgtcgatttcgagggaagcctcgctgagaacagattcacagtgctgccaaacatcgaccctgagatagacgagaaaaagcgaagactgatgggacttccctcctttcttacggaggtcgctaggaaggaacttgaaaacttggatagccggattccctcctgctctgtcatctacatccccctgatcggttttctcctttccattccgagattgcctagcatggtggaagctagtgattttgaaattaacggcctggactttatgttcttgtcagaagaaaaactgcactacagatcagcgcgcactaaggaactggatgcactgctgggcgatctgcattgtgagatccgtgatcaggagaccctcctgatgtatcagctgcagtgtcaggttctggcacgagccgcagtactcacccgagtgttagacctcgcctcaaggcttgacgtcctactcgctcttgcaagcgccgccagggattacgggtactcgaggccccgatatagtcctcaagtgctgggggtccgtattcagaacggaagacaccctctgatggaactctgcgccagaacgtttgtgcctaattctactgagtgcggcggagataaaggacgcgtgaaggtcattaccgggccaaactcaagtggaaagagcatctacctcaagcaggttggactgatcacctttatggcactggtaggatccttcgtccccgcagaggaggcagaaatcggcgccgttgacgcgatctttactaggatacatagctgcgagtccataagtctgggcttaagcactttcatgattgacttgaatcagcaagttgccaaagccgtgaataatgcaactgcccaaagtctcgtgctgatagacgagtttggaaaggggacgaacacagtcgacggcctggcgctcctcgcagcagttctgaggcactggctggcccgaggcccaacgtgtcctcatattttcgtcgccactaactttctgtccctggtccagctgcagctgctcccacagggtcctctcgtgcagtacctgactatggaaacctgcgaggacggaaacgaccttgtgtttttctatcaagtctccgatcttattaggtcaggcaagcccatcaaaccggttaaagatttgctcaaaaaaaatcaaatggagaattgccagacgcttgtggacaagtttatgaaattggacctggaagatccgaacctggacctgaatgtgttcatgagccaggaggtccttcccgccgccacgagcatcttgtag

SEQ ID NO: 19847 - DNA, 471 bp, Artificial Sequence
  Description of Artificial Sequence: Synthetic coding sequence
accgcccagagcctggtgctgatcgacgagttcggcaagggcaccaacactgtcgacggcctggccttgctggccgccgttttacggcactggctggctcggggacccacctgtccgcacatttttgtcgctaccaacttcctctctctggtccaactacaattgttaccacagggcccgctcgtgcaataccttgtctgcgagggcgtggccaaggccagtcatgcttcgcatactgccgcccaggcgggtctgccagataaactggtagccagagggaaggaggtgagtgacttaataagatctggcaaacccatcaaacccgtcaaggacctcctaaaaaagaaccaaatggaaaactgccagaccttagtggataagtttatgaagctcgacctagaagatcccaacctggacttgaacgtgtttatgtcccaggaggtgcttccagcagcaacctcgattttgtag

SEQ ID NO: 19848 - DNA, 2505 bp, Artificial Sequence
  Description of Artificial Sequence: Synthetic coding sequence
atggccagcctgggcgccaacccccggcggaccccccagggcccccgaccgggtgccgccagcagcggatttcccagtcccgcccccgtgcctggcccaagagaggctgaagaagaagaagtggaagaggaggaagagctggctgaaattcacctttgcgtcctgtggaattccggctatctcgggattgcatactacgacacctccgatagtacgatccatttcatgcctgatgcaccagatcacgagagcctcaaactgctccaacgggtccttgacgaaattaacccccagagcgtagtgacgtctgcaaagcaggacgagaacatgacaagattcttgggaaaactcgccagccaggaacaccgcgagccaaagcggcccgagattattttcctaccatcggtagatttcggactcgagatctctaaacaacggttactgtctgggaattatagctttatccctgacgcaatgacggcgaccgagaaaattttgttcctgtctagtatcataccctttgactgcttactgacggtgcgagctttgggcggcctgttgaaatttctgggtcggaggcggatcggggtggagctggaggattataacgtctccgtaccaatcctggggttcaagaagtttatgcttacacatctggtgaacattgatcaggacacctactccgtacttcaaatcttcaaatcagaaagccatccgtctgtgtataaggtagcatcagggttaaaagaaggcctgtcactgtttggcatcctgaaccgctgtcactgtaaatggggcgaaaagctgcttcggctgtggtttactcgcccgacacacgacttaggtgagctcagctctagactagatgttattcaatttttcctcttgccacagaacctggatatggctcagatgttacaccggcttctgggacacatcaagaacgtgcctctgattctgaaaagaatgaaactatcacacaccaaagtgtcagactggcaagtcttgtataaaactgtctattccgccctcggccttagagacgcttgtcgcagcctcccccagagcattcaacttttcagagatatcgctcaggaatttagcgacgatctgcaccatattgcctctttaattggcaaagtagtggactttgaaggcagcctcgctgagaatagattcacggtgctgccaaacattgatccagagatcgacgagaagaagcggcgtttgatgggcctgcccagcttcctaacagaggtagccagaaaagagctggaaaatctcgatagcagaataccctcatgttccgttatctacattccgctaatcgggttcttactgtctattccccggcttccgtccatggttgaggcctccgattttgagattaacggcctagacttcatgtttctctccgaagaaaaactccactatcgttccgctaggactaaagagctggacgcattattgggtgacttgcactgtgagatcagggaccaggagactctcctgatgtaccagctgcaatgccaggtattggccagggccgcagtcctgaccagagtcttggacttggctagcagactcgacgtactgctcgccttggcatcagcagctagggattacgggtatagccgaccacggtactctcctcaagtgctaggagtacgcatccagaatgggaggcacccgctgatggagctgtgcgcccggactttcgtccccaactcgaccgagtgcggcggtgataagggacgagtcaaggtaattacaggacccaacagctccggaaagagcatctatctcaaacaagtgggactgatcaccttcatggcactcgtcggttcattcgtgcccgcagaagaagctgagatcggagccgtggacgcaatctttacacgcattcactcctgcgagtcaataagcctggggctgtctacattcatgatcgatcttaatcaggtggccaaggcagtaaacaacgccactgcccagtccctcgtattgattgacgaatttggtaaaggcactaacaccgtcgatggactcgctcttttggccgccgtgctgagacactggctcgcgaggggccccacttgtccccacattttcgttgcaactaatttccttagtctggtgcagctgcagcttttgcctcagggccccttagtgcaatacctgactatggaaacatgcgaggacggcaacgacctagtgttcttctaccaagtttgcgagggcgttgcaaaggctagtcacgcctctcacaccgctgcccaggccggactgcctgataagttagttgcaaggggcaaggaagtatcggacctgatacgctccggaaaacccataaagcctgtaaaggacctcttaaagaagaatcaaatggagaattgccagacactggtagataagtttatgaagcttgatctagaggacccgaatcttgacctcaatgtatttatgtctcaggaggtcctccctgccgccacctccattctttag

SEQ ID NO: 19849 - DNA, 2505 bp, Artificial Sequence
  Description of Artificial Sequence: Synthetic coding sequence
atggccagcctgggcgccaacccccggcggaccccccagggcccccgacccggcgcggccagctccggatttcccagtccggctcccgtgccaggacctagggaggccgaggaggaagaggtggaggaggaagaggagctggcggagattcatctgtgcgtactgtggaattctgggtatttgggcatagcgtattatgataccagtgattccactattcatttcatgcccgatgcacccgaccacgagtctctgaaacttttgcagagagtcttggacgagattaacccacagtcagttgttactagcgctaagcaggatgagaatatgactagatttcttggtaaactagcctcacaagaacatagggagcctaaacggcccgaaatcatctttctcccatctgtggattttggactagagataagcaagcagagacttctgtccggcaactactccttcataccggacgcaatgaccgctaccgaaaagatcttatttctgtcgtccattattccctttgactgcttattgactgtccgcgctctcgggggattgctaaagttccttggacgaaggcggattggtgttgaactggaagactacaacgtttccgtgcccatcctcgggttcaaaaaattcatgctgactcatctggtgaacatcgatcaagacacctactcagtgctgcagatctttaagtcagagtcccatccttccgtctataaagtcgcctccggtctaaaagagggcctgagtcttttcgggatactgaaccggtgtcattgcaagtggggcgaaaaactgctgcgcctctggttcaccagacccacacacgatttgggcgaactgtcctcgcgcttagatgtcatccaatttttcttgctgccccagaacttggacatggctcaaatgcttcatagactgttaggccatatcaagaacgtacccctcattctgaaacgcatgaagctgagccataccaaagtcagcgactggcaggtgttgtacaagaccgtctacagtgccctgggattgcgcgacgcctgccgcagtctgccccagtccatacaactgttccgggacatagcccaagaattttccgacgacctgcaccacatcgcttcattgattggaaaggtggtggattttgaggggtctctagcggagaaccgtttcactgttctgcccaacatcgacccagagattgacgaaaaaaaacgacggttaatggggctgccttcatttttaacagaagtggcaagaaaagagctggaaaacctcgattcgcgcatcccatcatgtagcgttatctacatccctctgattggcttcctactatctatcccgcggttgcctagtatggtagaggcatcagactttgagattaacggattggacttcatgtttctcagcgaggagaaactccactaccggagcgctcgcacaaaggaactggacgcactcctgggggatcttcattgtgagatcagggaccaggaaaccctgcttatgtatcagcttcagtgccaagtgttagcccgagcagcagtccttaccagagttctggatctcgcaagccggctggacgtgctgctcgccctggcatccgcagcacgggactacggctacagcagaccccggtatagcccccaagtactgggcgtgcgaatccaaaacggccgacacccactcatggagctctgtgcacgaacattcgttcccaactccacggagtgtgggggcgataagggacgcgtgaaagtcattaccggtcccaacagcagtggaaagtctatatacctgaagcaggtcggcctgataacctttatggctttagtgggtagtttcgttccggcagaggaggccgagattggcgcagtggacgcaatcttcacacggattcattcttgtgagtccatctctctagggctctctacctttatgatcgatctaaaccaggttgccaaggctgtgaataacgccaccgcccaatctttggtgctgatcgatgaatttgggaagggaacaaatactgtcgacggccttgctctcctggcggccgtccttaggcattggctggcgcggggcccgacctgcccgcatatcttcgtggcaacaaacttcctatctctggttcagttgcagctactcccacagggtcccctagtgcagtatctgaccatggaaacatgcgaggatggcaatgacctggttttcttctatcaggtatgtgagggtgtggccaaggcgagccacgccagccacacagctgctcaggcggggcttccagacaagctggtggccagaggaaaggaagtgagcgacctgattcggtccggtaaaccaatcaagccagttaaggatctactcaagaaaaatcaaatggaaaactgtcagacacttgttgataagtttatgaagctggatctcgaagatcccaatctggacctgaacgtgtttatgagccaagaagtgttgccggccgcaacctctatactctag

SEQ ID NO: 19850 - DNA, 471 bp, Artificial Sequence
  Description of Artificial Sequence: Synthetic coding sequence
accgcccagagcctggtgctgatcgacgagttcggcaagggcaccaacaccgtggatggattagctttgctggcggccgtactccgacactggctggccaggggacctacatgcccgcacatttttgtggcaactaattttctgtcgctcgtgcaactccagctcctgccacaggggcccctggtgcaatacctagtttgcgagggcgtagccaaggcatcacacgcctcccatacggccgcccaagcaggactccctgacaagcttgtcgcacggggcaaggaggtctcggatctcatacggtccggaaagccaattaagcctgtgaaagacttgctgaagaagaatcaaatggagaactgtcagactttggttgacaagttcatgaagctggacctagaggacccgaacctggacctgaacgttttcatgagccaggaggtattacccgccgcaacctccattctgtag

SEQ ID NO: 19851 - DNA, 2466 bp, Artificial Sequence
  Description of Artificial Sequence: Synthetic coding sequence
atggccagcctgggcgccaacccccggcggaccccccagggcccccgacccggtgcagcttcgtccggattcccttctcccgcccccgtacctggaccacgcgaagccgaagaggaagaggtggaggaggaggaggaactcgccgaaatccacctgtgcgtactctggaactcaggttatctcggaattgcctactacgatacgagcgacagtaccatacattttatgcccgacgcgcccgatcacgaaagcctgaaattgctgcaacgggtgcttgacgaaattaatccccagtccgtggtgacatccgctaagcaagatgagaacatgaccagattcctcggaaagctggccagccaggagcatagagaaccaaaacggcctgagataatctttctccccagcgtagactttggcttggagatttctaagcaaagactgctgtctggcaattacagcttcatcccagatgcgatgaccgcgacagagaagattctctttctgtcaagcataattccgttcgactgtttgctgactccaccaggcgatctccggttcacccctatccctctactcattccttcccaagtccgtgcgctggggggacttcttaaatttctggggcggaggcgcatcggagttgaactggaagattacaacgtttccgtacctatcctggggtttaagaagtttatgttaacccaccttgtaaacatcgaccaggacacatatagtgtgctccagatctttaagtctgagtcccaccccagtgtatataaggttgctagcggactcaaagagggattatccctcttcggcattttaaatagatgtcattgtaaatggggcgagaagctgttgagactgtggtttactcgccctacccatgaccttggtgagttgagttccaggttggacgtgatacagtttttcctgcttccccagaacctcgacatggcccagatgctccatagactgctggggcatatcaaaaatgtccccttgatcctgaagaggatgaagttaagccatactaaggtgagcgattggcaggtgctttacaaaaccgtatacagtgctttgggactccgtgacgcttgccggtcactacctcaatccattcagctgtttagggatattgcccaggaattctccgatgatctgcatcacattgcaagcttaattggtaaagtggtggatttcgaaggctcactggcagagaacagatttactgtgcttcctaatatagatcctgagatcgacgaaaagaagaggcgcttaatgggacttccttcttttctcacagaagttgcccggaaggagttagaaaacctggactcacgtatccccagttgtagcgtcatctacatcccattgatcgggttcctgctgtccatcccacgcctgcccagcatggtcgaagcatcagacttcgagatcaacggcctcgactttatgtttctcagtgaggagaaacttcactaccgaagcgctcggaccaaagagctggacgccctgctgggtgacctgcactgtgagatacgagaccaggagacccttctgatgtaccagctccagtgtcaagtgctagctcgcgcagctgtgctgaccagggttttggatctggcttctcgactggatgtactgctggctttggcaagcgccgccagagattacgggtatagcaggcctcggtattccccgcaggtgctgggcgtgcgaatacaaaatggaaggcaccccctgatggaactgtgtgcccggacgttcgtgccgaactctactgagtgtggcggagataagggacgcgtgaaggtgattacaggacctaactcgtccggaaaatctatttacctgaagcaggtcgggctcataacattcatggccttggtggggtcctttgttcctgcagaggaggctgagatcggtgcggtcgatgctattttcacacgtatccacagctgtgagtctatctcactcgggctgtctactttcatgatcgatctcaatcaagtcgcaaaagctgtgaacaatgctaccgctcaatccctcgtgctgattgatgaatttgggaaggggacaaataccgtggatgggctggccctgctcgcagccgtgcttagacactggttggctcgggggcccacctgtccccacatatttgtagcaacgaattttctgtctttggtgcagttacagctcctgccccaggggccacttgtacagtacctcactatggaaacctgtgaagacggtaacgacttagttttcttttatcaagtgtctgacctgatccgaagcggaaagcccattaaacctgtaaaggacttgctgaagaagaatcagatggagaattgtcagaccctcgtcgataaattcatgaaactggacctggaggatcctaaccttgacttgaacgtgtttatgtcacaagaagtgctccctgccgcaacatccatcctgtag

SEQ ID NO: 19852 - DNA, 2556 bp, Artificial Sequence
  Description of Artificial Sequence: Synthetic coding sequence
atggccagcctgggcgccaacccccggcggaccccccagggcccccgcccgggggcagcttcatcaggcttcccctctcccgccccggtaccagggccgcgtgaggcagaagaggaggaggtggaagaggaagaagaactggcagagattcacctgtgcgtgctctggaactctgggtatctcgggattgcctactacgatacctccgattcaactatccacttcatgcccgacgctcccgatcatgagagtttaaagctgcttcagagggtgctggatgagattaatccccagtcggtggtgacgtccgccaaacaggatgagaatatgaccaggtttctggggaaattggcgagccaggagcacagggaacctaagagaccggagatcatattcctgcccagcgtggactttgggctggaaatctccaagcagaggctcttatctggcaattattcattcatacccgacgcaatgaccgcgaccgagaagatactctttctgtcatccataatccccttcgactgtttgcttacacctcccggggatcttaggtttacacccatccccctgcttatccctagccaagtgcgggcactgggaggactgttaaaatttttaggcaggagacgcataggcgtcgagctagaggattacaacgtgtccgtgccaatcttgggtttcaaaaagttcatgctgacacatttagtaaacatcgatcaagatacctattccgtgctgcagatctttaagtccgaatcacaccctagcgtctataaggtggcgagtgggctgaaagagggattatcattattcggcatccttaaccggtgccattgtaaatggggtgagaaactcctaaggttgtggttcacaagacccacacacgacctaggcgaactttcaagtaggctcgacgtaattcagttttttcttctgccacagaacctcgacatggcccagatgctgcatcgtctccttggccatatcaagaacgtaccactgatcttgaaacggatgaagttatctcacactaaagtaagcgactggcaggtgctatataaaactgtctactctgccctggggcttcgggacgcttgccgctcattacctcagtctatacagctcttcagagatattgcccaagaattcagtgatgatctgcaccacattgccagtctgataggaaaagtagtcgattttgaaggttccctggccgagaataggttcaccgtgctccctaacattgatcccgagatagacgagaaaaagaggcgcctcatgggactcccctcctttcttacagaagtcgcacgcaaggagctggagaacttggacagcagaatcccctcctgttctgtgatttacatacccctcatcgggtttctactatccatccctagactaccgagtatggtggaggccagtgacttcgagatcaatgggctagacttcatgtttctttccgaggagaagctgcactataggtcagcaagaaccaaggaacttgacgccttgctgggcgatctacactgcgagatcagagatcaggagaccctgctcatgtaccagctgcagtgtcaggtcctagccagggccgccgtactgacacgcgttctggatctggcatcccgccttgacgttctgttggccctggcttccgctgctcgggactatgggtattcccgcccccgatatagcccacaagtactcggagtgcgaatccagaacggtcgtcatcctctgatggagctttgtgctcgcacctttgtgcccaactccacagaatgtggaggcgacaagggaagagtgaaggtgatcactgggccaaactcttctggcaaatcgatctatctaaaacaagtgggactgattacattcatggcgctggtggggagcttcgtgccggccgaggaagccgagatcggagccgttgacgccatatttacccggattcactcttgtgagtctattagtttgggtttatcgacgttcatgatcgatctgaatcaggtggcgaaagctgtgaacaatgcaactgcccagagtctcgtgctcattgatgaatttggcaaaggcaccaatacagtggatggcctggccctgcttgctgcggtcctccgccactggctggcccgcggaccaacatgtccccacatcttcgtggccacgaatttcttgagtctagttcaattacagctcctcccccaaggccccctggttcagtacctgaccatggaaacatgtgaggacggcaatgacctcgtcttcttctatcaggtgtgtgagggtgtggccaaagcttcacacgcatcccacacagcggcacaagctggtttaccggacaagttggtggccagggggaaagaagtttccgacttaatccgttcaggaaaaccgatcaaaccagttaaggacttgctgaaaaaaaatcagatggagaattgtcagacccttgtagacaaattcatgaaactagaccttgaagaccccaatctcgatctcaacgtcttcatgagtcaggaggttttgcccgccgcaacctccatcctatag

SEQ ID NO: 19853 - DNA, 1602 bp, Artificial Sequence
  Description of Artificial Sequence: Synthetic coding sequence
atggcccagatgctgcaccggctgctgggccacatcaagaacgtgcctcttatcctgaaaaggatgaaacttagccatacaaaggtaagcgactggcaggtcttgtacaaaacagtctattcagcgctaggtcttcgtgatgcgtgtcggagtttacctcagtctatccagctgttccgggacatcgcccaggagttctccgatgatctccatcatatcgcctccctcataggcaaggtcgtcgactttgaaggtagccttgcagaaaaccgctttaccgtgctgccaaacattgatcccgagatcgatgagaaaaaacgccggctgatgggactcccatcgtttctgaccgaggtggcccgtaaagaactagaaaacctagactcccgcatcccatcgtgctctgtaatttatattccactgattggtttcctgctttctataccacggttaccatctatggttgaggctagcgatttcgaaattaatgggctagatttcatgtttttatcagaggagaaactacattaccgctcagccagaactaaggagctggatgcactgctgggggacctccactgcgagatcagagatcaggagacattgcttatgtatcaactgcagtgtcaagtcttggcccgcgccgcagtcctaacccgggtgcttgatttggcttcccgcctggatgtattgctggcactggcctccgctgcccgtgactacggctactcccgaccaagatacagcccacaggtgcttggagtacggatacagaacggaagacacccactgatggagctttgcgctaggacattcgttcctaattcaactgagtgcggcggagataagggcagggtcaaggtaatcactggccctaattcctcaggcaagtcaatatatctgaaacaggttggccttatcacttttatggccctggttggcagtttcgtccctgccgaggaagccgaaatcggagccgtggatgctattttcacgcggatccactcatgcgagtctatcagcctcggcctttctacattcatgatagatctcaaccaggtcgccaaggccgtgaacaacgccaccgctcagtcactcgttctgattgacgagttcggcaagggaaccaatactgtagacggcctcgcgttgttagcagcagtgctgcggcactggcttgcccggggccccacatgtccgcacatatttgtggccaccaacttcttgtcattagttcaactccagctgctgcctcagggcccccttgttcagtatctcaccatggaaacgtgtgaagacggcaatgatttagtatttttctatcaagtctgcgaaggagtggcaaaagcctctcatgccagccacaccgccgcccaagcaggtctgcccgataaactcgtcgctcgaggtaaggaggttagtgacctcatcagaagtggcaaacctattaagcctgttaaagatctgctgaaaaaaaaccagatggagaactgtcagacgctggtggataagtttatgaaattagacttggaagaccctaacttagacctcaatgtgttcatgtcacaagaagtactgcccgcagccaccagcattctgtag

SEQ ID NO: 19854 - DNA, 765 bp, Artificial Sequence
  Description of Artificial Sequence: Synthetic coding sequence
atggccagcctgggcgccaacccccggcggaccccccagggccccaggcccggtgccgcctccagcgggttcccatcacccgcgcccgttcccgggccccgcgaggcagaagaggaagaagttgaagaggaggaggaattagccgagatacatttgtgtgttttgtggaattccggctatctcggcattgcctattacgacacatccgatagcacaatccattttatgcctgatgcgcccgaccatgagagcttaaagcttcttcagagggtgcttgacgagatcaatccacagagcgtagttacgagcgccaagcaggatgaaaacatgacaagattcctgggaaagctcgcgtctcaagagcatcgcgaacctaagcgtcccgaaatcatctttcttccctccgtagattttggcctcgaaatatcaaagcagagactcctgagcggaaactatagtttcatccccgatgcaatgaccgccaccgagaagatcctgtttttgtcttccatcatcccttttgactgtctgctgacggtgagagctctcgggggactccttaagttcttgggcaggagaagaatcggcgtcgaattggaggattataacgtgagtgtccctatcctggggttcaagaaatttatgttgactcacctcgtcaacatcgatcaggatacatacagactggagtgcaatggcgctattagcgcacaatgcaacctgtgcctcctcggctcatcagactccccggctagcgcttcttag

SEQ ID NO: 19855 - DNA, 816 bp, Artificial Sequence
  Description of Artificial Sequence: Synthetic coding sequence
atgttcctgagcgaggagaagctgcactaccggagcgcccggaccaaggagctggacgcactcttaggggacctccattgtgagatacgcgatcaggaaacacttttaatgtaccaactccaatgccaggttttggcaagagctgccgtcctcacacgcgttctcgatctggccagcagactcgatgtgttactggcgctggcatccgccgcccgtgactatgggtactcaagaccccgctactccccccaagtcctcggcgtccgcattcagaacgggaggcacccgctgatggaactgtgcgccagaacgttcgtgccgaattctaccgagtgcggaggagataaggggagggtcaaggtgattaccgggccaaacagctccggcaagtccatctatctgaaacaggtcggactgattacattcatggcgctcgtcggatcattcgtgcctgctgaggaggccgagatcggggcggtggacgctatatttacacggatacactcatgcgagtctatatccctggggttgtctacattcatgattgatctcaaccaggtcgcaaaggcggttaataatgccacagcccagtccctggtgcttatcgatgagttcggtaaaggtacgaacaccgtagatggtctggctctcctagccgccgtcctgcgccactggttagcacggggaccaacctgtccacacattttcgtcgccaccaatttcctcagtctggtgcagcttcagctccttccgcagggcccacttgtccaatacctcgactggcctcgagttagcggccaagaaggaggcgattag

SEQ ID NO: 19856 - DNA, 1602 bp, Artificial Sequence
  Description of Artificial Sequence: Synthetic coding sequence
atggcccagatgctgcaccggctgctgggccacatcaagaacgtgccattgatactcaaacgaatgaaactatctcacaccaaggtgtcagactggcaggtgctctacaagaccgtctacagcgccctcggcctgagggatgcctgccgatccctaccccaatctattcaactgtttagagacatagcccaggagtttagcgacgacctgcatcacattgcatcactaatcggcaaggtggtcgacttcgaaggctcccttgcagagaacaggtttacagtgctcccaaatattgaccctgagattgatgagaaaaagcgcaggctcatgggtctgccctcctttctgactgaggtcgcacgtaaggagttggagaacctggactcccgaattccctcttgttccgtgatttacatccccctgatcggcttcctgctaagcattccaaggctgccctctatggttgaggcttctgactttgaaatcaacggtctcgactttatgtttttatccgaagaaaaactgcattaccggagcgccaggacaaaagagttagatgccctcctcggagacctgcactgcgaaattagggatcaggagaccttgctgatgtaccagctgcagtgtcaggttctggcgcgcgccgccgttctgactcgagttttggatctggcgtccaggcttgacgtccttcttgccctcgcttctgccgcccgagactatggatacagtcggcccaggtactctccacaagtgcttggtgtgcgaattcagaatggacgacatcccctgatggaactttgcgcacgcacctttgtgccaaattcgacagagtgcggaggagacaagggccgtgtgaaagtcatcaccggccccaactcatccggcaagagcatctacctgaagcaggtaggtctgattactttcatggctttagtgggatcatttgtgcccgccgaagaggccgagataggcgccgtcgatgccatttttacccggatccactcatgcgaatctatttcactgggcctgtccaccttcatgattgacttgaaccaggtcgccaaagctgtaaacaatgctacggcccagtccttggtactgatcgatgagtttggcaagggcactaacacagtggacggcctggccctgctggctgccgtactgcgccactggctagctcgtgggcccacctgtccacacatttttgtggccaccaactttttgtctttagttcagctgcagcttctgcctcagggtccattggttcaatacctgactatggagacatgtgaggatggaaacgatctggtctttttctaccaagtgtgtgagggcgtcgccaaagcctcacacgctagccatactgccgcccaagccggactgccagataaactggtagctagggggaaagaagtgagcgatttgatcaggagcgggaagccaattaaaccagtcaaggacctgcttaaaaaaaatcagatggaaaattgccagacactggtggacaagtttatgaagctcgatctggaagatcccaatcttgacttgaatgtttttatgtcgcaggaggtgctgcccgcggccacaagcatcctgtag

SEQ ID NO: 19857 - DNA, 816 bp, Artificial Sequence
  Description of Artificial Sequence: Synthetic coding sequence
atgttcctgagcgaggagaagctgcactaccggagcgcccggaccaaagagctggatgcccttttgggggatctacactgcgagattcgcgaccaggaaacacttctgatgtatcagctgcagtgccaggttttagcaagagctgcagtgctcaccagagttctggacctcgctagtcggctggacgtcctcctggcactggcgtctgctgcaagagactacggctatagcagacccagatacagtccccaagtcctgggtgtgaggatccagaacggacgccaccccctaatggagctgtgcgcaagaacattcgttccaaactccaccgagtgtggaggtgataagggccgagtgaaggtgattaccggcccaaattcctccggaaagtctatctatctcaagcaagtcgggctcatcaccttcatggctctcgtagggtccttcgttccagcagaagaggccgagattggcgctgttgacgctatcttcacacgcatccactcttgcgagagcatctctttaggtctcagcacatttatgatagatctgaatcaggttgctaaggctgtgaataatgccactgcacagtcactggttctgatcgacgaatttgggaagggaacaaacaccgttgatggcttagctttgctcgccgccgtgctacggcattggctggcccggggcccaacctgtccccacatcttcgtcgccacaaactttttgtcacttgtgcaactgcagctgctgccacagggcccattggttcaatatctcgactggcctagagtgtccgggcaggaaggaggggattag

SEQ ID NO: 19858 - DNA, 765 bp, Artificial Sequence
  Description of Artificial Sequence: Synthetic coding sequence
atggccagcctgggcgccaacccccggcggaccccccagggcccccgtcccggagcggccagctctggctttcctagtccggcacccgttcctggacccagagaagcagaggaggaggaagtggaggaagaagaagagctggccgagatacacttgtgcgtgttgtggaattctgggtacctaggtattgcctattacgatacatctgatagcacgatacacttcatgccagacgctcccgaccatgaatctcttaaactcttgcagcgggtattggacgagatcaacccacaatctgtggtgacttctgccaagcaggacgagaacatgacgaggttcctgggcaagttagcctcacaggagcatcgcgaacccaagaggcccgagataatcttcctccccagcgtggatttcgggctcgagattagtaaacaacgactgctctccggaaactacagctttataccagacgccatgacagccaccgaaaaaattctctttctgagttccatcattccctttgattgcttactgactgtccgcgcactagggggtttgctgaagtttctcggcaggaggcggataggggtagagctcgaagactataacgtgagtgtgcccatactggggttcaaaaagttcatgctgactcatctcgtcaacattgaccaggacacttatagactggaatgcaacggcgcaatttctgcccagtgcaacctttgcctattgggcagctcagattcccccgcatcagcttcctag

SEQ ID NO: 19859 - DNA, 765 bp, Artificial Sequence
  Description of Artificial Sequence: Synthetic coding sequence
atggccagcctgggcgccaacccccggcggaccccccagggcccccggccaggggcggcttcaagcggatttccaagcccggcccccgtgccaggccctcgggaggcagaggaagaggaggtagaagaggaggaagaactcgcagaaatccatctctgcgtgctctggaatagcgggtatctggggattgcatactacgacactagcgactcaactattcacttcatgcccgacgctccagatcatgagtcactgaagctgctgcagcgggtgttggatgagataaacccacagtctgttgttaccagcgccaaacaggacgaaaatatgaccaggtttctcggcaaactagccagccaggagcaccgagaaccaaagcgccctgagattattttcctgccaagcgtcgactttggtttagagataagcaaacagagactgctatccgggaattactcattcatccccgatgcaatgacagccactgagaagatactttttctgagttctattatcccgttcgactgcctgctcacagtgagggctcttggaggcctccttaagttcttggggaggcggagaattggggtagagctggaagattataatgtaagtgtccccattctcggatttaaaaagtttatgctgactcatcttgtgaatatcgatcaggatacatacaggctggaatgcaatggcgcaatctcagctcagtgcaacctatgtctactaggcagctccgatagccctgccagcgcttcctag

SEQ ID NO: 19860 - DNA, 1602 bp, Artificial Sequence
  Description of Artificial Sequence: Synthetic coding sequence
atggcccagatgctgcaccggctgctgggccacatcaagaacgtgccactgatcttaaagcggatgaaattgtcacatacaaaggtctcagattggcaggtgctgtataaaactgtgtactcagccctcggacttcgggacgcctgtcgttctttgccacagagcattcaactcttccgtgacatagcacaggaattcagcgacgatctgcaccacatcgctagtctgatcggcaaagttgtcgatttcgaaggcagccttgccgaaaaccgcttcaccgtgctgcctaacatagaccccgagatcgatgagaagaagcggcggctgatgggtctgccatcctttctgacggaggtagccagaaaagagctggaaaatctcgattcacgcattccttcttgttccgtgatttatatcccactgattggcttcttgttaagcatccccaggctgccttccatggttgaggctagcgatttcgagatcaacggactggactttatgtttttatcggaggaaaagctccattacaggtcagcacgcactaaggaactcgatgctcttttaggagaccttcattgcgagatcagagatcaggaaaccctgcttatgtatcaactccaatgccaggtgctcgcaagagctgcggtcttgactagggtgctggatctagcctcacggctggacgtactgctcgcgcttgcatcagctgcgcgagattacggttactcccgcccgcgatattctccgcaggtactgggcgtccggatacaaaatggtagacatcccctgatggagctctgcgctcgcactttcgtgccaaatagcaccgagtgtggtggggacaaaggcagagtgaaggtgattacgggacctaacagcagcggaaaaagtatatatctgaagcaagttgggctgattacctttatggctctggtcgggagctttgtgcccgctgaggaagccgaaattggcgccgtcgatgccattttcaccaggatccattcttgcgaatccatctctctgggcctgagtacctttatgatcgacctgaaccaagtcgctaaggcagtgaataacgccactgctcagagcttagtgctgattgacgagtttggtaaaggcacaaataccgtagatggcctcgccctgctcgccgccgtgctgcggcactggttggcccgaggccccacctgtccacatatctttgtggcaacgaattttctgagcctcgtccagcttcaactgttacctcagggaccgctggtgcaatatctgactatggagacttgcgaggatggcaatgatctcgtattcttttatcaggtgtgcgagggtgtcgccaaggcgtcccacgccagccacacagccgcacaggccgggctccccgacaaactcgtggcccgaggcaaagaggtaagtgacctcatcagatccggcaagcccatcaagccggttaaagatctgttgaaaaagaatcagatggagaactgccagaccctcgtagacaaatttatgaagcttgatttggaggatcctaatctcgatttgaacgtgttcatgagccaggaggtactccccgctgcaacatcaatcctgtag

SEQ ID NO: 19861 - DNA, 2556 bp, Artificial Sequence
  Description of Artificial Sequence: Synthetic coding sequence
atggccagcctgggcgccaacccccggcggaccccccagggcccccgtcctggtgccgcctcatctggcttcccatctccggcccccgtgccaggtccgagggaggcggaagaggaagaggtcgaggaagaggaggagttagcagaaatccatctttgcgtactttggaattctggttacctcggcatcgcctattacgacaccagtgattctacaatacattttatgcccgatgcaccggatcatgagagcctgaagttgttgcaacgggtgcttgatgaaatcaacccacagtctgtcgtgacctcagccaagcaggacgagaacatgaccaggttcttgggaaagctggcttcacaggagcatcgcgaaccgaaaaggcccgagattatattcctgcccagcgtcgacttcggcctcgagatcagcaaacagcgcctcctaagtggaaactatagcttcatcccagacgccatgaccgcgactgagaagatactgttcttgagcagcataattcctttcgattgtctactgacgcctcccggcgacctgcggtttacccccatcccgctgctgatacccagccaggtccgggcattgggggggctactcaaatttttaggacgtagacgcataggagtggagttggaggattacaacgtcagcgtgccgattctggggttcaagaagttcatgttgacccatctggtcaatattgatcaggacacatattctgtgctccagattttcaagtctgagtcacacccaagcgtctacaaggttgcttctggattgaaagaagggcttagtctttttggaatcctgaatagatgccactgcaaatggggcgaaaagctgctgcgtctttggtttactcgacccacccacgacctgggggaactgtctagccggttagacgtgatccaattctttctcctgcctcaaaaccttgatatggctcagatgctgcacaggttactgggacatatcaagaacgtgccactaatcttaaagcgtatgaagctctcccatactaaggttagtgattggcaggtcctctacaaaaccgtatatagcgccctgggcttgcgggacgcgtgcaggtccctcccccaaagcattcagttgtttagggatatagctcaggagtttagcgatgacctgcaccacatagcgagtctcatcgggaaggtcgttgacttcgagggtagcctagccgaaaaccgttttaccgtgctgccaaatattgatcccgagatcgacgaaaaaaaaaggagactcatgggccttccttccttcctgactgaggtggcgaggaaggaactcgagaacctggattctcgtattccgtcatgttctgtgatatacatccccctgatcggctttcttctgtcaatccctcgtcttccttctatggtggaagcttccgacttcgagattaatggtctggactttatgttcctgtcagaggagaaacttcactacaggagtgccaggaccaaagagctggatgcactgttgggcgacctgcattgcgaaattcgcgaccaggagacccttttgatgtatcagctccaatgccaggtgcttgccagagccgctgtacttacacgggtcctagatctggcttcccgtctcgatgttttgctcgccctggccagcgccgccagagattacggatactcacgtcctcgctattctccacaggtgctcggagtgaggattcaaaatggacgacaccccctgatggaactttgcgctcggacgttcgtccccaacagtaccgagtgtgggggggacaaggggcgggtgaaagtaatcaccgggcctaattcatccgggaaaagcatttacctgaaacaggtcggtctgataacgttcatggctctagtcggatcctttgttccagctgaggaggcagagatcggcgcggtcgacgcgatatttaccagaatccactcctgtgagagtataagcctaggcctgagcacattcatgattgacctcaaccaggtagctaaagctgttaataatgccaccgcccagagcctggtccttattgatgagttcgggaaggggacaaatactgtggacggccttgctctgttggccgctgtcctaagacactggttggcacgaggccccacctgcccccacatcttcgtggctacaaacttcctgtccctcgtgcaattgcagcttctgcctcagggcccactcgtgcagtatcttactatggaaacatgtgaagacggaaacgatctggtgttcttttatcaggtgtgtgagggtgtggccaaggcgtcccatgcctcccacactgcagctcaggctgggctgcccgacaagctcgtagccagagggaaggaagtgtctgacttgataagaagcgggaagcccattaagccagtaaaagacctgcttaagaaaaaccaaatggaaaactgccagacactggtggataagttcatgaaattggacctcgaggacccaaacctggatttaaatgtgttcatgtcccaggaggtcctgcccgccgctacttccattctttag

SEQ ID NO: 19862 - DNA, 1200 bp, Artificial Sequence
  Description of Artificial Sequence: Synthetic coding sequence
atggccagcgccgccgccggcgaggccgaggagaccacccggctgcgcaaaccgagattctcatttgaagaaaaccagatcctgatccgcgaggtacgcgcccattatccacagctgtacggtgcccagagccggcgcgtgtccgtcgccgaaagacgccgggtgtgggatggtatagcagctaaaattaacggaattaccagctggaagaggaccgggcaggaggtgcagaagcggtggaacgatttcaaacgtagaactaaggaaaaactcgctagggtacctcactcaacacaaggagctggcccagcggcggaagatgcattttccgcagaggaagagaccatctttgccatccttggtccaggcgtcgccgccccaggagccggggccggggccgaagagccgcccgcggctccatcttcccagccccctccaccctccgcttgcccccagcgttacgttttaagtgaagacaggagagaggacagacgcgctgacactagtgcacactcgaaggccgggagctcctccccagagccttgggcccggccatcctgcacgcctcaggaaggaggctgcccacggccgaaggagagggagagccccccaccttctgccctccaacctgttcagctgccgaggctcgcattatcaccaccacctcctgccccaccactgccccctccgcctcccctggctcaggtggcacccagccctccaagtccaccccctccccctagacctccacctacactgtccgctagcgatccaagtcttgacttcctgcgcgctcagcaagagacagcgaatgccattagagaactcgccgggaccctcagacaaggcttggcaaaattaagcgaggctttgtcagcactgttgccactgctgcccggcacccctgtggattcattgcccccgcccctcccaccccctcccccaccccctccccctccccgtccggttctccctccccctgccccaaaggtagagataacccccgagccagtgtccgtggtggcggcagtagtggatggcgccgttgtggcggcccgcggtgtgatcattgcgccgagatcagaagaaggcgctcccaggcccccgcccgccccactgcccccacatgatagtccaccgcataagcgcagaaagggcttcccaacgaggaagaggagaggaaggtggaaatctccctag

SEQ ID NO: 19863 - DNA, 708 bp, Artificial Sequence
  Description of Artificial Sequence: Synthetic coding sequence
atgcggacccaggtgtacgagggcctgtgcaagaactacttcagcttagccgtcctccaacgagacagaattaaactgctttttttcgatatcctggtattcttgtcagtgtttttgctgttcttgctgtttcttgtggatattatggccaacaacacaacttctctcggcagcccttggcccgaaaacttctgggaggatctgatcatgtcctttacagtctccatggcaatcggtctcgttttgggtggcttcatatgggctgtgttcatatgtctctcgcggagaagacgagctagcgctccaatatctcagtggtcctccagccggcgctctcggagcagctatactcacgggctcaacaggaccggattttaccgacactctggctgcgaacggcgatccaacctgtctctggcatcgctaacattccaaaggcaagccagtctggagcaggccaactccttcccccggaagtccagcttccgggcctcaacgttccaccccttccttcaatgccccccacttcccgtagagacagagagtcaactggttacactgccgagttccaatataagcccaactatttccaccagtcattctttgtctcgccccgattactggagtagtaactcacttagagttggcctctcaaccccgccaccccccgcctacgaaagtatcattaaagcattcccagactcctag

SEQ ID NO: 19864 - DNA, 651 bp, Artificial Sequence
  Description of Artificial Sequence: Synthetic coding sequence
tgacgggaccggatcaagctgctgttcttcgacatcctggtgttcctgagcgtattcctcttgttccttctgtttctcgttgatataatggctaataacacaacatcactgggttccccatggcctgagaatttctgggaggacctgatcatgtccttcactgtgtctatggctattggcctggtcctgggaggcttcatatgggccgtctttatctgtctctcacgaagacggagagcttccgctcctatctctcaatggtcatctagccgaaggtcccggtcctcttacacccacggccttaacagaacgggattctaccgccattcagggtgtgagcgaaggtccaatcttagccttgcgagtctaacattccagagacaggcttcattggaacaggccaacagcttcccaaggaagtcgtcgttcagagcaagcactttccaccccttcctccagtgtcctcccctgcctgtcgagactgagtcgcagctggttacgctgcccagctcaaatatatcccccaccatttcgaccagtcacagtctgagtaggccagactactggtcatcgaattcactgcgggtagggctgtccacacctcctccgcctgcctatgaatctatcattaaggcattccctgattcatag

SEQ ID NO: 19865 - DNA, 1833 bp, Artificial Sequence
  Description of Artificial Sequence: Synthetic coding sequence
atgcagtacagccaccactgcgagcacctgctggagcggctgaacaaacagcgcgaggccggtttcctttgcgactgtacaattgtgataggagaattccagttcaaggcacatcgcaatgtgctggcgtccttctccgaatacttcggagccatttatcgatccaccagtgagaataacgtcttcttggaccagagtcaggtgaaggctgacggcttccagaaattacttgagtttatttacacaggaaccctgaacctcgactcctggaacgtcaaagagattcatcaagccgcagactacctgaaggtcgaggaggtcgttacaaagtgtaagatcaagatggaggatttcgcatttattgccaacccctcatccactgagatctcttccatcaccggtaacatcgaactgaaccaacagacttgtcttctaactctgagagattacaacaatcgggagaagtcagaagtctccacggacctcattcaggctaaccccaaacagggggccctggcaaagaagtccagtcaaacaaagaaaaagaagaaggccttcaacagtcctaagacaggccagaataaaactgttcagtacccttccgatattctcgagaatgctagcgtcgagctcttcctggatgctaacaaacttccaactccagtcgtggagcaagtggcccagatcaatgataattcggagctcgagctgaccagcgtcgtggagaacacattccctgcacaggatattgtccacacagtgaccgtgaagcgaaaaagggggaagtcacagccaaactgcgccctaaaagaacactctatgtctaatattgcttccgttaaatcaccatacgaggccgagaactccggggaggagctagaccagcgatactcaaaggcgaaacccatgtgcaatacttgcggcaaggtattttcagaagcgtcttccttacgaagacatatgaggatccataagggagtgaaaccctacgtgtgtcatctgtgtggaaaagcgttcacacagtgcaatcagctcaagacccacgtcagaactcacacaggagaaaaaccatataagtgcgagctgtgcgataaagggttcgcgcagaagtgccagctcgtctttcattcaaggatgcatcacggagaagagaaaccatacaagtgcgacgtctgtaatctccagtttgccactagttctaacttaaaaattcacgcgagaaagcacagcggagagaagccctacgtgtgtgataggtgcggccagcgcttcgctcaagcttccactctcacttatcatgtgaggcggcatactggagagaagccctacgtatgcgatacctgcgggaaggccttcgctgtgtctagcagccttatcacacacagtcgtaagcatacaggtgaaaagccttatatctgcggcatttgcggaaagtccttcatctcgtccggggaattaaataagcattttaggagccacacaggtgaacgccccttcatctgtgagttatgcggcaacagctacacagatattaagaacctgaagaaacacaaaacaaaagtgcatagtggggcggataaaacgttggattcctccgccgaagatcacaccttaagcgagcaggacagtattcaaaagagtccgttgagtgagaccatggatgtgaaaccttcggacatgaccctcccgcttgcactgcccttgggaactgaagaccaccatatgctgttgcctgtgaccgacactcaaagtcccacgtcagatacactgctgcgatcaacagtgaacgggtattccgaacctcagctgattttccttcagcagttgtattag

SEQ ID NO: 19866 - DNA, 1833 bp, Artificial Sequence
  Description of Artificial Sequence: Synthetic coding sequence
atgcagtacagccaccactgcgagcacctgctggagcggctgaacaagcagcgcgaagcgggtttcctttgcgactgtaccattgtgatcggggagtttcagttcaaggcccaccggaatgtcctggcttcattttcagaatatttcggggccatttatcgtagtacttccgaaaacaatgtctttttagaccaatcccaggtcaaagcagatggtttccagaagcttctagaattcatctacactggtaccctgaatttggacagttggaacgtgaaagagatccatcaagcagccgattaccttaaagtggaggaggtggtgaccaagtgtaagatcaagatggaagactttgcgttcatcgcaaaccccagctcaaccgaaatctcttcaattaccggcaacatcgaactcaatcaacagacgtgcctgttgacgctacgtgattataataatcgtgagaaaagtgaagtgtccacagacctgattcaagccaacccaaaacagggcgcgttggctaaaaaatcaagtcagaccaagaagaaaaagaaggcttttaattcccccaagaccggtcaaaataaaacagtccagtatcctagcgacatactggagaatgcgagcgtggagctgttcctggatgctaataagcttcccacaccagtcgtcgaacaagttgcccagatcaacgacaattcagagctcgaactgaccagcgtggtggagaatacctttcccgctcaggatattgtccacacggtgactgttaaacgcaagcggggcaagagccagcccaattgtgcactcaaggagcactctatgtctaacatcgcctccgtgaaatctccttatgaagctgaaaacagcggcgaagagctggaccagcgttattccaaagccaaacctatgtgcaacacgtgcggtaaggtgttctccgaggcaagctcacttcggaggcatatgagaatccataagggcgtgaaaccctatgtctgccacctgtgtggaaaggcctttacccagtgtaaccagttaaagactcatgtgcgcacgcataccggagaaaaaccttacaagtgcgagctttgcgataaggggttcgctcagaaatgtcagctggtctttcatagccgcatgcatcatggggaagaaaagccctataaatgtgacgtctgcaatctccagttcgcaacaagctcgaatctaaagatccatgctagaaaacactccggggaaaaaccctatgtgtgtgataggtgcggacagcggttcgcgcaggccagtacactcacataccacgttcgacggcacaccggcgagaagccctatgtgtgtgatacctgtggaaaagccttcgctgtctcatcttctttgatcactcattcccgaaagcacaccggtgaaaaaccgtatatatgtggtatctgcggcaagagttttatatcctcaggagaactcaataagcactttcgatcccatactggggagcgacccttcatttgtgagctgtgtggtaattcttacacagatataaagaatttaaaaaagcataaaactaaagtgcacagcggagctgataaaacactggattcctcggccgaggaccacaccctgagtgagcaggattctattcaaaagtctcccctgtcggagacaatggacgttaaaccttccgacatgacgcttcccctcgctctgccattaggaacggaggaccaccatatgctgctccccgtgacagacacacagtctccaacatcagacacactcctcagatctactgttaatggttactctgaaccacagcttattttcctgcaacagctgtattag

SEQ ID NO: 19867 - DNA, 1503 bp, Artificial Sequence
  Description of Artificial Sequence: Synthetic coding sequence
atgcagtacagccaccactgcgagcacctgctggagcggctgaacaaacagagagaagctggatttctgtgcgattgcactattgtgataggtgaattccagttcaaggcgcatcgcaacgtactcgcatccttctccgagtatttcggcgccatctacagatctaccagtgagaacaatgttttcctcgatcagtctcaagtcaaagcggacggctttcagaaattactggaatttatctacacagggactctgaatctggacagttggaatgttaaggaaatccaccaagcagccgactacctgaaggtcgaggaggtggtcacgaagtgcaaaatcaagatggaggattttgcctttattgcaaatcccagcagtacggaaattagttccattactggcaacatcgaacttaatcagcaaacctgcttgctgacattacgcgactacaacaatcgggagaaatccgaagtgagcaccgatcttatacaggctaacccaaaacagggtgccctcgcaaaaaaatcatcacagactaagaaaaagaaaaaggcttttaactccccaaagaccggtcagaacaagaccgtgcagtacccgagcgacattctggaaaacgcttctgtcgaactgtttctggacgccaataagctcccaacccctgtggtagagcaggtggcgcagattaacgataattccgagctggaactgaccagcgtggtggagaatacttttcctgcccaagacattgtccataccgtgacagtcaaaagaaaaagagggaaatcccagcctaactgcgctctcaaggaacattctatgagtaatatcgcctctgtgaagtcaccttacgaagctgagaatagtggcgaagagctggatcagcgatatagtaaggcaaaacctatgtgcaatacatgtggcaaagtgttcagcgaagcttcctctttacgtcggcacatgagaattcacaagggcgtgaagccatatgtgtgccatctgtgcggcaaagctttcacgcagtgtaaccaattaaagactcatgttcggactcacaccggggagaaaccttacaaatgcgagctgtgcgataagggcttcgcacagaagtgccagttggtcttccactcccgcatgcaccacggcgaagaaaagccttacaaatgtgatgtctgcaatcttcagttcgccacctcctctaatctcaaaatccatgctcgtaaacacagcggcgaaaagccttatgtctgtgatcgatgcgggcagagatttgcccaggcctcgacactgacataccatgttaggaggcataccggcgaaaagccctacgtgtgtgacacttgtgggaaggctttcgcggtgtcaagctcactcatcacacattcccgaaagcacacaggcgaaaaaccctacatctgcggtatttgcggaaagagttttatttcttccggtgagctgaacaagcacttccgctctcacaccgtcgtgtggtctatgaactag

SEQ ID NO: 19868 - DNA, 1746 bp, Artificial Sequence
  Description of Artificial Sequence: Synthetic coding sequence
atgcagtacagccaccactgcgagcacctgctggagcggctgaacaagcagagggaggcagggtttctgtgcgattgcactattgtaataggagagttccaattcaaagctcataggaacgtcctggcttctttttccgagtacttcggtgcaatatatagaagtacgtccgaaaacaacgtttttctagaccagtctcaggtgaaggccgacggtttccagaagctgctggaatttatttatacaggcacccttaatctcgattcttggaatgtgaaagagatccatcaggccgccgactatctcaaggtagaggaggtagtcactaagtgtaagatcaaaatggaagactttgccttcattgctaatcccagtagcacagaaatctctagcattacaggcaacattgagcttaatcagcagacatgtttgcttaccctgagagactataacaatagagagaagagcgaggtgagcaccgatctgattcaggctaaccccaagcagggtgctttggccaaaaaaagcagccagacaaagaagaaaaaaaaagctttcaacagtcccaagacagggcagaacaagacagttcagtacccctctgacatcctcgaaaacgccagtgtggagctttttttggatgctaacaaactgcccactccagtagttgaacaggtggcccaaatcaacgataattccgagctggagcttacaagcgttgtcgaaaacaccttccccgcacaggacatcgtccacacagtgacggtcaaacgaaagcgtggcaagtcccaacctaattgtgctctaaaggagcattccatgagcaacatcgcgagcgtcaagtccccctatgaggcggaaaactccggggaagagctggaccagaggtactccaaagctaagcctatgtgcaatacctgtggtaaggtgtttagcgaagccagctcgctgcggcgtcacatgagaatccacaaaggcgtgaaaccttacgtgtgtcatctgtgtgggaaggcctttacacagtgtaaccagctgaaaacccacgtgaggacccacacaggggaaaagccatataaatgcgaactttgcgataaaggcttcgcgcagaagtgccagctcgtttttcactcacggatgcatcacggtgaggagaaaccatacaagtgtgatgtctgtaacttgcagtttgctacctcctccaatctgaaaatacatgcaaggaagcactccggggagaagccttacgtttgtgacaggtgtggtcaaaggttcgcccaagcttcaacactgacttaccacgttcgacgccacaccggcgagaagccttacgtatgtgatacatgcggaaaggcattcgctgtgtcctcatccctgatcacccactcccgcaagcacaccggcgagaagccctacatttgtggtatttgcgggaagtcattcatttctagtggggagctgaataagcatttccgctctcacacaggggccgataaaacactcgattcaagcgctgaagaccacacgctctctgagcaggactccattcagaaaagccctctatccgagacaatggatgtgaaaccaagtgatatgacactaccattagccctgccattagggacggaagaccaccatatgctcctgcctgtgaccgatacacaatcgcccactagtgacaccctgctccggagtacagtcaacgggtactctgagccacagttgatttttcttcagcaactgtattag

SEQ ID NO: 19869 - DNA, 1167 bp, Artificial Sequence
  Description of Artificial Sequence: Synthetic coding sequence
atgctgaaggtgaagcggctggaggagttcaacacctgctacaacagtaaccagctggagaaaatggccttctttcagtgtcgggaggaggttgagaaagtcaaatgttttcttgagaagaactcaggcgaccaggattcaaggtccggtcataacgaagccaaagaagtgtggtccaatgccgatctgacagagcgcatgcccgtcaaaagcaagcgtacctccgctctcgccgttgatatccctgccccaccagcaccctttgaccaccgcattgtgactgccaaacagggcgcagtcaactccttttacacagtatctaagacagaaatcctagggggaggaagatttggccaagtacataagtgtgaagagacagctaccggcctaaagctagcagccaaaataatcaaaacgcgtggtatgaaagacaaagaggaggtgaagaacgagatcagtgtaatgaatcagctggatcacgccaatctgatccagctctatgacgccttcgagtctaagaatgatatcgtgctcgtgatggagtacgtagatggtggagaactttttgaccgcatcatcgacgagagctataaccttaccgagctggataccatcctttttatgaaacaaatctgcgaggggattcggcatatgcaccagatgtacattcttcaccttgatctgaagactacaagttttcagtgcagccgatttctgatagatacctctattctccctctgtgcctcctgaactgccgatacaaacccagggagaagctgaaagtgaactttggaactcccgaattcctggcccctgaggtggtgaactacgacttcgtttcttttcccacagatatgtggtcagtgggcgtcattgcgtatatgcttctttctggactctctccctttttgggtgataatgacgccgaaacattaaacaatatcctagcatgtaggtgggacctggaggatgaggagttccaagatatctcagaagaggccaaggagtttatcagtaaactgctgatcaaagagaaatcatggcgtatatcggcctcagaggcactgaaacatccgtggctaagcgatcataaactccattctaggttgaacgctcaaaaaaaaaagaatagaggttctgacgctcaggattttgttacaaaatag

SEQ ID NO: 19870 - DNA, 1167 bp, Artificial Sequence
  Description of Artificial Sequence: Synthetic coding sequence
atgctgaaggtgaagcggctggaggagttcaacacctgctacaactcaaaccaactggagaagatggcttttttccaatgccgcgaggaggttgagaaggtgaagtgtttcctggagaaaaactccggtgaccaggactctagatccgggcacaatgaggcgaaggaagtctggagcaacgctgacttaaccgagagaatgccagttaaatccaagcgaaccagcgcccttgccgtggatatccccgctcctcccgcccctttcgaccacagaatcgtgacagcaaagcaaggcgccgtaaattctttctatacagtctctaagactgagattcttggcggcggccgttttggtcaagtgcacaagtgcgaagaaactgccacagggctgaaactggccgcaaagattataaaaacccgaggcatgaaggacaaagaggaggtcaagaacgaaattagtgtcatgaaccagctggatcatgcaaacttgattcagctatacgatgccttcgaaagcaagaatgacattgtactggtaatggaatatgtggatggcggagagctgttcgacaggatcatcgacgaatcctacaatctcaccgaactggacacaatactgtttatgaagcaaatatgcgagggcatcaggcacatgcatcagatgtatatcttgcatctggacctgaagccggagaatatcctttgtgtcaatcgggacgctaagcaaattaagattattgacttcggacttgccagacgctataagcccagggagaagttgaaggtgaattttggcacacccgagttcttggcgcccgaagttgttaactatgattttgtgagcttccccaccgatatgtggagcgtcggtgtgatcgcttatatgttgcttagcggactgagccctttcctgggtgataatgacgccgagaccttgaacaatatcctggcatgtaggtgggacttggaggacgaagagtttcaggatatctcggaggaggctaaggaatttataagcaaactcttgataaaagagaaatcctggcggatctccgcatctgaagccttgaagcacccttggctcagcgaccataaacttcactcccgtttaaatgcccaaaaaaaaaaaaacagaggctccgacgcacaggatttcgtcaccaaatag

SEQ ID NO: 19871 - DNA, 576 bp, Artificial Sequence
  Description of Artificial Sequence: Synthetic coding sequence
atggccatgcacaacaaggccgcccccccccagatccccgacaccagacgtgaacttgccgagctggtcaaaagaaaacaggagctcgccgagacactggctaacctggaaaggcaaatctatgcctttgaagggagttatctggaggacacacagatgtatggcaacattattcggggatgggataggtatctgaccaatcagaagaacagcaacagtaaaaatgatcgaagaaatcggaagtttaaggaagctgagcgactctttagtaaaagcagcgtcacctcagctgctgccgtgtccgctctcgccggggtgcaggaccagctgattgaaaagcgagagcctggctccggcacagaatccgacacgtcccctgatttccacaatcaggaaaatgaaccttcccaggaggaccctgaggacctggatgggtccgtccagggtgtgaagccgcaaaaggccgcctcctctaccagttcgggctctcatcactccagccacaagaaacggaagaacaaaaatcgacacaggattgatctgaaactaaataagaagccaagagctgactattag

SEQ ID NO: 19872 - DNA, 579 bp, Artificial Sequence
  Description of Artificial Sequence: Synthetic coding sequence
atggccatgcacaacaaggccgcccccccccagatccccgacacccgtcgcgaactggccgaactagtgaaacgcaaacaggagctggccgagacgctcgctaacctcgaacgtcagatctacgcttttgaggggtcctatctagaagacactcaaatgtacgggaatatcatacgcggctgggatagatatctgactaatcagaaaaactcaaattctaagaacgatcgcaggaatcggaagttcaaggaggctgagcgcttatttagcaagtcctcagtaacatcagctgcggctgtcagtgccttagccggagtgcaggaccagttaatagaaaagcgtgaacccggaagcggcaccgagtcagatacaagcccagatttccacaatcaggagaacgagcccagccaggaagatcctgaagatttagatggctccgtgcagggcgtcaagccacagaaagcagcgtcatccaccagctcgggctcccatcactcctcccacaaaaaacgtaagaacaagaatcgccaccggatgaacgtatctcctaaaaccggatggcatcagttgcatctgtag

SEQ ID NO: 19873 - DNA, 510 bp, Artificial Sequence
  Description of Artificial Sequence: Synthetic coding sequence
atgagcctgttcttcatcagccaggagaccctggccaacctggagcggcagatctacgcctttgaaggaagttatctagaggacactcagatgtatggtaacatcattcgcggctgggacagatatctcaccaatcagaaaaattctaatagtaagaatgatagacggaaccgaaagttcaaggaagcagagcgtctgtttagcaagagcagtgtcacttcagccgctgccgtgagcgctctcgccggtgttcaggaccagctcatagagaaacgtgaaccaggaagcggaaccgaatctgacacctccccggacttccacaaccaggaaaacgaacctagccaggaggacccagaggatcttgacggaagcgtgcagggcgtcaagccccagaaggccgccagctctactagcagcggctcacatcacagttcacacaaaaaaaggaaaaacaaaaaccggcaccggatagacttgaaactgaacaaaaagccgcgagccgactattag

SEQ ID NO: 19874 - DNA, 606 bp, Artificial Sequence
  Description of Artificial Sequence: Synthetic coding sequence
atggccatgcacaacaaggccgcccccccccagatccccgacaccaggcgcgagctggcggagctggtgaagcgcaagcaggaactagctgagaccttagccaatctcgaaagacagatatacgcattcgaaggaagctacctcgaagatacacagatgtatggtaatatcatccggggatgggatagatacctaactaaccagaaaaactctaactcgaaaaatgataggagaaaccgtaagttcaaggaagccgagcggctgttcagcaagtccagtgtgacatccgccgctgccgtgagcgccctggctggggttcaggatcaactgattgagaaaagagaaccgggctctggcacagaatctgacacctctcccgactttcataaccaggaaaatgagccctctcaggaggatcccgaagacctggacgggagtgttcaaggagttaaaccacagaaggccgcttccagtacttccagtggttcacatcactcatctcacaaaaaacgcaagaacaaaaacaggcactccccatccggcatgtttgattatgactttgaaatcgacctgaagctgaacaagaagccaagggcggattactag

SEQ ID NO: 19875 - DNA, 576 bp, Artificial Sequence
  Description of Artificial Sequence: Synthetic coding sequence
atggccatgcacaacaaggccgcccccccccagatccccgacacccgacgtgaactcgctgagcttgtgaaacgaaaacaagagcttgcagaaacattagctaaccttgaacgtcagatttacgcgttcgaaggaagttatctggaggacacccagatgtacggcaacataattcgtgggtgggacaggtatctgacaaaccagaagaactcaaactccaagaacgataggcgcaaccgcaagtttaaggaggccgagaggctcttttccaagagctcagttacaagtgctgccgccgtgtccgccctggccggcgtccaggaccagctgatagagaagcgagaaccaggatctgggacggaaagtgacacgagccctgattttcataatcaggagaatgagccaagccaagaagatccagaagatctagacgggtcagttcagggcgttaaacctcaaaaagctgcctcctccacgagctctgggagccaccacagtagccacaaaaagcgcaaaaataagaacaggcactctccttcgggtatgttcgactacgactttgaatacgtctattag

SEQ ID NO: 19876 - DNA, 291 bp, Artificial Sequence
  Description of Artificial Sequence: Synthetic coding sequence
atgaccagcgccctggagaactacatcaaccggaccgtggccgtgattaccagcgacgggcgtatgatcgtggggaccttgaaaggattcgaccagacgatcaatctaattctggacgaatcccacgagcgtgtcttcagctcgagtcagggtgtggagcaggtcgtccttggactttacatcgtgcgaggcgacaatgttgccgtaatcggggaaattgatgaagagaccgattcggctctggaccttggcaatattcgagccgaacccctcaactccgttgcacactag

SEQ ID NO: 19877 - DNA, 1764 bp, Artificial Sequence
  Description of Artificial Sequence: Synthetic coding sequence
atgagccagatgctgcacatcgagatccccaacttcggcaacaccgtgctgggatgcctcaatgagcaaagacttttaggactgtactgcgatgtaagtattgtggttaaaggacaagcctttaaggcgcaccgggccgtcctcgccgccagttctctgtactttcgtgacctcttctcgggcaactctaagtccgcctttgagctccccggctcggtgccgcctgcatgctttcagcagatcctaagtttttgctatacaggacggctcacaatgacagcctccgagcagctggtggtgatgtacacagccggctttcttcaaatacaacatattgttgagcgcggaacggatctgatgttcaaagtgtcctcacctcactgcgactcacagaccgccgttatcgaagatgccgggtccgaaccccagagcccttgtaatcaactgcaaccggccgctgccgcagcagccccctacgtggtgtcgccatcagtgcccattccactgctgacacgcgtgaagcatgaagccatggagctgccacccgcaggacccggattagcacccaagagacctctggagacgggccctcgtgacggagtggcagttgctgctggcgccgcggtggcagcggggaccgcccctcttaagctgccaagggtgagctattacggtgtgcccagtttagcgacgctgatcccgggaatccagcagatgccttatccccaaggagagcgtacgtctcccggcgcctcaagtctcccaaccacggacagccccacgtcttaccataatgaagaagatgaggaggatgacgaagcatacgacacaatggtggaggagcaatatggccagatgtatattaaggcctcaggctcttacgctgttcaggaaaagcctgagcctgtgcctttggaaagccggtcctgtgtgttaattcgtagggacctcgtggccctccctgcttcactgatttcccaaatcggctacagatgccaccccaaactatacagcgaaggagatccaggcgaaaaactggaactggttgcgggatcgggagtctacatcacccgaggacagctgatgaattgccacctgtgcgcaggcgtgaaacacaaggtgctcctgcgccggctgttggccaccttcttcgaccggaatacactcgctaattcttgtgggactggcattcgcagctctacttcagacccttccaggaagcctttggactcccgcgttcttaacgccgtgaagctctattgtcagaattttgccccctcctttaaagagtcagagatgaatgttatcgccgccgatatgtgtactaacgccagaagggttcggaagcgatggctgcccaagatcaagtccatgctgccggaaggcgtcgaaatgtatagaacggtaatggggagcgccgctgccagcgtaccgctcgaccccgagttcccacccgccgccgctcaggtgttcgaacagcggatctacgcagaacgtcgcggggacgctgccacgatcgtggctctgcggaccgatgctgtgaacgttgacttgtcagcggctgccaacccggccttcgatgcgggcgaagaggtggacggggccggaagtgtgatccaagaagttgccgcaccagagccactccccgccgacggccagtcccccccacagccctttgagcagggtgggggaggaccctcacgcccccagacaccagccgccgcggcacgacggcccgaaggcacctatgccggcaccctttag

SEQ ID NO: 19878 - DNA, 1764 bp, Artificial Sequence
  Description of Artificial Sequence: Synthetic coding sequence
atgagccagatgctgcacatcgagatccccaacttcggcaacaccgtgctcgggtgtttgaacgagcaacggctcctcggtctgtactgcgatgtgtctatcgtggtgaagggccaggcgttcaaggcccatcgggctgttttagcagctagttcgctgtattttagagatctgttttctgggaattctaagtctgcatttgagttgccaggcagcgtgcctccagcatgctttcagcagattttgtccttctgttacacggggcggctgaccatgacggcttccgaacaactggtggtgatgtacacagctggctttctacagattcaacacatcgttgaaagaggaactgaccttatgttcaaagtgagttcaccacattgcgactcccagacggcagtgatcgaagacgccgggtccgagccacagtcgccatgtaaccagctgcaaccggccgccgcggctgctgcaccttacgtggtttcgccctccgtgcctatacctctgctcactcgagtgaagcacgaagccatggagctccctcctgctggcccgggcctggccccaaagcgccctctagagaccgggccccgggatggagtagccgtggcggctggggcagccgttgcagccggaaccgcaccactgaaactaccccgagtaagttactacggcgtcccctctctagccactctcattcccggcatccagcagatgccgtacccacagggggagaggacttctccaggcgcctcttcactgcccactactgacagcccaacctcctaccacaatgaggaggacgaggaggatgatgaggcttacgacaccatggttgaggaacaatacggccagatgtacattaaggcctcagggagctacgcagttcaagaaaagcccgagccagttccactggaatcaagaagctgtgtgttaatccgacgggacctcgttgccttgcctgcctctttaatctcacaaatcggttacaggtgtcatccgaaattgtattcagagggggacccaggcgaaaagctggagctggtggctgggagtggggtatacatcacccgcggacagctgatgaactgccatctgtgcgctggcgttaagcacaaagtcctcttgagacggcttctggccacatttttcgatcgcaacactctagccaatagctgtggaacgggcatccggagctcaactagcgatcctagccgaaaacctctggactctagggtccttaacgcggtcaagctgtactgccagaacttcgccccaagctttaaggagagtgagatgaatgtgatcgccgctgatatgtgtaccaacgcccgcagggtgcgtaagcgatggctccccaaaatcaagagcatgcttccagaaggcgtggaaatgtatcgcaccgtgatgggatccgccgccgctagtgttccgctggaccccgagttccctcccgctgcagcccaggtctttgaacagaggatctacgccgaaaggcgcggggatgcagctactatcgtcgccctgcggaccgacgccgtgaatgtggacttatccgcagctgctaacccagcctttgacgccggcgaggaagttgatggcgctggctcggtcattcaggaagtggccgcccccgaacctcttccagcagacggccagtcacccccacagccttttgagcagggtgggggaggcccttcccgacctcagacacctgccgcggccgctagacggcccgagggtacttacgccggaacactgtag

SEQ ID NO: 19879 - DNA, 3078 bp, Artificial Sequence
  Description of Artificial Sequence: Synthetic coding sequence
atgcaccggaagaaggtggacaaccggatccggatcctgatcgagaacggcgtggcagagcgccagaggagtttgtttgtggtagtgggagatcgaggtaaagatcaggtggtgatccttcaccacatgctgagcaaggccacggtgaaggctcgaccttccgtgctgtggtgctacaaaaaagaactgggcttctcaagccacaggaagaaaaggatgagacagctccagaagaaaatcaaaaacggcactcttaatattaagcaagacgacccattcgaactgtttatcgcagcaacgaatatcagatactgttattacaatgagactcacaaaatcctaggtaacacctttggcatgtgtgtgctacaggacttcgaggctctgacacctaatcttcttgctcgcacagtagagactgtggagggaggcggtttggtggttattctgctccgcacaatgaatagcctgaagcaactttacactgtcactatggacgttcattcaaggtaccgcacagaagcacatcaagacgttgtcggacgcttcaacgagaggtttatcctcagccttgcgtcatgtaagaagtgcctggttattgatgaccagttaaatatacttcctatttcttcccatgtggccacgatggaagccttaccacctcagaccccggacgagagtttaggtccatccgatttggagctgagggaactgaaagagtcgctgcaagatactcagcccgtgggcgtgttggttgattgctgtaaaacactggatcaggcaaaagccgtcctcaaatttattgaaggtattagcgagaaaactctgcggagtacagtggcgctcactgctgcaagaggacggggcaaatctgccgccctgggcctagctatcgctggagcagtcgcttttggctattccaacatattcgtcacatccccctctccggataatctccatacgttattcgagtttgtgtttaagggctttgacgcactgcagtatcaagagcatctagactacgagattattcagtccctgaacccggaattcaataaggccgtgatccgggttaatgtgtttcgggagcatcggcaaactattcagtatattcatcccgctgacgctgtgaagctggggcaggccgagctggtggtcattgatgaagccgccgcaatccctctgccactcgtgaagtccctactgggtccttatttggtgtttatggctagcactataaacggctacgaaggaaccggacggtctctgtctctgaagttgatacaacagctccgacagcaatccgctcagtctcaggtcagcacgacagccgagaacaaaactacgaccactgcacggttagcttcagcacgcacgctctatgaggtgtcccttcaggaatcgatcagatacgccccaggggatgcagtagaaaagtggttgaatgatcttctttgtctcgactgcctgaacatcacgaggattgtgtctggatgtcccttacccgaagcgtgtgagctgtattacgtgaatcgggacaccctcttctgctaccacaaggcttccgaggtcttcctccagagactgatggccctctatgtcgcgtcacactataaaaactcccctaacgatcttcagatgctgtcagacgctcctgcacatcatctgttctgcttgctgccaccagtcccaccaacccagaatgctctccctgaagtgctcgctgtaatccaggtctgcctcgagggtgagatttctcgccagtccattttgaacagcctgtccagagggaagaaggcatctggggaccttataccatggaccgtgtctgagcaattccaggatcctgatttcggtgggttgagcggtgggcgggtggtcagaatcgcggttcacccagactatcagggtatgggctatggctctcgggccctgcagctcttgcagatgtactacgaaggacgatttccatgtttggaggaaaaggtgctcgaaactccgcaggaaatccacacggtgtcatccgaagccgtaagtttactcgaggaggttattacccccagaaaggatctgccacctctgctgcttaaacttaacgaaagacctgccgagcgcctagactaccttggggttagctatggccttacaccccggttgctgaaattctggaagcgggccggttttgtccccgtctatttaagacaaactcctaacgacttaacaggagaacactcttgtattatgctcaagactttgaccgatgaggacgaagctgaccagggagggtggctggccgctttctggaaggattttcggcgcaggtttctcgcattgctgtcttaccagttttcgacattctccccatctctcgccttgaacataattcaaaatcggaacatggggaagcccgcacaacctgccctatctagggaggagttagaggccctatttcttccatacgatctcaaaagacttgagatgtacagccgcaatatggtcgattaccacctcattatggacatgatacccgctatctcgagaatctacttccttaatcagctgggcgatttggctctgagcgctgctcagtctgctctgctgctgggaatcggcctgcagcataagtccgtagaccagctcgagaaggaaatcgaactgccgagtgggcagcttatggggctatttaacagaattattcgcaaagtagttaagctatttaatgaggttcaggagaaggcaatcgaggaacagatggtggccgccaaagatgtagttatggagcctacaatgaaaacattgtctgacgacctggacgaggcggcaaaggaatttcaagagaaacataaaaaggaggtcggtaaactaaagtccatggacctaagcgaatatatcataaggggcgacgacgaggagtggaatgaagtcctgaacaaagccggtcctaacgcctcaatcattagcctgaaaagcgataagaagagaaaattagaggctaagcaggaaccaaagcagtccaagaagttgaaaaacagagaaaccaagaataagaaagatatgaagttgaagcggaaaaaatag

SEQ ID NO: 19880 - DNA, 2862 bp, Artificial Sequence
  Description of Artificial Sequence: Synthetic coding sequence
atgcggcagctgcagaagaagatcaagaacggcaccctgaacatcaaacaggacgatccttttgagctgtttattgcagcaacaaatatcaggtactgctattataatgagacgcataaaattctgggaaataccttcggaatgtgtgtactgcaggattttgaagcgctcacaccaaatctgctggcccggacagtagagacggtggagggaggcgggctggtggtgatccttcttaggacgatgaattcgctcaaacaactgtatacagttaccatggatgtgcattcccggtacaggacagaagcacaccaggacgtggtcggacggttcaatgagcgcttcattctgtccctcgcaagttgtaaaaaatgcttggtgatagatgaccaattaaacattctgcctatctcaagccacgttgctactatggaagccctgccacctcagaccccggacgaatcccttggacctagtgacctggagctgagggaactgaaggagtccttgcaggacactcagcctgttggcgtacttgtcgattgttgcaagaccctcgaccaggctaaggctgtcctaaagtttatcgaagggatcagcgaaaaaaccttgaggtctaccgttgcgctgactgccgcaaggggcagaggcaagtccgcagctctcggtctggcgatcgctggagcagtggccttcggctactctaatatatttgtgaccagtccaagtcccgacaatcttcacaccctctttgaatttgtgtttaagggattcgatgctctccaataccaggaacacctcgattatgaaattatccagtctctgaaccccgaatttaacaaagcagtgatccgggttaacgttttcagggagcaccggcagactatccagtatattcacccagcagatgctgttaagctcggtcaagccgaactggtggtaatagacgaagctgcagctatcccattgccgttggtcaagagtcttctcgggccatacctggtgtttatggcatcaaccataaacgggtatgaaggaacaggtcggagcctgagcctgaagctgatccagcagctgcggcagcagagcgcccagtcccaagtgtctacaacagctgagaataagaccacaacaaccgctcgcttggcatcagcccggacgctgtacgaggtgtcacttcaggagtcaataagatacgctcccggagacgccgtggagaagtggctgaacgatctgttgtgtctcgactgcctgaatattacccgtattgtgagtgggtgcccactccccgaagcctgcgaactttactatgttaatagagacaccctgttttgctaccataaagcatccgaagtcttcctccagagactaatggccctgtatgtggccagccattacaaaaactcaccaaacgacctgcagatgctttctgacgcacccgcccaccacttattttgccttctaccacccgtgccacctacccaaaatgccttgcccgaagtgctggccgttattcaggtttgtctggagggcgagatttcgaggcagtctattcttaattctctctcacgggggaaaaaggcgtccggggatctgattccttggactgtctccgaacagttccaggaccccgattttgggggactgtccggcggacgcgtggttcggatcgctgttcatccagattaccaaggaatgggatacgggtctcgcgctttacagctgcttcagatgtattatgagggaagatttccatgcctggaagaaaaggttctcgaaaccccccaggaaattcacaccgtaagctccgaagctgtctccctcctagaggaagtcattactcccagaaaagacctaccccccttgctcctgaaactcaatgagcggccagcagagaggttagattacctgggagtgtcatatggcctcaccccccggcttttaaagttttggaagcgcgctgggtttgtgcccgtctatctgcggcaaacacctaacgatctcaccggagaacacagctgcattatgcttaagaccctgacagacgaggatgaggcagaccaggggggctggctcgcagccttttggaaggattttcgacgcagatttctggcacttctttcttatcaatttagcaccttcagcccgagcttggctttgaacatcatacaaaaccgcaacatggggaaaccagctcaacccgccttgtcccgggaagagttggaagcgctctttcttccttatgatcttaagaggttagaaatgtactctcgaaatatggttgattatcacctgataatggatatgatcccggccattagccggatctattttctcaatcaactgggggacctagcattgagtgctgcccagtcagctttgctcctggggatcgggcttcaacacaaaagcgtggatcagttagaaaaagagatcgagcttcccagcggtcaattgatgggcctcttcaacagaatcattagaaaggtcgtgaaactgttcaacgaggtgcaggaaaaagctattgaggagcaaatggttgcggcaaaagacgtcgtcatggagcctactatgaagaccctcagtgatgatctcgatgaggccgcaaaagagtttcaggaaaaacataagaaagaggtgggtaagctgaaaagtatggatctaagcgagtatatcattaggggtgacgacgaggaatggaacgaggtgctgaataaagcaggtcccaacgcaagcatcatttccctgaagtcagacaaaaagcgcaaacttgaggctaaacaggagcctaaacaaagcaaaaaactgaaaaatagagagaccaaaaacaagaaagacatgaagctgaagaggaaaaagtag

SEQ ID NO: 19881 - DNA, 711 bp, Artificial Sequence
  Description of Artificial Sequence: Synthetic coding sequence
atgaccagcgagaagggccccagcaccggcgaccccaccctgcggcgccgcatagagccgtgggagttcgatgtattctatgacccaagagagcttagaaaggaagcttgtcttctgtacgagataaagtggggtatgtcccggaaaatttggaggtccagtggaaaaaacactactaatcacgtcgaggtaaatttcattaagaaattcacctcagagcgagatttccatccctccatgtcctgcagtatcacctggtttttgagctggtccccatgttgggaatgttctcaggctatacgtgaattcttaagtcggcatcctggcgtgacactggtgatatacgtcgcccgactcttctggcatatggaccagcagaaccgacaagggctacgggatttggtgaactctggcgtgaccatccagatcatgcgtgcctctgagtactatcactgctggagaaacttcgtgaactacccccctggtgacgaggcgcactggccacaatatcctccgctctggatgatgctatatgcactggagctccattgcattattctctctctgcccccttgtctaaaaattagccgtaggtggcaaaatcacctcaccttcttcaggcttcatttgcagaactgccattatcaaacaataccaccccatatattgctggcgacggggctgatccaccctagtgtggcttggcggtag

SEQ ID NO: 19882 - DNA, 870 bp, Artificial Sequence
  Description of Artificial Sequence: Synthetic coding sequence
atgagcgtggaccccgcctgcccccagagcctgccctgcttcgaggcctccgattgtaaagaatctagtcccatgcctgtcatctgcggccccgaagagaattacccatcattgcaaatgagttcagccgaaatgccccatacagaaaccgtatctcccttgccctcctcaatggatctgctcatccaggattctccagactcgagtactagccccaagggaaagcagccaacctccgccgagaaaagtgtggccaaaaaggaagataaggtccccgtcaaaaagcaaaaaactcgaaccgtgttttcatccactcagctctgcgttctgaacgacaggtttcagcggcagaaatacctaagtcttcagcagatgcaggagttgtctaatattttgaatctctcatacaaacaagtaaagacgtggtttcagaaccagcgtatgaaaagtaagcgttggcagaaaaacaactggcctaagaactctaacggagttacacaagggtgtctcgtgaaccccaccggcaacctgcccatgtggtcaaatcagacttggaacaattctacttggagtaatcagacacaaaacatacagtcgtggtccaatcacagttggaacacccagacatggtgtacacagtcctggaataaccaagcttggaacagtcccttttataactgcggcgaagagtcactgcagagttgtatgcagttccagcctaattcccccgctagcgatttggaggccgctctggaggccgctggggaggggttgaacgtcattcagcagacaacaaggtatttttcaactccccaaaccatggatctgtttctgaactattcaatgaatatgcaaccagaagatgtttag

SEQ ID NO: 19883 - DNA, 567 bp, Artificial Sequence
  Description of Artificial Sequence: Synthetic coding sequence
atgcaccgggcccggtggctgacccccgtgatccccgccctgtgggaggccgaggccggaaggtcccgtggtcaagagatcgaaacaatccttgctaacaaaaagcagtcagccatgccatgggatcaggaccctgagcagtctactggcaactattccgaagacgaacagaatgggaagcagaagtggagagaagagggcgaggccggacggaagcgcgaacgcgagaaagaggagaaaaacgaaaaagagctgcaggatgagcaagaaaataaacgaaagcgcgagaacgagaagcagaagcagtaccctgaaaagaggctggtgtcaaagtctcttatgcataccctctgggccaagttcaagttaaatagatgccctacaatccaagaatctctatccctgagtttcgagtttgatatgacacacaaacagattagccaatggttctgcaaaacacggaaaaagtacaataaggagatgtctaagcgcaagcacaagaagaagcatatgagatggagaagtctgtgttgccaagggtggtccagaacgccggcgctgaagtag

SEQ ID NO: 19884 - DNA, 2691 bp, Artificial Sequence
  Description of Artificial Sequence: Synthetic coding sequence
atggccgcccgggccgtgctggacgagttcaccgcccccgccgagaaggcggagttgctagaacagagtcgcggacgaatcgagggactttttggagtttctctggcagtcctaggggccctgggcgccgaggaacctctccctgctcggatctggttgcaactttgtggagcacaggaagctgtacactcagcaaaggagtatattaaagggatttgtgagccagaactggaagagcgcgagtgctaccctaaggacatgcattgcattttcgtcggggccgagtcactctttctcaaatcactgattcaagacacatgtgccgacctttgcattcttgatatcggcctgcttggaatcagaggctctgccgaggcggtggtcatggcccgctcacacatacagcagtttgttaagctgtttgaaaataaggagaacctgcccagctctcaaaaagagtccgaggtgaagcgggagtttaagcagttcgtggaagcacacgctgacaactataccatggatttgcttattcttcccacatctctgaaaaaggagcttctaaccctgacacagggcgaagagaacttatttgaaacgggcgatgacgaagtgattgagatgcgagacagccagcagactgaatttactcagaacgcggcgactggcctgaatatttcccgagatgaaacagtactgcaggaggaagctcggaataaggccggcactccagtatcagagctgacaaaacagatggataccgttctgtcttcctcccccgacgtgctgtttgaccctatcaatgggctgactcccgatgaggaagctctgagcaatgaaagaatctgccagaagcgccgcttttctgactcggaggaacggcacacaaaaaaacagttctcgctggaaaacgtgcaggagggcgaaatactgcacgatgctaaaaccctggctgggaacgtgatcgctgacctgagcgattcgagtgcggattctgagaaccttagccccgacattaaggaaaccactgaggagatggagtataatatacttgtcaattttttcaagactatgggttattctcaagagatagttgagaaggtaataaaagtctatggcccgagcacggagccattgctcctgttagaagagatcgaaaaggagaacaaacgtttccaggaagatagagaattctcagccggaactgtgtatcccgaaactaataagactaaaaacaaaggcgtctatagcagtacaaacgagctgactacggactcaaccccgaaaaagacccaagctcatactcaacagaatatggttgaaaaattttctcaactacctttcaaggttgaagccaagccatgtaccagtaactgcagaatcaatactttcaggaccgtgcccattgaacaaaaacatgaggtgtggggaagcaatcagaactatatctgcaacactgaccccgagacagacggactcagcccctctgtggcatcaccatcccccaaggaggtaaactttgtgagtaggggtgcgagcagccaccaacccagggtgcccttgttccccgaaaatggcctccatcagcaaccggagcctctgttgccaaataatatgaagagtgcctgtgaaaagagactggggtgttgcagtagccctcactctaaacctaattgctccactctgagtcctcccatgcctctgccacagctgctgccttcagtgactgacgcccgctccgcggggccgtcggatcacatagactcaagtgtgactggggttcaacgttttcgtgataccctgaagattccgtataagctggagctgaagaacgagcccggccgcactgatcttaagcacatcgtgattgatgggagcaatgtagccataacgcatgggctgaagaagttcttctcatgccgcggcatcgctattgcggttgagtatttctggaaactgggcaacagaaacattactgtattcgtgccccaatggcgcacccgtagagatcctaacgtcaccgagcaacacttccttacacagctgcaagagctaggcatcctctctctaacacccgcgcggatggtattcggggagcgcatcgccagtcatgacgaccgatttctcctccatctggccgataagaccggaggcatcatcgtcactaatgataacttccgagagttcgtcaacgaaagtgtttcctggcgggagatcataaccaaacggctgctgcagtacaccttcgtcggcgacatctttatggtgccagacgatcctctaggcagaagtggccctcgacttgaagaattcctacaaaaggaagtgtgtctgcgagacatgcagcccctgctgtccgccttgccaaatgtgggaatgtttgacccatctttcagggtacctggaacacaggcagcgtcaacctctcaccaaccccctacccggattcagggggccccctccagtcattggctgccacagcagccccatttcccgttactccccgcacttccaagcctccaacagaatctgccgatgcccgcccagagaagctcagctgaaaccaacgaactgagggaggcactgcttaagatttttcctgattcagagcagaggctgaaaatcgatcagattctggtcgcccacccatatatgaaggatttgaatgccctgtccgcaatggtcctcgattag

SEQ ID NO: 19885 - DNA, 1848 bp, Artificial Sequence
  Description of Artificial Sequence: Synthetic coding sequence
atggcccagaagaagtacctgcaggccaagctgacccagttcctgagagaggaccgcatccagctctggaagcccccctacacagacgaaaacaagaaagtgggactggcactcaaagatctggccaaacagtactcagatagactggagtgctgtgaaaacgaagtagaaaaggtcattgaggaaattagatgcaaagcaatagagcgggggacagggaacgataactatagaaccaccgggattgctaccatcgaggttttcctgcctccccgtctgaaaaaggatcgcaagaatctgcttgagactcgtcttcacatcacaggacgggagctccgaagcaagatcgctgagacctttgggctgcaagaaaattacattaaaatcgtgatcaataagaaacagctccaactgggaaagaccctggaggaacagggagtggcacacaatgttaaagcgatggttctggagctgaagcagtccgaagaagacgcccggaaaaatttccaattagaggaggaagaacagaacgaggccaaactgaaagagaaacagatacaaaggactaagagaggactggagatcctggccaagcgtgccgcagagactgtcgttgaccctgagatgacaccttatcttgatatagccaaccagaccggaagatccattcgaatcccaccaagtgaaagaaaggccctcatgttggccatgggctaccatgaaaaaggtcgtgcctttctcaagcggaaagagtacggaatcgccttgccatgcctcctcgatgctgataagtacttttgtgagtgttgccgggagctgctggatacagtggacaattacgccgtcctgcagctggatatcgtatggtgttattttcggctagagcaactcgaatgcctcgacgatgcggagaaaaagctgaacctcgcccagaagtgctttaagaactgctatggtgagaaccaccagaggcttgtccatattaagggaaactgcgggaaggagaaggtcttattcctgaggctgtacctgctccaaggcattagaaactaccacagcggcaacgacgtggaggcctatgaatatctcaacaaagcgagacagctcttcaaggagctttatatcgatccttctaaggtggataacctcctccagctgggattcactgcccaggaggcccgtctcgggcttcgtgcctgtgacggaaacgtggatcatgctgcaacccatataactaatcggcgggaggagctagcacagataagaaaggaagagaaggagaaaaaaagaagaaggcttgaaaacatccggtttttaaaaggaatggggtactctactcacgccgcccagcaggtgctgcacgctgccagcgggaacctcgacgaagccctgaaaatcctcctatctaacccccagatgtggtggttgaatgactccaacccggaaacagataaccggcaggagagcccctctcaggagaacattgacaggctggtgtatatgggattcgacgccctcgtcgctgaagcagcccttcgcgtcttccgcggtaatgtacaattggccgcacagaccctcgcccataacggcggatccttgccaccagaactgccgctgagcccagaagactctctaagccccccagcaacgtctccttccgactccgcgggaacttccagtgcctctactgacgaagacatggaaactgaagctgtcaacgaaattctcgaagacatccctgagcacgaggaagattacctggatagtactctggaggacgaggaaattattatcgctgagtatctgtcttatgtagaaaacagaaaatccgccacgaagaagaattag

SEQ ID NO: 19886 - DNA, 1806 bp, Artificial Sequence
  Description of Artificial Sequence: Synthetic coding sequence
atggcccagaagaagtacctgcaggccaagctgacccagttcctgcgcgaggacaggatacagctatggaagccaccttacactgatgaaaacaagaaagtggggcttgctttaaaggatctggcgaaacaatactcagaccggctagagtgctgtgaaaatgaagttgagaaagttattgaagaaattaggtgcaaggcaatcgagagaggaaccggcaacgacaattatcggactacggggatcgctacaattgaggtgttccttcccccaagactgaaaaaggatcggaaaaacctgttggagacgagactccatatcactggtcgcgagctgcgatccaagatcgccgagaccttcggtttgcaagagaactacatcaaaattgtcatcaataaaaaacagctccagctgggtaaaacgttagaggagcaaggggtcgcccataacgtgaaagcaatggtcttggagctgaaacagtccgaggaagatgctcggaagaactttcagttggaagaagaggagcaaaacgaagcaaagctaaaggagaagcaaatacagcgcacaaagagagggcttgagatcctagccaaacgggccgcggaaacagtcgtagaccccgagatgactccctatctcgatattgcaaatcagacgggcagaagtatccggatcccaccttcagaacgcaaggccctgatgctggcaatggggtaccacgaaaaagggagagcctttctgaaaaggaaggaatacgggattgctctgccctgtctcctggacgccgacaaatatttctgtgagtgctgtcgtgaactgctagataccgtcgacaactacgcagtactgcaactagacattgtgtggtgctattttcgtctcgagcagctggagtgcctagatgacgcagagaaaaaactaaacctcgcgcaaaagtgtttcaagaactgctacggcgagaatcatcagaggctagtacacattaagggaaattgtggaaaggagaaggtgctgttcttaagactataccttttgcaaggcattcggaattaccactctggtaacgacgtggaagcttacgagtatctcaacaaagcacgacaactctttaaggagttgtatatcgacccctctaaggtcgacaatctgctccaacttgggtttacggcacaggaagctagactcggactccgcgcatgcgacggcaacgtggaccacgccgctactcacattacaaacaggagagaggagctggctcagatacggaaagaggaaaaggaaaaaaaacgtcggcggctcgagaacattagatttctgaagggcatgggctacagcacacacgcagcacagcagattctgttgtctaatccacagatgtggtggctgaatgattcaaatcccgagactgacaacaggcaggagagcccttcccaagagaatatcgacaggctggtttatatgggatttgatgccctcgtggctgaggccgcgctgcgagtgtttcgcggtaacgtgcagttggccgcccaaacactagctcacaacggaggatcgctgccaccggagctccccttatcgccagaagattccctgagcccgccggccacctccccatctgatagtgctggaaccagttcagctagcaccgacgaggacatggaaactgaggctgttaatgaaattctcgaggatataccggaacatgaagaagattatctggattccacattagaggacgaggagatcattatcgcagagtacctttcttacgttgaaaacagaaagtctgctaccaaaaagaattag

SEQ ID NO: 19887 - DNA, 465 bp, Artificial Sequence
  Description of Artificial Sequence: Synthetic coding sequence
atggcccagaagaagtacctgcaggccaagctgacccagttcctgcgggaggaccgaatccagctgtggaaaccaccttacaccgacgaaaataagaaggtaggcctcgccctgaaagacctggccaaacagtatagtgatcggcttgaatgttgcgagaacgaggttgagaaagttattgaggagattcgctgtaaagcaattgagaggggcactgggaatgataactacaggactaccggaattgccactatcgaggtttttcttccccccagactgaaaaaagatagaaagaatctgctggaaactcgtctccacatcaccgggcgggagctgcgcagtaagattgctgaaacattcggcctccaagaaaactacattaagattgtcatcaacaaaaaacagttacagctgggcaagactctagaggagcaaggagtagcccacaacgtgaaggctatgtag

SEQ ID NO: 19888 - DNA, 765 bp, Artificial Sequence
  Description of Artificial Sequence: Synthetic coding sequence
atggcccagaagaagtacctgcaggccaagctgacccagttcctgagggaagatagaattcagctttggaaacctccatacaccgacgaaaataagaaagtaggactggctttgaaggatctggccaagcagtatagtgatagactcgagtgctgcgaaaatgaggttgaaaaggtgatagaggagatccgttgcaaggccatagaacgcggcacaggtaatgacaactatcgcaccactggcatagcgacaattgaagtttttctgcctccccgccttaaaaaagacaggaaaaatctgttagagacacgactgcatatcactggcagggagctgcgcagtaaaattgctgaaacctttgggttacaggaaaactacattaagattgttattaataaaaagcagttgcaactgggcaagacactggaggagcaaggtgtcgcccacaacgttaaagctatggttttagagcttaagcagagcgaggaggacgctcgtaagaacttccagctggaggaggaagagcagaacgaagccaagctcaaggaaaaacaaatccagaggacaaagcgaggcttggagatcctcgccaaaagggcagccgaaactgttgtggaccccgaaatgaccccctacctagacatcgccaaccagactgggcgatccattagaattccacccagcgagcgcaaagcccttatgttggccatggggtatcatgaaaagggacgcgccttcttaaaacggaaggagtatgggatatag

SEQ ID NO: 19889 - DNA, 495 bp, Artificial Sequence
  Description of Artificial Sequence: Synthetic coding sequence
atggcccagaagaagtacctgcaggccaagctgacccagttcctgcgcgaagataggattcagttatggaaaccgccatacaccgacgaaaacaagaaggtggggctggctctgaaagacctggccaagcagtactcagatcgccttgaatgctgcgagaacgaagtggagaaggtgatcgaggagatcagatgcaaagctattgaacgggggaccggcaacgataattacaggacaaccggtattgcaaccatcgaagtgttcctccctccgcggcttaagaaggaccggaaaaatctcttggaaacacgcctccacattactggacgcgagctgcgttccaaggcagtgagaggcggtttccggaagtggcatgccacacatatgcggcgacgtattgcggaaacattcggacttcaagaaaactatataaaaattgtgattaacaaaaaacaacttcaactcggaccctatgtttcttatggtatctcctag

SEQ ID NO: 19890 - DNA, 1806 bp, Artificial Sequence
  Description of Artificial Sequence: Synthetic coding sequence
atggcccagaagaagtacctgcaggccaagctgacccagttcctgcgtgaggatcgaattcagctctggaagccaccctacaccgatgagaataagaaagtgggcttggctttaaaagacctcgccaaacagtactccgacagactcgaatgctgcgagaatgaggttgagaaggtgatcgaagagatcaggtgcaaagcgatcgagcgcggtaccggaaatgataattacaggacgacaggcatcgctaccatcgaggtttttctaccccctcgtctgaagaaggaccggaagaacctgttagaaacccggctccatatcactggtagggagctcagatcaaaaattgcagagacttttggcttgcaggagaactacatcaaaatcgttatcaacaaaaaacaactgcagctcggaaagactcttgaagagcaaggagttgcgcacaacgtcaaagctatggtcctggaattaaaacagtccgaggaagatgcaagaaagaattttcagcttgaagaggaagagcaaaatgaagctaaattgaaagaaaaacagattcaacgcaccaaaagaggacttgaaatcctcgccaaacgtgcggccgagaccgttgtggatccagaaatgaccccctatttagatattgctaatcagacaggaaggtccattaggatccctccatcagagaggaaagccctcatgctggccatggggtatcatgaaaaggggagagcctttctgaagagaaaagagtacgggatagccctcccatgccttcttgatgccgataaatatttctgcgaatgctgtagggaactgttggatactgtagacaactatgctgttttgcagctggacatagtgtggtgctactttaggttggagcagttggaatgcctggatgatgcagaaaaaaagctcaacctcgcccagaaatgtttcaaaaactgctacggtgaaaatcatcagcgcctcgttcatatcaaggggaattgtggcaaggaaaaagtactcttcctccgcctgtatttgctccaggggatccggaattatcattctggtaatgatgtagaagcatacgagtatctaaataaggcacgacagctgttcaaggagttgtacattgatccaagcaaagtagataacctgctacagttgggttttacagcccaggaggcccggttaggactccgagcttgtgacgggaatgtcgaccatgctgcaactcacataacaaaccggcgagaggagctggctcagatcagaaaagaagaaaaggagaaaaagcggagacgattggaaaatattaggttcctcaagggcatgggttactcaactcatgcagctcaacagatactgctttccaatccgcagatgtggtggctgaacgactccaaccctgaaaccgacaacaggcaggaaagtcccagccaagagaacattgacagacttgtttacatggggtttgacgcactggtggcagaggctgctctccgggtatttaggggaaatgtgcaacttgcagcacaaaccctcgcgcacaacggtgggtccttaccacccgagctcccactcagccccgaagacagtcttagtcctccagccaccagtccctcagactctgcaggaaccagcagcgccagcacagacgaggacatggagaccgaggccgtgaacgagattttggaagatattcctgagcacgaagaggactacctggactctactctcgaggacgaggagataatcatagccgagtatctgtcctacgtggaaaacaggaaatcggccactaaaaagaattag

SEQ ID NO: 19891 - DNA, 1920 bp, Artificial Sequence
  Description of Artificial Sequence: Synthetic coding sequence
atgaagaccaacggcggccggtgccggatccgggccctgtgctggagtcgtcgcgaatggcggggcgccggtatggctcaaaaaaagtatttacaggctaaacttacccagtttcttcgcgaagacagaatacagctatggaagccaccatacacagacgagaacaagaaggtgggcctagccctgaaagaccttgcaaaacagtattcagatcgactcgagtgctgtgaaaacgaagtggaaaaggtaattgaggagatccgttgtaaggcaatcgagagaggaactgggaacgacaactaccgcaccaccggaatagcaacgattgaggtgttcctcccccctagactaaagaaagataggaaaaatctgctggagaccagactgcacatcacaggtagggagctgcgttcaaagatagccgagacattcgggcttcaggagaattatatcaaaatcgtaattaacaagaaacagctccagttgggcaaaacactcgaagagcagggcgtcgctcacaatgtcaaagcaatggtgctcgaactgaaacagtccgaagaggatgccagaaaaaatttccaactggaagaagaggaacaaaacgaggcaaaactcaaggaaaagcaaattcagcggacaaaaagaggtctcgagattctagcaaagagagccgccgaaactgttgttgaccctgagatgacaccttatctggacatcgccaatcagaccgggcggtctatccggatacctccgagcgaacgtaaagcacttatgcttgctatggggtaccacgagaagggacgcgcctttctgaaacggaaggaatatggaatcgcactcccgtgcctgttggacgccgataagtatttctgcgaatgttgcagagaactgctcgatactgtcgacaactacgccgtgttgcagctcgacatcgtgtggtgttactttcggctggagcagctcgagtgcctcgacgatgcagagaagaagctgaacctggcacagaagtgcttcaagaattgctatggcgagaatcaccagcgactcgtgcacataaagggaaattgcggaaaggagaaggtgctgttcctgcgcctgtatcttctccaggggatcagaaactaccatagcggaaatgacgtggaggcgtacgaatacctcaacaaagccaggcaattgttcaaagaattgtacatcgatcccagcaaggtggacaatctgttacagttgggcttcaccgctcaggaagcccggctgggactgcgagcatgcgacggaaacgtcgatcacgccgccactcacatcactaacagacgagaggagttggcgcagattaggaaggaggaaaaagagaaaaaaagaagacgactggagaacattcggttcctcaagggaatgggctactctacacatgcggcccagcaggttctgcatgccgcaagcggcaacttagacgaagctttaaaaattctgctgagcaacccacagatgtggtggctgaatgactctaaccctgagactgataaccgtcaggagtccccgtcacaggaaaatatagatagacttgtttatatgggcttcgacgcactagtcgctgaggccgccctgcgagttttccgcgggaatgtacagctggctgctcagacccttgcccataacgggggttcactcccaccagagttgcccctgagtcctgaagactctctctcacctcctgctactagtcccagtgatagcgccggcacatccagcgcatccaccgatgaggacatggaaacagaggccgtgaacgagattttggaagatatcccggaacacgaagaagactatctggactcaaccctagaagacgaggagattatcatagctgagtatctcagctacgtggaaaaccgcaagtcagcaactaagaagaattag

SEQ ID NO: 19892 - DNA, 246 bp, Artificial Sequence
  Description of Artificial Sequence: Synthetic coding sequence
atgctgatcaaggtgaagaccctgaccggcaaggagatcgagatcgatattgagcccaccgataaggtcgagagaatcaaggaacgggtggaggagaaggagggcattccgccccaacagcagaggctcatctacagtgggaaacagatgaacgacgagaaaaccgctgctgattacaagatcctaggtgggtcagttctgcacctagtccttgcactcaggggcggcggcggcctcaggcagtag

SEQ ID NO: 19893 - DNA, 819 bp, Artificial Sequence
  Description of Artificial Sequence: Synthetic coding sequence
atgttcgtgaagagcgagaccctggagctgaaggaggaggaggacgtattggttctgctgggttccgccagccccgcgcttgcagccctgaccccactgagtagtagcgccgatgaagaagaggaggaggagcccggagcaagcggcggggccagaaggcagaggggtgccgaggcagggcagggcgcccgcggcggtgtggcggccggagctgagggctgccgaccggctcggctgcttggcttggtgcacgattgcaagcgtcgtccttcccgtgctcgcgcagtgagccgcggtgccaagacggcagagaccgtccagagaatcaaaaagactaggcgcctgaaggccaacaacagggagaggaacaggatgcacaaccttaatgctgctctggatgctctgcgggaggtgcttccgaccttccccgaggatgccaaactaaccaagatcgaaactctgcgcttcgcacacaattacatatgggcactcactgagaccctgcggctggctgaccattgcgggggaggaggcggtggactgcccggagccttgtttagcgaggctgtcctgctgtccccaggtggagctagcgctgctcttagcagcagcggcgattcaccaagtcctgcgagcacttggagctgtaccaacagcccagcgccgtccagctctgtgtcgtccaacagtacctctccatactcctgcacattatctccagctagcccggccggcagcgacatggattattggcaaccacctccacccgacaagcacagatatgcacctcaccttccaattgctcgcgactgcatatag

SEQ ID NO: 19894 - DNA, 1158 bp, Artificial Sequence
  Description of Artificial Sequence: Synthetic coding sequence
atgccccagaacgtggccaagaccgagcccgtgagcatcctgcagcctcagacaacagtcaatcctgatcgtattaagcaaactctgcccagttctccaactacaacaaagagctctccgtcagaccccatgaccaccagccgagcgaaccaggttaaaatcatcgtgcctaatagcactgccggactaatcatcggcaagggaggcgccaccgtgaaagccgttatggaacagtctggtgcgtgggtccagctgtcacagaagcctgatggaatcaatttacaggaacgcgtcgtgactgtcagcggcgagcccgagcaaaatcggaaggcggtggagctgatcattcagaagattcaggaggaccctcaatctggatcttgcttgaacatctcttacgctaacgtgactgggcctgtggccaattccaatccaactggatctccatacgctaataccgccgaggttctgcccaccgctgccgccgccgcaggacttttgggacatgccaatctggccggcgtggcagcctttccagcggtattgagcggtttcactgggaatgacctggtagctattacctctgcacttaacacactggcgagctacggttataacctcaataccctggggctcggtctctcacaggcagcggccaccggagcgctggccgcagcagccgccagtgctaacccagctgctgctgccgccaatttacttgctacctatgcctcagaagcatcagcttctggatctacagctggtggaactgcaggaacgtttgccttggggtcactggctgccgcaactgcggctaccaacggatatttcggggctgctagccccctggccgcctccgccatcctaggcacagagaagagtaccgacggttccaaagacgttgttgaaatagctgtccctgagaatttggtaggcgccattctgggtaaggggggtaaaaccctggtcgagtatcaagaattgacaggcgcacggattcagatctcgaagaagggggaattcgttccaggcacaaggaaccgaaaggttactattacggggacacctgctgccacacaggcagctcagtatctgattacacagagaatcacgtacgaacagggtgtgagagctgcgaatccacagaaagtcggatag

SEQ ID NO: 19895 - DNA, 546 bp, Artificial Sequence
  Description of Artificial Sequence: Synthetic coding sequence
atgatggccgccgcccccatccagcagaacggcacccacaccggcgtccccattgaccttgatccaccagacagccgcaagagaccgctggaggctccgcccgaggctggatcaacaaagagaactaatacgggagaagatggacagtactttctcaaggtgctgattccttcctatgctgcaggatctataattgggaagggtggtcagacaatcgtacagttacagaaggaaaccggcgctacgattaagttgagcaagagcaaagacttctaccctggaaccacggagcgcgtgtgcctgattcagggaacagtggaagcactcaacgctgtgcatggtttcattgcggagaaaattcgggaaatgccgcaaaacgtggccaagacggaacccgtcagcattctgcaaccacagaccaccgttaatcccgatcgcatcaagcagacgttaccctcctcgccgacgacgacaaagtccagccctagtgatcccatgaccacatccagggcaaatcaaaaacacaatatcagctggataagctag

SEQ ID NO: 19896 - DNA, 1452 bp, Artificial Sequence
  Description of Artificial Sequence: Synthetic coding sequence
atgatggccgccgcccccatccagcagaacggcacccacaccggcgtgcccatcgacctggatccccccgacagcaggaagcggcctctggaggcacccccagaagctggctcaacaaaaaggacaaatacaggggaagacggacaatattttctcaaagtcctgattccttcctacgccgccgggtctattatcgggaaaggaggacagaccattgttcaattgcagaaggaaactggtgctaccattaagctcagcaaaagcaaagacttttaccctggcacaaccgaacgcgtctgcctcattcaggggactgtggaagccttaaatgccgtccacggattcattgccgaaaaaatcagggagatgccccagaatgttgcgaaaaccgaacctgtgagcattctgcaacctcagaccaccgttaacccagacaggatcaagcaggtgaagatcatagtccctaacagcacagcgggtttaataatcggtaaaggaggggctacagtgaaagccgtgatggagcaaagcggggcctgggtgcagctgtcacagaagcccgacgggatcaacctgcaggagagggtggtgactgttagcggcgaacccgaacaaaaccggaaggccgttgagctcatcattcagaagatacaggaagatcctcagtccggctcttgcttgaacatcagctacgctaatgtgacgggccccgtcgcaaatagcaatcccacgggttctccgtatgctaatacagccgaggtgctacctacagccgcggctgccgccgggctgctgggccacgccaatctggctggcgtcgcggcatttccagcagtgttgtctggcttcacgggtaacgacctcgttgccatcacctctgccctcaacacactcgcatcatatggctataacctaaacaccctaggcttgggactgtcccaggccgctgcgactggagctctagccgctgctgccgcaagcgccaatcccgcagcagccgcagcaaacctgctggcaacctacgccagtgaggcctcagcctccgggtcaacggcaggcgggactgcgggaacctttgctctcggctccttagcagctgccacagccgcgactaatggctatttcggggccgcatctcctctcgctgcctcggctatcctcggcaccgagaaatcaacagatggaagcaaagacgtggttgagatcgctgtccctgaaaatctggtaggcgccattctgggcaagggaggaaagacgctcgtagagtaccaggagctgactggcgcaaggatccagatttccaaaaagggcgagtttgtgccggggacaaggaaccggaaggtcacgatcaccgggacccctgcagcgacccaggctgcccagtatctcattacccagcgcatcacctatgaacagggggtgcgtgcagcaaatccccagaaggtgggatag

SEQ ID NO: 19897 - DNA, 1524 bp, Artificial Sequence
  Description of Artificial Sequence: Synthetic coding sequence
atgatggccgccgcccccatccagcagaacggcacccacaccggcgtgcctattgacctcgaccccccagattcacgcaaaaggccactggaagcaccacccgaagctggatcaaccaagcggacgaacacgggagaggacggccagtacttcttgaaggttctaatcccatcctatgctgctggcagcatcattgggaagggcggccagacaattgtgcagttgcagaaggaaaccggggccactataaagctctcgaaatccaaggacttctaccccggaaccacagagagagtgtgtctaatacaggggaccgtagaggcattaaacgccgtgcatgggtttatagctgaaaaaataagagaaatgccacagaacgttgcaaaaacagagccagtcagtatcctccagcctcagaccaccgttaaccctgaccgtatcaagcagactctgcctagcagccctactaccactaaatcttcgccctcagacccaatgaccacaagcagagcaaaccaggtaaagatcatcgtgccaaacagtaccgctggactgataatcggcaagggtggggctacggttaaagccgttatggagcagagtggcgcttgggtgcaactctcacagaagcccgacggcataaatctccaggaacgagttgtaaccgtcagcggggagcccgagcagaatcgcaaagccgtggagcttatcatccaaaaaatccaggaggacccgcagagcgggagttgcctgaatatctcctacgctaacgtgactgggccggtggctaattcgaatccaacaggctccccatacgccaacaccgcagaggtcctgccgacagccgccgcggctgctggtcttttaggacacgctaacctggccggtgtcgctgccttccccgccgtgctcagcgggtttaccggcaatgatctggtagctatcacctctgccctgaatacccttgcgagctatggatataacctgaacactctgggtctcggcctgagccaggcggccgccaccggggccctggccgctgcagcagccagtgccaatcccgctgcggctgccgcgaacctgctggcaacatatgcatctgaagcaagcgctagtgggagtaccgccggcggtactgctggcacatttgccttagggagcctggccgccgctacagcagccactaacggatactttggggcagcctcacctctggctgcctcagctatattgggcactgagaaaagcacagacggttcaaaggacgtagttgaaattgcggtgcctgagaatctcgtcggcgcgatacttggcaagggcgggaaaactctcgttgagtatcaggaactcaccggcgctagaatacagatcagtaagaaaggggagttcgtgccaggcacacgtaatagaaaggtgacaattacgggaacaccagcggcgacccaagctgctcagtacctcattacacagagaattacgtacgagcagggcgtgagggccgcgaaccctcagaaggtcggctag

SEQ ID NO: 19898 - DNA, 1479 bp, Artificial Sequence
  Description of Artificial Sequence: Synthetic coding sequence
atggagcccgaggcccccgacagccggaagcggcccctggagaccccacccgaggtggtatgcactaagaggagcaacaccggtgaagagggcgaatacttccttaaggtgctgatacctagctacgcagccgggtctatcatcggaaaagggggtcagaccatcgtccagctccagaaggaaactggggctactattaagctgagtaagtcaaaagatttttatcctgggaccacggaacgcgtgtgcctggtgcaagggacggctgaggcactgaacgctgtgcacagtttcatcgctgagaaagtgcgggaaatcccacaggccatgactaagcccgaggtggtgaatatcctgcaaccccaaacaaccatgaatccggatagagccaaacaggctaaactaattgtgccaaacagcaccgcaggacttattatcgggaaaggaggagctactgtgaaagctgttatggaacaatccggagcttgggtgcagctcagccagaaaccggaaggaattaacctgcaggagagggtggtgacagtaagcggtgagccagaacaggtgcacaaagccgtttctgctatcgtgcagaaggttcaagaggatcctcaatcaagctcgtgcctgaatattagctacgccaatgtagcaggccctgtggccaacagcaatcccaccggctctccatacgccagccctgccgacgtgcttcccgcggcagctgccgcctccgccgcagcggcctctggcctgctgggcccagcagggctggctggtgtgggcgcttttcctgctgctttacccgcgttctctggtacagacctgttggccatctctacagcactgaacaccctggcttcatacggctacaataccaattctctggggctcggtctgaacagcgcagccgcctcaggcgttctagcagctgtggccgcaggggcaaacccggcagccgcggctgccgcgaatctcctggcctcatatgccggggaggccggagccggccccgcggggggcgcagcaccaccgccaccaccgcctccgggcgctttaggttcattcgctttggccgcggctgccaatgggtacctgggcgcaggcgcgggaggcggcgcaggcggaggtggcgggcccttggtagctgccgcagctgcggcaggagcagccggtggtttcttgaccgccgaaaaactcgctgctgagagcgctaaagagctggtggaaatcgccgtgccagagaacttagtaggggcaatcttgggaaaaggaggcaagaccctagtagagtatcaggaactgaccggagctcgcatccaaatctcaaagaaaggggagtttttgcctggaactcgaaacaggcgagtgactattacgggctccccggcggccacccaggccgcgcagtacctgattagccaaagggtgacatatgaacagggtgtgagagcttccaacccgcagaaagtgggttag

SEQ ID NO: 19899 - DNA, 840 bp, Artificial Sequence
  Description of Artificial Sequence: Synthetic coding sequence
atggagaacagcgagaagaccgaggtggtgctgctggcctgcggctccttcaatccgatcacaaacatgcatttgcgcctttttgagctagcaaaggattacatgaatggaacgggccggtacacagtagtcaagggcatcatctccccagtcggggatgcgtacaaaaagaagggcctcattcctgcctaccatcgggtgattatggccgaactggcaaccaaaaacagcaagtgggtggaagtcgacacatgggagagcttgcagaaggaatggaaggaaacactcaaagtactgcgccatcaccaggaaaaattagaagccagcgattgcgaccatcagcaaaattccccaactcttgagaggccgggtcgtaaaagaaaatggacagagacacaggactccagtcagaagaaatccctcgaacccaagacaaaagctgtgcccaaagtcaaactcctgtgtggcgctgacctacttgagtctttcgctgtgccaaatttatggaaatctgaagatatcacacagatcgtggccaattatggcctgatttgcgtcaccagagcgggtaacgatgcacagaagttcatctacgagagcgacgtgctgtggaagcacaggagtaatatccatgtcgtgaatgagtggatagccaacgacatatcctcaacaaagatccgacgagccttacgccgcggacagtcaatccgatatttggtccctgatctggttcaagagtatatcgaaaagcacaatctgtactcatctgaatctgaggatcgtaatgctggcgtgatcctggccccccttcagcgcaatacggcagaggccaagacttag

SEQ ID NO: 19900 - DNA, 483 bp, Artificial Sequence
  Description of Artificial Sequence: Synthetic coding sequence
atggagaacagcgagaagaccgaggtggtgctgctggcctgcggctcctttaacccgatcaccaacatgcatttacggctgttcgaactcgccaaggactatatgaacggcacaggccggtacactgtagtgaaaggaattatttcacctgtaggcgatgcatataagaagaaaggactgattcctgcgtaccatcgcgtcataatggcagagctggccactaagaacagcaagtgggtggaggtagacacatgggagtcgctgcagaaagaatggaaagaaaccctgaaggtgctgcggcaccaccaggagaagcttgaggcttctgattgtgaccaccagcagaatagcccaaccctcgagaggcctgggagaaagaggaaatggacagagactcaggacagctcacagaagaagtcactagagcctaagactaaggacggcgtgtccctataccatcccggttggtccgccgtggcatag

SEQ ID NO: 19901 - DNA, 840 bp, Artificial Sequence
  Description of Artificial Sequence: Synthetic coding sequence
atggagaacagcgagaagaccgaggtggtgctgctggcctgcggcagcttcaatccaatcaccaacatgcatctgcggctttttgaattggcaaaggattacatgaacgggaccggccgctatacggtcgtaaaaggcataatctcgccggttggcgacgcttacaaaaagaagggactgatccccgcctaccaccgtgtcatcatggcggagctggctacgaagaactcaaagtgggtagaagtggatacctgggaaagcctccaaaaggagtggaaagagactctgaaggttctgcgacaccaccaggaaaagctagaagcttctgattgcgaccatcagcagaattcgcccaccctagagcgccctggacgcaaaaggaaatggaccgagacacaggacagctcccagaaaaaatccctggaaccgaaaacgaaggccgtgccaaaagtgaaattactctgtggtgccgacttgctggagtccttcgctgtaccaaacctgtggaagtctgaggatattacgcagatcgtcgctaactatgggttgatttgcgttacacgggccggaaacgatgcccaaaaattcatctacgagtccgatgtcctgtggaagcaccgctccaatattcatgtagtgaatgaatggattgcaaatgacatctctagcacgaaaatcagacgcgcactgcgccggggccaatctattagatatctggttcctgatcttgttcaggagtatatcgaaaagcacaatctctattcttccgaatcagaggaccgcaatgcaggggtcatcctggcccctttgcagagaaacactgctgaggcaaagacttag

SEQ ID NO: 19902 - DNA, 1239 bp, Artificial Sequence
  Description of Artificial Sequence: Synthetic coding sequence
atggcccccgtggagcacgtggtggccgacgccggcgccttcctgagacatgcagcactgcaagatataggcaaaaacatctacactattagagaggtggtgaccgagatcagggacaaggctaccagaagaagacttgctgtcttaccctacgaactgcgcttcaaggaaccactgcccgagtatgttagactcgtaacagagtttagcaaaaagactggggactatccttcactgagcgcaactgacatccaggtactggcattgacgtaccagttggaggccgagttcgtgggggtaagccacctgaagcaggagcctcaaaaggtgaaagtgtcttcttccatccagcatcctgagacccccctgcacatttctggtttccacttgccatacaaaccaaagccccctcaggagaccgaaaagggccactccgcgtgcgaacctgagaatttggagtttagcagcttcatgttctggcggaatcctttgcctaatatagatcatgagctccaggaactccttattgacagaggggaggacgtgccttctgaagaagaggaggaggaggagaatggctttgaagatagaaaggatgactctgacgacgacggcgggggctggatcacacctagcaatataaaacaaatccagcaggaactggagcagtgcgatgttcctgaggacgtgagggtgggctgcctgacaactgacttcgccatgcaaaatgtcctgctccagatgggcctgcatgtgttggccgtaaatgggatgctgatccgggaggcaagatcctatatcctgcggtgccatggatgctttaagaccactagtgatatgagcagggtgttttgttcgcactgtggtaacaagactttgaagaaggtatcggtcactgtgtcggacgacggcaccttgcacatgcatttctcaagaaatcccaaggtcttaaacccacgtggcctgcgttacagcctccctacgccgaagggtggtaaatacgccatcaacccccatcttacagaggaccagcgatttcctcagctgcgcttatcgcagaaggcccgccagaaaaccaacgtgttcgctccagactacatcgccggcgtgtcccctttcgttgaaaatgacattagcagccggagcgctacactgcaggtcagggactctacactaggagccgggcgacgtaggctcaaccccaatgccagtcgcaaaaaattcgtgaaaaaacgctag

SEQ ID NO: 19903 - DNA, 1236 bp, Artificial Sequence
  Description of Artificial Sequence: Synthetic coding sequence
atggacggccgggccgagctgcccgccttcccccgggccggcgcccctcccctcgccgcctccgataccgtgcctgcagcacccgagggtgccggagccgcacggcctgccgcacctctgaggccaacctccttcagcgtcctagacatcttggatccgaacaagtttaactccagacgcaggcgttgcgttctgttagggcccgtagcccctgccgcatgcgccccttgtgcctcagccccttgcgctcccgcccctgcggcctcaggacggcccccccgcgcagaggagctggagaggcgtgcgctcgccggcgccggcggcgtgggagccgcaggcgccgagccacccaatgcaggcgatcctttcaaagctggggaagccgagaccaacgatactaacggttattcttccggtggaggcggacattcacccagtgcagactcaggagacgaggtcccagatgacgaagatgacgatgaggatgaagcgccagagaccgaggcagcccgaggggccgaggaagcccggggaggagggggtgggctgggagcacgtggaagcggttgccagggggccgccgagactgatgcatcaccaggcgctactgtcgacgaggcagcagcccctggtcccagggaaaattctcctgttgcccagggcccaccgggcggtgctgccgcacccggtggtgccggaaccacaccccagggcacagctacagccgccaaaccgaaacgaaagaggaccgggagcgattctaagagcgggaagccaagaagagcccgcactgccttcacttacgagcaactcgtggcgcttgagaataaatttaaggccacccgctatctgtcagtgtgtgaaaggttgaacctggcactgagcctgtccttaaccgaaactcaagtgaaaatctggtttcaaaacagaaggaccaaatggaagaagcagaaccccggggccgatacttctgcgcccactggggggggaggtggacccggtcctggagccggtccaggaactggtctgccaggtgggctttcacctctgtcccccagccctcccatgggggctcctctcggcatgcacggcccggccggatatccagcccacggccctggcggtttagtgtgtgctgcacagctgccttttcttagttcacccgcagtgttgagcccttttgtgctaggctctcaaacttatggagcccctgctttttacgcaccccacctctag

SEQ ID NO: 19904 - DNA, 1095 bp, Artificial Sequence
  Description of Artificial Sequence: Synthetic coding sequence
atgatgctgcccagccccgtgaccagcacccccttcagcgtgaaggacatccttaatttagagcagcaacaccagcacttccacggggcccatcttcaagcagatctcgagcatcactttcattcagcaccatgcatgctagcagcagcagaagggacgcaattctctgatggaggtgaggaagatgaggaggatgaaggagagaaattatcctatctaaactcactggcggccgcggatggccacggagattccggcctctgcccacaggggtacgtacatactgtattacgtgactcatgcagcgagcccaaagagcatgaagaggagcccgaggtggtgagggacaggagccagaaaagttgccagttgaaaaagagcctagagaccgcaggggattgcaaagccgcggaggagagcgaaaggccaaaaccacgtagcaggagaaagccaagagtcctgtttagccaggcccaggtgtttgagctcgagaggcgcttcaagcagcagagatacctgtcagctcctgaacgcgagcatctcgcctctagcctcaaactcacatctacccaggtgaaaatttggttccaaaacagaagatacaagtgcaagcggcagcggcaggataaaagccttgagctcggagctcacgcacctcctccccccccccgtagggtggcagttccggtgctagtaagagacggcaaaccatgtgtcacaccgagcgcacaagcctacggagccccatactctgtaggggcatccgcttatagctataacagctttcctgcatatggctatggcaactcagcggccgcagcggccgcggcggcagcggctgctgccgctgctgccgcatacagcagctcctatgggtgcgcttacccagctgggggcgggggcggagggggcggcacatcagcggccacgactgccatgcagccagcttgtagcgccgccggaggaggtccttttgttaacgtatccaacctcggcggctttggctctgggggatctgcgcagcccttacatcaaggaacagcggccggagctgcatgtgcacagggaacgctgcagggcattagagcttggtag

SEQ ID NO: 19905 - DNA, 1104 bp, Artificial Sequence
  Description of Artificial Sequence: Synthetic coding sequence
atgctggccgtgggcgccatggagggcacccggcagagcgccttcctactgtcatcccctcccctggccgcactccatagtatggctgaaatgaagacccctctctatcccgccgcctatccccccctgccagccggccccccatcctcttccagctcatccagtagttcatcttctccctcaccccctctggggacccataatcccggggggttaaaacctccggctacagggggcctgagcagcctggggtcacccccccagcagctttcagccgccactcctcatggaattaacgatatccttagcagaccgagcatgcccgtggcctctggcgcagctctgcctagcgcaagcccaagtgggtcttcttcgtctagtagctctagcgccagcgcgtctagcgctagcgcagctgcggccgcagctgcagccgccgccgcggccgcttccagccctgcaggcctcctcgcagggttgccccgattttcttctctgagccccccacctcctccacccggtttatacttttccccctcagctgctgctgtggctgctgtgggtcgataccccaagcccctggctgagctcccagggaggaccccaatattttggccaggtgtcatgcagtctcctccctggcgggatgcacgtttggcttgtacaccccaccaaggttccattctactggataaagatggcaaacgaaaacatactcgcccaacgttcagtggccagcagatctttgccctcgagaagacctttgagcagactaaatatctagcaggtcccgagagagcgcgcctggcttattctctgggcatgacggaatctcaagtcaaggtgtggtttcaaaatcgccggactaagtggaggaaaaaacatgcagcagaaatggcaacggcgaagaaaaagcaagattctgagactgaacggctcaagggggcgtccgagaacgaggaggaggacgacgactacaacaagcctctcgacccaaactctgacgacgagaaaatcactcaattattaaaaaagcacaagtcgtcatcaggcggcggcggcggcctgctactgcatgcttcagaacccgaatctagtagctag

SEQ ID NO: 19906 - DNA, 834 bp, Artificial Sequence
  Description of Artificial Sequence: Synthetic coding sequence
atggacaccaaccggcccggcgccttcgtgctgagcagcgcccccctcgcagctttgcataacatggccgagatgaagacctcactgtttccttacgccttgcagggcccagccggatttaaggctccggccctcgggggtctgggggcacaactgcctctggggaccccccatggtatttccgacattttgggcaggcccgtcggtgctgcggggggagggctcttgggagggctgccaagattgaacggcctggcatctagcgcgggtgtatacttcggtccagcagcggccgttgcgagagggtaccctaagcccctggccgagctgcctgggcggcccccaatcttctggcctggggtggtccaaggcgccccctggcgggatccacggcttgccgggccggccccagcaggaggcgtgctcgataaggatggaaagaaaaaacactctcggccaacattcagcggtcaacaaatattcgccttagaaaagaccttcgagcagaccaagtatttggccggtcccgaaagggctcgcctggcctacagtctgggcatgacggagtctcaggtgaaagtatggttccagaatagacggaccaagtggagaaagaggcatgccgtggagatggcaagtgccaaaaagaaacaggacagtgatgctgagaagttaaaggtcggcgggagcgatgctgaggacgatgatgagtacaatcggccactagacccaaactcagacgatgagaagatcactcggctcctgaaaaagcacaagccctcgaacctcgccctcgtgagcccctgcggcgggggggcgggagatgctctctag

SEQ ID NO: 19907 - DNA, 225 bp, Artificial Sequence
  Description of Artificial Sequence: Synthetic coding sequence
atggtggccctgcggggcctgggcagcggcctgcagccctggtgccccttagacctgcgcttggaatgggtagacacagtctgggagctcgacttcaccgaaactgagcctctggacccatctattgaagccgaaattatagaaaccggcctcgctgccttcacaaaactatatgaaagcctgttgccatttgcaaccggagagcacgggtctatggaagtgtag

SEQ ID NO: 19908 - DNA, 108 bp, Artificial Sequence
  Description of Artificial Sequence: Synthetic coding sequence
atggtggccctgcggggcctgggcagcggcctgcagccctggtgccctctggatctccggctcgaatgggtggatacagtgtgggagctggattttactgaaacttag

SEQ ID NO: 19909 - DNA, 4497 bp, Artificial Sequence
  Description of Artificial Sequence: Synthetic coding sequence
atggtggccctgcggggcctgggcagcggcctgcagccctggtgccctctggatctccgtctggagtgggtcgacacagtgtgggagctggattttacggaaacggaaccattggacccttcaatcgaagccgaaataatcgaaactggactggctgctttcacgaaactgtatgaaagcctattgccctttgccacgggagaacatgggtcaatggaatccatttggacattcttcattgagaacaatgtgagtcattctactctggttgcccttttctatcactttgttcaaattgtgcacaagaagaacgtgtctgtccaataccgggagtatggactgcatgctgccggactttacttcctgctgctcgaggtgccagggtcagtggctaatcaagtcttccatcccgtaatgttcgacaaatgtattcagaccctcaagaaaagctggccacaagagtctaacttgaaccgtaaacgcaagaaggagcaaccgaagagcagccaggccaatccaggacgccacagaaaacgagggaaacctcctcgtagggaggacatagagatggatgaaattatcgaagaacaggaggacgagaatatctgctttagcgcacgggatcttagccagattcggaatgctatcttccatcttcttaaaaattttctgcgcttgttacctaagttttcacttaaggaaaagccacagtgtgtgcaaaattgcattgaggtgtttgtgagtctgacgaactttgagccagttctccatgaatgtcacgtcacacaggctcgcgctctgaaccaggccaagtacatcccggagctggcctactatgggctttatcttctgtgtagcccaatccatggagagggggataaggtcatttcatgtgtttttcaccagatgctgtctgtgattctcatgctagaggtgggggaaggtagtcacagggcacccctggccgtgacaagtcaggtcattaactgcagaaatcaggcagtgcagttcatctccgcacttgtagatgagttgaaagagagcattttccctgttgtgcggattctgcttcagcacatttgcgccaaagtggttgacaagagcgagtatcggactttcgccgcccagtcccttgtgcaacttctgtctaagctgccttgcggagaatatgccatgtttatcgcctggctctacaagtatagtcgaagctctaagatcccccaccgtgtatttactctggacgtcgttctagcactgttagaattgccagagcgggaggtcgacaacacactgtccctcgagcatcagaaatttctgaagcataagtttctcgtacaggaaattatgttcgaccgttgccttgacaaggctccaacagttaggtcgaaagcactgtcctctttcgcccactgcctggagctgacagtaacctctgcttctgagtcaatcttagagctgctaattaattcccctaccttcagcgttatcgaaagccaccccggaacgctcctgcgcaacagttccgccttcagctatcagaggcagacgtcgaatagatctgagcctagcggggagatcaatatagattccagcggcgaaaccgtcggatccggcgaaaggtgtgtgatggccatgttgagaaggcgaattagggacgagaagactaacgttaggaagtccgccctgcaggtgttggtcagtatactgaaacactgcgacgtatcaggaatgaaggaagacctttggatcctgcaggaccagtgccgggaccctgccgtgtccgtgcggaaacaagcactgcaatctctgacagaattgttgatggcccagccgcgatgtgtgcagatccagaaagcatggctccggggcgtggtgccagttgtgatggattgtgagagcaccgtccaggagaaggcactggagttcctcgaccagttattacttcagaacattagacaccattcacatttccactctggcgacgattcccaggtactggcatgggccctgcttacacttctgaccacggagtcacaagagctgtctcggtatctaaacaaagcctttcacatctggtcaaagaaggagaaattctctcccactttcataaataacgtaatatcccatacgggaaccgagcacagcgcccctgcctggatgctgctctccaagatcgcaggcagctctccaagacttgactatagccggataatacaatcgtgggaaaagatctcgtctcagcaaaacccgaactccaataccctggggcatatcttatgcgttattggtcacatcgcaaagcatctgcccaagtcaacacgggataaagtaacagatgctgtcaaatgtaaactcaacgggtttcagtggtctttggaggtaatcagttccgccgtcgacgcactacagagactgtgccgagcatcagcagaaacaccagcagaagagcaggagctccttacccaggtgtgtggagacgtgctgagcacgtgtgagcatcggctgtctaacatagtccttaaagagaacggaactggaaacatggacgaggatctgcttgtgaaatacatctttactctaggcgacattgctcagttgtgccccgcaagagtagagaaacgcattttcttgctcatacagtctgtcctggcttccagcgccgacgcagaccacagcccttctagccaagggtcgtcagaagccccggcctcacagccaccacctcaggttcggggttctgtgatgccaagcgtgatccgagcccatgcaatcatcactctgggcaagctgtgcctgcagcatgaagacttggccaaaaagagcattcctgccctcgtacgagaactggaggtctgtgaggacgtagcagttagaaacaacgtgattatcgttatgtgtgacctgtgtatcaggtataccattatggtcgataaatatattccaaatatttccatgtgcctgaaagacagtgatccttttatcagaaagcaaacacttatcctcctcacaaatctgctgcaggaggaattcgttaaatggaagggctcgctctttttccggtttgtgtccacactgattgattcacaccccgacatcgctagcttcggagagttctgcctcgcgcatctgctgctgaagcgcaatcccgtgatgttctttcaacacttcatcgaatgtatcttccatttcaataactacgagaagcacgaaaagtacaacaaattccctcaaagtgagagagagaaaagactgttcagtctcaagggcaaaagtaacaaggaaagacggatgaagatttataagtttctgctggaacactttaccgacgagcagaggtttaacatcacctcaaaaatttgtctgtccatactcgcatgctttgcagatgggatcctcccgctggatttggatgcatccgaattattgtctgatacgttcgaggtcctgtccagcaaggaaataaaattgctggcaatgaggtcgaaacccgacaaggatttattgatggaggaggacgatatggcccttgccaacgtcgttatgcaagaggcacaaaagaagctcatctctcaagtgcagaagaggaattttatcgaaaacataatccctattattattagcttaaaaaccgtcttagaaaaaaataagattcctgccctgcgtgagcttatgcactacctaagggaagtgatgcaggattatagggatgagctgaaagatttcttcgcggtagacaagcagcttgccagtgagctcgagtatgatatgaaaaaataccaggagcagctcgtgcaggaacaggagttagctaaacatgctgatgtggccgggaccgccggtggcgctgaagtcgctccagttgcccaggtggcactgtgcctggaaactgttccagttcccgccgggcaagagaatccagccatgagtccagccgtttcgcagccctgcactcctcgagccagcgccggccacgtggcagtctctagccctacacccgaaacgggtccattgcaacgcctgttaccaaaggctaggccaatgtccctctccaccatcgctatattaaactctgtgaagaaggcagtggagagcaagagtcgccaccgctccagaagtctgggcgtgttgcccttcaccctgaactcaggcagccctgagaagacttgttcacaggtgagtagctactccctcgagcaagagtctaatggagaaattgaacacgtgacaaagagggcaatcagtacccccgagaagtccatctccgacgttacgttcggggccggggtatcttatattggcactccaaggacccccagttctgccaaggaaaagattgaaggtagaagccagggcaacgacattctctgtctttccctgcccgacaaaccccctcctcagccccagcaatggaacgtgagatctcccgcccggaacaaggatactcctgcatgctcaaggaggtcgctccggaaaaccccgttgaagactgcaaactag

SEQ ID NO: 19910 - DNA, 2667 bp, Artificial Sequence
  Description of Artificial Sequence: Synthetic coding sequence
atgctgctggagtgcttcatcaacatcaactacatcaagaaggaggaaggtcggaggtttctgtcctgcctgttcaactggaacatcaacttcataaagatgatccacggcaccatcaagaaccagctacagggcctccagaagtctctgatggtatatattgctgaaatatactttcgggcctggaagaaagcaagcgggaaaatccttgaggccatcgaaaatgattgcatacaggatttcatgttccacggaatccatctgccgcgacgtagcccagtgcatagcaaagtgcgagaggtactttcttacttccaccaccagaaaaaagttaggcagggagtcgaggagatgctctaccgcttatataagcctattctctggaggggacttaaagcacggaatagcgaagttagaagcaatgccgctttactgtttgtggaggcatttcctatccgtgacccgaacctgcacgcaatcgagatggacagcgaaatccagaagcaattcgaggaactgtactccctgctggaggacccttacccaatggttagaagtactgggattctgggggtgtgcaagatcacaagcaaatactgggaaatgatgcccccaacgatcctcatagatttgttgaaaaaggtgactggggagctggcgtttgatacgtcatcagcggatgtccgttgctccgtgtttaaatgcctgcccatgattttagataataagctctctcacccgcttctggaacagctgctacctgcactgcgttactcactgcacgataatagcgaaaaagtgagagtggccttcgtggatatgttactgaagattaaggcggttagggcagccaagttttggaaaatttgccccatggagcatattttggtacgactggagacagattctcgacccgtctcacgtagactcgtgagcctcatctttaatagtttcctgccagttaatcagcctgaggaagtgtggtgcgaacgatgtgtgacactggttcagatgaatcacgccgccgctaggaggttttatcagtacgcccacgagcacacagcctgcacaaatatagccaaactcattcacgtcattagacattgtcttaatgcttgcatccaaagggctgtgcgggagccccctgaggatgaggaagaggaagatggaagggaaaaagaaaacgtgaccgtcctggataagacccttagcgtcaatgacgtcgcttgcatggctggtttgctcgaaatcattgtcatcctgtggaagagcatcgatcggagtatggagaataacaaagaggccaaactgtatactattaataagtttgcctcggtgctgcccgagtacttgaaagtgttcaaggatgaccggtgtaaaattcctctgttcatgctaatgtcattcatgcccgccagtgccgttccccccttctcctgtggagtgatctcaactcttcgaagccgcgaagagggagctgtggacaagtcatactgcaccctgctcgactgtctatgtagctgggggcaggtgggccatatactcgagctggtcgataattggctgcctactgagcacgctcaggctaaaagcaatacagcttcaaaggggcgggtacagatacatgacacacggccagtgaagcccgaactcgccttggtctacattgagtacctgctgactcatcccaaaaatcgagagtgccttctgtccgcaccaaggaaaaagctgaatcacctcctcaaggccctggagaccagcaaggctgacttagagtcattactgcagaccccaggcggaaaaccacgcggcttcagcgaagccgccgcgccaagggcgttcggactccattgccgcctgtccatccacctccagcataaattttgtagtgaagggaaagtctatctgtcaatgttggaggatacgggattctggctggagagtaaaatcttaagcttcatccaagaccaggaagaggactacttaaaattacaccgagtaatctaccagcagatcattcagacttacctcactgtgtgcaaggatgtggtaatggtggggctcggggatcaccagttccaaatgcagctgctgcagagaagcttggggattatgcagaccgtaaaaggcttcttctatgtaagcctgctcctcgatatacttaaagaaatcaccggatcaagcctaattcaaaagaccgactccgatgaggaggtggcgatgcttctagacaccgttcagaaggtgtttcagaagatgctcgagtgtatagcaagaagctttcggaagcaaccagaggaaggactgcgcgtgtccgacgtagaagagctgactccccctgagcacttgagtgatctgcctcccttctcccggtgtctgatcggcatcattatcaaatcaagtaacgtcgttagatcctttcttgacgagctcaaagcttgcgtggcatccaatgacatcgaaggaatcgtgtgtttgacagccgccgtacacattatactggtgatcaatgcaggcaagcacaaatcaagtaaagtgagggaagtggccgcaactgtccatcgaaaactcaagacttttatggaaattaccttagaagaagactccatcgagaggtttctgtacgaatcctccagtaggacactcggggagttgctgaatagctag

SEQ ID NO: 19911 - DNA, 3432 bp, Artificial Sequence
  Description of Artificial Sequence: Synthetic coding sequence
atggagaagcgggagaccttcgtgcaggccgtgagcaaggagctggttggagagttcctgcagtttgtgcagttagacaaggaggcttcagaccccttttccttgaatgagctgctggacgagttatcccgcaaacaaaaggaggagctgtggcagcggctgaagaatctgctgactgatgtattattagagtctcccgtggatggatggcaagttgtagaagcacagggcgaggataacatggagactgagcatggctcaaagatgcgaaagtcaatcgaaattatttacgctatcacttcagtaatcctcgcctcagtctcggttataaatgaatcagagaattacgaggccctgctcgaatgcgtgataatcttgaacggcatactgtatgcgctcccagagtcagagaggaagctgcagtccagcatacaggatctgtgcgtcacatggtgggaaaagggcctgcccgctaaagaagataccggaaagactgcctttgtcatgcttttaaggcgcagcctggagacaaagaccggagctgatgtgtgcaggctgtggcggatccatcaggcactttattgtttcgactatgacctggaagaatcaggcgagatcaaggacatgctactggaatgttttattaacatcaattatattaaaaaagaagaggggcgtagatttctcagttgtctctttaactggaacattaacttcattaagatgatccatggaacaataaagaaccaactccagggtttgcagaagagtctcatggtgtacatcgcagagatctattttagggcttggaagaaagcttccgggaaaatcctggaagccattgaaaacgattgcatccaggatttcatgttccatggcattcatctgcccaggcgatcccctgtgcacagcaaggtccgggaagtgctttcttactttcatcaccagaaaaaagtgcgacagggagtggaggaaatgctataccggctgtacaaaccaatcctgtggagaggcctgaaagctagaaattcagaggttaggtcgaacgccgctctactgtttgtggaagccttccccatcagggatcccaatctacatgctattgaaatggattcagaaattcaaaagcagtttgaagagctttacagcttgctggaggatccctacccaatggtccgctccacaggcattctcggggtttgtaagataacaagcaagtattgggaaatgatgcctccaactatcctgattgaccttctgaagaaggttactggagaattagcatttgacaccagctccgcagacgtaagatgttccgtgtttaaatgtctgcctatgatcctggataacaagttgtcccaccctctcttggaacaactgctcccggccctgcgatattctcttcacgataattctgaaaaggttagagtggctttcgtggatatgctcttaaaaattaaagctgtgcgcgcagctaagttctggaaaatttgtcctatggagcatattcttgttcggttggaaaccgattcgaggcctgtttccaggaggctggtcagcctcatctttaatagctttctgccagtcaaccaaccagaggaagtgtggtgtgagaggtgtgtgacactcgtgcaaatgaatcatgcagcggcgagacggttctaccagtatgcccatgagcacacagcatgtactaatattgccaagctgattcatgtcattcggcactgtttgaacgcctgtattcagcgggcggtcagagaaccaccggaagatgaggaggaagaggacggacgtgagaaggaaaacgtgaccgtgctggacaagactcttagtgtcaatgatgtggcttgcatggcaggcctgctggagatcatcgtcatcctttggaagagcatcgacagatcaatggaaaataacaaagaagctaagctgtatacaataaacaaatttgcgtcagtgttgccagaatacctgaaagtcttcaaggatgaccggtgtaagattcctctgtttatgctgatgtcttttatgcccgcttccgcagtccctcccttttcgtgtggcgtcatcagcacactgcgttcccgggaggagggcgctgtggataagtcatactgcacactcttagattgcctgtgtagctggggacaggtcggccacatcctcgagctggtcgacaattggcttcccactgaacacgcgcaggccaaaagcaataccgcgtccaaaggtagagttcaaatccacgacactaggcccgtgaagcctgagttagcccttgtgtatattgaatacttgctgactcatccgaagaatcgcgagtgcctgctgtccgcaccgagaaaaaagctgaatcatctcctaaaagccctcgagacatcgaaggccgatttagaatctctgcttcagacacccggagggaagccaagaggtttttccgaagcagctgcccctagagcctttggattgcactgtcgattgtctatacacctgcagcacaaattttgtagcgaggggaaagtctatctcagcatgctggaagatacgggtttctggctggaatccaagatcctgagtttcattcaggaccaggaagaagattacctaaaacttcaccgcgtgatttatcagcagatcatccagacgtatctgaccgtgtgcaaagacgttgtcatggtgggccttggtgatcaccagtttcagatgcagcttctacagcgcagtctaggcatcatgcagactgtgaaagggttcttctatgtcagtctgttattagatatactaaaagaaataaccggctcctcgctcattcagaagaccgatagtgacgaagaagtcgccatgctgctggatactgttcagaaggtctttcagaaaatgcttgagtgtattgcacgctcctttaggaaacagccagaggaaggtctgcggctgttatacagcgtgcagagaccgcttcatgagttcattacagcagtccagagcagacacacagatacgcctgtccatcgcggagtactaagcactttgattgccggccccgttgttgagatctcccatcagctgagaaaggttagtgatgtggaggagctgacgcctccagagcatcttagcgacctccccccattttctcgctgccttatcgggattatcataaagagcagcaatgtagtgaggtccttcttggacgagttgaaggcgtgcgtcgcttcgaacgacattgaaggcatcgtctgcttaacggccgcagtccacattatcctggttatcaacgcaggtaaacacaaatcttccaaggtgcgcgaggtggctgcgaccgtgcatcgaaagctgaaaactttcatggagatcacactggaggaagacagcattgagaggtttctctatgaatcttcctcgaggaccctgggagaattactcaattcctag

SEQ ID NO: 19912 - DNA, 3471 bp, Artificial Sequence
  Description of Artificial Sequence: Synthetic coding sequence
atggagaagcgggagaccttcgtgcaggccgtgagcaaggagctggtaggcgagtttctgcagttcgtacagctggacaaagaggcttctgaccctttcagtctaaacgagctcctggacgagctttctaggaaacagaaggaggagctctggcagcggcttaagaatctcctgactgacgtactcctggagtcgcccgtggacggatggcaggtagttgaagcacagggcgaagataatatggaaaccgagcacggctcgaaaatgaggaaatccattgaaataatctatgccataacgagtgtaattctcgcatccgtgtctgtaataaacgagagcgaaaattacgaagccctgcttgaatgcgtgatcatacttaacggaattctttatgccctaccagaatctgagcggaagttacaatccagcattcaagacctgtgtgtgacgtggtgggagaagggtctcccggccaaggaggacacgggcaagactgcgttcgtgatgctcctgcgccgcagcctcgagactaaaaccggcgcagatgtgtgtcggctctggcgcatacatcaagcactctactgtttcgattacgatctggaggaatcaggtgaaatcaaggatatgctcctagagtgtttcatcaacataaattacattaaaaaggaggagggcagacgtttcctgagctgcctgtttaactggaacatcaacttcatcaagatgatacacggaaccatcaagaaccagctgcaggggctgcagaaatccctgatggtgtacatagctgagatctatttcagagcatggaagaaggccagtgggaagatccttgaggccatagaaaacgactgtatccaggacttcatgtttcacggaattcatctccccaggcgctcacccgtgcattcaaaagtaagggaagtcctgtcatattttcaccaccagaagaaagtgaggcaaggagttgaagagatgctataccgcctgtataagcctatcctgtggagggggcttaaggctcgcaattcagaagtcaggtctaatgcagcattgctgtttgtagaggcctttcctattcgggatccaaacttgcatgcaatagagatggactccgagatacagaaacagtttgaggagctctactctttacttgaagacccatatcccatggtacgcagcacagggattctgggcgtttgcaagatcacctccaaatactgggaaatgatgcctccaactattttaatcgacctactcaagaaggtgaccggggagctggcctttgacactagtagcgccgatgttagatgttctgtgtttaaatgcctgcctatgattctagacaataagcttagccacccgctcctcgaacagctgcttcccgccctccggtattccctccatgataactccgagaaggtgcgggtggccttcgtagatatgctgttaaaaataaaggcggtccgggccgcaaagttttggaagatctgtccgatggagcacatcctggttaggctggagactgactcccgccccgtgagcaggcgcctggtcagtcttatcttcaattcttttctgcccgtgaatcaacctgaagaggtctggtgtgagcggtgcgtcaccctggtccaaatgaatcacgcggccgccaggaggttctaccagtacgctcacgaacacaccgcctgtaccaatatcgccaagctgatacatgtgatcagacactgccttaacgcctgtattcagcgagccgtcagggagccccccgaggacgaagaagaagaggacggacgagaaaaagaaaacgttacagtgctggacaagacgttgagcgtgaatgacgttgcatgcatggccggcctgctggagattatcgtgattctgtggaagagcattgacaggtcaatggaaaataacaaagaggcaaaactgtacactatcaacaaatttgcctccgtgctgcctgaatatcttaaggtgttcaaagatgaccgatgtaaaatcccactgttcatgttgatgtcatttatgcccgccagtgctgtgccacccttctcttgtggcgtaattagtactctcaggagcagggaggagggagcagtggacaaatcttattgcaccctcctcgactgcctatgttcatgggggcaggtggggcacattttggaacttgtggacaattggctcccaacagagcacgcacaggcaaaaagtaatactgcgagtaaaggcagggtgcaaatccacgacacccgccctgttaaaccagaactcgccctcgtgtatatcgagtatctgctcacccacccaaaaaacagagaatgccttctttccgcccctaggaagaaactgaatcatttgctgaaggccctagagacaagtaaagcagacttggagtcattgctccagaccccaggaggcaagcctcggggcttctctgaggcagcagctccacgagccttcggtttacactgcaggttgagtattcacctgcagcacaagttttgtagcgaaggaaaagtatatctgtctatgctcgaggatacaggtttttggctggaatctaagattctgagttttatacaggatcaggaagaggactatctgaagcttcatagggtcatatatcaacagattatccaaacttacctgaccgtatgtaaggacgtcgtcatggtaggacttggcgatcaccagttccagatgcaactactgcagcggtctctgggaattatgcagacagttaagggcttcttctacgtatctttactgttggacattctgaaggaaattaccgggtcctcgctaatccagaagacggatagtgatgaggaggtggccatgctgctagacaccgttcaaaaggttttccagaaaatgcttgaatgtattgctaggagcttccggaagcaaccagaggaaggactgcgtctcttgtattcagtgcaaaggccactgcacgaattcatcacagccgtgcagtccaggcatacagacacccccgtgcaccgcggcgtcctatctaccctcatcgccggccctgtggtggagatctcacatcaattgagaaaagtgagtgacgtggaggaactgaccccgcctgagcacctgagtgacctgcccccattctcgcggtgtctgataggaataatcatcaagtccagcaacgtggtgcgtagcttcttggacgaactgaaagcttgtgttgcaagtaatgatatcgagggaatagtctgcctgaccgcagcagtgcacatcatattagttatcaatgccggcaaacataagtccagtaaagtgcgcgaggtcgcagcgacagtccaccgtaaactgaaaacctttatggagattacgctcgaggaggactcaattgagcgctacgaagatctcctgtgctgtcctggctgggctctgaccccaggtttgctcgacagcatttacccatccgcatcagtccccattggctag

SEQ ID NO: 19913 - DNA, 3432 bp, Artificial Sequence
  Description of Artificial Sequence: Synthetic coding sequence
atggagaagcgggagaccttcgtgcaggccgtgagcaaggagctggttggtgagttcctgcagtttgttcaactcgacaaagaagcctccgatcccttctctctgaacgagcttttagacgagctgtctagaaagcaaaaggaagagctgtggcagcgcctgaaaaatctgctcaccgacgttctgctggagtcgccagtagacggctggcaggttgtggaagcccaaggcgaagacaatatggagaccgagcacggctcgaagatgcggaagagtatcgagatcatctacgccatcaccagtgtcattctagcctccgtgagcgtgatcaacgagagcgagaactacgaggcacttttagaatgtgtcatcattcttaatgggatcctttacgctctgccagagtctgaaaggaaacttcaatcctccatacaggacctctgcgtgacgtggtgggagaaaggcctgcccgcaaaagaagatacaggaaagacagcctttgtgatgttgctaagacggtccctggaaaccaagaccggagctgatgtgtgtagactctggcggattcaccaggcgctgtactgttttgattacgatctggaagagtcaggcgaaattaaagacatgctcctggaatgcttcatcaacattaattatatcaagaaagaagagggccgacgcttcctcagctgtctgttcaactggaacatcaatttcattaaaatgatccatggaacaattaaaaaccaactgcagggactgcagaaatccctgatggtatacatcgccgagatctattttagagcttggaagaaggcttctggcaaaatactggaagccattgagaatgactgtatccaggactttatgtttcacggaatacacttgccaaggcgttcccccgtccacagcaaggttcgagaggtcctgagttactttcatcatcagaagaaggttagacaaggggtggaggagatgctgtaccggctgtataaacctattctctggcgaggcctgaaagcacgcaatagtgaggttagatcgaacgctgccctgctgtttgtggaggccttcccaattagagaccccaacttacacgctatcgagatggacagcgagattcagaaacagttcgaagagctctacagcctcctagaagacccttatccaatggtgcggtcaacaggcatcctgggtgtctgcaaaatcacgtctaaatactgggagatgatgccccctactattctgatcgatctactgaagaaggtcacaggagagctggcattcgacaccagctccgccgacgtccggtgcagtgtgttcaagtgtctgcccatgattctagacaataagctctcacaccctctgcttgagcagctcttacccgcacttagatattccttgcatgataactcagagaaagtccgtgtggcattcgtggatatgctgcttaagatcaaggcagtgcgagcagcgaaattttggaaaatctgcccaatggaacacattctcgtgcgactcgaaactgattctcgacccgtgtcacgcaggctggtgagcctgatatttaatagtttcctgcccgtcaaccagcccgaggaagtttggtgtgaacgctgcgttacactggttcagatgaaccatgccgctgcacgacgtttctaccaatatgcgcatgagcacaccgcgtgcactaacattgccaagctgatccacgtgataaggcattgtttaaacgcatgcatccagcgtgccgtcagagaaccacccgaggacgaggaagaagaggatggcagagaaaaggaaaacgtgacagtgctggataagactctgtccgtgaacgacgtggcatgtatggctgggctgctggaaataattgtgattctttggaagagcattgatcgatcaatggagaacaataaggaggcaaagctgtataccattaacaagttcgcctcggtcttgccagaatacttaaaggtcttcaaagacgatcgatgcaagatcccgctgttcatgctgatgagttttatgcccgcctccgccgtcccgcctttttcatgcggggtcattagcactctgcgcagcagggaagaaggtgccgttgataagagttactgcactctactcgattgcctatgcagctggggacaggtgggacatatccttgagctggtggacaattggctccccaccgaacatgctcaggctaaatctaataccgctagcaaaggacgggtccagatccacgacaccaggcccgttaaaccagaactcgcattggtgtacatagagtacctgttaactcaccctaagaaccgagagtgcctactgagtgccccaaggaagaagttaaatcatctgctgaaagccctggaaacctccaaggcagacctcgaatcactcttgcagacaccaggcggcaaacctcgcgggttcagtgaagccgccgcccctcgcgccttcggcttacattgcagattgtccatccaccttcagcacaagttctgttctgaggggaaggtctatctgagcatgcttgaggatacaggattttggctcgaatccaaaatactttccttcattcaggaccaggaggaagactacctaaagctgcaccgggttatctaccagcagataattcaaacctacctgaccgtctgcaaggacgtggtaatggtcgggttaggcgaccaccagttccagatgcagctcctgcaacggtctctcggcatcatgcagacagtcaagggattcttttatgtgtctctgctgctagacattctgaaagaaattactgggagctcattgatacaaaagaccgatagcgacgaagaagtcgccatgctgttggacaccgtgcaaaaggtgttccagaagatgctggaatgcatcgccagaagtttcagaaaacagcccgaggaggggctacgccttttatattccgtgcaacgcccactacacgagtttatcactgcggtccagtctagacatacagacacccccgttcaccgcggagttctctctaccctcatagccggacccgtggtagaaatttcccaccagctccgaaaggtgtcagacgtcgaagaactgacacctcccgagcacctctccgatttgcccccttttagccggtgcctcatagggatcatcattaagtccagcaacgtggttcggtctttcctcgatgaactgaaggcatgcgttgccagtaacgacattgaggggatcgtgtgcctcacagcagctgttcacattatcctggtcatcaacgcaggaaagcataaatcttctaaggtaagagaagtagcagcgaccgtacacagaaagttaaaaaccttcatggaaataaccctggaggaagattccattgagcggttcctgtatgaatccagctctcgtactttgggtgagctgttgaactcttag

SEQ ID NO: 19914 - DNA, 2697 bp, Artificial Sequence
  Description of Artificial Sequence: Synthetic coding sequence
tgactggaggagagcggcgagatcaaggacatgctgctggagtgcttcataaatattaattacattaagaaggaagaaggacggcgatttctgtcctgtttgtttaactggaatatcaatttcataaagatgattcacgggaccattaaaaaccaactgcagggcctgcagaagtctctgatggtctatatcgcagagatctacttcagggcttggaaaaaagccagcggcaaaatcctggaggccatcgaaaacgactgcattcaagattttatgttccacggaatccacctacctcggcgatctcccgtgcattctaaagtccgggaggtcttgagttatttccatcatcaaaagaaagtgcgtcagggcgttgaggaaatgctgtaccgactctacaaaccgattttatggaggggactcaaggccagaaattccgaggtgcgaagtaacgcagcgctgctcttcgtagaagccttccccatccgcgaccccaacctccacgctatagagatggatagtgaaattcagaagcagtttgaggagctatacagtttgttagaggacccttaccccatggttaggagcacaggcatattgggggtctgtaagatcacaagtaaatactgggagatgatgcctcccacaattctgatagaccttttgaaaaaagtaacgggcgaactggcctttgatacctctagtgcggatgtgagatgcagtgtgttcaagtgcctcccaatgatcctagacaacaaactgagccatccactcctggaacaactcttacccgctctcaggtactccctgcatgataattctgaaaaagtgcgggtggcctttgtagatatgctgctgaaaattaaggctgtccgtgccgccaagttttggaaaatttgtcctatggagcacattctggtacggctcgagaccgatagccgccccgtttctcggcgattggtcagcctcatctttaattctttcctgcccgtcaaccagccagaggaagtatggtgcgagcgctgtgtgactttggtgcagatgaaccacgccgctgcacgtagattctatcagtacgcacacgagcacacagcatgcacaaacatcgctaagctgatccatgtgattcgacactgtctgaacgcttgcatccaacgcgcagttagggagcccccagaggacgaggaagaggaggacggcagagagaaggaaaatgttaccgtcctggacaagaccttgtccgtgaacgacgtcgcttgtatggctggcttacttgagataatagtcatattgtggaagtcaatagataggagcatggagaataataaggaagcaaagctctatactatcaacaaattcgctagcgtgcttccagagtaccttaaagtcttcaaagacgaccgctgtaagattcccctctttatgctgatgtctttcatgcctgcatcagccgtgccgcccttttcctgcggagtcattagcacactcaggagtagagaggagggtgccgtagataagagttactgtactttgctcgattgcctgtgttcctggggccaggtcggccatatattggagctggttgataattggctgcccaccgagcatgcgcaggccaaaagcaatactgcatctaaaggtagagtacagatccatgataccaggccggtgaagccagagctggcgctagtgtacattgagtacctgctcacacacccaaaaaacagggaatgtcttctctccgccccgcgcaaaaagttaaaccacttgttgaaggccctagagaccagcaaggcagatctcgaatcactcttgcagactcccggcggtaaacctcgaggcttcagtgaagcggccgcccctagagccttcggcctgcattgcagactctctattcatctccagcataaattctgttcagaagggaaagtttatctttccatgctggaagatacagggttttggctggaatccaaaattctgtcctttattcaagatcaggaggaggactatctgaaattgcatcgcgtcatctaccagcaaattatccagacgtatctgaccgtctgtaaggacgtagtgatggtgggcttgggggatcatcagtttcagatgcaactgctccagcgttcactgggtataatgcagaccgtgaagggctttttttatgtctcactgctgctggatatattgaaggagattactggcagctccctcattcaaaagacagattcagatgaggaggttgcaatgttgctggacaccgttcagaaagtttttcagaagatgctggagtgcatcgcccgttcttttagaaaacagccagaggaggggctacgtgtgagtgacgtggaggagctcacacctccagagcacttgtccgacttaccccccttcagccgatgtctgatcggcatcattatcaagtcaagtaacgtggtgcgtagtttcctggatgagttaaaagcgtgtgtggcatctaatgatatcgagggaatcgtttgcctaacggccgccgtccatatcatactggttatcaatgccgggaagcacaaatcttccaaggttcgtgaggtggccgccacagtacaccgcaaactcaagacgtttatggagataaccctggaggaagactcgattgagcgctttctctacgaatcctcttcacgtactctgggtgaactcctgaactcttag

SEQ ID NO: 19915 - DNA, 3471 bp, Artificial Sequence
  Description of Artificial Sequence: Synthetic coding sequence
atggagaagcgggagaccttcgtgcaggccgtgagcaaggagctggtaggagagtttttacagtttgtccagctggataaagaggcctcagacccgttctcgctgaacgagctgctggatgagctctctaggaagcagaaggaagaactgtggcagcgcttaaagaatctgctcaccgatgtcctcctagaatctcctgtggacggttggcaggtcgtggaggcccagggcgaagataatatggaaaccgaacacggtagtaagatgagaaagtccattgaaatcatttatgcaatcacatcggtgattctcgcatctgtgagtgtgataaacgaatcagaaaactatgaggctctgttggaatgcgttatcatacttaatgggattctgtacgctctgccagaaagtgaacgcaagctccaatctagtattcaagatctgtgcgttacatggtgggagaaggggctcccagccaaagaagatactgggaaaacggcgtttgtgatgctgcttaggagaagtcttgagaccaagaccggggccgatgtctgccgcttgtggaggattcatcaggctttatattgctttgactatgatcttgaggagagcggtgaaataaaggacatgcttctcgaatgttttatcaatataaattacattaagaaggaagaaggaagacgctttctgtcttgtctgttcaactggaacatcaacttcatcaaaatgattcatgggactattaagaatcagctgcaggggctacaaaaatccttgatggtgtatatcgccgaaatctactttcgcgcctggaaaaaggcctcaggcaaaatactggaagccatcgagaacgactgcattcaagattttatgttccacggaatccatctgccacggaggtcgcctgtacactccaaagtgcgggaggtgttatcttactttcaccatcagaagaaggttagacagggcgtagaggagatgttgtataggctctacaaacccatactgtggagaggtttaaaagcccggaacagcgaggtgcggtcaaacgccgccctattattcgttgaggctttccccattcgggacccgaacctgcacgccattgaaatggacagcgaaatccagaaacaattcgaagagctctacagccttctagaggatccttaccctatggtgagaagtacagggatccttggagtatgtaagattacctccaaatattgggagatgatgccccctacaatcctcatcgacctgttaaagaaagtcaccggagaattggcatttgacaccagcagcgccgacgtgcgatgctccgtcttcaagtgcctccccatgatcctagacaataagctctcccacccactcttagaacagctgctccccgccctgaggtactcactccacgacaacagcgagaaagtaagggtggccttcgtcgacatgctgctcaagattaaggcagttagagcagctaaattttggaaaatttgcccgatggagcacatcttagttagactcgagaccgactccagaccagttagccggcggcttgtcagcctaatcttcaatagcttccttcccgtgaatcagcctgaagaggtgtggtgtgagaggtgtgtcacactggtgcagatgaatcacgctgccgcgcgacgattttatcaatacgcgcacgaacacactgcctgcacaaacattgcaaagttgatacatgtgattcgccactgtttgaatgcctgcatacagagagcggtacgcgagcctcctgaagacgaggaagaggaagatggccgagagaaagagaacgtgaccgttctcgataagaccctaagcgttaatgatgtcgcatgcatggccggtctgctcgaaataattgttatcctttggaagagcatcgatcgaagcatggagaacaataaggaggcaaagctgtacactatcaataagtttgcgtcagttctacctgaatatctgaaggtgtttaaggacgatagatgcaaaatacccctgttcatgctgatgtcctttatgccggcttctgccgtgccacccttttcttgcggagtcatctccacgctgcgatcacgagaggagggagcagtcgataagtcctactgcacattactcgactgcttatgctcctggggacaggtgggacacattttggagctggtcgacaactggctgccaactgagcatgcccaagccaaaagcaacaccgctagcaagggcagagtgcaaatacatgacactcgcccggtcaaaccagagttggccctggtctacattgagtacctgctgacgcatccgaagaatagagagtgcctgctgtctgctccgcgcaagaagctgaatcatcttcttaaggccctggaaacatcaaaagctgacctggagtccctccttcagaccccaggggggaaaccgcggggcttttccgaggctgctgcaccgcgggcattcggactgcactgtcgtcttagtatccatcttcaacacaagttttgttccgaaggaaaagtgtacctgagtatgctggaagacaccggcttttggttagagtccaagatcctaagtttcatccaagaccaggaggaagactaccttaagctgcatagggtcatttatcagcaaattattcagacgtatcttacagtgtgcaaagacgtggtgatggtgggcttgggggaccatcagtttcagatgcagcttctgcagcgctctctcggcatcatgcaaacggtcaaagggttcttctacgtatctcttctgctagatatactcaaggaaattactggtagctcacttattcagaaaacggactccgatgaagaggtggccatgcttctcgatacagttcagaaggtgttccagaaaatgctggaatgcatcgccaggagcttccgtaaacagcccgaggagggtttgcgtttgctatactccgtgcagcgtcctcttcacgagtttatcacagctgtccagagcaggcacaccgatacaccagtgcaccgcggtgtcctctcaacccttattgccggaccagtagttgagattagtcatcagctaaggaaggtgagcgacgtggaagaactcacacctcctgaacatctgtcggacttgcccccattttcacgctgtctgatcggaatcatcataaagtccagcaacgtggtgcgaagctttttagatgaactgaaagcgtgtgtagcatcaaacgatatcgagggcatagtctgcctcactgccgctgtgcacatcatactggttatcaatgccggaaaacacaaatcctctaaagtgagagaggttgctgccacagttcatcggaagctgaaaactttcatggagatcaccctcgaggaagattctatagagagatacgaagacctgctctgttgcccggggtgggctttgaccccaggtctcctggatagcatctacccatcagcttctgtgccgattggatag

SEQ ID NO: 19916 - DNA, 1794 bp, Artificial Sequence
  Description of Artificial Sequence: Synthetic coding sequence
atggagcacatcctggtgcggctggagaccgacagccggcccgtgtctcggaggctcgtgtctctgatcttcaatagcttcctgccagtcaaccagcccgaagaagtttggtgcgaaaggtgcgtgacactggtgcaaatgaatcacgccgctgctcggaggttttaccagtatgctcatgaacatactgcttgtacaaatatcgcgaaactcatccatgtcatacggcactgtctcaacgcttgcatccagcgggcagtgcgcgagccccccgaagacgaagaagaagaggatggcagagagaaagaaaatgtcaccgttctggataagaccttatcggtaaatgatgtggcctgcatggcaggcctgctggaaatcatagtgatcctctggaagtcaattgaccggagtatggagaataataaggaagctaagctgtacacgataaataaattcgcgtcggtgctgccagaatatctcaaagtgttcaaagacgaccggtgtaagattcctctgttcatgttgatgagttttatgcctgcttccgccgtgcctccatttagttgtggtgtgatttctactctgcgcagtcgggaagagggcgccgtggataaaagctactgtacccttctcgattgcctgtgcagttgggggcaagtcggtcatattctagaactggtcgacaactggctcccaacagagcacgcccaggcaaaatcaaacacagcatctaaggggcgcgtgcaaatccatgacacccgcccagtaaagccggaattggccctagtgtacattgagtacctgctaactcaccccaagaatcgggagtgtctgctttctgcaccgagaaagaaattgaatcatctgttgaaagccctggaaacatcgaaggccgatctggagtcgctgttacaaacccccggcggtaaacctcggggcttctctgaggcggccgccccgcgcgcattcggactccactgccgactgtcaattcatctacagcataagttttgttccgaagggaaagtctacctctcgatgctcgaagacaccggattctggctcgagtccaagatcctgtccttcattcaagatcaagaagaggactacctcaagttgcaccgcgtgatataccaacaaatcatacagacatatctgacagtgtgtaaggacgtggttatggtcggactgggcgatcatcagtttcaaatgcagctcctgcagaggtccctggggatcatgcagacggttaaggggttcttttacgtctcactgctcctcgacattcttaaggagattacgggaagctcattaatacaaaaaactgactcggatgaagaagtggctatgcttctggatacagtgcagaaggtattccagaaaatgcttgagtgcatagcacgatcctttcgtaagcagcccgaggagggattgagggtgtccgacgtggaagaattaactcctcccgagcacttatcagacctgccccctttttccaggtgtttgattggcataatcattaaatcaagcaatgtagtgaggtctttcttggatgagctcaaggcttgcgtggcttctaatgatatcgagggcatcgtgtgcctcaccgccgcagttcacatcatcttggtgatcaacgcaggcaaacacaaatcctccaaggtccgagaagtggctgccaccgtgcacagaaagctcaaaacattcatggaaataaccctggaggaagattcaatagaaagatttctgtacgaatctagcagtcgtactttgggagaattattgaattcctag

SEQ ID NO: 19917 - DNA, 1716 bp, Artificial Sequence
  Description of Artificial Sequence: Synthetic coding sequence
atggagcacatcctggtgcggctggagaccgacagccggcccgtgtcaagaagattggtgtccctgattttcaatagcttcttaccagtcaatcagcccgaggaagtgtggtgcgaacgttgcgtgactctcgtccaaatgaaccacgccgcagcaaggcgtttctaccagtacgcccacgaacacaccgcatgcacgaatatcgcaaaactgatacacgtgatacgccactgcttaaacgcttgcattcagcgcgctgtgcgggaacctcccgaagatgaagaagaggaggacggacgcgaaaaggaaaacgtgaccgatgacaggtgtaagattccactctttatgcttatgagctttatgcctgcatctgcggtgcccccgttttcctgcggcgtcatcagcacactgagaagccgcgaagagggggcagtggacaagtcttattgtacactactggattgcctctgctcttggggccaggtcggacacattctagagctggtggacaactggttgcccacagagcatgcacaggccaaatctaatactgcctcaaaggggagggtgcagatacacgacaccaggcctgtaaaacccgagttagctctcgtgtatatcgaatacttgcttactcacccaaagaatcgagagtgtcttctctccgcgccaaggaagaagctgaatcacctcctcaaggcccttgaaaccagtaaagccgatttagaatccctccttcaaacgccaggggggaagcctcgaggcttcagtgaggcagcggctcctcgcgcctttggcttgcattgccgattgtcaattcacctacagcataagttttgcagcgaaggaaaagtgtacctatctatgctggaagacacgggattctggctggagagtaagatcctgagtttcatccaagatcaagaagaagactatctgaaacttcatcgagtcatatatcagcagattatccagacttatttgactgtgtgcaaggatgttgtcatggtcgggttgggagatcaccagtttcagatgcagctgctgcaaaggagcctcggtatcatgcaaaccgtgaaagggttcttttacgtgtcattgctgcttgacatcttgaaggagatcaccgggtcctcccttatacaaaaaaccgatagtgacgaagaggtggctatgctgctcgacactgtgcagaaagtgttccaaaagatgttggaatgtatagcccgctcattccgcaagcagcctgaggagggcctgcggctgctctacagcgtgcagcgtccgcttcacgaatttataacagctgtgcaatcgagacatacagacactcccgtacaccgaggcgtgctttcgacactcattgcaggcccagtcgtcgaaatatctcaccagctgcggaaggtttctgatgtcgaggaactaaccccgcccgagcatctgtcagatctgccacccttttctcgttgccttattggcattatcatcaagagtagtaacgtggtgcgctcattcctggacgagctgaaggcatgcgtcgcgtcaaacgatattgagggaatcgtttgcctcacagccgctgtgcacatcatccttgtcattaatgcgggaaaacataagagcagcaaagtgcgcgaagtcgccgcaactgtgcaccggaagctgaaaacttttatggagatcacactggaagaggactctatcgagcggatttag

SEQ ID NO: 19918 - DNA, 1821 bp, Artificial Sequence
  Description of Artificial Sequence: Synthetic coding sequence
atggaggacgtggaggcccggttcgcccacctgctgcagcccatcagggacctcacaaagaattgggaggtggatgtcgctgctcagctgggggagtacttggaagagctcgaccagatttgcatttcctttgatgaaggtaagacaaccatgaattttatcgaagccgcactgcttatccagggaagcgcttgcgtgtacagcaaaaaagtggagtacttatattctttggtgtatcaggctctggattttatttccggaaagaggcgggcgaagcagctcagcagtgtgcaggaagatagagccaacggggtggcctcctccggagtcccccaggaggctgaaaacgagttcctgtcactggacgattttcccgattcgagaacaaatgttgatctgaagaatgaccagacaccatctgaggtactgatcattcccctgctgcccatggcattagtagctccggacgagatggagaagaacaacaatccactctatagtcgccaaggcgaagtgctggcctcaagaaaggatttccggatgaacacctgtgttcctcacccgcgtggcgcttttatgctggagcccgaagggatgtctcccatggagcctgcaggtgtaagccctatgcccggtactcagaaagacaccgggcgcaccgaagaacagccaatggaagtcagcgtgtgcaggagccctgtgccagccctggggttttcccaagaaccgggaccttccccggaggggccaatgcccctgggcggcggggaggatgaagacgccgaagaggcagtggaattgccagaggccagcgccccgaaggccgcgctcgagcccaaggagtcacgttctccacagcagagtgccgcattgccccgcagatacatgctgcgcgagagagagggtgcacccgaacccgcatcctgcgtcaaagagacgcccgatccatggcagagcctcgacccatttgacagtctcgaaagcaaaccttttaaaaaaggaagaccctactccgttccaccttgcgtggaggaagcactggggcagaagaggaagcgtaagggcgccgcaaagctgcaggactttcaccagtggtaccttgccgcatatgccgaccatgcggactccaggcgcttgcgccggaaagggccctcattcgccgacatggaagttctctactggactcacgtgaaggagcagctcgaaacactgcgtaagttacaacggcgcgaagtggccgagcagtggttgcgcccggccgaggaggaccacctcgaagattctctcgaagacctcggggctgccgccgatgattttctggagccagaggagtacatggaacctgaaggcgcggatccaagggaagcagctgaccttgatgccgtgcctatgagcctgtcatacgaggaactggtgcgaagaaatgtcgaattgttcatcgctacatcacagaagttcgtgcaggagaccgagttatcacaaagaattcgagattgggaagacacagtgcaaccgctcctccaggagcaggaacaacacgttccgtttgacatccacacctacggggatcagttggtgagccgctttccccagctcaatgaatggtgtccattcgcagaactggttgcgggtcagccggcgtttgaagtgtgtaggagcatgttggcctctctgcaattggctaacgattacacagtcgagattactcagcagccaggcctcgagatggcagtggataccatgtctctgcgcctgctgacccatcagcgggcgcacaagagattccagacctacgccgctccctccatggcccaaccttag

SEQ ID NO: 19919 - DNA, 900 bp, Artificial Sequence
  Description of Artificial Sequence: Synthetic coding sequence
atggaggacgtggaggcccggttcgcccacctgctgcagcccatcagggaccttactaaaaattgggaggtcgacgtggctgcgcagctcggggagtacctggaagaactcgaccagatctgcattagttttgatgaagggaaaaccacgatgaatttcatagaagcggctctcctgatccaggggtctgcttgcgtctattccaagaaagtggagtacttgtacagcctggtataccaggcccttgacttcatttcaggtaaaaggcgagccaaacagctctcaagcgttcaggaagacagagctaacggggtggcctctagtggagtcccccaagaggctgaaaacgagttcctcagtttggatgatttccccgattcccgtactaatgtggatctgaaaaatgatcaaactccatcggaggtgctcattattcccctactgcctatggctctcgtcgctcctgacgagatggagaaaaacaataacccactttattcccggcaaggagaggtcctggcgtccaggaaagacttcaggatgaacacctgtgtaccacatccccgaggcgctttcatgctggagcccgagggaatgtccccaatggaacctgctggagtatctcctatgccgggcacccagaaagacacagggcgcacagaggagcagcccatggaagtgagcgtatgtcggtctcccgttcccgctctggggttttcccaggagccaggacccagccctgagggacccatgccacttggaggcggcgaagatgaggacgcagaggaagccgtggaactgccagaggcgtccgctcccaaagcggcacttgagcctaaggagagccggtcccctcaacaggtgggtcccacgtggcggcccgccgagccagagctatag

SEQ ID NO: 19920 - DNA, 1818 bp, Artificial Sequence
  Description of Artificial Sequence: Synthetic coding sequence
atggaggacgtggaggcccggttcgcccacctgctgcagcccatccgcgacctcactaagaactgggaagtagatgtcgcagcccagctgggggaatatttggaggaactggatcagatctgcatctctttcgatgagggaaagacgaccatgaatttcatagaggcggcccttctaattcagggttctgcttgcgtgtatagcaagaaggtggagtacctctacagtttggtgtaccaggctctggatttcatcagtggtaaaagaagagcaaaacaactctcctccgtccaagaagaccgagcaaacggggtggcaagctcaggcgtccctcaggaagctgagaacgagtttctgtcactggatgactttccggacagcaggactaacgttgacctgaagaacgatcaaacaccctctgaggtcttaattatccccttgctgccaatggccctcgtggctccagatgaaatggagaagaacaataaccctctgtattctcgacagggggaagtactcgcctcccgcaaagacttccgcatgaacacctgcgtgccgcatccacgcggggctttcatgttggagcccgaaggtatgtcacccatggagccagctggagtgtcacccatgccaggcacgcagaaagacacaggacgcacggaagaacagcccatggaggtgagtgtctgccggtccccagtgccagccctgggcttcagccaggagcccggcccctcccctgaaggtcccatgcccctcggcgggggtgaggacgaggacgcagaggaagctgtggaactaccagaggcatctgctcccaaggccgcactcgagccgaaggaatctcggtctccacagcagtccgccgcacttccacgaaggtacatgctacgagagagggaaggtgcccccgaaccagcttcttgcgtcaaagaaactcctgacccctggcagtcactcgacccatttgattccctcgaaagcaaaccgttcaagaagggcaggccttactcagtgcctccttgcgtggaggaggccctgggtcagaagcggaaacgtaagggagccgctaagctccaagacttccatcaatggtacctggccgcctacgccgaccacgccgactctcggaggctgagaaggaagggcccgtctttcgccgacatggaggtcctctactggacccatgttaaggaacagcttgaaacacttcgaaagctccagaggcgagaagttgccgagcaatggctgcggcccgcagaggaggatcatttggaagactcgctggaagacctcggcgcggctgatgactttcttgagcccgaagaatacatggaaccagaaggcgcagaccctagagaagctgcagatctggacgcggtcccaatgtctcttagctatgaagaactggtgaggagaaacgttgaattgtttatcgctacctcccaaaagtttgtccaggaaaccgaactgagtcagcgaattcgagactgggaggacactgtccaaccactgctccaggagcaggaacaacatgtcccgttcgatatccacacctacggggatcagttagtgagtcgcttccctcagctcaatgaatggtgcccttttgcagagctggttgccggccaaccagccttcgaggtatgccgctccatgctcgcttccctccagctcgccaacgattacactgtggaaattacacagcaacctggactcgagatggccgtagatacaatgagcctccgactcctgacacatcaacgcgctcacaagcgcttccagacctatgccgccccttcgatggcccaaccttag

SEQ ID NO: 19921 - DNA, 801 bp, Artificial Sequence
  Description of Artificial Sequence: Synthetic coding sequence
atgcagggcagcacccggcggatgggcgtgatgaccgacgtgcacaggagatttctacagctactcatgacccatggcgttctggaggagtgggacgtgaaacggctccaaacacactgttacaaggtccatgacagaaacgctactgtcgacaagctggaggattttatcaacaacataaacagcgtactggagagcctctacatagagattaagagaggggtcacggaggacgatggtaggcccatttacgctctcgtcaacctggccaccacaagcatctccaaaatggcaaccgattttgcagaaaacgagttggatctgtttcggaaagccctggagcttatcattgattctgagacgggcttcgccagcagtactaatatcctgaatctcgtggaccagcttaagggtaaaaagatgcgtaagaaggaggccgagcaggtcttgcagaagttcgtgcagaacaaatggttaatagagaaagagggcgaattcacactgcatggtcgtgccatcctggagatggagcagtacatcagggaaacgtacccggatgctgtcaagatatgcaacatatgccacagtttgctgatccaaggacagtcatgcgagacctgtgggatacgaatgcaccttccctgcgtcgctaagtacttccagtccaacgctgaacctaggtgcccacactgcaacgattactggccccacgagatccccaaagtttttgatccagagaaagaaagggaaagcggcgtcttgaaatccaacaaaaaaagcctgcgctcccgtcagcattag

SEQ ID NO: 19922 - DNA, 744 bp, Artificial Sequence
  Description of Artificial Sequence: Synthetic coding sequence
atgcccggccggagcagcagcaacagcggcagcaccggcttcatctcgtttagtggcgtcgagagcgcactcagttcactgaaaaactttcaggcatgtattaactccggcatggacaccgccagttctgtggccttagacctggtcgagagtcaaaccgaggtgtcctctgagtactcaatggataaagccatggtcgaattcgcaaccttagacagacagctcaaccactacgtcaaagccgtgcagtcaacgataaatcacgtgaaggaggagcggccagaaaaaattccggacttaaagctcctggtcgaaaagaagttcctggccctgcaaagcaagaatagtgatgcagacttccagaataatgaaaaatttgtccagtttaaacaacagctcaaggagctgaagaagcagtgcggcctgcaggcggacagggaagccgatgggactgagggggtggatgaagacattatcgtgacgcagtcacagaccaattttacctgccctatcactaaagaagaaatgaaaaaaccagtcaagaataaggtgtgtggacacacatatgaagaagacgccatcgtgaggatgatcgagagtcgacagaagcgcaagaaaaaggcttattgcccccagataggctgttcacacaccgacataagaaagtcagacctcatccaggatgaggcgctacggagggcaatagagaaccacaacaaaaagcggcaccgccactcagagtag

SEQ ID NO: 19923 - DNA, 582 bp, Artificial Sequence
  Description of Artificial Sequence: Synthetic coding sequence
atgcccggccggagcagcagcaacagcggcagcaccggcttcatctcattcagcggagtcgagtccgccttgagttccctcaaaaacttccaagcctgtattaacagcggtatggacacggcttcatcagtggcgctggaccttgttgaaagccagaccgaggtttcctccgagtactcaatggacaaggccatggtggagttcgccacactcgatcgtcagcttaaccattacgtaaaagcagtgcaaagcacaatcaaccatgtgaaagaagagcgtcccgagaaaattcccgacctcaagctcctagttgagaaaaaatttctggcacttcagtccaaaaacagcgatgctgatttccagaataacgaaaagtttgtgcaattcaagcagcagcttaaggagcttaagaagcagtgtggactgcaggctgacagagaggctgatggtaccgaaggggtggatgaggacataatagtgacacagtctcagaccaacttcacttgccctatcaccaaagaagagatgaagaagccagtgaaaaacaaagtctgcggtcacacctacgaggaagacgcttag

SEQ ID NO: 19924 - DNA, 138 bp, Artificial Sequence
  Description of Artificial Sequence: Synthetic coding sequence
atgcccggccggagcagcagcaacagcggcagcaccggcttcatcagcttttcaggtgtggaaagcgctctgagtagtctaaagaattttcaggcgtgtattaatagtggcatggatacagcatccagcgttgcctag

SEQ ID NO: 19925 - DNA, 744 bp, Artificial Sequence
  Description of Artificial Sequence: Synthetic coding sequence
atgcccggccggagcagcagcaacagcggcagcaccggcttcatcagcttctcaggcgtggagtctgccctttcctcactgaaaaactttcaggcatgtatcaatagtgggatggacaccgcatcatccgttgcgctggaccttgtcgagtcacagactgaagtctctagtgagtattcaatggataaggcaatggtcgaatttgcgactctggacagacagctgaatcactatgtgaaggcggtccagtctaccatcaatcatgtcaaagaggaacggcccgaaaaaatccctgatctaaaactcctcgtcgagaaaaagttcctagctttgcagagcaaaaacagcgatgccgattttcagaacaatgaaaagttcgttcagtttaaacaacagcttaaggagttaaagaagcagtgtgggctgcaagccgatcgtgaagccgatggcactgaaggcgtggacgaggatatcatcgtgacccagtcccagacgaattttacctgtcctatcaccaaggaagagatgaaaaaaccagtgaaaaataaggtttgcgggcacacatacgaggaggacgccatagtgcgcatgatcgaatcgagacaaaaaaggaaaaagaaagcctattgcccacagatcggctgttcacacaccgatataaggaagagcgatttaatccaggacgaggccctgaggcgggcaattgaaaaccacaataaaaaaaggcacaggcatagcgaatag

SEQ ID NO: 19926 - DNA, 420 bp, Artificial Sequence
  Description of Artificial Sequence: Synthetic coding sequence
atgcccggccggagcagcagcaacagcggcagcaccggcttcatctcattcagtggcgttgagagtgcactgtcatctctgaaaaattttcaggcgtgcattaactctggaatggacacagcatccagtgtggctctggacctggtggaatctcaaaccgaggtgtcttccgagtattcaatggacaaggcgatggttgaattcgccactctagaccgccagcttaaccactacgtcaaagcagtgcagagcaccattaaccacgtgaaggaagaacgaccagaaaaaatccctgacctgaagctcctcgtggagaagaaattccttgccctccagtcaaaaaatagtgatgcggatttccagaataatgaaaaatttgtacaattcaaacagcagctgaaagaattgaagaagcagtag

SEQ ID NO: 19927 - DNA, 705 bp, Artificial Sequence
  Description of Artificial Sequence: Synthetic coding sequence
atgctggacggccggcagcggcggggcagcaacgcccccaccagcgatatgcctggcactaccctgaataggtatggcaggacttggccgagatggggctggctttggacacctactggcggtgctctgaggaagcggaaggttaaggctatggaggtcgatattgaggagcgccccaaggaacttgtcaggaagccctatgttttaaatgacctggaagccgaggcctctctccctgaaaagaagggcaataccttgagtagggatctcattgattacgttcgctacatggtagagaaccacggtgaagactataaggccatggccgtgatgagaaggataacaattaaaatcccacaaaaccgcttcggcgtacggtctacgtctattaacgccttcactcaacagtctggaaagacgagctcaatcctgtgccgtcggggacggtggcgctggagcgactggtttactagtcagctgcctcaagccgaggccagccccggtccagtcaagcttgaacccggatgtaaagctcggaggtgctgcgtggcccccgaggagctggcacggtcccacgggatacgtcgcctgcacgtccacacaccacgttccggtgagggcaccgtgcttaggggtagcaatctgtacagttcaggggggagccggaagagtcagaacctcctgttcagcggctgggtgatgtag

SEQ ID NO: 19928 - DNA, 537 bp, Artificial Sequence
  Description of Artificial Sequence: Synthetic coding sequence
atgcccaaggccaagggcaagacccggcggcagaagttcggctactctgttaaccgtaaaaggttgaataggaatgcccgccgaaaagccgctccaagaatcgaatgcagccatatcagacatgcttgggaccatgcaaagtcagtgcgacaaaatctggctgagatgggcctggcagtcgatcctaaccgcgccgtgcccttaagaaagcgcaaggtgaaggccatggaggttgatatagaagaaaggccaaaggagcttgtcaggaagccttacgtgctcaatgacctggaggccgaggcctccctgccggagaagaaaggcaatactctgagcagggatctgatcgactacgtgagatatatggttgagaatcatggcgaagattataaggctatggccagggacgagaagaactattaccaggacactccaaagcagatcagaagtaagatcaatgtttacaaacgcttctacccagccgagtggcaggacttcctggattcactgcaaaaacgcaaaatggaggtggagtag

SEQ ID NO: 19929 - DNA, 696 bp, Artificial Sequence
  Description of Artificial Sequence: Synthetic coding sequence
atgcccaaggccaagggcaagacccggcggcagaagttcggctactcggttaatcgtaaaaggttgaatcgcaacgcacggagaaaggctgcccctcgtatcgaatgctcccacatcagacatgcttgggatcatgccaagtccgtcagacagaacctggcggaaatggggctcgcagttgatcccaatcgagccgtcccattacgaaagcgaaaggtaaaagccatggaggtggacatcgaggaaaggcctaaggagctggtgcgaaagccctacgtgctgaacgatctcgaggcagaagcatctttacccgagaaaaaaggcaacaccctgtcgcgggatctgatagattacgtcagatacatggtggagaaccatggggaagattataagcagagcggcaagacctcctcaatcttatgtcgcagaggccgatggaggtggtccgattggtttacaagccagctgccacaagctgaagcctccccaggaccagtaaagttagaaccaggatgtaaggccagaagatgctgcgtcgccccagaagagttggcccgctcgcacggcattaggcgcctgcaccacgtgcacactcctaggtctggggaaggaactgttcttcgtggctccaatttatactcctctggtggcagtcgcaagtctcaaaacctactttttagcgggtgggtgatgtag

SEQ ID NO: 19930 - DNA, 711 bp, Artificial Sequence
  Description of Artificial Sequence: Synthetic coding sequence
atgcccaaggccaagggcaagacccggcggcagaagttcggctactccgtgaatcgcaaaagactgaatcgcaacgcccgcagaaaagccgcaccacggatcgagtgctcccatatcagacatgcctgggaccacgccaagtccgtgagacaaaatcttgcagaaatgggactagcggtggatcccaacagggccgtgccactccgtaagcgcaaggtaaaggcaatggaagtggacatcgaagaaaggcctaaagaacttgtgaggaaaccttacgttctgaatgatctcgaggctgaggcttctctaccagaaaagaaaggaaacactctatcccgagacctgatcgactacgttaggtacatggttgagaatcacggcgaggactataaatccggaaagacatcaagcatcttgtgcagaagaggcagatggcgctggagcgactggttcacttctcagctgccacaggcagaagcctccccagggccggtaaaactggaaccaggatgtaaggctagacgatgctgtgtggcccctgaggaactggctagatcacatggaattcgcaggttacacactagagcgcattcacccctatggggaaggaattgctcccaaaggttgcagttcatttttatctgggggtttaccgaaaaaccagagccagcagtgtttcgagtaggggacgtgaacattgtttgtacgtag

SEQ ID NO: 19931 - DNA, 2439 bp, Artificial Sequence
  Description of Artificial Sequence: Synthetic coding sequence
atgggccggaagctggaccccaccaaggagaagcggggccccggccgtaaagcccgcaaacagaagggtgctgaaaccgagctggtgagattcttgccagcagtttctgacgaaaatagtaaaagactgagttcccgggccagaaaacgggcagcaaagaggcgactcggaagtgtggaggcccccaaaacgaataagtctcccgaggcgaaacctctgccagggaaattaccaaagggcattagtgccggagcagtgcagacagccggcaagaagggtcctcagtccttgttcaacgcaccgcgggggaagaagaggccagctcccggatccgacgaagaagaggaggaagaggactccgaggaagatggcatggtcaatcacggggacctgtggggaagcgaagatgacgcagacaccgtcgatgattacggcgccgatagtaatagtgaggatgaggaggagggcgaggccctccttccaatcgagagagccgccagaaagcaaaaggccagagaggcagcagccggaatacagtggagtgaagaggagacggaggacgaggaagaggagaaagaagtgacccctgaaagcggcccacccaaagtcgaagaggctgatgggggtttgcagataaatgtcgacgaagagccattcgtccttccccccgccggagaaatggaacaggatgcacaggcacccgacctgcagcgcgtgcacaaaaggatccaagacattgtcggtatactgagagactttggcgcccagagggaggagggacgctcaaggagtgaatatctgaatcgcttgaagaaagatctggccatttattactcctatggggacttcctgctgggtaaactgatggatctgtttcccctaagcgaattggtggagtttctcgaggcgaatgaggtcccccgccctgtcacgctgcgtactaacactctaaagacacgcaggcgggatctcgcccaggccctgatcaaccgtggggtgaatctagaccccctcgggaagtggtctaagacgggcctcgtggtttacgatagctcggtgccaattggcgctacccctgagtatttggcagggcactatatgcttcagggagccagttccatgctgcctgtaatggcgctggctccccaggagcatgagagaatccttgacatgtgctgtgcccccggtggtaagactagttatatggcacagctgatgaaaaacacaggggtgatattggctaacgacgcaaacgccgagcgtctcaagagcgtagtggggaacctccatcggctgggtgtgacaaatactatcataagtcattatgatggcaggcagttccccaaagtggtgggcggtttcgacagagtactactcgacgctccatgtagcgggacaggggttatctcaaaggatcctgccgttaaaactaacaaagatgaaaaagacatcttaaggtgcgcccatctgcagaaagagcttctcctgagtgccatcgacagcgtgaatgccacctctaagactggcggttacctcgtatattgtacctgctccattacagtggaagaaaacgaatgggtggtagactatgctctcaagaagagaaacgttcgcctggtgccaaccggattagattttgggcaggagggcttcactcggttccgggagaggcgattccacccctcattgcgttccacacgcagattttatccccacacacataatatggacggattcttcatagcaaagtttaagaagttttcgaacagcattccacagtcccagaccggtaattccgagacagcgaccccaaccaacgtagacctcccccaggtgattccaaaatccgagaatagctcccagccagccaaaaaagctaagggtgcagctaagactaagcagcagctccaaaagcagcaacatccaaagaaggcttcctttcagaagttgaatggaatctctaagggcgccgattcagaactgagcacggtgcccagcgtgaccaagacccaagccagcagctcattccaggacagcagccagccagccgggaaggcagaggggatacgggaacccaaagtcacgggaaaactgaagcagcgttcacccaaactgcaatctagcaagaaggtcgccttcctgagacagaatgcccctcctaaagggacagacacccagacaccggctgttctgtctccttccaaaacacaggccaccttaaagcccaaggaccatcaccagccactgggtagagccaagggtgtggagaaacagcagctgccagagcagcccttcgagaaggcagctttccagaaacaaaatgacacgccaaagggcccgcagcctccaactgtgagcccaattagatcctctcgaccccctccagccaagcgtaagaaaagccagagcagaggcaactcccagcttctcctcagttag

SEQ ID NO: 19932 - DNA, 2427 bp, Artificial Sequence
  Description of Artificial Sequence: Synthetic coding sequence
atgggccggaagctggaccccaccaaggagaagcggggccccggccggaaggcgagaaaacaaaaaggagcagaaaccgagctcgtaagattcctgccagcagtgtctgatgagaactccaagcgactctcatcgcgggctcggaaaagagctgccaagaggagattgggaagcgtcgaggcccctaaaaccaacaaatcccccgaagctaaacccctgccaggtaaactaccaaaaggtgccgtgcaaaccgccgggaagaaagggccgcaatcattatttaatgcccctcggggcaagaagaggccggcacctggaagcgacgaagaggaggaagaggaggacagcgaggaagacggcatggtgaaccacggggacctgtggggatccgaggacgacgccgatacagttgatgattacggcgccgacagcaacagcgaggatgaggaggagggtgaagctctcctccctattgagcgtgccgctcggaaacaaaaagcaagagaggcggccgccggcattcagtggagtgaggaggaaacggaagacgaagaggaggagaaagaggtgaccccagaatccggaccgcccaaagtagaagaggcagacggcgggctccagatcaacgtggacgaggagccgttcgttcttcccccagccggagagatggaacaggacgctcaagctcccgacttgcagcgtgtccataaaaggattcaggacatcgtgggcatactgcgagattttggggctcagcgagaagaaggcaggtcccgttctgaatacctgaacaggcttaagaaggacttggccatatattactcttacggcgactttctgcttggaaaactcatggaccttttccctctatcagaacttgtggaatttctggaggccaacgaagttcccagaccagtgacactgaggaccaataccctgaagacacgcagacgggacttagcccaggcactgattaacaggggggttaacctagacccgctgggaaagtggtccaagaccggactggtggtgtatgacagttccgtccccatcggagccacccccgagtatttagcaggccactacatgctgcagggcgcctcctcaatgctgcctgtgatggccctggcacctcaggagcatgagcgtatcctggatatgtgttgtgccccaggggggaagactagctatatggctcagttgatgaaaaataccggggtcattcttgcaaatgacgccaacgccgaacgtctcaagtcagttgtgggaaatctgcaccgactcggtgtaaccaataccatcatatcgcactatgacggccgacagttccccaaggtggttggcggattcgatcgcgtcctcttggatgctccatgcagcggaacaggagtaatctcaaaagacccagctgtgaagacgaacaaagacgagaaggacatactgcgctgcgctcacctccagaaagaactcctactatccgccatcgattccgtgaacgccacttccaaaaccggaggatatctcgtgtactgtacttgcagcattaccgttgaggaaaatgaatgggtggttgactatgcactgaagaaaagaaatgtgaggctggtgcccaccggccttgatttcggccaggaggggttcacaagattccgggagcggcgctttcatccatccctgcggagtactaggcgcttctacccccacacccacaatatggacggcttttttattgccaaattcaagaaattttctaactccatccctcaaagccagacggggaatagcgagaccgccacccctaccaatgtggacctcccacaagttatccccaaatctgaaaacagcagccagcccgctaaaaaggctaaaggtgcggctaagacaaagcagcagcttcagaaacaacagcatcctaaaaaggcctcattccaaaagctgaatggcatcagtaaaggcgccgatagtgagctttctaccgtgccttcagtgactaaaactcaggcatctagttccttccaggatagcagtcaacccgccggcaaggcagaaggtatcagggaaccaaaagtcacgggcaagctgaagcagcgttcccctaagcttcagtctagcaagaaggttgcatttctgcggcagaatgcccctcctaaaggtactgacactcaaactccagccgtcctctcaccatctaagactcaggccacacttaaaccaaaggatcatcatcagccccttggtcgagcgaaaggcgtggagaagcagcagctgcccgaacaacccttcgagaaagccgcatttcagaagcagaacgatacgcccaaggggcctcagcctccgactgtatcccctatccgttcatctaggccaccaccggccaaacggaaaaagagccaaagccgagggaactctcagttactactttcttag

SEQ ID NO: 19933 - DNA, 2439 bp, Artificial Sequence
  Description of Artificial Sequence: Synthetic coding sequence
atgggccggaagctggaccccaccaaggagaagcggggccccggcagaaaagcgagaaaacagaagggcgcggagacagagctggtgcgcttcttgcctgctgtcagtgatgaaaacagtaagagactgagcagcagagccagaaaacgcgccgctaagcgcaggctgggctccgtggaagccccaaagaccaacaagtcacccgaggccaagcctctcccaggcaagcttccaaagggcattagtgcgggagcagtacagacggccgggaaaaaaggcccgcagtctctgttcaatgcgccaaggggcaagaagcggcctgccccagggagcgatgaagaggaagaggaagaggactctgaggaggacggaatggtcaatcacggcgatctgtggggaagcgaggacgacgctgacaccgttgatgactatggcgctgactccaacagtgaggacgaagaggagggggaagccctgttgcccatcgagagagcagctcgaaaacagaaggctagagaggctgccgccggaattcagtggtcggaggaagagacggaggacgaggaagaggagaaggaagtgactcccgaatctggccctcctaaagtggaggaggcggacggaggcctacaaataaatgtggatgaagaaccatttgtactcccccctgccggtgaaatggaacaggacgcccaagcccctgacctgcagagggtgcataagcggatccaggatatcgtcggcattcttcgggactttggagcccagagagaggagggacgctcacgctcagagtacttaaataggctgaagaaggacctggctatatactactcttatggagattttctgttaggcaagctgatggacctctttcctctttccgaactcgtggaattccttgaggcaaacgaggtaccacggcccgtgaccctgcgtaccaatacactgaagactagaagaagggatttggctcaagcactcatcaatcgcggcgtgaacctcgaccctttggggaaatggagcaagactggcctggtggtatatgattcatcggtgcccattggagcaacacccgaatacctggccggccattacatgcttcagggagccagctctatgctgcccgtgatggctctcgctcctcaggaacacgaaaggatattggatatgtgctgtgcccccggcggcaaaaccagctatatggcacagctgatgaaaaacaccggtgtaatcctggccaatgacgcaaatgcggagcgacttaaaagcgtagttggtaaccttcatagattaggggtgaccaacaccatcatcagtcattatgacggtcggcagtttcctaaagtggtaggaggttttgaccgcgtgctgctggatgctccatgcagtgggaccggtgtgatcagcaaggatccagccgttaagaccaataaagacgaaaaagatattttaaggtgcgcccaccttcagaaggaactgctgctgtcagctattgatagtgtgaacgccacctctaaaaccggtgggtatctggtgtattgtacgtgttcgattaccgttgaggagaatgagtgggtcgttgattatgcactgaaaaaacggaacgtgcgcctggtgcctacaggtctggacttcgggcaagaaggatttactcgcttccgagaaaggcgctttcatccctccctgcggtccacaagaaggttctacccacacacccataacatggacggcttttttatcgccaagtttaagaagttctccaactccatacctcaatcccagacagggaatagcgagaccgctacccctacaaacgtggatctgccacaagtcatccctaagtccgaaaattcgtcacagcccgcaaagaaggcgaagggggcagccaaaactaagcaacagctgcagaagcagcagcacccgaaaaaggcctccttccaaaaattgaacggaatatccaaaggcgctgattctgaactgagtaccgttccaagtgtaactaagactcaggcttcttcaagctttcaggactccagtcagcccgcaggcaaagcggaagggataagggagcccaaggtcacaggcaagctgaaacagcgcagccctaagctgcagagctccaaaaaggtagccttcctgaggcaaaacgctcccccaaagggaaccgacacccagacccctgccgtgttgtcaccctctaaaacacaagcaactctgaagccgaaagaccaccatcagcccttgggccgggctaaaggggtcgagaagcagcagctcccagaacaacctttcgaaaaggctgcatttcagaaacagaatgatacgcctaagggccctcagcctcccacagtgtcacccatcaggagtagccgtcccccccctgctaagagaaagaaatcgcagtccaggggaaattcacagttattgttgagctag

SEQ ID NO: 19934 - DNA, 2427 bp, Artificial Sequence
  Description of Artificial Sequence: Synthetic coding sequence
atgggccggaagctggaccccaccaaggagaagcggggccccggccgcaaggctaggaagcagaagggcgcggaaaccgagcttgtcagattccttcctgctgtgtccgacgagaactctaagcgcctgtcaagccgagccaggaaacgcgctgctaaacgccgtttgggttctgtcgaggcacctaaaacaaacaagtccccggaggcgaagcccctgcccggaaaattgcctaaaggggcagtccagactgcggggaaaaaagggcctcagagcctgtttaatgcccccaggggaaaaaaaaggccggcgccagggtccgacgaagaggaggaggaggaagactctgaagaagacgggatggtaaatcacggagacttgtggggaagtgaggatgatgcagacaccgtcgatgattatggcgcggactcaaactctgaggatgaagaagagggtgaagcactcctgccaattgagcgcgccgcacgtaagcagaaagctcgcgaagctgcggccgggatccagtggtcagaagaggagaccgaggatgaagaggaggagaaagaagttacccctgaatccggtcctccaaaggtggaagaggctgatggcggacttcaaattaatgtagatgaggagcctttcgtgcttcccccagcgggcgaaatggagcaggacgcgcaggcacctgatctgcagcgcgtgcacaagcgtatacaggatattgtcggtatcctcagggacttcggggctcagcgcgaggaggggcgttcccgatctgagtacctcaacaggctcaaaaaagacctggccatctattattcctacggtgatttcctgctgggcaagctaatggacctgttccccctgagcgaactggtcgagttcctcgaggctaacgaagtgccccgcccagtcactcttcggacaaatacactgaagactagacgacgggacctagcccaagcccttataaatcggggagtcaacttggatccactgggtaaatggtccaagactggattagtggtgtatgactcgagtgtgcctatcggcgcgaccccagagtacctcgctggccactacatgcttcagggcgcctcgtcaatgcttcccgtgatggccctggccccacaggaacacgaaaggatacttgatatgtgctgtgcgccaggcggaaagactagctatatggcacagctcatgaagaacaccggagtcatattggctaatgatgccaacgcagagagactcaagtcggtcgtaggaaatttacatagattaggagtcaccaacaccattatatctcattatgatggacggcagttccccaaggtggttggagggttcgatagggttctactagatgccccgtgcagtggaactggtgttatttctaaggaccctgcggttaaaaccaacaaagacgaaaaagacattctgcgctgcgcacacctgcagaaggaactgttgctgagcgctatcgacagcgtaaatgccacatccaaaacaggcgggtatctcgtttattgtacctgtagcatcacagtcgaagaaaatgagtgggtggttgattacgccctaaagaagcgcaacgttaggcttgttcctaccggattggattttggacaggagggattcacgcggtttcgcgaacggcggttccacccatccttgcggagcacacgtaggttttacccgcacacccacaatatggacgggttttttatagcgaagtttaaaaaatttagcaacagcattcctcagtctcaaactggcaatagcgagacggcaacccccacaaacgtagaccttccccaggtcattcctaaatcagaaaattcctcacagcccgccaaaaaagcgaaaggagccgccaagacaaagcagcagctacaaaagcaacaacatccaaaaaaagcatctttccagaaactgaacggcatcagtaagggcgccgattctgagctgagtactgtcccgagcgtgaccaagacacaggctagctcatctttccaggatagctcccagccagccgggaaagccgagggtattcgagaacctaaggtgacaggaaagctgaaacagagatcccccaagctgcagtccagtaagaaggtagcatttctgaggcagaatgctccccccaaaggcacggatacacagactcctgcagtgttgagtccatccaagactcaggctacactgaagccgaaagatcatcatcagcccctcgggcgcgctaaaggcgtcgaaaagcaacaacttcctgaacaaccttttgaaaaggccgcattccagaagcagaacgatacgcccaagggaccccaaccacctacagtttcaccaatccggagctcacgcccaccgccagctaagcggaagaaatcccagagcagaggcaacagtcaactgttactcagttag

SEQ ID NO: 19935 - DNA, 2538 bp, Artificial Sequence
  Description of Artificial Sequence: Synthetic coding sequence
atgggccggaagctggaccccaccaaggagaagcggggccccggcagaaaggcacgaaagcagaagggcgcagaaacagagttggtccgcttcttaccagcagtctctgatgagaactcaaaaaggttgtcatcgcgtgcaaggaagagggcggccaagaggcggctgggtagcgtcgaggcccctaaaaccaataagtctcctgaggcgaaacccttgccaggaaagcttcctaaggggattagcgccggggctgtccaaactgcaggtaaaaagggcccccagagcctattcaatgcacctaggggaaaaaagcgccccgcccccgggagcgacgaagaggaggaggaggaagacagcgaggaagatggcatggtcaaccacggggacttatggggctccgaggatgacgcagatactgttgatgactatggagctgattctaactcagaagacgaagaggagggcgaagctgccggggtgcagtggctggggctcggcagcctgcagccccctcccccggggtttaagcaattcagctgtttatccttcccatcatcctgggatctccagctcctgccaatcgagcgcgcggccagaaaacagaaagccagggaggccgccgccggaattcagtggtccgaggaggaaacagaagacgaagaagaggagaaagaggtaactccggagtcaggtccacccaaggtggaagaggcggacggcggattgcagattaacgtagatgaagaaccattcgtgctgccccctgctggggaaatggagcaggatgctcaggcccctgacctccagcgtgtgcacaaacggatccaagacatcgtgggaatcctccgggactttggcgcccagcgggaggagggcaggtcccgttcagaatacctgaacagattaaaaaaagatcttgccatctattatagttacggggatttcttattaggcaaactcatggatttatttccccttagcgagcttgtggagttccttgaagccaatgaggtgccgcggccggtgactctgaggaccaacacgttgaaaacaagaaggcgggatctcgcccaggcactgataaaccgcggagttaacctggacccactgggcaaatggagcaagaccggtctggttgtgtatgattcgagcgtgcccattggggctacccctgaatacctagccggccattatatgctgcagggagcttcgtctatgctccctgtcatggccttggcaccacaggagcatgaaagaattctggatatgtgctgtgcacctggggggaagacgagctatatggcacaactgatgaagaacacaggcgttatcctagccaatgacgctaacgccgagaggcttaagtcggtcgtgggcaatctgcacaggctgggagtgacgaacaccattatctcacactatgacggcaggcagtttccaaaagttgtcggaggatttgaccgagtgcttttagacgccccatgtagcggtaccggagtgatctccaaagaccctgctgtgaaaactaataaagatgagaaagacatcctgcggtgcgctcacctgcagaaagaactgttgttgtcggccatagattcggtgaacgcaacttccaagacagggggctacctggtctactgtacatgtagtatcacagtggaagagaatgagtgggtcgtagactatgccctaaagaagcgtaatgttcggttggtcccaacaggcctggattttggccaggaggggtttacccgctttagggaacgaagattccacccgtcactccgcagcacgcgtcgcttctatcctcacacacataacatggacggttttttcatcgctaagtttaagaaattttcaaactcaattccccagtcacaaaccggcaactcggaaacagccaccccaactaatgtcgatctccctcaagtcatccctaagagtgagaactcttcccagccagctaaaaaagctaagggtgccgcaaaaaccaagcagcagctgcaaaagcagcagcaccccaagaaagcatcattccagaagctcaatgggattagtaagggggccgatagtgaattgtctacagtgcccagcgtcacaaagactcaagcgtctagctcgttccaggactcttcccagcctgctggaaaggcggagggaatccgggagcccaaggtgacagggaagctgaagcaaaggagccccaagttacagagttccaagaaggtggccttcttacgtcagaacgcccccccgaagggcaccgatacccagacccctgcagtccttagtccctcaaagactcaggccacgctcaagcccaaagatcaccaccagcccttagggagggccaagggcgtggaaaagcaacagcttcctgagcaaccatttgagaaagcggcctttcaaaagcagaacgatacccctaagggacctcagccaccaaccgtgtctcccattcgtagctctaggccgccacccgccaagcggaagaagtcacagtctcggggcaactcccaactgctcctgagctag

SEQ ID NO: 19936 - DNA, 1887 bp, Artificial Sequence
  Description of Artificial Sequence: Synthetic coding sequence
atgggccggaagctggaccccaccaaggagaagcggggccccggccggaaggctcgaaaacagaaaggcgccgagacagagctggtgagattcctgcccgctgtgagtgacgagaacagcaaacggctgtcgtctcgcgctcgtaagcgcgcagcgaaaaggagattgggatccgtcgaggcacccaagaccaataaatcccccgaagccaagccgctccccggaaagctgccaaaaggcgcagtgcagactgccggcaaaaaaggcccacagagtctgttcaacgctccaagaggcaaaaagaggcccgctccaggatcagacgaggaggaagaagaagaggactccgaggaggacggcatggtgaaccatggcgacctttggggctcagaggatgatgccgacacggttgatgactacggagccgattctaactcagaagacgaagaggagggagaggccttgctacctatagaaagggccgcaaggaaacagaaggcacgcgaagcagccgctggcatacagtggtcagaagaggagaccgaggacgaggaggaggaaaaggaggtgacgccagaaagtggcccacccaaagttgaagaggccgacggaggactccagattaacgtagatgaagagccattcgtgctgcctccagcaggcgagatggagcaggatgctcaggctcccgatctgcagcgtgtgcacaaacgcattcaggatattgtgggaatcctccgtgatttcggcgcacagcgggaggaaggacggagcagatctgaatacctgaatagactcaaaaaggacctggccatatactacagctatggggacttccttctcggcaagctaatggacctgttcccactgagtgaacttgtcgagtttctagaggcgaacgaagttccacggcctgtcactctcagaacaaacaccctaaagaccagaagacgagatttagctcaagctcttatcaaccgtggtgtcaatctggaccctctcggtaaatggtccaagactggtctggtggtctatgactcctcagtccctattggtgccacgcccgaatacctggcgggccattatatgttacagggggccagtagcatgctgccggtgatggctcttgcgcctcaggagcacgagaggattctggatatgtgttgtgcgcccggtggtaaaacgagctatatggctcagctgatgaagaacaccggagtcattctggctaacgacgcaaacgccgaacggcttaagtcagtcgtcggaaatcttcaccggcttggcgtgaccaatactatcatctcccactacgatggtcgacagttccctaaggtggtgggaggcttcgacagagtgctgctggatgcgccctgttccggaacgggcgtgatcagtaaggaccctgccgttaagaccaacaaagacgagaaggacattcttcgctgtgcacacttgcagaaggaactcttgctcagtgcaatagattccgtgaacgcaaccagcaagacaggaggatatcttgtctactgtacatgttctataacagtggaggagaatgaatgggtcgtagattacgcattgaagaagagaaatgttcggctcgtccctaccggtctggatttcggccaagagggctttactaggttccgtgagcggaggttccaccctagtctgcgaagtacacggagattctacccacacacacacaatatggacggattcttcatcgctaagttcaagaaattttccaactctatcccacagtcccagactgatggtgtgctcctgtgccgtagcggttggaccgcagtggtgcagtcacagcttattgccacctctacttttcaagtgcaggccattctggttcctcagactccaaagtag

SEQ ID NO: 19937 - DNA, 582 bp, Artificial Sequence
  Description of Artificial Sequence: Synthetic coding sequence
atggccctgagcaccgactacgccctgcggaccggcgccttcgagcctgccgaggcatccgtcaatccccaggaccttcagggttctctgcaggaactgaaggaacgggccctaagccgatataatctcgtccgtggccagggaccagagaggctggtgtctggatctgacgacttcactttgttcctctggtcccccgccgaagacaaaaaacccctcacgaggatgaccggacaccaggccttaattaatcaggttctgttttcccccgattctcggatcgttgctagtgcctcctttgacaaaagtatcaagttgtgggatgggagaaccgggaagtaccttgcctcgttgcgcggtcacgttgcagccgtgtaccagattgcctggagtgctgattcacgtctgcttgtgagcgggagcagcgatagtactctgaaagtatgggacgttaaagcccagaagctcgctatggaccttcctgggcatgccgacgaagtttatgctgtcgactggtctccagacggacaaagagtagcatctggcggaaaagacaagtgcctgcgcatctggcggcgctag

SEQ ID NO: 19938 - DNA, 915 bp, Artificial Sequence
  Description of Artificial Sequence: Synthetic coding sequence
tgaagcagcaaggacggcagcgtgcggatctgggacaccaccgccggtagatgcgagcgtatcctgaccggacacacccagagtgtgacgtgcctgaggtggggtggagacggacttctttactctgcgtcccaggacagaacaatcaaagtgtggcgcgcacacgacggcgtgctatgtagaacattgcagggacacgggcactgggttaatactatggccttgagcaccgattatgcgctgagaaccggagcattcgagccggcagaagcttccgtgaaccctcaggacctccagggatccttgcaggagcttaaagagagagccctctcaagatacaacctggtgcggggccagggacccgagaggctggtctctgggtctgacgactttaccctgttcttatggtcccccgccgaggacaagaaaccactcacgcggatgaccggacatcaggctctgattaatcaggttctcttcagcccagatagcagaatagttgcgtctgcgagttttgataaatctataaagctgtgggacggcaggactggaaaggatgactttcatagcgtaacatggtgctccagtggatcttcagccgcggcacggtcatggctcataacaaccagcgcatcttgggtgcaagttatccttttgccccagccacctcggtacttagcctctctgcggggccatgttgcagccgtgtaccagattgcctggtccgcagactcccgtctgcttgtcagtggctcatccgactccactctcaaggtgtgggatgtgaaggcccaaaagctggcgatggaccttcccggacacgctgatgaggtctatgctgtggattggagccctgatggacagcgagtagcctctggaggcaaggataagtgcttgcgcatatggaggcgctag

SEQ ID NO: 19939 - DNA, 1458 bp, Artificial Sequence
  Description of Artificial Sequence: Synthetic coding sequence
atggccgccgccgtgcccgacgaggccgtggcccgggacgtgcagcgtctattggtgcaattccaagacgaaggcggccaactcctgggcagcccattcgacgtcccggtagacatcactcctgataggttacaactggtgtgcaacgcacttctggcgcaggaagaccccctccctttagccttttttgtgcatgacgcagagattgtgagcagcctggggaagaccttggaatcgcaggctgtagagactgagaaggtcctggacattatctaccagccacaagcaatctttcgcgtgcgagcggtgacacgctgcacttcatccctggaagggcactcagaagccgttatctcagtggctttctccccgaccggcaaatatctggcgtcaggatctggtgacactacggtgcgcttttgggatcttagcacagagactccacatttcacatgcaaaggccaccgccattgggtgttgtctatcagctggtccccggacgggcggaagctggcgtccggctgtaaaaacggccagatcctcctttgggacccttctactgggaaacaggtgggccgtacactggccggtcattctaagtggattactggtctttcttgggagccgttgcatgccaatcccgagtgccgctacgtggcttcctcatccaaagatggctctgtgaggatatgggataccacagccggaagatgtgagaggatcctgactggacatacacagtctgttacctgcctgcgctggggcggggatggtttgctttatagtgcttctcaggacaggactataaaggtttggcgggcccacgacggcgtcctttgccggacccttcagggacacggacattgggtaaacacgatggcactgtccacggattacgctctgaggacaggtgcctttgaaccagccgaagctagcgtcaacccacaagacttgcaaggtagcttacaggagcttaaagaacgtgctctgagtagatacaacttggtcagaggtcaagggcccgaaagacttgtcagcggttccgacgattttaccttgtttctgtggagtccagccgaggacaagaagcccttgacccggatgaccggccaccaagctctcataaaccaggtactgttcagtcccgattcaaggatcgtggcttctgccagctttgacaaaagcattaaattgtgggacggacgcaccgggaaatatttagcgagtttacgggggcacgtcgctgccgtgtatcaaattgcctggagcgctgattcccggctcctggtctcaggcagcagcgatagtaccttgaaggtatgggacgtcaaggcccagaagctggctatggatctgcctgggcacgccgacgaggtttatgccgtggattggagtcccgacggccaacgcgttgcctccggaggaaaggataaatgcctcaggatctggcgacgttag

SEQ ID NO: 19940 - DNA, 1386 bp, Artificial Sequence
  Description of Artificial Sequence: Synthetic coding sequence
atggccgccgccgtgcccgacgaggccgtggcccgggacgtgcagcgactgctagtgcagtttcaggacgaaggcggtcaactgcttggtagcccttttgacgtaccagtggacattacccccgaccgactgcagctggtgtgcaatgccttgttggctcaggaagatccactgcctctggccttctttgtccacgatgccgagatagtctcgtcactggggaagacccttgagtcccaggctgtggagactgaaaaggtgctagatataatttaccaacctcaggccatattcagagttcgggccgttacccgctgtacttccagcctggagggtcactccgaagcggtcatctctgtcgctttcagcccaactggcaaatatctggcctcaggctctggggatactacagtccgattttgggatttgagcacggagacgcctcacttcacatgcaagggacatcgccactgggtgttgtccatctcatggagcccagacggccgcaagctagcctccgggtgtaaaaatggccagatcctgctatgggagccgctgcacgcgaatcctgaatgtagatatgtggctagctctagcaaagatgggagtgtgaggatttgggatacaaccgccggacggtgcgagcgcatcctcaccggccacacccagagtgtcacctgtctcagatggggaggcgacggcctgttgtactctgcgtcccaggaccgtacaattaaggtctggagggcgcatgacggcgtgctgtgccggactctacagggccacggccactgggttaacactatggccctgtcaactgattacgccttaaggactggcgccttcgaacccgcagaggcctcagttaacccccaagacttacaggggagtttacaagagttgaaggaaagagcgctgtccagatataatttagttaggggtcagggcccagagcggctggtctccgggtcagacgattttaccctcttcttgtggtcaccggccgaagataaaaaacccctgaccagaatgaccggccaccaggctctcattaatcaagtgctcttctcgcctgacagccgaattgtggcttctgctagctttgataagagtatcaaactgtgggacggccgaactgggaagtatctggctagcctacgaggtcatgtggcggccgtgtaccagatcgcttggtccgccgattcccggctcctcgtgtcaggatctagcgactccaccctcaaggtttgggatgtgaaggcacaaaagttagcaatggatctgccgggacatgcggacgaggtttacgccgtcgattggtcacccgatgggcagcgggttgccagtgggggcaaagacaaatgcctgcgaatctggagacgttag

SEQ ID NO: 19941 - DNA, 582 bp, Artificial Sequence
  Description of Artificial Sequence: Synthetic coding sequence
atggccctgagcaccgactacgccctgcggaccggcgccttcgagccggccgaggcttccgtcaaccctcaagaccttcaagggtcactccaggagttaaaagagcgggcacttagtaggtataatcttgtgcggggtcaaggacctgagagactcgtgtcaggaagcgacgatttcaccctgttcctgtggagccccgcagaggataaaaagccactgacccgaatgacaggccatcaggcgcttatcaaccaggtgctgttctcacccgattcaagaatcgtggcatccgcttcgtttgacaaaagcatcaagctgtgggatgggcgcaccgggaagtatctggcgagtctgaggggtcatgtggctgccgtctatcagatcgcatggtcggccgactctcggttgctggtgtccggcagtagcgatagcactctcaaggtgtgggacgtgaaagctcaaaagctggccatggaccttccaggacatgctgacgaggtgtatgctgtcgactggagccccgatgggcaaagagtagcatcagggggtaaagataaatgcctgagaatctggcgccgctag

SEQ ID NO: 19942 - DNA, 756 bp, Artificial Sequence
  Description of Artificial Sequence: Synthetic coding sequence
atgcccagcccccggccccggggcagccccccccccgcccccagcggaagtcgggttcgcccaccgaggtcaggacggagcccagcccctcgcagccctaccggcccgaacaccccccgagcacctggtaggtttgagtctccgttcagtgtcgaggccatcttggcccgccctgatccgtgtgcacctgcagcgtctcaaccaagcggcagcgcttgtgttcaccctgcgttctggacagccgcttcactgtgtgctaccggcggcttgccctgggcgtgccccactagttggcttcctgcctacctgtctgtggggttctatcctgtgccaggacctagagttgctcccgtctgcggtctgcttgggtttggcgttacaggcctcgagctggcccattgcagtggtctctgggccttccctgattgggccccaacagaggacttgcaggacaccgaacgccagcaaaaaagagtgagaacaatgtttaacttggagcagttggaagaattagagaaggtgtttgcaaagcagcacaacctggtgggtaagaagcgggcccaactggctgccaggcttaagctcaccgaaaatcaagtcagggtctggttccaaaatagaagagttaaatatcaaaaacagcaaaaacttagagcggcagtcacctccgcagaggccgcgtccttggacgagcccagttcctcttccattgcgagcattcagtccgatgacgccgaatctggcgtggacggctag

SEQ ID NO: 19943 - DNA, 1110 bp, Artificial Sequence
  Description of Artificial Sequence: Synthetic coding sequence
atgttctgctgcctgggctacgagtggctgagcggcggctgcaagacctggcattcagcatgggtgattaatacactggccgaccaccgccatcggggtacagattttggggggtctccctggctgctgatcatcaccgtatttctacgtagttataagttcgccatctcgctgtgtacctcttatttgtgtgttagcttcctgaaaaccatttttccctcacaaaacggtcacgacggctcgacagacgtgcaacagagagccagaagatcgaactgtaggcgccaggagggaattaagatcgtccttgaggatatttttaccctgtggagacaggtggagaccaaggtcagggctaagatcaggaaaatgaaagttacgactaaggtgaatcgacatgataagattaacggcaaacggaaaaccgcaaaagagcacctgagaaagctgtctatgaaagaaagagaacatggggagaaagagcgccaagtgtccgaggccgaggagaacggaaagttggacatgaaggaaattcacacttatatggaaatgttccagagagcacaggctttacgccggcgcgctgaggattattatcggtgcaagatcacaccttcagcaaggaaacccctgtgcaacagagtgcggatggctgctgtggagcaccgtcatagctcgggattgccatactggccgtatctgacagctgagacactaaaaaatcgaatgggccatcaacctcccccaccaacacagcagcattcaataatcgataacagtctcagcctcaaaacccctagcgaatgcgttctgtacccgctgccgccctctgcagacgacaatctgaagactccccctgaatgcctgctgacccccctgcccccaagcgcactgccgtccgctgatgacaacctgaagacccccgccgagtgtcttctgtacccattgcccccatccgcggacgacaatctcaagacccccccagagtgcctactgacccctttgcctccctcagctccaccatcagctgatgacaacctgaagacaccaccagagtgtgtatgcagcttaccctttcatccccagcgaatgattatatcccgtaattag

SEQ ID NO: 19944 - DNA, 1110 bp, Artificial Sequence
  Description of Artificial Sequence: Synthetic coding sequence
atgttctgctgcctgggctacgagtggctgagcggcggctgcaagacctggcatagcgcttgggttatcaataccctggccgatcatcggcaccggggaaccgatttcggtggctcaccctggctcctcatcattactgtctttctgagaagctacaagtttgccatatccctatgtacctcttacctttgcgtctctttcctgaagacgatcttccccagtcagaatggacatgatgggtccaccgatgtgcagcagagagcccgcagatcaaactgccgcagacaggagggtatcaagattgtgctagaagacattttcacactgtggaggcaggttgaaacgaaagtgcgtgcgaagatacgcaagatgaaagttaccactaaagtgaaccgccatgataagattaatggaaagcgaaagactgctaaagaacacctgaggaagttaagtatgaaggaacgcgagcacggcgaaaaggaacgacaagtgtccgaggcagaagagaatggaaaacttgatatgaaagagattcatacgtatatggaaatgttccagagagctcaggccctgagacgtcgcgcagaggattactacagatgcaaaattactcccagcgccagaaagccactttgtaacagggtgcgtatggccgccgtggaacacaggcactccagtggactgccatattggccctacctgacagcagagaccctgaaaaatcgtatgggtcatcagcctccacctcctacacagcagcacagcatcattgataacagtctgtctctgaaaacaccgagtgagtgtgtcttgtatccgctgccgccaagtgccgatgacaatctaaagaccccacctgagtgtcttctgaccccactgccacctagcgctcttccctcggctgacgacaatttaaaaaccccggctgagtgcctgctgtacccccttccccccagcgcggacgacaacctcaaaacaccaccggagtgtttgctcacccccctgcctccctccgcccccccatccgcggacgataatcttaaaacgcctcccgagtgtgtgtgcagtctgccctttcacccccagcggatgatcatatcacgaaactag

SEQ ID NO: 19945 - DNA, 1110 bp, Artificial Sequence
  Description of Artificial Sequence: Synthetic coding sequence
atgttctgctgcctgggctacgagtggctgagcggcggctgcaagacctggcacagcgcctgggtaatcaacacattggctgaccatcgccatcggggtaccgactttggcggaagtccctggctattgattatcacggtgttcctacggtcatacaagtttgctattagcctgtgcacttcttatctgtgcgtcagctttcttaagaccatcttcccatctcaaaacgggcacgacggcagcaccgacgtgcagcagcgcgcccggagaagcaattgcagacgccaggagggaattaagatagtactggaagacatctttactctatggaggcaggtggaaacaaaagtacgcgctaagatcagaaaaatgaaggtgactacgaaggttaataggcatgataaaatcaacgggaaacgcaagaccgccaaagaacacctgcgaaaattgtctatgaaggagcgagaacatggagagaaggagcgacaggttagcgaggctgaggagaacggcaaactggatatgaaagaaattcatacatacatggagatgtttcagagagcccaggctctgcgcaggcgagctgaggattactacaggtgcaagatcacgccgtccgctcgaaaacctctgtgcaaccgcgttcggatggccgccgtcgaacacaggcactcctccggcctcccatattggccctatctcactgctgagacactgaagaaccgcatggggcatcagccgccccccccaacacaacagcactccatcatagataattccctcagcctcaagacgccctctgagtgtgtcctgtacccccttcccccaagcgccgatgataacctgaagacccctcccgagtgcctgctgacgccattgcccccctctgcactcccctccgccgacgacaacctgaaaactccagctgagtgcctgttgtaccctctccctccgtctgccgatgacaacctgaagactccaccagagtgcctgctgacacctctccctccaagtgccccgccaagtgccgacgacaatctgaagacaccaccagaatgcgtgtgcagcctaccttttcatccccagcggatgatcatttctcgaaactag

SEQ ID NO: 19946 - DNA, 699 bp, Artificial Sequence
  Description of Artificial Sequence: Synthetic coding sequence
atgttctgctgcctgggctacgagtggctgagcggcggctgcaagacttggcacagcgcgtgggtcataaatacacttgctgatcacagacatcgaggtactgattttggcggtagcccttggctgttgattattactgtgtttctcagatcttacaaattcgctattagcctgtgcaccagctatctctgtgtttcttttctgaaaacgatttttccctctcagaatggccacgacggtagcacagacgtccaacagagagctaggagatccaattgccgtcggcaagaggggattaagattgtacttgaggatatctttaccctgtggcgccaggtggaaaccaaagttagggcaaagatacggaagatgaaagtgaccaccaaagtcaatagacacgataagattaacggcaaacgcaagacggctaaggagcacctgagaaaactttctatgaaggagagagaacatggcgagaaggaacgacaggtttctgaagcggaagagaacggcaagctggatatgaaagagatccacacgtacatggagatgttccagagggctcaagcgctgcgccggcgagccgaagattactataggtgtaagataactcctagtgcgcggaagcccctgtgcaaccggtgcacatacaatctggtcctccctggctctgagaagaaatattacagtcacgcttag

SEQ ID NO: 19947 - DNA, 699 bp, Artificial Sequence
  Description of Artificial Sequence: Synthetic coding sequence
atgttctgctgcctgggctacgagtggctgagcggcggctgcaagacttggcactccgcttgggtaataaacacactagcagatcatcgacacagaggcacagattttggcggcagtccgtggctgctcatcatcaccgtatttctgcgcagctacaaatttgcgattagtctgtgtacatcttatctgtgtgtaagcttcctcaagaccatatttccctcacaaaacgggcacgatgggagtaccgatgtccagcaacgcgcacgacgctcaaactgccgccgtcaagagggcattaagatcgtcttagaggacattttcacgctgtggagacaggtggaaactaaagtcagagcgaaaatcaggaaaatgaaggtcacaactaaggttaacaggcacgataagattaacggaaagcgcaaaacagctaaggagcacctgcgcaaactttccatgaaggagcgtgaacatggcgaaaaagagcgccaggtttcagaagcggaggagaacggcaagttagacatgaaggaaattcacacatatatggaaatgtttcaaagggctcaggcgcttcggcgccgtgccgaggactactacaggtgtaagattacaccatcagcccggaagcccctgtgcaatcgatgcacctataacctggtcttgcccggatccgaaaaaaaatactactctcacgcctag

SEQ ID NO: 19948 - DNA, 1110 bp, Artificial Sequence
  Description of Artificial Sequence: Synthetic coding sequence
atgttctgctgcctgggctacgagtggctgagcggcggctgcaagacctggcacagtgcctgggttatcaacacactcgctgaccatagacacaggggcactgatttcggggggagtccatggctcctcataatcacagtgttcttgcggtcttataaatttgctatttctctctgtacctcctatctctgtgtctccttcctaaagactattttccctagccagaatgggcacgatggatccacggatgtgcagcagagagcccgccggtcgaattgcaggcggcaagaaggcataaagatcgtgcttgaagacattttcacactctggaggcaggtggagacaaaagtgagggctaaaatccgaaagatgaaggtgactacaaaggtcaaccggcacgacaaaattaatgggaaacggaaaaccgccaaggagcacctccgtaagctgtccatgaaggaaagggagcacggagagaaggaaaggcaggttagcgaagcggaagagaatggtaaattggatatgaaggaaattcacacatacatggaaatgttccagcgtgcacaggccctccggcgccgcgccgaggactattatcgttgtaagattactccttccgctagaaagcccttgtgcaatagggtgagaatggcagccgtggagcatcgccactcttctggcctgccgtactggccatatctgaccgcagaaacactaaagaaccgtatggggcatcagccgccgccacctacccagcagcactccatcatcgacaacagcttgtctctaaaaactccaagcgagtgcgtcctctacccactgccgccctcggcagatgacaacttgaagacaccccctgaatgcttgctgaccccattacctccttctgcgctgccctctgccgatgataatctgaaaacaccagccgagtgccttctttacccattgcctccttcagccgatgacaatttgaagactccgccagagtgtctgctcacccctctccctccaagcgcacctcccagcgccgacgacaacctgaaaacgccgcctgagtgcgtgtgctcattgccctttcatccccagcgcatgattatcagccgcaactag

SEQ ID NO: 19949 - DNA, 2067 bp, Artificial Sequence
  Description of Artificial Sequence: Synthetic coding sequence
atggagaacggcgtgctgggcaacgccctggagggcgtgcacgtggaagaggaggaaggagagaaaacggaagatgaaagtctcgtggagaataacgacaatattgatgaagaagcaagggaggagctgagggaacaggtatacgacgccatgggggagaaggaagaagcgaaaaagacagaagacaagtcgcttgccaagcctgagacagataaggaacaggacagcgagatggagaaaggcggacgagaagacatggatatctctaaatccgccgaagagccacaggaaaaagttgatctgacactggactggctgacggaaaccagcgaggaggccaaaggaggtgcagcccctgagggcccgaacgaagcggaggtgacctcaggcaagcctgaacaggaggtgcccgatgcagaagaggagaagtccgtttccggaactgacgtacaggaagagtgcagggagaagggtgggcaggagaaacagggggaggtcatcgtctctatcgaagaaaaacccaaggaggtgtcggaggagcagccagtcgttaccctggaaaaacagggcactgccgtcgaggtcgaggctgagtccctcgatcccacagtgaagccagttgacgttgggggagacgaaccagaagaaaaagtcgttacctcagagaatgaggctggcaaggcggtgctcgagcaacttgtcgggcaagaagtaccgccggccgaagagtctcctgaggtcacgactgaggccgctgaagcttctgccgtggaggccgggtctgaagttagcgaaaagcctggtcaagaagcacctgtactcccgaaagatggtgcagtgaatggacctagcgtagtgggggaccaaaccccaattgagcctcaaacatcaatcgaacgcctaaccgagacaaaagacggttcgggcttggaggaaaaggttagggccaagctcgtgccctcccaggaagagaccaaactgtctgttgaagaatctgaagcagccggcgatggggtagataccaaggtggcccaaggtgctaccgagaagtcccccgaagacaaagttcagatagccgcaaatgaagagacccaggagcgggaagagcagatgaaagaaggggaggagacagagggtagcgaagaggatgataaagaaaatgacaagactgaagaaatgcccaacgactccgttctagaaaacaaaagtttacaggagaacgaagaggaagaaatcggcaatttggagctggcatgggacatgctggatctggccaaaatcattttcaaacgccaggagacgaaagaagcacagctctacgccgcacaagcgcatctgaagctgggagaggtcagtgtggaatctgagaactatgtacaggccgtggaggaatttcagtcttgcctgaatcttcaagagcagtatctggaagcccacgatcgccttctagcagagacccattatcagctggggctagcctatggctataatagccaatacgacgaagccgtcgcacagttttcaaagagcatcgaggtaattgagaaccgaatggcagttctaaatgagcaggtgaaggaagccgagggatcttccgctgagtataaaaaggaaattgaggaactgaaagagctgctcccagaaatcagggagaagatcgaggatgccaaggagtcacaacggtctgggaatgtagcagagctcgctcttaaggccaccctagttgagtcaagcacctcaggttttactccaggcggcgggggatcgtcagtctctatgatcgcatcgcggaagcccactgatggggctagcagctcgaattgcgtgacggatatctcccacttggtgcgaaagaaacgaaagcctgaggaggagtctccccgtaaagatgatgctaagaaggccaagcaggagccagaggtgaacggaggcagcggcgatgccgtcccctcgggaaatgaggtgagcgaaaacatggaggaagaggcagaaaatcaggctgaatccagagccgctgtggagggaactgtggaagccggagcgactgttgaatcaactgcctgttag

SEQ ID NO: 19950 - DNA, 2367 bp, Artificial Sequence
  Description of Artificial Sequence: Synthetic coding sequence
atggccatggagagcaccgccaccgccgccgtggccgccgagctggtatccgctgacaagattgaagacgttcctgccccatccacttccgcagataaggtggagagtcttgatgtggactccgaggctaagaaactgctaggtctgggacagaagcatctggtgatgggggatatccccgcagcagtcaatgccttccaggaagctgcttcactgctgggaaagaagtatggggaaactgcaaacgagtgcggagaggctttctttttttacggaaagagcctcctagagctcgcaaggatggaaaacggtgtcctgggcaatgcactggagggagttcatgtggaggaggaggagggagaaaagaccgaagacgaatctctggtggaaaataatgacaacattgacgaggaggctagggaagagttacgggaacaggtgtacgacgcaatgggtgaaaaagaggaggccaagaagacagaagacaaatcgctcgctaagcccgaaacggacaaagaacaggactcggagatggagaagggtggtagagaagatatggacattagcaaatcggctgaggagccacaggaaaaagtggatctgactctggactggctgaccgaaactagcgaagaagctaaagggggtgctgccccggagggccctaacgaagcagaagtgacaagcggcaaaccagagcaggaggtcccagacgccgaggaggagaagtcagtctcaggaactgacgtacaggaggaatgtagggaaaagggcgggcaggaaaaacagggtgaagtaatcgtgtccatcgaggaaaagccaaaggaagtctccgaagagcagcctgtcgtaacactggaaaagcagggaactgctgtcgaggtcgaagccgagagtctcgaccccactgtgaagccagtcgacgtgggtggcgatgagcctgaggaaaaagttgtgacctccgaaaatgaggccggtaaagccgtgctcgagcagcttgtaggacaagaagtacccccggccgaggaaagtcccgaggtgactactgaggctgccgaggctagtgccgtcgaggccggctccgaggtgagcgagaaaccaggccaggaggcccccgttctgcctaaggatggcgccgtcaacggtccatccgtggtgggggaccagactccaattgagccccagacctcaatcgaacggcttaccgagactaaagacggatccgggttggaagagaaagtacgcgccaagctggttccttcacaggaagagacgaaactgagtgtggaggagtccgaggccgccggtgacggtgttgacacaaaggtggcacaaggcgctacagagaagtcccctgaggacaaggtccagatcgccgcgaacgaggaaacccaagagagagaagagcagatgaaggaaggtgaggagaccgaagggtcggaggaggacgacaaggagaacgataaaaccgaagagatgccaaacgattccgtcttggagaacaaaagccttcaggaaaatgaagaagaggagattggcaacctggagttggcttgggatatgctcgatcttgctaaaatcatcttcaaacggcaggagacgaaggaggcccaactgtatgcagctcaggcacacctcaagctgggcgaggtgagcgtggaatcagaaaactatgtccaggccgttgaagaattccagagttgcctgaatctccaagagcagtatctcgaagcacacgacagactgctggctgagacccattaccaacttggtcttgcgtacggctataacagccagtacgatgaggcagtggcacagttcagcaagtcaattgaagtgatcgaaaacagaatggccgtgttgaatgaacaggtgaaggaagctgaagggagtagcgcggagtataagaaggagatcgaagagctcaaggaattactgccagagattcgggagaagatagaggatgctaaagaaagccagcggtccgggaacgtcgccgagctggcccttaaggcaacgttagttgagtcatccaccagcggattcacacctggaggcgggggatcctccgtctccatgatcgctagccgcaagcccacagatggggccagctcttccaattgcgtgactgacatttcccatctggtgaggaaaaaaaggaaaccagaggaagaaagcccgcggaaggacgacgccaaaaaggccaagcaggaacctgaggtgaacggggggagtggcgatgctgtgccaagcggcaatgaggtgtctgaaaacatggaagaagaggccgaaaaccaggctgagtcccgagccgccgttgagggcaccgtggaagccggggcgaccgttgaatctactgcctgttag

SEQ ID NO: 19951 - DNA, 1350 bp, Artificial Sequence
  Description of Artificial Sequence: Synthetic coding sequence
atggccatggagagcaccgccaccgccgccgtggccgccgagctggtgtctgcagataagattgaggatgtgcccgcaccttccacgagtgccgataaagttgaaagtctggatgtggacagcgaagctaagaaactcttaggtctcggccaaaaacacctcgtgatgggtgatatcccagccgcggtaaacgcgttccaggaagccgcctctctattgggcaagaagtacggtgaaaccgccaacgaatgtggcgaggcattctttttctacgggaaatcgctgctggaactcgcgcgaatggagaacggagtgctgggtaatgcattggagggagttcatgttgaggaagaagaaggagaaaaaactgaggatgagtctcttgtggagaacaacgataatattgacgagaccgagggatccgaggaggacgacaaggaaaatgataaaacggaggagatgcctaatgactcagtactggaaaacaaaagcctgcaggaaaatgaggaggaggagattggtaatctcgaactggcctgggacatgctagatctggcgaagattatatttaagcgtcaggaaacaaaggaggcccaattgtatgccgcacaggcgcacctcaaacttggggaggtttccgtggaatccgagaactatgtgcaagcagtggaggagttccagagctgcctgaaccttcaggagcagtacctcgaagcccatgaccggttgctggccgaaactcattaccagctcggcttagcttacggatacaacagccagtacgatgaagcagtggcacaattcagcaaaagcattgaggtgattgagaataggatggcagtgctcaacgaacaggtgaaggaagcggagggctccagtgctgagtataagaaggaaatagaggagctgaaggagctcctgccagagattagagagaagatcgaggacgccaaagagtcccagcgctctggtaatgtagccgaactcgccttaaaagccactctggtagaatcatccacgagcggctttacacctggaggtggagggagcagcgtcagcatgatcgcctctcgcaagccaacagacggtgcgtcaagtagcaactgcgtgacagatattagccatctcgtgcgcaaaaagaggaagccagaagaagaatcaccgaggaaggacgacgcaaagaaggccaaacaggagcccgaggtgaacggaggctccggtgacgccgtacccagcggaaatgaggtgtctgaaaacatggaggaggaagcagaaaaccaggcggaatcacgggccgcagttgagggcaccgttgaggctggcgccaccgtcgagtccaccgcctgctag

SEQ ID NO: 19952 - DNA, 2373 bp, Artificial Sequence
  Description of Artificial Sequence: Synthetic coding sequence
atgttcctgctgctgctgcacctgcagatcaagtggcgggccaccattaatctgttatctgtcacagaagatggccttcactttgtcgagtattatctgaatcggatcatccacctagacgttgacagcgaggcgaagaaattgttgggcctcgggcagaagcacctggttatgggcgatatccctgctgcagtaaatgcattccaggaggccgcctccctgctggggaaaaagtacggcgaaaccgccaacgagtgcggcgaagctttcttcttttacggcaagtccctgctggagttggcccgcatggagaatggcgtgctgggcaacgctcttgagggcgtgcatgtcgaagaggaggagggcgaaaagaccgaagatgaatctctagttgaaaacaacgacaacattgacgaagaagcgcgcgaagaattgagagaacaggtgtatgatgctatgggagagaaggaagaggctaagaaaactgaggataagagtctagccaaacccgaaaccgacaaggagcaggactcagaaatggagaagggtggacgcgaggacatggacatttcgaaaagtgccgaggagccccaagagaaagtcgacctcaccttggattggcttacagagacctcagaggaggccaaaggaggtgccgcacctgaaggaccaaacgaagcagaggttacaagtggtaagcccgagcaagaagtgcctgacgccgaggaggaaaagtccgtgtctggtactgacgtccaggaggagtgtagagagaagggaggacaggaaaaacagggggaggtgattgtttctattgaggagaagccaaaagaggtttccgaagaacagccggttgtgacactagagaagcagggcaccgcagtagaggtggaagccgagtccctggatcccaccgtgaagcccgtggacgtcggcggcgacgagccagaggagaaagtggtgacaagtgagaatgaggcaggcaaggcggtgcttgagcagctggtgggtcaggaagtgcctcctgcggaggagagccctgaggttacgacggaggctgctgaagcgagtgccgtggaggcgggcagtgaagtaagcgagaaacctggccaggaagctcccgtcctgcctaaagacggagcggtgaacggccctagcgtggtgggagatcagacaccaattgagcctcagacctccatagaaagactgaccgagaccaaggatggttccggcctggaggagaaagtccgagcgaaactcgttccaagtcaggaagaaacaaagttatccgtggaagagagtgaagcggctggggatggagtcgacaccaaagtagctcagggagcgacagaaaagtctcctgaggataaggtacagatcgccgcgaacgaagagacacaggaacgggaggagcagatgaaagagggcgaagagaccgagggatcagaagaggatgataaggaaaatgacaagacagaagagatgccaaatgatagcgtgcttgagaataagtcactgcaggagaatgaagaagaggaaattggtaacctggaactagcttgggacatgttggacctggctaaaattatcttcaagcgccaagagacaaaggaggcccaactctacgccgcacaggcccacctgaagctcggcgaagtgtccgtggaaagtgaaaactacgtgcaggccgttgaagaatttcagagttgtctaaatttgcaagaacaatatctcgaggctcacgaccggctactggcggaaactcactaccaactcggtctggcctacggctataattctcagtacgacgaggccgtggcccagttctcgaaatccattgaggtaattgagaatcgaatggcagttctcaacgagcaagtcaaagaggccgaaggtagctcggccgaatataagaaggagatcgaggagctgaaggaattattacccgaaatccgggaaaagatcgaggatgccaaggaatcccagcgaagcggaaacgtggccgagctcgcccttaaagccaccttagtggaaagtagtacaagtggattcacccccggtggcggggggtcctctgtgagcatgatagcctctcgtaagccaacagacggagcatcctcatctaactgtgtcactgacatttctcacctggtaaggaagaagagaaagcccgaggaggagagccccagaaaggacgatgctaagaaggccaaacaggagccagaagtgaacggagggagcggggatgcggtgccttccgggaatgaggttagcgagaacatggaggaagaggcagagaatcaggctgagtctagagccgctgtcgagggcactgtagaggctggtgcgaccgtggagtctaccgcttgctag

SEQ ID NO: 19953 - DNA, 771 bp, Artificial Sequence
  Description of Artificial Sequence: Synthetic coding sequence
atggccatggagagcaccgccaccgccgccgtggccgccgagctggttagcgcagacaaaattgaggatgtgcctgctcctagtaccagcgccgacaaggtggagagtctcgacgtggattccgaagccaaaaaattattgggtttaggacagaaacatttggtaatgggagacatacctgccgcggtgaatgcattccaggaggcagcatccctcctgggcaaaaagtatggcgagactgccaacgagtgtggtgaagcgttttttttctacgggaaatctttgctggagctagccagaatggagaatggagtgctggggaatgcactggagggtgttcatgtggaggaggaagagggagagaagactgaggacgagtcgctggttgagaacaacgacaatatagacgaaactgaaggtagcgaagaggatgacaaagagaatgataaaacagaagaaatgccaaatgatagcgtcctcgagaataagtcgctgcaggagaacgaagaagaggagattgggaacctcgagttagcctgggacatgttagatctggccaagatcatctttaaaaggcaggagactaaagaggcacaactttacgctgcacaggcacatcttaaattgggagaggtctccgtggagagcgagaactatgtgcaagctgtggaagagttccagagctgtcttaatctgcaggaacagtacttagaggcgcatgataggctcctcgcagagactcattaccagctgggcttggcttatgggtag

SEQ ID NO: 19954 - DNA, 2175 bp, Artificial Sequence
  Description of Artificial Sequence: Synthetic coding sequence
atggccatggagagcaccgccaccgccgccgtggccgccgagctggtttccgccgacaaaattgaggatgtacctgcgccttctacaagcgcagacaaagttgagagaatggaaaacggtgtgctggggaacgccctggagggggtccatgtcgaggaagaagagggggagaaaacggaggacgaatcgttagtcgagaataatgacaatattgacgaagaagccagagaggaactgagagagcaggtctacgacgcaatgggcgagaaggaagaggccaaaaaaactgaggacaagtccctggccaagcctgaaactgataaggaacaggacagcgaaatggagaagggggggagggaggacatggatattagcaaatcagctgaggaaccacaggaaaaggttgatttaacgctggactggctgacggagacatccgaggaagctaagggaggtgccgcccctgaaggtccaaatgaagctgaagttacatcagggaaacctgagcaggaggtgccagacgccgaggaagaaaaatctgtaagcggcactgacgtgcaggaagagtgtcgtgaaaagggcggtcaagagaagcagggtgaagtgatagtaagcattgaggagaaacctaaagaggtgtccgaagagcaacccgtggtcactcttgaaaagcagggaacagcagtggaagtcgaggcagagagcttggaccctactgtcaaaccagtggatgtgggcggagacgaaccggaggagaaagtagtaacatcagaaaatgaagcaggtaaggcagtgcttgagcagctggtcggccaggaggtgcccccagccgaagagagtccagaggtgactactgaagccgctgaggcctctgccgtcgaggcgggatccgaggtttcggaaaagcctggccaggaagcccctgtcctgccaaaggatggggccgtcaatggaccgtctgtcgtgggagatcagaccccgatcgaacctcagacatcaatcgagaggctgacagaaactaaagacggatctgggcttgaagagaaggtgcgggcaaaactggtcccatcccaggaggagacgaagctgagcgtagaggagtccgaagccgccggagatggcgtcgacactaaagtcgcacagggggcgactgaaaaaagccccgaagataaggtgcagatcgccgccaacgaggagactcaggaacgggaagaacaaatgaaggaaggtgaagaaaccgagggctctgaggaggacgataaagagaacgacaaaacagaggagatgccaaatgatagtgtgttggagaacaaatcccttcaggagaacgaggaggaggaaatcggtaacctggaattggcctgggacatgttagatctggctaagatcatctttaaacgtcaggagaccaaggaagcgcagctttacgccgcacaggctcatctgaagctcggtgaggtaagcgtcgaaagtgagaactatgtgcaggccgttgaagagttccagagttgcctcaatctccaagagcagtatttggaggcccacgaccgacttcttgcagagacacattatcagctcggcctcgcctacgggtacaacagccagtacgacgaggcagtggcacagttttcaaagtcaatagaagttattgaaaatagaatggctgttctgaacgaacaagtcaaagaggccgaaggtagctccgccgagtacaagaaggagatcgaggagctgaaggagctcctccccgagataagggagaagatcgaagatgctaaagagagtcagcgatccggcaacgtcgcagagctcgccctcaaggccaccttggtggaatctagcacgagcggattcacacccggtggcgggggcagttcagtgtccatgatcgcatcacggaagcccacagatggtgcgagttcatcaaattgcgtgacagatattagccatctggtcaggaagaagcgcaagccagaagaagagtccccaaggaaggatgatgctaagaaggccaaacaggagcccgaggttaacgggggcagcggagatgctgtgccatctggcaatgaggtcagcgaaaatatggaagaggaagctgaaaatcaggcagaaagccgagcagctgtggagggcacagtcgaggccggcgccactgtagaaagcactgcgtgctag

SEQ ID NO: 19955 - DNA, 453 bp, Artificial Sequence
  Description of Artificial Sequence: Synthetic coding sequence
atgcggagctgctgcgtggtgcaggccggcctgcagctgctggccagcagcgatccgccatcgagtgcatcccagtcagcacgcataaccggcgtgaatcatagaacccctccaagagagattaagtccaacaagactgtccttcacctggctgtacaagctgccaacccaacgctcgtgcaactcctgttagagctccctaggggcgacctgcgcacgttcgttaatatgaaggcgcacggcaacactgcattgcatatggctgcggcgctgccccctggtccggcccaagaggccatcgttaggcacctgctggccgcaggtgccgatcctacactgaggaacttggaaaatgagcagcctgtccacttgcttagacccggacccggtcctgaaggactgcggcagctccttaaaaggagtagggtggctccgccaggactgtccagctag

SEQ ID NO: 19956 - DNA, 1398 bp, Artificial Sequence
  Description of Artificial Sequence: Synthetic coding sequence
atgtgggtgtgcctgcggggcatcctggacagccaggccttctggcatgaaacactcaggcgctgggagtgcctgcttgccgagatgaaagtgtctcgaggcgagcggtcgcactgtcccacacagaccgtgaaaaaactgctggaggaacagagacggaggcagcagcagcagcctgacgcaggcggcgttcagggccagttcctgccaccacccgagcaaccactgactcccagcgttaatgaagccgtgactgggcatccgcctttccccgcccactcagagacggtgggatccggaccctcatcgctgggcttccccgattgggaccccaacacacacgcggcttacaccgattcaccatactcatgcccggcctctgcagccgagaactttctccctcccgatttctaccctccatccgaccctggccagccatgccccttccctcaaggcatggaagctggcccatggcgtgtgtcagcacctccctccggccccccgcagttccccgctgtagtgcctgggccaagtcttgaagttgctagagcacacatgctggcccttggaccccagcagctgttagcccaggacgaggaaggagacactctgctgcatctgttcgcagctcgagggctgcgttgggctgcgtacgccgctgccgaggttctccaggtttaccggagactagatatccgggagcataaaggcaaaacaccactattagtagccgcggcagcaaatcagcccctgatcgtcgaggacctgctgaacctaggagccgaacctaatgctgctgaccaccaggggagatcagtgctccatgtggcagccacatacggcctgcccggagtgctactagcagtattgaattcaggggtgcaggtggacctggaggcccgggattttgaaggcctcacccctcttcacacagcaatcctggcactcaacgtcgctatgcgtccatcagacctgtgcccgagggtgctctctacgcaggccagagacagacttgattgcgttcacatgctcctgcagatgggcgcaaaccataccagtcaggagatcaaaagtaataagaccgtgcttcatctggcagtgcaggcggcgaatccaactttagtgcagttgctgctggagttacccagaggtgacctgaggacttttgtcaatatgaaggcccacggcaataccgccctgcatatggccgcagcactcccccctgggcctgcccaggaagcaatagtaaggcatctgttggcagctggcgcggacccgactctgagaaatctggaaaatgaacagccagtccacctcctgaggccaggccccggaccagaggggctccgccagctcctgaagcggtctcgtgttgccccgcctgggctctcctcctag

SEQ ID NO: 19957 - DNA, 942 bp, Artificial Sequence
  Description of Artificial Sequence: Synthetic coding sequence
atggaggccggcccctggcgggtgagcgccccccccagcggcccccctcaatttcctgccgtggttccaggaccctccttagaagtcgctcgtgcgcacatgttggctctcggccctcagcaactcctggcccaggatgaggagggcgacacactgctgcacctctttgctgccagaggactgcgctgggctgcctatgctgccgccgaggtcctgcaggtctaccgccggcttgacatccgggagcacaaaggtaaaacccccctgctcgtggctgccgccgccaaccaacctctaattgtggaagacttgctgaatctgggcgctgagcctaacgcagccgaccaccaagggagatccgttctacacgtcgcagccacttatggactaccaggcgtacttctcgcggtgttaaacagcggcgtgcaggttgatctggaagccagagattttgaaggtcttacacctctgcacaccgcgatccttgcactaaacgtggccatgagaccgagcgacctgtgtcccagggtgctgagcactcaggcaagggaccgcttggactgcgtgcacatgctcctgcagatgggtgccaatcacacgtcccaggaaattaagagcaataaaaccgtcttacacctggccgtccaggctgcaaatccaacgctcgtacaacttctgcttgagctccctaggggtgatctgagaacctttgtcaacatgaaggcacatggaaatacggcactgcacatggccgctgccctgccccccggtccagctcaagaagcaatagtgaggcacctcctggctgctggggccgatcccacactcaggaatctcgagaacgaacagcccgtccacctcctgcgccccggcccgggaccggagggtctgcgccaactcctaaagagatctcgggtggccccccccggactttcatcctag

SEQ ID NO: 19958 - DNA, 543 bp, Artificial Sequence
  Description of Artificial Sequence: Synthetic coding sequence
atgcggcccctgaccgaggaggagacccgggtgatgttcgagaagattgcaaaatacatcggcgaaaatttacaactgctggtggatcggccagatggcacatactgtttccgtttgcataacgatagggtctattatgtgtcggagaagatcatgaagttggctgcgaacatctctggcgacaaacttgtgtcgctgggaacatgtttcggtaaattcacaaaaacccataagttccgtctgcatgtcacagctctagattacctcgctccctatgcaaagtacaaggtgtggatcaagccaggagcggagcagagcttcttatatgggaatcatgtattgaaatccgggctgggccgcatcaccgaaaatacaagccagtaccagggtgtcgttgtgtattccatggccgatatccccctgggcttcggggttgccgccaagtcgactcaggactgtaggaaggtggacccaatggcaatcgtggtctttcatcaagcggacattggagaatacgtccggcatgaagagactctgacatag

SEQ ID NO: 19959 - DNA, 402 bp, Artificial Sequence
  Description of Artificial Sequence: Synthetic coding sequence
atgcggcccctgaccgaggaggagacccgggtgatgttcgagaagattgccaaatacatcggtgagaatttacaactccttgttgaccggcccgatggtacttactgcttcagactccataatgatcgggtttattatgtgagcgagaagattatgaagctggcagccaatatcagcggcgataagcttgttagcctgggaacatgttttggcaaattcacaaagactcataaattccggttacacgtgaccgccctggattacctcgctccttatgccaagggctttggcgttgcagcaaaatccactcaagactgtcgcaaggtggatcccatggccatcgtggtattccaccaggctgacataggggaatatgtgcgccacgaggaaaccctgacctag

SEQ ID NO: 19960 - DNA, 249 bp, Artificial Sequence
  Description of Artificial Sequence: Synthetic coding sequence
atggccaccttcccccccgccaccagcgccccccagcagccccccggaccggaggatgaggacagttcactagacgagtcagatttatactccctcgctcacagttacctcgggggtggagggagaaaggggagaacgaagagggaggccgccgccaacactaatcgcccctctcctggtggccatgaacgcaagctggtaacgaagctgcagaattctgaaagaaagaagcgaggggctagaagatag

SEQ ID NO: 19961 - DNA, 303 bp, Artificial Sequence
  Description of Artificial Sequence: Synthetic coding sequence
atggccaccttcccccccgccaccagcgccccccagcagccccccggccctgaggacgaagatagttcactggacgaatccgatctctactctctggcccattcctatctcggacccctgattatgcccatgcccacctcgcccttgactcctgccctcgtcaccggtggaggagggcgtaaaggaagaaccaagagggaggccgcggctaacactaatcgtccaagccccggaggccatgagagaaaattggtgacaaagcttcagaattctgaaaggaagaagcggggagcacggaggtag

SEQ ID NO: 19962 - DNA, 420 bp, Artificial Sequence
  Description of Artificial Sequence: Synthetic coding sequence
atgacccacagcctggtgtgccccgagaccgtgagccgggtgagctccgtgcttaatagaaacacccgccagttcggtaagaagcatcttttcgaccaggatgaggaaacctgttggaattcagatcaggggccctcccagtgggttaccctggagtttccacagctgatcagagtctctcagctgcagatccaatttcagggtgggttcagcagccggcgcggttgtttggagggcagccagggaactcaagcactccacaaaatcgtggacttttatcctgaggacaacaactcgctgcaaaccttcccaatccccgccgctgaagtggaccgccttaaagtaacttttgaagatgcgacagatttctttggcagagtagtgatttatcacctgcgagtattgggcgaaaaggtgtag

SEQ ID NO: 19963 - DNA, 1740 bp, Artificial Sequence
  Description of Artificial Sequence: Synthetic coding sequence
atgaacaccgcccccagccggcccagccccacccggcgggacccctatggctttggcgatagtagagactcaaggcgtgatcgcagtccaatcaggggtagccctcgacgggagccaagagacggccgcaatggccgagatgcgagagactctcgcgacattcgcgatccacgcgatctacgcgaccacagacactcccgagatctacgtgatcacagagattcgaggagcgtgcgcgacgttagagacgtgcgggacttgcgtgactttcgcgacctgcgcgattcccgggatttcagagaccaacgcgatccgatgtacgaccgatacagagatatgcgcgacagtcgggaccctatgtaccgtagggaggggagctatgatcgctatctacgaatggatgactactgtcgccgaaaggacgactcatacttcgatagatatagggatagcttcgatggtagaggaccacctggaccagagagccaaagccgtgcaaaggagagactcaagagggaagagaggcggagagaggagttatacagacaatatttcgaggagatccagaggcggtttgacgctgagcgcccagtggattgttccgtgatcgtggtgaacaagcagacaaaggactacgccgagagcgtcgggcggaaagtgcgagatctggggatggttgttgacctcatatttctgaacaccgaagtgtcactatcccaggccctggaagatgtcagtcgcggcggcagcccattcgccattgtaattactcagcagcaccaaattcaccgatcgtgcactgtgaacattatgtttgggactccacaggaacaccggaacatgccccaggccgatgctatggtccttgtggcccgcaattatgagaggtataaaaacgaatgtcgcgagaaggaacgagaagagattgcacgacaagcagccaaaatggcagacgaggctatcctccaggagagagagcggggaggacctgaggaaggagtgaggggggggcaccctcccgcgatccagagcctaataaacttactggccgataacagatatctgactgcggaagaaactgacaagataataaattatcttagggagagaaaagagcggctgatgagatctagcaccgactccctgccaggcccaatctctagacagcccctaggcgctacttcaggcgcaagcctgaaaacccaaccaagctcccagcccctgcaatctggtcaggtactaccatcagccaccccaactccctcagcaccccctaccagccagcaagagttgcaggccaagatcttaagcctgtttaattccggaaccgtgacagccaattcgtcttctgcttcccccagtgtggctgccggtaacactcccaaccagaatttttccacagccgccaacagccagccccagcagcgcagtcaggccagcgggaatcagcctccttctatattagggcaagggggctcagcacagaacatgggcccccgtcctggtgccccctcacaggggctcttcggtcagccgagtagtaggctggctccggctagtaacatgactagtcaaagacccgtgtcctcaactggcatcaatttcgacaaccccagtgtgcagaaagctctcgacacccttatccaatcaggaccagctttgtcccacctggtctcacagacaacagcacagatggggcagccccaagcaccgatgggctcctatcagcggcattattag

SEQ ID NO: 19964 - DNA, 315 bp, Artificial Sequence
  Description of Artificial Sequence: Synthetic coding sequence
atgtacgaccggtaccgggacatgcgggacagccgggaccccatgtatcgcagggagggatcatatgacagatatcttcggatggatgactactgtcgccgaaaagatgatagctattttgatcggtatagagacagtttcgacgggcgcggcccccctgggccagaatcacaatcacgggctaaggaaagactgaagagagaggaaaggaggagagaagaactctatcgccagtacttcgaagaaatccagaggagattcgatgctgagcggccagtagactgcagtgttatagttgtcaacaagcagacctag

SEQ ID NO: 19965 - DNA, 1278 bp, Artificial Sequence
  Description of Artificial Sequence: Synthetic coding sequence
atgggcagcaagatgaacctgatcgagcacagccacctgcccaccactgacgaattctcctttagcgaaaacctgtttggtgtgctcaccgagcaagtggcaggccctttagggcagaatttggaagtcgagccctactctcagtacagcaatgtgcagtttccgcaggtccagcctcaaataagctcctctagctactattccaatctgggcttctaccctcaacaacctgaagagtggtacagccctggcatctacgagctacgacggatgcctgcggaaaccctctaccagggggagactgaagtggccgagatgccagtgactaagaaaccgaggatgggtgcatctgccggtaggatcaaaggggacgagttatgtgtggtgtgcggggaccgtgcatctggttaccactacaacgctctcacctgcgagggctgcaagggactactaaccgaaattcaatgcaaaagtaaacgtctgaggaaaaatgtgaaacagcatgcagatcagactgtcaacgaggactctgagggcagagacctcagacaagtgacaagtaccacgaagtcttgccgggagaaaactgagctaaccccggaccagcagactttgctccacttcatcatggattcttataacaagcagcggatgccgcaggagattaccaataagatcctgaaggaagaattcagtgctgaggagaatttcctgatcctaacagagatggctacaaaccatgttcaggtcctggtggaatttacaaagaagctgcctggattccagaccctggaccatgaggaccagattgcactactcaaaggatccgcggtggaggccatgtttctgaggtctgccgaaatctttaataaaaaattgcccagcgggcactctgatctgctagaggaacggattcggaatagcgggatctccgacgaatacattacacctatgttctctttctataagagcattggcgaattaaaaatgacgcaggaggaatacgccctgttgactgctatcgtgatactgagcccagaccggcaatacatcaaggacagggaggccgtggaaaaactgcaagaaccactcctggacgtactgcagaaactgtgcaaaattcaccaacctgagaatccacagcattttgcgtgcctactcggccggctaactgagctgagaacatttaaccatcatcatgcagaaatgttaatgagctggcgtgttaacgaccacaaattcacacctctgctatgtgagatatgggatgtgcagtag

SEQ ID NO: 19966 - DNA, 1740 bp, Artificial Sequence
  Description of Artificial Sequence: Synthetic coding sequence
atggaggtgaacgccggcggcgtgatcgcctacatcagcagcagctcctcagcttctagtccggcctcatgccattctgagggaagcgagaattcatttcagtcttcctcatcctccgttccctctagcccaaatagctccaatagcgataccaatggaaatcccaaaaatggggatctggctaacatcgaagggattcttaaaaacgaccggatcgattgttccatgaaaacaagcaaatcctctgcacctgggatgaccaaatctcactccggggtgactaagttttccggtatggttttgctatgcaaagtgtgcggagatgtggcgagcggctttcactacggggttcatgcttgcgagggttgtaaaggatttttccgccgcagtatccaacagaatattcaatataagaagtgcctgaaaaacgaaaattgttcaatcatgcgcatgaaccggaatagatgccagcagtgtcggttcaagaagtgtctgagtgtgggaatgtctcgggacgccgtccggtttggaaggattcccaagcgggagaagcagcgcatgctgatcgagatgcaatctgcgatgaagactatgatgaacagccagttctcaggccatctccagaatgatactctggtagaacatcacgagcagacagcccttcccgcccaggagcaactaaggccaaagcctcaactggaacaggaaaacatcaaatcatcttcaccccctagttctgattttgcgaaagaagaagtgatcggcatggtcactcgagcacacaaagacacgtttatgtataaccaggagcagcaagagaattcagctgaaagcatgcaacctcagcggggcgaaaggatcccaaagaatatggaacagtacaacctgaaccacgaccattgtggaaatggcctcagctcccattttccttgctctgaaagccaacagcacttgaacggccagttcaaaggtcgcaatataatgcactatcctaatgggcacgctatctgtatagctaatggtcattgcatgaatttctccaatgcctacacccagcgcgtgtgtgaccgagtaccaattgatggcttcagccagaacgagaataagaatagctatctgtgtaatacaggcggccgcatgcatctcgtctgtccgctaagtaaaagcccatacgtcgatcctcacaagagtggtcatgaaatctgggaagaattcagcatgtcattcactcccgcagttaaggaagtggtagaattcgcaaaaaggattcccggctttagggacttgtcgcagcatgatcaggtgaatctgctgaaggctggcacatttgaggtgctgatggtcaggtttgcaagcctattcgacgcaaaagagcggacagtcacctttctgtcgggtaagaaatattccgtggatgatcttcattcaatgggcgccggagacctgctgaattccatgtttgaattctcagaaaagctgaacgcactccagttgtctgacgaagagatgagccttttcacagctgtggttttagtgagcgccgatagatccggcatcgagaacgtcaatagcgttgaggccttgcaggaaaccttgattagggctcttcgaaccctgattatgaagaaccatcccaacgaggcctccatattcactaagttgctgctcaaattgccagatctgagaagcctgaacaatatgcacagcgaggagttgttagctttcaaggtgcacccatag

SEQ ID NO: 19967 - DNA, 1227 bp, Artificial Sequence
  Description of Artificial Sequence: Synthetic coding sequence
atggaggtgaacgccggcggcgtgatcgcctacatcagcagcagctcgagcgcttccagtccagccagttgccattccgaaggtagtgaaaattccttccagtctagcagctcgagtgttccctctagcccaaacagttctaactccgataccaatggaaaccctaagaacggagatttggcgaacattgagggtattctgaaaaatgaccgaatcgactgtagcatgaaaaccagtaagagcagcgcccctggtatgactaaaagccattctggggtgaccaagtttagcggaatggtcctgctttgcaaagtgtgtggcgatgtcgcaagcggcttccactacggtgtccacgcctgtgaagggtgtaaaggcttcttccgcagatcgatacagcagaatatacagtataaaaaatgcctgaagaatgaaaattgctctattatgcggatgaacaggaatcgctgtcagcaatgtagattcaagaagtgcctgtccgtcggtatgtcgcgggacgccgtcaggttcggcaggattccaaagcgggagaaacagaggatgctgatagaaatgcagtctgctatgaagaccatgatgaactcccagttctcaggacatctccagaatgatacactcgtcgaacaccacgagcagaccgcactacccgctcaagagcagctccgcccaaaacctcagctcgaacaagagaatataaagtcatcctcaccacccagtagtgacttcgccaaagaggaagtcatcgggatggttacgagggctcacaaagatacattcatgtacaaccaggaacaacaggaaaacagtgctgaatccatgcagccacaaagaggcgaacggatcccaaaaaatatggaacagtataacctcaaccatgaccattgcgggaatggcctgtcctcacactttccgtgctcagagagtcaacagcacctgaatgggcagttcaaggggcggaatatcatgcattacccgaatggccacgcaatatgcattgcaaacgggcattgtatgaacttctcaaatgcttacacacagcgggtctgtgatcgcgtgccgattgacggcttctcccagaacgagaacaaaaattcctacctctgcaacactgggggtcgtatgcatctctactccgttcacatccagcccaaattccatcagaagcagcagtaccacacgatttccagcctcaatcatgaggttctctag

SEQ ID NO: 19968 - DNA, 1740 bp, Artificial Sequence
  Description of Artificial Sequence: Synthetic coding sequence
atggaggtgaacgccggcggcgtgatcgcctacatcagcagcagcagctccgcatcaagtcctgcttcctgtcactccgagggttctgaaaactcattccagtcatccagcagttcggtacctagtagcccgaactctagcaactccgacaccaatggaaaccctaagaatggagaccttgctaatattgaaggcatcttaaaaaacgataggatcgactgcagcatgaagacctcgaaatcgtccgcgcctggtatgacaaaatctcactctggggtaaccaaattttcagggatggtcttgctgtgtaaagtgtgtggcgacgtggccagcgggtttcactatggagtgcatgcttgcgaaggatgcaaaggtttcttcagaaggtcaattcagcagaatatacaatacaagaaatgtcttaaaaatgaaaactgtagtatcatgagaatgaacagaaaccggtgccagcagtgtcgcttcaagaagtgtcttagtgtcggcatgagtcgagacgcggtccgattcggaagaattcccaaacgcgaaaaacaacgcatgctgattgagatgcagagcgcgatgaagacaatgatgaattcacaattttccgggcatctgcagaacgacaccctagtggagcaccatgagcaaacggcccttccagcccaggagcagcttcgacctaagcctcaactggagcaagagaatattaaatcctctagtcccccctctagcgatttcgccaaggaagaggtgattgggatggtgacccgcgcgcacaaggacacattcatgtataaccaggagcagcaagagaattcagccgagagtatgcagcctcagcgaggagaacggatccccaagaacatggaacaatataatctcaatcatgaccactgcgggaatggacttagttcacacttcccctgctctgaatcgcagcagcatttaaacggccagtttaaaggccgcaacattatgcactaccccaacggtcatgctatctgcatcgccaatgggcattgcatgaacttctcaaatgcctacacccagcgcgtgtgtgatcgcgtgcctattgacggattttcccaaaatgaaaacaagaacagttacctgtgtaacaccggggggcgaatgcacctggtgtgtcccttgtccaagtccccctacgtggaccctcataagtcaggacatgagatctgggaggagttttctatgtccttcaccccggcagtcaaggaagttgtcgagtttgccaaacgcatccccggcttccgggatctgtcacagcatgatcaggtgaaccttctcaaagctggaaccttcgaggtcctgatggttcgttttgccagcctgtttgacgccaaagaaagaaccgtcacatttctgtcagggaaaaagtattcagtggacgatttgcattcaatgggtgctggtgatctcctaaactcaatgtttgaattctcggagaagcttaatgccctgcagctcagcgacgaagaaatgtctctgtttactgcagttgtactggtcagcgccgacaggtctgggattgagaacgtgaactcggttgaggccctccaagagactctaataagggcactgagaactctaatcatgaagaatcaccccaatgaggccagtatctttactaaactgcttctgaagttgcctgaccttagatcgctgaacaatatgcatagcgaggagctgctcgcctttaaggtgcacccgtag

SEQ ID NO: 19969 - DNA, 1449 bp, Artificial Sequence
  Description of Artificial Sequence: Synthetic coding sequence
atggtgatgcagttccagggcctggagaaccccatccagatcagcccacattgttcatgtacaccatctggattcttcatggagatgatgtctatgaagccagccaagggggtcctaacagaacaggttgcggggcccctgggccagaatctggaggttgaaccttactcccaatattcgaacgtgcagtttccccaggtgcaaccacagatctccagctccagttattacagcaacctcggtttttaccctcagcaaccagaggagtggtattcgcctggaatttatgaattacggagaatgccggcagagacgctataccagggagaaactgaggtggccgagatgcctgtcaccaaaaagccacgcatgggcgcaagcgcgggtcgaataaagggagacgagctgtgtgtggtatgtggagatcgagcctctggctatcactacaatgcgctgacatgtgaaggctgtaaagggttctttagaagaagcattacgaagaacgctgtatataaatgtaagaacggcggcaactgcgtaatggacatgtacatgcggagaaaatgccaagagtgccgactgagaaagtgtaaagagatggggatgctggcagaatgcctacttactgaaatccagtgcaagagtaagaggttgaggaagaacgtgaaacagcacgccgaccaaaccgtgaacgaggatagcgagggacgagatctacggcaggttacgtctacaaccaaaagctgtcgtgagaagaccgaactgactcctgaccagcagacattactgcattttatcatggattcctataacaaacagagaatgccacaggaaataacaaacaagatcttgaaggaggagttttcagcagaagaaaattttctgattctgactgaaatggccacaaaccacgtgcaggtgctagtcgagtttacgaagaaactccctggctttcagaccctggatcatgaggatcagatagcacttcttaaaggatctgcagtggaggccatgtttcttaggagcgcagagatattcaacaaaaagcttcccagcgggcactcggatctcctggaggagcgcataagaaattccgggatcagcgatgaatatatcacccccatgttttcattctacaagagcattggcgagctgaaaatgacccaggaggagtatgctctgctgacggccattgttatcctctctcccgacagacagtacattaaggacagggaggcagtggaaaaactccaggaacctctgctcgacgtgttgcagaaactgtgtaaaattcaccagcctgaaaatcctcaacatttcgcttgcttgctggggcgtctgacagaactgcgaaccttcaaccaccatcacgccgaaatgcttatgtcgtggagagtcaatgatcacaagttcacccccttattgtgcgagatttgggacgttcagtag

SEQ ID NO: 19970 - DNA, 1431 bp, Artificial Sequence
  Description of Artificial Sequence: Synthetic coding sequence
atgggcagcaagatgaacctgatcgagcacagccacctgcccaccaccgacgagtttagtttttctgagaacctattcggcgtgcttaccgagcaggtggccgggcccctcggacagaacctggaggtcgagccatactctcagtatagtaatgtgcaatttccacaagtgcaaccccaaatcagctctagctcttattactcgaatttgggattttaccctcagcagccggaggaatggtacagtcccgggatctacgagctacgacgtatgcccgccgagacgctgtatcagggtgaaactgaggttgctgaaatgcccgtcaccaaaaagcctaggatgggggcctctgctggccggataaagggggatgagttgtgcgtggtttgtggtgaccgggcctcaggctatcactacaacgccctgacatgcgaggggtgcaagggcttttttcggcgatcaattactaaaaatgccgtctataagtgtaagaacggcggaaattgcgtcatggacatgtacatgagaaggaaatgtcaggagtgccgtttgcggaagtgtaaagagatggggatgctggccgagtgcatgtacacgggcctgcttacggagatacagtgcaaatcgaaaaggctgaggaaaaatgtgaagcagcacgccgatcagacggtgaacgaagactctgaaggacgtgacctgcgtcaggtgaccagtacaacgaaatcttgcagggagaagacggagctgacccccgaccagcagacgcttttgcatttcataatggacagttataataaacagcgtatgccgcaagaaatcactaataagatccttaaggaagaattctcagccgaagagaactttctcatccttacagaaatggccacgaatcatgtgcaggtgttagtcgaattcaccaaaaagttgccagggtttcagactcttgaccacgaagaccaaatcgctctgctcaagggatctgccgtcgaagcaatgtttcttagatcagcagaaattttcaacaagaaattgccaagtgggcatagcgatctcctggaagaacgaataagaaactctgggatttccgacgaatacatcacaccgatgttcagcttctacaaatccattggggagcttaagatgacacaggaagagtacgctttactgacagcaatcgtcatcctttcccccgaccgccagtatattaaggatagggaggccgtcgagaagctgcaggaaccgttgttagatgtcttacaaaagttatgcaaaatccaccaaccagagaatccacagcactttgcctgcctgctcggccggttgaccgaactgcggacatttaaccaccaccacgcggagatgctcatgagttggcgcgtcaatgatcacaaatttactccactgctgtgtgagatctgggacgttcagtag

SEQ ID NO: 19971 - DNA, 1419 bp, Artificial Sequence
  Description of Artificial Sequence: Synthetic coding sequence
atgggcagcaagatgaacctgatcgagcacagccacctgcccaccaccgacgagttcagtttctccgaaaacttgttcggggtgctgaccgaacaggtagccggccctctgggccaaaatctggaggtggagccttattcccaatattctaatgtacagttcccacaggtgcagccacaaatatcctccagtagctactacagtaacctcggattttatccccaacaacctgaagaatggtactcccctgggatctacgaactccgaaggatgcccgcggaaactctgtaccagggcgagacagaggtagctgaaatgccagttacgaaaaagcctcgtatgggggcatccgccggcaggataaaaggcgacgaattgtgtgtcgtctgtggcgaccgggcctccggctaccactataacgccctcacatgcgaaggatgcaaaggattctttagaagatctatcacaaaaaatgccgtgtacaagtgcaagaatggagggaactgcgtgatggatatgtatatgcggcgcaaatgccaggagtgtaggttgagaaaatgtaaggagatgggtatgcttgccgagtgtctccttacggaaatccagtgtaagtcaaagcggttgcgtaagaacgtcaagcaacatgcagatcagacagtgaacgaggactccgaagggagagatttgcgtcaggtaaccagtaccactaagagttgtcgggagaagactgagctgacgcctgatcagcagaccctgctgcattttatcatggattcttataacaaacaacggatgccgcaagagatcaccaataaaattctcaaggaggagttctcagccgaagagaatttcctgatcctgacggaaatggctaccaaccatgtccaagtcctcgtcgaattcactaagaagctacctggtttccaaacgttagaccatgaggatcaaattgcccttctgaagggatccgccgtcgaagctatgttcttaaggtcagccgaaatcttcaacaagaagctaccttctggacactcggaccttctcgaagagcggattaggaattctgggattagtgatgaatacatcacccccatgttctccttctacaagagtattggggaattaaagatgacacaggaagaatatgctcttttgactgcaattgttatcttaagccctgacaggcagtacattaaagaccgggaagccgtcgaaaaactccaggagccactgctggacgttctgcaaaaactctgcaagattcatcagccagaaaacccacagcactttgcatgcctgctgggacgattaaccgaactcaggactttcaaccaccaccatgcagaaatgctgatgtcctggcgagtgaatgatcataagttcaccccactgctctgtgagatttgggatgtgcagtag

SEQ ID NO: 19972 - DNA, 1461 bp, Artificial Sequence
  Description of Artificial Sequence: Synthetic coding sequence
atggtgatgcagttccagggcctggagaaccccatccagatcagccctcattgttcatgtaccccgtccggcttcttcatggagatgatgtccatgaagcccgccaaaggcgtgctcacagagcaggtcgcaggacccctcggccagaatctggaggtggaaccttatagccagtattctaatgtacagtttcctcaggtccagccccagatttcaagcagttcctactactcaaatctcggtttttatccacagcaaccagaagaatggtattctcccggtatctatgaactgagacgcatgcccgccgagacactgtaccaaggagagaccgaggtagcagaaatgcctgtgaccaaaaaacccaggatgggagcgagcgctggccgtataaagggggacgaactgtgcgtggtatgcggggaccgggcttccggataccactacaatgcactgacttgcgagggatgtaagggttttttcagacgaagcatcaccaaaaatgccgtctacaagtgtaagaacggaggcaattgtgtcatggatatgtatatgaggcgcaagtgtcaggagtgtcgcctcaggaagtgtaaggaaatggggatgctcgcggagtgtatgtatactggcttgttgactgaaattcagtgtaaatccaagcgcctaaggaagaacgtgaagcagcatgccgatcagactgttaacgaggattcagaaggcagagatctgagacaggtgacgtcaactacaaaatcctgcagagaaaagactgaattgactccagatcagcagactttacttcacttcattatggattcatacaacaaacagcgcatgcctcaggagattacaaacaaaatcctcaaggaggagttctctgccgaggaaaacttcttgatcctcacagagatggcaaccaaccacgtgcaggttctggtcgaatttaccaagaagctgcctggtttccagactctggatcacgaagatcagatcgcgctgttgaagggatcggcggtggaggcaatgttcctgcgctcagccgaaatttttaacaaaaagttgccatcagggcattcggacttactggaggaacgcatcagaaattccggtatttctgatgaatacatcacacccatgttctcattttacaaatccatcggggaacttaagatgacacaagaggagtatgccttactgactgcaattgtgatactaagcccggatcggcaatatattaaggatcgagaggccgtggagaagctgcaggagcccctcctggacgtcctccagaagctttgcaagatccatcaacccgagaatcctcagcacttcgcctgtctcctggggcgcctaaccgagctccgcacatttaatcaccatcacgccgagatgcttatgagttggcgagtcaacgaccacaagtttacaccactcctgtgtgagatttgggacgtgcagtag

SEQ ID NO: 19973 - DNA, 1074 bp, Artificial Sequence
  Description of Artificial Sequence: Synthetic coding sequence
atggccagccgggaggacgagctgcggaactgcgtggtgtgcggcgaccaggccaccggctaccattttaatgccctcacttgtgaggggtgcaagggtttctttagacggacggtgagcaagtctatcggccccacatgccctttcgccggcagttgtgaggtgtcaaagacacaaagacggcactgcccagcatgccgactccagaaatgcctcgacgccggtatgaggaaggacatgatcctgagcgccgaggccctcgcccttagaagagctaaacaggcacaacgccgcgcacagcagacacccgttcaactaagcaaagagcaggaagagttaatccgaaccctccttggagctcacacccggcacatgggcactatgttcgaacagttcgtgcaatttagaccaccggcacaccttttcatccatcaccagcctctgccgacactggcaccagtgctccctctggttacccactttgccgacattaatacgttcatggtgctccaggtgatcaagtttacaaaggatctgccagtgtttagatcactccctatcgaggaccagatcagtctattgaaaggcgccgcagtcgagatctgccatatcgttctcaacaccacattctgtttgcaaacgcagaattttctatgcggccctctgcggtatacgatcgaagatggtgctcgggtttcaccgacagtcggcttccaagtcgaattcctggagctgttatttcacttccatggaactctgaggaagctccagctgcaggaacccgagtacgtcctgctggccgccatggcacttttcagcccagcgccatacctcacggatagaccgggggtaactcagcgggacgaaatagaccagcttcaggaagagatggccttaactctgcagtcctatatcaaaggacaacaacggaggcctcgggaccgcttcctgtatgctaagcttctggggctccttgctgagcttagatcaattaatgaggcttatggctaccaaatccaacacattcaggggctcagcgccatgatgccgctgctgcaggaaatttgctcatag

SEQ ID NO: 19974 - DNA, 1074 bp, Artificial Sequence
  Description of Artificial Sequence: Synthetic coding sequence
atggccagccgggaggacgagctgcggaactgcgtggtgtgcggcgaccaggccaccggctatcattttaatgcgctcacgtgcgaaggatgtaagggtttttttcggcgaaccgtctccaaaagcattggcccaacatgtccattcgcaggcagttgtgaggtctccaagactcaacggaggcactgccctgcttgtcggctgcagaagtgtttagatgctggtatgaggaaagatatgatccttagcgcagaggctctggctctgcgtcgagctaaacaagcccagcgcagagcgcagcagaccccggtccagctaagcaaggaacaggaggagcttatccgtacgctgctcggcgctcatacacggcacatggggacgatgtttgaacagttcgtgcagtttagacccccagcccatctgtttattcaccatcagcccttgccaactctcgccccagtgctcccgctggtgacccatttcgccgacattaacacattcatggtgctgcaggtgataaagttcactaaagatctgccggtgttccgttccctccctattgaagaccaaattagcctgttgaaaggcgctgccgtggaaatctgccacattgtccttaacacaacattttgcctgcaaacccagaactttctctgtggtccgctgcggtataccattgaggacggagcccgggtcagccccacagtcggtttccaggtggagtttctcgaactgctgtttcatttccacggcactcttagaaaactgcagctgcaggagcccgagtacgtgctgctggccgccatggccttgttttctccggctccttatctgaccgatcgacccggagtcactcagcgcgatgaaattgatcaactccaggaagaaatggccctcactttacagagctatattaaggggcagcagcgccgtccaagagatagatttctttatgccaaactgcttggactcctagccgaactcagatccataaacgaagcttacggctatcagatccagcacatacagggcctctctgctatgatgccccttctgcaggaaatctgtagttag

SEQ ID NO: 19975 - DNA, 975 bp, Artificial Sequence
  Description of Artificial Sequence: Synthetic coding sequence
atgctgcccaagcggagccggcggaccgtgagcaagagcatcggcccgacctgtccctttgctggctcttgtgaagtgtccaagacccagaggcgccactgtcccgcatgccggttgcagaaatgcctggacgccgggatgcgcaaagacatgattctaagcgctgaggcattggccctccgccgcgctaagcaggctcagagaagggcccagcagacccccgtgcagctgtcaaaggaacaggaggaacttattagaacacttttgggcgcccatacaagacacatgggcactatgttcgaacagttcgttcagttccgccctccagcgcatctgtttattcatcatcagccgctgcctacccttgccccagtgctgccgttggttactcatttcgcagacataaacaccttcatggtcctacaagtgattaaattcacaaaagaccttcctgtttttcggtcgctcccgattgaggaccaaataagcctgttaaagggtgccgcggtggaaatctgccacattgttttgaacacaaccttttgtctccagacacagaatttcttgtgtggtccgctacgctatactattgaagacggcgcgagagtgggttttcaggtggagttcttagaattgctgttccattttcacgggacactccgcaagctgcaactgcaagagccggagtatgtgctcctggcagccatggctttgtttagtccggctccatacttgaccgatcggccaggggtgacccaaagagatgagatcgaccagctgcaggaagaaatggccctaactctccagtcatacatcaaggggcaacagcgacgtcctagagatcgttttttgtacgccaaactgctgggactgcttgctgaactcagatctataaatgaggcttatggttatcaaattcagcatattcaaggattatcggctatgatgcccctcctccaggaaatatgtagctag

SEQ ID NO: 19976 - DNA, 1059 bp, Artificial Sequence
  Description of Artificial Sequence: Synthetic coding sequence
atggccagccgggaggacgagctgcggaactgcgtggtgtgcggcgaccaggccactgggtatcactttaatgcattaacctgtgaaggctgtaagggcttctttcggcgcacagtttcgaaaagtatcggccccacatgcccatttgctggctcctgcgaggtgtctaaaacacagaggagacattgtccggcttgccgtcttcaaaagtgtctcgatgcgggaatgagaaaggatatgatcttatcagcagaggctcttgctctgcgccgggctaagcaggcccagcgcagagctcagcaaacaccagtgcagctctcaaaggaacaagaagaactcattcggaccttgttgggggcacacaccagacacatgggcactatgtttgagcaatttgtgcagtttaggccgcccgcccatctgttcatacaccatcagcctttgcctactctggcccctgtcttgcctcttgtcactcatttcgcagatatcaataccttcatggtgcttcaggtgattaaattcacaaaggacctcccggtgttccgcagcctcccaatcgaagatcaaatctcgctcctcaaaggagccgctgtggaaatctgccacatcgtgttgaatacaacattctgtctgcagacacagaacttcctctgtggacctctccgttatactatagaagatggagctcgcgtgagcccgactgttggatttcaggtggagttcctcgagctactttttcattttcacgggaccctgagaaagttacagcttcaggagccggaatacgtcctactggcagccatggctctgttctcaccagacagacctggggtcacccagcgtgatgagatcgaccaattgcaggaggagatggccctgactctgcaatcctacattaagggtcagcaaaggagaccacgagaccgctttctgtacgctaagctcctcggcttactagcagagttaaggagcataaacgaggcgtatgggtaccagattcaacatatccaaggcctgtccgcaatgatgccactcctgcaggaaatatgttcctag

SEQ ID NO: 19977 - DNA, 1047 bp, Artificial Sequence
  Description of Artificial Sequence: Synthetic coding sequence
atggccagccgggaggacgagctgcggaactgcgtggtgtgcggcgaccaggcaactgggtaccacttcaatgcactcacttgtgaggggtgcaagggcttctttaggcgaacagtgtcaaagtcgatcgggcccacatgcccgttcgcaggatcatgtgaggtgagcaaaacccagaggagacattgtcccgcctgtcggctgcagaagtgccttgacgccggtatgcggaaggatatgatactctcagccgaggccctggcgcttcggagagcgaaacaggctcagcggagggctcagcagaccccagtacaactctctaaagagcaggaggagctgatccgcaccctcctgggtgcacatacccgacacatgggtactatgtttgagcagtttgtgcaattcagaccgcccgcgcatctgtttatacatcaccagccgctccccacccttgcgcctgtgctccccttggtgacccatttcgcagacatcaatacatttatggtgctacaggtgattaagtttactaaagatctccctgtgtttaggtcactccccatcgaggatcagatcagtctgctgaagggcgccgctgtggagatatgccacattgtcttgaacaccacattctgtttgcagacacagaattttctgtgtggcccactgagatataccatcgaagatggcgcccgcgtgggatttcaggtcgagttcctcgaattgctattccattttcatggtaccctccggaagctccaactccaggaacctgagtacgtcctgctcgccgccatggctctgttctccccagatcggcccggcgtcacccagagggacgaaatcgaccaattgcaggaagagatggctctgacactccagtcttacattaagggccagcagagaaggcccagagatcgatttttatacgccaagctgctcggcctcctcgccgaactcagatcaataaacgaagcttacggatatcaaatacagcacatccagggactgagtgctatgatgccactgcttcaggagatttgctcttag

SEQ ID NO: 19978 - DNA, 930 bp, Artificial Sequence
  Description of Artificial Sequence: Synthetic coding sequence
atggccagccgggaggacgagctgcggaactgcgtggtgtgcggcgaccaggctactggatatcattttaatgccctcacatgtgaaggctgtaagggatttttccggcgaactgtctcgaaaagcattggccctacgtgcccatttgccggttcatgcgaggtgtccaaaacacaaagaagacactgtcccgcctgcaggctgcagaagtgtctggacgcggggatgcggaaagatatgattctctctgcagaagctctcgctctgcgcagagccaagcaggcacagcgaagagcccagcagacgccagtgcagctgtctaaggagcaggaggagctcataaggactcttctgggtgctcatacaagacatatgggaacaatgtttgagcagtttgtacagtttcgcccgcccgctcacctattcatccaccaccagccgctgcctacgttggccccagttctcccattggtgacacattttgccgacattaacacatttatggtgctgcaagtcattaagttcaccaaggacctgcccgtgttccgttcacttcccatcgaagatcagatctcactcctcaaaggcgcagcggtcgagatttgccatattgtcctcaacactactttctgcctgcagactcagaattttctgtgtgggccactgaggtatactatcgaggatggtgctagagatcgcccgggagtgacccaaagagatgagatcgatcagctccaggaggagatggcactcaccctccagtcttacattaaaggccagcagcgaaggcctcgcgataggtttctgtatgccaaattacttggcctactggccgaacttaggtctatcaatgaggcctatggttaccagatccagcacatccaaggcttgagtgcgatgatgcccctgctacaggaaatctgtagttag

SEQ ID NO: 19979 - DNA, 945 bp, Artificial Sequence
  Description of Artificial Sequence: Synthetic coding sequence
atggccagccgggaggacgagctgcggaactgcgtggtgtgcggcgatcaggctaccggatatcactttaacgccctgacctgtgaaggctgcaaggggtttttcaggcgaacggtgtccaagtcaatagggcccacctgccccttcgcaggttcgtgcgaggtatcaaagacccagcggcgacactgcccagcctgtaggctacagaagtgcctggacgcaggaatgagaaaggacatgatactgtccgcagaggcgttggcccttaggagggctaagcaagcccagcggcgagctcagcagactcccgtgcagctcagcaaagaacaggaggagctaattaggactctgctcggtgcacatactcgtcatatgggaactatgttcgagcaatttgttcagtttcggccgcctgcccacctgtttattcaccaccagccgcttcctaccctggctcccgtgctccctctagtgactcatttcgcagatattaatacctttatggtactgcaggttattaaattcacaaaggacctaccagtgtttcggagcctgccaattgaggaccagatcagcctcctgaaaggagccgcggtagagatttgtcacatcgtactcaacacaactttctgcctgcagactcagaatttcctctgtggaccattgcggtacacaatcgaagatggagcccgcgctccatacctgacagacaggcccggcgtcactcaacgggatgagatcgatcagctgcaggaagagatggcactcactctgcagtcctacatcaagggtcagcaaaggagaccccgcgatcggtttttatatgccaagttactgggcctgttagcagaactaagaagtattaatgaagcttatggctaccaaatccagcacatccagggactgagcgcaatgatgccgctgctgcaagagatatgcagttag

SEQ ID NO: 19980 - DNA, 948 bp, Artificial Sequence
  Description of Artificial Sequence: Synthetic coding sequence
atgctgcccaagcggagccggcggaccgtgagcaagagcatcggccccacatgccctttcgccggaagttgtgaagtgtccaaaacacagagaagacattgtcccgcctgccggctacagaagtgtctcgatgccggaatgcggaaagatatgattctgagtgctgaggctctggccctgcgcagagctaaacaggcccagagacgggcacaacagacacccgtccagctgtctaaagagcaggaggagctcattcggaccctgctcggtgcccatactcggcatatggggactatgttcgagcagtttgtgcaattcaggccgccagcgcacttgttcattcaccaccagcctctgcccacactggcaccggttctgccgcttgtgacccactttgctgatataaatacgttcatggtactgcaagtaattaaatttacgaaggatctccctgtgtttcgttctctccctatcgaagaccagatcagtctgttaaagggggccgccgtggaaatctgccatattgtactcaatacaacattttgccttcaaactcagaattttctgtgtggcccactacgatacaccatagaagacggcgcacgcgtgtcgcctactgtggggtttcaggttgagtttttggaactgctcttccacttccatggcaccttgagaaaactccaattacaggaacctgaatatgttctcctggcagctatggcactcttctctccggcaccctacttgactgaccgcccaggggtgacccagagggacgagatcgatcagctacaagaggaaatggctttaacccttcagtcatatatcaagggccagcagcggcgcccgcgggataggtcacccggcacaccctggatacactggtccggaaaaatgctggggcctaaaataggacctggcagcaaaggcgcacagtggctccagtag

SEQ ID NO: 19981 - DNA, 1023 bp, Artificial Sequence
  Description of Artificial Sequence: Synthetic coding sequence
atggccagccgggaggacgagctgcggaactgcgtggtgtgcggcgatcaggccaccggataccatttcaatgctcttacatgcgaaggctgtaaaggcttctttagaaggaccgtctctaaaagtattggccctacctgcccattcgccggatcctgcgaggtgtcaaagacacagagacgccattgtcctgcttgccggctccaaaagtgtcttgacgctgggatgaggaaggacatgattctctccgccgaagctcttgccctacggagagctaagcaagcccaacggcgagcccaacagacccctgttcaactcagcaaagagcaggaagaactgattcgcacacttttgggtgcccacaccagacatatgggcactatgtttgaacagtttgtgcaatttaggccaccagctcatctgtttatccaccaccagcctttgccaacccttgcacctgtcctacctctggtgacacatttcgctgacataaataccttcatggtgctgcaggtgatcaaatttacaaaggacctgcctgtgtttaggagtttgccgatagaggatcaaatctctttactgaaaggagcagcggtggagatctgtcacattgtgttgaacactacattttgcctgcagacacagaattttttatgtgggccactgcgttatactatcgaagacggagccagagtgggatttcaggtcgaatttctggaacttctgttccattttcacggtacgctgcgaaagctgcagttacaagagcctgaatacgtgctcctggccgccatggcattgttcagcccagctccatacctaacagatcgacctggggttacccagcgagacgaaattgatcaacttcaagaagagatggcgctcacactccagagctatattaagggacaacagcggcggcctagggacagatcccctggtactccgtggattcactggagtggtaaaatgctgggcccaaaaattgggccaggctctaaaggggcccagtggctgcagtag

SEQ ID NO: 19982 - DNA, 921 bp, Artificial Sequence
  Description of Artificial Sequence: Synthetic coding sequence
atgctgcccaagcggagccggcggaccgtgagcaagagcatcggccccacatgtcctttcgctggctcatgtgaagtgagcaagactcaacggaggcattgcccagcttgtcgcctgcaaaaatgcctggatgcagggatgcggaaagatatgatcctttcagctgaagcgcttgccctcagacgggctaaacaagcccaacgacgcgcacagcaaacgccggtgcagctgtccaaagaacaggaggaacttattcggactctcctgggggcccatacgcgccacatgggtaccatgtttgagcaattcgtgcagtttcgtccacctgcacaccttttcatccatcatcagcccctgcccaccttggcccccgtactgccattagtcacacattttgctgatatcaataccttcatggtgttgcaggtgattaaattcactaaggacctgccggtctttcggtctctgcccatcgaggatcaaataagcctgttgaagggcgcagctgtggaaatttgtcatattgtgctgaacacgaccttctgtctgcagacgcaaaatttcctgtgtggcccacttcgttacaccattgaggacggggccagggttggtttccaagtcgagtttcttgagctgctgttccacttccacggaacattgcgaaaactgcagctccaggagccagagtacgttctactggctgccatggccctcttctcccctgatcgcccaggtgtgacccagcgcgacgaaatcgatcaactccaggaagaaatggcactgacattgcagagctatataaaaggtcagcagagacgcccccgtgacagatccccaggaaccccctggattcactggagcggaaaaatgttgggacctaagattggcccagggtccaaaggggctcagtggctgcagtag

SEQ ID NO: 19983 - DNA, 1020 bp, Artificial Sequence
  Description of Artificial Sequence: Synthetic coding sequence
atggccagccgggaggacgagctgcggaactgcgtggtgtgcggcgaccaggctaccggctaccatttcaatgcacttacttgtgaggggtgtaagggcttctttagaagaacggtctcaaagagcattgggccaacctgtcccttcgccgggtcttgcgaggtgtccaagacccagaggcggcactgtccagcatgtcggctacagaaatgtctcgacgctggcatgaggaaagatatgatcctaagtgccgaggctctggcccttagaagagctaaacaagcacaaagacgggcacaacaaacccccgtgcagctttcgaaagaacaggaggagctaattagaactcttctgggcgcccacacaaggcatatgggtactatgtttgagcaatttgtgcagtttagaccacccgctcatcttttcatccaccatcagcccttgcccacgctggcgccggtgctgccgcttgtaacgcacttcgccgacattaacacttttatggttctacaggttatcaagttcaccaaggacctgcccgtgttcagaagccttccgatcgaggatcagatctctctgctcaagggtgctgccgtcgagatctgtcacatcgtgttaaacaccacattctgcctgcagactcagaattttctctgcggacccctgcggtacaccatcgaagacggagccagagtgagtccaactgtggggtttcaggtggaatttttagaacttcttttccacttccatggaaccctgaggaaactgcagctgcaggaacctgaatatgtgctgctcgctgcaatggccctgttctcgccagacagacctggggtgacacagagagacgaaattgaccagctccaggaagagatggccctgacattgcagagctacatcaagggccagcagaggaggcctagggacaggagcccagggacgccctggattcactggagcggaaaaatgctgggacctaaaattggtcccggatcgaagggcgctcagtggcttcagtag

SEQ ID NO: 19984 - DNA, 360 bp, Artificial Sequence
  Description of Artificial Sequence: Synthetic coding sequence
atggccagccgggaggacgagctgcggaactgcgtggtgtgcggcgaccaggcgactggttaccacttcaacgctttaacctgtgaagggtgtaaaggcttctttagacggaccgtgtccaagagcataggacctacatgccctttcgccgggagctgcgaagtctcaaaaactcaaagacggcattgtccggcttgtcgcctgcaaaagtgtctggatgcgggaatgcggaaggatacaagctcttcctctgtgcatcctagtcccgccctggctcatcccggcccttgcgccgcttcagggcataccctgaggaggcaccagcatttccatggtaccgcatctcatcaggtttactag

SEQ ID NO: 19985 - DNA, 444 bp, Artificial Sequence
  Description of Artificial Sequence: Synthetic coding sequence
atggccagccgggaggacgagctgcggaactgcgtggtgtgcggcgatcaggccactggatatcactttaatgctcttacctgtgaaggttgcaaaggattcttcaggagaacagtgagcaaatccattggccctacatgcccttttgcaggctcatgcgaggtgtcaaagacacaaaggcgccattgcccagcttgccgactgcagaagtgcctcgatgcaggcatgcgaaaggatattccatgccccttgaaaacaaggtcccctttcagtcgggagcagctgtggaagtcagtgacctcctatagcatccctctaagcgttagcaagcacaaaacctcatcagcaggtcttttcgccacacagctaaaaatggagccagttacagatcttgagcttcccagggagatgcgtctgatttcgtgcaaaagacgctggcactag

SEQ ID NO: 19986 - DNA, 843 bp, Artificial Sequence
  Description of Artificial Sequence: Synthetic coding sequence
atgctgcccaagcggagccggcggaccgtgagcaagagcatcggccccacatgcccctttgcaggttcctgcgaggtcagtaaaacacagcggcgtcattgtcccgcctgtcggctccagaaatgcctggatgctggcatgagaaaagacatgatactgtctgccgaggcgctggctctgcggagggctaagcaggcccagcgccgggctcagcagacgccagtccagctgtccaaagagcaagaggagcttatccgtaccctgctgggagcccacactcggcacatggggacgatgttcgaacagttcgtccaatttcggcctcccgctcatctgttcatccatcatcagccattgcctacacttgctccagtgctgccgttggtcacccatttcgcagatataaataccttcatggtattgcaggttataaagtttacaaaggatcttccagtattccgatccctgccaatcgaggaccagatctctctcctgaaaggcgctgccgtggagatatgtcacattgttctcaatacaacgttctgcctccagacgcagaacttcctgtgcggacctctgcgttatacgattgaggacggtgctagagacagacccggtgttacccaacgcgatgaaattgatcagctgcaagaagaaatggccctcacccttcaaagttatattaaaggacagcagcgccgtccccgcgaccgctttttgtacgcaaaactcctgggattacttgcagagcttcgcagcatcaatgaggcctacggataccaaattcagcatatccaggggctgtccgcaatgatgcccctgctgcaggagatctgtagctag

SEQ ID NO: 19987 - DNA, 891 bp, Artificial Sequence
  Description of Artificial Sequence: Synthetic coding sequence
atggccagccgggaggacgagctgcggaactgcgtggtgtgcggcgatcaagcaaccggctatcattttaacgctctgacatgtgagggatgtaagggctttttcaggagaacagtttctaagagtatcggacctacatgccctttcgctggctcctgcgaagtgtccaagacacagcgcaggcactgccctgcctgccggctacagaaatgtttggacgcggggatgcgcaaggatatgatccttagtgcagaagcgctggccctcagaagagccaagcaggcccagagacgcgcccagcaaacaccagttcagctttctaaagagcaagaagagcttatccgtacactcctcggggcccacactagacatatgggaactatgtttgagcagttcgtccagtttaggcctccagctcaccttttcattcaccatcagcccctgccaactctggcccctgtgctccctctggtcacacacttcgctgatatcaatactttcatggtgctgcaggttatcaagttcacaaaggatctgcctgtctttaggtccctccctatcgaggaccagatttcccttctgaagggtgcggccgttgagatttgtcacattgtactgaataccaccttttgccttcagactcagaacttcctatgtggccctcttaggtatacaatcgaagacggcgcccgcgaccgcccaggcgtgactcagagagacgagatcgatcagctgcaggaagagatggcgctcaccctgcagtcttacataaagggacagcaaaggcggcctcgagataggagcccaggaacaccctggattcactggagtggaaagatgcttggccctaaaattggccccggctctaagggcgcccagtggctccagtag

SEQ ID NO: 19988 - DNA, 825 bp, Artificial Sequence
  Description of Artificial Sequence: Synthetic coding sequence
atgctgcccaagcggagccggcggaccgtgagcaagagcatcggccccacttgcccttttgctggcagctgcgaggtttcgaagacccagagaaggcactgcccagcatgtcggctgcagaaatgcctggatgccggcatgaggaaggacatgatcctctccgccgaggcccttgctttacgacgagcaaaacaagcgcagcgtagggcccaacagacgcccgtccaactgtccaaggagcaggaagagctgattagaactctcctgggtgctcatactcggcatatggggactatgtttgagcaatttgtgcaattccgtccacccgctcaccttttcatccatcatcagcctctacctacactagctccggtactgccgctcgtaacccattttgccgacatcaatacattcatggtcctccaggtgataaaattcactaaagatcttcccgtgttccgcagcctccctatagaagaccaaatatctctgctgaaaggcgctgcagtggaaatatgtcacatcgtgctgaacacaaccttttgtcttcagacacagaattttctctgcggccctctccgatataccatcgaggacggagctcgcgtgtcccctacagtcgggttccaggtggagtttttggagttactattccacttccatggaacactgcggaagctgcaactgcaggagccggaatacgttttgctcgcagcaatggctctcttttctcctggagagcatctacccaaacctcgagctttctgttgtaccacctcagcacaaattttgtcctccctatcaccctctacccaggcattctag

SEQ ID NO: 19989 - DNA, 273 bp, Artificial Sequence
  Description of Artificial Sequence: Synthetic coding sequence
atgctgcccaagcggagccggcggaccgtgagcaagagcatcggccctacttgcccttttgctgggtcatgcgaggtaagtaaaacccagcgcagacattgccctgcatgtcggctgcagaaatgtctggacgccggaatgaggaaagataccagttcatcttccgtgcatccctcgcctgcgctcgcccatccggggccctgtgccgccagcggccacacattgcgcaggcatcagcattttcatggtacagcttcccaccaggtttactag

SEQ ID NO: 19990 - DNA, 357 bp, Artificial Sequence
  Description of Artificial Sequence: Synthetic coding sequence
atgctgcccaagcggagccggcggaccgtgagcaagagcatcggccccacttgtccttttgccggaagttgtgaggtgtccaagactcaacgcagacattgtcctgcctgtcgactgcagaaatgtttggatgctggcatgagaaaggatatcccttgtcccctaaagacgaggagtcctttcagccgagagcaactgtggaaatccgtgacttcatactccatacctctcagtgtgtccaaacataagactagtagcgctggcctctttgctacacagctcaaaatggagccagtcactgacttggaacttccccgggaaatgaggctgatatcgtgtaaacggcgttggcattag

SEQ ID NO: 19991 - DNA, 936 bp, Artificial Sequence
  Description of Artificial Sequence: Synthetic coding sequence
atgctgcccaagcggagccggcggaccgtgagcaagagcatcggcccaacatgtccatttgctggcagctgcgaagtcagtaaaacgcagcgaaggcattgtcccgcgtgtagactgcagaaatgtttggacgctggcatgagaaaggacatgatcctgtctgcagaagcattggcccttaggcgtgctaagcaggctcagcgaagggctcaacagacgcccgtgcaactgtccaaggaacaggaggaacttattcgcactctgctcggcgcccacacgcggcacatgggtacaatgttcgagcaatttgtccagttcaggcctcctgcccacttgtttatccaccaccagccactgcctactctagcccctgttctgccacttgtcacacactttgctgatattaataccttcatggttctgcaagtgatcaaatttacgaaagacttacctgtgttccgttccctgccgattgaagaccagatttccctgttgaaaggcgctgcagttgagatctgccacatcgtgttgaacaccaccttctgcctccagacacagaactttctgtgcgggcccctgaggtacaccatcgaggatggcgcgagagtgggcttccaggtggaattcttggaactgctgtttcattttcacggcacccttaggaagctccagctccaggagcccgagtatgttctgttagccgccatggccctgttctccccggccccttaccttacagatcggcctggtgtgactcagcgagacgaaattgatcagctgcaggaggagatggccctgaccctgcagtcctatataaagggtcagcagagacggccccgggaccgcagcccaggaactccgtggattcattggagcgggaagatgctgggcccaaaaattgggccgggctccaagggagcacagtggctccagtag

SEQ ID NO: 19992 - DNA, 273 bp, Artificial Sequence
  Description of Artificial Sequence: Synthetic coding sequence
atgctgcccaagcggagccggcggaccgtgagcaagagcatcggcccaacttgccctttcgccggctcctgcgaagtcagcaaaacacagcgccgccactgtccagcctgccggctgcaaaaatgccttgacgccggcatgcgtaaggacactagctctagtagcgtgcacccctctccggcattagcacatccaggtccttgtgccgcaagcggccataccctgagacgccaccagcattttcatggtacagcctcccaccaggtctactag

SEQ ID NO: 19993 - DNA, 960 bp, Artificial Sequence
  Description of Artificial Sequence: Synthetic coding sequence
atgctgcccaagcggagccggcggaccgtgagcaagagcatcggcccaacatgccctttcgccgggagttgcgaagtgagcaagacccaaagacgacactgcccagcatgccggttgcagaagtgcctggacgcagggatgagaaaggatatgatcctgtccgctgaagcactggctcttaggcgagccaagcaggcacaacgacgtgcccagcagactccagttcagctgtctaaggaacaggaagaattgattaggacccttctgggagcccacacacgacacatgggcactatgttcgagcagtttgtccaattccgtcccccagcgcacttgttcatccaccaccagcccctgcctaccctggcgcccgtactgcccctggtgacccacttcgctgacattaacactttcatggtactgcaggtgatcaagtttacgaaggatttgcctgtgtttagatcactgcctatcgaggatcaaatcagtttgttgaaaggtgccgcggttgaaatctgccatattgtactcaatacgactttttgtctccagacacaaaacttcttatgcggaccactccgttacacgatcgaagacggggccagagtcggcttccaggtggagtttctggagctcctgttccacttccatggtaccctgcgaaagctgcagctgcaagagccagagtatgtcctgctcgccgccatggctctgttcagcccagacagacccggagttacgcagcgcgatgagattgatcagctccaagaagagatggctctcaccctgcagagctacatcaaggggcagcaacgcaggccaagagaccgctttctatacgctaagctcctaggcctgctcgccgagctgagaagtatcaatgaggcttatggctatcagatacagcacatccaaggcctgtctgccatgatgccactgcttcaggaaatatgcagctag

SEQ ID NO: 19994 - DNA, 357 bp, Artificial Sequence
  Description of Artificial Sequence: Synthetic coding sequence
atgctgcccaagcggagccggcggaccgtgagcaagagcatcggcccaacttgcccttttgccggatcatgtgaagtgagtaaaactcagcgccgacattgtccagcatgtcggcttcagaaatgcctggatgctggcatgcgcaaggacatcccatgccctttgaagaccaggtcccctttcagcagggagcagctgtggaaaagtgttacaagctatagcatccccctgtccgtgagcaaacataagacaagctcagccggcttgtttgccactcagttaaagatggagcccgtgaccgatctagaactgcccagggaaatgaggcttatttcctgtaagagacgctggcattag

SEQ ID NO: 19995 - DNA, 444 bp, Artificial Sequence
  Description of Artificial Sequence: Synthetic coding sequence
atggccagccgggaggacgagctgcggaactgcgtggtgtgcggcgatcaggccaccggatatcacttcaacgccctgacctgcgaaggatgtaaggggttcttccgacgcaccgtttctaaatccatagggccaacttgcccctttgccggttcctgcgaggtttcaaagacacaaagacgacactgtcccgcttgtcgtctccagaagtgtttggacgctggcatgcgaaaagatataccgtgccctctgaagactcgttctcccttcagccgggaacagctttggaaatcagttaccagttactcaatccccctgagcgtctctaaacacaaaacctccagtgccgggctgttcgccacccagctgaaaatggaaccggtgaccgacctggaattacccagagagatgagacttatttcatgtaagcgtcggtggcattag

SEQ ID NO: 19996 - DNA, 273 bp, Artificial Sequence
  Description of Artificial Sequence: Synthetic coding sequence
atgctgcccaagcggagccggcggaccgtgagcaagagcatcggcccaacctgtcccttcgcaggatcatgcgaggttagcaagacccagcgaaggcactgtccagcttgccgtctgcagaaatgcctggacgctggcatgcggaaagacactagctcatcatccgtacatccgtcacccgctctggctcatcccgggccctgtgccgctagcggacacacactaaggaggcaccaacattttcacgggacggcgagtcatcaggtatattag

SEQ ID NO: 19997 - DNA, 804 bp, Artificial Sequence
  Description of Artificial Sequence: Synthetic coding sequence
atgctgcccaagcggagccggcggaccgtgagcaagagcatcggccccacatgcccatttgcgggaagttgcgaagtgtcaaaaacccagagaaggcactgccccgcttgtagattacagaaatgcctagacgctggaatgagaaaagatatgattctatccgccgaagccttggccctcagaagggcaaaacaggcccaacggagagcacagcagacgccagtccagctatcaaaagagcaggaagagctgataaggaccctcctcggcgctcacacaagacacatgggtaccatgtttgagcagtttgtacaattccggccgcccgcccatctctttatccaccaccaacctctcccgactcttgctccagtgttgcccctggttacgcatttcgctgacattaacacatttatggtcctgcaggtgataaagtttaccaaagacctgccagtatttcgatcactgcctatcgaggaccagatctccttgcttaagggtgccgccgtcgaaatttgccacattgtgttgaatactactttctgcttacagacccaaaactttctgtgtggtcccctcaggtatacaatcgaggacggggcaagggacagacccggtgtgacccaacgtgacgaaatcgatcagttacaggaagaaatggccctcacactccagagctacatcaaggggcagcaaaggagaccccgcgatcgctcaccaggtacaccctggatccactggagtgggaaaatgctcggccccaagattgggcctggctcaaaaggcgcccagtggttacagtag

SEQ ID NO: 19998 - DNA, 717 bp, Artificial Sequence
  Description of Artificial Sequence: Synthetic coding sequence
atggccagccgggaggacgagctgcggaactgcgtggtgtgcggcgatcaggccacgggctaccattttaatgccctgacgtgtgaaggttgtaaaggctttttccggagaactgtgagtaagagtatcggtcctacctgcccattcgcaggctcctgcgaagtgtcaaagacacagagacggcactgtcctgcctgcaggctgcagaaatgtttggatgctggcatgcgcaaggatatgatcctatccgctgaggccctcgcactacgccgtgctaagcaggctcaacgaagggcccaacaaacaccggttcaactgtccaaagaacaggaggaattaattaggaccctccttggagctcatactagacatatgggaaccatgtttgagcagtttgtgcagttccggccacctgcccacctgttcatccatcaccagcctctccctactctcgccccagtgctgcctctcgtaactcacttcgcagatattaataccttcatggttctgcaggtgatcaagttcacaaaggatctcccagtgttccggtccctacccatcgaagaccaaatctcactgctgaaaggtgctgctgtggagatatgtcacatcgtgctgaacacaacattctgtcttcagacacagaacttcctctgcggacctctacgctacactatcgaagatggtgcccggggcgaaatggtccttgagcagtag

SEQ ID NO: 19999 - DNA, 1452 bp, Artificial Sequence
  Description of Artificial Sequence: Synthetic coding sequence
atggccaccatcgaggagatcgcccaccagatcatcgagcagcagatgggcgagattgtaaccgagcaacagacgggacagaaaatccagattgtgactgcgctagaccataacacacagggcaagcagtttatccttaccaatcatgacggcagcacgccatcgaaggtcatcttagcccgtcaagactcaaccccgggaaaagtctttctgacaacccctgacgctgctggggtcaatcagctgtttttcacaacaccagacctgagcgctcagcacctacagctgctcactgacaactctcctgatcaggggcccaacaaagttttcgatctatgcgtggtctgtggtgacaaggctagtggaaggcattacggcgccgtaacatgcgaaggatgcaagggtttctttaaacgatctatcagaaagaatctagtgtactcatgtagaggatctaaggactgtatcattaacaaacatcataggaatcggtgccagtactgccgtctccagaggtgcatagccttcggaatgaaacaggactccgtccaatgtgagagaaagccaattgaggtttcacgggagaaatcttcgaactgtgccgcatctactgagaagatctacattaggaaagatctgcggtctccattaacggccactcctacattcgtgaccgattctgaatctactcggtcaacagggctgctggattcaggcatgttcatgaacatacatccctcaggcgtcaagacagaaagtgccgtgttgatgacatctgacaaagctgagagctgtcagggagaccttagcactctggcaaatgtggtgacgagtttagccaacctggggaagacgaaggacctgagccagaacagcaatgagatgagcatgatcgagagcctgtccaatgatgacacatcactgtgcgagttccaggagatgcagactaacggcgatgtcagtagggcctttgatacactcgccaaagctcttaatcctggggagagtaccgcctgccaatcttccgtcgcggggatggagggatctgttcacttgattaccggagattctagcatcaactatacggaaaaggaaggtcccctgttgagcgattctcacgttgctttcagactgaccatgccatctcctatgccggagtatctcaatgtccattacatcggggagtccgcatctaggctactttttctgtctatgcactgggcacttagcataccctcttttcaagctcttgggcaggagaatagcatctctttggtcaaggcttactggaatgagttgtttactctcggactcgcccagtgctggcaagtaatgaacgtggccaccatcctcgctaccttcgtaaattgcctgcacaatagccttcagcaggatgctaaagtgattgccgccctgatccattttacgaggcgtgccatcacggacctgtag

SEQ ID NO: 20000 - DNA, 1812 bp, Artificial Sequence
  Description of Artificial Sequence: Synthetic coding sequence
atggccaccatcgaggagatcgcccaccagatcatcgagcagcagatgggtgagatcgtgactgaacaacagacaggacaaaaaatccaaatagtgacagcgctggaccataatacccaggggaagcaattcattcttactaaccacgacgggtcaaccccctccaaagtgattctggcccgacaggatagcaccccagggaaggtgttccttaccacacccgacgccgccggagtcaaccagctgttcttcaccactcctgatttgagtgcccagcacctacagttgctgacagacaattccccagaccaggggcctaacaaagtgttcgatctgtgcgttgtttgcggcgataaggccagtggccgacactacggggcagtcacctgtgaaggctgcaagggcttctttaagagaagcatccgcaaaaatctcgtgtacagttgccgtggctctaaggactgcatcattaacaagcaccacagaaatcgatgccagtactgtaggctgcaaaggtgcattgcatttgggatgaaacaagatagcgttcagtgtgagcggaaacctatcgaggtgtcccgcgaaaagtcttctaattgtgcggccagtaccgaaaaaatctatatccgcaaggatttgcgttctccgctgaccgccacccctacattcgtgaccgattctgagagtactcgctcaacaggtctgctggactcagggatgtttatgaacatccatccgtcaggtgttaaaactgagtccgccgttctaatgacaagtgacaaggccgagtcatgtcaaggcgacttgtctactttagccaatgttgtgacaagcctggcgaaccttggaaaaacaaaagacttgagtcaaaactcgaacgagatgagtatgatcgagtccctctcaaatgatgatacgtcactgtgcgagtttcaggaaatgcagacaaatggcgacgtgagtcgggcctttgataccctcgcgaaggccctgaaccccggggagtccaccgcctgtcaatcttcagttgcaggaatggaaggttctgttcacctcatcactggcgattctagtataaattacacggagaaagaaggacctctgttatccgattcccatgtggctttcagacttaccatgccttcaccaatgccggagtacctcaacgttcactacatcggggaatccgctagccgcctcctgttcctctctatgcactgggccctgagcatcccgagcttccaggcccttggccaagagaacagcatctctctggtgaaggcatattggaatgagctttttaccctagggctggctcagtgttggcaggtcatgaatgtggccactatcttggctacgttcgtgaattgccttcacaactccctccagcaagacaaaatgagcacagagagacgtaagctgctgatggagcacatttttaagttgcaggaattctgtaactccatggttaagctgtgcatcgacggttatgaatacgcatacttaaaggccatcgtgctgttctccccggaccacccctctctcgaaaatatggaacagatcgaaaagtttcaggagaaggcctacgtagaattccaggattatatcactaagacctatcctgatgacacatataggctgagtaggctacttctgcgcctgcccgcgctgcgactcatgaacgcaactatcacagaggagctgtttttcaaggggttaatcggcaacatacggattgattccgtaatcccgcatatcctgaaaatggagccggcagattataattcccaaatcattggtcattccatttag

SEQ ID NO: 20001 - DNA, 1404 bp, Artificial Sequence
  Description of Artificial Sequence: Synthetic coding sequence
atggccaccatcgaggagatcgcccaccagatcatcgagcagcagatgggcgaaatagtcacagaacaacagactggccagaagatacagatcgttacagccctggaccacaatacacagggtaaacagttcattctgacaaaccatgatggctccaccccctcaaaagttatccttgcaagacaggattctactcccgggaaggtttttctcacaacccctgacgccgcaggagtaaaccagctcttcttcactacaccagacttatcagcccagcaccttcagttgctcaccgacaattcacctgatcagggccctaacaaagtctttgacctgtgtgttgtatgcggcgacaaagccagcgggcgccactacggagctgtgacctgtgagggctgtaagggcttcttcaagcgatcaatcaggaaaaatttggtatacagctgccgtggttccaaggactgcattatcaataaacatcaccgaaaccgatgccagtactgtcgccttcagcgttgtattgcgtttggaatgaaacaggactctgtgcagtgcgagaggaagcccattgaggtaagccgagagaagtccagcaactgcgccgcttccaccgaaaagatctatattagaaaagatcttcggtcccctctgacagcaacccccacatttgttaccgactcagaaagcacgagaagcactggcctgctcgatagcgggatgttcatgaacattcacccatccggcgtcaagacggaatcagcggtgctgatgacgtcagataaagccgaatcttgtcagggtgatctaagcaccctggccaatgtcgtgacctctctggctaacttgggtaaaaccaaggaccttagtcagaattcaaatgaaatgtccatgattgaaagcctgtcgaatgatgatacaagtctctgtgaatttcaggaaatgcagaccaatggagacgtatctcgtgccttcgataccttggccaaggccttgaacccaggtgagagcactgcctgtcagtcatctgtcgccggaatggaggggtctgtgcacttaataacgggagattcatccataaattacaccgagaaagaggggcccttgctatctgactcacacgtcgccttccggttgacaatgcctagcccaatgccagagtatctgaacgtgcactatattggtgaatctgcctcgcgccttttattcctgtcgatgcactgggccttgagcataccatcgtttcaggctctggggcaggaaaattcaattagcctggtcaaggcttactggaatgaattgttcactcttggactagctcagtgttggcaggttatgaatgtggctacaatactcgccacttttgtcaactgcttgcacaactcccttcagcaggcagaagggtag

SEQ ID NO: 20002 - DNA, 51 bp, Artificial Sequence; identical to SEQ ID NO: 8896
  Description of Artificial Sequence: Synthetic coding sequence

SEQ ID NO: 20003 - DNA, 969 bp, Artificial Sequence
  Description of Artificial Sequence: Synthetic coding sequence
atgtgccccgtggacaaggcccaccggaaccagtgccaggcctgccgccttaaaaagtgtctccaggccgggatgaaccaggacgctgtgcagaatgaacgccagccgagaagcaccgcccaggtccacctagactctatggaatctaataccgaatcccgcccagaaagtcttgtagctccacccgcgcctgcagggagaagcccaaggggcccaaccccaatgtctgccgccagagcgctagggcaccacttcatggcctctttgattacagctgaaacatgcgcaaaattggagcccgaggatgccgacgagaacattgacgtgacgagtaacgacccagagttcccatcctccccttattcctcctccagcccatgtggcttggacagcatacacgagacaagcgcgaggctgctcttcatggctgtgaagtgggccaagaatctgccagtcttttcctctctgcctttcagggatcaagtgatcctgctcgaagaggcctggtccgagctctttctgttaggggcaattcaatggagcttgcctctggacagctgcccattgttggccccacccgaagcgtccgcggcaggcggggctcagggacgtctgactctggcttccatggaaaccagggtgctgcaggagacgatttcccggtttcgtgcccttgcagtggaccccactgagttcgcttgtatgaaggcacttgtattgtttaaacccgagactcgggggctgaaagatcccgagcatgtggaagcactgcaggatcaaagccaggtgatgctgagccagcattctaaagcacatcatccatcccagcccgtgcgatttggaaaattgctgctgctcctcccctctttaaggttcatcaccgcagagcggatcgagctgctattcttccggaagaccattggcaacactccaatggagaagctgctctgtgacatgtttaagaactag

SEQ ID NO: 20004 - DNA, 1104 bp, Artificial Sequence
  Description of Artificial Sequence: Synthetic coding sequence
atggagacccggcccaccgccctgatgagcagcaccgtggccgccgccgccccggccgcaggcgccgcttctcgcaaggagtcacctggaagatgggggctcggtgaggatccgaccggcgtttccccaagtttgcagtgtagagtatgcggagactcgagcagtgggaagcactatgggatctacgcctgcaacgggtgctccgggttctttaaacggtcagtgaggcgccgactgatctacagatgccaggtgggcgcgggtatgtgtcctgtggacaaggcccatcgaaaccagtgccaagcgtgtagattgaaaaaatgtttacaggctggtatgaaccaggacgctgtgcagaacgagcgtcagcctcgatccaccgctcaagtgcatctggactctatggagtccaatacggaatccagacctgagtctctggtcgcacctccagctccagccgggcgcagcccgcggggacctacccctatgagtgccgcccgggctttaggccaccactttatggctagcctgattactgcagagacttgcgccaaactggaacctgaagatgcagacgagaacattgacgttacctcaaatgatcccgagtttcccagctccccctattctagttctagcccgtgcggccttgatagcatccacgagacatcggctcggctactgttcatggccgtgaagtgggcaaagaacctacccgtattctcatcactaccctttagggatcaggtgattctacttgaagaggcatggtccgagctgttcctccttggggccatccagtggagcctcccactcgactcatgtcccctgctggccccacccgaggcaagcgccgcgggtggcgcccagggaagactgactctggcgtcaatggagaccagggtattgcaggagacgatcagcaggttccgggcgctggcagtggaccctaccgagtttgcatgtatgaaggccctggtgttgtttaagcctgagacacgagggttaaaggatccggagcatgttgaggcgctgcaagatcagagtcaggttatgttatcccaacattctaaagctcaccacccatcgcagcctgtccggtag

SEQ ID NO: 20005 - DNA, 1431 bp, Artificial Sequence
  Description of Artificial Sequence: Synthetic coding sequence
atggagcgggacgagcccccccccagcggcggcggcggcggcggcggttcagccgggtttttggagcccccagccgctttacctcctcctccccggaacggcttttgtcaggatgaactcgctgagttggatccagggaccaatgacagagcagaacagagaacttgccttatctgtggggacagggcaaccggcctacactacggcattatcagctgcgaggggtgtaagggatttttcaaacgatccatttgcaacaagagagtgtacagatgctccagggataaaaattgcgtcatgagcaggaagcagaggaaccggtgccagtattgccgtcttttgaaatgcttgcaaatggggatgaatcgcaaggctatcagagaggatggtatgccaggcgggaggaacaagtcaatcggcccagttcagataagcgaagaagaaattgaaaggattatgtcaggccaggaattcgaagaagaggccaaccactggtctaaccatggggatagtgatcactcgagtccagggaacagggccagcgaatcaaaccaacctagcccaggctctaccctgagctccagccgcagtgttgaacttaatgggttcatggcatttagggagcagtacatggggatgagtgtccctcctcactaccagtacatcccacatctgttttcctattccggtcactctcccctacttccccagcaagcccgcagccttgatccacaatcatatagtctgatccatcagctgctctccgccgaggacctagaacccctcgggactccaatgcttatcgaggatggttatgccgtgacgcaggcagaacttttcgccctcttgtgcagattggccgacgagctcctgttccggcagattgcttggattaaaaaactgccctttttctgtgagctaagtattaaggactatacttgtctgctgtcgagtacgtggcaagagctgattcttctgtctagcctgactgtgtattctaagcagatttttggagagttggccgacgtgaccgccaaatattcaccatccgatgaggagctacaccgattcagcgacgaggggatggaggtgatcgaacgcctgatttatttataccacaaatttcaccagctaaaggtcagcaacgaggagtacgcctgtatgaaggctattaactttctgaatcaagacatacggggcctgacctctgcctctcagcttgagcagctgaataagaggtattggtatatctgccaggactttacagagtataagtacacacatcagccaaacaggtttccggatctgatgatgtgcttgcccgaaatcagatatatcgctggcaagatggtcaacgtgcccttggagcagctgccccttctcttcaaggtggtcctacactcctgtaagactagcgtggggaaagaatag

SEQ ID NO: 20006 - DNA, 1428 bp, Artificial Sequence
  Description of Artificial Sequence: Synthetic coding sequence
atggagcgggacgagcccccccccagcggcggcggcggcggcggcggctctgctggctttctcgagccccctgccgctcttccaccccccccacggaatgggttctgccaagacgagctggctgagctcgacccaggaacaaatgacagagccgagcaacggacttgtcttatttgcggagatagggcgaccggacttcactacggcatcatttcttgcgaaggttgtaaaggcttctttaagcgtagcatttgcaacaagcgcgtttataggtgttcaagggataaaaactgcgtcatgagtcggaaacagagaaaccgatgtcagtattgcagactgctgaagtgccttcagatgggcatgaacaggaaagctatcagagaggacggtatgccagggggacgcaataagagcattgggcctgtgcaaatttccgaagaggagatcgagcggatcatgtcaggacaggaatttgaagaggaagctaaccattggtcgaaccatggtgattccgaccactccagccccggcaaccgcgcctcagaaagtaaccaaccctcgcccggttcaacattatcatctcggagcgtcgagctgaacgggttcatggcttttcgcgagcagtacatggggatgagcgttcctccccattatcagtacattcctcatctcttctcctactccggccacagccccctgcttcctcagcaagctcgttccttagatccacagtcctatagcctcattcaccagctcctgtctgctgaggaccttgagccattaggaacccctatgctaattgaggatggatatgctgtcacacaggctgaactttttgcactgctctgtaggcttgccgacgaactattgtttagacagatcgcttggatcaagaagttgccctttttctgtgagctgagcattaaggactacacttgcctcctgtccagcacttggcaggagctcatcctgctgtccagtctaaccgtgtatagtaagcagatctttggagaacttgccgatgtgactgccaagtactctccaagcgatgaggagctccatagattctcggacgagggaatggaggttatcgagcgcctcatctatctttaccataagtttcaccaactaaaggtgtctaacgaggaatatgcctgtatgaaggccatcaatttccttaatcaggatatcaggggcctaacttcagcaagtcaactcgaacagctcaataagcgttattggtatatctgtcaggacttcacagagtacaagtatacgcatcagccaaaccgattccctgatcttatgatgtgtctccctgagattaggtacattgctgggaagatggtcaacgttcctcttgaacaactgcccctgctgttcaaggtggtgttacattcctgtaagacatctgtcggcaaggaatag

SEQ ID NO: 20007 - DNA, 1443 bp, Artificial Sequence
  Description of Artificial Sequence: Synthetic coding sequence
atggagcgggacgagcccccccccagcggcggcggcggcggcggcggctcagcgggcttcctggagccaccagctgctcttcctcctcctcccaggaatggcttctgtcaagacgagctggcggagctggatcctggcactatatcagtatctgatgatcgcgccgagcagcggacatgcctgatatgcggcgatcgcgctaccggtctccactatggcattatctcctgtgaaggatgtaagggtttctttaagagatcaatttgcaataaaagggtttaccgctgtagcagagacaaaaattgtgttatgagtagaaaacaaaggaacaggtgccagtattgtcgtctgctgaaatgtctgcaaatggggatgaacaggaaagctattagggaggacggcatgccaggtggccggaacaaatcaattggacctgtacagatttccgaagaagaaatagaaaggattatgtccgggcaggaatttgaagaagaggccaaccactggagtaaccatggggacagtgatcactcctcaccaggaaatcgagcaagcgagagtaatcagccgtcgcctgggtctacactgagttccagtcgcagcgtcgaattaaatgggtttatggctttcagggagcagtatatgggaatgtcggtccctccgcactaccagtacatcccacatctattttcttattctggtcatagccccttgctccctcagcaggctaggagcctggacccgcagtcatactcactaattcatcaactgctgagcgccgaggacctcgagccactggggactcccatgctgatcgaggacggctacgccgtgacgcaggcagagctgtttgcgcttttgtgccgactggctgatgaactattattccggcaaatcgcttggatcaaaaagcttccattcttctgtgagctgtctataaaggattacacctgccttcttagctcaacctggcaggaactgattctcctctcatctttaaccgtgtatagtaaacagatattcggtgagctcgccgacgttaccgcaaaatatagcccgagtgatgaggagcttcacaggttcagtgatgaaggaatggaagtgatagaacggctgatttatctctatcataaatttcatcagctgaaggttagtaatgaggagtatgcctgtatgaaggctattaattttctgaatcaggatataaggggcctgacaagtgcaagtcagcttgagcaattaaacaaaaggtactggtatatttgtcaggactttaccgagtacaagtacacacatcagcctaaccggttccccgacctgatgatgtgcttacccgagattaggtacattgccggtaaaatggtgaacgtccctctggaacagttaccattattgtttaaggtggtgttgcattcctgcaaaacctccgtcggcaaagagtag

SEQ ID NO: 20008 - DNA, 1677 bp, Artificial Sequence
  Description of Artificial Sequence: Synthetic coding sequence
atggccatccccggccggcagtacggcctgatcctgcccaagaagacacagcagcttcatccagtactccagaaaccttccgtgttcggcaatgattcggacgacgacgatgaaacttctgtgtcagaaagtctgcagcgggaagccgccaagaagcaggcaatgaagcaaacaaaacttgagatacagaaggctctcgccgaggacgccacggtgtacgaatacgattctatctacgatgaaatgcaaaaaaaaaaggaagaaaataaccccaaacttttactgggcaaggatcgaaagccaaagtacatacacaatctgctgaaggctgtcgagattaggaaaaaagagcaggaaaagcgaatggaaaaaaagatacaaagggagcgtgaaatggagaaaggcgaatttgacgacaaggaagcattcgtcacaagcgcctacaaaaagaagctccaagagcgggccgaagaggaggagagggagaagcgggcagctgctctggaagcttgtctggatgtgaccaagcaaaaggatttgagcggcttctatcggcacttactgaaccaagcggttggcgaggaggaggtgccaaagtgctcctttagagaagctcgatcaggtataaaggaggagaagtccaggggctttagcaacgaagtttccagcaaaaaccggattcctcaagaaaaatgcattctgcagacagatgtgaaggtggaggagaaccctgacgccgactcagacttcgatgccaagtctagtgccgatgacgaaatcgaggaaacccgtgtgaattgtcggagagaaaaagtgatagagacacctgagaatgacttcaagcaccaccggtcgcagaaccactctcgatctcccagtgaggaacgcggacactcaacccggcaccatactaaagggagtcgtacgagtcggggccacgagaagagagaagatcagcatcagcagaagcagtcgcgcgaccaagagaaccattatacagatagagactaccggaaagaacgggactcccaccgacatcgggaagcctcacatagagacagtcattggaagcgacacgaacaggaagacaagcctagggcacgggaccagagagaaaggtcggacagagtttggaagagagagaaggatagagagaaatactcacagcgggagcaagagagagaccgccagcagaatgatcagaaccgccctagcgagaagggggaaaaggaggaaaaaagcaaagccaaggaggaacatatgaaagtccgcaaagaacgatatgaaaataatgacaagtaccgcgacagagaaaaacgcgaagtgggcgtgcagagcagtgagaggaaccaggaccgcaaagagtcctctccgaacagccgtgctaaagacaaattcctggaccaggaacgctctaacaaaatgagaaacatggccaaggataaagagaggaatcaggagaaaccttccaactctgagtcatctctcggagctaagcaccggctgactgaggagggccaagaaaagggcaaagagcaggagcgcccacccgaagcagtcagtaaattcgctaagcgcaataacgaggaaacagtgatgtccgcacgagaccgatacctggcacgccagatggctagggtgaatgccaagacctacatcgagaaagaagatgattag

SEQ ID NO: 20009 - DNA, 1062 bp, Artificial Sequence
  Description of Artificial Sequence: Synthetic coding sequence
ctgaagatgaccaagctggagatccagaaggccctggccgaggacgcgacggtgtatgagtacgactccatttacgatgagatgcagaaaaaaaaggaagagaataatcccaagcttttgctgggaaaggataggaagccgaaatacatacataacctgctcaaggccgtcgagatcaggaaaaaggagcaagagaaaaggatggagaaaaaaatacagcgcgagcgggagatggaaaaaggggaatttgacgacaaagaagcttttgttacttccgcatataaaaaaaagctccaagaacgtgctgaggaggaggaaagggagaaacgcgcggccgctctggaggcatgtctcgacgtaactaagcagaaagacctgtcaggtttctatcggcacctcttgaaccaggccgtcggcgaagaagaagtaccaaagtgcagcttccgcgaggccaggtccggaatcaaagaggagaagagccgaggcttttctaacgaagtctcatccaagaaccgtatccctcaggaaaaatgtatcttgcagaccgatgtgaaggtcgaggagaatcccgatgcagactcagattttgacgcaaagtcctctgctgacgacgagattgaggaaacccgtgttaactgtaggcgtgagaaagtgattgagactcctgagaacgattttaagcaccatcggtcgcagaaccactccagaagtccatcagaagagagagggcatagcactaggcaccataccaagggatctaggacaagtcggggccacgagaagagagaggatcaacaccagcagaagcagtcaagagaccaagagaaccactacacagatcgcgactaccggaaggagcgggattcccacagacatcgggaggcttcacaccgggactcacattggaagaggcacgaacaggaggataagccgcgcgccagggatcagagagaacggtctgatcgggtttggaaaagggaaaaggatagggaaaagtattcgcagcgcgagcaagagagagaccggcagcagaacgatcagaaccgcccttcagagaaatag

SEQ ID NO: 20010 - DNA, 1470 bp, Artificial Sequence
  Description of Artificial Sequence: Synthetic coding sequence
atgctgctgtgcatgaacatgaccgtgttcatgatgaagtgccggaaaaaggaagagaacaatcctaagctgcttctcggaaaggacaggaagccaaagtatattcacaatctgctgaaagctgttgaaattcgaaagaaagaacaagaaaaacgtatggagaagaagatccagcgggaaagggagatggagaagggggagtttgatgacaaggaggccttcgtaacctcagcctacaagaaaaagctgcaggagcgcgcagaagaagaagaaagagagaaacgcgcagccgcactggaggcctgcttggacgttacaaaacagaaagacttgagcggcttttataggcacctgctcaaccaggcagtcggcgaagaagaggttcctaagtgctcttttcgggaggccaggtcggggatcaaagaggagaagagtaggggattttcgaacgaggtttcctctaaaaatcgtattcctcaggagaaatgtattcttcagacggacgttaaggtcgaggagaaccccgacgcagatagcgatttcgatgccaagtcttccgccgacgatgagattgaagaaacgagagtgaactgccggcgggaaaaggttatcgaaactcccgagaatgacttcaagcaccacagaagtcaaaatcacagtagatcaccctccgaggaacgcggacatagtacacggcatcacaccaagggaagtcgaacctctagaggtcacgagaagcgggaagatcagcaccaacaaaagcaatcacgcgaccaagagaatcactatacagatcgcgattacaggaaagagcgcgacagccacagacaccgggaggctagccaccgggactcgcattggaaacgccacgagcaggaggacaaaccacgagcccgagaccagagagagaggtcagaccgagtatggaaacgcgagaaagacagagaaaagtatagtcaacgagagcaggaaagggatcgtcagcagaacgatcagaaccgcccctccgagaaaggagagaaggaggagaagagcaaggctaaagaggaacatatgaaggtcagaaaggagagatatgagaacaatgacaagtaccgagaccgcgaaaaacgagaggtgggagtgcaatcctcagaacgcaaccaagaccgtaaggagtccagccctaactccagagccaaggacaaattcttggaccaagaacgctctaacaaaatgagaaatatggcaaaagataaagagaggaaccaggagaaaccttccaactcagagagctctctgggagccaaacaccggctcacagaggagggccaggaaaaaggaaaggaacaggagcgcccgccagaagcggtgtctaaatttgcaaagcgtaacaatgaagaaactgtcatgtcagcaagggaccgctacttagcccgccagatggctcgggtgaacgccaaaacctatatcgaaaaagaagatgactag

SEQ ID NO: 20011 - DNA, 474 bp, Artificial Sequence
  Description of Artificial Sequence: Synthetic coding sequence
atgggcaagcacgagttccggagcaacatcccctgccacctggtggatatttcgtgcggcctcccatgtagtgcaacactcccctgtggcatgcataagtgtcagaggttgtgccataaaggggagtgtctagttgatgaaccatgcaagcagccctgcaccactccaagggccgactgtggccacccctgtatggctccgtgccatacatcgagtccttgccccgtgacagcatgcaaagccaaggtggtcgaactccaatgcgagtgcgggcggcgaaaagaaatggtcatatgtagcgaggcatccagtacttatcaacgactagttatcgcggcgatctccatggcgtcaaaaattacggatatgcagctggggggcagtgtagaaatctccaaactcatcacaaaaaaagaggtccaccaggcgcggcttgaatgtgacgaggagtgctctgcgctggaaagaaaatag

SEQ ID NO: 20012 - DNA, 2502 bp, Artificial Sequence
  Description of Artificial Sequence: Synthetic coding sequence
atggccgaggccccccccgtgagcggcaccttcaagttcaacaccgatgcagctgaattcattcctcaagagaagaaaaattccggcttaaactgcggcacgcagcgccgcctcgattcgaaccgcatcggtagacgcaattactccagcccacccccctgccacctgtcaaggcaggtcccttacgatgagatcagtgcagtgcaccaacattcttaccaccctagcgggtccaagcccaagagtcagcaaacctcatttcaaagctctccctgcaataagagtcccaaatcccacggtctgcaaaatcaaccctggcagaaattaagaaatgagaagcatcatatcagagtgaaaaaggcccagtctctggctgagcagacgtctgacacagctggcttggaatcttctacccggagtgagagtggcacagatctgcgtgaacattcaccctctgagtcagagaaggaagtggtaggcgccgacccccggggagcgaaacccaagaaagccacgcagtttgtatacagctacggcagaggccctaaagtgaagggaaaactgaagtgcgaatggtctaatcgcacgacgccgaaacccgaggacgctggtcccgaaagcaccaagcctgtcggcgtgtttcatcctgattctagtgaagccagcagccgtaagggagtgctagacggatatggggctcgaagaaacgaacagcgacggtatccccagaaaagacctccatgggaggtagaaggtgcacgtccccgcccaggacgcaatccgcctaagcaggaaggtcaccgccacaccaacgcaggccatcgtaataatatgggtcctattccaaaggatgaccttaatgaacggccagccaagtcaacctgcgatagcgaaaacctcgctgtgatcaacaaatcgtcaaggagagtcgatcaggaaaagtgtacagtgaggcggcaggaccctcaagtggtgagccctttttcaagaggaaagcagaatcatgtgctcaaaaacgtcgagactcacacgggaagcttaatcgagcagctgacaacagagaaatacgagtgtatggtttgctgcgaattggttagagtgaccgctcctgtgtggtcctgtcagtcatgctaccatgtgttccacctcaactgcattaagaagtgggcccgatcccctgctagccaggcggacggacagagcggctggcgatgtccggcatgtcagaatgtcagcgcccacgtccccaatacatatacatgcttctgcggtaaggtgaagaatcctgagtggtcacgcaacgagatccctcacagttgcggggaggtttgccggaaaaagcaaccaggtcaggactgccctcacagttgtaaccttctctgccacccaggaccctgtcctccttgtcctgcgttcatgacaaaaacttgtgaatgcggccggacgagacacacagttcgatgcggccaagctgtctcagtgcactgtagcaatccatgtgagaacatactgaactgcggccagcatcagtgtgcagagctttgccacggcggtcagtgccaaccctgccagattattctgaatcaagtctgctactgcggctctacctcccgggatgttctctgtggcacggacgtgggtaagtccgacggcttcggcgactttagttgcctgaagatttgtggcaaggacctcaaatgcgggaatcacacctgttcccaggtctgtcacccacaaccatgccaacagtgcccacggctgccacagctggtcagatgttgtccatgtggccagacgcctttgagtcagctactcgagctgggcagttctagtcgtaagacatgcatggaccctgtgccctcctgtgggaaagtgtgtgggaagcctttgccctgcggtagtctggactttatacacacttgcgagaagctctgtcacgaaggggattgcgggccatgttcccgaacttcagtgatcagctgtcgctgttcctttcgcacgaaggaactgccctgtacttccctcaagagcgaggatgccacgttcatgtgcgacaaacgttgtaataaaaagcgcttatgcggaagacataaatgcaatgaaatctgctgcgtggacaaggagcataaatgtccccttatctgtggcagaaagttaaggtgtggcctgcacagatgcgaggagccgtgtcacagaggaaattgccagacatgctggcaggctagttttgacgagttgacatgtcactgcggcgcctcggtaatttatccgcctgtaccctgtggaacgagaccccctgagtgcacccaaacctgtgcacgggtccacgagtgtgaccacccggtctaccattcctgtcactctgaagagaagtgtcctccttgtacctttcttactcagaagtggtgcatgggtaaacacgaacagtcccactactgggcttcgacccagaaaaagagaagccactatatgaaaaaaattcctgcccatgcatgtctgtag

SEQ ID NO: 20013 - DNA, 3075 bp, Artificial Sequence
  Description of Artificial Sequence: Synthetic coding sequence
atggccgaggccccccccgtgagcggcaccttcaagttcaacaccgacgcggcggaatttattccacaggagaaaaagaatagcggccttaactgcgggacacagcgaaggctcgactccaatagaattggccggcgcaattattcctccccccctccttgccacctttcccggcaggtcccctacgacgagatctctgctgttcaccaacactcctaccatcccagcggttccaagcccaagtcccagcagacatctttccagtcatctccctgcaataaatcccccaagagccacggattacagaatcagccttggcaaaaattacggaacgagaagcaccacatccgggtcaagaaggcccaatccctcgctgagcagacaagcgataccgccgggctcgagtcctcaacgcgctcagaatctggcacggaccttcgggaacacagcccttcagaatccgagaaagaagtcgttggagcagatcctagaggcgcaaagcctaagaaagccacccagttcgtgtactcctatgggcgtggccccaaagtcaagggcaagctgaaatgcgagtggagtaacaggacgacccccaaaccagaagacgctggccctgagtctaccaagccagtgggcgtgtttcacccagacagctccgaggcttcctcacgcaagggcgttctggatggctatggcgccaggcgcaatgagcagcggcggtaccctcaaaagcggccaccttgggaagtggaaggggctcggcccaggcctggccgaaacccccccaaacaggagggccaccgccacacaaatgctggtcatcggaataatatgggtccaatccccaaggatgacttaaatgagcgccctgccaaaagtacttgcgacagcgaaaatcttgccgtaatcaataaaagttcacggcgcgtggaccaagaaaaatgcactgtgcgtagacaggaccctcaggtggtcagtccattcagtcggggcaaacagaatcatgtgcttaagaacgtggagacccatacaggatctttaatcgaacagctgaccacagagaaatacgaatgtatggtgtgctgtgagctcgtccgggttactgccccggtttggagctgccaatcctgttaccatgtgtttcacctgaactgcattaagaaatgggccagaagcccagcctcccaggcggatggccagtctggatggcgttgtccagcttgccaaaacgtgagcgcgcacgtgcctaatacctatacttgtttctgcgggaaggtcaaaaaccctgagtggtctcgcaatgaaatcccccattcctgcggcgaagtctgccggaagaaacagccggggcaggattgtcctcatagttgtaatttgctgtgccaccccggtccttgtcccccatgtcctgcctttatgacgaagacatgcgaatgtggccggactcggcataccgttcgatgtggtcaggcagtcagcgtccactgttccaatccgtgtgagaatattctgaattgcggacagcaccagtgcgccgagctttgtcacgggggccagtgtcaaccatgtcagatcatactaaatcaagtttgttattgtggcagtacgagccgcgacgttctgtgtggcaccgatgttggcaaatccgacgggtttggggactttagctgcctcaagatctgtggtaaggatttgaagtgtgggaaccatacctgttcacaggtgtgccacccccagccatgccaacagtgtccaagattaccccaactggtgagatgttgcccgtgtggccagactcccctgtctcagcttctggaattaggttcctcttctcgaaagacatgcatggaccctgtcccatcctgtggaaaagtctgcgggaagccccttccctgtggtagtctagattttatccacacgtgtgaaaagctgtgtcatgagggggactgtggaccttgcagcagaacgtcagtgatcagctgccgctgcagctttagaaccaaggaactcccatgcacctcccttaaatccgaagatgctaccttcatgtgcgataagaggtgcaacaagaagcgcttgtgtgggaggcacaagtgcaacgagatctgctgcgtagacaaagaacacaagtgcccactgatatgtggtagaaagttgcgctgtggtctgcatcgatgtgaggaaccgtgtcaccgggggaattgtcagacctgctggcaggcctcgtttgacgagttgacctgtcactgcggagcttcggtgatttatcccccggtcccctgtggcacgcgaccccctgaatgcacccagacatgcgctcgcgtgcacgaatgtgatcatcccgtctatcactcatgtcactccgaagagaaatgtccaccctgtaccttcctcactcaaaagtggtgcatgggcaagcatgagtttaggtcaaatatcccatgtcacctggtggacatcagttgcggcctgccttgcagtgccacactcccatgtggcatgcataagtgccagcggctgtgtcacaaaggagaatgtctcgtggacgaaccttgtaagcagccatgcacaacaccccgagctgactgcgggcacccctgcatggccccgtgccacacttcttccccctgtcccgttaccgcttgcaaggctaaagtggagctccaatgcgaatgtgggcggcggaaggaaatggtgatctgtagtgaagcaagttctacttatcagcggatcgccgccatttcaatggcttcaaagatcacagatatgcagcttggcggaagtgtcgaaatatcaaaactgattacaaaaaaagaggtgcaccaagccaggttagagtgtgatgaagaatgcagcgccctggagcgcaaaaaaaggctcgcagaggcctttcacatatccgaagacagcgatcccttcaatattcgttccagcggcagcaagtttagcgattccctgaaggaggatgctagaaaggatctcaaatttgtgtcggatgtcgagaaggaaatggaaacactcgttgaagcagtcaacaaagtggaggtggaaaccagccattggaccttcctgtag

SEQ ID NO: 20014 - DNA, 3363 bp, Artificial Sequence
  Description of Artificial Sequence: Synthetic coding sequence
atggccgaggccccccccgtgagcggcaccttcaagttcaacaccgatgcagctgaattcattcctcaagagaagaaaaactcaggcctcaactgcggtacccagcggagactagactccaaccgaatcgggagaaggaactacagcagtccacctccctgtcacctgtctaggcaagttccatatgatgaaataagcgccgtgcaccagcactcatatcacccctccggtagcaaacccaagtcccagcagacatcctttcagtcatcaccctgtaataaatcccctaaatctcacggtctacagaaccagccatggcaaaagctcagaaatgaaaaacaccacatcagggtgaagaaggctcagtctctggcggagcagaccagtgacaccgcaggcctcgaatccagtacacgctctgaaagcggcaccgacttgcgggaacacagcccaagcgagtcagagaaggaagtcgtaggcgcggacccgaggggagcaaagcccaagaaagccacccagttcgtttattcatacggacgcggcccaaaggtgaagggcaagctgaaatgtgaatggtccaaccgcaccactcccaagcccgaagacgccggaccagagtccaccaaaccagtgggagttttccatccagattcctctgaggccagtagccgaaaaggggtgctcgatggttatggtgcgcggagaaacgaacaaaggcgttacccacagaaacgccccccatgggaggtggaaggggcccgtcccagacctggacggaatcccccaaagcaagaaggacacaggcacacaaacgccggccatagaaataatatgggtccgatccccaaagacgatctaaatgagaggcctgctaaaagcacatgcgactccgaaaatctggcagtgataaataagtcctcccgccgtgtcgatcaggagaaatgcacagtgagacggcaggatccgcaggtcgttagcccttttagccgtggaaagcaaaaccatgtcctcaaaaacgttgagacccatacgggcagtctgatcgaacaactcactacagagaagtatgaatgcatggtgtgctgcgagctcgtcagggtgactgcgcctgtttggtcctgtcaatcctgttatcatgtctttcacctgaattgtatcaaaaaatgggcacgcagtccggcttcgcaggccgacggacaatccggatggcgctgcccggcctgccaaaatgtgtccgcacacgtaccaaacacctacacctgcttctgtggcaaggttaagaacccagagtggagccggaatgaaataccccatagctgcggtgaggtgtgtcggaaaaagcagccaggccaagattgccctcactcgtgcaacctgctgtgccacccagggccatgcccgccttgtccagccttcatgactaaaacctgcgaatgcgggaggacccgccacacagttcgttgtggacaggccgtgagtgtacattgtagtaacccttgtgagaatatcttgaactgcggccagcatcagtgtgccgagctgtgtcatggaggacagtgccaaccttgccaaattattctgaaccaggtctgctattgtggcagcaccagccgggacgttctgtgtgggaccgacgtggggaagagtgacggatttggcgacttctcctgcctcaaaatctgcggaaaagatttgaaatgcggaaaccatacatgctctcaagtgtgtcacccacagccctgtcagcagtgccccagactgccacaactcgtgaggtgttgtccgtgcggccagacccccctgtcccagctgctcgagctcggaagctcctcccgcaagacatgcatggatccagtcccctcttgtggcaaagtttgtggtaaacccctaccctgtggaagcctcgattttatccatacctgcgagaagctatgtcacgagggagattgcggtccttgcagtcgaaccagtgtcatctcctgtagatgttcatttcgaactaaagaactcccttgcaccagtctgaaaagcgaagatgcgacctttatgtgtgacaaaagatgtaataagaagaggctgtgcggcaggcacaaatgtaatgaaatctgctgcgtggataaagagcataagtgcccactgatttgcgggcgcaagttgcgctgcggtctgcaccggtgtgaagagccctgccataggggtaattgccagacatgctggcaggcttcctttgacgagttaacctgtcattgtggggcttctgtgatatatcccccagtcccatgtggtacccgaccacccgaatgtacacaaacatgtgcacgtgtccatgagtgcgatcacccagtgtatcactcctgccacagtgaggagaaatgtcccccttgtaccttccttacccagaaatggtgtatgggaaagcacgagttccgttctaacatcccttgtcatctggtcgacatttcatgcggcctgccctgttccgcaacgttgccctgtggcatgcacaaatgtcagcggttgtgccacaagggggagtgcctagtggatgagccatgcaaacagccatgcacaaccccacgcgccgactgcggccacccatgcatggcgccgtgtcatacaagctcaccttgcccagtaacagcctgtaaggcaaaggtggagctacaatgcgaatgtggacggagaaaggagatggttatttgcagcgaggcctcttccacctaccaacggatcgccgctattagtatggctagcaagattactgatatgcagctgggtgggtctgtggagatatctaaactcatcaccaaaaaagaggtccaccaggcccgactggaatgtgacgaggagtgctctgccctcgagcgaaagaaaagactcgcggaggctttccatatatctgaggatagcgacccgtttaatatcagatcatccgggtctaagttcagcgacagtcttaaggaggacgcacgaaaggatctgaagttcgtgagcgacgtcgagaaagaaatggaaaccttggtggaggcggtgaacaagggcaagaacagcaaaaaatctcactccttccctcccatgaatcgggaccaccgccgcatcattcacgacctggcccaggtgtacggcctggaaagcgtgtcttatgatagtgagccgaagagaaatgttgttgtcacagctattcgtgggaagagcgtgtgtccgccaacaaccttaactggggtgcttgagagagagatgcaggcacgaccaccccccccaattccccatcatagacatcagtctgacaaaaatcctggatcctcgaacctgcagaagatcactaaggaaccgatcattgactattttgacgtacaggactag

SEQ ID NO: 20015 - DNA, 2391 bp, Artificial Sequence
  Description of Artificial Sequence: Synthetic coding sequence
atggccgaggccccccccgtgagcggcaccttcaagttcaacaccgacgctgccgagtttatcccccaggagaagaagaattctgggttaaattgcggcactcagcgaagattggactctaatcgaatcgggcgccgcaattattcctctccaccaccatgccatctcagccgtcaagtgccatatgatgaaatatcagctgttcatcagcatagctatcatccatcgggctctaagccaaaatctcagcaaacctcgtttcagtctagcccgtgtaacaagtcacccaaatcccacggcctccagaaccaaccctggcagaaacttcgcaacgagaagcatcacattagggttaagaaggcccagtcactcgctgagcaaaccagcgacaccgcgggcctggagtcttcaacacgctccgagtctggtaccgacctgcgtgaacattccccttctgagtctgaaaaggaagtcgtgggagccgatcccaggggagccaagcccaagaaagcaacgcagtttgtgtactcatacgggagaggacctaaagtcaagggcaaactaaaatgcgagtggagtaataggactacacccaagccagaggacgcggggccagagagcacaaagcctgtgggtgtgttccacccagattcctccgaagctagcagtagaaagggagtccttgatggttatggagctcgccggaacgagcagaggaggtacccacaaaagcgcccaccttgggaagtggagggcgcacgcccccgccccggcagaaacccgcccaaacaggagggacataggcatacaaatgccggtcataggaataacatgggcccaattcctaaggatgatctgaatgagcgacccgctaagagtacctgcgactctgaaaatctggcagtgatcaataagtctagtcggcgagtcgatcaagagaaatgtactgtcagacggcaggatccgcaggtggtcagcccattctcacgcggtaagcaaaaccacgttcttaaaaatgtggaaactcataccggtagcctgattgagcaacttactactgaaaagtacgaatgcatggtctgctgcgagctggtgcgcgtgacagctcccgtgtggtcctgccagtcatgttatcatgtgtttcacctcaattgtattaagaagtgggccagatcccccgcatctcaagcggatggccagtccggctggcgatgcccggcctgtcaaaatgtctccgcgcacgtaccaaatacatatacttgcttttgcggtaaggtcaagaatcccgagtggtccaggaacgagatccctcactcttgcggggaagtttgccgcaagaagcaaccgggacaggattgcccccactcctgcaacctcctgtgtcacccagggccctgtccaccctgccctgctttcatgacaaagacatgtgagtgtggccgtacgcgacatacggtgcgctgcggacaagccgtgagtgtgcactgtagtaacccttgcgagaacatcctgaactgcggacagcatcagtgtgccgagctgtgccatggggggcagtgccagccatgccagataatactgaaccaggtatgctactgtggatcaacttctagggatgttttatgtggtactgatgtgggaaagagcgacggattcggcgattttagctgcctcaagatatgcggaaaagatcttaagtgcggaaatcacacctgttcccaggtttgtcatccccagccctgccaacaatgcccaagactccctcaactggttagatgctgcccgtgtggccagacgcccctcagccagctccttgaactcggatcaagctctcgcaagacttgtatggacccggtgccttcctgtggaaaggtgtgcgggaaacctctgccctgcggcagccttgactttatccatacttgcgagaaactgtgccatgagggtgactgcggcccctgctcacgtacatccgtcatcagctgccgctgcagcttccgcactaaggagctgccctgtacttccttaaagtccgaggacgctacctttatgtgtgacaaacgctgcaacaaaaagagactgtgtggacgccataaatgcaatgagatatgctgcgttgacaaagaacacaagtgccctcttatctgcggtagaaaactacgctgcggcctgcatcgttgcgaggaaccatgccacaggggcaattgtcaaacttgttggcaagcgagctttgacgagctgacatgccactgcggggcgagcgtcatttaccccccggtgccctgcggaacccgtcctccagaatgtacacagacttgcgctcgtgtgcatgaatgcgatcacccagtgtatcattcatgccactctaggagcgttcccctcgcattgtcctag

SEQ ID NO: 20016 - DNA, 1917 bp, Artificial Sequence
  Description of Artificial Sequence: Synthetic coding sequence
atgcaggtgagcagcctgaacgaggtgaagatctacagcctgagctgcgggaagagcctgccagaatggctttctgatcggaaaaagcgcgctttgcagaagaaagacgtcgatgtgcgtagacggatcgaactaatccaggacttcgagatgccaaccgtttgtaccacgattaaagtatcgaaggacggtcagtacatcctcgccactgggacttacaagcctcgcgttcgatgttacgacacctaccaactcagcctgaagttcgagaggtgcctggattcagaagtcgtgactttcgagatcctgtcagacgactactccaagatcgtgtttctccataatgacagatacatcgaattccattcacagtccgggttttactacaaaactcgtattcctaaattcggccgagactttagttatcactatccctcatgtgatctgtattttgtgggagctagtagcgaggtgtacaggctcaacctggagcaaggacggtatctgaatccactgcagacggatgccgcagagaataacgtgtgcgacatcaactccgttcacggcctgtttgccaccggtaccattgagggtcgtgtcgagtgctgggacccaagaacgaggaatcgggttggtctgcttgattgcgccctaaatagcgtcaccgccgacagcgagatcaatagcctgccgaccatatccgcccttaagtttaacggggctctgactatggccgtcgggactacaactggtcaggggaagatcttcacatcccttgagcctgagcacgacctgaacgatgtgtgcttgtaccccaactccggcatgcttcttaccgccaatgagacacccaagatggggatatattacatccctgtcttgggtccagcgcctcgatggtgtagttttctggataacttgaccgaggagctggaggaaaatcccgagtcaaccgtttacgatgactacaaattcgtgaccaagaaagatcttgagaatctaggcctgactcaccttataggctctcccttcctccgcgcctatatgcacggcttcttcatggatattcggctctaccataaagtgaagctgatggtcaatcctttcgcctatgaagaatataggaaagacaaaataagacaaaaaatcgaggaaactcgtgctcaaagagtgcagctgaaaaaactgcccaaggtgaacaaagagctggcactcaaactgattgaggaggaagaagagaagcaaaaatccacctggaagaaaaaagtgaaatcactacctaatattttgacagacgaccgatttaaggtgatgtttgaaaaccccgactttcaggtggacgaggagtcagaagagtttagacttctgaaccctctcgttagtaagatcagcgaaaaaagaaagaaaaaactgagacttctcgaacaacaggagctgcgggagaaagaggaagaggaggaaccggaagggaaaccaagcgacgcagagagcagcgaatcatcagatgatgagaaagcttgggtggaggaggtgcgcaagcagcgccgcttactgcagcaggaagaaaaggtaaagcggcaagaaagactcaaggaggatcagcaaactgtactgaaaccccagttctacgagattaaggctggagaggagttccgaagcttcaaggactctgccactaaacagaagctcatgaacaagaccctcgaagaccggctgaaaattgaggcgaagaatgggactctgagcgttagcgataccacagtcggctctaaacagctgacgtttacactgaagcggtcagagcagcagaagaaacagcaggaggctgagaagctgcataggcaggagagaaagaggctgcgccgaagcgcaggacaccttaaaagccgccataagaggggccggtcattccactag

SEQ ID NO: 20017 - DNA, 2067 bp, Artificial Sequence
  Description of Artificial Sequence: Synthetic coding sequence
atgcaggtgagcagcctgaacgaggtgaagatctacagcctgagctgcggaaagtccctgcccgagtggctgtcagacagaaagaaaagagcgttgcagaagaaagacgtcgacgtccggaggcggatcgaacttattcaggatttcgaaatgccaactgtctgcacaactatcaaggtgagcaaagacgggcagtacatacttgctaccgggacatataaaccacgcgtgcggtgctacgacacataccagctgtctcttaaattcgagaggtgcctggattctgaagtagtcacctttgagatcctcagcgacgattatagcaagatagtgttcctacataatgacaggtacattgagttccacagtcagtctggtttctattacaagaccagaattcccaagttcggcagggacttctcttatcactacccatcctgtgacttgtatttcgtcggtgctagctccgaggtgtaccgactcaacttggaacagggaaggtatcttaatccactgcaaaccgacgctgcggaaaataacgtgtgcgacattaatagcgttcacgggctttttgctacagggaccatcgaggggcgggtggagtgttgggatcctcgcacacggaacagggtgggactccttgattgtgcgttaaattctgtaaccgccgattcagaaatcaatagtttgccgaccatctccgcactgaaatttaacggcgcacttacaatggccgttggcaccacaacagggcaggtgcttctctacgacctccgctcggacaagcctttgctggtcaaggatcaccagtatggcctccccatcaagtcagtgcacttccaagattctttggatttgatcctgtccgcagatagccggattgtaaaaatgtggaacaaaaactctgggaaaatctttacatcactggagcccgagcatgatttaaatgatgtttgtctgtatcctaattcaggaatgctgctgaccgcaaacgaaactccaaagatgggcatatattatattcctgtcctgggccctgctcctcggtggtgcagcttcctggacaatctgacagaggagctggaggaaaatcctgaatctacagtatacgatgattacaaattcgttacaaaaaaagacctggaaaacctgggtcttacacatttaatagggtcaccctttctccgtgcgtacatgcacggtttctttatggacattaggttgtaccacaaggtcaaactgatggtgaacccatttgcgtacgaggagtacagaaaggataagatccgacaaaaaattgaggaaacaagggcccagcgtgtccaactgaagaaattgcccaaggtgaacaaggagttagccctgaaacttatcgaagaagaggaggaaaaacagaaatccacctggaagaagaaagtgaaaagcctccctaatatcctcacagacgatagattcaaggttatgttcgagaaccccgacttccaggtggacgaggaatctgaagagttcaggctcttaaacccactggtaagcaagatctcagagaagagaaaaaagaagctgagactcctagagcaacaagaactacgtgaaaaggaggaagaggaggagcctgaggggaaaccatccgacgccgaatcgtccgagagcagcgacgatgagaaagcttgggttgaggaggttcgaaaacagcgcagacttctacagcaggaagagaaggtgaaaaggcaggagcggttgaaggaggaccagcagaccgtgctgaagcctcagttctatgagatcaaggctggggaagagttcagatcatttaaggactcagccacgaagcagaaactgatgaacaagacactggaggataggctgaagattgaagccaaaaatgggacgttgtcagtctccgatactaccgtcggttctaaacagctcacattcacactaaagagaagcgaacaacagaaaaaacagcaggaggccgagaaacttcacaggcaagaacgcaagcgcttacggagaagcgccggccacctcaagtctagacacaagcgaggacgcagctttcattag

SEQ ID NO: 20018 - DNA, 1989 bp, Artificial Sequence
  Description of Artificial Sequence: Synthetic coding sequence
atgcaggtgagcagcctgaacgaggtgaagatctacagcctgagctgtggcaaatcacttccagagtggttatcagaccggaagaagagagcgctccagaagaaggacgttgacgtgcggaggcgaatagagctgatccaggacttcgagatgccgacagtctgcacaacaataaaagtgtctaaagacggccagtacatactggctactgtggttaccttcgaaattctatctgatgactacagcaaaattgtgttccttcataatgaccggtacatcgagttccactcccagtcgggattctattacaaaacaagaataccaaaatttggccgtgacttcagctaccattaccccagctgtgatctgtacttcgtgggcgctagtagcgaggtgtatcggctgaatcttgagcagggcagatacctgaacccactgcaaacggacgctgcagaaaataacgtatgcgacatcaacagtgttcatggattattcgccacaggcaccattgaggggcgcgtggagtgttgggatccacgcacacgaaacagagtgggactgctcgactgtgcactgaattctgtgacagcagactccgagattaacagtctgcccactatctccgcattgaagttcaacggcgcgctgactatggcagtcggaaccaccacaggacaagtcctcctgtacgatctgagaagtgacaagcccttgctggtgaaggaccaccaatacgggctgccaattaaatccgtgcactttcaggacagtttggaccttatattatccgcggattcccgaatcgtgaagatgtggaataagaacagtggcaagatctttacttctcttgaaccggagcacgatctcaatgacgtgtgtctttaccctaacagtggcatgttattgactgcgaacgaaactcctaagatgggcatctattacatccccgtgctcggtcccgcgcctcggtggtgctcatttctcgataatcttactgaagaactcgaagaaaacccagaatctacagtgtatgacgactataaatttgtcacaaagaaagacctcgagaatttaggcctgactcacctgatcggatccccttttttacgggcttatatgcatggatttttcatggatatccgactgtaccataaggtgaagctaatggtgaaccctttcgcatacgaagagtatcgtaaggataaaattcgccagaaaatcgaagagacacgggcccagcgggtgcagttgaagaagctgccaaaggtgaataaggagcttgccctcaagctgatcgaggaagaagaagaaaagcagaagtctacttggaagaagaaggtgaagtcccttcccaatattctgacagatgatcgcttcaaagtcatgttcgaaaatccagacttccaggtagacgaggagagcgaggagtttcgcctgctgaacccgttggtgtctaaaatttcggaaaagcgtaagaagaagcttcgtctgctagaacagcaggagctccgggagaaagaagaggaggaagagccagagggaaagccctcagacgccgagagcagcgaaagctcagatgacgaaaaagcctgggtcgaggaggtgaggaagcaacggaggctactccagcaggaggaaaaggtgaaacggcaggagagactgaaggaagatcagcagactgtcctgaagccccagttttatgagatcaaggctggggaggagtttcgcagcttcaaggactcagccaccaagcagaagctgatgaacaagactttggaggaccggctgaagatcgaagccaagaatggtaccctgtcagtcagtgatactacagttggatctaaacagctgaccttcaccctcaaacggtctgagcagcagaagaagcaacaggaggcagaaaagctgcatcggcaggaaaggaagcggctcaggcgctcagctggccacctgaagtctaggcacaaacgcggcaggagttttcactag

SEQ ID NO: 20019 - DNA, 1917 bp, Artificial Sequence
  Description of Artificial Sequence: Synthetic coding sequence
atgcccaccgtgtgcaccaccatcaaggtgagcaaggacggccagtatatcctggccacaggaacatataaacctagggtgaggtgttacgacacgtatcagctctctttgaagttcgaacggtgcctggatagcgaagtggtgacatttgagatcctgagtgacgattactctaagatcgtcttcctccataacgataggtacatagagtttcattctcagtcaggcttttactataagacgcgaattccaaaattcggacgtgacttttcataccattaccctagttgtgacttgtacttcgtgggggccagcagtgaagtctaccgcctcaatctcgagcagggccggtatctcaatcctctgcagacagacgcagctgagaacaacgtatgcgacattaactccgttcatggattgttcgctaccggaacgatcgaagggagagttgagtgctgggaccctcggacgcgcaaccgggtgggtctgctggattgcgccttgaacagcgtgaccgcagacagcgagatcaacagtctcccgaccataagtgccttaaaattcaacggcgcactcaccatggccgttggaaccactacaggacaagtcttgctgtatgatttacgatctgataagcccctcctcgttaaggatcaccagtacggccttccgataaagtccgtacatttccaagacagtctcgatctaattctttcagcagacagccggattgtgaaaatgtggaacaaaaacagtggtaaaatattcactagtcttgagccggaacatgacctcaatgatgtgtgcctgtacccaaacagcggaatgctccttaccgccaacgaaacacccaagatgggcatctattatatcccagtgctgggccctgctccccggtggtgtagcttcctggataatctcactgaggaactcgaagagaacccggagagcactgtgtacgatgattataagttcgtaactaagaaagatttggagaacctgggccttactcatctcatagggtccccttttctccgcgcatatatgcacgggttttttatggacattagactataccataaggtcaaattgatggtcaatccatttgcttatgaggagtacaggaaggacaagatcaggcaaaagattgaagagacccgcgcacaacgggtgcagctcaaaaaactgcctaaggtgaacaaggagctggccctgaagctgatagaagaggaggaggaaaagcagaaaagtacctggaaaaaaaaagtcaagtcactgccgaacatcctcaccgacgatcgattcaaggtcatgtttgaaaacccagatttccaggtggacgaagagagtgaggagtttcgacttcttaaccccctcgtgtccaagatatcagagaagaggaaaaagaaactgaggctgttagaacagcaggagcttcgcgagaaggaggaggaggaagaaccagaaggcaaaccatcagacgccgagagctccgaatctagcgatgacgagaaggcatgggtagaggaggtccggaaacagcgaagactactgcagcaggaggaaaaggtcaaacgacaagagcggctgaaagaagatcagcagaccgtactcaaaccgcagttctatgaaataaaggctggtgaagagtttcgatcttttaaagattccgctactaaacaaaagttgatgaataaaacacttgaggatcgcctgaagattgaagccaagaatggaacattatccgttagcgacactaccgtgggctccaagcaattgaccttcaccctgaaaagaagtgaacagcagaagaagcagcaggaggctgaaaagctgcaccggcaggaaagaaagaggctgaggcgaagcgcaggccacctcaagtcccgtcacaaaagggggcggtctttccactag

SEQ ID NO: 20020 - DNA, 2160 bp, Artificial Sequence
  Description of Artificial Sequence: Synthetic coding sequence
atggccgccctggaggaggagttcaccctgagcagcgtggtgctgtctgcaggccctgagggtctgctgggagtggaacagtctgacaaaacagatcagttcctcgtcactgatagcgggcggacagtgatcctttacaaagtttcagatcagaagcctttgggctcttggtcagtgaagcaggggcagattattacctgcccagctgtgtgcaatttccagacgggggaatacgtggttgttcatgacaataaagtcctgcgcatctggaataacgaggatgttaatctggacaaggtcttcaaggccactctgtctgccgaggtgtaccgcatcctctcggtccagggcaccgaaccactcgtgctgttcaaggaaggagctgttagaggcctggaggccctgttggcagaccctcagcaaaaaatcgaaacagtgatctcagatgaagaggttattaagtggaccaagttctttgtggttttccggcaccctgtcctgattttcatcaccgaaaagcatggtaactacttcgcctacgttcagatgttcaacagcaggattctgaccaagtacaccttgctgcttggccaagatgagaattctgtgattaagtccttcacagccagcgtggatcgaaagttcattagcctgatgagtttgtcctcagacgggtgcatatatgaaaccctgattcccataagacccgcagatcctgaaaaaaaccagtccttggtaaaatcactgctgctaaaagctgtggtcagcggcaatgccagaaatggcgtggcactaaccgcactggaccaggaccacgtcgccgtactgggctctccgctggcggccagcaaggagtgcttgtctgtgtggaacataaaattccaaactttacagacttctaaagagctcccccagggaaccagtggtcaattgtggtactatggagaacatctgttcatgctgcatggcaagtcactgacagtcattccctataagtgtgaagtctcgtcccttgccggggctctgggaaaactgaagcactcccaggacccaggcacacacgtggtgagccacttcgtgaactgggaaacaccacaggggtgcggcctggggtttcagaatagcgagcaatccaggagaatcttgcgaagacggaagattgaagtgagcctgcaacctgaggtcccgcccagcaaacagctgctgtccacgataatgaaagactctgaaaagcatatagaagtggaggtgcggaagtttctcgctctaaagcagacccctgacttccacactgtgatcggcgatacggttactggcctccttgagcgatgtaaggccgaaccatccttttacccgcggaactgcctgatgcagctgatccagacacacgttctctcttacagcttgtgccctgatcttatggagatcgcactgaagaagaaagacgtccaactgctgcagttatgtctgcagcagtttcccgacattcccgagtcagtgacctgtgcgtgcctgaaaatcttcctttccattggggacgactctttgcaagaaaccgacgtgaatatggagagcgtctttgactattccattaatagcgtccacgatgagaaaatggaggagcaaaccgagatcctgcagaacggtttcaatccagaggaggataaatgtaacaattgtgaccaggagctcaataagaaaccccaggatgaaaccaaagaatctacttcctgtcccgtcgttcagaagcgtgccgccttgttaaatgcaatccttcatagcgcctatagtgagactttcctcttacctcatctcaaggacatccctgctcaacatatcacgctcttccttaaatatctatacttcttatacctaaaatgttccgagaacgctacgatgaccctccccgggatacatccaccaacgctcaatcaaataatggattggatttgcttgctgctagacgcaaatttcactgtggtggtgatgatgcctgaggctaaacgcctgcttataaacctgtacaaactggtgaagtcccagattagtgtctattccgagctgaacaagattgaggtatccttcagggagctccagaagctcaatcaggagaaaaacaatagaggtctctactccatcgaagtcctcgagctgttctag

SEQ ID NO: 20021 - DNA, 1614 bp, Artificial Sequence
  Description of Artificial Sequence: Synthetic coding sequence
atgttcaacagccggatcctgaccaagtacaccctgctgctgggccaggacgagaatagcgtgattaaaagcttcaccgccagtgtggatcggaaattcatctcattgatgtcactttcaagtgacgggtgcatttacgagaccttaatcccaatcaggcccgccgatccagagaagaaccaatcccttgtaaagtcacttctgctcaaggctgtcgtctccggcaatgccagaaatggagtagcactgactgctctggatcaggaccacgttgctgtgctgggctccccactcgccgctagcaaggaatgcctgtccgtatggaatataaaattccagacgctacagacttcaaaggagcttcctcagggtacttcaggtcagttgtggtattacggagagcatttgtttatgctgcatggaaaatcactcacagtcattccgtataagtgtgaggtctcatccttggccggcgcactcggcaagctcaaacactcgcaggatccgggcactcatgtggtgagtcatttcgtcaactgggaaacccctcaggggtgcggattggggttccagaattcagaacagtcacgcagaatcctgcggcggcgtaaaatagaggtctctctacagcctgaagtcccacctagcaagcagctgctcagcaccataatgaaggacagtgagaaacatatcgaggtcgaagttcgtaagttcctggctctaaaacagacccccgactttcacactgtaataggcgacactgtgaccggtctgcttgagcgttgtaaggcagaaccaagcttttatccgaggaactgcctcatgcagctgatccagactcatgtccttagttacagcctgtgtcctgatcttatggagatcgcactgaaaaagaaagatgtccagttactgcaattatgcctacaacaatttcctgatatacccgagagcgtcacctgtgcctgcctgaagatctttctcagtatcggagacgactcgttacaggaaactgatgtgaatatggaatcagtgttcgattactcaatcaactctgtacatgatgagaaaatggaggagcagacagaaattctgcaaaacggtttcaaccccgaagaagacaaatgcaacaactgtgaccaggaactgaataagaagccccaggatgaaaccaaggagtcaactagctgtcccgtagtccagaagagggccgcactcttaaatgccatcctccactctgcgtacagcgagacgttcttgttgccgcacctgaaagatatcccagcccagcacattaccttgtttctgaaatacctgtattttctttacttaaagtgtagtgaaaacgcaacaatgaccctcccaggtattcatccccccactctgaatcagatcatggattggatatgcttacttttggacgcgaacttcaccgtcgtggtgatgatgcccgaggctaagcgactgctaatcaacttgtataagctggtaaagagccagatatccgtgtatagcgaactcaacaaaatcgaggtctcattcagagagctccagaagctgaaccaagaaaaaaataaccgcggtttatatagcattgaggtcctagagctcttctag

SEQ ID NO: 20022 - DNA, 642 bp, Artificial Sequence
  Description of Artificial Sequence: Synthetic coding sequence
atgggccggaacaagaagaagaagcgggacggcgacgaccggcggccccggttggtcttatcctttgatgaagagaaaaggagagagtacctcacagggttccacaagaggaaagtggagcggaaaaaagctgctatcgaagagattaaacaacggctgaaagaggaacagaggaagctgagggaggagcgccaccaagaatacctgaagatgctagctgaaagagaagaggccctggaggaagccgacgaattggataggctcgtgactgctaagaccgaatctgtacagtacgaccaccccaaccacaccgtcactgtgacaacaatctcagacttggatctttcaggtgccaggttgcttggcctgactcctccggaaggcggagccggtgaccgatccgaggaggaggcgtcctccactgagaagcctaccaaggccctcccgcgaaagagtagggatccactattgtctcagcggatcagctcacttactgccagcctgcacgctcactcaagaaaaaaagtgaagaggaagcaccctaggagggctcaggattcgaaaaagccccctagagctcccaggacgtccaaggcccaaagacgaagactgaccgggaaagccagacactccggagagtag

SEQ ID NO: 20023 - DNA, 642 bp, Artificial Sequence
  Description of Artificial Sequence: Synthetic coding sequence
atgggccggaacaagaagaagaagcgggacggcgacgaccggcggcctaggttggtcctaagcttcgacgaggagaaaaggcgcgagtatttaacgggcttccacaagcgcaaggtggaacggaagaaagccgccattgaggagataaaacagaggctgaaagaagaacagcggaagctgcgcgaagagagacatcaggaatacttgaagatgctggcagagagggaggaggccttggaggaggcagacgaattggatagactggtgacggcaaaaacggagtccgtgcagtatgaccatccaaaccacacagtgacagtcacaactattagtgatctagacctgtcaggagcacgactcctggggctgacaccgcccgaggggggtgcaggcgacagatcagaggaggaggccagttccaccgagaaacctaccaaggcgctacctaggaagagccgcgatcccttgctgtcccagagaatctcttctctgaccgcatctctgcacgcccatagtcggaagaaagttaaacgcaagcatcctaggcgtgctcaggattccaaaaagccccctcgcgctccacgtacctcgaaagcccagcggaggcgcttaacagggaaggcccgccactcaggggaatag

SEQ ID NO: 20024 - DNA, 1917 bp, Artificial Sequence
  Description of Artificial Sequence: Synthetic coding sequence
atggagagcgagcgggacatgtaccggcagttccaggactggtgcttgcgaacttatggtgactccggaaaaacaaaaactgtgacacgaaaaaaatatgaaaggatcgtgcagcttctgaatggctctgagtctagctctactgataatgcaaaatttaaattttgggtcaaaagtaaaggattccaactgggccaacctgatgaagtgagaggcgggggggggggggcaaaacaggtcctctatgtgcccgtcaagaccactgatggcgtcggtgtggacgagaaattaagccttaggcgggtcgccgtcgtggaagatttctttgacatcatttactctatgcatgtcgagactggccctaatggagaacagatccggaaacacgcgggacagaagaggacctacaaggctatttcagagtcttacgcctttctcccccgcgaggctgtgaccaggttcctgatgagctgctcagagtgccaaaagagaatgcaccttaaccctgatggtactgaccataaggataatgggaaaccacctaccctggtaactagtatgattgattataatatgcccatcacaatggcgtacatgaagcacatgaaactgcagcttcttaatagccagcaagatgaagatgagtcctctatagagagtgacgagtttgatatgtcagactcaaccagaatgagtgcagtcaatagcgatttaagcagcaacttggaggaacgtatgcagtcaccgcaaaatctgcatggacagcaagacgatgattctgctgccgaaagctttaatggcaacgagacgctgggccactcgtctattgcgagtggtggcactcacagcagggagatgggggacagtaacagtgatggtaagaccggcctcgaacaagatgaacagcctctcaacctctctgattcccccttgtctgcccagctcaccagtgagtataggattgacgaccacaacagcaatggcaagaacaaatacaaaaaccttcttatcagtgacttgaaaatggagcgagaagcccgcgaaaatggaagtaagagtcccgcccatagttattcctcctacgactcagggaagaatgaaagcgttgacagaggtgctgaggaccttagcttaaataggggggatgaagacgaggacgatcatgaagaccatgacgactccgagaaagtaaacgagactgatggagtggaggcagaacgtttgaaagcctttaacatgtttgtgcgccttttcgttgacgagaaccttgacagaatggtgcctatctcgaagcaacccaaagagaagattcaggcaatcatcgactcctgtagaaggcagttccctgagtatcaggagcgcgctagaaaaagaatccgaacctatctgaagtcctgccgcaggatgaagagatctggcttcgagatgtctcgacctatcccctctcatctcactagcgccgtggccgaaagcatcctggcaagtgcatgtgaatctgagagtcggaacgctgcgaagcgtatgagactggaacgacagcaggatgaaagcgctcccgcagacaaacagtgtaagcccgaagccacgcaggcaacttattccacttcagcagttcctggttcccaggacgtgctttacataaatgggaacgggacatattcataccatagctatagaggtttgggaggggggcttctaaacttaaacgatgcttcgtcatccgggcctaccgaccttagcatgaaaaggcaattagccacctccagcgggagcagctcgagttctaactccaggccccaactgagcccaacagagatcaatgcggtgagacaactggtagcaggctacagggaatcagcggctttccttcttaggtccgctgacgaacttgagaacctcatcctgcagcaaaattag

SEQ ID NO: 20025 - DNA, 1269 bp, Artificial Sequence
  Description of Artificial Sequence: Synthetic coding sequence
atgcacgtggagaccggccccaacggcgagcagatccggaagcacgcaggccagaagcgaacctacaaagcgatcagcgaatcttacgcctttttaccacgagaagcagtgactcgctttctaatgagttgcagcgagtgtcagaaaaggatgcacctgaatccagacgggacggaccacaaggacaatggcaaacctcccaccttggtgacgtctatgattgattacaatatgcctatcactatggcctatatgaagcacatgaaacttcagctgttgaactcccagcaggatgaggatgagagtagcatcgaaagtgacgagtttgacatgtccgattctactagaatgtctgctgtgaactctgatcttagttctaatctggaagaaaggatgcagtccccacaaaacttacacggtcagcaggatgacgactctgccgccgaatcattcaacggcaacgagaccctggggcactcaagcatcgccagcggtgggacgcactctagagagatgggggactctaactcggatggtaaaaccggcctcgaacaagacgaacagccactaaatctatcagacagccctctgagcgcccaacttaccagcgaataccgcatcgatgaccataacagtaacggtaagaacaaatacaaaaacttgctgatttccgatcttaaaatggagcgcgaggccagggagaatgggtcgaaatcaccggcccattcatactcttcttacgactccgggaagaatgagtcagtggacaggggagcagaggacctctcactgaatcgaggggacgaggacgaggacgatcatgaggatcacgacgattctgaaaaggtgaacgaaaccgatggagtggaagcagagagactgaaggcctttaatgatgagtcggcaccggctgacaagcagtgcaaaccagaagctactcaggccacctacagcacatctgctgttccaggctcccaagatgtgctctatattaacggaaacggaacgtatagttatcatagttaccgtggcctcggcggcggcctcctgaatcttaacgacgctagctccagcggcccaaccgacctgtccatgaagcgccagcttgccacctcctccgggtctagctcaagctccaactcacggccgcagctgtcaccaactgaaattaacgctgtgcggcagctagtggcgggctatcgtgaaagcgctgcctttttgctgagatctgccgacgagctagagaacctgatcttgcagcagaactag

SEQ ID NO: 20026 - DNA, 600 bp, Artificial Sequence
  Description of Artificial Sequence: Synthetic coding sequence
atggaccagaccatgctggacgacagcgccgccgagagcttcaacggcaacgagaccctaggtcatagttccattgctagtggaggaacccactctcgggaaatgggggactctaacagcgatggaaaaacgggactcgagcaggatgaacagcccttaaatctaagtgacagcccgttgagcgctcaactcacctccgagtatcgcatcgacgaccataatagcaatggcaagaacaaatataaaaatctgcttatcagcgatctaaaaatggaacgcgaggctagggagaacgggagcaaaagccctgctcattcgtatagctcatacgactcgggtaagaacgagtccgtcgatagaggcgctgaggacctgtcactgaatagaggcgatgaggacgaagatgaccacgaagaccatgatgatagcgaaaaagtaaatgagacggatggggtggaagctgaacggctcaaggcctttaactctcgacctatccccagtcatcttactagtgcagtggccgagtctatcctggccagcgcctgcgagagcgaatcacggaatgctgccaaaaggatgagactcgaacggcaacaatag

SEQ ID NO: 20027 - DNA, 1062 bp, Artificial Sequence
  Description of Artificial Sequence: Synthetic coding sequence
atgggcgacagcaacagcgacggcaagaccggcctggagcaggacgaacagcccttgaacctgtcagacagtcccctgtccgctcagctgacaagcgaatatcggattgatgatcataactcaaatggaaagaacaagtacaaaaatttgttgatttcagaccttaagatggaacgcgaagcaagagaaaatggatcaaagtccccagcacatagttatagttcttatgacagcggaaagaatgaatcagtcgatcgcggggctgaagacctgtcgcttaacaggggtgatgaggacgaagacgaccacgaggaccacgacgacagtgagaaagtgaatgaaaccgatggggtcgaggctgaacgtctgaaggcctttaatatgttcgtgcggctgtttgtcgatgaaaacctagataggatggtcccaatatcaaagcaaccaaaggaaaaaatccaggccatcattgactcctgtcgccggcagttccctgaatatcaagagcgggcccgcaagagaatccgaacatatctcaagtcttgtagacggatgaaaagatcgggattcgagatgtcccgaccaatccccagtcacctgacatctgctgtggccgagtcaattctcgccagcgcctgcgagtctgaaagccggaacgcggcaaagcggatgaggctcgaacggcaacaggacgagagcgcccctgccgacaagcagtgtaagcccgaggctacgcaagcgacctactccacatcagctgtccccggatcccaggacgtcttgtatattaacggcaacggtacatactcctatcattcatatcgcgggcttggggggggattgctgaacctgaatgacgcctcatcctccggtccaacagatctgtcaatgaaaagacagctggcgacatcctcgggctcatctagtagttccaactccaggcctcagctctctcccaccgaaatcaatgctgtgagacagctggtcgcgggctatcgggaatcagccgcctttctcctgcgaagcgccgatgagctggagaatctgatcttgcagcagaattag

SEQ ID NO: 20028 - DNA, 1260 bp, Artificial Sequence
  Description of Artificial Sequence: Synthetic coding sequence
atgagctgcagcgagtgccagaagcggatgcacctgaaccccgacggcacagatcacaaggataacgggaaaccccccaccttggtaacctcgatgatcgattataacatgccaatcaccatggcatatatgaaacacatgaagctgcagctcctgaacagccaacaggacgaagatgagtccagcatcgaaagcgatgagtttgatatgtcagattctacaagaatgtccgcagtcaactctgatcttagctctaatctggaggagaggatgcagtcaccccagaatctgcatgggcaacaagatgatgatagtgccgccgagtcatttaatgggaatgaaaccctgggccactcgtcaattgcttcaggaggcacgcacagtcgcgagatgggagattcaaattctgacggcaagacaggactcgaacaggacgagcagcccttaaatttgtccgattcacctctcagcgcccagttgacttccgagtaccgtatagacgatcataattctaacggaaagaacaagtacaaaaacttgctcatttcggacctgaagatggaaagggaagcccgggaaaacggttcgaaaagccctgcgcatagctattcttcgtacgacagtggaaagaatgaaagcgtggatcggggtgcggaggatttgtcgctcaacagaggagatgaagacgaagatgaccatgaggaccatgacgatagcgagaaagtgaacgagaccgatggcgtcgaggctgaacgtctcaaagcatttaactcacgcccaattccatctcacctcacaagtgccgtggccgagagcattctggcttctgcctgtgaatcagagagcagaaatgctgcaaagcgaatgcgactggagcgccagcaggacgagtccgctcctgccgataaacaatgtaaacccgaagcaacacaagccacatacagcacctccgcagttcctggatcacaagatgtgctttatatcaatggtaatgggacctattcctaccattcatataggggcctaggtggaggtctgttgaacctaaacgacgccagcagctctgggcctactgatttgagtatgaaacggcagctggcgacatcatccggatcgagttcctcatctaattctaggccacagctcagtccgaccgaaattaacgccgtgcggcagctggtcgccggctatcgcgaatcagccgcatttttgctgagatctgcagatgagctcgaaaacctgattctccagcagaattag

SEQ ID NO: 20029 - DNA, 1695 bp, Artificial Sequence
  Description of Artificial Sequence: Synthetic coding sequence
atggccgacctgatgcaggagaccttcctgcaccacgccaccgacggcgtgggcgtggacgaaaaactgagcctgaggagggtggccgtggtggaggatttttttgatatcatctatagcatgcatgtggaaacaggccccaatggcgaacagattcgcaagcatgctgggcagaaacggacctacaaagctatctcagagtcttacgcatttctgcctcgggaagcagtcaccagatttcttatgagctgttcagaatgccagaagcgaatgcacctgaatcctgacgggacagatcacaaggataatggcaagccaccaacactggttacaagtatgatcgattacaacatgcctataacgatggcctatatgaagcacatgaagttgcagcttctcaactcccagcaagacgaggatgagagctctatcgagagtgacgagtttgacatgtctgatagtacccggatgtcagcagttaactctgatctgtcgtctaacctggaagagagaatgcagagcccccagaacctgcatggccaacaggacgatgattccgcggccgagtccttcaatggcaatgagactttgggtcattcctcaatcgctagcgggggaacgcatagcagagaaatgggagacagcaacagcgatggcaagacgggacttgaacaggatgagcagccgctgaacctgtctgatagtccccttagtgctcagctgacttcggagtaccgtatcgacgatcataactctaacgggaaaaataagtataagaacttgttgatatcggacttgaagatggaacgagaggcccgggagaacggcagcaaatcacccgcacattcctactcttcctacgacagtggtaaaaatgaatctgtggacaggggtgcggaggatctttctctgaatcgcggcgatgaggacgaggacgaccacgaggatcacgatgactcggagaaggtgaacgagacagatggtgtagaggccgagagactcaaggctttcaatatgttcgtcagacttttcgtggacgaaaacctggaccgcatggtgcctatatccaagcagcccaaggagaaaatccaggccatcatcgattcgtgccgaagacaatttcccgagtaccaggagagggcaaggaaacggatcaggacttacttgaagtcatgtagaaggatgaagagatccggatttgaaatgtcccgcccaatccctagtcacctcacaagcgcagtggccgaatcgatccttgcgagcgcctgtgagagtgaatccaggaatgcagccaaacggatgcgcctggaacgccaacaggatgagtccgccccggccgataaacagtgtaagcccgaggctacccaggcgacatacagtacttctgcagtgcctggtagtcaggatgtgctatacatcaatggcaacggcacctacagttaccattcttatagaggcctaggcggcggcctgcttaatttaaatgatgcatcctcttctggcccaactgatctgtccatgaagcgacagctggctacgtcttcagggtcttcctctagtagcaactcacgtccccagctgagcccaacagagatcaacgcagtacgccagttagttgcaggctatcgagagtccgccgcgttcttgctgagatccgcagacgagctggagaatctcatccttcagcagaactag

SEQ ID NO: 20030 - DNA, 2109 bp, Artificial Sequence
  Description of Artificial Sequence: Synthetic coding sequence
atggccgacagcggcctgctgctgaagcggggcagctgccggagcacctggctcagagtgcggaaggctcgtccccagttgattctgagtagacgaccgcggcgtaggctgggatcacttcgctggtgtggtcgccggcgcctgcggtggaggctgttgcaagcacaggctagtggcgtggactggagagagggcgctcgccaggtcagccgggcagcggcagctaggaggcctaatacagccacaccctctcccataccaagccctacccccgcaagcgagcctgagtctgagcctgaactggagtccgccagtagttgtcaccgccctctcttgatccctcccgtacgccctgtgggcccgggcagagcactgctcctcctgccagtcgaacagggttttaccttcagtggcatttgccgcgtaacatgcctgtatgggcaggtgcaagtttttggttttaccatatcacaggggcagccagctcaggacattttcagcgtttacacccattcctgtttaagcattcacgctcttcactattctcagccggagaagtcaaagaaggagctgaaaagagaggctcggaacttgcttaaatcccacctaaacctggacgaccggagatggagcatgcagaacttcagcccacaatgtagtatcgtgctgctggagcatctaaaaactgccaccgttaactttatcacatcctatcccggttcctcatacatatttgtgcaagagtcccccacacctcagattaaacccgaatatcttgctctgcgcagcgtcgggattcggagggagaagaagcgcaaagggctgcagttgactgaaagtaccttgtccgccctagaagagctggtgaacgtcagttgtgaggaggtggatggctgccctgtgattctggtgtgcggctctcaggacgttggcaagagcactttcaatcgttacctgatcaatcatctcttgaacagtctaccatgcgtagattacctcgagtgtgacctggggcaaactgaatttacaccgcctgggtgtatcagcctcctcaacatcacagaacccgtgctgggacctccttttactcacttgcgaacacctcaaaagatggtttattacgggaaaccgagctgcaagaacaactacgaaaattacattgacatcgttaagtatgttttcagcgcctacaagcgcgagtcaccactgatcgttaatacaatgggatgggtatccgatcagggtctgctgttgctgattgatttaatcaggctcctgtccccaagtcacgtcgtccagtttcgctccgatcattctaagtatatgcctgacctcacacctcagtacgtggatgatatggatgggctatacacaaagtccaaaacaaagatgaggaaccgccggtttcgcctggccgcctttgccgacgcactggaatttgcggacgaagagaaggaaagcccagtcgaatttaccgggcacaaactaatcggcgtatacacggactttgcattcagaataacaccccgaaaccgggagagccacaataagatcctgagggatttaagtatcctttcctacctgtcacagttacagcctcccatgccaaaaccgctctctcccttgcattccctgacaccataccaggtcccattcaacgctgttgcactgaggatcacgcacagcgatgtcgcccccacccacatcctctacgccgttaatgcaagctgggtaggattatgcaagatccaggacgatgtccggggctacactaacgggcctatcttgctggcccagacgccaatttgtgattgtctaggttttggcatctgtagagggatcgatatggagaagaggttgtaccatatactgacaccagttccaccagaggaattacgaacagtgaactgcctgttggtgggcgcgatcgccatccctcattgtgtcctaaaatgtcagcgtggcattgaggggaccgtcccatacgtgaccactgattataactttaagctacctggcgcttccgagaaaatcggggctagagaacccgaagaggcccacaaagaaaaaccctatcgcaggcctaaattttgcagaaaaatgaaatag

SEQ ID NO: 20031 - DNA, 2583 bp, Artificial Sequence
  Description of Artificial Sequence: Synthetic coding sequence
atggccgccagccggagcgccggcgaggccggccccggcggcagccagggtcgtgtcgtgagaatgaaacggcgtggaggacgagggcctcgacgcggccctgcggggggtggcgaaaaggccctgaagcggttaaaacttgccgtggaagaattcgtccacgcgacctccgaaggggaggcaccaggcggctgtgagggcagaggcgcccccgtcagcttcagacccggcggaaggaaaagcaggaaggaacttcggaaagaaaaaaggcacctgcggaaagcgcgtaggctacagcgcactgccggcccagaacagggacccggcctcggaggaagatccggggctgaggaggcctctggccacagacaggacacggaggaacgggcgcggccagcgccttcgagggatccttcccccccccgcaagccgaggccaagtcgagtaaaggccaaagccaccgccgctactgcgaaaacccgcccaagtgctgctgccaccgctgccgctaggaagcgggcactactcgctgcgaacgaggaagaggacagagagattcgaaagcttgaaagatgcctgggcttgaacaagcgaaagaaaaaagacggctctagcagcgtgccgctctcattcgcacgcgacgggctcgattacatcctcggcgcattggaatctgggaagaactctgggctctatgattcatcaggcgaagaggaggaggacgccgggcagaccttgcctgagtccgatctggagtccgattcgcaagacgagtctgaggaagaggaggagggagatgtcgaaaaggaaaaaaaagcacaagaggccgaggctcagtctgaggacgatgatgaagacacagaggaggaacagggggaggaaaaggagaagggcgcacaagaaaagcgacgcggtaagcgtgtgcgatttgcagaagatgaggagaagagcgaaaattcatcagaggacggtgacattaccgataaatccctatgtggcagcggcgaaaaatatattccacctcatgtgaggcaggctgaggagactgtcgatttcaaaaaaaaggaagagctagagcgtctcaaaaaacacgtcaaggggctgctgaatagactgagtgaaccgaatatggccagtatctcaggccagctagaggagctgtatatggcccactctcgaaaggatatgaatgatacgctcacatccgccttgatgggtgcctgtgtaaccgcaagcgcaatgccatcaagattgatgatggagcacgtcctgctagtgtctatcctgcatcacaccgttgggatcgaagtaggcgcacatttccttgaggccgtagttagaaagttcgatgcgatctacaagtacggcagtgaaggcaaggagtgtgataatctgtttactgtaattgcccacttgtataatttccatgtggttcagtcacttctgattttcgacatcctgaagaagctcatcggtaccttcactgagaaggacatcgagctgattctcctcatgctgaaaaatgtgggattttctctccgaaaagatgatgccctctctcttaaggaacttattacggaggcccagactaaagcatccggtgctggatccgagttccaagatcagactcggattagatttatgctcgaaactatgcttgcactcaaaaataacgatatgagaaagatcccaggctacgaccctgaacctgtggagaagctgaggaaactgcagagagccctggtaaggaacgccggaagcggatccgaaacacagctccgtgtctcttgggactcagtacttagtgcggaacagactggtcgctggtggatcgtgggttctgcctggtccggcgcccccatgatcgacaactcacatcacacgcacctgcagaaacagcttgttgggaccgtgtcctctaagattctcgagctggccagaaagcagagaatgaatacagatatacggcggaacatcttctgcacaataatgacttccgaggactttttagatgcttttgaaaagctgttgaaactggggcttaaggaccagcaagaaagggaaatcattcatgtgctaatggattgttgcctgcaagagaagacctataatcccttttacgccttcctggccagcaagttttgtgagtatgaacgcagattccagatgacctttcaattctccatatgggacaaatttcgagatctggagaaccttccagccacaaatttctctaatctcgtgcatttggtggctcatctgctaaagaccaaatcgctgagtctcagtattctgaaggttgtggagtttagcgagctggacaagccccgtgttagattcttgcgaaaggttctcagtatcttgctgatggaaaccgaggtcgaagacttgagtcttatctttacgcgcgtgtccgataatcccaagctgggagtattacgagaaggtcttaagctttttataagtcattttctgctgaaaaatgctcaggcccaccggagtgccgacgaggccaacgttctgagggagaaagctgatctggcaacaaaatgcctgcagggcaaagcttccttacggatgtag

SEQ ID NO: 20032 - DNA, 4917 bp, Artificial Sequence
  Description of Artificial Sequence: Synthetic coding sequence
atggccgccgccgccggcggcccctgcgtgcggagcagccgggagctgtggacgatcttgctcggccggagcgcgctgcgcgagttatcccagattgaagctgagttaaataagcactggcgcagacttttggagggcctcagctactacaagcctccatctcctagctcggctgaaaaagttaaagccaataaggacgtggcctcccctctgaaagaactgggcctgcggatttcgaaatttctgggtctcgatgaggagcagagtgtgcaactgctgcaatgttaccttcaagaggattatagaggtacccgtgattccgtgaagaccgttctgtacttcgagatggcccctagcgacttgctcgttctgacaaaaatgttcaaagagcaggggtttggttcccgacagaccaatagacacctggtggacgaaaccatggaccctttcgtggatagaataggttatttttctgctctgatcctggttgagggcatggacatcgagtccctacataagtgtgccctggacgaccgaagagaattgcaccaattcgcacaggacggtctcatctgccaggacatggactgcctgatgctgacgttcggtgacattccccaccatgccccagtcctgcttgcgtgggccttactcagacacacgctgaatccagaggaaacatcctccgttgtccggaaaatcgggggaactgccattcagctcaacgtatttcagtatcttacaagattacttcagagcttggcttccgggggtaacgattgtactaccagtaccgcttgcatgtgcgtgtacggtttactgtctttcgtgctcaccagcttggaactgcacactctgggcaatcaacaggatataatcgacactgcatgtgaagtgttagcggatccttcgcttccggaactgttttggggcacggagccaacgtcagggttagggattattctggactctgtctgtggcatgtttccccatctcctcagtcctctgctgcagcttttaagagcattagtgagtgggaagtccactgcaaagaaagtgtacagcttccttgacaaaatgagcttctacaatgagttatataagcataagccacacgatgttatttcccacgaggacggaactctgtggcgcaggcaaacacccaaactgctttaccctttaggaggccagacaaatttgcgtattccacaagggactgttgggcaggtaatgcttgatgaccgtgcctatcttgtgcggtgggagtacagttactcttcatggactctgtttacatgtgaaatagagatgctgttacacgtagttagcaccgctgatgtgatccagcattgccagcgcgtcaaaccgattattgatctggtgcacaaggtcattagtactgacctgtctatagccgattgcctcctccctataaccagcagaatctatatgctgctgcaaaggctcactacagtcataagtcccccagtggacgttatcgcctcctgcgtgaactgcttgactgtgctggccgcgcggaatcctgcaaaggtatggacagacctcagacatacaggcttcctgccattcgtggcacaccctgtgagttcattaagccagatgatctccgcagagggaatgaatgccgggggctatggcaatctgctgatgaattctgagcaaccacagggggaatatggcgttacaattgcgttcctgcgtctcattaccactctcgtgaagggccagttaggcagcacacaatcacagggcctcgttccttgtgtaatgttcgtattaaaggaaatgctgccttcttatcacaaatggcggtacaacagccacggcgttagggaacagatcgggtgccttatcttagagctgatccacgcaatacttaacctatgtcacgagactgatctgcattcctctcataccccttcactccagtttttatgcatatgctcacttgcatatacagaggccgggcagacagtaatcaacatcatggggatcggcgttgacacaatcgatatggtgatggccgctcagccccgtagtgacggcgcagagggacagggccaaggacagctgctcataaagactgtgaagctggcattcagcgtaacaaataacgttatccgactcaagcccccttcgaatgtcgtgtcaccgcttgagcaagctctcagccagcacggcgcacacggcaataacctgatcgctgtcttagccaagtatatttaccacaagcatgatccagcattacctcgcctggctattcagctgcttaagcgattagctactgttgctcccatgtccgtctacgcctgcctaggcaatgatgctgccgctatcagagacgcctttctgaccaggttgcaatctaagatagaagatatgcgcattaaagtcatgatcctcgagtttctcactgtggctgtggaaacccagccagggctaattgagttgtttctcaacttagaagtgaaggatggtagcgatgggagtaaggaattctctctgggtatgtggtcttgcctccacgcggtgcttgaactaatagactctcagcaacaagaccgatattggtgtccccctctgctgcaccgcgctgccatcgcctttttacacgccctctggcaggaccggcgcgattcagctatgctagtgctacggaccaagcctaaattttgggaaaaccttacgtctccactgttcgggacccttagtcccccttcagagacctctgaaccatcgatcttggaaacatgtgccctcataatgaagattatctgcctcgaaatctactacgtagtcaaagggtccctggaccagtcattgaaggacaccctaaaaaagtttagtatcgagaagaggttcgcatactggagcgggtacgtcaaatccctggcggtccacgtcgcagaaacagaaggaagcagctgcacgtcattacttgaataccagatgctcgtgtccgcgtggagaatgctgctgatcattgctacaactcatgcggatatcatgcacctgacagattccgtagttcggcgccaactctttctagacgtgctggatgggaccaaggcactcctcctcgtgccggccagtgttaattgcctgcgtctcggctcaatgaagtgtaccctgcttctcattctgttgaggcagtggaagcgagagcttggaagtgtggacgagatcctcggacccctgactgaaatcttggagggagtgctgcaggcagatcagcagctcatggagaaaactaaggccaaggttttttccgcttttatcacagtactacagatgaaggagatgaaagtctccgacatcccccagtactcacagttggtgctgaacgtgtgtgagacccttcaggaggaggtcatcgcgttgttcgaccagacaaggcactccctggccctggggagcgcaaccgaagacaaggacagcatggagaccgatgactgctccaggtctaggcatagagatcagagggatggagtgtgtgtccttggattgcatttagcgaaggagctctgcgaggtagatgaggacggtgacagctggctacaggtgacacggcgtctgccaatccttcccaccctgctgaccaccctggaagtgtccttgcggatgaagcagaatctgcatttcaccgaagccacattacatcttttactgacactcgcccggactcagcagggtgcgactgccgtggccggggccggtataactcagagcatctgcctgccattgctgagtgtttaccaactgagtactaacggaactgcccagactccatctgccagtagaaaaagtctcgatgcacctagctggcccggggtgtaccgtctcagtatgtctctgatggagcaattgctgaaaactctgaggtacaacttcctgcccgaggcactggattttgtgggcgttcatcaggaaagaactctccagtgtctcaatgcagttagaactgtccagtccttggcatgcctggaagaggcggaccataccgttggctttatccttcagctgagcaatttcatgaaggaatggcatttccatctgcctcagcttatgagagacatccaggtgaacctgggatatctgtgccaggcttgtactagcctccttcactcacgtaagatgcttcagcattaccttcaaaacaagaacggagacggactgccgtcagcagtagctcagcgggtgcagcgccctccaagtgcggcaagcgctgcaccctcctcctccaagcagcccgctgcagacactgaagcgtccgagcaacaggcgctgcacaccgttcagtacggcttgttgaagatactgagcaagaccctggccgccctgcgccacttcaccccagacgtgtgccagattttacttgaccaaagcctcgatttagcggaatacaacttcctttttgcgctgagctttacaacaccgaccttcgatagcgaggttgccccatctttcggtactcttttggccactgtgaacgttgcgttgaacatgctcggcgaattagacaaaaaaaaggagccgctgacccaggctgttgggctctcaacgcaggcggagggcactcgcacgttgaaatccctgctgatgtttacaatggagaactgcttttacctcctgatcagccaagccatgcggtatctgcgggaccctgccgtgcatcctcgggacaaacaacgtatgaaacaagagttgtccagcgagctatccacgctgctgagctcactctcacgctactttcggcggggggccccttcttctcccgctacgggtgtgcttccatctccgcagggcaaaagcacatcactgagtaaagcatctccagaatcccaggagcccttgatccagctcgtgcaggccttcgtgcggcatatgcagcgatag

SEQ ID NO: 20033 - DNA, 5250 bp, Artificial Sequence
  Description of Artificial Sequence: Synthetic coding sequence
atggccgccgccgccggcggcccctgcgtgcggagcagccgggagctttggacaatcctgctaggcaggtctgctcttagagaattaagccaaatcgaggctgaattaaacaagcattggaggcgactactggaaggcctgagttactacaagccaccaagccccagctcggccgagaaggtgaaagcgaacaaagacgtagcatctcctctcaaagagctgggattacgcataagcaaattcctgggactggacgaggaacagagcgtccagcttctgcaatgctatctgcaggaggactacagggggacgcgggatagcgtcaagaccgtcctgcaagatgagcgacaaagccaggcgctgatcttgaagattgctgattactactatgaggaaagaacttgcatactccgctgcgtcttacacttactcacatactttcaggatgagaggcacccctatcgggtggaatatgcagattgtgtcgataaactcgaaaaggagctggtgtctaagtaccgacagcaattcgaggagttgtacaagaccgaagcccctacctgggaaacacatgggaacctcatgacagaaaggcaagtcagcagatggttcgttcagtgtttgagagaacaaagcatgctgctcgagattatttttctgtattacgcctactttgagatggcgccatctgatctcctggtgctcactaaaatgttcaaagaacagggatttgggtctcggcaaacaaacaggcatctcgtggatgaaactatggaccccttcgtggatcggatcggctatttctcagccctgattctcgtagaaggcatggatattgaaagtctgcataaatgtgccttggatgaccgtcgtgaactccaccagtttgctcaggatggcctgatatgtcaggatatggactgcctaatgcttacatttggggacatcccccatcatgccccagtactcctggcctgggctctactaagacatacattgaatcctgaggagacctcatccgtcgtgaggaagatcgggggcacagcgattcagttaaacgtgttccagtacctcacaaggctgttgcaatcattggcctccggcggcaacgactgtacgacctccaccgcctgtatgtgcgtgtatggactgttgagctttgtgctgacgagcctggagctacatacactcggtaaccagcaggacatcatagatacagcatgcgaggttctggcggacccatcactgcctgagttgttttgggggaccgagcccacttctggtctggggattatcctggacagcgtgtgtgggatgttcccacacttactctctccgcttcttcagcttttgcgggctttggtatctggcaaatctacagccaagaaagtctactcctttctggacaaaatgtctttctataatgaactgtacaaacacaagccccatgacgttatatcacacgaggacgggactctgtggcgtcgccagacaccgaagttgctgtatcccctggggggacagaccaatttgcggatcccgcagggaacggtggggcaggtaatgctagatgaccgcgcttatctggtgcgttgggagtattcttatagcagctggaccttatttacttgcgaaatagaaatgctgctacacgtggtctcgacagccgacgtgatacaacattgccagagggtgaaaccgattatcgatctagtccataaagtcatcagcacggatttaagcattgctgattgcttgcttcccattacctctaggatttatatgctgttacagaggctgactactgtgatttccccccccgtggatgttattgcgtcctgtgtgaattgcctcaccgtgcttgccgctcgcaacccagcaaaggtgtggacagatctgcgccatacaggcttcctgccattcgttgcacacccagtttcgagtttgtcccaaatgatctccgccgagggtatgaatgctggcggctatggtaacctgctgatgaactccgagcagcctcagggcgagtacggggttactatcgcttttctgcggctgattacaacactggtcaaggggcagctcgggtccacccagtcgcaaggcctggttccttgtgtgatgtttgttctgaaggagatgctgccctcctaccataagtggaggtacaatagccacggagtcagggaacagattggctgcttaatattagaactaatacacgccatcctgaatctttgtcacgaaaccgacctgcactcctcccacactccttcactgcagttcctctgtatctgttcattggcctacaccgaagccggccagactgtcataaacatcatgggcattggcgtggatacaatagatatggtcatggccgcccagccgcgttcagacggggctgaggggcagggacagggtcagctgcttattaagactgttaaactcgccttttctgtcaccaataatgtgatccgacttaagccccccagcaatgtggtgagcccgttagagcaagcgttatcccagcacggggctcatggtaacaacctcatcgctgtgctggccaaatatatctaccacaaacatgacccggcattgccacgactggctattcagctgctaaaacgtctggccactgtggccccaatgagcgtgtatgcctgtctggggaacgacgcagccgccatcagggatgccttcctgacaagactgcaatctaaaattgaggatatgagaattaaagtgatgattttggaattcctcaccgtagccgtggagacccagcctggactcattgaactcttcctcaacctcgaagtcaaagacggatccgatgggtctaaggaatttagcctagggatgtggtcttgcctgcacgccgtgctggaactgatcgattctcagcagcaggatcggtattggtgccccccgttgctccaccgggctgccattgctttcttgcacgcactgtggcaggataggagggattccgccatgctggttttaagaactaagccaaagttctgggaaaacctgacaagccccctttttggcactctttctcctccaagcgaaacaagtgaacctagcatactggaaacctgcgccctgattatgaaaataatctgcctggaaatttactacgtggtgaaaggttcacttgatcagtccctaaaggatacactcaaaaagttcagcatcgaaaagcgctttgcctattggtctgggtacgtgaagagcttagctgtgcatgtggcagagaccgaggggagttcctgcacctcattgctcgaatatcaaatgctggttagcgcttggaggatgctgctgataatcgctaccacccacgctgacattatgcatctcacagactccgtggtccgtcgccagctgttccttgatgtgctcgatggaaccaaagctctcctgcttgttcccgcaagtgtcaattgtcttaggctgggatctatgaagtgtactctgctgctgatcctactgcgtcaatggaagcgtgagctgggatcagtggatgagatactcggaccactgacagagatcctcgagggcgtactccaggctgaccagcaattgatggaaaagactaaagccaaggtgttttcagcttttatcactgtcctgcagatgaaagaaatgaaggtctcggatatccctcagtattcacagcttgtcctgaacgtctgtgagacattgcaggaggaggtgatcgcgctgtttgaccaaacacgacactctctcgctctgggttctgctacagaggacaaagatagcatggagacagacgactgcagccgttctcggcatagagatcagagggacggggtttgcgtgttaggcctgcacctcgcaaaggaattgtgcgaggtggacgaggacggagattcttggctccaggtaactaggagattgcccattctgcctacactactcacaacgctcgaggtaagcctgcgtatgaaacagaatctccacttcactgaggctactctgcacctgttgctcacgttggccaggacccagcagggggccactgcagtcgcaggcgctggaattacccagtctatttgcctgcccctgctgagcgtgtaccaactcagtaccaatggtaccgcccagaccccctctgcatccagaaagtctctggacgccccttcttggcccggcgtgtacagactctccatgtctttaatggagcagctgctgaagacgctaagatacaatttcctccctgaagctctcgattttgttggcgtgcatcaagagcggacactgcagtgtctcaacgctgtgaggacagtgcagtctttggcttgcctagaagaggcggaccatactgtgggatttattctccagctctccaacttcatgaaagaatggcatttccatctaccccagttgatgcgtgacatacaggtaaatttgggctatctgtgtcaagcctgtacgtctctacttcattcccggaagatgctgcaacattacctccagaataagaacggggatggcctgccatctgcagtcgcccaaagagtccaacggcccccaagtgctgccagtgctgccccctcgagctcgaaacagccggcggccgatactgaggcttcagagcagcaggccctgcataccgtacagtacggactgctgaaaatcctgtcgaagactctggcagctttgcgacacttcacgcccgacgtatgtcagatccttctagatcaatctctggatctcgccgaatacaacttcttatttgctctgtccttcactacccccacttttgactctgaagttgcaccttcctttggaacactgttggcaaccgtgaacgttgccctgaacatgctaggagagctggacaaaaagaaggaacccctcacgcaggctgtagggctctctactcaagcagaggggactagaactctgaagtctctccttatgtttacgatggagaactgtttctatctgctgatcagccaagctatgcggtacctcagggaccccgccgtccaccctagagacaagcagagaatgaagcaggagctgtcatctgagctttcgactcttctatcgtcactctcccgctattttcggagaggtgctcccagtagtccagcaaccggcgttttgcccagtccacagggtaaatcaacctccctgtctaaagcctccccagaaagtcaggaaccactgattcaacttgtgcaagcctttgttaggcatatgcaacgttag

SEQ ID NO: 20034 - DNA, 219 bp, Artificial Sequence
  Description of Artificial Sequence: Synthetic coding sequence
atgcagttcaccagcatcagcaacagcctgaccagcaccgccgccattgggctgagttttaccacttcaacaaccacaaccgcaacctttaccacaaataccaccacgaccatcacttcaggcttcaccgtgaatcagaaccagctgctcagccgggggtttgaaaacttagtcccatatacaagcacagtccgctttgttttctacatggagaagtag

SEQ ID NO: 20035 - DNA, 801 bp, Artificial Sequence
  Description of Artificial Sequence: Synthetic coding sequence
atgcagttcaccagcatcagcaacagcctgaccagcaccgccgccattggcctgtccttcaccacgtccactacaaccactgctaccttcacgactaacaccacaacaactattacatccggtttcacggtgaaccagaatcagctgctctcgagaggctttgagaacttggtaccttacacatccacagtttcagtcgtggccactcctgtgatgacgtacggccaccttgagggcctgattaatgaatggaatctggaactggaggatcaggaaaagtattttctcctacaagctacacaggtaaacgcgtgggatcataccctcatcgaaaacggcgagatgatccggatactccacggggaggtaaacaaagtcaaactggatcaaaagcggcttgagcaggagctggatttcatcctgagccagcagcaagagctcgaatttttgctgacctatttggaagaatccactagggaccaaagcggccttcattatttgcaagacgcagacgaggagcacgtggagatatacaggctggcagaatctatcgatgcccagcttaaacagatggctcaggatttaaaggatgtggtcaaccatcttaatactttcgaatcatcatcagacacaaccgatccgctacaccaaatctgtagaatactgaacgctcacatggactccctgcaatggatcgatcgaaattcaggtatgctgcggaggaaggtcgaagttgtaacgcgcgtgtttgaagattacagacacgaggagcatgcacacaacgtgaacacagcattctag

SEQ ID NO: 20036 - DNA, 555 bp, Artificial Sequence
  Description of Artificial Sequence: Synthetic coding sequence
atgcagttcaccagcatcagcaacagcctgaccagcaccgccgccattggtctaagcttcaccaccagcaccaccaccactgccactttcaccacaaacacaaccacaacaattacttcgggctttaccgtgaaccagaaccagctactctctcgcggcttcgagaacctcgtgccatacaccagcactgtgtctgtggtcgccacaccggtgatgacttatgggcatctagaggggctgatcaatgagtggaacctggagctggaggatcaagaaaagtatttcttgttgcaggccacccaggttaatgcttgggaccatacgctgatagaaaacggcgagatgatcaggatattacacggcgaagtcaacaaggtaaagctggaccagaaaagacttgaacaggaacttgatttcatcctatcacaacaacaagagctggagtttctcctgacctacctggaagagagtactagagatcaatccgggcttcattacctccaggatgccgatgaggaacatgtggaaatatctacaaggtctgccgagttctag

SEQ ID NO: 20037 - DNA, 411 bp, Artificial Sequence
  Description of Artificial Sequence: Synthetic coding sequence
atgcagttcaccagcatcagcaacagcctgaccagcaccgccgccatcggcctgtcgttcacaacttcaacaactactacagctaccttcacaaccaataccacgaccaccataacttccggattcaccgtgaatcagaatcagctcctgtctcgtgggttcgaaaatctggtgccatataccagcacagtcagcgtggtggcaacaccggtaatgacttacggccacttggagggtctgattaatgagtggaatctggagctggaggatcaggaaaagtattttctgctgcaagcaacacaagtgaatgcttgggaccacactctgattgaaaacggcgagatgatcagaatcctccacggtgaggtgaacaaagtgaaactcgatcagaagcgccttgagcaagaatag

SEQ ID NO: 20038 - DNA, 597 bp, Artificial Sequence
  Description of Artificial Sequence: Synthetic coding sequence
tgacccgtgatgacctacggccacctggagggcctgatcaacgagtggaatctcgagctggaagatcaagagaaatacttcttattgcaagcaacccaagtgaatgcctgggatcataccctgatcgagaacggcgaaatgataagaatccttcatggagaagtcaacaaggtgaaactggaccaaaagcgtttggagcaggagcttgacttcatcctctctcagcagcaagaattggagttcctgctcacctaccttgaagagagcacgagggatcagtctggactgcactacctgcaggatgcagacgaggaacacgtcgaaatatatcggttggcagagagtatcgacgctcagctcaaacaaatggcccaggatctaaaggacgttgtgaaccacctgaatacctttgagtcttcatccgatactaccgatcccctccatcagatctgtagaatccttaacgcacacatggattcactacagtggattgatcggaacagcggaatgcttcgccgcaaggtggaagtagtgacccgggtctttgaagactataggcatgaagagcatgcacataacgttaacaccgcattttag

SEQ ID NO: 20039 - DNA, 1383 bp, Artificial Sequence
  Description of Artificial Sequence: Synthetic coding sequence
atggccgagagcgagaaccggaaggagctgagcgagagcagccaggaagaagctggtaaccagatcatggtcgaggggctgggcgagcacctagagcggggcgaggatgccgctgcgggcctgggcgatgacgggaaatgtggggaggaggctgccgccggactcggcgaggagggagagaacggagaggacaccgcagctggatcaggcgaagacggaaagaaagggggggatacggacgaggattctgaggcggacaggcccaaagggttgatcgggtatgtgttagacactgactttgtcgagtccctgcccgttaaagttaagtatcgagtcctggccctcaaaaaactacagacccgcgcggccaaccttgaaagcaaattcctgcgtgaatttcacgatatagaaagaaagttcgcggagatgtaccaacccttgttagagaagagacgtcagattatcaacgccatttatgaaccgaccgaggaagagtgtgaatacaagagtgatagcgaggactgcgacgacgaggagatgtgtcacgaagagatgtacggaaatgaagaagggatggttcatgagtatgtggatgaagacgacggttacgaagattactactacgactacgctgttgaagaagaggaagaagaggaggaggaggacgatatagaggccaccggtgaagaaaacaaagaagaagaggaccccaaggggatcccagacttctggctgaccgtcttgaagaacgttgacacactaaccccactcatcaaaaagtacgacgagccaatcctgaagctgttgactgatatcaaagtgaaactgtccgatccaggagaacccctgtccttcacactggaatttcacttcaagccaaatgaatattttaagaacgagctgctgacaaaaacatatgtccttaagagtaagctggcttattacgacccccatccgtatcgggggactgctattgaatacagcacagggtgtgagatcgattggaacgagggaaagaacgtcaccctgaaaacaataaaaaaaaaacagaagcacaggatatggggcaccattaggacagttaccgaggactttcccaaggactctttctttaacttcttctcgccacacggcataacatcaaacggaagagatgggaatgacgattttctcctgggacacaacctgcggacctacatcatacctagatccgtcctcttcttcagcggggacgccttggaatctcagcaggagggagtcgtccgcgaagtgaacgacgctatatacgacaagattatctacgacaattggatggccgccatcgaggaagtcaaagcctgctgcaaaaacttggaggcactagttgaagatatagatcggtag

SEQ ID NO: 20040 - DNA, 957 bp, Artificial Sequence
  Description of Artificial Sequence: Synthetic coding sequence
atgtaccagcccctgctggagaagcggcggcagatcatcaacgccatttatgaacctactgaagaggagtgcgagtacaaatctgatagcgaagattgtgatgacgaagagatgtgtcatgaggaaatgtacggtaatgaggaggggatggttcacgaatatgtcgacgaggacgatggatacgaagattactattacgactacgcagttgaagaggaggaagaggaggaggaggaagacgacatcgaagctacaggagaggagaacaaggaggaggaggatccgaagggtattccagatttctggctgaccgtcctgaagaatgtggacaccctcacccctctaatcaagaaatacgatgagccaatcctcaagctgctaactgatatcaaggtgaagctatctgaccccggtgagcccctgagctttaccctcgaatttcattttaagccaaatgaatatttcaagaatgagctcttaacaaaaacttacgtcttaaagagtaagttggcttattatgatccacatccctatagaggcaccgctatcgagtacagtaccggttgtgagattgattggaatgagggcaagaatgttacattaaagacaatcaaaaagaaacagaagcataggatctggggtacgatcagaaccgtgaccgaggattttcccaaagatagcttctttaacttcttttctccacacggaattacttccaatgggagggacggcaacgatgacttcctgctgggccacaatctgcgaacgtacatcatcccacggtccgtgctgttctttagcggcgacgctttggagtcccagcaggagggcgttgtgcgggaagtcaacgacgcgatttacgacaagatcatttacgataactggatggcggccatagaggaggtaaaggcctgctgcaagaatttggaagctctagtggaagatatcgacagatag

SEQ ID NO: 20041 - DNA, 489 bp, Artificial Sequence
  Description of Artificial Sequence: Synthetic coding sequence
atgctgttcggccggatccccctgcggtacgccatcctgatgcagatgaggtttgatggacggctcgggttccccggggggtttgttgatacacaggacagaagtctggaggatggccttaatcgggagctgagggaagaactaggggaagcagccgccgcatttagggtggaacgcaccgattacagaagctcacacgtaggcagcggtccccgggtagtggcccacttttatgcaaaacgacttacgctcgaggagctgcttgcggtggaagccggagcgacgagggctaaggatcacggcctagaggtccttggtttagttagggtgcccttgtatacgctgcgagatggggtgggaggtcttcccacattcctagagaactcctttattgggtctgcccgcgaacagttacttgaagccctccaagatctgggtctgctacagtccggcagcatctccggactcaaaatccccgctcaccactag

SEQ ID NO: 20042 - DNA, 588 bp, Artificial Sequence
  Description of Artificial Sequence: Synthetic coding sequence
atggccggcgcccggcggctggagctgggcgaggccctggccctgggcagcggatggcgccacgcctgccatgcactgctttacgctcctgacccaggaatgctgttcggtaggatccctctccggtacgccatcctgatgcaaatgagatttgacgggagattgggttttcctggagggttcgtagatacccaggaccggagcctggaggacggtttaaaccgcgaacttagagaggagttaggcgaggcagccgccgctttccgagtagagcgtaccgactatcggagcagccacgtcggcagtgggccccgcgtcgttgcccacttctacgcgaagcgcctcactctagaggaattgctggctgtggaagccggcgctaccagggcaaaggaccacggcttggaagtacttgggttggttcgcgtgcctctgtacaccctccgggacggggtcggcggcctccccacttttctcgaaaactcgtttattggctcagcacgagagcagcttctcgaggccctccaagaccttgggctgctgcagtcagggtcaatcagcggcttgaagatccccgcgcaccattag

SEQ ID NO: 20043 - DNA, 480 bp, Artificial Sequence
  Description of Artificial Sequence: Synthetic coding sequence
atgcagatgcggttcgacggccggctgggcttccccggcggcttcgtggacactcaggatcgtagtttggaggacggccttaacagagagctccgcgaggagctgggtgaagccgccgctgcatttagagtcgaacggactgattaccggtcctcgcatgttggcagtgggcctcgcgtggtggctcatttttatgctaaacgactgaccttggaggagctgctggcagtcgaagctggcgctacacgcgccaaggatcacggtttggaggtactgggcctggtccgtgtcccgctctacactctgagggacggagtagggggtctaccgacattcctcgagaacagcttcatcggttctgcccgcgagcagttgttagaagctgcccttcacggtcctatgaaaaccgagatgcgaacactggtgctgggaagggagggaagaacctgggagtgttttctgatcggatctgagcgttag

SEQ ID NO: 20044 - DNA, 684 bp, Artificial Sequence
  Description of Artificial Sequence: Synthetic coding sequence
atggccggcgcccggcggctggagctgggcgaggccctggccctgggttcaggctggcgtcatgcctgtcatgccctgctatacgctccagacccaggaatgttgtttggacgaattccactcaggtatgcgatcctgatgcaaatgcggtttgacggaagactgggctttcccggcgggttcgtggacacacaggaccgatctctggaggacggactcaatagagaactcagagaagaactcggcgaggctgcggccgctttccgtgtggaaaggactgactaccgctcttcccatgtcgggtctggtccaagagtcgtagcccatttttacgccaaaaggttaacgctcgaagaacttctcgctgtggaggccggagctacaagagccaaggatcacggccttgaggtagggcccgcctgggactcggtgccttttcctatctcctcttctccgaaagcgttttcccccccccgcaaacatccatggcgtaaagtttttgctcctctgaccctgcccagccctcagttgtcatggtggtcttgggaccgcgaccacctttactctgagctcgtcctgccaacctgggcattctgcaagggcctgtcccatccgctacccggagagatactgagccgcacccatagcagtatgagtctctgttgcagcctcttgaccgtctag

SEQ ID NO: 20045 - DNA, 768 bp, Artificial Sequence
  Description of Artificial Sequence: Synthetic coding sequence
atgctgcggccccagcggcccggcgacctgcagctgggcgccagcttgtacgagcttgtggggtatcggcagcctcccagcagcagctcttcctctacgtcctcgacctcgagcacttctagcagcagtactaccgccccgctcttgcctaaggctgcccgtgagaagcctgaggcaccggcggagcctcctggtccaggaccggggtccggcgcacatccgggtggttctgcacgacctgacgccaaagaggagcagcagcaacagttgcggagaaaaataaatagccgggagcggaagaggatgcaggacctgaaccttgccatggacgccctgcgggaagtgattttaccatattcagcagcccactgccagggtgctcctggccgtaagcttagtaagatcgctacactgctgctggcccgtaactacatactgcttctgggttcctcactccaggagctccgacgcgccctgggcgagggagctggacctgccgctcctcgcctcctgctggcaggcctgcctctactcgccgccgcgccaggcagtgttctcctggcaccaggagctgtgggcccccctgacgctttgcgacccgcaaaatacttatcattagcactggacgaacccccttgtgggcagttcgccctcccagggggaggagctggaggccccggcctttgtacttgtgcggtatgtaagttcccgcacctggtgccggcttccctggggctggcggcagtgcaagctcagttttccaagtag

SEQ ID NO: 20046 - DNA, 816 bp, Artificial Sequence
  Description of Artificial Sequence: Synthetic coding sequence
atgtactacgccgtgagccaggcccgggtgaacgccgtgcccggcacaatgttgcggccccagagacccggtgatctgcaacttggagcaagcctgtacgaactcgtgggctataggcaaccgccttcttcttcctcatcttcaactagtagcactagtagtacatcctcatcctcgaccacagcacctcttttacccaaggctgctcgagagaaaccagaagccccggcggaaccccctggtccgggaccaggatccggcgcacacccaggtggctccgcgcggcctgatgctaaggaggagcaacagcaacagctgcggaggaagatcaactccagggagagaaaacgtatgcaggaccttaatctggcaatggacgccctgcgggaggtaatacttccatactcggcagcccattgtcagggcgcccccggcaggaaattgtcgaagatcgccactctacttttggcaagaaactacatactgctgttgggtagctctctgcaggaattaagacgcgctctcggggagggcgctggcccagccgccccgcggctattgctcgcgggcttgccgctgttggctgcagcccctggatctgtgctgttggcccccggcgccgtggggcccccagacgcactgagacctgcaaaatacctatcactagctctagatgaacccccctgtggacagtttgctctccctggaggaggcgcaggaggccccgggctttgtacctgcgcggtatgcaagtttccacacctggtcccagcatctcttgggctggctgcggtgcaggcccagtttagcaaatag

SEQ ID NO: 20047 - DNA, 99 bp, Artificial Sequence
  Description of Artificial Sequence: Synthetic coding sequence
tgaggccccggcctgtgcacctgcgccgtgtgcaagttcccccacttggtgcctgcttctcttggattagcagccgttcaagcccagttttctaaatag

SEQ ID NO: 20048 - DNA, 1485 bp, Artificial Sequence
  Description of Artificial Sequence: Synthetic coding sequence
atggagctgagcctggagagcctgggcggcctgcacagcgtggcccacgcacaagctggcgaactgctcagcccagggcacgctcggtctgcagccgcacagcaccgcggactggtcgctccaggacgccccgggctcgtggctggtatggctagcctgctggatggcggtgggggggggggcggcggaggtgctgggggcgcaggcggtgcaggttccgccggtggcggcgccgattttcggggcgaactggcaggcccactccacccagcaatggggatggcctgtgaggcacctggtcttggaggtacatatacaactctcacccccctgcagcacctccctccattagctgctgtcgcggataagttccaccagcacgctgcagccgcagccgtagctggagcccacggcgggcatcctcacgcccatccgcaccctgctgctgctcccccaccgccaccccctccacagcggctggctgcctccgtatctggatcttttaccctcatgcgcgacgagcgcgcagctctggcgtctgtggggcacctgtacgggccttacgggaaagaactgccggcaatgggaagccccctgtctcctctccccaacgcccttccccccgctctgcacggtgcgccacagccacccccccctcctccgccccccccgctcgcagcatacgggccgccagggcaccttgccggagacaagctgctcccccccgccgccttcgaacctcatgcagcactgctgggccgcgccgaagacgcgctcgcccgaggtctccctgggggcggcgggggaactggaagtgggggggcgggctccggatctgcagctggcctactagcacctctgggtggactggctgcggccggtgctcacgggccgcacgggggcggtggtggcccaggtggaagcggcggtggaccttcagccggtgccgctgctgaagagataaatacaaaagaggtggctcagcgcattactgccgaactgaagaggtactctatcccccaagccatttttgcacaacggatcctttgccgctcgcaggggacgctgagtgacctccttcgaaaccccaagccttggagtaagctgaagtctggccgagagaccttcagaaggatgtggaaatggcttcaggaaccagagtttcagcgaatgtcagcactccgactcgctgcgtgtaagcgaaaggaacaagagcaacaaaaggaacgcgctctccagccaaagaaacagcggctggtgtttaccgatctacagaggcggaccctgattgcgatcttcaaagaaaataagagaccatccaaagagatgcaggttaccatctcccagcaacttggcctggagttaaataccgtgagcaacttcttcatgaacgcccgaagacggtgcatgaatcgctgggcagaggaacccagcaccgcccctgggggtcctgcgggggcaaccgctacgttttccaaagcatag

SEQ ID NO: 20049 - DNA, 2922 bp, Artificial Sequence
  Description of Artificial Sequence: Synthetic coding sequence
atggccagcatcctggacgagtacgagaacagcctgagccggagcgctgtgctccaacctggttgtcccagcgtgggcattcctcatagcggctatgtcaatgcgcagctggaaaaagaggtgcctattttcacgaagcagcgaatcgacttcacaccttctgaacggattacatctttggtggtgtcatcgaaccagctctgcatgtctctgggcaaggacactctgctccgaatcgaccttggtaaagccaacgaacccaaccacgttgagttgggtcgcaaagatgatgccaaggtgcataagatgttcctggatcacactggcagtcatttgctgatcgccttgagttccactgaggtgttatatgttaaccggaatggtcagaaagtgaggcctctcgcgcgatggaaggggcaacttgttgaatcagtgggctggaacaaggccctgggtacagagtccagcacaggaccgattctcgtcgggacagcacagggacacatctttgaagccgagctatctgcctctgagggtggcttatttggacctgcccctgacctctattttaggcctttatacgtcctcaacgaagaaggggggcctgccccagtgtgctccttggaggcagagcgcggcccggacgggaggagtttcgtcatcgcgacgaccagacaaagactgtttcagtttattggccgggcggctgaaggtgcagaagctcagggctttagcgggttattcgccgcttatactgaccaccctcccccctttagagaattcccgtcaaacctgggttactcggagcttgcattctacactcctaagctacggagtgctccccgggcattcgcctggatgatgggcgatggcgtgctgtatggcgcactcgattgtggccggcccgacagccttctctcagaggagcgtgtttgggagtacccagagggggtcgggcctggcgcctctccgcctcttgccatagtacttacccagttccattttctgctgctgctggcagatagggttgaggcagtttgtaccctcacagggcaagtggtcctacgcgatcactttctggagaagtttggcccccttaagcatatggtcaaggattcttctactggacagctttgggcctacaccgagcgtgcggtgtttcgttaccatgtgcagagagaggcgagggacgtctggagaacctatcttgacatgaaccggtttgaccttgccaaagagtactgcagggagcggcctgattgcctggataccgtgctggcacgggaggccgacttctgcttcaggcagcgccgatacttagagtctgccaggtgctacgctctcactcagtcctacttcgaggagatagcgctcaaatttttggaggctcggcaggaggaggcgctggcggagttcctacagaggaaactagccagcctaaagcccgccgaacggacacaggccaccctcctcacaacctggctaactgaattatatttgagtagactcggggcgcttcagggcgatcctgaggctcttaccctgtaccgggagaccaaggagtgcttccgaacgtttctgtctagcccaaggcataaagagtggctttttgcttcccgcgcttccatccacgaattactggcttcgcacggtgacaccgagcatatggtatactttgccgtaatcatgcaggattatgaacgagtggtggcctatcactgccaacacgaggcatacgaggaagccctcgccgtgcttgctaggcatcgggaccctcagcttttctacaagttttccccgattcttatccgacacattccaaggcagctcgttgatgcctggatagagatgggctcccggctagacgcacggcagctgattcccgcacttgttaactatagtcagggaggagaggtgcaacaggtgtcccaggccatccgctacatggagttctgcgtgaacgtactgggagaaacggagcaagcgatccacaactacctcctgagtctttatgctcgcggcaggccggactcccttctcgcctacctcgagcaagcaggcgcctccccccatcgcgtgcattacgaccttaaatacgctctgcggttgtgtgctgagcacgggcaccatcgagcctgtgttcacgtgtacaaggtgttggagttgtacgaggaggctgtcgacttagctcttcaagtagacgtggacctggccaaacagtgtgctgacctccctgaggaagatgaagagttgcgaaagaagctctggctcaagattgcacgccatgtggtccaagaagaggaagacgtgcagacggccatggcttgcctcgccagttgccccctgctcaagatcgaggacgtcctgcccttttttcctgatttcgtgactatcgaccacttcaaggaagccatatgttcgagcctcaaggcctacaaccaccatattcaggagttgcagagagagatggaggaggcaactgcaagcgcgcagcgcattagaagagacctgcaggagcttcggggccgctacggcacagtggagcctcaagataaatgcgcgacatgcgactttccactcctgaataggccattctatctcttcctttgtggccacatgtttcatgctgattgtttgctgcaagccgtcagacccggtttacctgcctacaagcaggccaggctggaggagcttcaacgaaaactgggagccgccccacctcccgcaaaaggttccgcacgggcaaaggaagcagagggtggagcagctaccgcgggaccctctcgcgagcaacttaaagccgacctggatgagctcgtggccgcagagtgtgtgtattgtggtgagctgatgataaggagtatcgatcgcccttttattgatccacagagatatgaggaagagcaactgtcttggttatag

SEQ ID NO: 20050 - DNA, 828 bp, Artificial Sequence
  Description of Artificial Sequence: Synthetic coding sequence
atgcccaaggtgttcctggtgaagcggcggagcctgggcgtgagcgtgcgctcatgggacgaactgccagatgagaaacgcgccgatacatatatcccggtggggctaggcagactcctgcatgatcccccagaggattgtaggtcagatgggggctcgagcagcggctctgggtcctcatctgccggtgagcccggcggcgctgaatcatcatccagtccccacgccccagaaagcgagacccctgagcccggagacgctgaaggacctgacgggcatctcgccacgaagcagcgtcccgtcgccaggtctaagatcaagttcacaactgggacctgctctgactcagtagttcattcatgtgacctctgtggaaagggttttcgactgcagaggatgctaaatagacaccttaagtgccacaaccaggtgaaaagacacttatgtactttctgtgggaaaggtttcaacgacacattcgatctgaagaggcatgtgagaactcacactgggattcggccatacaagtgtaacgtttgtaacaaggcctttacacagcggtgcagtctggagtcacatttgaaaaagatacacggcgtgcaacaacagtacgcctataagcaaaggcgggataaactctatgtctgcgaggattgcgggtacaccgggccaacccaggaagacctgtatctgcacgtcaatagtgcacaccccgggtcctcgttcctcaaaaaaacatccaaaaaactcgccgcactgctacaggggaaattgacttccgcacaccaggagaataccagccttagcgaagaggaagagcgcaagtag

SEQ ID NO: 20051 - DNA, 1269 bp, Artificial Sequence
  Description of Artificial Sequence: Synthetic coding sequence
atgcagaacagccacagcggcgtgaaccagctgggcggcgtgttcgtgaatggtcgtcctctgcccgattcaacacggcaaaagattgttgagttagcgcacagtggggcaagaccatgtgacatctcacgcatcttacaggtcagcaacgggtgcgtaagcaagatcctgggcaggtactacgagactgggagtattaggccccgcgcaatcggaggatcaaaacccagagtggctacacctgaggtggtgagcaaaattgctcagtacaagcgcgagtgtccatccattttcgcatgggaaatccgagaccggctgctcagtgaaggtgtctgtacaaacgataacattccttccgtgagttctataaacagggtcctgcggaaccttgcctcagaaaaacagcagatgggagcagatggaatgtatgataaattgagaatgctaaacggtcagaccgggtcgtggggtactcgtccaggttggtaccctgggacgtcagtaccaggtcagcctactcaggacggatgccaacagcaggagggggggggtgagaacacgaattccattagcagcaacggagaagattcggacgaggctcagatgcgcttgcagctcaaacggaagctgcaaagaaaccgcacttcttttacccaggagcagattgaagcgttagagaaggaattcgaacggacacactacccagatgtgttcgctcgtgaacgactagctgcaaaaattgatctgccggaggcacggatacaggtgtggttcagcaatagacgcgcaaaatggaggagggaggaaaaattacgcaatcaacgcagacaggcatcaaatactccatcccacatacctataagcagttcatttagcacatctgtgtatcagcccatacctcaacccaccactcccgttagtagctttacttcggggagtatgttagggcggacagacactgccctgacaaacacatactcagctttgccaccgatgccgtctttcactatggctaataacctgccaatgcagccccctgtgccgagtcaaacatcgtcctattcatgcatgctcccgacctccccttcggtcaatggcaggtcctacgatacttataccccaccccacatgcagacccatatgaacagccagcccatgggcacctcagggaccactagcactggcttaatcagcccaggagtgtccgtaccagtacaggtcccgggttctgagccggatatgtcccaatactggcctcggctgcagtag

SEQ ID NO: 20052 - DNA, 1311 bp, Artificial Sequence
  Description of Artificial Sequence: Synthetic coding sequence
atgcagaacagccacagcggcgtgaaccagctgggcggcgtgttcgtgaacggccggcctttacccgactccacccgccaaaaaattgtggagctagcccacagcggagcaagaccctgtgatatctcacgaatcctgcagacccatgcggacgccaaggtgcaggttctggataaccagaacgtgtctaatgggtgcgtatcgaagatcctggggaggtattacgaaaccggctctatccgaccacgcgctattggaggttctaaaccacgcgtggccactcccgaagttgtgagcaaaatcgcgcaatacaaaagagaatgcccttctatttttgcctgggagattcgggatagactgctgtctgagggggtgtgcaccaacgataatattccgagcgtgtcttcaattaatcgcgtgttgaggaatctggcaagtgaaaagcagcagatgggagctgatgggatgtacgataagttaaggatgctcaacggtcagaccggtagctggggcacccgtccaggctggtatcctgggacctcagtgcccgggcagccaacacaggacggctgccagcagcaggagggcggcggcgaaaacacaaacagtatctcttccaatggagaagattccgatgaagcccagatgagactacaactcaaacggaaactgcagcgaaacaggactagttttacccaggagcaaatcgaggctctggagaaagaattcgagcgaacccattatcctgatgtctttgctcgagagcggcttgccgccaagatcgatctgcccgaggccagaattcaggtgtggttctctaatcgaagggctaaatggaggagagaagagaaactgcgcaaccagaggcgtcaggcttctaacactccctcccatatcccaatcagcagctctttttcgacctctgtctaccagccgatcccccagcctacaactcccgtgtcctctttcaccagtggatccatgttaggccgtactgatactgctctcacaaatacttactccgccctgccacctatgccgtcgttcaccatggccaataatctgccaatgcaacccccagtcccatctcaaacatcaagttattcatgcatgctgccaacaagcccctccgtgaacgggcgaagctatgatacttatacacctccacatatgcaaacacacatgaactcacagcctatgggtacgtccggaaccacgagtactggattgatcagtcccggcgtatctgtaccggtccaagtccccggatcggagccggacatgagccagtactggccacggctccaatag

SEQ ID NO: 20053 - DNA, 1269 bp, Artificial Sequence
  Description of Artificial Sequence: Synthetic coding sequence
atgcagaacagccacagcggcgtgaaccagctgggcggcgtgttcgtaaatggcagacccttgccagacagcacccgccagaagatcgtggagctagcacacagtggcgcccggccctgcgacatctctagaatcctgcaggtgtctaatggctgtgtgagcaagattctaggccgttactacgagactgggtccattcggcccagagccatcggtggctctaaacctcgggtcgccactccagaggtagtatctaagattgctcagtacaagcgtgaatgcccaagcattttcgcctgggaaatccgcgatagactgctaagtgagggagtctgcacgaacgacaacatcccttcagtgtcttctattaatagagttttgagaaacctcgcaagtgaaaaacagcagatgggggccgacgggatgtacgataagcttcgcatgctcaatggccaaaccggttcctggggcaccaggcctggatggtacccaggcacgtcagtccccggccagcccacccaggatggatgccagcagcaggagggcggcggcgagaacaccaacagcatttccagcaacggagaagactccgacgaagctcagatgcggctccaactcaagcggaaactgcagcgcaaccgaacttcattcactcaggagcaaatcgaggcgctggaaaaggaatttgaaaggacacactatcctgatgtatttgcgcgagagagactggctgctaagatcgacctcccagaggcccggattcaggtatggttttcaaataggcgtgccaaatggaggcgggaagagaaactccgcaatcagcggcgccaagcaagcaacactccttcacacattcctatctcaagcagttttagtacctctgtctaccaacctataccacagcccactactcctgtttcttcttttacctctggaagcatgctgggacgcaccgacaccgccctgaccaacacgtactccgccctgccacccatgcctagcttcacaatggccaacaatttgcctatgcagccccctgttccaagccaaacctcgtcctactcttgcatgcttccgacttcccctagcgtgaacggaaggagctacgacacctatacacctccccacatgcagacacacatgaacagtcagcctatgggcacctcaggcactacttcgaccggactgattagcccaggagtgagcgttcccgtacaggtcccaggctccgaacctgatatgagtcaatactggcctaggttgcagtag

SEQ ID NO: 20054 - DNA, 1269 bp, Artificial Sequence
  Description of Artificial Sequence: Synthetic coding sequence
atgcagaacagccacagcggcgtgaaccagctgggcggcgtgttcgttaatggccgccccctgccggacagcactagacagaagatcgtcgaactggcacacagtggagcaagaccttgtgacataagcaggatccttcaagtcagcaatggatgtgtcagcaaaatactgggccgctactacgagacaggctcaatacgccctcgcgcaatcggcgggtctaagccgcgggtggccacacctgaagtggtgtctaagattgcccaatacaagcgggaatgcccttctatatttgcctgggagattagggatcgcctgctgtctgaaggcgtgtgtacgaacgataacataccaagcgtgagttcgatcaatcgggtgttgcgtaacctggcaagcgaaaagcagcagatgggggccgacggaatgtacgataaactgaggatgctgaacggtcagacaggctcgtgggggacgagacccggctggtacccgggcacatctgtccctggacagcccactcaagacggctgtcagcagcaggagggaggcggtgaaaacactaacagtatatcttctaacggggaggattcagacgaagctcagatgaggctgcagctcaaaagaaagctgcagcgcaaccgcaccagttttactcaggaacagatcgaggccctagaaaaggaattcgagcgtacgcactatcccgatgtgttcgcaagggaacggcttgctgcaaaaattgacttgcccgaagccaggatccaggtgtggttctcaaatcggcgcgccaaatggcggagggaggaaaaattgaggaaccagcggagacaggcttctaacaccccgtctcatattcctatttcttctagcttctctacctctgtttaccagccaataccgcagcctaccaccccagtgagtagtttcacgagcgggtcaatgctgggaaggaccgacaccgcccttaccaatacctattcagctctccccccaatgccctctttcacaatggccaacaacttgcctatgcagcccccggtgccatcccagaccagctcatatagctgcatgttgcctacatcaccatcagtcaacggtcgctcttacgacacctataccccccctcacatgcaaactcacatgaactctcaacctatgggaacatcaggcaccacttcaactggactgattagcccaggggtctctgtccccgtgcaagttcctggctctgaaccagacatgtcccagtattggccaaggctgcaatag

SEQ ID NO: 20055 - DNA, 1311 bp, Artificial Sequence
  Description of Artificial Sequence: Synthetic coding sequence
atgcagaacagccacagcggcgtgaaccagctgggcggcgtgttcgtgaacggacgtccgctgccagactctacacgccaaaaaatcgtggagctggcacattcaggcgcccgtccctgtgacatttcccggatcctccagacacatgccgacgcgaaggtacaggtccttgataaccagaacgtgtctaacgggtgtgtgtcaaagattcttggtcggtactacgagactgggagcatcaggccccgagccatcggcggaagtaagccacgggtggctactcccgaggtggtgtccaaaatcgctcagtataagcgtgagtgtccatccatcttcgcctgggaaattcgtgacagactgctttccgagggcgtgtgtactaatgacaatattccttctgtctctagcatcaacagggtactccggaacctggctagcgagaaacagcaaatgggggctgacggaatgtacgacaagttaaggatgcttaatgggcagactgggagctggggaaccagacctggctggtacccaggtacaagtgtccctggccaacctactcaagatggatgtcaacagcaggaagggggaggtgaaaacaccaactccatttcaagcaacggcgaagattccgatgaagctcagatgcgactgcagcttaagaggaaactacaacgaaataggacctctttcacccaggagcaaatcgaagcccttgaaaaggagtttgagagaacacactatcccgatgtgttcgcacgagagcgccttgcggccaagattgacctgccggaagcacgaatccaggtctggttcagcaatcgccgcgcgaaatggcgcagagaggaaaagcttcggaaccagaggcgacaggcctccaatacaccgtcccatatcccaatttctagcagttttagcacgtccgtttatcagcctatcccccagcccactacccctgtgagttccttcaccagcgggagcatgctgggaagaaccgacaccgccttaacaaacacctactctgcactcccccctatgccatcatttactatggctaataacctacctatgcagccccctgtgcccagccagacctcgagttatagctgcatgcttcccaccagcccgagtgtgaacggcaggagctatgatacgtacacccccccccacatgcagacgcacatgaatagtcaacctatgggtacatcagggacgaccagcactgggctcatatcccctggcgtgtctgtgccagtgcaagtacccgggtccgagccagatatgagtcagtattggcctagacttcagtag

SEQ ID NO: 20056 - DNA, 1269 bp, Artificial Sequence
  Description of Artificial Sequence: Synthetic coding sequence
atgcagaacagccacagcggcgtgaaccagctgggcggcgtgttcgtgaatgggcggcctctccccgactccacacggcaaaagatcgttgagttggcccactcgggggcacgtccctgcgacattagtcgaattctgcaagtaagcaacggctgcgtcagcaagatcctgggacggtactatgagaccggatccatcaggccaagagcaatcggtggttccaagcctagagtagcaactcctgaggtggtctctaaaatcgcgcaatacaaacgggagtgtcctagcatttttgcatgggagatcagagatagactgctgtctgaaggcgtttgcaccaacgacaacattcctagtgtgagttccatcaacagggttttgcggaacctggcttccgagaagcagcagatgggagcagatgggatgtatgataagctccggatgctcaatggacagaccggctcatggggtacccggcccggatggtaccctgggacaagtgtcccgggtcagcccacgcaggacggctgccagcaacaggaaggggggggagagaacaccaacagtatctccagcaatggcgaagattcagatgaggctcaaatgcgcttacagctgaaacgcaaactgcaacggaatcggacttcgtttacacaggagcagatcgaagcattagagaaagagttcgaacgcacacactaccctgacgtgtttgcaagagagcggctcgccgcgaagatcgacttaccagaagcccggatccaggtttggtttagcaataggagagcaaagtggagacgagaggagaagctgcggaaccaacggcgccaggcctccaataccccgtctcacatacccatcagcagtagcttcagcacttccgtctatcagccaataccacagcccactaccccggtctccagcttcacctcaggaagcatgctcgggagaactgacaccgccttaaccaacacctattccgctcttccccccatgccgagtttcaccatggccaacaacttacctatgcaacccccagtcccgagccagacaagttcttattcctgcatgctgcctacttctccatccgttaacggaagatcctatgacacttacacccctcctcacatgcagacgcacatgaacagccaacccatggggactagtggcactactagcacaggcctgatctcgcctggggtttcggtgcctgtccaggttcccgggagcgaacccgatatgtcccagtattggcccaggctccagtag

SEQ ID NO: 20057 - DNA, 1311 bp, Artificial Sequence
  Description of Artificial Sequence: Synthetic coding sequence
atgcagaacagccacagcggcgtgaaccagctgggcggcgtgttcgtgaacggcaggcctcttcccgactcaacaagacaaaagatagtcgagctggcccattccggcgcccgaccctgtgatatctcgcgaatactacagacccatgctgacgccaaggttcaggtattggataatcaaaacgtgtcaaacggatgcgtgagcaagatcctgggaaggtactacgaaaccggtagcatcagaccccgcgcgattgggggttctaaaccgagagtggccacacccgaggtggtatccaagatcgcccagtataagcgggagtgtccttccatctttgcttgggaaatcagagacaggctgttgtccgagggggtttgtaccaacgacaacatcccttccgtgagcagcataaacagggtcctgaggaacctggcaagcgagaagcagcagatgggagcggatggcatgtatgataagctcagaatgctgaatggtcagacaggatcttggggaacaagaccagggtggtatcccggaaccagtgtacccggccagccgacacaggatggctgccagcaacaggaaggaggtggcgagaacactaacagcatctcctctaacggggaggattccgacgaggcccagatgcgccttcagctgaaacgcaaacttcaacggaatcgcacgagctttacccaagagcaaatcgaggctctggagaaagagttcgagcgcacccattaccctgacgtttttgccagagagcgcctcgccgctaagatagacctgccagaagcgaggatccaggtttggtttagcaatagacgggccaaatggcgacgagaggaaaagctcaggaatcagaggcgccaggcctcaaatacgccctcacacatccccatatccagttcattttcaacttccgtctaccagccaatcccacagcctactacccccgtgtcgtcctttacaagcgggagcatgctcggccgaacagatacagcattaactaatacctattctgccttgccacccatgccttcatttactatggccaataatctgcccatgcagcctccagtgccttcccagacgtctagctactcctgtatgctcccaactagcccaagcgtgaacggcagatcatacgacacatatacgcccccacacatgcagacccatatgaattcccagcccatgggcacaagcggtacaacatcaaccggacttatctcaccgggggtctccgttccggttcaggttcctggctctgagccggacatgagtcagtattggccgcggttacagtag

SEQ ID NO: 20058 - DNA, 1269 bp, Artificial Sequence
  Description of Artificial Sequence: Synthetic coding sequence
atgcagaacagccacagcggcgtgaaccagctgggcggcgtgttcgtgaatgggcgccctctccccgactccaccaggcagaagattgtagaactggcgcactcaggggccagaccatgcgatataagcaggattctgcaggtgtctaatggctgtgtgtctaaaatattgggacgctattatgagaccggatcaataaggcctcgggccataggcggctccaaaccccgcgtggctacgcctgaggtggtgtccaagatcgctcaatataagagagaatgtccatcaattttcgcttgggaaattagagatcgactgctgagtgagggtgtgtgtacaaatgacaatattccctcagtgagttcaatcaaccgagtcctgagaaatttggcttcggagaagcagcagatgggcgccgatggcatgtacgataagctccgcatgctaaatggccagacaggctcgtgggggacccgcccaggatggtaccccggcaccagcgtgccagggcaaccgacccaggatggctgccagcagcaggagggggggggtgagaatactaactccattagttcgaatggagaagacagtgacgaggcccaaatgcgcctccaactcaagcgcaaactgcagcggaaccgtacatcctttacacaggagcaaatcgaagcgctcgaaaaggagttcgagaggacacactaccccgatgttttcgctagggagagactggccgctaaaattgacctacctgaggcgcgaatccaggtgtggttttccaatcgacgggccaaatggcgccgagaggaaaaactgcggaaccagcgcaggcaggcatctaacaccccaagccacatcccaatcagctcctcattctccacaagtgtataccagcctattccgcaaccaaccacaccagtgagctctttcacatcaggctccatgcttggacgcacagataccgcgctcaccaatacgtattccgccctgcctcccatgccatcgtttactatggcaaataacctgcctatgcagccgcccgtcccaagccagacaagtagctatagctgtatgctgccaaccagccccagtgtcaatggtcggtcttatgatacttatacaccaccacacatgcaaacgcatatgaattcacaacccatgggaaccagcggcaccacctctaccggcctgatttccccaggcgtttctgtaccggtgcaggtccccggttccgagcctgacatgtctcagtactggcctcgtttgcagtag

SEQ ID NO: 20059 - DNA, 1311 bp, Artificial Sequence
  Description of Artificial Sequence: Synthetic coding sequence
atgcagaacagccacagcggcgtgaaccagctgggcggcgtgttcgtgaatggtaggcccctgccagacagtaccaggcagaagatagtagagctggcccacagcggcgctagaccgtgtgacatctccaggatcctgcaaacacacgctgatgcaaaagtgcaggtgttggataatcagaacgtaagcaatgggtgcgttagcaagatcctcggccgctattatgagacgggatcaatcagaccccgagccatcggcggatcaaagccacgcgttgctactccggaagttgtgagtaagatagcacaatataaaagagaatgtcctagcatcttcgcatgggaaataagagaccggctactgtcagagggagtgtgtacaaacgataacattccatccgtgtcttccattaacagagtgctgagaaacctggcttccgagaaacagcagatgggggccgacgggatgtacgataagctacgtatgttgaacgggcagaccggctcgtggggcacccgacccgggtggtacccgggcaccagtgttccgggccagcccactcaggacgggtgtcagcagcaggaaggcgggggggaaaacaccaattctatttccagcaatggtgaggactccgatgaggcccagatgcgcctgcagctcaaaaggaaactgcagcggaaccgaacctccttcacacaagaacagattgaggccctggaaaaggaattcgagaggactcactatcccgacgttttcgcccgggaaaggctggctgctaagatcgacctacccgaggccagaatccaggtgtggttcagcaaccgcagagccaaatggagacgggaagagaagttgcggaaccagcgacgtcaagcaagcaacactccatctcacattccaatatcaagtagcttcagcacttctgtatatcagcccattcctcagccaaccactcctgtgagctcttttactagcggttccatgctagggcggactgataccgcgctgactaatacctactcagccctgccccctatgcccagcttcaccatggccaataacctaccaatgcagccccctgtgccttcacaaacatcatcctacagttgcatgctccctactagcccctctgtgaatgggcgttcgtatgatacatatacacctccccacatgcaaacccacatgaattcgcagccaatgggcacgagcggaacaacatcgacagggcttatatcccctggggtgtctgttcccgtacaggtgccaggttcagagcccgacatgagccagtattggccccgcctgcaatag

SEQ ID NO: 20060 - DNA, 201 bp, Artificial Sequence
  Description of Artificial Sequence: Synthetic coding sequence
atgcagaacagccacagcggcgtgaaccagctgggcggcgtgttcgttaacggaaggccactccctgatagtacgcgccaaaaaatcgtggaactggcacactcaggcgctagaccctgcgatatttcccgcatcctccagacacatgcggacgcaaaggtccaggtgctcgacaatcaaaatgtgtccaacggctgctag

SEQ ID NO: 20061 - DNA, 120 bp, Artificial Sequence
  Description of Artificial Sequence: Synthetic coding sequence
atgcagaacagccacagcggcgtgaaccagctgggcggcgtgttcgtgaacggccgaccactgccagacagcacccgtcagaaaattgtcgagttggcccacagtggggccaggccctag

SEQ ID NO: 20062 - DNA, 375 bp, Artificial Sequence
  Description of Artificial Sequence: Synthetic coding sequence
atgcagaacagccacagcggcgtgaaccagctgggcggcgtgttcgttaacggcaggcctctgccagacagcaccagacagaagatcgtggagcttgcacactcaggggctagaccctgtgacatttcccggattctgcaaacccatgccgatgccaaggtgcaggtcttggacaatcagaacgtatctaacggatgcgtgtcctccattaacagggttcttcgaaatctggcgagtgagaaacaacagatgggcgccgacggcatgtatgacaaactgaggatgctcaacggccagaccgggagttggggcactaggcccggctggtatcccggcacctcagtcccggggcagccaacacaggacggctgctag

SEQ ID NO: 20063 - DNA, 177 bp, Artificial Sequence
  Description of Artificial Sequence: Synthetic coding sequence
atgcagaacagccacagcggcgtgaaccagctgggcggcgtgttcgtgaatggccgccccctgcctgattcgaccaggcagaagattgtagagctcgcccattccggcgctcggccttgtgacatcagtcggatcctgcaggtcagcaatgggtgtgtgtcaaaaatactcggatag

SEQ ID NO: 20064 - DNA, 9 bp, Artificial Sequence
  Description of Artificial Sequence: Synthetic coding sequence
atgcagtag

SEQ ID NO: 20065 - DNA, 1134 bp, Artificial Sequence
  Description of Artificial Sequence: Synthetic coding sequence
atgcaggtgagcaacggctgcgtgagcaagatcctgggccggtactatgagactggtagtattcgcccacgcgccattgggggaagcaaacctagggtggctacacccgaggtggtcagtaaaatcgcccagtataaaagggagtgcccctccatctttgcgtgggaaattcgggacagactgctctcagaaggtgtttgcactaacgacaacatcccctccgtctcctcgattaaccgagtgctgcgtaatctggcatctgagaaacagcagatgggtgccgacggcatgtacgacaagctccgtatgctgaatgggcagaccggctcatggggaacaaggcctggctggtacccaggcacctctgttcccggacagcctacccaggacgggtgtcagcagcaggaaggcgggggcgagaataccaattccatctcttctaacggcgaagacagcgacgaggctcagatgcgcttgcagctaaagcgcaagctgcaacggaatagaaccagtttcactcaagagcagatcgaggcactggaaaaagagtttgagcggacgcattatccagatgtattcgctcgcgagcgcctcgctgcgaaaatagacctgcccgaagcccgcatccaggtatggtttagtaaccgaagagccaaatggaggcgggaggagaaactccgcaaccagcgtcgacaggcatcaaacacccccagccatatcccaatctccagctcattttccacctctgtctatcagcccatcccacaaccaaccaccccggtcagctctttcacatctgggagtatgctggggaggacggacaccgcgttaacgaatacctactctgccctgccaccaatgccatccttcaccatggctaataacctccccatgcagccacccgtgcctagccagacctcttcgtacagctgtatgctgccgaccagcccatcagtcaatggccgcagttacgacacttataccccgccacatatgcagacccacatgaactctcaaccaatgggcacatccggcactacttcgaccggactcatctctccaggcgtaagcgtgcctgtgcaggtaccaggctcagaacccgatatgtctcagtattggccgaggctgcagtag

SEQ ID NO: 20066 - DNA, 1389 bp, Artificial Sequence
  Description of Artificial Sequence: Synthetic coding sequence
atgagcagcgtgaagcggagcctgaagcaggagatcgtgacccagttccattgcagcgcggcagagggcgacattgccaaactgactggcattctctcgcacagtccctccttgctaaacgagacatcagaaaatggctggacagctttgatgtacgcggccaggaacggccacccggagattgtgcagtttcttctcgaaaaaggctgtgatagaagcatagtgaacaagtctcggcaaaccgctctggacatcgccgtgttctggggctacaagcatatagccaatcttctcgctaccgccaaaggcggcaaaaagccttggttcctgactaatgaagtcgaggagtgcgagaactattttagtaagactctccttgatagaaaatccgaaaagaggaataactctgactggctgttggcgaaggagtcacatcccgcaaccgtcttcattctcttctctgacctgaacccactcgtgaccctaggaggaaacaaggagtctttccagcagcctgaggtgcgcttgtgccagctgaactataccgatattaaggattatttagctcagccggagaaaatcaccctgatcttcttgggtgttgagctcgagattaaggataaactcctgaactacgcaggagaagttccccgagaagaagaagacggactggtggcatggttcgctttgggcattgatcccattgccgctgaagagtttaaacagcgacacgaaaattgctatttcctacacccgcccatgcctgcgttgctccaattaaaggaaaaggaagcaggggtagtggcccaggcacggtctgtgctcgcctggcacagcaggtataagttctgcccaacgtgtggaaatgccactaaaatcgaggagggcggctacaagcggctttgtctgaaggaggattgtccctctctgaacggcgtgcataacacctcctaccctagggtagacccggttgtaattatgcaggttattcaccctgacggcaccaagtgtttgctgggcagacaaaagagattcccccccggaatgtttacttgtcttgctgggttcatagagcctggcgagactatcgaagacgctgtgcggagagaagtcgaggaggaaagcggggtgaaggtgggccatgtgcagtacgttgcctgtcagccatggcctatgccttcgagcttgatgatcggatgccttgctttagctgtttccaccgagattaaggtggacaaaaacgagattgaggacgcaaggtggttcaccagagaacaggtactggatgtcctcaccaagggaaaacaacaggcattctttgtgccccctagtcgcgccatcgcccaccagctgattaaacactggatccgcatcaacccaaacttgtag

SEQ ID NO: 20067 - DNA, 84 bp, Artificial Sequence
  Description of Artificial Sequence: Synthetic coding sequence
atgagcccctgccccgaggaggccgccatgcggcgggaggtggtgaaacgcattgagaccgtagttaaagacctgtggccttag

SEQ ID NO: 20068 - DNA, 1095 bp, Artificial Sequence
  Description of Artificial Sequence: Synthetic coding sequence
atggccctggccctgctggaggactggtgccggatcatgagcgtggacgaacaaaaatcactcatggtgaccggtatccccgcagacttcgaggaagcagagatacaggaagttctgcaagagaccctaaagagcctaggccgctaccgtctcttggggaagatcttcaggaagcaggagaatgccaacgctgtcctactagaacttctggaagacacggatgtgagcgccatcccatcggaggtccaaggtaaggggggggtgtggaaagtcatctttaagacacccaatcaggacacagagtttctggagagactaaacttattcctggagaaagaggggcagactgtctccggcatgtttcgcgccctggggcaggaaggggtgagccccgcgacagttccctgcatttctcccgagctgctagcccacctcttgggccaggctatggcccacgcgccgcaaccactcctgccaatgcgctatcggaagcttcgggttttttccggatctgccgttcccgcacccgaagaggagtcatttgaggtgtggctggagcaagccaccgagattgtcaaagaatggcccgtgactgaggctgaaaagaagcgctggcttgccgagtcactgaggggccccgcacttgacttgatgcatatcgtccaagcagacaacccttctatctctgtggaagaatgcctcgaggcctttaaacaggtctttggaagcttggagagccgcagaacggcacaagtgaggtatctgaaaacgtatcaggaggagggggaaaaagtgagcgcctacgttctgaggttggaaactctgctccggcgggctgtggaaaaaagagctatcccccggaggatcgccgatcaagtgaggctcgagcaggtcatggctggggcgacgctgaatcagatgttatggtgtcgacttcgagagctcaaagaccaagggcctcccccttcctttctggaactgatgaaggtgatcagggaagaggaagaggaggaagcgagcttcgagaacgagtcaattgaggagcctgaggagagagatggctatggtcggtggaatcatgagggagatgactag

SEQ ID NO: 20069 - DNA, 1392 bp, Artificial Sequence
  Description of Artificial Sequence: Synthetic coding sequence
atgcccctgaccctgctgcaggactggtgccggggcgagcacctgaacacacgcagatgtatgcttatactaggtattccggaagactgtggcgaggacgagttcgaagagactttgcaggaggcatgccgtcatttggggcgctacagggtgatcggaaggatgttccggagggaagaaaacgcacaggccattttattagaacttgcccaggacattgattacgccttactaccacgcgagatccctgggaaaggaggcccttgggaagtgattgtcaaacctcggaacagcgatggcgaattcttgaaccggctcaacaggttcctcgaagaggagaggcgcacagtctcagatatgaatcgcgtcctagggagcgacaccaactgcagcgcaccgagggtgacaatctctcctgagttctggacctgggcccagacgttgggtgcagctgtgcagcctctgctggaacagatgctataccgagagttgagggttttcagtggaaataccatttcaattcctggagcattggctttcgacgcttggctcgaacacaccaccgagatgctccagatgtggcaggtgcccgaaggcgaaaagagaaggcgcctcatggagtgtctgagaggcccagcactgcaggtggtgagcgggctccgcgctagcaatgcctccattaccgttgaagaatgcttggccgcactccagcaggtgttcggcccagtcgagtcacataagatcgcccaggtgaaactgtgtaaggcttaccaggaagccggagaaaaggttagcagttttgtgctcaggcttgagcccctcctgcaacgggcagtggagaacaatgtagttagccgtcggaatgtgaaccaaactcgcctcaagagagttctcagcggggccactctccccgataaactccgggataagttgaaactgatgaagcagcgtaggaagccaccaggattccttgccttagtgaaattacttagggaagaagaagaatgggaagccacactagggcctgacagggagagtctcgagggcctggaagttgcacctcggccccccgcccggattactggagtgggtgctgtcccacttccagcctcagggaacagttttgatgtgagaccgtcccagggttatcgccggcggaggggacgaggacagcatcgcagggggggagtggctcgcgctgggagcaggggcagtaggaagagaaagaggcacactttctgctactcgtgcggagaagacggccatatccgcgtacaatgtattaacccgagtaacctgctcctcgtgaagcaaaagaaacaagccgcagtcgaaagtgggaacggcaattgggcctgggacaagtcccatccgaagtctaaagctaagtag

SEQ ID NO: 20070 - DNA, 1392 bp, Artificial Sequence
  Description of Artificial Sequence: Synthetic coding sequence
atgcccctgaccctgctgcaggactggtgccggggcgagcacctgaatactagaagatgtatgctgattttaggcatcccagaggactgcggagaagatgagtttgaggaaacattacaggaagcttgccgccatcttgggaggtatagggttatcgggcgaatgtttcgccgcgaagagaatgcgcaggccattttactcgagctggcccaggatatcgactacgccctgcttccaagagaaatacccggtaaaggaggtccttgggaggttatcgtgaagcccaggaacagcgatggagaatttctgaatcgattgaaccgtttccttgaggaggagcgccggaccgtcagcgatatgaatcgcgtgttgggctccgataccaactgctcagctcctagagttacgattagccccgagttctggacttgggcgcagacactgggcgcagccgtgcagccactccttgaacagatgttgtacagagaacttcgtgtgttttctggcaacaccattagcattcctggtgctttggccttcgacgcatggctagagcatacaacagagatgcttcagatgtggcaagtgcccgagggggagaagagacggaggctgatggaatgcttaaggggtcccgcacttcaggtcgtgagcggcctgagagcttctaatgcaagcattactgtagaggagtgtctggctgccttgcagcaggtcttcggccctgtcgaaagccacaagatagctcaggtaaagctatgtaaggcctaccaggaagccggggagaaagtttcaagctttgtgttgcgtctggaaccactgcttcagcgagcggtcgagaacaacgtggtcagccggcgcaatgtgaaccaaactcgcctgaaacgggttctttccggtgccacacttcccgataaactgcgtgataaactgaaactgatgaagcagcgaaggaaacctccaggtttcctggcccttgtaaaactcctgagggaggaagaggaatgggaggcaacccttggccccgacagagagtcactggagggacttgaggtggctcccagaccccccgctaggattactggggtcggagctgtgcctctgcccgcatccgggaatagctttgacgtgcgcccgagccagggctatagacggcgacggggcagaggacaacatcgccgcggaggtgtcgcacgcgcaggcagcaggggcagccggaaacgaaagaggcacactttctgttactcatgtggggaggacgggcacataagggttcagtgcattaaccccagtaatctgctgttggtgaagcaaaaaaaacaggctgccgtggaaagtgggaatggcaactgggcatgggacaagtcccacccgaaatctaaagcgaagtag

SEQ ID NO: 20071 - DNA, 1392 bp, Artificial Sequence
  Description of Artificial Sequence: Synthetic coding sequence
atgcccctgaccctgctgcaggactggtgccggggcgagcacctgaatactcgcagatgtatgttgatacttggtattccagaggactgcggtgaagatgagttcgaagagactctccaggaggcatgcaggcacttaggcaggtatagggtgatcggccgcatgtttcgccgcgaggagaacgcccaagccattctcctggagctggcccaagatatcgattatgcccttcttccacgcgagatacctggaaaaggtggcccatgggaggtgatcgtgaaaccaaggaactctgatggggagttccttaatcgtctcaacaggttcctggaagaagagaggcgcaccgtttccgacatgaatagggtattgggctctgacacaaactgctctgcaccccgggtgacaatatcgccagaattctggacatgggctcaaacgctaggcgcagcagtacagcctctgcttgagcaaatgctgtatcgggagctgcgggtgtttagcgggaatacgatcagtatacccggagccctggcgtttgatgcatggttggagcacaccacagagatgctgcagatgtggcaagtgcctgagggcgagaagcgcaggagactgatggagtgcctcaggggtcctgctctccaggtggtcagtgggctgcgcgcttccaatgcaagcattacagtggaagaatgtctggctgcgctgcagcaggttttcggccctgtagaatcacacaaaatcgcacaggtcaagttatgcaaggcgtaccaggaagctggtgagaaggtcagtagtttcgtgttgcgcttagagccgcttctgcagcgcgcggttgaaaataatgtggtgagccggaggaacgtgaatcagacgcggttgaagcgcgtgctttctggcgccaccctgcccgataagttgagggacaagctcaagctgatgaagcagcggcggaagcctccagggtttctagccttagtaaagttactcagagaagaggaagagtgggaggcaacactgggccccgatagagagagcctggagggtctggaggtggctccaagaccacctgcaaggataaccggtgtaggcgctgtaccactcccagctagcggtaactctttcgatgtgaggcccagtcaggggtacagacgcagacggggccgcggacagcacagacgaggaggagtcgctagggcaggcagcagaggcagccggaagcgcaagagacacacattttgctatagctgtggagaggacgggcacatcagagtgcagtgcataaatcctagcaacctgctccttgtgaaacaaaaaaagcaggccgcagtggagtctggcaacgggaattgggcctgggacaaatcccatcctaaatccaaagctaagtag

SEQ ID NO: 20072 - DNA, 759 bp, Artificial Sequence
  Description of Artificial Sequence: Synthetic coding sequence
atggagagcgagatggagacccagagcgcccgggccgaggagggctttacccaggtaactcgtaaagggggtcgccgagccaagaaacgacaggccgagcagctgtctgccgctggcgagggtggcgatgccggcaggatggatacagaagaagcccgccctgcgaagagaccagtgtttccacctctgtgtggggacggactgctcagtggcaaagaggagactagaaagatccccgtaccagctaatcgctacaccccactcaaggagaattggatgaagattttcacaccaatcgtcgaacacctcggattacagatacgctttaacctcaagtctaggaacgtggagataagaacctgcaaggaaacaaaagacgtcagtgctctgaccaaggccgcagacttcgtgaaggctttcatcctgggctttcaggtggaagatgctctagctctaatccggcttgatgacctgtttcttgaatcttttgaaatcacggacgtgaagccgctgaaaggtgatcacctgagccgcgcaattggacgcattgcgggaaaggggggaaaaacaaagttcaccattgagaatgtcacacggacaagaatcgtgctggctgacgtgaaagttcatattttggggtcctttcagaacataaagatggctcgaaccgccatctgtaacctgatcctggggaacccgccttccaaggtttatggaaatattagggccgtagccagcagatccgcagacaggttctag

SEQ ID NO: 20073 - DNA, 2322 bp, Artificial Sequence
  Description of Artificial Sequence: Synthetic coding sequence
atgaagatgcggggcgagaagcggcgggacaaggtgaaccccaagtccagccagcgcaaactcaactggatcccatcgttcccaacgtatgactattttaaccaggttactttgcaactcctagacgggtttatgatcactctgagtactgatggggtgataatctgtgtggctgagaacatctcttctttactgggccacctgcctgcggagattgtgggcaagaagctactctccttgctgccagacgaagagaaggatgaagtatatcaaaaaatcattttgaagtttccgctgctgaactccgaaacgcatattgaattctgctgccatctcaagcggggcaatgtcgagcacggcgactccagcgcctatgagaacgtcaaatttatcgtgaacgtgcgcgacatctgcaatgagttccccgtcgtgttcagtggcctgttcagttcccacctgtgcgcagacttcgcagcttgtgtccctcaggaagatcgcctgtatctagtgggtaatgtgtgcattttaaggactcaacttctgcaacaactgtacacttcaaaagcagtgagcgatgaggcggttttgacccaagacagcgacgaggagccttttgtgggcgagctgtcttccagtcaggggcagcgcggccacaccagtatgaaggctgtatacgtggagcccgcagccgccgcagccgccgctgccatcagcgatgaccagatcgatatcgccgaggtcgaacagtatggcccccaggagaatgtccatatgtttgtggactcagatagcacatattgctccagcacagtttttttggatacaatgcctgagtcaccagccttgagcttgcaggatttcagaggcgagcccgaagtgaacccgctgtacagggccgatcctgtggatctcgagttcagtgttgatcaggtcgactctgtggatcaagaggggcctatggaccagcaggatcccgaaaaccccgtcgcccctcttgaccaggccggactgatggaccccgttgatcctgaggacagtgtggatctgggggccgccggagcctctgctcagcccctgcagcccagctcacccgtcgcatacgatataatttcacaggaactggaactgatgaaaaaactaaaagagcaacttgaagaacgcacctggttgctgcacgacgccatccagaatcagcagaacgccctggagttgatgatggaccacctccagaaacaacctaataccttaagacacgtggtgattcccgatttgcagagttctgaggctgtgcccaagaagcagcaaaagcagcatgctggccaggtcaaaagaccactccctcatcccaaagacgtaaagtgtttttgcgggttgtcactctctaatagcctcaagaacaccggagaactgcaggagccctgtgtcgcttttaaccaacaacagctggtgcagcaagagcaacacctcaaagagcagcagcgccagctccgcgagcagctgcagcaattgagagaacagaggaaggtgcagaaacagaagaagatgcaggagaaaaaaaagctccaggaacagaagatgcaggaaaagaagaagctacaggagcagcggcgtcagaagaagaagaaattgcaggaacggaaaaagtggcagggccagatgctgcagaaggaacctgaggaggaacaacagaagcagcagctgcaggaacaacctctgaaacacaatgtaatcgtgggaaacgagcgagtgcagatttgcctgcagaacccaagggatgtatcagtccccttatgcaaccatccagtgagattcctgcaggcacaaccaatcgttccagtgcaacgggcagccgaacaacagccatccggcttttatcaagacgaaaattgtgggcagcaagaggacgagagtcagtctttttatcccgaagcttaccagggtcctcccgtaaatcaactcccattgatcgatacgtctaattccgaagctatctccagctctagcattccgcagttcccaatcacatccgattcaaccattagcacactggagaccccgcaagactatattcggctttggcaggaactgagtgattccctaggcccggtggttcaggtcaacacttggtcgtgcgatgaacagggcactcttcacgggcagccaacctatcaccaggtgcaggttagcgaggtgggcgtggaagggccacctgatcctcaagcttttcagggtcccgccgcgtatcagcccgatcagatgcgatctgccgaacagacccggcttatgcccgccgaacagagggattcaaataagccctgctag

SEQ ID NO: 20074 - DNA, 3069 bp, Artificial Sequence
  Description of Artificial Sequence: Synthetic coding sequence
atgttccgggaggtgaagtactacgccgtgggcgacatcgacccccaagtgatccagctgctgaaggccggtaaagccaaagaagtcagctataatgccctggcctctcacataatttcagaggacggcgacaacccagaggtcggtgaggcccgggaagtgtttgatctgccagtcgtgaaagttagcagtgaagatagaagtgcactttgggcgttggttaccttttacgggggagactgtcagctgaccctgaacaagaagtgcactcacctcatcgtgcccgagcctaaaggggagaagtacgaatgcgctctgaagagggcctctatcaagatcgtgacaccagattgggttttggattgtgtctctgaaaagacgaagaaagatgaggcattttatcatcctaggctcatcatatacgaagaggaggaggaggaggaggaagaagaagaagaggtggaaaatgaagagcaggacagccagaatgaaggaagtactgatgagaaatctagtccagccagttcccaggaggggtcgccttccggagaccaacagttctcccctaaaagcaacacagagaagtctaagggtgaattaatgttcgacgacagtagtgattctagtccagagaagcaagagcgaaatctgaattggacgccggctgaagtgccacaactggctgctgcgaaacgaagactccctcagggtaaggaaccgggcttgattaatctgtgcgccaatgtgccacctgtgcccggaaatattctgcctcccgaagtcaggggcaacctgatggcggccggccaaaatttgcagtccagtgaaaggagcgagatgatcgccacttggagtccggcagttcgcacactacggaatataaccaataatgctgacatccagcagatgaaccggcccagcaatgtggcccatattctgcaaaccttatctgcaccaacaaaaaacctcgagcaacaggtgaaccattcccaacaggggcacacaaacgctaacgcagtgttgttcagccaggtcaaggtgacaccagagacacacatgttgcagcagcagcagcaagcacagcagcagcagcaacaacaccccgtcctccacctacagcctcagcaaatcatgcaactacaacaacagcaacagcagcagatctcacaacagccatatcctcagcagcctccccaccccttctctcaacagcagcagcagcaacaacaggcgcacccacaccaatttagccagcagcagctgcagttcccccaacagcagctccacccaccacaacagctgcatcgtccacaacagcagctgcaaccgtttcagcagcagcatgcactgcaacaacagtttcaccagcttcagcaacaccagctgcagcagcaacagctggctcagctgcagcagcaacactcgctgctccagcagcaacagcagcagcagatccagcagcagcagctacagcgcatgcaccaacagcagcagcagcagcagatgcagagtcagaccgccccacacctgtcccagacatctcaggctttgcagcatcaggtacccccccagcagcctcctcaacagcagcagcagcagcagccccccccaagtccccagcagcaccaactttttgggcacgaccccgcagtggaaatacctgaagaagggttcctgctgggctgtgtgttcgccatcgcagactacccggagcaaatgtctgacaagcagcttctggctacttggaagaggattattcaagcacacgggggaactgtggatccaaccttcacgagcagatgtactcatctactctgcgaatcacaggtgtccagcgcctacgctcaggccatccgggagagaaagagatgcgtcacggcacactggttgaatacggtcctgaagaagaaaaagatggtgcctcctcaccgtgccctgcatttccctgtcgcgttcccacctggcggcaagccatgcagtcagcacattattagcgttacagggttcgtggattcagatagggatgatctcaagctgatggcttacctggccggtgcgaaatacactggttacctttgccgatctaatactgtcctcatctgcaaggagcccaccggcctcaagtacgagaaagcaaaggagtggagaatcccctgtgtgaacgcgcagtggctgggggatatcctgctgggcaattttgaagctcttcggcagatacagtactcacgttatactgctttctccctgcaggatccattcgctccaacacagcatttggtgttgaacctgctcgacgcttggagggttccactgaaggtgagcgctgagctcctgatgtccatccgtttaccccctaagctcaagcaaaatgaagtggcaaatgttcagccttcctccaagcgtgcacgcatcgaggacgttccccctcccacgaagaaacttactcctgagcttacccctttcgtgctgttcacaggctttgaacctgtgcaggttcaacagtatatcaagaagctatatattctgggtggagaagttgcagagtcagcccagaagtgcactcatctgattgcgtcgaaggttacacgcactgtgaagttccttactgccatttctgtcgtgaaacacattgtaacccctgagtggctggaagaatgtttcagatgtcagaagttcattgatgaacagaactacatcctgcgtgatgcagaagctgaagtcttattctctttctccttggaggaaagtttgaaacgggcccatgtgtcaccactctttaaggcaaaatacttctacatcacacctgggatttgtccaagtctgtcaaccatgaaagctatcgtcgagtgtgctgggggtaaggtgctctccaaacagccttcttttagaaagcttatggagcacaagcagaattcttctctcagtgaaatcatccttatttcttgcgagaatgatctacacttgtgccgagaatactttgcccggggtatagacgtgcacaatgctgagtttgtgctgacaggggtgttgacccagacacttgactacgaatcctacaagtttaattag

SEQ ID NO: 20075 - DNA, 2682 bp, Artificial Sequence
  Description of Artificial Sequence: Synthetic coding sequence
gtgcgggtgctgatccaggccggcgccctgtgctggagcctgcccgaactgtcccagggcgaagtgggcaaaggagcatgccccgcggaagtaggcaaacatcgtgaccacctgccatcttcggaccctgtgttgatgcaggccgaggcttctgtggttatgtgttgggtgagctctgaggatcgtagtgcactgtgggcattggtaactttctatggtggcgactgccagttaaccctgaacaaaaagtgcacacatctgattgttcctgagccaaagggggaaaagtatgagtgcgcactgaaaagggcctctattaagatcgtcacacctgattgggtgctggattgcgttagcgagaagacgaaaaaggacgaagccttctaccacccacgcctcatcatttacgaggaggaggaagaggaggaggaggaggaggaggaagtggaaaacgaggaacaggactcgcagaacgaggggagtacagacgaaaagagctctccagccagtagccaagaaggctcaccgtccggggaccaacagttttcaccaaagtctaacacggaaaagtccaagggggagttaatgtttgacgactctagtgacagttcgccggaaaaacaggaacgcaatctgaattggacaccagccgaggtgccccaactggctgcagctaaaagaaggctgccacagggaaaggagccaggactgataaacctgtgcgccaacgttcccccagtccctgggaacattctgccccccgaggttaggggcaatcttatggccgcaggacagaatctgcagtccagcgaaaggagcgaaatgatcgctacttggagcccggcagtacgtaccctccggaacatcacaaacaacgccgacatccagcagatgaaccgaccttccaatgtggctcacattttacagacattgagcgcgcccacaaaaaacctggagcagcaagtgaaccactcacagcaaggtcatactaatgccaatgccgtgctattttcccaggtgaaggtgacccccgagacacatatgctgcagcagcagcagcaggcccagcagcaacagcaacagcatcccgtcctacacctacagccgcagcagattatgcagcttcagcaacagcagcaacagcagatatctcagcaaccatacccccagcaaccaccacaccccttcagccagcagcagcagcagcagcagcaaccccccccttcaccacagcaacatcagctgtttggacacgaccctgcggtggaaatcccagaggagggctttctgctcgggtgtgtcttcgcaattgctgattaccccgagcaaatgtctgacaagcaacttctggccacatggaagagaattatccaagctcatggtggaacagtggatccaactttcacctccagatgcactcaccttctgtgcgaaagtcaggtgtcctcagcatatgctcaggccatacgcgagagaaagcggtgtgtcacagctcactggctcaataccgttcttaagaagaagaagatggttccccctcatcgtgccctgcacttccctgtggctttccctcccggcggaaagccgtgctcccagcacattatctctgtgactggattcgttgatagtgaccgggacgatctcaaactgatggcatatctggcaggtgcaaagtatacgggctatttgtgtcgatccaacacggtgctgatttgtaaggaaccgacaggactcaagtatgagaaggccaaagagtggagaattccctgtgtaaatgcccagtggctgggggacatccttctcggcaattttgaggctttgcgccagatccaatattcgcggtatactgcctttagtctccaggacccgttcgccccaacccagcacctggttctgaatttacttgatgcttggagggttccactcaaagtctccgccgaactgctgatgagcatcagactgccgcccaagctgaagcaaaatgaagtggccaacgtgcagccctcctccaaaagggccagaattgaagatgttcccccacctaccaaaaaacttactccggagttgacgccttttgtgctattcaccggtttcgaacctgtgcaggtgcaacagtatatcaaaaagctatatatcctgggtggtgaagtggccgagtcagcccagaaatgcacccaccttattgcctcaaaagtgacaagaaccgtcaaatttctgactgccatttccgtcgtgaagcatatcgtaacgccggaatggctcgaggagtgcttcagatgccagaagtttatcgatgaacagaattatattctgcgggatgccgaggccgaagtgctgtttagcttcagccttgaagagtccctgaagcgagcccacgtcagtccgcttttcaaggctaagtatttctacattaccccggggatctgccctagcctttcaacaatgaaagctattgtcgagtgtgccggaggcaaagtcctttcaaaacagccatcattccgcaagctgatggaacacaaacagaactcttctctgtccgagatcatccttatcagctgcgagaatgatctacacttgtgtagagaatattttgctagaggaattgacgtgcacaacgctgagtttgttctcaccggggtgctgacacagaccttagattacgaatcgtacaagttcaactag

SEQ ID NO: 20076 - DNA, 3210 bp, Artificial Sequence
  Description of Artificial Sequence: Synthetic coding sequence
atgagcgaccaggcccccaaggtgcccgaggagatgttccgggaggtgaaatactatgcagtgggcgacatcgacccacaggtaatccagcttcttaaagccggcaaagcgaaagaggtgtcctataatgccttggcgtctcacatcatctcagaagatggcgataatccagaagtgggggaagcacgcgaagtgtttgacctgcccgtagtaaagccaagctgggtgattctgagcgttcagtgcggtaccttactgcctgtgaacggtttctcgccggagagttgtcagatctttttcggcatcacagcctgcctcagccaggtgtcatctgaggaccgctccgcgctgtgggccctggtcacattctatggaggtgactgtcagttgactctgaataagaagtgcacacatttaattgtgcccgagcccaagggcgagaaatatgaatgtgccctgaagcgcgcctccatcaaaattgtgacccccgactgggtcctggactgcgtgtccgaaaaaaccaagaaagacgaggccttctatcatccacgcctgattatctatgaggaggaagaagaagaagaagaagaggaggaggaagttgaaaacgaggagcaggatagccagaatgaaggatcgacagacgagaaatccagcccagcctccagccaggaaggctcaccgtcaggtgatcaacaattctctccaaagtcaaataccgagaaatcaaaaggagagctgatgttcgacgactcatcagatagcagcccagaaaagcaggagagaaacctcaattggactcccgctgaggtcccacagctcgctgccgccaaacgtagattgccccaaggaaaggaacctggcctcataaacctgtgtgccaatgtcccacctgtgcccggtaacatcctgcctcccgaggtgcgaggcaatcttatggccgcgggccagaacctgcagagctcagaacgctccgaaatgatagctacttggtctcctgctgtgaggacattaaggaatatcactaacaacgctgacatccagcagatgaacagaccctcgaacgtggcccacattctgcagactctgtctgccccgaccaagaacttagagcagcaggtgaaccacagtcagcagggccacacgaacgccaatgccgtgctgttttcccaggtcaaagtcacccctgaaactcacatgcttcagcagcagcagcaggcacagcagcagcaacagcagcatcctgtgctccatttgcagccacagcaaatcatgcaactacagcaacagcagcaacagcagatcagccagcaaccatatcctcagcaaccacctcatcccttctcccagcagcagcagcagcaacaacaggcgcacccccaccagttctcacaacagcagttgcagtttccgcagcagcagttacatccccctcagcagctccataggccacagcagcagctccagcccttccagcaacaacatgcactgcaacagcagttccatcagttgcaacagcatcagctgcaacagcagcagctggcccagctgcaacagcagcacagccttttgcagcagcagcagcagcagcagatccagcagcagcagctccagcggatgcatcagcagcagcagcagcaacagatgcagtcccagactgccccccacctgagtcagacctctcaggccttgcagcatcaggttccccctcagcagccccctcagcagcagcaacagcaacagccaccaccaagccctcaacagcaccagctgttcggccacgatcccgccgtggagattccggaagaaggcttccttctgggatgcgtgttcgcgatagctgactaccctgagcagatgtctgataagcagttgctggcaacttggaaaagaatcatccaagcacacgggggcaccgtggatccgacctttactagtcgttgcacacaccttctctgtgaaagccaggtgtcctcagcctacgctcaggcaatccgcgagagaaaacgctgtgtgacagcccactggctgaacaccgtgcttaagaagaaaaaaatggttccaccccatagggcactccacttccctgtcgcctttccacccggcggaaaaccctgcagccaacacataatcagcgtaaccggcttcgtggattcggaccgcgatgacttgaagttaatggcctaccttgctggggccaaatacacaggctatctatgcaggtctaatacggtcctgatctgcaaagaacccaccggcctcaaatacgagaaagcaaaggaatggaggataccttgtgttaacgcccaatggttgggcgacatcctgttaggcaatttcgaggctctaagacagatccagtattcccggtacaccgctttctccttacaagatcccttcgcacctacccaacatctcgtgttgaatctactggatgcatggcgggtgccactcaaagtaagcgccgagctcctgatgtccattagactgcccccgaagttgaagcaaaatgaggtggcgaatgtgcagcctagttctaagagagcaagaattgaggatgtccccccccccactaagaagttgacgcccgagttgacaccctttgtactcttcacaggattcgaaccggttcaggtacaacaatacatcaagaagctctatatcctgggaggagaagtagctgaaagtgcgcaaaaatgtactcatctcatcgccagtaaagtcacacgtacagtcaagtttttaacggcgatcagcgttgtcaagcacatcgtgacccccgagtggttggaggagtgcttccgctgtcagaaattcatcgacgaacaaaactacattttgcgggacgcggaggccgaggtgcttttttccttctccctcgaggaatctctaaagcgcgcccacgtttcccctctcttcaaggcaaaatacttctatatcaccccggggatctgcccctccctgagcacaatgaaagctattgttgaatgcgcggggggcaaagtgctctcgaaacagccgtcgtttaggaaactgatggagcataagcagaatagtagtctttctgaaatcattttaatttcttgcgagaacgacctgcatctctgccgggaatatttcgctcgggggattgatgttcacaatgcggaattcgtactcaccggggttctgacacagacacttgattacgagtcgtacaaattcaattag

SEQ ID NO: 20077 - DNA, 3210 bp, Artificial Sequence
  Description of Artificial Sequence: Synthetic coding sequence
atgagcgaccaggcccccaaggtgcccgaggagatgttccgggaggtcaaatactacgccgtaggcgatattgatccccaggtgatccagcttctcaaggcaggcaaggccaaggaggtctcgtataatgcactcgcgtcccacattatctcggaggacggcgataatcctgaagtcggcgaagcgcgggaagtctttgacctgcccgtggtcaaaccaagctgggtcatactttctgtacagtgcggcacattactcccagtaaatggcttctcaccagagtcctgtcagatcttcttcggaataaccgcctgcttgtcacaagtgtcaagcgaagacaggtcagccctgtgggccttagtgacattctatgggggcgactgccagttaacgctcaataaaaaatgcacgcacctaatcgtgcccgaaccgaagggagaaaagtacgaatgtgctttgaagagagccagtattaaaattgtgacaccagactgggtacttgactgcgtgagtgagaagaccaaaaaagatgaggccttctatcaccctagattgatcatctatgaagaagaagaggaagaggaggaggaagaagaagaagttgaaaacgaggaacaggactctcagaacgaaggtagcacagacgaaaaaagttcccccgcctcatctcaggaaggaagcccttcaggcgaccagcaattcagtcccaaatccaacactgagaaaagcaaaggggagctgatgtttgacgacagttctgattcttcgccagagaagcaggagaggaatctaaattggaccccagcagaggtgccccagctcgcagccgcgaaaaggcggcttccccagggtaaagagccaggtctgattaatctatgcgccaatgtacctccagtgcccggaaatatccttccacccgaagtgaggggaaacttaatggcagccgggcagaaccttcagtcctctgagaggtctgaaatgatagccacctggagtcctgcggtgagaaccctgcgcaacattacaaataatgccgatattcagcagatgaacaggccttcaaacgttgcccatatcttacagactctttccgcccccacaaagaacttggaacagcaggtcaaccacagccaacagggacacaccaacgccaatgccgtgttgttctctcaggtaaaagtgacaccggaaacacatatgttgcaacagcaacagcaggcccagcaacagcagcaacagcatcccgttttgcatctgcagcctcagcagataatgcaactgcagcagcagcagcagcaacagatctctcaacaaccatacccgcaacagccaccccaccctttctctcaacagcaacagcagcaacagcaggcacatcctcaccagtttagccaacagcagctgcagttcccacagcagcagttacatccaccccagcagttgcacaggccccaacaacagctgcagcctttccagcagcagcatgcactgcagcagcagttccaccaactgcaacagcaccagctccagcaacagcagctcgcgcagttacagcagcagcactcgctcctacagcagcaacagcagcagcagatccagcaacaacagctccagcggatgcatcagcagcagcagcagcagcaaatgcagagccaaacagctcctcacttatctcagacaagtcaagctctgcagcatcaggttcccccccagcaacccccccagcagcaacaacagcagcaaccccctcctagccctcagcagcaccagctgttcgggcacgatccagctgtggagatacccgaggaagggttcctgctcggatgcgtttttgccatcgccgactaccccgaacaaatgtcggacaagcagctgcttgctacttggaagcggataatccaagctcacggcggcacagttgatcctacgtttactagtagatgtacccatttgttgtgtgaatcacaggtgagcagcgcatacgctcaggcgatcagagagcgaaagagatgcgtcacagcccactggttgaacacagttttgaagaagaagaaaatggtgccccctcatagagcactgcattttcctgtggctttccctccaggaggaaagccttgtagtcagcacatcatcagcgtcacaggatttgtggactctgaccgcgacgaccttaagctgatggcgtatcttgccggcgccaaatataccgggtacttgtgccgctctaacacagtcctcatatgtaaagaacctactgggttgaagtatgaaaaagccaaagagtggcgtatcccctgcgttaatgctcaatggctgggtgatatcctgctcggaaacttcgaagctttgcgacagattcagtatagccgctatacagcctttagtttgcaggacccctttgctcctacccaacatctcgtgctgaacttactggacgcttggcgggtaccactaaaggtatcagccgagctgctcatgagtattcggctgccgcctaaactgaagcagaacgaggtggctaatgtgcagccatcctctaaacgggcacggattgaagatgtgcctccccccaccaaaaagttaaccccagagctcaccccttttgttctgttcacaggctttgaacccgtgcaggtgcaacagtacataaagaaactctatatacttggtggtgaggtcgctgaatcagcccagaagtgtacccacctcatcgcctccaaagtgacccgcaccgtgaaattccttacagccatttccgtggtcaagcacatcgtgacccctgagtggcttgaggagtgtttcaggtgtcagaagttcatcgacgagcagaactatattctacgcgacgctgaagcggaggtcttgttctcattttcgctggaggaaagcttgaaaagagctcatgtatcaccgctgtttaaagccaagtacttttacatcaccccagggatctgcccttccctgtctactatgaaagcaatagtcgagtgcgccggtggcaaagtactgagtaaacagccaagttttcggaaactcatggagcataagcagaacagcagcctgtcagagataattctgattagttgcgaaaacgatctccacctctgccgggagtattttgcccggggaatcgatgtgcacaacgctgagtttgtgctaacgggggtactgactcaaacattggattatgaatcttataagtttaattag

SEQ ID NO: 20078 - DNA, 4668 bp, Artificial Sequence
  Description of Artificial Sequence: Synthetic coding sequence
atgagcgagcagacccccgccgaggccggcgccgccggcgcccgggaggacgcctgccgggactaccagtccagtctggaggatcttactttcaattcaaaaccccatatcaacatgctcactattctcgccgaggaaaatttgccatttgcgaaggagattgtctccctcatcgaagcacaaactgctaaggccccaagctctgaaaaactccccgtgatgtatctaatggactccatcgtgaagaatgttggaagggagtacctgactgcatttactaagaacctggtggccacctttatttgtgtgtttgaaaaggtggacgagaacacccggaaatcattgttcaagttacgatccacgtgggacgagatctttccattgaagaagctgtatgcgttggatgtgcgcgtcaatagccttgaccctgcttggcctataaagccactacccccaaacgtgaacacatcatccatccatgtaaaccccaaattccttaataagagtcccgaggagcccagtacccctggtaccgtcgtgagcagcccctccatctccactccccctatcgtgcctgacatccagaagaatctgacacaggagcagctgattaggcagcaactcctagccaaacagaagcagctgctggagctccagcagaagaaacttgagctcgagctcgagcaggctaaggcccagcttgctgtatcactgagtgttcagcaggaaaccagtaatctgggtcctggatccgctccctcaaaactgcacgtgagtcagattcccccaatggccgtgaaggcaccccaccaggtccctgtgcaatccgagaaatcccggcctggaccctccctgcagatccaagacctgaaaggaacaaacagggatccacgcctgaatcgtatcagccagcactcccatggtaaagatcagtctcaccgaaaggagttcctcatgaacaccctgaatcagtcggacacaaagacgtcaaagaccatcccgtccgaaaaattgaactcttctaaacaagagaagagcaagagcggcgaaaaaattacgaagaaggaactcgaccagctggactccaagtccaagtccaaaagtaagtcaccctcgcctttgaagaataagctttcccacaccaaggacctcaagaaccaggaatccgaaagtatgcgcttgtccgatatgaacaagagagacccacgacttaagaaacacttacaagataaaacggatggaaaggacgatgatgttaaagagaagagaaaaacagcggaaaagaaggataaagatgagcacatgaagagttcggaacataggctcgccggctcacggaacaagattatcaatggcattgtccaaaaacaggacaccatcaccgaagagagtgagaagcaggggacgaaacccggacggagtagcactcggaaacggtctagaagtcgatcccctaagagccgtagccctatcattcactcgcccaaacgcagggaccgccgttcccccaagcgccggcagcggtcaatgagccccacctctactcctaaggccggcaaaattcggcagtccggggctaaacagtcacacatggaagaatttacaccacctagcagagaagacaggaacgcgaaaaggtcaacaaagcaggatatcagggaccccagaaggatgaaaaaaacagaggaagagcgcccacaggagacgacaaatcaacactctacaaaatccggcacagaacccaaggaaaatgttgagaattggcagtctagcaaaagtgctaaacggtggaagtccgggtgggaagaaaacaaatccctgcagcaggtggacgagcactcaaaaccgccacatctgaggcatcgtgagagctggagctctaccaaggggatcctgtccccgcgcgcccccaaacagcagcaacataggttgtctgtggatgccaatttacagatccctaaggaactcaccctggccagcaagcgggaattgttgcaaaagacctcagaacggctggcctctggcgagatcacccaggacgattttctcgtggtcgtgcatcagatcaggcaactctttcagtaccaagagggcgtgagagaagaacagcgctctcctttcaatgaccgtttcccactgaagaggccacgttacgaggattccgacaaaccctttgtggactctcctgcctcccggttcgcaggcctggacactaatcaacggttgaccgccctggccgaggaccggccactattcgatggcccaagtagaccatccgtggcccgggatggccctaccaagatgatctttgagggccctaataaactgtcaccacggatagatggcccgcctacacccgcgtccctcaggttcgacggcagccctggtcaaatgggggggggcggcccgctccggtttgaaggcccgcagggacagctgggtggagggtgccctctgcggttcgagggaccgcccggccctgtgggcacgcccctgcggttcgaagggcctattgggcaggcgggaggaggcggctttagattcgagggtagtcccgggctgcggtttgaaggatcacctggcggactcaggtttgagggccctggaggccagccagttggcggtcttaggttcgagggccatcgcggccagcccgtgggcgggttgagattcgagggcccgcatggtcaacctgtgggtgggctaagattcgataacccacgtggccagcccgtcgggggcctacgatttgagggcggccacgggccaagcggcgctgccatacgttttgacggcccccatggccaacctggtgggggcattcgattcgagggccctctgctccagcagggcgtgggcatgaggttcgaggggcctcacggccagtccgtcgctggactgcggttcgaaggacagcataatcagcttggtggcaaccttcggtttgagggcccacacggacagcccggagtagggattcggtttgagggaccattagtccagcaaggaggcggcatgcgctttgaaggcccatctgttccgggggggggactgcggattgaaggtccactggggcaggggggcccccggttcgagggctgccatgctctgaggtttgatggtcaacctggccagccttccctgcttcctcgtttcgatggacttcatgggcaacccgggccaaggttcgagaggacaccaggccagcctggtccccaacgcttcgatggaccacctggacaacaggtgcagccacggtttgacggagttccacagcgattcgacgggcctcaacatcagcaggcctcacggtttgacatcccgcttggcctccagggaacccggttcgacaaccacccatcccagagattagaaagtgtctcatttaatcaaacgggaccttacaatgacccacccgggaacgcgttcaacgccccaagccagggcctgcagttccaaagacatgagcagattttcgattctccacagggccccaacttcaatggcccgcatggcccggggaatcagtcttttagcaacccgttgaatagggcttccggtcattacttcgatgagaagaacctccagtcttcccagttcggcaacttcgggaacattcccgcacccatgacagtcggtaacatccaagctagccagcaagtgctgtccggtgttgctcaacccgtcgcttttggacagggacagcagtttcttcccgttcatccccagaacccaggttttgtacagaacccaagcggagcgcttcccaaagcctaccccgacaatcacctgtcgcaagtggatgtgaacgaactcttctctaagctgctcaaaacgggaatcctcaagctcagccagaccgactccgccaccactcaagttagcgaggtcacagcacaaccgcctcccgaggaggaagaggatcagaacgaggatcaggatgtgcccgaccttacgaacttcaccgttgaggagctcaagcaacgctatgacagcgtgattaatagactttatacagggattcagtgctacagttgcggaatgaggttcacaaccagccagaccgatgtgtatgctgatcaccttgactggcactatcggcagaatcgtacagagaaggacgtctccagaaaggtcactcaccggcgctggtactactcgctgacggattggatcgagttcgaggaaatcgccgatctagaagaaagagcaaaatcccagtttttcgaaaaagtccacgaagaggtcgtgttgaaaacacaggaggccgccaaggagaaggagtttcaatccgtaccagctgggcctgccggcgcagtggagagttgcgaaatttgccaggaacagtttgagcaatactgggatgaagaggaggaagaatggcatctgaaaaatgccatccgtgtagacggtaagatctatcatcccagttgttatgaagactatcaaaatacatcttcgtttgattgtaccccctcaccttccaagaccccagtggaaaaccccttgaacatcatgttaaatatcgtgaagaacgagttgcaagaaccctgtgactcgccaaaagttaaggaggagcgcatcgacacccctcccgcctgtaccgaggagtctatcgccactcctagcgagatcaagaccgagaatgacacagtggagtctgtgtag

SEQ ID NO: 20079 - DNA, 2355 bp, Artificial Sequence
  Description of Artificial Sequence: Synthetic coding sequence
atgagcgagcagacccccgccgaggccggcgccgccggcgcccgggaggatgcctgtagggattatcagtccagcctcgaggatctcaccttcaactcaaagcctcacatcaacatgctcacaatactagccgaagaaaacttgccttttgccaaggagattgtatctcttatcgaagctcagaccgctaaggccccttcttcagagaagctgcccgtgatgtatctcatggactccatagtgaaaaatgtgggtcgggagtaccttaccgcctttactaagaatctggtggccacatttatatgtgtatttgagaaagtggacgaaaacacaagaaaatcactgttcaagctgcgctccacatgggacgagatcttccctctgaagaagctatatgctctggatgtacgtgtgaacagcctcgatccagcttggccaatcaaaccactgcctcctaacgtgaatacctcctcgatccacgtgaatccaaagtttcttaataagtcgcccgaggaaccttcaaccccgggtacagtcgtcagtagtccttcgatctccactccccctattgtgcctgacatacagaaaaacttaacccaggaacagctgataagacagcaactgctagcaaaacagaagcagctacttgagctgcaacagaaaaagctcgaactggagttggagcaggcaaaagcccagttggcagtgtctctgagtgtgcagcaagaaaccagcaaccttgggcccggctccgccccatctaaattgcacgtgtcccaaatccctccaatggctgtcaaggccccacatcaggtcccagttcagagcgagaaatctcgacccggcccatcattgcaaatacaggacctgaagggaaccaaccgggaccctagactaaaccgcatctcacaacacagccacggtaaagaccagagccacagaaaagaatttctcatgaacactttaaatcagtcagacactaaaacctcaaagaccattccctctgagaaactgaattcctctaaacaggagaaaagcaaaagtggcgaaaaaattaccaagaaagaactcgaccagctggacagtaagtcaaaaagcaaatcaaagtccccttcacctcttaagaataagttgagccacaccaaagatttgaagaaccaggagtccgaatctatgcgtctgagcgatatgaataaacgggacccccgactgaagaaacacttgcaggacaagaccgatggcaaggatgacgacgtgaaagagaagcgcaaaacagcagagaaaaaagacaaggatgagcatatgaaaagttcagaacataggctggccgggagtcggaacaagattattaatgggattgtccagaaacaggacaccataactgaggagtcagagaagcagggcactaaacctggacgttcctcaactaggaagcggtcgcgatctaggtccccaaagtcccggagcccgattattcactcaccaaagaggcgagaccggcgcagcccaaagaggaggcagagatccatgagtcctacctccaccccgaaggccggaaaaattagacaatccggagctaagcagtcgcatatggaggagttcaccccaccctcgcgcgaagaccgaaacgcgaagcgcagtaccaagcaggatatccgggacccaagacgcatgaaaaagacagaagaggagcggccacaagaaactacgaaccagcattccaccaaatcaggcacagagcccaaagagaacgtagaaaattggcaatcatctaagtcagcgaagagatggaaatcaggatgggaagagaacaagtccctgcagcaggtggatgaacactctaaaccaccacacctgaggcaccgcgaaagttggagctccaccaagggcattctgagtcctcgcgcgccgaaacagcagcagcatcggttatctgtagatgccaatctgcaaatcccaaaggagctcaccctggcaagcaaacgcgagctgctgcagaagacatccgagaggctggctagtggcgagatcacgcaggatgattttcttgtggtcgtacaccagatcaggcaactgtttcaataccaagagggagtgcgagaagagcaaagaagccccttcaatgacagattccccctaaagcgaccaaggtacgaggactcggacaagcccttcgtggatagcccagcttcacgattcgccggattagacaccaatcaacgactgacagctctggccgaagatcggccccttttcgatggaccctctcgtccatcagtcgcccgcgacggccccactaaaatgatcttcgagggccccaataagctgtctcctcgcatcgatggccctccttag

SEQ ID NO: 20080 - DNA, 4344 bp, Artificial Sequence
  Description of Artificial Sequence: Synthetic coding sequence
atggcccacagcaagacccggaccaacgacggcaagatcacctaccctcccggagtcaaagagatcagcgacaaaatcagtaaagaggagatggtccggagattgaaaatggtggtcaaaacattcatggatatggaccaggactcagaagaggaaaaggagttgtacctgaatctagctctccaccttgcttcagatttctttttgaagcatcctgataaggacgtgcgattactcgtcgcttgttgcctcgccgacatttttagaatctatgccccggaggctccatatacgtctccagacaaactgaaagacatctttatgtttattactcggcagcttaagggactggaggacaccaaatcaccacagtttaacagatacttctatctactggagaacatcgcatgggtgaagtcttataacatctgttttgaactggaggattcaaacgaaatatttacccagctttatcggactcttttcagcgttatcaacaacggtcacaaccagaaggtccatatgcacatggtggacctcatgagcagcatcatttgcgaaggagacactgtgtctcaggagctgctggatacagtcctcgtcaatcttgttccagcccacaagaatctgaataagcaggcatatgacctggcgaaggctcttctgaaaaggactgctcaggccattgaaccttatattaccaattttttcaatcaagttttgatgttgggcaagacctctattagcgacctgtcggagcacgtgttcgatctgattctcgagctgtataacatcgactctcatctcctcctgtctgtcctgccccagctggagttcaagctaaaatctaatgacaatgaagaaaggcttcaagtggtgaagctcctggccaaaatgttcggcgctaaagactccgaactggcttctcaaaacaaacccctttggcagtgttacctggggaggtttaacgatatccacgtgcctattcggctggaatgtgtcaagtttgcaagccattgtctgatgaaccaccccgaccttgccaaagatctgacagagtatcttaaggttcgatcacatgatcccgaggaggcaattcggcatgacgtgattgtgagtattgtgacggccgctaaaaaagatatactcttggtcaacgatcacctgctgaacttcgttagagagcgcaccctggataagcgatggcgtgttcgtaaggaggccatgatgggactagcgcagatctacaaaaagtacgccctccagtcagccgccggcaaagacgccgccaagcagatagcttggatcaaggacaaacttttgcacatctactatcagaacagtatcgatgataggctacttgtggagcggatttttgcccaatatatggtcccacacaacctggaaaccacagaacgcatgaaatgcctctactacctctatgctaccctcgacctgaacgcagtgaaagccctgaatgagatgtggaagtgtcagaatctgctacgccaccaagtgaaggatctgctggacctaattaaacagcctaagactgacgcatcagtgaaggccatcttttcgaaggtgatggttattacacggaacctgcctgacccgggaaaggcccaggatttcatgaaaaagttcacacaagtcctggaggatgacgagaaaatcagaaaacagctggaagtcctcgtaagccccacctgctcctgtaagcaggccgagggttgtgttagagagatcactaagaagcttggcaacccaaaacaacctactaacccttttttggaaatgatcaagtttctgctagagagaattgcccccgtgcacatcgacaccgagagcattagtgctctgattaaacaggtgaacaagagcatcgacggcacagccgatgatgaggatgagggcgtgcccactgatcaggcgatcagggccggcctggaattgctgaaggtgctgtccttcactcaccccatctcatttcactctgcagaaacctttgagagtcttctggcttgcctgaagatggacgatgaaaaggtcgccgaagccgccctgcagatttttaaaaataccggatccaaaatagaggaagatttcccccacatccgatccgcgctcctcccggttctgcaccacaagtcaaagaagggtccaccccgccaagctaagtatgcaatacactgtattcacgctatcttctccagtaaagagacccaattcgcacaaatctttgaacctctgcataaatctctcgacccctcgaatctggagcatctgatcacaccactggtgactataggacacatcgctctccttgcgcccgaccagtttgctgctcccttgaagtcactcgtggccaccttcatcgtgaaagatttactaatgaatgataggttaccaggcaaaaaaacaacgaaattgtgggtaccggacgaggaagtcagcccagaaacaatggtgaaaatccaggccattaagatgatggtccgttggttactgggtatgaagaacaaccacagcaagtccggcacttcaactctgcggctgcttaccacaattttacactccgacggagatctcaccgagcagggtaaaatctcgaagccagatatgagtaggcttcgcctggctgcaggttctgccatagtcaaactcgctcaggagccctgctaccacgagattattacacttgagcagtaccagttatgtgccttggcaattaacgacgaatgttaccaggtgcgtcaggtatttgcccagaagcttcataagggactgagcaggctgcggcttccactggaatatatggctatttgcgcgctgtgcgccaaagatcccgttaaagagcgcagggcccatgctcgtcagtgtctcgtgaagaatataaacgttcgcagagagtacctgaagcaacacgccgccgtgagcgagaaactcctgagtttgctgcctgagtacgtggtaccttacacaattcatctgctggctcacgatccggactacgttaaggtacaggacatagaacagctaaaagacgtcaaggaatgcttgtggttcgtcttagaaatcttgatggctaagaacgaaaacaacagtcacgccttcatacgcaaaatggtggaaaatattaagcagacaaaggacgcgcaaggcccagatgacgcaaaaatgaacgagaagctttacaccgtgtgcgacgtggcgatgaacatcatcatgtccaagagcaccacctattcccttgaatccccaaaggatcccgtcctacctgcgcggttcttcacccagcctgacaagaatttttctaacaccaagaactacttacctcctgagatgaaatcattctttacgcccggaaagccaaaaacaacaaacgtgctaggtgcagtgaataagcctctgtcatcagctgggaagcaatcccaaacgaagtctagccgtatggaaacagtgtccaatgcctctagttcctctaatcctagttcccctggacggataaagggaaggttagattccagtgagatggaccactcagaaaacgaagattatacgatgagtagccctcttccgggcaagaagtccgataaaagagatgacagtgatttggtgagatcagagctcgagaagccccgtggtcggaaaaaaacaccagtaactgaacaggaggaaaaattgggcatggacgatctgactaagctagtacaggaacaaaagcccaagggttcccagagaagccggaaacgaggccacactgcctccgaatctgacgagcaacagtggcccgaggagaagcgtctcaaagaagatattctggagaatgaagatgaacagaactctccccccaagaagggtaagcggggtcggcccccaaagcccctgggagggggcacccctaaagaagagccaacgatgaagacgagtaagaaaggctccaagaagaaaagcggaccacctgcacccgaggaggaggaagaagaggaacgccagtccggtaatacagagcaaaaatccaaatcaaaacagcacagagtatcccggcgggcccaacagcgtgctgagagccccgaaagtagcgctatcgagtccactcaaagtaccccccagaagggcagaggtcgcccttcgaagactccaagcccgtcccagccaaagaaaaacgtgcgcgtgggtagaagtaaacaggccgcaaccaaggaaaacgacagcagtgaagaggtggacgtgttccaagggtcatcgccagtggacgacattcctcaggaggagacagaggaagaggaagtgtcaactgtaaacgtgcgacgtaggtcggcgaagcgagaacgccgctag

SEQ ID NO: 20081 - DNA, 3909 bp, Artificial Sequence
  Description of Artificial Sequence: Synthetic coding sequence
atggcccacagcaagacccggaccaacgacggcaagatcacctacccacctggagtgaaggaaataagcgataagatcagcaaagaagagatggtgcgcagacttaagatggtggtaaagacattcatggatatggaccaagactcagaagaagaaaaggagttgtacctgaacctggccttgcacctcgcctctgatttcttccttaaacacccggataaagatgtgcgattactggtggcctgttgcctggctgatatattccgcatatacgccccagaagccccttatacgagccccgataaacttaaggatatttttatgttcattacacgccaactgaaggggctggaagacaccaaatctccgcagttcaatcggtacttttatttgctcgagaatattgcatgggtgaaaagctataacatttgctttgaactcgaagactctaatgagatatttacccagttatataggacactcttttccgtgatcaacaacggccataatcaaaaagttcatatgcatatggttgatctgatgtcctctatcatctgcgagggcgatactgtaagtcaggagctcttggacactgtgcttgtgaatctcgtgcccgcccacaagaacctcaacaagcaggcatatgacctggctaaggccctcctgaagcgcactgcgcaggccatcgaaccctacattaccaattttttcaaccaggttctgatgttggggaagacctcgatctctgacctgtcggagcatgtgttcgacctaatcttggaactgtacaacatcgactcacacctgctcctctccgtgctgcctcagctggaattcaagctaaagtcaaacgataacgaagaacgactgcaagtggtgaagttactagccaaaatgttcggcgccaaggacagcgagctagcctcccagaataaaccactgtggcagtgttatctggggcggttcaacgacatccacgttcctattcggctggaatgcgttaaatttgcaagccattgtctgatgaatcaccccgacctcgctaaggatctcacggagtatttaaaagtgcggtcccacgatccagaggaggctatcagacacgatgtgatagtgtccatagtgaccgcggctaaaaaggatattttactggtaaatgatcacctgcttaattttgtcagggagcgcacgctggataagagatggagagttagaaaagaggccatgatggggctggcacaaatatacaagaaatacgctcttcagagcgctgccggcaaagatgcagccaaacagatcgcatggatcaaggataagcttctccatatctactaccagaattcaatcgatgaccggctactagtcgagcgaatctttgcccagtacatggtgcctcataatctcgaaacaacggaaaggatgaagtgcctttactacctgtacgcaacgctggacctgaacgccgtgaaagcactaaatgagatgtggaaatgtcagaaccttctgcgccatcaggttaaagatctcttggatttaattaaacagccaaaaactgatgcttcggtgaaagccatatttagtaaggtcatggtgatcacccgaaatttacctgacccaggaaaggcccaggacttcatgaagaagtttacacaggtcctggaggatgacgagaagatccgcaagcagctggaggtactggttagcccgacgtgttcatgcaagcaggcagaaggatgcgttcgggagataaccaaaaaactgggtaatccaaagcagcccacgaatcccttccttgagatgatcaaatttctcctggagaggatcgctccagtgcacatcgacacagagtctattagcgcactgataaagcaggtgaacaagtccatagatggaactgccgacgatgaagatgagggcgttcctacagaccaagccatccgtgcaggcttggaactcctgaaggtactctcgttcacgcatcctataagctttcactctgccgagacctttgagtccctgcttgcatgcctcaagatggatgatgaaaaagtcgcagaagcagctctgcaaatcttcaaaaacacagggagtaaaattgaagaagacttcccacacatccgttcagccctcctccccgtcctacaccataaaagcaagaagggcccccccaggcaggctaagtacgccattcactgcatacatgctattttctcctccaaggaaacccagtttgcacagatctttgaaccattacacaaaagcctcgacccatctaacctggaacatctcattacccctcttgtcacaatcggccacattgcccttctggctcccgatcagttcgctgcacccttgaagagtttggtggctacattcatcgtgaaggatctcctcatgaatgatcgccttccagggaagaaaaccacgaagctctgggtgcctgatgaagaggtgtcacccgaaacgatggtcaagatacaagcgatcaagatgatggtacgctggcttctgggtatgaagaacaaccacagcaagtccggaactagtacgctccgactacttaccaccatactgcatagcgatggggacctgactgagcagggcaagataagcaaacctgacatgtcccggcttaggctggcggcgggaagcgccatcgttaagctcgcacaggagccttgctaccacgagattattaccctggagcaatatcagttatgtgctctggcaattaacgacgaatgttaccaggtccgccaggtgtttgcccaaaagctgcataaagggttgagccggcttagattaccactcgagtacatggcgatctgcgccctgtgtgctaaggacccagtcaaagaaaggagggcccacgctcgccagtgcctggtgaaaaacattaatgttcgccgtgagtatttgaagcaacatgccgcagtgtccgagaagctgctgtcgctgctaccagagtacgttgtcccctacacaattcatcttttagcacacgatccggactatgtgaaagtacaggacatagaacagttgaaagatgtgaaggagtgcctctggttcgtgctggaaatcctgatggccaaaaacgaaaacaactcccacgccttcattagaaaaatggtggagaatatcaaacagacaaaggacgcacagggccctgatgacgcgaagatgaacgaaaagctttatactgtgtgtgacgtggcgatgaacataatcatgtctaagtctacgacctatagcctagaaagtcctaaggatccggttttgccagcacggtttttcacacagcctgacaaaaatttttctaataccaagaactatctccccccagagatgaaatccttctttactccaggcaagcccaagaccactaatgtcctcggggctgtgaacaagcctctgagcagcgccggcaaacaaagccagacaaaaagctcccgcatggagaccgtgagcaacgcctctagcagcagcaacccctctagtccaggccggattaagggaagactggatagcagcgaaatggaccattctgagaacgaagattacaccatgtcatcccctctgcctggcaaaaaaagcgataagagggacgattcagacttggtccgcagcgagcttgagaagccacgcgggagaaaaaagactccagtcacggagcaggaggagaaactgggtatggacgatctgaccaagttagtccaggagcagaaacccaaggggagtcaaaggtcaaggaaacgcggacacaccgcaagcgagtccgatgaacagcaatggcctgaagagaagcgcctgaaagaggacattctggaaaatgaagatgagcagaatagtctccctcttcaccaaaaggacgcatctgaccgaaggaccacgatgcagatcgtgaagtag

SEQ ID NO: 20082 - DNA, 2115 bp, Artificial Sequence
  Description of Artificial Sequence: Synthetic coding sequence
atggccaacgagaaccacggcagcccccgggaggaggccagcctgctgtcccactctcctgggacaagcaaccagagccagccctgctcgcccaagccaattaggctggttcaggacctgccagaggagctggtgcacgctggttgggaaaaatgctggagtcggcgtgagaaccgtccttactactttaaccgtttcaccaaccagtctttgtgggaaatgcccgtgctcggacagcatgacgtaatcagtgatccactgggccttaatgcgaccccactgccccaggattcctccttggtggaaacaccaccagctgaaaataagccaagaaagagacaattgtccgaggagcagcctagtggcaacggtgtgaaaaagcctaagattgagattcctgttacaccaactgggcagtctgtgccatcttccccatctattcctggcactccaactctaaaaatgtggggcacttctcccgaggacaagcagcaggccgctctactgcgccccacggaagtttactgggacctggatatccaaacaaacgccgtcatcaagcacaggggcccgtcggaggtccttcctccccatcccgaggtcgaattgctgcgctcgcagctcatcctcaaattgcgccagcactatagagagctgtgtcaacagagagagggcatagaacctcctagggagtcctttaatcgttggatgctcgagagaaaagtggttgataagggctccgatcccctactcccaagcaattgcgagccagtagtcagcccgtcaatgtttagggagattatgaatgatatccctatccgcctcagccgcatcaagttcagggaggaggctaagcggctcttgtttaagtacgccgaagccgctcgccgccttatcgagtctaggagcgcctcaccagattccaggaaggttgtgaagtggaacgtggaggatacattttcctggctaaggaaagatcatagcgccagtaaggaggactatatggaccgcctggagcacctcaggcgacagtgcggccctcatgtcagtgccgctgctaaggactccgtggaagggatctgcagcaaaatttatcatatttcattagagtacgtaaagcgaataagagagaagcacctggcgatcctgaaggagaataatatcagcgaagaagtggaggcccctgaggtggagccccgtcttgtctactgttaccccgtacgacttgctgtctctgctccccccatgccttccgttgagatgcatatggaaaacaacgtcgtgtgtatacggtacaagggagagatggtgaaagtgtctaggaactacttctccaagctgtggctgctctaccgctatagctgcatcgacgatagcgccttcgaacgatttctgccacgggtctggtgtctgctgcgaaggtaccagatgatgtttggggtgggactgtacgaaggaactgggcttcagggcagcctgccggttcatgtgtttgaggccctgcacagactgtttggggtgtcttttgagtgtttcgcctcgcctctgaattgctatttcaggcaatattgtagtgcctttccagacactgacggttacttcggaagtaggggcccgtgcctggacttcgcacccctcagcggtagttttgaagctaacccccccttttgcgaggaactgatggatgcaatggtctcacactttgaacgcctgttagaaagcagtcccgagcccttatcatttattgtcttcatcccagagtggagggaacctccaacgccagcattgactagaatggaacagagtcgattcaaaagacaccagctcatactgcctgccttcgaacacgaataccgctccgggagccagcacatatgcaaaaaggaggaaatgcattacaaagcggttcacaatactgccgtgctcttcctgcagaatgatcctggctttgctaaatgggcacccacccccgagcggttgcaggagttgtctgccgcttacaggcagtcaggccgcagtcactcctccggaagctcttccagttcgtcaagtgaggccaaggacagggacagcggaagggaacagggcccgagcagagagccacaccccacctag

SEQ ID NO: 20083 - DNA, 2133 bp, Artificial Sequence
  Description of Artificial Sequence: Synthetic coding sequence
atggccaacgagaaccacggcagcccccgggaggaggccagcctgctgtcccacagcccaggcactagtaatcaaagccagccttgctctcccaaacccattcgtctagttcaggaccttccagaagaacttgtgcacgctggttgggaaaaatgctggtctcggcgtgagaatagaccatactatttcaataggtttacaaaccaaagcttgtgggagatgcctgtgctggggcagcacgatgtcatctccgaccccctgggcctcaatgccactcctctaccacaggattcttccttagtggaaacaccccctgcggaaaataaaccacgcaaaaggcagcttagcgaggaacagccgtctggaaatggagtaaaaaagcccaagatagaaatccctgttaccccgacaggacagtcggtgcccagcagtccttctatccccgggactccaaccctcaagatgtggggaacatctcctgaggacaagcaacaggccgcccttcttaggccaaccgaggtctattgggatctggatatacaaactaacgccgtcattaagcacaggggtcccagtgaggtactcccaccgcaccccgaggtggaattactgagatcccagctgatcctgaaactccgccagcactaccgggagctgtgtcagcaacgggagggcatcgaacctccccgcgaaagttttaaccgctggatgctggagagaaaggtcgtggacaagggttcagatccattgctcccctccaactgcgagcccgtggtttcccctagtatgtttcgggaaatcatgaacgatataccgattcggctgagccgtatcaagttcagggaggaagccaagagattgctgttcaaatacgcagaagccgcccggcggttgatcgagagtaggtctgctagcccagactcaaggaaagtggtaaaatggaatgtcgaagataccttctcctggttacggaaagatcacagcgcatcaaaggaggattatatggataggttggagcaccttcggaggcagtgtggaccccacgtttctgctgccgccaaggactcagtagagggtatctgctccaaaatctaccacattagcctggagtacgttaagaggattagagaaaaacaccttgccatcctcaaagagaataacatcagcgaagaggtggaggcccctgaggtggaaccacggttggtttactgttatcccgtcagattagccgtgtccgctccgcccatgccttctgtagaaatgcatatggagaacaatgtggtttgcatccggtataagggggagatggttaaggtgtctcggaattacttctccaagttatggcttctgtacagatacagctgtatcgacgacagcgcctttgaacgcttcctgcctcgcgtctggtgtctgctaagacgataccagatgatgttcggagtgggtctctatgaaggaactggcctgcaaggctcccttcccgtgcatgtgtttgaagctctccatcgactttttggggtttccttcgaatgttttgctagtcccctaaactgttactttagacaatactgttcggcgtttcctgacactgacggctactttggctcacgggggccctgccttgattttgccccgctgtccggatctttcgaagcaaatccacctttttgtgaggaactcatggacgccatggtcagccacttcgaaaggctgcttgagtcatctccggagcctctaagcttcatcgtttttatacctgaatggagggaaccgcctactcccgccctcactcgcatggaacagagcaggttcaaacggcaccagcttatactccctgccttcgaacacgaataccgctctgggagtcagcacatttgtaagaaagaggagatgcactataaagctgtccacaatacggcagtcctcttcctgcaaaacgatcccggatttgctaaatgggctccaactcctgaaagattgcaggagctatctgcagcttatcgtcaatcagggcgctctcacagcagcggtagcagttcctcctctagctctgaggctaaagaccgcgactctggcagggagcaggggccatctagggagccacaccccgtggccacgctcttccacctgtag

SEQ ID NO: 20084 - DNA, 498 bp, Artificial Sequence
  Description of Artificial Sequence: Synthetic coding sequence
atgagcgtgaccctgcacaccgacgtgggcgacatcaagatcgaggttttctgcgagcgcacccccaagacatgcgagatggagagtcggtgtgtcccgcaggccggggtacagtggagggacttagggtccctgcagcctccgccacccggcttcaaacaggtgttctgcctgagccttccaagaaccgggagagggggcaactccatttggggaaagaaattcgaagatgaatattctgaatacctcaagcataacgtgcgaggcgtggtgtctatggcgaataacggtcccaacacaaatggctctcagtttttcatcacatacggcaagcaaccccatcttgacatgaagtatactgttttcggcaaggtcatagatggtctcgaaacgttagatgagctggaaaagctgccagtcaatgagaaaacttatcggccattgaacgacgtacatatcaaagatatcactattcatgctaacccctttgctcagtag

SEQ ID NO: 20085 - DNA, 486 bp, Artificial Sequence
  Description of Artificial Sequence: Synthetic coding sequence
atgagcgtgaccctgcacaccgacgtgggcgacatcaagatcgaggtcttttgcgaacgaacacctaagacgtgtgaaaattttctagccctgtgtgctagtaattactacaacggctgtattttccatcgaaatataaaagggttcatggtgcagaccggcgacccaaccgggacgggcagaggaggcaactcaatctggggcaagaagttcgaagacgaatactctgaatatcttaaacataacgtcagaggcgtggtcagtatggccaataatgggcctaacaccaacggatcccagttttttataacctacggaaaacaaccacatctggacatgaaatatacagtgttcggaaaagtgattgacggattggaaaccctggatgagctcgagaagctccccgtgaacgagaaaacatatcggccccttaatgatgtacatattaaggatataacaatccatgccaaccctttcgcccagtag

SEQ ID NO: 20086 - DNA, 498 bp, Artificial Sequence
  Description of Artificial Sequence: Synthetic coding sequence
atgagcgtgaccctgcacaccgacgtgggcgacatcaagatcgaggtgttttgtgagaggactcctaaaacctgcgaaatggagagtcggtgtgtcccacaggctggagttcagtggagggacctcggatcactgcagccacccccacctgggtttaagcaggtattctgtctgagtttaccacgtaccgggagggggggcaattccatctgggggaaaaagttcgaggacgagtactctgagtacttgaagcacaatgtgaggggcgtcgtttcaatggccaataatggtccaaataccaacggatcacagttttttatcacttacggcaagcagcctcacttggacatgaaatatactgtctttgggaaagtcattgatggactggagactctggacgagctggagaagctgccagtcaacgagaagacttacagacctctgaatgatgtgcatattaaggacatcacaattcatgcaaatcccttcgcgcaatag

SEQ ID NO: 20087 - DNA, 243 bp, Artificial Sequence
  Description of Artificial Sequence: Synthetic coding sequence
atgagcgtgaccctgcacaccgacgtgggcgacatcaagatcgaggtcttttgtgaacggacgccaaagacatgtgagaatttcctcgccctctgtgcaagcaattattataatggttgtatcttccaccggaacatcaaagggttcatggtccagacgggagatcccacaggaacgggtcgtggcggcaactcaatctggggaaaaaaattcgaagacgaatatagtgagtaccttaaatag

SEQ ID NO: 20088 - DNA, 1941 bp, Artificial Sequence
  Description of Artificial Sequence: Synthetic coding sequence
atggccgccgagagcggcagcgacttccagcagcggcggcggcggcggcgagatccagaggagcccgagaagactgagctgagcgagagagagttagccgtggcggtggccgtctctcaggaaaacgacgaggaaaatgaggaaaggtgggtgggacccctcccggttgaggcaactttagcaaagaagaggaaggtccttgaattcgaaagagtatacctggacaatttacctagcgcgagtatgtatgagaggtcctacatgcacagggatgtcattacacacgtggtttgcacaaaaacagattttataatcaccgcctctcacgacgggcatgtaaagttctggaagaaaatcgaggagggtattgaatttgtaaagcacttccggtcccatctcggcgtcatcgaaagtattgccgtctctagtgaaggagctctgttttgcagcgtgggcgacgataaagccatgaaggtgttcgacgtggtcaactttgatatgataaacatgttgaaactcggctacttcccgggccaatgtgaatggatttattgtccaggcgatgccatctcaagcgttgccgcttcagaaaaaagtactgggaaaatttttatctacgacgggagaggagataaccagccactgcacatttttgataaactgcatacttcacccttaactcagataagactgaatcctgtttacaaggccgttgtatcaagtgataaaagtgggatgatcgaatattggacgggacctccgcacgagtacaaattccctaagaatgtcaattgggagtataaaactgataccgatctgtatgaatttgccaaatgtaaggcttaccctaccagtgtgtgcttttcccctgatggcaaaaagatcgcgactattgggagcgataggaaagtccggattttccgctttgtgaccggcaagctaatgagggtcttcgatgaatcactgagtatgtttaccgaactccagcagatgcggcagcagctccctgacatggagttcgggaggcgaatggcagtagagcgagagttagaaaaggtggacgctgttagattgataaacattgtgtttgatgaaaccggacactttgtcctgtacggaactatgttgggcatcaaggttattaatgttgagacaaaccgatgcgtgaggattctgggaaagcaggagaacataagagttatgcaactagctctgtttcaggggatcgccaagaagcatcgggccgctacgacgattgagatgaaagcctcagagaatccagtgctgcagaacattcaggctgatcccacaattgtgtgtacttcctttaaaaagaaccgtttttacatgttcactaaacgcgagcctgaggacactaaatctgcggatagcgatcgagacgtgtttaacgaaaaaccaagtaaagaggaggtgatggccgcaactcaggctgagggacctaagagggtgagcgacagcgctattattcataccagtatgggagatatccataccaagctgtttcctgtcgaatgtccgaagactgtggagaacttctgtgtgcattctcgtaatggatactacaatgggcatacattccacagaataataaagggctttatgatccagactggtgatcccacaggcacgggaatgggtggggagtctatctggggtggggaatttgaggacgagtttcactctacactcagacacgaccggccgtacactctatccatggcaaacgccggcagtaataccaacggttcccagttcttcatcaccgtagtgcctacgccgtggttggataataaacacaccgtctttggtagagtgaccaaagggatggaggtggttcagcggatcagcaatgtaaaggtgaaccccaagaccgataagccatatgaggatgtgagcatcatcaatataacagttaaatag

SEQ ID NO: 20089 - DNA, 1851 bp, Artificial Sequence
  Description of Artificial Sequence: Synthetic coding sequence
atgcggcggaccaagagcgccggcctggacctgtacctgtggcggcaacattggcctaggcgcggaaagcaaccacacgaagtcgggatttctaatagctacttggtcctggaattcgaacgtgtgtacttggataaccttccttcagccagcatgtatgaacggagttatatgcatagagacgtgatcacccacgtggtctgtaccaaaaccgattttatcattacagctagccatgacggccacgtcaaattctggaaaaaaatcgaggagggaattgagttcgtgaaacatttcaggagccacctgggagtgatcgagagtattgcggtgtctagcgaaggcgccctcttctgctctgttggggacgacaaggcgatgaaagtgttcgatgtagtgaatttcgacatgattaatatgctaaagttgggatacttccccggccagtgtgagtggatttactgtccaggcgacgcgattagctctgttgccgcatccgagaaaagcactggcaagatcttcatatacgatggcaggggggacaatcagccactgcacattttcgataaattgcatacatctcccctgacacaaatcaggctgaacccggtatacaaagcggtggtgtcttccgataaatccgggatgatcgagtattggaccggccccccccatgaatacaaattccccaaaaacgtaaactgggagtataagacagacaccgatctgtatgagtttgccaagtgtaaagcttaccccacgtccgtatgcttctccccggacggaaagaagatcgcgactataggcagtgacaggaaagtgcgcatcttccggtttgtaaccgggaagctgatgagagtctttgatgagtctctgagcatgttcacagaactccagcagatgagacagcagttgccggacatggaatttggccgccgaatggccgtcgagcgggaattggaaaaagtcgatgccgttagactcatcaatatcgtctttgacgagaccgggcacttcgtattgtacggcaccatgctcggaatcaaagtgattaacgtcgaaactaaccgctgtgtccgtatcctgggaaagcaggaaaacataagagtaatgcagttggccttattccagggaattgccaagaaacatcgcgctgctaccactatcgagatgaaggctagcgagaaccccgtgctgcagaatatccaggcagatccaacgatcgtctgtacctctttcaagaagaaccgattttacatgtttaccaagcgtgagccggaggacacgaaatctgctgatagcgatcgcgatgtttttaatgagaagccgtcgaaggaggaggtgatggcggctacacaggccgaaggccccaagcgcgtgtccgattctgcgatcatccacacttctatgggtgatatccacactaaacttttccccgtggaatgccccaagaccgtggagaatttttgtgtgcacagccgcaatggatactataacgggcatacctttcacagaataatcaagggcttcatgatccaaaccggcgaccccacagggaccggcatgggaggggagtctatctggggaggcgaatttgaggacgaattccactccacattgcggcacgaccggccctacaccttaagtatggcgaatgccgggtccaatacaaacggatcccagtttttcattaccgtcgtgcccacaccgtggctggataataagcacactgtctttgggcgcgtgaccaaggggatggaagtggtgcagcgaatctccaacgtcaaagtcaaccccaaaacggataagccttacgaggatgtgagtatcatcaacatcacagtgaaatag

SEQ ID NO: 20090 - DNA, 1473 bp, Artificial Sequence
  Description of Artificial Sequence: Synthetic coding sequence
atgaaggtgttcgacgtggtgaacttcgacatgatcaacatgctgaagttggggtactttcccgggcagtgtgaatggatttactgccctggcgatgccatatcctcggtggccgcctccgagaaatcaaccgggaaaatcttcatctacgatgggcggggggataaccagcccctccacatctttgataaacttcacacatcccctctgacacaaatcagacttaaccccgtatacaaggctgtggtcagttccgacaagtcaggaatgatcgagtattggactggtcctccgcacgaatataagttccccaaaaatgtcaactgggaatataaaaccgataccgatctatacgaatttgcaaaatgcaaagcctatcccaccagcgtgtgcttctcccccgacgggaagaagattgcaacgatcggaagtgatagaaaagttaggatatttcggtttgtgacaggtaaactgatgcgggtgttcgacgaaagcctgagcatgttcaccgagcttcagcagatgaggcagcagctgccagacatggaattcggccggcggatggctgtagagagggaactggaaaaggtggatgccgtacgactcatcaatattgtttttgacgaaacgggccactttgtgttgtatggcacaatgctaggcattaaagtgatcaatgttgagacaaatcgctgtgttcgaatcttgggcaagcaggagaatatccgggttatgcagctggcactgttccagggaattgcgaagaaacacagggcggcgactaccatagaaatgaaggcttctgagaacccggtgcttcagaatattcaggctgatccgacaattgtgtgcacatcattcaaaaagaataggttctatatgtttaccaagcgtgaacctgaggatactaaaagtgctgactccgacagggatgtattcaatgaaaagccttcgaaagaagaggtcatggccgcaacacaggcggagggccctaaaagggtgagtgattctgccatcatacacacctctatgggggatattcatactaaactatttccagtggagtgtccaaagaccgttgaaaatttttgtgtgcattcaagaaatggatattataatggacatactttccaccgtatcataaagggctttatgatccaaacaggtgacccgacaggcacgggaatgggcggggagtctatctgggggggggaatttgaagatgaatttcactcaactcttagacatgatagaccttacacattgtctatggcaaatgccgggagcaatactaatggctcacaatttttcattacagtggtgcccaccccctggttggataacaaacacaccgtatttgggagagtcaccaaaggcatggaagtcgtgcagagaatatccaacgttaaggtcaatccaaaaaccgataaaccctatgaggacgtgtctatcatcaatattacggtgaagtag

SEQ ID NO: 20091 - DNA, 906 bp, Artificial Sequence
  Description of Artificial Sequence: Synthetic coding sequence
atggccaccaccaagcgggtgctgtacgtgggcggcctggccgaggaagtggatgacaaggtactgcacgccgctttcataccgttcggcgatattacagacatacagatcccgcttgactacgaaaccgagaagcaccgtggatttgcgttcgtggaatttgaattagccgaggacgcagctgctgccatcgataatatgaacgagagcgagctgtttggtcgcacgataagggtaaacctagcaaagcctatgcggatcaaagaaggatcctctcgtcccgtctggagcgatgacgattggttaaaaaagttctccgggaaaaccctagaagagaacaaggaggaagagggctccgagcccccgaaggccgagacgcaagaaggggagccgatagctaagaaggcaagaagcaatccgcaggtctacatggatatcaaaatcggaaacaagccagcgggtcggatacagatgctcctgcgcagcgacgtcgtccccatgacagctgagaatttccgatgtctctgtacacacgagaaggggttcggctttaaaggcagctccttccaccgaatcattccacagttcatgtgccagggaggcgatttcacaaaccacaacggcaccggtgggaagagcatttacggaaagaagttcgatgatgaaaatttcattctgaagcatacagggcctggccttttatcaatggcaaactccggtccgaataccaacgggtcgcagtttttcttgacatgcgacaagaccgactggctcgacggaaagcacgtggtgtttggggaggtgaccgaaggcctcgacgttctccgacagattgaagcacaggggagcaaggatgggaagccgaagcaaaaggttattatcgccgattgcggagaatatgtgtag

SEQ ID NO: 20092 - DNA, 891 bp, Artificial Sequence
  Description of Artificial Sequence: Synthetic coding sequence
atggccaccaccaagcgggtgctgtacgtgggcggcctggccgaggaagttgatgacaaagtgctgcacgcggcattcatccccttcggcgacataaccgatatccagattcccttggattacgagaccgaaaagcacagggggtttgcgtttgtggagtttgagctagctgaggatgcagcagccgcaatcgacaatatgaacgagagtgagctgtttgggcgcaccataagagttaaccttgctaaaccaatgcgcatcaaagagggctcctcccgccctgtttggtcagacgacgactggttgaaaaagttctccggaaaaacattagaagagaacaaagaggaggaggggtcggagccccccaaggccgagacacaggagggcgaacctatcgcaaagaaagcccgctcgaatcctcaggtttatatggatatcaagattgggaacaagccagcgggtaggattcagatgctcctccgatccgacgtcgtccctatgacagccgagaatttcaggtgtctctgtacccacgaaaagggctttggcttcaagggcagctccttccaccggattattcctcaattcatgtgccaaggaggagacttcacgaatcataatggtactggcgggaagagcatttacggcaagaagttcgatgatgaaaactttatcctaaagcatacaggacctgggctgctcagtatggccaactcaggcccaaatacgaacggcagccagttctttctcacatgtgacaaaacggattggctggatgggaaacatgtggtgtttggcgaagtgaccgagggcctagacgtactcaggcaaatcgaaaaacaggaagaaagtgctattacaagccagcctagaagttggaaacttacctag

SEQ ID NO: 20093 - DNA, 945 bp, Artificial Sequence
  Description of Artificial Sequence: Synthetic coding sequence
atggccaccaccaagcgggtgctgtacgtgggcggcctggccgaggaagtcgacgataaagtgcttcatgccgcctttatcccttttggagatataactgatatccagattccgctggattacgaaactgagaagcacaggggattcgccttcgttgagttcgaactggctgaggatgcagccgctgctattgataacatgaatgaatctgagctgtttgggaggaccatccgagtaaatctcgcaaagcctatgagaataaaagaaggatcaagcaggcccgtgtggagtgacgacgactggctgaaaaaatttagcgggaagacccttgaagagaacaaggaagaagaggggagtgagccccccaaagctgaaacccaggaaggtgaaccgattgctaagaaagctagaagcaatccccaggtctatatggatattaagattgggaacaaacccgcagggcgaattcagatgctgctgagatctgatgtggtgccaatgactgcggaaaacttcaggtgcctgtgtacacacgaaaaaggcttcgggttcaagggatcctccttccacagaataatcccacagttcatgtgtcaggggggcgatttcactaatcacaacggcactggcgggaagtctatttacggcaaaaaattcgacgatgaaaactttattctcaaacacactggtccgggcctgctgtccatggctaattcgggacctaacactaacggctcacagttcttcctgacttgcgataagaccgactggctcgatggtaagcatgtggtgtttggcgaggttactgagggcctcgacgtcctacggcaaatcgaagttgcacctgacacgaaagcttccaaagccagggggtcccgtaagaataaggacggccaagaacgcaattgggggaagtcacaaaaagtggaaagccacactatttag

SEQ ID NO: 20094 - DNA, 6243 bp, Artificial Sequence
  Description of Artificial Sequence: Synthetic coding sequence
atgagcagcagccccagccggagcgccgccgacatctacatccgggagtactttcacagtcacgtgtcaggcggacatcccgaagccacccccctgagagttatgtacaccgatagaccacttagccagactgaccccgtgacactgcagtattgctgcctgacggacgacagacaggcgttccggcctcccacccgcgcagagctggcgcgtcaccgcgtggttgtgactacaactagccaggccagggaattacgcgtacctgtaggttttttctctcacattctcattgatgaggcagcccagatgctggagtgtgaagcgctgaccccactggcttatgccagccatggtactagactggttctcgccggggatcacatgcaggtgacccctaggctgtttagtgtcgcaagggcaagagcagccgagcacaccctgcttcatcgtctgtttctatgctaccagcaggagacgcacgaagtggctagacaaagccgtctggtattccacgagaattaccgctgtacagacgctatagtgagcttcatttcgcgtcatttttacgtagcgaaggggaatccaattcacgccaggggcaaggtgccgcctcaccccaggcattaccccctcatgttttgtcacgtggcaggttcccccgatcgcgacatgtccatggcctcctggctaaatctggctgagatcgctcaggtcgtggagaaagtgcaagaagcatacaacacctggccttcatgttgggggggccgcgaacagcgttgcatttgcgttgtgtcgcacggtgctcaagttagtgccttgagacaagaactgcgacgcagagaccttggtcaggtatcagtggggagttttgagatcctgcccggtcggcagtttagggtcgtcgtcttatcaaccgtgcacacttgccagagcttgttgagccctggcgcgctggcaccagaatttttcacagacgcacgtgtattgaatacggttctgacacgggcccagagccaactggtggtggtaggtgacgcggttgcactttgctccttcggcgcttgtggtaagctttgggagagttttatcagagagtgcgtcgaaagacatagcgtctgcccagaaggactttcgatggagcaggtcgagcaaggtgttgcccagagaagaagatggcccccacgtgggacccaggccggagctgccggtaattgggaagctgcccctgaacccgtgggggatctggcagaagaacaggccgccgtagtaaccgccatggtaaaggcagaacccggagacgaggctctgagtcctgctagtcgcgatattaccgccactaccgcacaaacagaagccgccgccgcccccgcaggcgacgccgtgaaggaagacgtcgtgcctggggcttgtgcagcaggagcggccgcggccgcaggcgtggagtcgactgaagcagaggatgccgaggcagacttttggccttgggatggcgagcttaatgccgacgatgctatacttcgggaattgcttgatgaaagccagaaggtgatggttacagtgggcgaggacggactgctggacaccgtagctcggcccgagtctctgcaacaggccagactttacgaaaaccttcctccagctgctctgcgtaagctgctgcacgctgagccagagcgctacagacactgcagtttcgtgccggaaaccttcgaacgagcatcagctattccattagacgacgcatcaagtggcccgatacaagtccggggcagactggactgtgggatggcctttgccggagacgaagtcctggtccagctcctctccggtgacaaagcccccgagggacggctgaggggccgcgtgcttggggtgctgaaaagaaaacggcatgagctggcatttgtttgccggatggacacctgggatcctcgcatcatggtgccaattaatggaagcgtcactaagatattcgtcgccgagcttaaagaccccagtcaggtcccaatctactcactacgcaagggtagactgcagcgcgttggacttgagagactgaccgcggaggcaaggcacagccgacttttctgggtgcagattgtgctgtggcgtcaaggcttttactacccactgggaatcgtgagggaggtgcttcccgaagcctccacctgggaacaggggctgagaatcctaggcctcgaatatagtctgcgagttccacccagcgatcaggccaccatcacgaaggtgttacagaaataccacaccgaactcggcagagttgccggaagacgggaagattgtcgtgcgtttctgactttcacagtcgacccacagggagcctgcaatctggacgacgccctctcagtgcgcgacctgggcccccggtgcgaggtagccgtgcacatcactgatgtggcttctttcgtgccccgagatggagtgctggacgtggaggcccgacgccagggcgcagccttctacgccccagggagggaacccgtgccaatgctccccgcaagcttgtgtcaggacgtgctatccttgcttccaggccgcgaccgactcgcaatttctctgtttttaacaatggagaaagcctccgggcaactgaagagcttaagattcgcgccctcggtggttcagtctgaccgacaactcagctatgaagaggcggaggaggtgatccgtcagcacccaggagcaggtcgcgagctgccagccaggctggactccgtagacgcatgcgtagtggccgcgtgctacttctccagactcttgcgccgtcaccgcctgcggtctgattgcttctatgaacaacctgatgaggacggcacacttgggtttcgagcggctcatatcatggttaaagagtatatgattcagttcaaccgactcgtggcagaattcttggtgggttcggaatgtactaggacggtgacaccgctcagatggcagcccgctccccgctctcagcaacttaaagcactgtgcgagaagcatggcgaccgggtgccactgtcactacacctaggccaccacttgcatggaggaggaggaagcccccccgacaccagactccacctgctggcttctctgtggaaacaggttcagttcgctgctcgtactcaggactacgaacagatggtggacctggtgacaaccgatgacatgcacccattccttgcacctgctggtagggacttgagaaaggcacttgaacggtctgcatttggacggtgtgctcgggggcatcaacagcagggaggacactacagtcttcaggtggactggtacacctgggcaaccagtcctattcggagatatttggacgtggtgctgcaacgacagattttgctcgcccttgggcatgggggtagcgcgtatagcgctagggacatagacgggctgtgccaggccttcagcctgcaacacgccctcgcccagagttaccaaagacgagctcgatctctgcacctggccgtgcagctgaaggcccagccccttgataagttagggttcgtggttgacgtggaggcgggaagcagatgtttcaggctattatttccatcgaatagagaaacgttgccagatccatgccccgtcccctacgggtcacttcaacttgctgagcatccgcacgctctggccggcagaccaggcctgcgtctcctgtggcgccgacgcgtgtacagtgcccaaggcagttccccccccctcccactgcctgggaccgtgccagatccccacaccctagcagttgaaactgccctttggaaacaactattggagctggtggagctccaaagatggcccgaggctgctgcactcattcaggaaaaaggggaagcctctcaacgcagagagctggtgcaagtgcaacgcagtcattgcggtcacttcctcgaagtggctcgggaactaggctccggagatactctgcaggtgcagctgggtacgtctctgcaacacggcttcctggtgccatctcctcaactctggaccgtggctccaggatttagcttgtgcctagagcacgttgagcggccgggtgattgtttttcagggagagtgtacagggcgccacgcgatagatacagagatgtcgacgaatatgcatgcgtatgggagcctttctgtgctttagagagcgccacaggcgccgttgccgagaatgactctgtgactcttcagcatctctccgtgtcttgggaagcctcccggacaccgcagggccagctccagggtgcctttcgcctggaagctgcctttctggaagagaactgcgccgacattaacttctcctgttgctacctctgcattcggctggaagggctgcccgcccctacagcctcacctcgaccgggacccagttctttggggccggggctgaatgtcgatcccggcacttacacctgggtcgcacatggacaaacgcaagattgggaccaggagcggcgcgctgacaggcaggaagcgccacgcagggtgcatctgttcgtgcaccacatgggaatggagaaagtgccagaagaagtgttgaggcccggaaccctgtttacggtcgagttactccctaaacagctgcccgatctaaggaaagaagaagccgtgcgaggtctcgaggaagcaagtcccctggtcacttctattgcgctgggtcgtcctgtacctcagccgctctgccgagtgatcccctcaagatttctcgagagacagacatacaacattcctggtgggagacacaagctaaaccctagccagaacgtcgctgtgcgtgaggcattggagaaaccctttaccgtgatccaggggccaccaggaacgggcaaaaccattgttgggctgcatatagtgttttggttccacaaatctaatcaggagcaggttcagcccggcggacctcctaggggtgagaagcggctgggcggcccctgcattctctactgcgggccatccaataagagtgtggatgtgctggctgggctgttgctgcggaggatggaattgaagccccttagagtctatagcgaacaggccgaggcctcggaattccccgtcccccgtgtaggctcaagaaaattgttacgaaaaagtccgcgggaagggagacccaatcaatcacttagatctatcacactccaccatcgcattaggcaggctcccaacccctatagttccgagatcaaagctttcgacacccggttgcagcgaggagagctcttcagccgggaagatctggtgtggtataaaaaggtattgtgggaggcgaggaaattcgaactggaccgacatgaggttatactatgcacctgcagttgtgccgcgtctgctagcctgaaaatcctagatgtgcgccagatccttgtggatgaggccggcatggccacggaaccagagacgctcatcccccttgtccaatttccacaggctgagaaagtggtgcttctcggggatcacaaacaattgcgtccggtcgttaaaaacgagagactccagaatctcggtctagacagatccctgtttgaacgatatcatgaggacgcccatatgcttgacacacagtataggatgcatgaagggatttgcgcttttccatccgtagcgttttataagtcaaagctcaagacttggcagggcttgaggagacctccaagcgtgctgggacatgcgggtaaagagagttgccccgtcatcttcgggcacgtgcagggccatgagagatcactgctggtaagcacggacgaaggtaacgaaaactcaaaggccaatctcgaggaggtggccgaagtggttagaatcaccaagcaactgactctgggccggactgtggagccccaggatattgccgtcctgaccccatataatgctcaggcttctgaaatatccaaagctctgagaagagagggtatagcaggggttgctgtctcatctatcaccaagtcacagggatccgagtggcgatacgtgctagtctccacagtgaggacgtgtgcgaagagcgaccttgaccagcgcccgacgaagtcatggctgaagaaatttctggggttcgtcgtggatcccaatcaagtgaacgtggcagtgacccgagctcaggaaggactgtgtctgatcggcgaccacctgctgcttagatgttgtcctctgtggaggtctctgctggatttttgtgaggctcagcagaccttggttcccgcaggccaggtgcgcgtttgtcggcggccaacaatgccttcgtag

SEQ ID NO: 20095 - DNA, 7950 bp, Artificial Sequence
  Description of Artificial Sequence: Synthetic coding sequence
atggccgtgtgggaggccgagcagctgggcggcctgcagcggggcgatctgctgaccccccccgcaccagatggcgatgggagaactgcccccctggggcagccaccaggcgctcaactgtactgccctgcctgtctcgtcacatgtcatagtcaggaagcttttgaaaaccactgcgcctcttctgagcacgcccagatggtcgccttcgaccaggcgctgccatgggagcaccgtagcccgcctcccgggctgtccaaatttgagctttgccccaaaccagacctatgtgagtatggggacgcgtgcaccaaagcccattccgcccaggagttgcaggaatgggtcaggaggacccaggccgtggagctcaggggccaggcggcttggcaagatggattagtaccttaccaggaacggctacttgctgagtaccagcggagctcaagtgaggtgcttgtactggccgagacactagacggtgtaagggtcacctgtaaccagcctctgatgtatcaagcccaagaaaggaaaacccagtactcttggacatttgcagtgcatagtgaggaaccgttgcttcatgtagctcttctgaaacaggaacccggcgccgacttctctttggtggccccgggactgccaccaggcaggttgtacgctcgcggggagcggttcagagttccctctagcaccgctgacttccaggtcggcgtgagagtgcaagctgcttctttcggcacatttgagcaatgggtggtgttcgactttggcagaaggccagtgctactgcagaaattaggcttgcagctggggcagggccgtcgccccggcccttgtcggaacttagctctgggccacccggaagaaatggagcgctggcatactggcaaccggcatgtagtgcccggggtcgagagaaccgccgaacagacagcgttaatggctaagtacaaaggcccagccctggccctggagttcaaccgttcttctgtggcctccgggccaatctcacccaccaattaccggcagagaatgcaccaattcctttacgaggaggaggcggctcagcagcagctagtggctaagctcaccctcagaggccaggtgttcctgaagaccgctctccaaacccccgcactcaatatgctttttgctccccctggcgccctttacgcggaagtaccagtcccttccagcctgatgcccgacacggatcaaggctttctccttggacgtgctgtcagtactgctctggtcgctcccgtccctgcccctgacaacaccgtcttcgaggtccggctggagcgcagagcaagctccgaacaagcactctggctgctcctcccagcccgctgctgccttgccctggggctgcagcccgaggcccgccttgtgctggaggtgcaattccagattgacccaatgacgttcagactgtggcatcaggcggtagatacgctgccagaagagcagctggtggtgccagacttacccacctgcgctctccctcggccatggagcgtacccccactccgcaggggaaacaggaagcaggagcttgcggtggcgttgatcgctggttgggggcctggggacggaaggcgagtgccgcctttactgatttacggacccttcggtactgggaaaacgtataccctggctatggcctccctggaggtgattagacgccctgagacaaaggttctaatctgtacccacacaaattcagcggctgatatatacatacgggagtactttcatagccatgtttcaggcggtcacccagaagcaaccccactgagggtcatgtacacggaccgtcccctgagccagactgatcccgtgacattgcagtattgttgtctaaccgacgatcgacaggctttcaggccccccacccgagccgaactggcccgccatcgggtagtggtgacgactacctctcaggccagagaactccgtgtacccgtgggattcttttcacatatactgattgacgaggcggctcagatgctagagtgtgaagcgctgacccctctggcctacgctagtcacggcaccaggctggtcctcgccggggaccacatgcaggtcacccctaggctctttagcgtggcaagggcccgggcagccgagcataccttgttgcatcgcctctttctgtgctatcagcaggagactcacgaagttgcacgacagtcacgtctggtgtttcatgaaaactacagatgcaccgacgcaatcgtctcctttatatcaagacacttttatgtggccaaagggaaccccatacacgcccgaggaaaggtgccccctcatcccagacattaccccttgatgttttgtcatgtcgctgggagtcctgaccgggacatgagtatggcatcttggctcaacctcgctgagatcgcccaggttgtcgaaaaggtccaggaagcctataatacctggccaagctgttggggcggtagggaacagaggtgtatttgtgtggtgtcccacggcgcgcaggtgtctgccctgcggcaagagctaagacgccgggatctgggacaggtctccgtaggctcatttgagattctaccaggaaggcagtttcgcgtcgttgtactgtcaaccgtgcacacctgccagtcactgctttctccaggagcgttggcccccgagttctttacagacgctcgcgtgctcaataccgtcttaacccgagcccagagccagcttgttgtcgtcggagatgctgtggccctgtgcagttttggggcttgtggtaaattgtgggaatccttcatccgggagtgcgttgagagacacagcgtttgccccgagggtctctccatggagcaggtcgaacagggggttgcccagcgacggcgctggccgcccaggggcactcaggcaggtgctgcggggaactgggaagctgccccggagcccgttggtgacctggccgaggaacaagcggctgtcgtaactgctatggttaaagcagaacccggcgatgaagcactgtcgccagcctcaagagacattactgctactactgcccagaccgaagcagccgctgctcctgcgggggacgcagttaaggaggacgtcgtccctggtgcgtgtgctgcaggggcagcagcagccgccggggttgagtccaccgaagccgaggatgcagaggcagacttctggccctgggatggcgagttaaatgcagatgacgccatcctgagagaacttctcgatgaaagccaaaaggtaatggtgaccgttggcgaggacggtttgctggataccgtagctcggcctgaatcactgcagcaggcacggctttacgagaatctcccacccgctgcattaagaaaattgctgcatgccgagcctgagcggtaccggcattgctctttcgtccccgaaaccttcgaaagggccagcgcaatccccttggatgacgcttcatcagggcccatacaggtgagaggccggttggactgtggcatggcatttgccggcgacgaagtcttggtacagcttttatccggagataaggctccggagggccgcttgcggggccgggttctgggtgtgctgaagaggaagcggcatgaactggcctttgtatgcaggatggacacctgggacccacggatcatggtgcccattaatgggagtgtgaccaaaattttcgtggccgaattgaaagatccctcacaggtccctatttattctctgagaaagggacgcttgcaaagggtggggctggagcgacttaccgccgaggcaaggcacagtcgcttattctgggtgcagattgtgctctggagacagggtttctactacccattaggaatagtccgcgaagtgctccctgaggcttccacctgggagcaaggcctgcggatcttaggcctcgaatattccttgagagttccgcccagcgatcaggcaacgattacaaaggtgcttcagaagtatcataccgagttgggacgagtggctggaagacgagaagactgccgcgctttcctgacctttactgtggatccacaaggagcttgtaatctcgacgacgccctatcggtacgggatctgggccccagatgcgaggtcgccgttcacatcactgacgtggcctcatttgtgccccgtgacggcgtgctggacgtcgaagcacgtaggcaaggagctgccttttacgcccctggccgcgagcctgtccctatgcttcccgccagcctctgccaagatgtcctttctttactgcccgggagggaccggttggctatctcactgtttctcaccatggagaaggcaagtggacagcttaaaagcctccggttcgccccaagcgtcgtacagtctgatagacagctgtcgtacgaggaggccgaggaggtcattcgccagcaccctggagcaggtagggagctccccgctcgcctcgactctgttgatgcttgtgtcgtggcggcctgctattttagtcgactgcttcgtaggcaccggctccgaagcgactgtttctatgagcagcctgatgaggatgggactctggggtttcgtgccgcacacattatggtcaaggagtacatgatccaattcaacagactggtcgcagagttcctggttggtagtgagtgcacgaggaccgtcacgccattgaggtggcagccagcgcctcgctctcagcagctcaaggcactgtgcgaaaagcacggagacagagtccccctgtctctgcacctgggccaccaccttcatgggggtggcggcagccctcccgatacacgtcttcatctcctcgcttcactgtggaagcaggtgcagtttgccgccaggacccaggactacgagcaaatggtggacttagtaacaaccgatgacatgcatccattccttgcccccgcggggcgcgatctgcggaaggctttagaacggtctgcattcggaaggtgcgccaggggccatcagcaacaaggaggacattactccctccaggtagactggtatacctgggcaacctccccgatcaggcgatatttggacgtcgtgctgcagcgccagatattactggccctgggacacggagggagcgcttatagcgcacgagacatagacggcctgtgccaggcctttagccttcaacacgccctagcgcagtcctaccagcggcgcgcaagatctctgcatctcgcagtgcagctgaaggcccaaccactggacaagttaggatttgtggtggacgtggaggcaggatcacgctgcttccgtcttctctttcccagcaatcgagaaaccctacctgacccttgccccgtcccgtatggctctctgcagctggctgaacatccccatgccctcgccggtaggcccggcctgaggctgctgtggagacggcgcgtgtatagcgcccagggatccagtcctccactccctttgcctggcactgttcccgaccctcacacactcgctgtggaaaccgccctatggaagcaactgcttgagcttgtagagttacaacggtggccggaagccgctgccctcatccaggaaaaaggagaagcctcacagcgaagggaactggtccaggtgcagcggtctcattgtgggcactttctagaggtggcgagggagttggggtctggcgacaccctccaggtgcaattagggactagccttcagcacggcttcctcgtgcccagtccacaactgtggactgtcgcacccgggttttctctgtgccttgaacacgtggaaagacctggagattgcttctctggccgggtctaccgagctcctcgggaccgttaccgcgacgtcgacgagtatgcctgcgtgtgggaacccttctgcgcactggaatcggccacaggcgccgttgccgagaatgactctgtcaccctgcagcatctgtccgttagctgggaggcatccaggaccccacagggccaacttcaaggagcctttcggttggaagcagcctttctcgaggagaattgcgccgacattaatttttcctgctgctatctgtgtataagactggaagggctgccagctcctaccgccagcccaaggcccggtccatcctctctggggcccgggctgaatgtggatcccgggacttatacctgggtcgctcacggacagactcaggactgggaccaagagcgccgtgccgaccggcaggaagcaccacgccgcgttcatctatttgtccatcatatgggtatggaaaaggttccagaagaggtcctccgacctgggactctgtttaccgtggaacttctgcctaagcaactgcccgacctccggaaggaggaggctgtccggggccttgaggaagcttcccccctcgtaacttctatcgcgctgggaaggccggttccccagcctctctgtcgggttattccatctcgattcttggaaagacaaacctacaacataccagggggtaggcataagctcaacccgtctcagaatgttgctgtacgtgaagccctggagaagccctttacagtgatacagggacccccggggactggaaaaaccatcgttggcctacatatcgttttctggttccacaagagcaatcaggagcaagttcaacccgggggacccccgagaggcgaaaagcgcctgggggggccctgcatcctgtactgcggaccaagcaacaagagcgtcgacgtgctggcgggcctgctcctgagaaggatggagctgaagccactcagggtttactccgaacaggccgaggccagcgagtttcccgttccacgggtcggcagtagaaaacttctgaggaaaagcccaagggaaggccggccaaaccaaagcctgagaagcattacattacaccacagaattaggcaggccccaaacccatattcttcagagattaaggcttttgacactcgcctgcagagaggcgagctgtttagcagggaagacctcgtctggtacaagaaggttctgtgggaggcaagaaagtttgagctcgatcggcatgaggtgatactgtgcacatgctcttgtgccgccagcgccagcctcaagatcctggacgtccgccaaatcctggtggacgaggctgggatggccactgagcccgaaacattaatacccctggtccagttcccccaggcagagaaggtggtattgctaggagaccacaaacagcttcggccggtggtgaagaatgagcgactccagaatttggggcttgaccggtctctgtttgagcggtaccacgaggatgcgcacatgctcgatacccaatacagaatgcacgaagggatatgcgccttcccatctgttgctttctacaaatccaaacttaaaacgtggcagggtctccgaaggcctccatccgtcttaggccacgcaggaaaggagtcatgccccgtgatcttcggacatgtgcagggccacgaaaggtctctgttggtgtccaccgatgaaggcaatgagaactccaaggcaaacttagaagaggtggcagaggtggttcggattacgaaacagttgactttaggaagaactgtcgagcctcaggacattgcagtactgacgccctataatgcacaagcatccgaaatatctaaggcactgcgccgagaaggtattgccggcgttgccgtctcatccattaccaaatcccagggatcagaatggcgctatgtgctggtgagtaccgtgcgaacttgtgccaaatcagatctagaccaacgaccaacaaagagctggcttaagaagttcctgggttttgttgtagaccctaaccaagtgaatgtcgccgtcactagagctcaggaaggcctctgcctgattggagatcatctcctccttcgctgctgcccactgtggcggagtctactggatttctgcgaagcacagcagacgctggtgcctgcaggacaggtgcgcgtttgtagaagacctacaatgcctagctag

SEQ ID NO: 20096 - DNA, 4995 bp, Artificial Sequence
  Description of Artificial Sequence: Synthetic coding sequence
atggccgcccggcggggccggcgggacggcgtggccccccccccctctggaggccccggccccgacccaggcggcggagctcgcggcagcgggtggggctcgcggtctcaggcgccgtatgggactctgggtgccgtttccggaggggaacaggtgctgctccacgaggaagctggtgacagcggatttgtgtcactgagtaggctcgggccaagtctcagggacaaagatctcgagatggaggaactgatgttacaggacgagactctgttgggaacaatgcaatcatatatggacgccagcttgatttccctgatcgaagactttgggtctttaggcgaatcacgcctatcactggaagatcagaatgaagtcagcttactgacagctttgaccgagatcctcgacaacgccgactccgagaacctcagcccgtttgatagcatccccgatagcgagctccttgtgagcccaagggagggcagcagtctacataagctgctgacactgtctagaacgccaccagagcgagatcttatcacccctgtcgatccacttggaccctctacaggaagcagccgaggatccggggtggagatgtcgctccctgatccatcttgggatttcagccccccttcattcctcgagacatctagcccaaaactgccttcctggagacccccccgttctaggccaaggtggggacagagcccacctcctcagcagcggtcagacggtgaagaggaagaggaagtggccagtttctctggccagatccttgctggcgaattggataactgtgtgagctcaatacctgatttcccgatgcatctggcctgtccagaagaagaagacaaggccaccgccgccgaaatggcggtaccggccgctggtgatgaatcaatctcgtccttatccgagctggtgagagctatgcacccttattgcttacctaatctgactcacttggcatctctggaagacgaactgcaggaacagcccgacgacctgactctaccagagggctgcgtcgtgctggagatagtggggcaggcagccacagctggtgacgacctcgaaatcccagtcgtcgtccgccaggtatcacccggcccaagaccagtactgctggacgactctctggaaaccagctccgctctgcagctgctgatgccaactctggaatcagagacagaagcagccgtgccaaaggtcacactgtgctctgagaaggaggggctgtctcttaattcggaagagaagctggactcagcttgtcttctgaaacctcgcgaagtggtagagcccgtagtccccaaagagccccagaatccacctgccaacgcagctcccgggagtcagagggccaggaaaggaagaaaaaaaaaatccaaagaacagcctgccgcctgcgttgaaggatacgcacggaggttaagatcttcttcccggggccagagcaccgtgggtacggaggtgacttctcaggttgataacctgcagaaacaacctcaagaagaattacaaaaggagagtgggcctctccaggggaagggaaaacccagagcttgggcgcgggcgtgggccgcggcactggaaaactcttcccctaagaatctggaacgctcggctggccagtcctctccagcaaaggaagggcctcttgatctctacccgaaactggctgacaccattcagaccaaccccatccccacacacctctcacttgtggatagcgcccaggcaagtccaatgcctgtggacagcgtggaggctgaccccacagcagtaggacccgtactggccggcccggttcccgtggaccccgggctggtggaccttgcgtccacctctagcgagctggtcgagccccttcccgccgagcccgtcctgatcaacccagttttagcagacagcgccgccgtggaccccgcagtagtccccatatcggataacttgccccctgtggacgctgtgccgtccgggcctgctcctgtcgacctagcgctggtggatcccgttcctaatgatctcacacccgtggatcccgtactggtaaagtcccggcctaccgaccccagacgcggagcagtgtcttcggccctgggtggctctgctcctcagttgctggtggagagtgagagtttggacccccccaagaccatcataccagaggtgaaggaagttgtggatagcctgaagattgaatcggggacctcagcaaccacgcatgaagcgcgccctcgaccactgtccttgagtgaataccgtagaagaaggcaacagcgccaggcagagacagaggaacgcagcccacagccgcccaccgggaagtggcccagtttaccagaaacccctactggcctggctgatatcccttgcttggtgatcccccccgcacccgccaaaaagactgctctgcagcggagcccagaaacccccctcgagatatgtctcgttccagtcgggccaagtcccgcttcaccatctcccgaacccccagtgagtaagccagttgcatcctcccctaccgaacaagttccgagccaggagatgcccctcctggctcgcccttcaccacccgtccagagtgttagtcccgctgtgcccaccccaccttctatgtctgccgcactaccattcccggctggagggttaggtatgccccccagccttcccccccctcccctgcagcccccatccctgcccttgagcatggggcctgtacttcctgatccatttactcactacgcaccacttccctcctggccttgctatcctcatgtgagtcccagcgggtatccttgtctgccgcccccaccaaccgtgccgctggtaagcggtacacccggggcgtacgctgtgcccccaacttgttccgtgccttgggcgccgccacccgcacctgtgagtccatattccagcacatgtacctacggcccattaggttggggccctggcccccagcacgctcccttttggagcacagtgcctccgccccctcttccccccgcatcaattggccgggcggtaccccagcctaagatggagagtcgaggcaccccagccggtccacctgagaatgttcttcccctgtcaatggctccgcctctttctctgggattgccgggccatggagcaccccagaccgaacctacgaaggtggaggtgaaacccgtgcccgccagccctcatccaaaacataaggtctccgccctagtgcaatctccacagatgaaggccttggcctgtgtgtccgcagagggagtgaccgtggaagagcccgcgagtgaacgcctgaaaccggagacccaggaaacgcgtccacgcgagaagccacccctaccagcgactaaagccgtgcccacccctagacaatctactgtaccaaagttacctgccgtacatccagctcggcttcggaaactttcattcctgcctactccccgcacccaaggaagcgaggatgttgtacaggcttttatctctgagattggaatcgaagcaagcgacctcagctccttgcttgagcagtttgagaagagtgaagcaaaaaaggaatgtcccccaccggcaccagccgactccctggcggtcggaaattcaggaggcgttgacatcccccaggaaaaacgacccctcgatcgcctgcaagcaccagaactggcaaacgtggcgggactgactcctcccgccaccccaccacaccagctgtggaaacccctcgcagctgtgtcattactcgctaaagccaaaagtccaaagtctaccgctcaagaaggaacgcttaaacccgagggggtcactgaagccaaacatccagccgcggtgcggctgcaggagggtgtgcacggacccagcagagtccacgtcggctctggcgatcatgattactgcgtgaggtcacgaaccccgcccaagaagatgcctgcactggtaattcctgaagtagggtctcgttggaacgttaaacgacatcaagatatcaccatcaaaccagtgctcagtctaggtcctgccgcacctccacctccatgcattgccgcttcacgggaacccctggatcaccgcacgtcgtcagaacaagccgatccttctgccccttgtctggcaccttcctccttgctttcccctgaggcctccccatgccggaatgacatgaacacgagaacaccccctgagccaagtgcaaaacagcgctcaatgcgctgctatagaaaagcctgccggtctgcctccccaagtagccaaggctggcagggtcggcgaggccgaaatagcagatctgtcagttccggtagtaataggacaagtgaggcaagctcttcctcctcaagcagctcctcatcatctagatcacgctccagatcactgtcccctccccacaagagatggcggagaagcagctgttcctcttccggtagaagtaggaggtgctccagcagttcttcaagcagcagctcttcctcctcttcctcttcttccagctcaagctcccgctctaggtctaggtccccctcacctaggcgacggtctgacaggagaaggagatactcttcttaccgctcccacgaccactaccagcgacagcgtgtgttgcagaaggagagggccatcgaggagagacgtgtggtatttatagggaagattccaggccgcatgaccaggtccgaactcaaacagagattttcagtgttcggggaaattgaggagtgtacaatccatttcagggtccagggtgacaactatggctttgtgacctatagatacgccgaggaggccttcgccgccatagagagcggtcacaaactgaggcaggctgacgaacagccattcgatctatgctttggtgggcgtcggcagttttgtaagcgctcttacagcgacttggactccaatagagaggattttgaccctgcccctgtaaaatcaaaatttgactctctcgactttgacaccttactcaagcaggcgcagaaaaacctgagaagatag

SEQ ID NO: 20097 - DNA, 4203 bp, Artificial Sequence
  Description of Artificial Sequence: Synthetic coding sequence
atggccgcccggcggggccggcgggacggcgtggcccccccccccagcggggggcccggacctgaccctggcggcggagcacgggggtccggctgggggtctagatctcaggcgccatacggcacgttgggggccgtgtccggaggcgagcaagtgctcctccatgaagaggctggtgattccggcttcgtaagcctgtccagactcggaccttccctcagggataaggacctcgagatggaagaactcatgctgcaagatgaaacccttctaggcacaatgcagtcctatatggacgccagtctgatcagtctcatcgaagacttcgggagcctcggcgaatctagactgagcctcgaagatcagaacgaggtcagtctgctgacagcattgacggaaattctggacaatgccgactcagagaacctgtcaccttttgattcaatccctgattcagagctgctggtttcaccccgcgaggggtcaagcctgcacaaattactgactctctctcggactccgccagaacgcgaccttatcacgccagtcgatcccttaggcccctcaaccgggtctagtagaggatcaggtgtggaaatgagcctcccggacccctcctgggatttttccccaccttcattcctcgaaacatctagtcctaaacttccttcgtggcgaccccctagaagccgcccaagatggggacagagccctcctccccaacagaggtctgacggcgaggaggaagaggaggttgcctctttcagtggccaaatattggctggcgagttagataattgcgtgtccagtatccccgatttccccatgcaccttgcttgtccagaagaagaggataaagcaaccgcagccgaaatggccgtccctgcagccggtgatgagagtatctcctccctcagcgaactggtgcgcgccatgcacccttattgcctgccaaacctgacacatctggcttctctcgaagatgagctgcaggagcagcccgatgacctgaccctgcccgagggctgtgtggtgcttgaaattgttggtcaggctgctaccgccggcgacgatctggagatccccgtggttgtaagacaggtttcccccgggcctcggcctgtcctcctcgatgactctctggaaacatcatctgctttacagctgctgatgcctaccttggaatccgagaccgaggctgcagtgcccaaagtcaccttgtgttccgagaaggagggcctctctctgaactccgaagaaaagctcgacagcgcttgtttgctcaaacctcgcgaggtggttgagcctgtggttcctaaagagcctcagaatcctcctgctaacgccgctccagggtctcagagagcccgtaaagggaggaagaagaaatcaaaagagcagcctgccgcatgtgtagaagggtacgcccgtcgcttgagatctagcagtaggggccagtctaccgtgggtacagaggtgacgtcacaggtggacaatctgcaaaagcagccacaagaggaactgcagaaagagagtggccctctgcaagggaaaggtaaaccccgagcgtgggcccgcgcctgggcagctgctttggagaactcaagtcccaagaatctagagaggtctgcgggacaatcctccccagcaaaggaagggcctctcgacttgtacccaaaactggccgacaccatccagaccaatcctattcccacgcacttatccctggttgattcagcccaggcttctcctatgccagtggattccgtggaagccgatccaactgcagtgggccctgttctcgccggacccgtccccgtcgatcctggactcgtggacctggcaagcacaagtagtgagctagtcgagcctctccccgccgagcctgtgctgatcaatcctgtgctcgcggactcagcggccgttgaccccgcagtcgtaccaatcagcgataatctgcccccggttgatgccgtgccctctggtcccgctcctgtcgatctggctcttgtggatcctgtccccaacgatcttacaccggttgacccggtactagtgaagagcaggcccactgacccacgcagaggggcagtgtcttctgctctgggagggagtgcaccccagctcctggtcgagagtgagtctctggatccgcccaaaacaattattccagaggtgaaagaagtcgtggattccctgaaaatcgagagcgggacttctgcaactacccacgaggctcgtccacgcccccttagtctgagcgaatatcggcgccggagacagcagcgacaggccgaaaccgaagagcgttcgccacaacctcccactggaaagtggccgagcttgcctgagactccaacagggctggcagacataccatgtctggtgattcccccggcccccgcgaaaaaaaccgctctgcagcgttctcctgagacccccctcgagatatgtttggtgcctgttggtccctcccccgcctcgccaagccctgaacctcctgtgtctaagcccgtggctagttcaccaacagaacaggtcccctcccaagagatgcccctgctcgcccggccctcacctccggtgcagtcagtctcccctgctgtgcccacccctccgtccatgtcagctgcccttccattcccagccggggggctcgggatgcccccttctctaccgccaccccctctgcagcccccaagtttgcctctgtccatgggaccagtcctgcccgatccgtttactcactatgcccccttaccgtcttggccatgctacccacatgtcagcccaagtgggtatccgtgtcttcctccccctcccaccgttccattagtgtccggaaccccgggcgcctatgccgtgcctccaacatgctccgtgccttgggccccacctcctgcccctgtctccccttattcctctacctgtacatatggtcctctgggctggggccccggaccgcagcacgcccccttttggagcaccgtgcccccaccacctttgcccccagcatcaattggaagagccgtgcctcagccaaagatggagtctagagggacaccagctgggccgcccgagaacgtgcttccactgtccatggcgccaccgctgtccttggggctgcccggacatggagcccctcagaccgaacctacgaaggttgaagtgaaaccagtgccagcaagccctcacccgaaacataaggtctcagcgctagtgcagagtccccaaatgaaggccctcgcctgtgtttccgcagaaggtgtcactgtggaggaaccggctagcgaacggctgaagccggagacccaagaaacaaggccgagagaaaaacccccattgcctgcaacaaaggccgtccctactccaagacagtccactgtgcctaagctccccgctgtgcacccagcacggttaaggaagctgagttttttgccaaccccccgcacccaaggcagtgaggacgtcgtgcaggcctttattagcgaaattggcatagaggctagcgaccttagcagtcttcttgagcagttcgaaaaaagcgaggcgaagaaagagtgtcctccccccgcaccagccgattcattggcagtaggcaacagcggctctagttgctcgtcgtcgggcagatcacgcagatgcagtagttcctcctcatcatcctcaagttcttctagctcgtcgtctagttcctctagtagccgctcgagaagccgcagtccaagcccacggagaagaagcgacagacggcgtcgatatagctcatacagatcccacgaccactaccaaaggcagcgggtgctgcagaaggagcgcgctatagaggagaggcgcgtggtgttcatcggcaagattcctggacgcatgacaaggagtgagttgaaacagcgattctctgtgttcggggagatcgaggagtgcaccattcactttagggttcaaggggataattatggcttcgtgacatatcgctatgctgaagaggcatttgcagccattgaaagcggacataagctacggcaggcggatgagcagcctttcgatctgtgttttggcggccgccgccagttctgcaagagatcctattcagatctcgactccaaccgagaggacttcgacccagcccctgtgaagtcaaaattcgacagccttgatttcgatacattactgaaacaggctcagaagaacttaagaagatag

SEQ ID NO: 20098 - DNA, 537 bp, Artificial Sequence
  Description of Artificial Sequence: Synthetic coding sequence
atggccgacggcaaggccggcgacgagaagcccgagaagagccagcgggctggggccgcggggggccccgaagaggaggctgagaagcccgttaagaccaaaacagtttccagctccaacgggggggaaagcagtagtcgtagcgcagaaaaaaggagcgccgaggaagaagcagccgacctgcctacaaagcccacgaagatttctaagttcggcttcgccatcggttcccagacaaccaagaaggcttccgcgatcagcataaagctgggttcaagcaagccaaaggagaccgtaccaacacttgccccgaaaactctgtcagtcgcggccgccttcaatgaagacgaagactcagaacccgaggagatgccccccgaggccaaaatgcgaatgaagaatatcgggagagacactcccacttctgccgggccaaactcatttaataaaggaaagcacgggttctctgataaccagaagctgtgggaacgtaacatcaagtctcacttggggaatgtgcacgaccaagataattag

SEQ ID NO: 20099 - DNA, 4950 bp, Artificial Sequence
  Description of Artificial Sequence: Synthetic coding sequence
atggacgacgacagcctggacgagctggtggcccggagccccggccctgacggccacccgcaagtaggtcccgccgaccccgctggagattttgaggagtcttcagtcggtagcagcggcgattcaggtgatgacagtgatagtgagcacggtgacggaaccgatggagaagacgagggagcctctgaggaagaagacctagaggatcgctccggatctgaggattccgaggacgatggcgagactctgctggaggtggcaggtacacagggcaaactggaggccgccggctcctttaactctgacgatgacgctgaatcatgccccatttgtttaaacgcctttcgggaccaggctgtgggcacgccggaaaattgtgcacactacttctgcctggactgcatcgtcgaatggagcaagaatgcaaacagctgcccagtggatcggacattgtttaagtgcatttgcatcagagcccagtttggaggcaagatccttcggaaaattcctgtcgagaatactaaagcatcagaggaagaagaggatccaactttctgcgaggtgtgtggacgatcagatcgcgaagatcggctgctgctttgcgatgggtgcgatgctggttatcatatggaatgccttgacccccccctccaggaggttccggtggacgaatggttctgccccgagtgcgccgcccctggagttgtgctcgccgctgatgcgggccctgtgtccgaggaagaggtgtcgctactgttggctgacgtggtcccaaccacctcacgcctgcgacctcgggccggccgcacacgggccatagcacgcactaggcagagcgaaagagtcagagccaccgttaataggaatcggattagcacggccagacgggtgcagcacactcccgggcgcttgggctcttctctgctggacgaggcgatcgaggccgttgccaccggcctcagcactgcagtctaccagagaccactgactcctcgtacaccagcgagacgcaaaagaaagactcggcgccgaaaaaaagtccccggtcgcaaaaaaaccccaagtggtccaagcgcaaagtccaagtcctccgcaacacgatcgaagaagagacaacatagagtcaagaagcggagagggaagaaggtaaagtccgaagcgactacgcggagccgtattgccaggaccctcggccttagacgtccagtccactcttcatgcatcccgtccgtgttaaaacccgtggagccttcgttggggctactgcgtgcggacattggcgcggcatcgctctcccttttcggagatccctatgagctcgatcccttcgatagctccgaagaactctccgccaaccccctctcacctttgtcagcaaagagacgggcgcttagccggagtgcgttacagagccatcaaccagtggcgagacctgtctctgtggggctgagtcggcggcggctacccgccgccgtcccagaacctgatctggaagaggagcctgtgccagatcttctaggcagtatcttgtcaggccagtccctgctgatgctgggaagctctgacgtgattatacatcgcgatggaagcctgtccgcaaagcgggccgcccccgttagctttcagaggaatagtgggtcactgtcgagaggcgaagagggatttaaaggttgcctgcagcctcgggcattgccttccgggtccccagcacaaggtccctctgggaatagaccgcaatcaaccgggctgtcctgtcagggtaggtcgcgaacccccgcgaggaccgctggcgcacctgtgcgcctcgacctaccagcagcacccggagccgtgcaggcccgcaatttgagtaatggatccgtgcccggcttccgtcagtctcactctccttggtttaacggcaccaataagcatactcttcctttggccagtgctgcttccaagatttcaagtcgggattctaagccaccctgtagaagcgtggtgcccggaccgcctttaaagcccgctccccgtcgcacggacatctcagaactccctaggatcccgaagattaggagggacgacggaggtggaaggcgggatgctgccccggctcatggccagtctatcgagatcccatcagcctgcatttcgaggctgactggacgagaaggcactggccaacccggaagagggactcgcgctgagtctgaagcatccagccgagtgccacgggaaccaggtgtccatacgggttcgagccgcccacccgcacctagcagtcatggatctctggctccattggggccgtccagaggaaaaggagttggttctacatttgaatcatttagaatcaatatcccaggaaacatggcccattctagccagctctcatcacccgggttctgtaacactttcagacctgtggatgacaaggagcagagaaaagaaaacccttctcctctgtttagcatcaagaaaaccaagcagctgagatcggaggtatacgatccatctgaccccaccggcagtgatagtagcgcccccgggagttctcctgagcgatccggtcccggtctgttgcccagcgagattacccggactatcagtatcaattcacccaaagctcagactgtccaggctgtacgctgtgttacctcctataccgttgagagcatttttgggaccgaacctgaacctcctttgggtccatcatcagccatgtcgaaactcagaggcgcggtagcggccgagggtgcatccgacaccgaaagagaggagcctaccgagtcccaaggactggcggcccggttgcgccgaccctctcccccagagccctgggacgaggaagatggcgctagctgcagtacattttttggatctgaggaaaggactgtgacctgtgtgacagtcgtggagccagaggcccctcccagcccagatgtactgcaggcggctacccatcgagttgtcgagctgcgccccccgagtcgctccaggtccacatcctctagtaggtcaaggaagaaagccaaaagaaaacgagtatcccgtgagcacggtagaaccagatcgggcaccagaagcgaaagcagagacagatcctccaggagtgcttcaccttccgtcggagaggaacgccctcgcaggcagcgtagcaaggccaaaagtcgcagaagctcgtcagaccggagctcttctcgcgagcgagcaaagaggaagaaggcaaaagacaaaagccgtgaacaccggagaggcccttggggacacagtcgcaggacttccagatctcgctctggcagtcctggaagcagcagctacgagcattacgagagcaggaagaagaaaaaaaggcgttccgcaagccggccgagggggagggaatgctccccaacttcctcactggagagactgtgccggcacaagcatcagcgggagcggtcacacgagcggccagatcgcaaagagtctgtggcttggccacgtgaccggagaaagagacggtcgcggtctccgagctcagagcatagagcccgtgaacacagaagacctagatccagagagaagtggcctcaaacaaggtcccactcccccgagagaaagggcgccgtgcgagaggcctctcccgccccccttgcccagggggagcctggtcgggaagatctaccaacaagactgcccgcgctcggtgaggcacacgtgtcacccgaagtggcgactgctgacaaggcacctctccaggcccctccagtcctcgaggtggcagcggagtgcgagcctgatgatttagacctagattacggagattccgtcgaagccgggcatgtattcgacgattttagcagcgatgccgtgttcattcagctcgacgatatgtccagtccccccagccctgaatccaccgacagctcaccagaaagagatttccccctgaagcctgcattaccacctgccagcttagctgtggccgcaatacagcgcgaggtctctcttatgcacgatgaagatccctctcagcccccacccctccctgaaggaactcaagagccccatttgctgcgccccgatgcggccgaaaaggcagaggctccatcatcaccggatgtggctccggctggcaaggaggatagcccttctgcctctgggagagtccaagaggcagcccggccggaagaagtggtttctcagacacccctcttgaggagcagggccctcgttaagagagttacatggaacctccaggaatctgagagcagcgcccccgcggaggacagagctcctcgggcccccctgcatcggccccagaaaccaagggaaggggcctgggacatggaagacgttgcccccaccggtgttaggcaagtgtttagcgagctgcctttcccctcccatgtattgccggagcctggttttcccgacactgatccaagtcaagtgtacagcccaggtctacctccggcccccgcccagcccagcagcatcccgccctgtgcattagtgtcccagccgacggttcagttcattttacagggaagtctgccccttgtgggatgtggagcagctcagacacttgcccctgtgcctgccgccctcacccccgcctctgagccagcgtcccaggccacggctgcttccaactctgaggagaagactcccgcaccgcgattggccgccgaaaagaccaagaaggaagaatacatgaaaaagcttcacatgcaggagcgcgcggttgaggaggtcaagctggcaattaagcctttctatcagaagagggaggtcacaaaagaggaatacaaagacattctgcggaaggcggtgcagaaaatttgtcacagcaaatctggcgagatcaatcccgtgaaggtggcgaacctggtcaaggcatacgtggacaagtaccgacacatgcggaggcataagaagcctgaggctggagaagaaccccctacacagggggccgaggggtag

SEQ ID NO: 20100 - DNA, 4947 bp, Artificial Sequence
  Description of Artificial Sequence: Synthetic coding sequence
atggacgacgacagcctggacgagctggtggcccggagccccggcccggacgggcacccccaggtggggcccgctgaccctgcgggcgactttgaagagtcttctgtggggtctagcggagacagcggggatgactctgattccgagcacggcgatggaaccgacggagaggatgagggtgcttcagaggaagaagatctggaggacagatccggaagcgaggacagcgaggatgacggcgagaccctgctggaggtggctggaacccagggtaaattggaagccgccgggagcttcaactccgatgatgacgcagaatcttgtccgatatgtttaaacgcttttagggatcaggctgtcggcacccctgagaattgtgcccactacttctgcctggactgcatcgtggaatggagcaaaaacgccaattcttgcccagtcgaccgtaccttatttaagtgcatatgcattcgggcccaatttggcggaaagattctgcgtaagatcccagtcgagaataccaaagcctccgaggaggaggaagaccccacattctgtgaagtgtgcggacggagcgaccgagaagaccgtctgctactgtgcgatggctgtgatgcagggtatcatatggagtgccttgaccctccgctgcaggaagttcccgtggacgaatggttctgccctgagtgtgccgcgccaggagtggtgctggcagccgacgccggaccagtgagcgaggaggaagtgtctctcttattagcagatgtggtccccacaacgagccgtttaagacctagagcaggcagaacaagggccatcgcccggacgcggcagtccgaacgggttcgcgcaacagtgaaccgcaatcgcataagcacagctcgacgtgtgcagcatactcccggccgactcggttcttccctgctggacgaggcaattgaggcagtagccacaggtctgagcactgccgtctatcagagaccactgacaccacggactccggccaggcggaagcgaaaaaccaggcggcgcaagaaagttcctggtagaaaaaagacccctagcgggccgagcgcaaagtcaaagtcaagtgccacacgcagcaaaaagaggcagcatcgcgtaaaaaaaagaagaggaaagaaagtgaagagcgaagcaacgaccaggagtagaatagctcgcaccctcggcctgagacgacctgtgcactcatcctgtataccaagtgtgctcaagccagtcgagccttcgctagggctgctgcgagctgacataggagcagcttcactcagcctcttcggtgatccatacgagctggatcccttcgatagcgaggagttaagcgccaaccctctgtcgccactctccgccaagcgacgcgctttgagcaggtcggctctgcaaagtcatcagccggtcgccaggcccgtgtccgtgggactctctagaagacgcctgcctgctgctgtccccgaaccggatctggaggaggagcccgttcctgatttactcggcagcatcttgtccggccagtctctattgatgctcggctcatccgatgtgattatccacagagatggttcattgtctgctaaacgcgccgcacctgtgagtttccaaagaaatagtggctccctcagcaggggagaagagggatttaaaggctgtctgcagccacgagctctcccgagcggaagtccagcgcaagggccatcaggaaaccgtccacagagcacaggcctgtcgtgccaagggagatcgcggactcccgcacgaacagcgggagcccccgttagactggacctgcctgctgcacccggggcggtgcaggctagaaatctatctaatgggtccgttcctggttttcgtcagtcccatagtccttggtttaacgggactaacaaacacacgctcccactcgcaagtgcagctagcaagattagctcgagggactctaagccgccctgtaggtctgtcgtgcctggtcctccgctgaaacccgcacctcgaagaacggacatatcagaactcccacgtatacctaaaattcggcgggatgatgggggcggcaggcgcgacgcggcccccgcgcatggccagtcaattgaaatcccgagtgcatgcatctctaggctgaccggacgcgagggtacagggcagcctggcaggggaacgagagcagagtcggaggcatcatctcgggttccgcgagaacctggagtgcacaccgggagtagtcgaccccccgcgccgagctctcacggctctctcgctcccttgggcccttcaagggggaagggagtggggtccacattcgaatctttccggattaatattcccggtaatatggcacactcctcacagttaagtagcccaggtttctgcaacacatttcgtcctgtcgatgataaagagcagaggaaggaaaatccctccccattgttctccatcaagaagaccaaacaactgaggtctgaagtctatgatccctccgatcctactggttcggacagctccgccccagggtcctcaccagagcggtctggaccaggtctcctgccatcagagattacacggaccatttcaataaattctcccaaggcacagacagtacaggcggtcagatgcgtgaccagttatactgtggaatcaatcttcggcacagaacctgagccccccttggggccttcctccgcaatgtcaaaattacggggcgcagtagcagctgagggtgctagcgatacagaacgcgaagaacctacagaatcacagggtttggcggctaggctgcgccgacctagcccgcccgagccatgggatgaagaagatggcgcctcctgctccaccttcttcggcagcgaagaacggaccgtcacctgcgtaaccgtggtcgagccagaagctccaccttccccagatgtcctgcaagccgctacccacagggtagtcgagctgaggcccccttcaagatcccgctcaaccagctccagcagatcaaggaaaaaagccaagcggaagcgcgtgagccgagagcatggcagaactcggtcaggcactagatccgaaagcagggataggagtagcaggagtgcatcgccctctgttggcgaggagcggccaagaaggcagcgttcaaaggcaaaatccaggcgcagcagctctgacaggtctagcagcagggagcgtgccaaacgtaaaaaagcaaaggataaaagcagagaacaccgccgcgggccatggggacactcgcggcggacctctcgcagtaggtccggcagcccgggttcatcctcttatgagcactacgaaagtcggaagaagaagaagagaaggagcgccagtaggcctcgagggcgcgaatgctcaccaacaagttctcttgagagactgtgcaggcataaacaccaacgagagaggagccacgagaggcccgaccgtaaagaatcggtcgcttggcctcgtgaccgcagaaagcgtaggtcacgcagccccagttccgagcatcgggcccgagagcaccgtcgtccgcgttcccgcgagaaatggcctcaaactaggtcccacagtccggagaggaagggtgccgtccgagaggcttcaccagcccccctcgcgcaaggtgagccagggagggaagacttgccgacaagattaccagccctcggcgaggcccacgtgagccctgaagtagccaccgccgacaaggcccctctacaagccccccccgtgcttgaggtggctgctgagtgcgagcctgacgacctggatctcgattacggtgactctgttgaggccgggcatgtgtttgatgattttagtagtgacgctgtcttcattcagctggacgacatgagtagccccccatcaccagagtctactgacagctctccagagagagacttcccgctgaagccagcgcttccacctgcttccctggccgtcgccgcaatacagcgtgaggtgtctcttatgcatgacgaagaccctagccagcctccccccctgcctgagggcacccaagaaccacatctgctaagaccagacgcagccgagaaagccgaggccccatcttcccccgacgtcgcaccagccggcaaggaagactctccctccgctagcggacgcgtgcaagaggctgctcgcccagaagaggtggtgtcccagacaccacttctgcgatccagggctctggtcaagagggtgacatggaatctccaggagagtgagtcttcggccccagccgaggatagggcgccccgggcaccgctccacagaccacaaaaaccgcgtgagggggcctgggatatggaagatgtcgcccccacgggcgtaaggcaggtgttttcagagttacctttcccttcccatgtcctgccggagcctggatttcctgataccgacccttcacaggtatactccccggggcttccacctgctcctgcacagccctcctccattccaccatgtgcattggttagccagcccaccgtacagtttattcttcagggctccctccctctggtggggtgcggcgctgcacagactctggcccctgtgcctgcggcgctgaccccagcaagtgaacccgcttcccaggcaaccgctgccagcaactctgaggaaaaaaccccagcccccagactggctgctgaaaagaccaagaaagaggaatatatgaaaaaactccatatgcaggagcgggcagtagaggaggtgaagctggccataaaacccttctaccagaagcgagaagtgactaaggaagaatacaaggacatattaaggaaagccgtgcagaagatctgtcactcaaaatcgggcgagattaatcccgtgaaggtcgcgaacttggtgaaggcatatgtggacaagtaccggcacatgagacgccacaagaaacccgaggctggagaggagcccccgacacagggtgctgagggatag

SEQ ID NO: 20101 - DNA, 2115 bp, Artificial Sequence
  Description of Artificial Sequence: Synthetic coding sequence
atgtgggagaagatggagaccaagaccatcgtgtacgacctggacacctctggcggtctgatggagcagatccaagctcttctggcaccgcccaagactgatgaggctgagaagcgctcaaggaaacctgagaaagagccacgaaggtccggcagagcaaccaaccacgacagctgtgattcttgtaaggaagggggggacctgctgtgttgtgaccactgcccagcagcattccacctgcagtgctgtaacccccccctgtccgaggagatgcttccacccggcgaatggatgtgccaccggtgtacagtgcggcgcaagaaacgtgagcagaagaaagaattggggcatgtgaatgggctggtcgacaaatctggtaagcggactacatccccttcttctgacacagatctgctggaccgcagcgcctctaagaccgagcttaaggcaatcgcacacgccaggatactcgagcgacgcgctagccgtcccgggacaccaacatcctcagcgtctaccgagacccccaccagtgagcagaacgatgtggatgaggatatcattgacgtggacgaggaacctgtggcagcagaacctgattacgtgcaacctcaactgagacggccttttgaactactgattgcagcagccatggagagaaaccccacccagttccagctccctaacgagcttacctgtactactgcactgccagggagcagtaaacgcagaagaaaggaagaaactaccggcaaaaacgtgaagaagactcagcacgaattggaccacaacggtctggtgcctttacctgtgaaggtctgtttcacatgtaataggtcctgtagagtggccccccttatccaatgtgattactgtccgttattatttcacatggattgtctggaacctccccttacagcaatgcccttagggaggtggatgtgcccaaatcacatagagcatgtcgtgctcaaccagaagaacatgactttgtctaatcggtgtcaggtgttcgacagattccaagacacagtttcccagcacgtcgtgaaagtggatttcttgaatagaattcataagaaacaccccccgaatcgccgcgtgctgcaatctgtgaagagacgcagcctcaaggtccctgacgctattaaatcacaataccagttcccacctcccttgattgctccagctgccatcagggatggagagctgatttgcaacgggattccagaggagtcacagatgcacttgcttaattccgaacatctggcaacacaggccgagcagcaggaatggctctgctcagtagtagccctccagtgttccatcctcaaacacctgagtgccaagcagatgcccagccattgggactcagaacagactgagaaagctgatataaagccagtaattgtcaccgatagctccgtgacgacatcactacagacggcagataagacaccaactccatcccattatcccctctcctgtcccagcggcatctccactcaaaactccctgtcatgcagcccaccccaccagagccctgccttagaagacattgggtgcagttcttgcgctgagaagtccaaaaagaccccatgtgggactgctaatggccccgtcaataccgaggtgaaggccaatggcccacacctgtattctagccccacagacagcacagaccctcgcagacttccgggggccaatacacccctgccaggcctgtcccatagacagggctggcccagacctcttacaccccctgctgcaggcggattgcagaaccacactgtcggaatcatcgtcaagactgaaaatgcaaccgggccctcttcttgtcctcaaagaagcctggtccctgttccatcgctgcctcctagtattccatccagttgtgcaagtatcgaaaatacatcaaccctgcaaaggaagaccgtccaatcccagatcggtcccccgttgaccgattccagacccctggggtccccacctaacgccaccagagtcttgacacctcctcaggcagccggagatggaattctggccacaacggcaaaccaaagattttcttcacctgcgccatcctccggagaatgttgcagtgctttaggatag

SEQ ID NO: 20102 - DNA, 3015 bp, Artificial Sequence
  Description of Artificial Sequence: Synthetic coding sequence
atgtgggagaagatggagaccaagaccatcgtgtacgacctggacacatccgggggcctgatggagcagatccaagctctgctagcaccccctaaaacagatgaggccgaaaagcgctcccggaaacctgaaaaggagcccaggcggagtggtagagccactaatcatgactcctgcgacagctgcaaggagggtggggacttgttgtgctgcgatcattgtccagctgccttccaccttcagtgttgcaacccaccactatctgaggaaatgctcccaccaggcgaatggatgtgtcatcgttgtactgtgcggaggaagaaaagggaacagaagaaggagctcgggcatgttaacgggttagttgataagagcggtaaaagaactacttctcccagttcggatacggacttgctggaccggtccgcatccaagactgagttaaaggctattgcccacgcaaggatcctggagcgaagagcaagtcgacccggcacgcctacttcctctgccagcacagagacaccgacgagcgaacagaatgacgtcgatgaggatatcattgatgtggatgaagaacctgtggccgcagagcctgattatgttcaaccccaactacggcgaccctttgagttgctcattgccgctgcaatggaacgaaacccaactcaatttcagctacccaacgagctgacgtgtaccacagcgttgcccggaagttcgaaacgtaggcgtaaagaggagaccaccggtaagaacgtgaagaaaactcaacacgagcttgaccataatggtttggtgcccctgccagttaaagtgtgcttcacctgtaatcgatcttgtcgggtggcccccttaatccagtgcgactattgccctttgctgttccatatggactgcttggagccacctttaaccgccatgccgctaggaaggtggatgtgcccaaaccatattgagcatgtcgtactaaaccaaaagaacatgacattgagcaatagatgtcaggtattcgataggttccaggatacagttagccagcacgtggtgaaagtggacttccttaaccggattcacaagaagcatccacctaataggagagttctgcagagtgtcaaacgcagatctcttaaggttccggatgcgattaaatcacagtatcagttcccacctcctcttattgctccagcagctattcgggatggtgaactcatctgtaatggcatccctgaagaatcccagatgcatctattaaattctgagcacttggctactcaggccgagcagcaggaatggttgtgctccgtcgtggccttgcagtgtagcatccttaaacacttgagcgccaaacaaatgccgtctcactgggactctgaacagacggaaaaagctgatattaagccggttattgtgaccgattcatccgtaactaccagtcttcagaccgctgacaagactcccacaccgtctcactaccccctgtcctgtccctctgggatcagcactcagaattctctgtcctgttcccccccacatcagtcaccagccttggaggatattggttgctcctcatgcgccgagaagtcgaaaaagacgccctgtgggaccgccaacggacctgtcaacacagaggttaaagctaatgggccacatctttacagttccccgacggattcaacagaccctcgccggctccccggggccaacactccactccctgggctatcacaccggcagggctggccccgtcccctcacaccacccgccgccggcggcctgcaaaaccacaccgtgggcatcatcgttaaaaccgagaacgccaccggccccagctcctgcccccagcgcagcttagtgcccgtcccctcactgccgccctctatcccatctagttgtgccagtatagagaatacttcgactttgcagaggaagaccgtacagtctcagattgggcctcctctgacagactctcgtccgctaggctcccctccgaatgcaaccagggtcctgacgccccctcaggcagctggggatggcatactcgctaccactgctaaccaacgcttttcctcaccggcaccctcatctgacggtaaagtctcacccgggactctgtctatcggttctgccctcacggtgcccagcttcccagctaactccaccgctatggtggatctgacaaacagcttacgcgcattcatggatgtgaacggggagatcgagatcaatatgctggatgaaaagctgatcaaatttctcgccctgcagcggatccatcagctgttcccaagtcgggtccaaccttctccgggctccgtgggaacgcaccaactcgcatccggagggcaccatattgaggtccagaggaaagaggtgcaggcccgcgctgtgttctaccccctgttaggtttgggcggggcagtgaacatgtgctaccgtacgttgtatattggtacaggagcagacatggatgtgtgtctcactaactatggccactgcaattacgtgtcaggcaagcatgcgtgcattttttacgacgagaacactaagcactacgagctgctcaactactcagagcacgggaccaccgtagacaacgtgctgtacagctgcgatttttctgagaagacgccccccacccctccctcctcaatagtcgcaaaggtgcagtccgtgattagaaggcggaggcatcagaaacaggacgaagaaccttccgaggaagccgccatgatgtcatcccaggctcaggggccacagaggagaccatgcaactgcaaagcttcgtcaagctctctaatcggggggagtggagccgggtgggagggcacggcattgcttcaccacggctcttatattaagctcgggtgtctccagttcgtgttttctattacagagttcgctactaagcaaccaaagggagacgcgagcctgctacaggatggagtgctcgccgagaagttgtctctcaaaccccatcaaggccccgtgcttagaagtaactctgtgccatag

SEQ ID NO: 20103 - DNA, 2550 bp, Artificial Sequence
  Description of Artificial Sequence: Synthetic coding sequence
atgtgggagaagatggagaccaagaccatcgtgtacgacctggacacctctggcgggctcatggagcagatccaggcactcttggcgcccccaaagacagacgaggcagaaaagcgaagtcggaaacccgagaaggaaccgcgcaggtccgggagggcaacaaaccacgacagttgcgactcttgtaaagagggcggagaccttttgtgttgtgaccactgccctgcggccttccatttgttggtctatcaggattttgtggcgccgatatcccttttccacggcacctttcatgatgggccaacctgctcttttgctcaaaagcgggagcagaaaaaggaactggggcatgttaatgggctggttgacaagtcagggaagcgaacaactagtcccagctccgacacggatctgttagaccggagtgcctccaagacggagttaaaggctattgcccatgcacggattctggagcgacgtgcctcccgaccaggcacccccacaagtagcgccagtactgaaactcccactagcgagcagaatgatgtcgacgaggacatcattgatgtagatgaagaacccgttgctgctgagcctgactacgtgcaaccgcaactccgaagaccatttgaattgttgatcgccgccgctatggaaagaaatcccactcagtttcaacttcctaacgaactcacttgcacaacagcattgcccggcagcagtaagcgcaggagaaaggaggaaaccaccggcaaaaatgtgaaaaagacacagcacgaactggatcacaatggactggtgcccttaccagtgaaggtgtgttttacatgtaacagaagctgccgggttgcaccactcatccagtgtgattactgtcctctgctgttccatatggactgtctcgaaccacctttgaccgccatgcccttaggcagatggatgtgtcctaaccacatcgaacatgttgtgctgaatcagaagaacatgacccttagcaaccggtgccaggtattcgataggtttcaagatacagtgtcgcagcacgtggtgaaagtcgatttccttaaccggatccacaagaagcaccctccgaaccgtagagtgctgcagagcgttaagcgaaggtcactgaaagttccagacgcaattaagagccaataccaattccctcccccactcatcgcccctgccgctatacgcgacggagaactcatttgtaacggcattcccgaggagagccaaatgcacctgcttaactcggaacatctggctacccaggccgaacagcaggagtggctgtgctctgtcgttgcccttcaatgcagcatcctcaaacacctctcagccaagcagatgccctcccattgggattccgagcagacagaaaaggctgatatcaaacccgtgatcgtcaccgattcctcggtgactacttcgctgcagacagccgacaaaactcccaccccctcccactaccccctgtcttgccctagtggaataagcactcagaactccctgtcctgttctccacctcaccagtctcccgcactggaagatatcggatgcagcagttgcgccgagaaatccaagaaaaccccgtgtggcacagccaacggtccagttaacaccgaagtcaaggcaaacggccctcacctgtactcatcaccaactgattcaaccgatccacgaaggctccctggcgccaatacacctctgccaggtctaagtcatcggcaggggtggccccgcccacttacgcctcccgcggccggaggcctacagaatcatactgtcggcattatcgttaaaaccgagaacgccaccggaccctctagttgcccccagagatccctagtgcctgtaccgagcctacccccgagtattccaagctcctgcgccagcattgagaacaccagcaccctgcaaaggaaaaccgtgcagtcacagattggtccccctctaactgatagccgaccgcttgggagcccgcccaacgcaacccgagttctgacaccacctcaagctgctggagatggcatcctggccactaccgcgaaccagaggttttcttcaccagccccatctagcgacggaaaagtgtcaccgggaactctatccatcggaagtgctctcaccgttcccagctttcccgctaattcaaccgccatggtggatctgaccaacagccttagggccttcatggacgtcaacggcgagattgagatcaacatgcttgacgaaaagctgatcaagttcttggccctccaaaggatccatcagctgttcccatcaagagtgcaaccctcgcctggttctgtggggacccaccaactcgcatcaggcggtcatcatattgagggtgcccacgtgcacacctgccatcacatcatacgaagccctctctacgtctgcgagtggagcccttgtttacacggggaaagcgagctgcccgtgtcccagacaagcctgtgcgccttccatggtcttaacaaagctccatggttcttctccgaagagtcacgtaataagatggccactacggcgttctag

SEQ ID NO: 20104 - DNA, 903 bp, Artificial Sequence
  Description of Artificial Sequence: Synthetic coding sequence
atggacagcgacagctgcgccgccgccttccaccccgaggagtacagcccttcttgcaagaggcgcaggaccgtggaggacttcaacaaattttgtacgtttgtcctcgcctacgcggggtacatcccctacccaaaagaggaactcccgctgcgcagcagccccagtcctgccaacagtaccgccggcacgattgactccgacggatgggacgcggggttctcggatatcgcttccagtgtccccctgccagtgtcggatagatgcttttctcatttgcagccgaccctcctgcagcgagcaaaaccatccaactttctgttggatagaaagaaaactgacaaactcaagaagaagaagaaacgaaagcgaagagactctgacgctcccggaaaagagggatatagagggggcttgctgaagctggaggctgccgatccctacgttgagacaccgacaagccccaccttgcaagacattccccaggccccatctgatccttgctctggttgggacagcgacacaccatccagtggtagctgtgcgacagtgtcgcctgatcaggtcaaagagattaaaaccgaagggaaacgtacaatagtgcggcagggtaaacaggtcgtgttcagggacgaagactctacaggcaatgacgaagacatcatggtggacagcgacgatgattcgtgggacctggtgacctgtttctgtatgaaaccgttcgctggtagacccatgattgaatgcaatgagtgtcacacctggattcatctgagttgtgccaagataaggaagtctaacgtccccgaagtgtttgtgtgtcagaagtgtagggattccaagttcgacatccgtcggagtaacagatctcggaccggctccaggaaacttttcctcgactag

SEQ ID NO: 20105 - DNA, 2373 bp, Artificial Sequence
  Description of Artificial Sequence: Synthetic coding sequence
atggaggagaagcggcggaagtacagcatcagcagcgacaacagcgacacaacagacagccacgcaacatccacatccgcctccaggtgcagcaaactgccttcgagcacgaaatcaggatggcccaggcagaacgaaaagaagccaagcgaggtattcaggactgacctgatcaccgccatgaagatccccgatagctaccagctgagtccggacgactattacatcctagcagatccttggcggcaggagtgggaaaaaggcgtccaggttcccgcgggagctgaagccatccctgaacccgtcgtgcgcattttaccgcctctggagggccctccagcgcaggcttcgccatcctctacaatgctcggggaaggcagccagccggattggccgggcggatctagatacgaccttgacgagattgatgcctactggctggagctcatcaatagcgagctaaaggagatggaacggccagaacttgacgagctgaccttggagcgggtgttagaggaactggaaacactctgtcaccaaaatatggccagagctatcgagacacaggagggactcggcatcgagtacgacgaagatgtggtgtgcgatgtgtgccggtcaccggaaggtgaggacggaaatgaaatggtgttttgcgacaagtgcaacgtctgcgttcaccaagcatgctacgggattctcaaggtgccaaccggaagctggctgtgtcgtacctgtgccttgggtgtgcagcctaaatgcctactttgccctaaaagggggggcgccttgaagcctacacgatccggaaccaagtgggttcacgtgagctgcgctctgtggatccctgaggtcagtataggctgccccgaaaagatggagccaattacaaagatttcccacatccctgcttccaggtgggcactgtcctgctctctctgcaaagaatgtactggcacgtgcatccagtgtagtatgcccagctgcgtgacggcctttcacgtcacgtgcgcctttgatcacgggctcgagatgcgcaccatcttggctgataatgatgaggtgaagttcaagagcttttgccaagaacatagcgatggcggaccccggaatgagccgacatcagaacctactgaaccctcccaggccggagaggacctcgagaaggtcaccctgcggaagcaacgcctgcaacaactagaggaagacttctacgaactggtggagccagcagaagtggccgagagactagacctcgccgaagccttggtggattttatctaccaatattggaagttgaaacggaaggccaatgcaaaccaacccctgctgacacctaagaccgacgaggttgataatttagctcagcaagaacaggatgtcttataccgaagactgaagttgtttacccatctgcgccaggacctcgagagagtgcggaacctgtgctacatggtaacacgcagagaacgtacaaagcacgccatctgtaagttgcaagagcagatttttcacctccagatgaagcttattgagcaagacttatgtcggggattgagcacgagcttcccgattgacggcaccttcttcaactcgtggttggcccaatctgtgcagatcacggccgagaatatggccatgtccgaatggccgttgaataatggacaccgcgaagatcctgcgccaggcctgctgtctgaagaactactccaggacgaggagacgcttttgagcttcatgcgcgatccgtccctgagaccaggcgaccctgccaggaaggctcggggtcgcactcgactgccagccaagaaaaagccccctcccccacctccccaggatggcccaggctcacgtactactcccgacaaagccccgaagaaaacctgggggcaggatgccggaagcggcaagggtggacagggaccaccgactcgaaagccccctaggcggacatcctctcacctcccgtcttccccggccgccggggattgtcccatccttgcaactcctgaatcccctcccccactcgcccccgaaacaccagatgaggcagcctccgtcgccgctgactcagacgtacaggtgcctggccccgccgcttcgcccaagcccctgggaagactgcgtcctcctcgggaatctaaggtgactcgccgtctgccaggggccaggcccgacgccggcatggggcccccgagcgccgtggcagaacgccctaaggtgtccctacactttgatactgagaccgatggatatttctccgatggcgagatgtctgactccgacgttgaagcagaagatgggggagtgcagagagggccccgggaggcaggtgccgaggaagtagtgaggatgggagtcctagcttcttag

SEQ ID NO: 20106 - DNA, 2382 bp, Artificial Sequence
  Description of Artificial Sequence: Synthetic coding sequence
atggaggagaagcggcggaagtacagcatcagcagcgacaacagcgacaccacagatagccatgccaccagtacctctgcttcaagatgtagcaaactgcccagcagcactaaaagcggctggcctcggcaaaacgaaaagaaaccctctgaagtgttcaggactgatctcataaccgctatgaagatcccagactcttatcagctgagtcccgatgactattacatcctggcagatccatggcgtcaggagtgggagaaaggcgtgcaggtccccgcgggtgcagaagccatacctgaaccagtggtgcgcatcctgcctccgctggaggggcctcccgctcaggcatcccctagttctacgatgctgggagaagggagccagccggactggccaggcgggtcacgttacgacttggatgagatcgacgcttactggcttgaactgattaattcagagctcaaggaaatggaacgccccgaactggacgagctgaccctggagcgtgtccttgaagagttggagacgctctgtcatcagaacatggcccgtgccatcgaaacccaggaggggctggggatcgagtatgacgaggatgtggtgtgcgacgtgtgccgatcaccagaaggcgaggatggtaacgaaatggtgttttgcgacaagtgtaatgtgtgtgtccatcaagcatgctatgggatccttaaggtgcctaccggctcgtggctctgtaggacttgtgctctgggagtgcaacccaagtgtctcctgtgccccaaacgcggcggcgccctgaagcccactcgatctgggactaaatgggttcatgtcagctgcgccttgtggatccccgaagtctcaatcgggtgtccagagaagatggagcctattactaaaatcagccatatcccagcgagccggtgggctctttcctgtagcttatgcaaggagtgtaccgggacatgcatccaatgcagcatgccttcgtgtgttactgcattccacgttacctgtgcgttcgaccacggccttgagatgagaaccatcttggccgataacgacgaggttaagttcaagagcttttgccaggaacatagtgatgggggcccacggaacgagcctacaagtgaacccaccgaaccatcccaggccggcgaagatctggaaaaggtcacactcaggaagcagcgcctgcagcagttggaagaggatttctatgaattggttgaacccgccgaagtggccgagcgcctggatctggcagaggcactggtcgacttcatatatcagtactggaaacttaagagaaaagccaacgccaatcagcctttgcttacaccgaaaaccgatgaagtggacaacctggcccagcaggaacaagatgtactgtatcggcgactgaagctgttcacacacctgaggcaggatctagaacgggtgcgaaacctgtgttacatggtcacgcgccgggaacgaacaaaacatgcgatttgcaagctgcaagagcagatcttccacctccaaatgaagctgatcgagcaggatctttgcagggagagaagcgggagacgcgccaagggcaaaaagtcagactcaaagagaaaaggatgtgaaggtagcaaggggagtactgagaagaaagaaaaggttaaagctggccccgactctgtcctgggacagctggctgggctgtccacctcattccccatagacgggacattctttaattcttggctcgcccagagcgtccagattactgccgagaacatggctatgagcgaatggccactcaataatggacacagagaagacccagcccctggtctgctgtccgaggagctactgcaggatgaggagacattgctgtcattcatgcgcgatccatctctccgtccgggcgatcctgcaaggaaggctagaggacgtacccgccttcctgccaagaagaagccgcccagacgcactagttcccatcttccttcctcaccagccgctggggattgccctatcctggccacacctgaaagtccacctcctctcgcacctgaaacacccgatgaagcggcctctgtcgccgctgacagcgatgttcaggtccctggccccgctgctagcccgaaaccactcgggaggctccgtcccccccgagagtcaaaagtgaccagaaggctgcccggtgcacgacctgacgccggaatgggtccacctagcgctgtggcagaacggcctaaagtaagtctgcactttgataccgagactgatggatactttagcgatggggaaatgtccgacagcgatgtggaagcagaggacggcggggtgcaacggggccctcgcgaggccggggcagaagaagtggtgaggatgggggtcctggcgagctag

SEQ ID NO: 20107 - DNA, 768 bp, Artificial Sequence
  Description of Artificial Sequence: Synthetic coding sequence
atggaggagaagcggcggaagtacagcatcagcagcgacaacagcgataccacagacagtcacgccacctctacctccgctagtcgttgctcaaagcttccatccagcacaaagagcggctggccgcggcagaacgaaaagaagccctcagaagtgttccgcacagacctaataaccgcaatgaaaatcccggattcttaccagctcagccccgatgactactatatcctggccgacccgtggcgccaggaatgggaaaagggagttcaggtaccagctggtgctgaagcaataccggagcccgtcgtgagaattcttccaccacttgaaggtccccctgcccaggccagccccagcagcactatgctcggcgaggggtcccagcctgactggcctgggggctcccggtacgatttggacgagatcgacgcctattggctggaactcatcaacagcgagctcaaagagatggaaagacctgaactggacgaactcaccttagagcgtgtgctggaagaactggagactctgtgccaccagaacatggcgagagccatcgagacgcaagaaggactgggcatcgaatatgacgaagatgttgtatgcgatgtgtgtcgctctccagaaggggaggacggtaatgagatggtattttgcgataagtgtaatgtgtgtgttcatcaggcctgttacggaatactgaaagttccaaccggaagttggctctgtagaacttgtgctcttggagtccaacctaagtgcctgtag

SEQ ID NO: 20108 - DNA, 2376 bp, Artificial Sequence
  Description of Artificial Sequence: Synthetic coding sequence
atggaggagaagcggcggaagtacagcatcagcagcgacaacagcgacaccacagattctcatgctacgagtaccagtgcctcccgttgcagcaagctgcctagctccacaaaatcggggtggccgaggcagaacgagaaaaagcccagtgaggtgtttaggaccgatctgatcacagccatgaaaatccctgacagctaccagctgagcccagacgactactatatcctcgctgacccatggagacaggaatgggagaaaggagtgcaggtgcctgctggggccgaagctatccccgagccggttgtgcggattttgccgccgttagaaggcccccctgcccaggccagcccatcctccacaatgctgggggaaggatcccaacccgactggcctggaggtagcagatacgatctggacgagattgacgcatactggctggaattaatcaactctgagctgaaggagatggagcgaccagagctggatgagctgacactggagcgagtgttggaggagctcgagactctgtgtcaccagaatatggctagagccatagaaacacaagagggtctggggatagaatatgacgaggatgtcgtgtgtgatgtctgccggtcaccggagggcgaagatgggaatgaaatggttttttgtgacaaatgtaatgtctgtgtgcatcaggcctgttacgggatcttaaaagtgcctaccggctcatggctatgtcgcacttgtgcgcttggcgtgcagccaaagtgtcttctgtgtcccaaaaggggcggggctctgaagccaacccggtccggcactaaatgggttcatgtttcttgtgccctctggataccagaagtgagtatcggatgcccagaaaagatggagcccataacaaagattagtcacattcccgcttcccggtgggcccttagttgcagtctgtgtaaagaatgtactggtacttgcatacaatgcagtatgcccagctgtgtgacggcattccacgtcacttgcgccttcgatcacggccttgagatgcggactatcctcgcagataatgatgaggtgaaatttaagagtttttgccaggagcattcggatgggggccctagaaatgaaccgacatctgagcccactgaaccttcccaggcaggcgaggaccttgaaaaagttactctgcggaagcagagactgcagcaactggaagaagacttttatgaactggtggaacctgccgaggtggccgagcgattagacctggcagaagccctagtggatttcatctaccagtactggaagcttaaaaggaaagcgaacgcaaaccagccgcttcttaccccaaagaccgacgaggtagacaatctggcgcaacaggagcaagatgtgctctataggcgactaaaactgttcacacatcttaggcaggacctcgagcgagttcgaaacttgtgttatatggtgactagacgtgaacggacaaagcacgcgatctgcaagctgcaggagcaaatttttcatctgcagatgaagctgatcgagcaggacctttgccgcgcggggctttccacttcgttcccgattgatggcactttctttaatagctggttagcccaaagcgtgcagataacagccgagaacatggccatgtctgagtggcctctgaataatggacacagagaggacccggctcccggactgttgagtgaggaactcctgcaggacgaggaaactctgctctcttttatgagggaccccagtctgaggcctggggatcccgcaaggaaagctcggggtcgtacgcgcctgcctgcaaagaaaaaacctccaccacctccgccgcaggatggtccaggatcacgcacgacaccagacaaggctccaaagaaaacctggggacaggatgctggctcaggaaaaggaggccagggaccccccactcgaaagccaccacggcgcacatcctctcatttgcccagtagccccgccgctggggactgcccaattctcgccactccggagtcgccgccacctctggcccccgagacgcccgacgaagctgccagtgtcgcggctgatagcgacgtccaggttcccggaccggctgcaagcccaaagcccctcggaaggcttcggcctcctcgggaaagcaaggtaacccgccgtctgccgggtgctcgacctgacgcgggtatgggcccaccctccgctgtcgctgaaaggcccaaagtgagcctgcactttgacacggaaacagacggctactttagcgatggtgagatgtccgactctgacgtcgaagcggaagacggcggcgtccagaggggtccaagggaggccggcgccgaagaagtagtccggatgggtgtcttggctagctag

SEQ ID NO: 20109 - DNA, 2553 bp, Artificial Sequence
  Description of Artificial Sequence: Synthetic coding sequence
atggtgcccaccgccgccatcgccgtgggcggctacttcctgggcggaatggaggaaaaaagaagaaaatatagcatctcctctgataattctgacaccaccgattctcacgccacatcgacgtcagccagccgatgttctaagcttcccagcagcacgaaatccggctggccccgccaaaacgaaaaaaaaccctccgaggtctttcggactgacttgataacagccatgaaaattccagatagctaccagcttagtccggatgattactatatcctcgctgacccatggagacaagaatgggagaaaggggtccaggttcctgccggcgcagaggctatacccgaaccagtggtgcgaatcttaccccccctagaaggcccccctgcccaagcctccccaagctctacaatgctgggcgagggaagtcaacccgactggccaggcggctctcggtacgatctggacgagattgacgcatactggttggaactgatcaactccgagttgaaggagatggaacgccccgagttggatgaacttacattggagagggtccttgaggagctggagacactgtgtcatcagaacatggccagggccatcgaaactcaggagggcctgggaattgagtacgacgaggacgtggtttgtgacgtgtgcaggtcgccagaaggcgaggatgggaacgagatggtgttctgtgataagtgtaatgtttgtgttcaccaggcatgctacgggattctgaaggttcccacgggcagttggctgtgtagaacttgtgccctaggtgtgcagcctaaatgcctgctgtgcccaaagcgcggaggcgcactgaaacctacaagaagcggcaccaagtgggtccacgtgtcctgcgctctctggattccagaggtttccatcggctgccccgagaaaatggaacctataaccaagatctcccatattccagccagccggtgggctctctcatgttctctgtgcaaggagtgtacaggcacgtgcattcagtgcagcatgccatcctgcgtcactgccttccatgttacgtgtgcattcgatcacggcttggaaatgcgaacaatcctggccgacaacgacgaggtcaaattcaaaagtttttgtcaggaacattctgacggaggcccccgcaatgaaccgacaagcgagccgacagagccttctcaggccggggaagacttagagaaggtaactctgcggaaacagcggctacagcaactggaagaggatttttacgaacttgtagagccggctgaagtcgcagaacggttagacctagccgaagctctggtcgattttatctatcaatactggaagctgaagaggaaagcgaacgcgaatcagccattgctaactccgaaaacagatgaggtggacaacctggcccaacaggagcaggatgtgctttatagaaggctgaagttgttcactcacctgcggcaggacttagaacgcgtgagaaatctgtgctacatggtgacccggagggagaggactaagcacgccatttgtaagctgcaggagcagatcttccacttacaaatgaagctaatcgaacaggatctctgtcgagaaaggagcggtagacgcgcgaaggggaaaaagagtgactccaaacgtaagggctgtgagggaagtaaaggctctacagaaaaaaaggaaaaagtgaaggctggaccagactcggtgttgggacagcttgcaggattatcaacatcctttcccattgacggaacattcttcaatagttggctcgcccaatctgtccaaattactgctgaaaatatggccatgtctgaatggccattgaacaacggacacagagaggacccagctcccggcctgttgagcgaggagttactccaggacgaggagaccctcctttctttcatgcgagatccatcattgcgtccaggggatccagcgcgaaaagctcgcggccgaacgagactgccagcaaagaagaagccaccacctccgccccctcaagatggcccaggcagccggaccaccccagataaggccccaaaaaaaacttgggggcaggacgccggtagtggcaaaggtggccagggaccacccaccagaaagccgcctagacggacaagctctcatctgccttcaagtccagctgccggggattgccctatcctggcaacacccgaatcgccccctccgttagcccctgagaccccagacgaagctgcctctgtggctgcagacagtgacgttcaagtacctggccccgctgcgagccctaagccccttggcaggctcagaccacctagggagagcaaggtgacgagacgccttcccggggcacgacctgacgccggcatgggacctccctcagctgttgcagaaagacctaaggtcagtctacacttcgacactgaaactgacggttacttctcggacggtgaaatgtctgatagtgatgtggaggctgaggacggtggcgttcaacgcggcccacgcgaggctggggctgaggaagtggtgcggatgggagttctggcttcctag

SEQ ID NO: 20110 - DNA, 450 bp, Artificial Sequence
  Description of Artificial Sequence: Synthetic coding sequence
atggaggagaagcggcggaagtacagcatcagcagcgacaacagcgataccaccgattctcacgccacatccacttcagccagccggtgttccaagctgccttcttccaccaaatctggatggccgaggcagaatgaaaaaaagcccagcgaggtatttcggacggacctcatcacagctatgaaaatacccgatagctatcaactctctcctgatgattattacatactggccgacccgtggagacaggaatgggaaaaaggagttcaagtgcccgccggagccgaggcgatcccagaacccgtggtgcgcatcctgcctccactggagggtcccccggcacaggcatcccccagctccaccatgttgggtgaggggtcacagccagactggcctggaggaagccgatatgatctggatgaaatagatgcctattggctcgagttgtag

SEQ ID NO: 20111 - DNA, 1053 bp, Artificial Sequence
  Description of Artificial Sequence: Synthetic coding sequence
atgggctgcttcttcagcaagcggcggaaggccgacaaggagagcagacccgagaacgaggaggaacgccccaaacagtactcctgggatcagagagaaaaggttgatccaaaggattatatgttcagcggactgaaggacgagacggtgggaaggctgcctgggacagtggcaggccaacagttcctgattcaggattgtgaaaattgcaatatatatatatttgaccactctgcaaccgtgaccatcgatgattgcactaattgtatcattttcctgggcccagtcaaagggagtgtgttcttccgtaactgccgggattgcaaatgtaccctggcttgccagcagtttcgtgtgcgggattgtcgaaaactggaagtgttcctttgttgcgctacccagcccattattgagtcatcctccaacatcaagtttgggtgttttcaatggtattaccctgaactggcctttcagttcaaggacgcaggcctcagcattttcaacaatacgtggagtaacatccacgatttcacgccggtaagtggcgaactcaactggtcgctgctaccagaagacgccgttgtccaggactatgtcccgatccctacaacggaagagcttaaggccgttagagtgagtacggaagccaataggagcattgtgccgatcagtaggggccagaggcaaaaaagctcagacgaaagttgcctagtcgtcctgttcgccggagactacaccatagctaacgcccgcaaactcattgatgaaatggtcgggaagggcttcttcctggtgcagacgaaggaagtctctatgaaagccgaggacgctcagcgagtgttccgcgagaaggcccccgacttcctgcccttactgaacaaggggccagtcattgctttggaatttaatggcgacggcgcggtggaggtgtgtcagctcattgtcaacgagatctttaacggcaccaagatgttcgtgagtgagagcaaagagaccgcatctggtgatgtggactcattctacaacttcgccgacattcaaatgggaatctag

SEQ ID NO: 20112 - DNA, 2472 bp, Artificial Sequence
  Description of Artificial Sequence: Synthetic coding sequence
atgaagcggcaccggcccgtgagcagcagcgacagcagcgacgagagcccaagcacatctttcacatcaggctcgatgtaccgcatcaaaagtaagataccgaatgaacataagaagcccgcggaagttttcagaaaagacctgatttccgcaatgaagctccccgactcacatcacattaatcctgacagctactatcttttcgctgatacctggaaagaggagtgggaaaaaggcgttcaggtccccgcttctcccgacacagtccctcagcccagcctccgaattatcgccgagaaagtgaaagatgtcctgttcattaggcccaggaagtatatccactgcagcagccctgacacgacagaacctggatatataaatattatggaactggctgccagcgtgtgtcgctatgatcttgatgatatggacatcttctggctgcaggagcttaacgaagacctggcagaaatgggctgcggaccagttgacgaaaacctgatggaaaaaaccgtggaggttcttgaacgccattgccatgagaacatgaatcatgcaatcgaaactgaggaaggcctgggcattgaatacgacgaagatgtgatatgtgacgtttgtaggtctcctgacagcgaggaaggcaatgatatggttttctgtgacaagtgcaacgtgtgtgtgcaccaggcgtgctacggtatactgaaagtgcctgaaggcagctggctgtgtcgctcctgtgtcttgggaatttacccacagtgtgttctgtgcccaaagaagggtggggcccttaaaactactaaaactgggaccaaatgggctcatgtatcctgtgctctctggatcccggaggttagcatcgcttgccctgagcgcatggaaccgataactaagatttcacatataccaccttcccgttgggcactggtttgcaacctgtgtaaacttaaaacgggagcctgtatccagtgttccatcaaaagctgcataactgcttttcatgtcacttgtgcgttcgaacacgggcttgagatgaaaactatcctcgacgagggcgacgaggttaaattcaagtcatactgcctcaaacattcccagaatcgacagaaattgggcgaggctgaatatccccaccaccgcgccaaggagcagtcacaggctaagagcgaaaaaacttcactgcgagcccagaaattgcgcgagctggaagaagagttctacagtcttgtacgtgtggaagatgtggcggctgagttgggcatgccaacacttgctgtcgatttcatctacaactactggaagctcaaacggaaaagtaacttcaataagcccctttttcccccaaaggaagacgaagagaacggactcgttcagcccaaagaggaaagcattcatacaaggatgcggatgtttatgcacctgcgccaggatttagagcgcgtgcgaaatctctgctacatgattagtcggagagaaaagttaaagctgtcccacaacaagatccaggaacagatcttcggattgcaggttcagctcctgaaccaagagatagatgccggcctccctcttacgaatgcactggaaaacagtctgttctacccacctccacgcattacgctgaaactgaaaatgcccaagagcacaccagaggatcatcgtaactcatccaccgaaaccgatcagcagccacattcgccagactcctcctcctctgtgcattctatccggaatatgcaggtgccccaagaatcactagaaatgagaacaaagtcatacccccgatatcccctggagtcaaagaacaatcgactccttgcctcgctcagtcacagtcgttctgaagcaaaagagtcatcacctgcttggcgaacacctagtagtgaatgctaccacgggcagtccctgggaaagccgctggtacttcaggccgccctgcacggacaaagctcaattggcaacggcaaaagtcagcccaattctaagttcgcaaagagtaacggccttgaaggctcgtggagtggaaatgtcactcagaaagattcttcgagcgagatgttttgcgaccaggaacccgttttctccccccatctggtgagtcaaggttcattccgcaagagcacagtcgaacatttcagtcgcagcttcaaggaaaccacgaacaggtgggtgaaaaatactgaagacctgcagtgctacgttaaacccaccaagaacatgagccccaaagaacagttctgggggagacaggttttaagacggagcgcaggtagggcaccctaccaggagaatgacggttattgccccgacctggaacttagtgactctgaggccgaatctgacggaaacaaggaaaaagtccgagtaaggaaagattcaagtgatagagaaaatcctccccacgacagccggcgggactgccacggcaagagtaaaactcaccctctgtcccatagctccatgcaaaggtag

SEQ ID NO: 20113 - DNA, 561 bp, Artificial Sequence
  Description of Artificial Sequence: Synthetic coding sequence
atgaagcggcaccggcccgtgagcagcagcgacagcagcgacgagagcccttccaccagcttcaccagcggctctatgtaccggatcaaatcgaagattcctaatgagcacaagaaacccgccgaagtgtttcggaaggatttgatttccgcgatgaagcttcccgacagccatcacattaatcctgattcctattacctctttgccgacacatggaaagaagaatgggaaaagggggtgcaagtccctgccagtccagacaccgtgccacagccgagcctcaggatcattgccgaaaaagtaaaagacgtactcttcatccggcctcgaaagtacatacactgctccagcccggacaccaccgagcccgggtacatcaatattatggagctcgcagcaagcgtgtgccgttacgatctggacgacatggacattttttggcttcaggagctgaacgaggatctggcagagatggggtgcggacccgtcgatgagaatttgatggagaagactgtcgaagttctggaaagacattgccacgagaacatgaatcatgcttag

SEQ ID NO: 20114 - DNA, 345 bp, Artificial Sequence
  Description of Artificial Sequence: Synthetic coding sequence
atgaagcggcaccggcccgtgagcagcagcgacagcagcgacgagagcccttccacatccttcacatcgggcagcatgtatcggatcaaatcaaaaatcccaaacgaacacaaaaagcctgccgaagtgtttcggaaggatctgatatctgccatgaaactccccgacagtcaccacattaaccccgattcttattacctgttcgctgacacttggaaagaagagtgggagaaaggagtgcaggtgcccgcctcccctgatacggtgcctcagccttccttgcgcattattgcagaaaaggtaaaagatgtgttattcatcaggccccgtaagtacatacattag

SEQ ID NO: 20115 - DNA, 1632 bp, Artificial Sequence
  Description of Artificial Sequence: Synthetic coding sequence
atgaccaagcacccccccaaccggcggggcatcagcttcgaggtgggagcccagttagaggcacgtgatcgcctcaaaaactggtaccccgctcacattgaggatattgattatgaggaaggcaaagtactgattcatttcaagaggtggaaccacagatacgacgaatggttttgctgggacagcccgtaccttagaccgctggaaaagatacagttgcgcaaggagggcctccatgaagaagacggaagctctgagtttcagatcaacgaacaggtactggcctgttggtccgactgtagattttaccctgcgaaggtcacggctgtcaacaaggacggcacgtataccgtcaagttctacgatggcgtcgtgcagacggtaaagcatattcacgtgaaagccttctcaaaagaccaaaacattgtcggtaacgctcgtcccaaggaaactgaccataagtctctgagtagctctcccgacaagcgggagaagtttaaggagcaaagaaaagcaaccgtcaacgtaaagaaagacaaggaggataaacccctgaagacagagaaaaggcctaagcaacccgacaaggagggaaaactcatatgctctgagaaaggaaaggtgtcagagaagagcctcccaaaaaatgagaaagaagataaggaaaatatctctgaaaacgatagggaatactctggggatgcccaggtggacaagaagcctgaaaacgatatcgttaaatcgccccaagaaaatctgcgagagccaaagcgcaagcgaggccgcccaccgagcatcgcgcctacggcagtcgactccaattcacagactctgcagccgataacactggagcttcggagacgcaagataagcaaaggctgcgaggtcccactgaaacggccaaggttagataagaactccagccaggaaaagagtaaaaactattcagagaacactgacaaagacctctcccgaaggcgcagctcccgactatctactaacggaactcatgagatccttgaccctgacctagtggtgagcgaccttgtggacactgatcccctgcaggataccctctcaagtactaaggagagcgaagagggccagctaaagtcggcgttggaagctggacaggtgtcctcagctctgacttgccacagctttggggacggctcaggcgcagcagggctggaactgaattgcccaagcatgggtgaaaatactatgaagacggagccaacgtctcctctggtggagctacaagagatcagcactgttgaggtcacaaacacgtttaagaaaactgacgacttcggcagttcaaacgcccccgctgttgatctggatcacaagtttaggtgtaaggtggtggattgcttgaagttttttcgcaaggctaaactgctacactaccatatgaagtactttcatggtatggagaaatctctcgaaccggaagagtccccaggtaagaggcacgtccagaccaggggacccagcgcctcagacaagccatcgcaagaaacgctgactcggaaaagagtatccgcctcttccccaaccaccaaagataaggagaagaacaaagaaaaaaaattcaaagaattcgttcgtgtaaaacccaagaaatag

SEQ ID NO: 20116 - DNA, 1650 bp, Artificial Sequence
  Description of Artificial Sequence: Synthetic coding sequence
atgaccaagcacccccccaaccggcggggcatcagcttcgaggtgggagctcagctcgaggcgcgcgatcgcctgaaaaactggtatcccgcccatattgaagatatcgactacgaagagggaaaggtgttgattcactttaaacggtggaatcatcgctatgacgagtggttttgttgggactctccataccttaggcccctggaaaagattcaacttcgtaaggaaggactgcacgaggaagacggcagcagcgagtttcagattaacgagcaggttctggcctgctggagcgattgccggttttaccctgcaaaggtcactgctgtgaacaaagacggcacttacactgtgaaattttatgatggcgtcgttcagactgtaaagcatattcacgtcaaggccttctctaaggatcagaatatcgttggcaacgcaaggcctaaagagaccgatcataaaagcctgagttcctctcctgacaaacgggaaaagtttaaagaacagcgaaaagcaaccgtcaatgtgaaaaaggataaggaggacaaacctctgaaaaccgagaagcgccctaagcagccagacaaagaaggcaagctgatctgtagcgagaagggcaaggtctctgaaaagtccctgcctaagaacgagaaggaagataaggagaatatttccgaaaacgacagagaatattctggggacgcgcaggtggataagaagcccgaaaatgacattgttaagagcccccaagagaatctccgtgagccaaagaggaagcgagggcgaccaccaagcattgcccccaccgcagtggattcaaattctcagaccctccagccaattacactcgagcttaggagaaggaaaatttcaaaaggctgcgaagttccccttaagaggccgcgcctggataaaaattcgtcccaggaaaagtcgaagaattacagtgaaaacacggataaggacctgtccagacgcagatcctctcgactgagcacaaatggaactcatgaaatcctcgatccggatctcgtggtatctgatctcgtcgatacagatcctctgcaggatactctaagtagcacaaaggagtctgaggaaggtcagctgaaatccgccctcgaggcgggacaggtgagctctgcattgacctgccacagttttggagacggctctggtgccgctggtttagagcttaattgccccagtatgggcgaaaacacgatgaagacagaacccacatcacctctagtagagctgcaggaaatctccaccgtagaggtcaccaacaccttcaaaaaaaccgatgattttggttcctccaatgctccggctgtcgacttagatcataagttcaggtgcaaggtagtggactgtttgaagtttttccggaaggccaagctactgcactaccacatgaagtacttccacggcatggaaaaaagtcttgaacctgaagagtctccgggtaaaaggcatgtgcagacacgaggccctagcgcatcggataagccgagtcaggagacactcacacgtaagcgggtgtcggcctcaagtccaacgaccaaggataaggagaaaaacaaagaaaagaagttcaaggagttcgtacgggtgaagccaaagaagaaaaagaagaagaagaagtag

SEQ ID NO: 20117 - DNA, 3039 bp, Artificial Sequence
  Description of Artificial Sequence: Synthetic coding sequence
atgaccaagcacccccccaaccggcggggcatcagcttcgaggtgggagcacagctggaggcacgagataggttgaaaaactggtacccagcccatattgaagacatagactatgaagaaggaaaggttcttatccacttcaagcggtggaaccatagatatgatgagtggttttgttgggattcaccatacctgaggcctctggagaaaatacagttacggaaagaaggtctacacgaggaggatgggagcagcgaattccagattaacgaacaagtcctcgcttgttggtcagactgccgattctatcccgctaaagtcaccgcagtcaataaggatggcacttataccgtgaagttctacgatggtgtcgtgcagacggtaaagcatatccacgtgaaggcttttagcaaggaccaaaatatcgtgggaaatgcgcgtcccaaagaaaccgaccacaagtcgctttctagcagtcctgataagcgagagaagttcaaggagcagcggaaggcaaccgtgaacgttaaaaaagacaaggaggacaaaccacttaaaactgagaaacgcccaaagcagcccgacaaggagggcaagctgatttgcagtgagaagggaaaggtgtcggaaaagtctttgccaaagaacgagaaagaagacaaagagaatatttccgagaatgatagggagtattccggagatgcccaggtggacaaaaaaccggagaacgacattgttaagagccctcaggaaaatttacgggagccgaagaggaaacggggtagacctccttcgatcgcgcctacggccgttgactcgaacagccagacacttcagcctataacattggaattgcggcggcgcaagatttcaaagggatgcgaggttcctttaaaacgtccgagactggataaaaactcgagccaggaaaaatcgaagaactacagtgagaatacagataaggacctttcacgacgccgatcttccagactgtcaaccaatggaacccacgagatcttggacccagatctggtggtgagcgacctggtggacacagatccactgcaagatactctgtccagtactaaggaatcagaggagggacagcttaaatctgcactggaagccggccaggtgtcctcagccttgacctgtcactcgttcggagatggatccggagctgccgggttggaactgaactgcccatctatgggagagaatacgatgaagaccgagcctaccagccccttggtggagctccaagaaatcagcactgttgaagtgacaaataccttcaagaagaccgatgactttggcagttcaaacgcccccgctgtggatctggatcataaattccgctgtaaagttgtagactgcctcaagttcttccgtaaagccaagctgctacattatcacatgaagtatttccacgggatggagaaatcactggagcccgaagagtctccaggaaaaagacatgtccagacacgcgggcccagtgcttccgataaaccctcccaggaaacactcactcgtaaacgagtttctgcctccagccccaccacaaaagataaagagaagaacaaggagaagaaattcaaggagtttgttagagtgaaaccaaagaagaaaaagaagaagaaaaaaaagaccaaacctgagtgcccatgcagtgaggagatcagtgacacaagccaggaaccttctccacccaaggcatttgccgttacccgatgtggatcctcacataagcccggcgttcatatgtccccgcaactacacggtcctgagagcggtcatcacaagggtaaagtgaaggccctggaggaagataacctgtccgaaagctccagcgagagtttcctgtggtccgacgatgagtacggacaggacgtggacgttaccaccaacccagatgaagaactggacggcgacgataggtacgatttcgaagtggtgcggtgtatctgcgaagtgcaggaagagaatgacttcatgatacagtgcgaagagtgccagtgttggcagcacggtgtgtgcatggggttgctggaggagaacgtcccagaaaagtatacatgctatgtgtgccaggacccccccggccagcggccgggatttaagtattggtacgataaggagtggttaagtagaggccacatgcatgggcttgcttttttagaagagaactatagccaccagaacgcaaaaaagatcgttgccactcaccagctactcggcgacgtgcagcgggttattgaagtcctacatggactgcaactgaaaatgtccattttgcagagtagagaacaccctgacttgcccctatggtgccagccttggaagcaacactcaggcgagggaagatctcactttagaaatatcccagttactgatacgcggtctaaggaggaggcaccatcctataggaccctaaatggagctgtagagaagcccagacctctagccttgccactgccacggtcggtggaagagagctatatcacctcggaacattgctaccaaaaacccagagcttactatcctgctgtggaacaaaaactggtggtggaaacacgggggtccgctctcgacgacgccgtcaatccactgcacgagaacggtgacgactccttgtccccaaggctgggttggcctctggaccaggatcgaagcaaaggtgatagcgatcccaagcctggtagccctaaagtgaaggagtacgttagcaagaaggccttgccggaagaggcccccgcccgaaaattgctagatcgtggaggagaaggcttactgtcctcccagcaccagtggcagtttaacctgctgactcacgtcgagtctctgcaagatgaggttacccacagaatggactctattgaaaaagagctcgacgttctcgaatcctggctggactacacaggcgagcttgaacctcctgaacccctagcacgcctcccgcagctcaagcactgtattaaacagctcttgatggatctggggaaagtgcagcagattgcgctatgttgttcgacgtag

SEQ ID NO: 20118 - DNA, 819 bp, Artificial Sequence
  Description of Artificial Sequence: Synthetic coding sequence
atgaccaagcacccccccaaccggcggggcatcagcttcgaggtgggagcccagttggaggctcgtgatcgactcaagaattggtaccctgcacatattgaagacattgactacgaggaaggcaaggtgctgatccatttcaaacggtggaatcaccgctacgacgaatggttctgttgggactccccttaccttcgacccttggagaaaatccagctgcggaaagaagggctgcacgaggaggacggaagctctgagttccagatcaatgagcaggtcttggcttgctggtctgactgtagattctatccagcaaaagtgacagctgtcaataaagacggcacgtacactgttaagttctatgacggcgtggtacagaccgtgaaacatattcacgtgaaagcgttctcaaaggatcagaatattgtagggaacgccaggccaaaagaaactgatcacaagagcctgagttccagtcctgacaaaagagagaagtttaaagaacagcgaaaggctacggtcaacgttaagaaggacaaggaggacaaaccattgaagaccgaaaaacgccctaaacaacctgataaggaaggcaagctcatatgtagtgagaagggaaaagttagcgagaagagtttgccaaagaacgaaaaagaggacaaagagaacatcagtgaaaacgatcgtgagtattccggagacgctcagaaaacacgccaaactcctttccattcaagttattgttgcggattcaaactaagcaacttcgctactaataatatcgggactgagaaaaaggagaacatcaagaggatgtag

SEQ ID NO: 20119 - DNA, 2289 bp, Artificial Sequence
  Description of Artificial Sequence: Synthetic coding sequence
atggagggcccccggagcagcacccacgtgcccctggtgctgcccctgctggtccttctgttgctggctccggcgagacaggcggcagctcagcggtgtccgcaggcatgtatctgcgataactccaggaggcacgtggcgtgtagatatcaaaatctgaccgaagtgcccgatgccattccagaactcacccaaaggttggacctacagggcaacctgctgaaggtcattcccgccgccgccttccagggagtcccccatcttacacacctggacctgcgacactgcgaagtggagctcgtggccgaaggcgcttttcgcggactcgggcggctgctcttgctgaatctggcaagtaaccacttgagggagctcccacaggaagcgctggatggacttggctcactacgtcgcctggaattggaaggcaacgccctcgaggagctgagaccaggcactttcggcgccctgggtgctctcgctactcttaatttggctcataacgctctggtatatctgcctgccatggcgtttcagggcctcctccgtgtccggtggctgcggctgtctcataacgcgctgtcagtgctggcacccgaagctttagctgggctcccagcgctgcggcgcctttctctgcaccacaatgagttgcaggccctacccggcccagttctttctcaggctaggggcttggctcggctcgagctgggccataaccccctgacctatgcaggcgaggaggacgggttagccttgcccggccttagggagctcctcttggatggcggcgctctccaggccctcggtcctagagcatttgcccattgccctaggctgcatactcttgatctgcgaggaaatcagttggacacccttccccccctccaaggccccggtcaactccgaaggctgagactgcagggcaatcccctgtggtgtggctgccaggcccgaccactcttagagtggcttgctcgcgcgcgcgtaagaagcgacggcgcctgccagggaccaaggcggttgaggggtgaggccctcgacgccctgaggccttgggacctgagatgtccaggtgacgctgcacaggaagaagaggaactcgaagaaagagcagtggctggcccccgcgcccctccccgcgggcccccaaggggcccgggtgaagaaagagcggttgccccttgcccaagggcctgtgtttgcgtgccagaaagccggcatagcagctgtgagggttgcggccttcaagcagtacccagaggattcccgtcagatacacagctcctagatttgagaagaaaccacttcccctcagtgccaagagccgcattcccgggacttgggcacctggtgtctttacatctgcagcattgcgggatagccgagctggaggccggggctctcgctggccttggcagattgatctatctatacctgtcagataatcaactggcgggcttgagcgctgccgccctggaaggagcacccaggctgggctatctgtatctggaaagaaatcgctttctgcaagtacccggggctgccttgagagccctgccctcactgttttcgttgcatcttcaggacaatgccgtcgacaggcttgctcctggcgaccttggacgaacacgcgcactgcgttgggtgtatttgagcggaaaccggataacagaggtatcccttggcgctctcggcccagcccgcgagctggaaaaactccatttggaccggaatcaacttagagaagtacccacaggggctttggagggacttccggcgctcctggagctccagcttagtgggaatcctctcagggcccttagagacggcgccttccagcccgtcgggcggagcttgcagcatttgttcctcaacagttcaggtttagagcagatctgtcctggtgcattttctggcctcggtcctggactccagtccttgcacctgcagaaaaatcaactcagggccctgcccgcgctgccgtccctatcacaattggaactgatcgacttatcatctaatccctttcactgcgactgtcagctcttgccattgcatcgatggcttaccggcctgaatttaagagtgggagcaacttgtgcaaccccacctaatgctcggggacaaagggtgaaagctgccgctgctgtatttgaggactgtcccggttgggctgctcggaaggccaaacggacgcccgcatcccgccctagcgcgcgacggactcccatcaagggtcgccagtgcggggctgacaaagtgggcaaagagaaaggcaggctgtag

SEQ ID NO: 20120 - DNA, 1146 bp, Artificial Sequence
  Description of Artificial Sequence: Synthetic coding sequence
atgaagaccgtgaaggagaagaaggagtgccagcggctgcggaagtccgcgaagacccggcgagtgacccagcgcaagccctcatcgggtcccgtgtgctggttgtgtttgcgggaacccggcgaccctgaaaagctgggcgagtttctacagaaagataatattagcgttcattatttttgcctcatcctgagttccaagctaccacagagggggcaaagtaacaggggcttccacgggttcttaccagaggacatcaagaaggaggccgcccgggcatcaaggaaaatatgttttgtgtgcaaaaaaaagggtgccgctatcaattgccaaaaggaccaatgtttaagaaactttcatttgccttgcggacaggaaaggggctgtctctcccagttcttcggagagtacaaatcattttgcgacaagcatagaccaacgcaaaacatccagcacggccatgtcggcgaggaatcttgtatcctctgttgcgaggaccttagccagcagagcgtggagaacattcagagcccctgttgttcccaggccatctaccatcgaaagtgcatccagaagtatgcccacacttccgctaagcactttttcaaatgcccacagtgtaataacaggaaagaatttccccaagagatgctacgcatgggtatccacattcctgatagggacgccgcttgggaactcgagccaggggccttttctgatctgtatcagcggtatcagcactgcgacgcgccgatttgtttatatgaacagggcagggacagctttgaggacgaagggcgctggtgcctgatactgtgtgctacctgtggaagtcatggtacacatcgtgactgcagcagcctgagaagtaatagcaagaaatgggagtgtgaagagtgctccccagccgctgcaaccgactacatccccgaaaactctggtgacattccgtgctgcagttccaccttccacccagaggaacacttttgccgggacaacacgttggaggagaatcctggactctcctggacagactggcccgagccttctctgctcgaaaagcccgaaagctcccgaggtcgacgatcatactcttggaggtccaagggcgtcagaatcacaaattcgtgtaagaagtcaaagtag

SEQ ID NO: 20121 - DNA, 1029 bp, Artificial Sequence
  Description of Artificial Sequence: Synthetic coding sequence
atgaagaccgtgaaggagaagaaggagtgccagcggctgcggaagagcgcgaaaacacggcgggtgacacagcgcaagccctcttccgggcccgtgtgctggctgtgtctgagggaacccggggaccctgaaaaactgggcgaatttttgcaaaaggacaatatttctgtccactacttctgcctcatcctgtcctcgaagctcccccaacgggggcagtccaacaggggtttccacggctttcttcccgaggatatcaagaaggaagccgcccgggccagtagaaaaatttgctttgtctgcaagaagaaaggcgccgcaattaattgtcaaaaggaccaatgtcttagaaatttccacctaccatgtggacaggagagagggtgcctaagccagtttttcggtgaatataaatccttttgtgataagcatagacccactcaaaatatccagcacggtcatgtgggagaagaatcctgtatactgtgctgcgaagacctgtcccagcagagcgtggaaaatatccagtccccttgttgcagccaggcaatatatcatcgaaaatgtatccagaagtacgcccataccagcgctaagcacttcttcaaatgtccacagtgtaataataggaaagaatttccacaggaaatgcttcggatgggaatccacatccccgacaggcgatggtgcctgatcctgtgtgccacctgcggcagccatggcacacaccgggattgcagtagcttgagaagcaacagtaagaagtgggagtgtgaggaatgctcaccagccgctgccacggattacattccagagaacagtggtgatataccctgctgctctagcacatttcacccagaagaacacttttgccgcgacaacaccttggaggaaaatccaggcctttcatggacagattggcctgagccatcgctgttggagaaaccagagtctagccgaggaagacgatcatactcctggcggtccaaaggggtcaggatcactaattcctgcaagaagtctaaatag

SEQ ID NO: 20122 - DNA, 873 bp, Artificial Sequence
  Description of Artificial Sequence: Synthetic coding sequence
ttcaaccggaagatctgcttcgtgtgcaagaagaagggcgccgccatcaattgtcaaaaggaccagtgcctccgcaactttcacctcccctgtggtcaggaaaggggctgcctcagtcagttctttggagagtataagtccttctgcgacaagcaccgacccacgcaaaatatccaacacgggcacgtgggggaggaatcatgtatactgtgttgcgaggacctgtcgcagcagtcggtagagaacattcagtctccctgttgctctcaggccatttaccacaggaagtgtattcagaaatatgcccacacttccgcaaagcatttcttcaagtgtcctcagtgcaacaacagaaaagagttccctcaggaaatgctcagaatgggtattcatattcccgatagccgtgatgccgcatgggagcttgagcctggagcattctctgatctttatcagcggtatcagcattgcgatgcccctatttgtctgtatgagcagggtcgagactctttcgaagacgaaggccgctggtgcttaatcctgtgcgcaacgtgtgggtcccacggcacccacagggactgttccagccttcggtctaattctaaaaagtgggagtgcgaggaatgcagcccggccgctgccacggactatataccagagaacagcggagatatcccatgctgctcttctacattccaccccgaagagcatttctgccgtgataataccctcgaggagaacccggggctgtcctggactgactggcctgagccctccttgctggagaaacctgagagctctaggggccggcgttcttactcttggaggtccaaaggcgtgagaattactaactcctgtaagaaaagtaaatag

SEQ ID NO: 20123 - DNA, 642 bp, Artificial Sequence
  Description of Artificial Sequence: Synthetic coding sequence
atgctgcgggagcccggcgaccccgagaagctgggcgagttcctgcagaaggacaatatctctgtgcactatttctgtctgatcttgtcttcaaaattgccgcaaaggggtcagtcaaatcggggctccatggacttctgcctgaagacaagcaagagacgccagcccggcctactggggcggagcgccctttgtgcccggaaaagggaacttctgagtactgcccgtcgcatctcagcttccgagacctcaatttgtctggtagctaagaagggtgtggcattccacaactttctcgaatctacaaatcattttgtaacaaacatagcgcagcatagaacctctaacatgggaatgtggggccgcaaggcggcatcttacgtcgttaaaacatacccaaaccgggtcctgcgtacgtcacgggcaagggtggtggtgaagccaagtaccacagcatctgcataccgcaatatgccaactcatcaacagtccataagctccaacgtccacagtgttactattgagcgcgtatcatcgcggaacgcggaaaatgggaacagttattcccgacaggaggtagtccctcattcagtgtgttacatgagaatacctcggaatccacaaggcctgctgctatcttag

SEQ ID NO: 20124 - DNA, 72 bp, Artificial Sequence
  Description of Artificial Sequence: Synthetic coding sequence
atgaagaccgtgaaggagaagaaggagtgccagcggctgcggaagagtgccaaaactaggagggtaacctag

SEQ ID NO: 20125 - DNA, 1146 bp, Artificial Sequence
  Description of Artificial Sequence: Synthetic coding sequence
atgaagaccgtgaaggagaagaaggagtgccagcggctgcggaagagcgcgaaaacccgccgtgttacacagcggaagcctagttctggccccgtgtgttggctgtgtcttcgcgagcccggggatccagagaagctcggtgagtttctccagaaggacaacattagcgtgcattacttctgcttaatcttgtcaagtaagctccctcagcgggggcagtctaaccgaggattccacgggttcttacccgaggatattaaaaaggaagccgctagggcatctcggaaaatctgcttcgtttgcaagaagaaaggggccgccattaactgccaaaaagatcagtgcctgcgaaattttcatttaccctgtggacaagagcgagggtgtctgtcacagttcttcggggagtacaaatctttctgtgacaagcatcgaccgacccagaatatacagcacggtcatgtgggggaggaatcatgcatcctgtgttgcgaagatctatcacagcagagcgtggagaatattcagagcccttgctgtagccaggcgatctatcacagaaagtgcatccagaagtacgcgcacacctccgccaagcatttttttaaatgcccccagtgtaacaaccgcaaggagtttccgcaggagatgctcaggatgggcatccatattcctgaccgagatgcggcctgggaactagaacctggcgctttctccgacctgtaccaaaggtatcaacactgtgacgcgcccatttgcctgtacgaacaggggagggacagctttgaggatgagggtcggtggtgcctcattctgtgtgccacatgcggatcacatggtactcatcgcgactgctcatccttacgcagcaactcaaagaaatgggagtgcgaagagtgctcaccggccgcggcaaccgattatattccagagaattcaggggatattccctgctgttcctccaccttccacccggaggagcatttttgtagggacaacaccctcgaagaaaatcccggcctcagctggacagattggcctgagccatctctgcttgaaaagccggagagctcaaggggcagaagaagctatagttggcgttctaagggcgtgcgtatcacgaattcatgtaaaaaatctaaatag

SEQ ID NO: 20126 - DNA, 1557 bp, Artificial Sequence
  Description of Artificial Sequence: Synthetic coding sequence
atggaccagaccccccccgcccggcccgagtacctggtgagcggcattaggacaccaccggtgcgtcggaattccaagctggctacgcttgggaggatttttaagccctggaagtggcgaaagaagaaaaatgagaaactgaaacagacaacaagcgcactggaaaaaaaaatggcgggcagacaaggcagagaagagctgatcaaaaaagggttgctcgaaatgatggaacaggatgccgagtccaaaacatgtaatcccgatggaggcccaagatctgtccagtctgaacctccaactccaaaaagcgaaacacttacatccgaggacgcccagcccggaagtccactggccaccggtaccgaccaggtgtctcttgacaaaccgctcagcagcgccgcccatctcgatgatgcggcaaaaatgccaagtgcctcttccggggaggaggctgatgctggcagcctgctccctaccacaaacgaactgagccaggcactggctggggcagacagcctggattcccccccccgccctctggagcggagcgtcggccaacttccttctcctcctctgttgcccacccccccacctaaagccagctctaaaacgacgaagaacgtgactggacaggccactttgtttcaggccagttcaatgaaatctgccgacccaagtctgagaggccagctgagtacgcccaccggctccccgcatctgacaactgttcatcgcccactgccaccatcacgagtcatagaggagctgcatcgcgctttagcgacaaagcatcgccaggacagctttcagggcagggagtccaaaggatcaccgaagaagcgcctggacgtgcgactgtctagaacctcctcagtggaacgaggcaaagagagagaagaggcttggtctttcgacggcgcactcgagaacaaacgtacagccgcaaaggaaagcgaagaaaataaggaaaatctgattataaatagcgagcttaaggatgatctcttgctgtatcaggacgaggaggcactgaacgactcaatcatcagcggaacattaccccgcaagtgcaaaaaagagcttctcgctgtgaagctccgaaatagaccatctaagcaggaactagaggataggaacattttccctaggcggaccgacgaggaacgccaggaaattaggcagcagattgaaatgaaactttcaaaacgattaagtcaaaggcctgcagtggaggagttagagcgaagaaacatcctcaaacagcgtaatgaccagacagagcaggaagagcgcagggaaatcaagcagcgcctgactcggaagctgaaccaaagacctacagtcgatgagctccgcgacaggaaaatcctgatcagattctctgattacgtcgaggttgcaaaggcccaagattatgatcgaagggcagataagccatggacgagactgtctgctgcagacaaagccgcgatccggaaggagttgaatgaatacaagagtaacgaaatggaagtgcatgcctcgagtaagcacctgacaagattccaccgaccatag

SEQ ID NO: 20127 - DNA, 1347 bp, Artificial Sequence
  Description of Artificial Sequence: Synthetic coding sequence
atggaccagaccccccccgcccggcccgagtacctggtgagcggcattagaacaccaccagtgagaaggaatagcaagctggctacactcggccgcatcttcaagccgtggaagtggcgtaagaaaaaaaatgagaaactgaaacagacaaccagtgccctggagaaaaagatggctgggcggcagggaagagaagagctcatcaaaaaaggactgcttgaaatgatggagcaggacgcagaaagcaaaacctgcaaccccgatggcggccctcggtctgtgcagagcgagccacctaccccaaaatcggagacgcttacaagcgaagacgcccagccaggctcacctctggccactgggactgaccaggtgagcctagataaaccgctcagctcggccgcccatttggatgatgccggccaggctacattgttccaggccagttcaatgaaaagcgccgatcccagcctcaggggccaattgagcacaccgactggcagtccacatctcaccaccgtccatagaccactgcccccaagccgcgtgattgaagaactccacagggcccttgccacaaaacaccgtcaggactctttccaagggagagaatctaaggggtcacccaaaaagagactggatgtcagattgtcccgcacgtcctctgtggaacgcggaaaggagagggaggaagcctggagctttgatggtgctttggaaaataagcgcacggccgctaaggaatccgaagaaaacaaagagaacctcattataaacagcgaactgaaagacgatctgctgctgtaccaggatgaggaagctttaaacgatagcatcatcagcggtactctgcctcggaagtgcaaaaaggagctgcttgcagtgaagttgcgcaaccggccatcaaagcaggagctggaggatcgcaacatcttccctcggagaacagatgaagagaggcaggagatccggcagcagattgagatgaaactatctaagcgactatctcagcgcccagccgtggaagaactcgagagacgcaatatccttaagcagaggaatgaccagacagagcaggaggagcgcagggagataaaacagcggctcacccgcaaactgaaccaaagacctacagtggacgaactgcgggataggaagattctgatccgctttagtgactatgttgaggtggcgaaggctcaagactatgatcgacgggcggacaaaccttggacaagactgagcgccgcagacaaggctgcaattcggaaagaactgaacgagtacaagtcgaatgaaatggaggtacacgccagcagtaaacatctgacaaggttccatcgaccttag

SEQ ID NO: 20128 - DNA, 1680 bp, Artificial Sequence
  Description of Artificial Sequence: Synthetic coding sequence
atggccgccagcgaggacggcagcggctgcctggtgagccggggccggtctcagtccgacccgagcgtgttgacagatagctcagcaacttcctctgctgatgctggggagaaccccgatgagatggatcagactcctccggcaagacccgaatacctggtttccggcatccgtacccctccggtaagacggaattccaaactcgccaccttgggcaggatattcaagccatggaagtggagaaaaaaaaagaatgagaaactcaaacaaacaacgagcgccctcgagaaaaaaatggccgggaggcagggtcgcgaagaattgatcaagaaaggcctgctggagatgatggagcaagatgctgaatcgaaaacttgtaacccagacggcggtccacgctccgtgcagtcagagcctccgactccgaagtccgaaactctcacaagcgaggacgcccagcccgggtcacccttggctaccggtacggatcaggtcagtctggataaacctttgtcaagtgctgctcatctggatgatgctgcaaagatgcctagcgccagctcaggagaggaagccgatgctgggtcgctgctcccaacgaccaacgagttgagccaggcactggccggcgcagatagtctcgactccccaccgcggcccctggagcgatcagtgggccaacttcccagtccaccgttgctgcccactcccccaccaaaagcctcatcaaagactacaaagaatgtgaccggtcaggctacactgtttcaggcgtcctcaatgaagagcgctgatcctagtctgcggggacaactatctacacctacaggctcccctcatctgaccaccgttcaccgccccctgcccccttctcgcgtaatcgaggagctgcaccgcgccttggcgacaaagcaccggcaagattccttccaggggcgcgagagcaagggctctcccaagaagcgcttggatgtgcgcttatccaggaccagcagcgtggagcgtggcaaagaacgagaggaggcatggagcttcgacggtgccctggagaataagcgcacggcggctaaagagagcgaagaaaataaagagaatctgatcattaatagtgagttgaaagacgacttgctactgtaccaggatgaggaggcactgaacgacagcattatatctgggaccctgccccggaagtgtaaaaaggaattgttggctgtgaagctgcgtaataggcccagtaaacaggagctggaggatagaaacatctttcctagaaggactgacgaggaacgacaggagatcaggcagcagatcgaaatgaagctctccaagcgcttgtcacagcgccctgctgttgaggaactggaaaggcgaaacattcttaagcagagaaatgaccaaactgagcaggaggaacgccgggaaatcaaacagcggctcaccagaaaactgaaccaaaggccgacagtggacgagttgcgagaccgcaagatcctgatccgcttctccgactatgtggaagtggcaaaggctcaggactatgatcgaagagccgataagccctggacgaggctctccgccgccgacaaggccgccattcggaaagagcttaacgaatacaaatctaacgagatggaagtccatgcttcctccaaacacctcacacggttccatcgtccttag

SEQ ID NO: 20129 - DNA, 1557 bp, Artificial Sequence
  Description of Artificial Sequence: Synthetic coding sequence
atggaccagaccccccccgcccggcccgagtacctggtgagcggcatccgcacccctcctgttagaaggaactctaagctggcaaccctcgggagaatcttcaaaccatggaagtggcggaagaagaagaacgagaaactgaaacagactacaagcgcattggagaaaaagatggctggccgtcagggaagggaagagcttattaaaaagggtctccttgagatgatggaacaggatgccgaatctaaaacatgcaaccctgacggcggccctcgctcggtccagtctgagccccccacaccaaagagcgagactctcacgagcgaagacgcccagccaggaagcccgttagccaccggcacagatcaggtgagtctggacaaaccgctctccagcgcagctcacctggacgatgcggcaaagatgccaagcgcgagctctggcgaggaagccgatgccggaagtctcctgccaacaaccaacgaactaagtcaggctctggccggagccgacagcttggactctccccctagaccactggagagaagcgtagggcaacttccgagtccccccctactccccacccctccccctaaggctagctcaaaaaccaccaagaatgtgaccggccaggcgaccctgtttcaggcctccagcatgaagtcggcggacccctctctgcgcggacaactcagcactcccacaggatcaccccacttgacaaccgtgcatagacccctccctcctagcagggtgatcgaggaactacacagggcacttgccacaaagcacagacaggattccttccaaggacgtgaatctaagggcagccccaagaaacgtttggatgtcagactgtcccggactagctcagtggaacgggggaaagagcgcgaggaggcttggtccttcgacggagcactggaaaacaagaggaccgccgctaaggaatctgaggaaaataaggaaaatctgatcatcaatagtgagcttaaggacgacttgctcctgtatcaggacgaggaggccttaaatgactctataatctccggcacccttccccgcaagtgcaagaaggaactgctggccgtaaagctgcggaaccgcccaagcaagcaggagctggaggaccgcaacatttttccacggcggaccgatgaggagcggcaggagatccgacagcagatcgaaatgaagctttcaaaaaggctcagccagcgtcccgctgtcgaagagttagaacgccgtaacatactgaagcaacggaacgatcagaccgaacaagaggaacgccgtgaaatcaagcagagactgacaagaaagctgaatcaaagacctacagtcgacgagttaagagaccggaagatcttgataagattttcagactatgtggaagtggccaaggctcaggattatgaccgcagagccgacaagccctggactcgactctctgcagctgataaagctgccattaggaaagaactgaatgaatataagtctaatgagatggaggtccacgcatcaagcaaacatttgacaagatttcatcgaccctag

SEQ ID NO: 20130 - DNA, 1347 bp, Artificial Sequence
  Description of Artificial Sequence: Synthetic coding sequence
atggaccagaccccccccgcccggcccgagtacctggtgagcggcatacgaaccccccccgttaggcgaaatagtaaactggctacactggggcggatatttaagccatggaaatggcgcaaaaaaaagaacgaaaaactcaagcaaactacatcagctttggaaaagaaaatggccgggcgtcaaggcagggaagagctcattaagaaagggctcctggagatgatggagcaggatgcagagagcaagacttgcaatccagacgggggtccaagaagcgtccaatctgagccgcctacgcctaagagcgaaactcttacctcagaggacgctcagccgggctcgcctcttgcaaccggcaccgaccaggtgtccctggataaaccgttgtcttcggctgcccacctcgacgacgctggacaagctaccctcttccaggcgtcatccatgaagtctgctgatccaagcctgcgcgggcagctgtctacaccaacgggcagtccccacttgacaaccgtgcaccgcccactcccacccagcagagtgatcgaggagctgcatcgggccctggcaactaaacaccggcaggacagtttccaggggcgggagagcaaaggatctcctaaaaaaaggctcgacgtcagactgagccggacaagcagtgtggagagaggcaaagagagagaggaagcctggtcttttgatggggccctggaaaacaaacgcacagcagcaaaagaatcggaggagaacaaggaaaacctgatcataaattccgagctgaaggacgatttgctgctgtatcaggacgaggaggccctaaacgatagcatcatctcaggtaccctcccgcggaaatgcaaaaaagaacttctcgcagttaagcttcggaatcgccctagcaagcaagagctcgaggatcgcaatatcttcccaaggcgcactgacgaggagcgccaggaaattcggcaacagatcgagatgaagctatctaaacgcctcagccagaggccagcagtggaggaattggagagaagaaatatccttaagcagaggaatgatcagacagagcaagaggaacgccgcgaaatcaaacaaaggctgacacgtaagctgaatcagaggccgacggtcgacgaacttcgagatcgcaagatcctgattaggttcagcgattacgtggaggtagcaaaagcgcaggactatgaccggcgtgccgacaaaccttggactagactctccgccgcggataaggctgctatcagaaaagagctgaatgagtacaagagcaatgaaatggaagtgcacgcgagctcaaagcacctcacgcgcttccaccgcccttag

SEQ ID NO: 20131 - DNA, 126 bp, Artificial Sequence
  Description of Artificial Sequence: Synthetic coding sequence
atggccgccagcgaggacggcagcggctgcctggtgagccggggcaggagccaatcagacccaagtgtcctgacggattcgtctgctacctcgagcgctgatgcaggcgagaatccggacgaatag

SEQ ID NO: 20132 - DNA, 1557 bp, Artificial Sequence
  Description of Artificial Sequence: Synthetic coding sequence
atggaccagaccccccccgcccggcccgagtacctggtgagcggcattcggactcctccagtgcggcgcaattcgaagttggccaccctgggacgcattttcaagccgtggaagtggaggaagaagaaaaatgaaaagttgaagcagaccacgtctgcattagaaaaaaagatggccggtcggcagggaagggaagagctgataaagaagggcctgctggaaatgatggagcaggacgctgaatccaagacctgcaacccagatggtggccccaggtccgttcagtcagaaccccctaccccaaagtccgagaccctaacctccgaggacgcccagccaggttccccgctggctacaggaaccgaccaagtgagtctggataaacccctgtcgtcggcagcccatctggacgatgccgccaaaatgccatccgcttcttccggcgaagaagctgacgccggcagcctgctcccaactaccaacgaattgtcccaggctctcgccggagctgattccctcgattcgcctcccaggccattggagagaagtgtggggcaattgccgtccccccccttgctgcctacaccaccgcctaaagccagcagtaaaaccaccaaaaacgtgacgggccaggccaccctgttccaagcctcctccatgaaatctgctgacccatccctcagaggccagctctccacccctacggggagcccacacttgacaacagtgcaccgcccactgcctccttccagagtcattgaggagttacaccgggccctggcaacgaaacatcgtcaggactctttccaaggtcgggagagcaaaggctctccaaagaaacgtctcgatgtccgactgagtcgcactagtagcgtcgaacggggcaaggagagagaagaggcctggagcttcgacggtgctctggagaacaagcggacggccgccaaggagtccgaggagaacaaagagaatctgataatcaactctgaacttaaggatgaccttctgctttatcaggacgaagaagccctcaacgatagcattatcagtggcacgcttcctagaaagtgcaagaaagagttactagcagtcaaactccgcaacaggccaagcaaacaggagctcgaggacaggaacatttttccaagaaggacagacgaggagagacaggaaatcagacagcagatcgaaatgaaactgtctaagcgcctgtcacaacgcccagccgtcgaggagctggagcgccggaacattctgaagcagcgcaatgaccaaacagagcaggaagagcggcgtgagattaagcaacgcctgactagaaaactcaaccagagacctactgtcgacgagttacgggatcggaaaattctgatcagattttcagactatgtggaggtagcaaaggcacaggactatgatagacgcgctgataaaccctggacgcgcctgtcagccgcggataaggctgccatccggaaggaacttaatgagtataaatcaaatgagatggaggttcacgctagcagtaagcatctaactagattccatcggccatag

SEQ ID NO: 20133 - DNA, 2430 bp, Artificial Sequence
  Description of Artificial Sequence: Synthetic coding sequence
atgtacgaggccctgcccggccccgcccccgagaacgaggacggcctggttaaagtgaaggaagaggatccaacctgggagcaggtgtgtaacagccaagagggttcaagtcacacacaggagatatgcaggctacgcttccggcacttttgctatcaggaagcccacgggccccaggaggcccttgctcagctacgggagctctgtcaccagtggctccgccccgagatgcatactaaggagcaaataatggaactgctcgtactggagcagttcctgacgatcctgcccaaggagctccagccctgcgtgaaaacatatccactcgaaagcggtgaggaggccgtcacggtgctggagaacctcgagaccgggtcaggtgacacaggccagcaagcttcagtgtacattcaggggcaggatatgcatcccatggttgctgaatatcagggagtgagtttggagtgccagagcctccagctcctgccaggtatcacaacattgaaatgtgagcctcctcagcgaccgcaggggaacccacaagaggtttctgggccagtgccacatgggagtgcacatttgcaagagaaaaatccccgtgataaggctgtcgtcccagttttcaaccccgtgagaagccagaccctcgtgaagaccgaggaagagaccgcacaagctgtggccgccgagaagtggtcccacttgagcctcaccaggcgaaacttgtgcgggaatagcgcacaggaaacagtgatgtccctctcccctatgacagaagaaattgtcacaaaagacaggctctttaaggccaaacaggagacatccgaggaaatggagcagtcaggagaggcgtcaggaaaacctaaccgggaatgtgccccacagatcccctgcagcaccccaattgctacggagagaactgttgcccaccttaacacattgaaagatcgacaccctggcgacttatgggcccgtatgcatattagttccctggaatacgccgcgggggacattacaagaaaagggagaaagaaggataaggcacgagtgagtgaactgctgcaggggctcagcttctcaggcgattctgacgttgagaaagataacgaacctgagattcaaccggcccagaagaagctcaaggtcagctgtttccctgaaaagtcttggacgaagcgggatattaagcccaatttccccagctggagtgcactggactccggcctgctgaatctgaaaagcgagaaactgaacccggtcgaattgtttgagctctttttcgacgatgaaacctttaacttgatcgtgaatgaaactaataattacgcctctcagaagaacgtgagtctcgaggtcactgtccaggaaatgagatgtgtgttcggagttctgctgctcagcgggttcatgaggcaccctaggagagaaatgtactgggaggtatccgacaccgatcaaaaccttgtgcgagacgcgattagaagggaccgctttgagctgattttcagcaatctccactttgctgataacggccacttagaccaaaaagacaaattcacaaagctgagaccactgatcaaacagatgaacaagaattttttgctgtacgcacctctcgaggaatactattgcttcgacaaatccatgtgcgagtgctttgatagcgaccagttcctcaatgggaagccaatcaggatcggctacaagatctggtgtgggaccacgactcaaggatatctcgtatggttcgaaccctaccaggaagagagtacaatgaaggtggacgaagacccagacctgggtcttggcggaaatttggtgatgaactttgccgacgtcctgcttgagcggggtcagtatccctatcacctatgttttgattcattcttcacgagtgtgaagcttctatctgctcttaaaaaaaaaggtgtccgcgctaccggcacgatccgcgagaaccgtacagagaagtgtcccctgatgaatgtagagcacatgaaaaagatgaaacggggctactttgactttcggatcgaggagaacaacgagatcatcctgtgccgttggtacggtgatggaatcatttccctgtgctcaaacgccgtgggtatcgagccggtcaatgaagtgtcctgctgtgatgcggacaatgaagagataccgcagatttctcagccgtcaatcgtgaaggtttacgacgaatgtaaggagggcgtcgccaagatggaccagattatcagcaagtatcgcgtgagaatcaggtcaaaaaagtggtactcaattctggtgagctatatgattgatgtggctatgaataacgcatggcagctgcaccgagcatgcaacccaggggcttctctcgaccctctcgacttccggcgctttgtggcacatttctatctcgagcacaatgcccatctgtcagactag

SEQ ID NO: 20134 - DNA, 2430 bp, Artificial Sequence
  Description of Artificial Sequence: Synthetic coding sequence
atgtacgaggccctgcccggccccgcccccgagaacgaggacggccttgtgaaggtgaaggaggaggacccaacttgggagcaagtgtgtaactctcaggaagggtcctcccacactcaggagatttgccgcctccggtttcgacacttctgctaccaggaggcacatggaccccaagaagctctcgctcagctccgggagctctgtcatcaatggctcagacccgagatgcacacaaaggaacagatcatggaactgctggtgctcgagcagtttctcacgatcctgcccaaagagctgcagccctgcgtgaaaacataccccctcgagagcggggaggaagccgtgactgtgttagaaaacctggaaactggcagtggggacaccggacagcaggccagcgtctatatccagggccaggacatgcatcccatggtggccgaataccagggcgtctctctcgagtgccaatcacttcagctgcttcctgggatcaccactttgaaatgtgagcccccacagcggccccagggtaaccctcaggaggtgagcggtcccgtcccacatggaagtgcacacttgcaggagaaaaaccccagagacaaagccgtagtgccggtctttaaccccgtacggagtcagaccctggtgaagaccgaagaggaaactgctcaagctgttgcagctgagaaatggtcccatcttagtctcactcgacgcaatctatgtgggaactccgcccaggaaactgtcatgagcttaagtcccatgacggaggagatagtgaccaaagatagattattcaaagcaaagcaggagactagcgaggagatggagcagagtggcgaagcatccgggaagcctaatcgggaatgtgcacctcagattccatgttccactcccattgcgaccgagagaacagtggctcacctcaataccctgaaggataggcaccctggcgacctctgggcaagaatgcacatcagttctctcgaatacgctgcaggggacataaccaggaagggtcgcaagaaggataaggcaagggtgagcgagctcctgcagggcctctcattctccggtgacagtgatgttgagaaagataatgagccagagattcagcccgctcagaaaaaactgaaagtctcctgtttcccggagaaatcctggactaagcgcgatatcaagccaaactttccaagctggtctgctttggactctggattgctgaatctcaaaagcgaaaagctgaacccagtcgagctgtttgagttatttttcgatgacgagacgttcaatttaattgtcaatgagactaacaactatgcctcccaaaaaaacgtttcactcgaagtgacagtgcaggagatgcgctgcgtattcggcgtgctgctgctctccggcttcatgaggcaccctcgaagggaaatgtactgggaagtctctgacactgatcagaatcttgttagagatgcgattcggagagaccgatttgagctgatcttttccaatctgcactttgccgataacgggcacctcgatcaaaaggataagttcacaaagctgaggccactcatcaagcagatgaacaagaattttctgctctacgcacccctggaggagtattattgttttgataagtccatgtgtgaatgtttcgactcagatcagttcttgaatggtaagccaattaggataggatacaagatctggtgtgggactacaacccagggatatctagtatggtttgaaccgtaccaggaggagtcaacaatgaaagtggacgaagatcctgatcttggccttggcggtaacctcgttatgaacttcgccgatgtccttctggagcgcgggcagtacccgtaccacctctgtttcgattcattttttacaagcgtaaaattgctgtctgctctgaaaaaaaaaggcgtccgggccaccgggactatccgtgagaataggaccgagaagtgtccactcatgaatgttgaacatatgaaaaagatgaaaagagggtacttcgactttagaatcgaggagaataacgagatcatcctctgccgatggtacggagatggaattataagtctgtgcagcaatgcggttggtattgagcccgtgaatgaggtctcttgttgtgacgccgacaacgaagagatcccccagatttcccagcctagcatcgtgaaggtatatgatgaatgtaaggagggagtggcaaaaatggaccagataatctccaagtacagggtgcgaattcggagcaaaaagtggtacagtatcctggtgagctacatgatcgatgttgctatgaacaatgcttggcagctgcacagggcttgtaaccccggagcttccctggacccacttgattttcgtaggtttgtggcgcatttctatctggagcacaatgcacacctgtctgattag

SEQ ID NO: 20135 - DNA, 2418 bp, Artificial Sequence
  Description of Artificial Sequence: Synthetic coding sequence
atgtgggaccagggcggccagccctggcagcagtggcccctgaaccagcagcagtggatgcagtcattccagcatcagcaggacccttcccaaatcgattgggccgcactcgcccaggcgtggattgctcagcgggaggcttctggccaacaaagtatggtagagcagccccccggcatgatgccaaatgggcaggacatgtctacgatggagtcaggtccgaataaccacgggaattttcagggtgacagtaattttaataggatgtggcaaccagagtggggcatgcaccagcagccgcctcacccccctcccgatcagccgtggatgccgcctaccccgggcccaatggatatcgtgccgcctagtgaggactccaacagccaggattctggggagtttgcccccgacaataggcacatctttaaccaaaataaccacaacttcggaggcccacccgacaacttcgcagtgggaccagtgaaccagttcgactatcagcatggcgctgcttttggtcctcctcagggcgggttccaccccccctactggcagcccggacccccgggtccccccgcgcccccacagaacaggcgagagcgacctagctcctttcgggacaggcagaggtcccctattgcactgcccgttaaacaggaacctcctcagattgatgccgtgaagcgacggactctccctgcttggatcagagaaggtctggagaaaatggagagggagaagcagaagaaattagagaaagaacgtatggagcaacagaggagtcagctcagcaaaaaggaaaagaaggccaccgaagacgcagaaggcggtgatggccccaggctcccccagagaagtaagtttgattccgacgaggaagaggaagacacagagaatgtggaggcagccagttctggtaaagtgaccagatcgccttctcctgtaccacaggaagagcattctgatcctgagatgactgaagaagagaaggagtaccagatgatgctgctgacaaagatgcttctcacagagattctcctggacgtgacagatgaggaaatctactatgtggccaaagatgcacatcggaaggccactaaagcccctgcaaaacaattggctcagtcatccgccctggcgagtcttactggcttaggaggactaggcgggtatggcagtggtgactcagaagatgaacggagtgatcggggctccgagtcgtcagacactgacgatgaggagctgcggcacagaattcggcaaaagcaggaggcattctggcggaaggaaaaagagcagcagctgctacatgataagcagatggaagaagagaagcagcaaactgagcgcgtgacaaaggagatgaacgaatttatccataaggaacagaacagcctgagccttctcgaagcccgagaggcagacggagatgttgtgaatgaaaagaaacgtacccccaatgaaacaacctcagtccttgagccaaagaaagagcataaagagaaggaaaaacaaggccgaagcaggagcgggtcttcttcctcggggtctagtagcagtaattctagaacgtcttcaaccagctctactgtgtcttcgtcttcctactctagttcctcagggagcagcaggacgtctagtaggtccagttctcctaagagaaagaagagacattccagatcaagaagcccaactatcaaggctcggaggtccaggagtcgttcctatagtcgacggataaaaattgagagtaacagagcccgagttaaaatacgtgacaggcgacgatccaatcgcaacagtattgagcgagagcggcggcgaaaccggagccctagtagggaacgacgaaggagcaggtcacggtctagagataggagaaccaaccgtgccagccggtccagatcgcgagatcggagaaagatcgacgaccaaagaggcaatttatctggcaattcgcacaagcacaaaggggaggctaaagaacaggagcgcaaaaaagagaggtctcggtcaattgataaagataggaagaagaaagacaaggaaagagagcgtgagcaagacaagagaaaagaaaaacagaagcgggaggagaaagatttcaaatttagcagccaagacgatcgactgaagcgcaagcgcgagtccgaacggacgttcagccgttctggcagtattagcgtgaaaatcatcaggcacgattctcgccaggattcgaagaagagcacaaccaaagattctaaaaaacactcaggcagtgattctagcggcagatcctcctcagaatcccccggctctagtaaagagaagaaggccaaaaagccaaagcactctaggtccaggagcgttgagaaaagtcaaagaagcgggaagaaagccagtcggaaacacaaatctaagtcccgcagcagatag

SEQ ID NO: 20136 - DNA, 2418 bp, Artificial Sequence
  Description of Artificial Sequence: Synthetic coding sequence
atgtgggaccagggcggccagccctggcagcagtggcccctgaaccaacagcagtggatgcagtcgttccagcaccagcaggacccgtcccaaatagactgggctgcattggcccaggcctggatagctcaacgggaagcatctggccagcagagtatggtggagcaacctcccggcatgatgcctaatgggcaggatatgagtactatggagagcggccccaacaatcatggaaatttccaaggagactccaatttcaatcgcatgtggcaacccgagtggggaatgcatcagcagcctccgcatccaccccctgaccagccctggatgccaccgacacctggaccaatggatatcgtgccgccaagtgaagacagcaactcccaagacagtggagaattcgcacctgataatagacacatcttcaatcagaacaatcacaacttcgggggcccacctgacaattttgctgtggggcccgtcaaccagtttgattatcagcatggtgcagcattcggccctccacaaggcggctttcacccgccctactggcagccaggtccacccggcccccctgcccctccacagaaccggagagaaaggccaagctctttccgagaccggcagcggtctcccatagccctgccagtgaagcaggaacccccacagattgacgccgttaaaaggagaaccctgcctgcatggataagagagggcctggaaaagatggaacgtgagaagcagaaaaaattggagaaggagcgcatggagcagcaacgaagtcagctaagcaagaaggaaaaaaaagccactgaagatgcggaaggtggagacggcccacgtctgccacaaaggtcgaagttcgattctgatgaggaggaggaggacacagaaaatgttgaggctgcttcttccgggaaagtgacccgcagccccagtccagtcccacaggaggaacattccgatccagagatgacggaggaggagaaagagtatcagatgatgctcctgaccaaaatgttgctgaccgagattttgcttgacgtcactgacgaagagatatactatgtggccaaggacgcacatcgcaaggccactaaagcccccgctaagcagctggcccaaagctctgccttggcttccttaactgggctgggcggtctgggcgggtatggctctggcgattcggaggacgaaaggtcggaccgcggaagcgagagttcagacactgacgacgaggaattacgacaccggattcgccaaaagcaggaggccttctggagaaaggagaaagaacagcaattgctgcacgacaaacaaatggaggaggaaaagcagcaaacagaaagagtgacaaaggagatgaacgagttcatccacaaggagcagaacagcctgagcctgctggaggctcgagaggccgacggcgacgtggtgaacgaaaagaagcgcaccccaaatgaaactacaagcgtcttggaaccaaaaaaggagcacaaggaaaaggagaagcaggggagatccaggtctggcagcagcagctcagggtcttccagttcaaatagcagaacctcctctacctcatcaaccgtaagttcctccagttactccagctcgtcaggctctagcaggacctcaagccgatctagttccccgaagcggaagaaaaggcatagcagatccaggtctccaaccatcaaagctcgaagaagtcgatctaggtcttattcccgacggatcaagatcgaaagtaatcgtgcaagggtgaagattagagatcgacggagatcaaaccgtaacagcatagaacgggagcggcgccgcaatcgtagtccttcgagggagcgccgaaggtctagaagcaggtctagggaccgcaggactaatagagcatctcgctctaggtcgcgggaccggaggaagattgatgaccagaggggaaatctgtccggaaattctcacaaacataaaggcgaggctaaggagcaggagcgtaagaaggagcggtcacgctctatagacaaagatcgcaagaagaaagataaagagcgtgaacgggaacaagacaagcggaaggagaagcagaagcgggaagagaaggactttaagttctcttcacaggacgataggttgaaacggaaaagggaaagcgagcggaccttttcgaggtccgggtcaatttcggtcaagattatccggcatgattcgaggcaggattccaagaaaagcacaactaaggactcaaagaagcacagcggtagcgatagctctggccgcagctccagcgaaagtccaggtagcagcaaagaaaaaaaggcaaagaagccaaaacactcacggtctaggtccgtggaaaagagccagcgcagcgggaagaaggccagccgaaaacacaaatcaaagtcacgctcaagatag

SEQ ID NO: 20137 - DNA, 1830 bp, Artificial Sequence
  Description of Artificial Sequence: Synthetic coding sequence
atggagagcaccgcctaccccctgaacctgagcctgaaggaggaggaagaagaagaagaaattcaaagtagggagcttgaagatgggcctgcagatatgcagaaggtgaggatatgcagtgagggaggctgggtgcctgcattgttcgatgaagtagcgatctatttctctgacgaggagtgggaggtactgacagagcaacaaaaggcgttgtaccgggaggttatgagaatgaactacgagactgttctgtctctggaattcccgttcccaaagcctgatatgatcaccagactcgaaggcgaggaggagtcacagaacagcgacgagtggcagctacagggtggcacctctgcagaaaacgaggagtccgacgttaaacctcccgattggccaaacccgatgaatgcaacctcccagttcccccagccccagcacttcgattcttttgggctccgcctgccccgtgacatcaccgaattgcctgagtggagcgaaggctatccattttacatggccatgggcttcccaggatatgacctctccgccgatgatatcgcagggaagtttcagtttagcaggggcatgaggcgctcctacgacgccggtttcaaactgatggttgtcgaatacgcggagagtactaacaactgccaggcggcgaagcaattcggcgtgctggaaaagaacgtgagggactggcggaaggtgaaaccacaattgcagaacgcacatgccatgagaagagcctttcgagggcccaagaatggccgatttgccttggtggaccaaagggtggcggagtacgtcaggtatatgcaggccaagggagatcctataacccgcgaggccatgcagcttaaggccctcgaaattgcccaggagatgaatataccagagaaaggttttaaagctagcttaggctggtgcaggcgcatgatgcgtaggtacgatttatccctgcggcataaagttcccgtaccccagcatctgcctgaagacttgacagagaaactggttacataccaaagaagcgtcctcgccttacggcgagcacatgattacgaagtggcccagatgggcaatgccgacgaaactcccatttgtctggaagtacctagccgggtgactgtggacaaccagggagagaagccagtgttggttaagacacccggtcgtgaaaaattaaagattaccgctatgctgggtgtccttgccgacggcaggaaactgcccccgtacatcatactgcgagggacatatatcccacccgggaagtttccttccggtatggaaattagatgccataggtatgggtggatgacagaggatctgatgcaggattggcttgaggtggtctggcgtaggaggacaggagctgttcccaagcagcgagggatgttgatcctgaacggctttaggggccacgctacagacagtgttaaaaactctatggagagcatgaatacagatatggtgatcatcccaggggggctgacttcacagttgcaagtgctggatgtagtggtctacaaaccactcaatgattccgtgcgtgcacagtactccaactggctgttagccggcaatctagccctctcacccactggcaacgccaagaaaccaccgctggggctgtttttagagtgggtaatggttgcctggaacagtattagttctgaatcaattgtccaaggatttaaaaagtgccatattagttctaacctggaagaggaagatgatgtgttatgggagatagagtcggaactcccgggtggcggcgaaccacccaaagattgtgacacggagtcgatggcggagagcaactag

SEQ ID NO: 20138 - DNA, 1830 bp, Artificial Sequence
  Description of Artificial Sequence: Synthetic coding sequence
atggagagcaccgcctaccccctgaacctgagcctgaaggaggaggaggaggaggaggagatccaatctcgggaacttgaggacggccccgcagacatgcaaaaggtgcgcatttgtagtgaaggcggctgggtcccagccctgttcgatgaggtcgccatttatttcagcgatgaggagtgggaggtgcttacagaacaacagaaagcattatatagggaagtgatgaggatgaactatgagacagtgctgtcactagagttcccttttcccaaacctgacatgatcacaagactcgagggtgaagaggaatctcaaaattcagacgagtggcagctacagggaggcactagcgccgaaaatgaggaatccgatgtgaaacctccggactggcccaaccctatgaacgccacgtcccaattccctcagccacagcattttgattctttcggtctgaggcttccaagagatattaccgagttgcctgagtggagtgaagggtacccattttacatggcaatgggtttccctggttacgacctgagcgctgatgatattgccggaaagttccaattttcccgtggaatgcggaggtcttacgacgcaggcttcaagctcatggttgttgagtacgccgagagtaccaacaactgtcaggccgccaagcagttcggggtgttggaaaagaacgtgagggattggaggaaagtgaaaccccaacttcaaaacgctcatgctatgaggagagcattccgtggaccaaaaaacggccggttcgccctggtggaccagagagtggctgagtatgtgcggtacatgcaggccaaaggggacccaattaccagggaggcaatgcagcttaaggcactcgaaatagcgcaggagatgaacattcctgagaagggcttcaaggcttctctcggatggtgccggcggatgatgaggcggtatgatctcagtttgcgccataaggttcccgtcccacagcatttacccgaagaccttacggagaaactcgtgacctaccagaggagcgttctggcgctgagaagggctcatgactatgaagtggctcaaatgggtaacgcagatgaaactcctatctgtctggaagtgccatcccgggtcaccgtggataaccagggcgaaaagcctgtgctcgtgaaaaccccggggcgggagaagctaaagatcactgcgatgctgggggtcctggccgatggccgaaagttgccaccctacataattttgcgggggacttatatccccccgggcaagtttccttcaggaatggaaattaggtgtcatcgatatgggtggatgactgaggatctcatgcaggattggctggaggtggtgtggaggaggcgtactggtgcagtgccaaaacaacggggaatgttgatcctgaatggttttcggggacatgcgactgattccgtgaagaattctatggagagtatgaatacagatatggtgatcatacccggtggtctaacatcccagctgcaggttctcgatgtagtcgtttacaaacctctgaatgactctgtgcgtgcccagtattctaattggctgctcgccggcaacctggccttatctccaacgggcaacgccaagaaacccccactgggcctgttcctggagtgggttatggtggcttggaactcaatctccagcgagtctatcgtgcagggctttaagaagtgccatatctcaagcaacctcgaagaggaagatgacgtgttgtgggagatcgagtctgaattaccagggggaggcgaaccaccaaaggattgcgataccgagtctatggccgaatcaaattag

SEQ ID NO: 20139 - DNA, 630 bp, Artificial Sequence
  Description of Artificial Sequence: Synthetic coding sequence
atggagagcaccgcctaccccctgaacctgagcctgaaggaggaggaggaagaggaagagatccaaagccgggaactggaagatggcccggccgacatgcagaaggtgcggatctgcagcgagggcgggtgggtccctgcactgtttgacgaagtggccatttatttctcagacgaagagtgggaagtgttaaccgagcagcagaaagccttgtacagagaggtgatgagaatgaattatgaaaccgtgctttccctcgaattcccgttccccaagcctgacatgatcacccgtctggagggggaggaggagtcacagaacagtgatgagtggcagctgcagggaggcaccagcgctgagaacgaggagtccgatgtgaaaccaccagattggccaaatcccatgaatgctacatcccagtttccacagcctcagcacttcgactcattcggcctccgtcttcctcgggatatcaccgagctgcctgaatggtcagagggttacccattctacatggctatgggatttcctgggtacgacctaagtgccgacgatatcgcaggaaagtttcagttttcccgaggaatgaggagatcatacgacgctggctttaaacttatggtcgtttag

SEQ ID NO: 20140 - DNA, 1575 bp, Artificial Sequence
  Description of Artificial Sequence: Synthetic coding sequence
atggagttccccttccccaagcccgacatgatcacccggctggagggcgaggaggagtcccagaactccgatgagtggcagctgcagggcgggacatctgctgagaatgaggagagtgatgtgaagccgccggactggcccaatcccatgaacgctacatcccagttcccacaaccacaacacttcgacagctttgggcttagactccccagagacataaccgagctgccggaatggagcgaggggtatcctttctacatggccatgggtttcccaggctatgatctgtctgcagatgatatcgccggcaagtttcagttttcacggggcatgaggagatcatacgacgcagggtttaagctgatggtggtagaatacgcagaatcaacaaacaattgccaagcggctaagcagtttggtgtcttagaaaaaaacgtcagggactggcgtaaagttaagccacagctgcagaacgcacatgcgatgcgccgagccttccggggcccaaagaacggaaggtttgccttggtggatcagagagtggccgagtatgtgagatacatgcaggcaaaaggcgaccccataacgcgcgaagcgatgcagctgaaagccctggagatagcgcaggagatgaatatcccggaaaaggggttcaaggcttccttgggatggtgcagaaggatgatgcggcggtacgatctcagcctccgacataaagtgccagtgcctcagcatctccccgaagaccttactgaaaagctcgtgacgtatcaaagatcagtactggccttacgacgagcccatgattatgaagtggcacaaatgggaaatgccgacgaaacacccatatgcttggaggtcccaagtagggtaaccgttgacaaccagggggaaaagccagtactggtcaagacgcccggacgggaaaagttgaaaatcacagcaatgttgggcgttctggccgacggacgtaaacttcccccgtacatcatcctgagggggacttacatccctccgggcaagttcccaagcgggatggaaatacgctgccacagatatggatggatgactgaggaccttatgcaagactggctcgaagtggtgtggcggagaagaacgggcgcggtgcccaagcagcgggggatgttaatcctgaatggttttcgtggtcatgccaccgactcagtgaagaatagcatggagagtatgaatactgacatggtgattatcccaggaggattaacctcacagctgcaagtcctcgatgtggttgtgtataagccattaaacgactcagtgagagcccagtactccaattggctgctggccgggaatctggccttgtcaccaaccggtaacgccaagaaaccaccactgggcctattccttgagtgggtgatggtggcatggaactctatttcctccgaatccattgttcaaggctttaagaagtgtcacatctcttccaatttagaggaggaggacgacgtgctgtgggagattgaaagtgaattgcctgggggtggcgaacctcccaaggattgtgacacagagtcaatggctgagtccaattag

SEQ ID NO: 20141 - DNA, 2211 bp, Artificial Sequence
  Description of Artificial Sequence: Synthetic coding sequence
atgaaggagatgagcgccaacaccgtgctggacagccagcggcagcagaaacattatggaattacctctcctatctctttggcctcaccgaaggagattgaccacatttatacgcagaaactaattgatgctatgaagccatttggcgtgttcgaagatgaagaagaacttaaccatcggctcgttgtcttggggaaactgaataatctcgttaaagagtggatctctgatgttagtgagagcaagaaccttcccccgagcgtcgtcgcgactgttggcgggaaaatattcacgtttgggagctatagactgggtgtccataccaaaggagccgatatcgatgctctttgcgtggccccgaggcacgtggagcgcagcgacttcttccaaagcttctttgagaagctcaagcaccaggacggcattcgaaacttgcgggccgtcgaagacgcatttgtgcctgtcattaaattcgagtttgacggcattgaaatcgacttagtgttcgcaaggctcgcaatccaaacgatcagcgacaacctcgacctccgggacgatagtagacttagatcactggatatacgttgtatcaggagcctgaacggatgtcgcgtcactgacgaaatactccacctggtgcccaataaggaaaccttcagacttacattgcgtgccgtgaagctgtgggcaaagcggaggggcatctacagcaatatgctggggttcttgggaggtgttagctgggctatgctggtcgctcgtacatgccagctatatccaaacgctgctgcctcaaccttagtgcacaagttcttccttgtcttcagcaaatgggagtggcctaatccggtccttttgaagcagccagaggaaagcaacctgaacctgccagtgtgggacccgcgggtcaacccaagtgatagatatcacctgatgcctataattacacccgcctaccctcaacagaattccacgtataacgttagcacgagtaccagaactgtgatggtcgaagaatttaagcagggcctggcagtcacagatgagattctgcagggaaaaagtgattggagcaagttgctggaacccccaaatttcttccagaaataccgccactacatcgtattaacggcgtcggcttctacggaggagaatcacctggagtgggtaggcctggtggaaagcaaaattcgggtgttggtcggaaatcttgagaggaacgaatttattacgttagcgcatgtgaatccccagtctttcccgggaaacaaagagcatcacaaggataacaactacgtatctatgtggttcctagggataattttccgcagagtggaaaacgcagaaagcgtgaacatcgatctaacctatgatatccagagcttcaccgacacagtttaccgccaggctaataatataaacatgctgaaagagggcatgaaaatagaggcaactcatgtcaagaagaagcagctccaccattatctcccagccgagatactccagaaaaagaaaaaacaaagtctatctgacgtcaacaggtcttccggcggccttcagtccaagagactgtccctggattctagctgtctggattcgagtcgagacacagacaacggcactcctttcaactcccccgcgagtaagtctgacagccctagtgtgggggagaccgagaggaattcagcggagcccgccgcagtgattgtagaaaagcccctgtctgttccaccagcgcaggggctgagtatccccgtgatcggtgcgaaggtggattctaccgttaagacagtcagcccacccaccgtctgcacaattccaaccgtggtaggacggaacgtaattcccaggattaccacaccacacaatccagcccagggacagccccatttaaatggtatgagcaacatcacaaagactgtcactcctaagcgtagccactcaccatctatcgatggcactcctaagagactgaaggatgttgagaaattcatcagactggaaagcacgttcaaagacccgcgtactgccgaagagcggaaacgtaaatctgtggatgccatcggtggggagtccatgcctattccaacaatcgatacctccaggaagaaaagactgccatctaaggagctgccggattcttccagccctgtgcccgcgaacaacattcgcgtaataaaaaatagcatcagattaacactaaatagatag

SEQ ID NO: 20142 - DNA, 1212 bp, Artificial Sequence
  Description of Artificial Sequence: Synthetic coding sequence
atgcccatcatcacccccgcctacccccagcagaacagcacctacaacgttagcacgtccactcgtacggtaatggtggaagagttcaagcaggggcttgcggtaactgacgaaatcttgcagggcaagtctgattggtcaaaattgctggagccccctaacttttttcagaaatataggcattatattgttctgacagcttcagcatcaactgaggagaaccacctggaatgggtgggtcttgtggaatctaagatccgagtgctggtgggaaacctcgagcgaaatgagtttattactctagctcatgtgaacccccagtctttcccagggaacaaggaacatcacaaagacaacaattacgtgtccatgtggtttttgggtattatcttcagacgcgtggaaaatgcagaatcagtaaatatcgacctcacctacgacatccagagttttacggatacagtgtatagacaagccaacaacataaacatgctgaaagagggaatgaaaatagaagcaacccatgtcaaaaagaagcagttgcatcactacttaccagccgagatccttcagaagaaaaaaaagcaatcactctcagacgtcaacaggagctccggcggattacagagcaagcgtctctcactggatagtagttgtctggactcaagccgtgacacggacaacggtacgcctttcaactctcccgccagcaagtctgacagcccatccgttggtgaaacggagagaaactcagcagagccagcagccgtgatcgtcgagaagcccctgtccgtgccccccgcccagggcttaagtatacccgtcataggggccaaggtggattccaccgttaaaacagtgtccccaccaaccgtgtgtactattcctaccgtggttggccgcaatgtcataccaaggatcactacgccgcacaaccccgcacaaggccagccccatcttaacggcatgagcaacattacgaaaaccgtgacccctaagcgtagccattcgccttccatcgacgggaccccaaaacggctgaaggatgttgaaaaggatgcaattgggggagagagcatgcctattccaaccatagacactagccgcaagaagcgcctacctagtaaggagcttcccgattccagttcccccgtgccagctaacaacattagagtgatcaaaaatagtattcggcttacactgaatcggtag

SEQ ID NO: 20143 - DNA, 1149 bp, Artificial Sequence
  Description of Artificial Sequence: Synthetic coding sequence
cggaccgtgatggtggaggagttcaagcagggcctggccgtgaccgatgagattctccagggaaagtcagattggtccaaactgcttgaaccaccaaatttcttccagaagtaccgacactatattgtcctcacagctagtgcgtcaacagaggaaaatcacctagagtgggtgggtctagttgagtccaagatcagggtcctggtggggaatctggaacggaacgagttcatcactcttgctcacgtgaatccccagtccttcccaggaaacaaagagcatcataaagacaacaactacgtgagcatgtggttcctcgggattatttttcgtagagtggaaaacgccgaaagtgtgaacatcgaccttacctacgacatccagagcttcaccgatactgtttatcggcaggctaataacatcaatatgttgaaggagggcatgaaaatcgaagccacacatgtgaaaaaaaaacagcttcatcattacctacctgcagagatcctccagaagaagaagaaacagagcttaagtgatgtaaaccgcagttctgggggactccagagtaaaagattgtctctggatagctcttgtctggattccagcagggataccgacaacggcactccgtttaattctccagcctcaaaatctgacagcccaagcgtcggggaaaccgagcgaaatagtgccgaacccgcagccgtgatagtcgaaaaacctctgtccgtaccacccgctcaaggattgagcatccctgttataggagccaaggtcgattccacggtaaagacggtgtctcctccaaccgtttgtactattccgacagtcgtgggtcgcaacgtcattccccggattactacaccacataatccagcgcaaggacagccccaccttaatggcatgagcaacataacaaagacagttacaccaaaaaggagtcactccccttccatagatggcaccccgaagagactcaaggatgtggaaaaagatgccatcgggggcgagtctatgccaatacccacaatcgataccagtagaaagaagcgactgcctagcaaggagctcccggattcatcctcccctgttcctgctaacaatattagagtgataaagaacagtatccgtcttactcttaataggtag

SEQ ID NO: 20144 - DNA, 642 bp, Artificial Sequence
  Description of Artificial Sequence: Synthetic coding sequence
atggccgtgctgagcgcccccggcctgcggggcttccggatcctgggactacggtcttcagtcggtccagctgtacaggcaaggggagtgcaccagagcgtcgctaccgacggaccatctagtacccagcctgccctgcctaaagcccgggccgtggccccaaagcccagtagccggggagaatatgtcgtggccaaacttgacgatctagttaattgggcaagaagatcttcactgtggcccatgactttcggtctggcctgctgcgctgttgagatgatgcacatggccgccccaagatacgacatggacaggtttggcgtcgtattccgggcttcacctagacaaagcgatgtgatgatcgtagctggaaccctgacgaacaagatggcgcctgccctgcgcaaagtttatgaccaaatgcctgagccccgttatgtcgtctcaatggggtcatgtgctaatggtggggggtactaccactactcctacagtgtcgtccggggctgcgacaggatcgtacctgtggacatctacatccccggttgcccacccactgccgaagccctgctgtatggcatccttcagcttcagcgtaagatcaagcgggaaaggagattgcagatttggtaccggcggtag

SEQ ID NO: 20145 - DNA, 1035 bp, Artificial Sequence
  Description of Artificial Sequence: Synthetic coding sequence
atgcaccggaccacccggatcaagatcaccgagctgaacccccacctcatgtgcgctttatgcggagggtattttattgacgctacaaccattgtggagtgtctgcacagtttttgtaagacctgtattgtgagataccttgaaacaaataagtactgccctatgtgcgacgtgcaggtacacaagacccggccgcttctgagcataagaagtgacaagactctgcaagacatcgtgtacaaacttgtccctggattattcaaggacgaaatgaaaagacgaagagacttttatgccgcttacccccttacagaagtccctaatgggtctaacgaagataggggtgaggtcctggagcaggaaaaaggtgcactttccgatgatgagatcgtgtcacttagcattgagttctacgagggggcgcgggaccgcgacgagaaaaagggcccactcgaaaatggagacggtgacaaagagaaaacaggcgtgcgatttttgcgttgtccagcggcaatgactgtgatgcacctggcaaagtttctgagaaataagatggacgttccaagcaaatataaggtcgaggtgctctatgaagacgagcccctcaaagaatactacacattgatggacatcgcttacatctatccctggagaaggaacgggccacttcctttgaaataccgggtgcagcccgcatgcaagagactgacgctggctactgtgccaacacctagcgagggcacaaacactagtggcgcatctgaatgtgagtctgtctcggataaggctccttctcctgccacgctgcccgcgacaagctcctctctcccatcacctgctacaccctcccatggcagcccatcatcacacggtccgcccgccacccacccaacgtcgccaacccccccaagcactgcgtccggggctacgacagccgctaatggcggcagtctgaactgcctccagacccccagctcgacatctagaggacgcaaaatgaccgtgaatggcgcgcctgtgccacctctcacttag

SEQ ID NO: 20146 - DNA, 729 bp, Artificial Sequence
  Description of Artificial Sequence: Synthetic coding sequence
atgctgacccggaagatcaagctgtgggacatcaacgcccacatcacttgcaggttgtgttctgggtatttaattgacgctactacagtgaccgaatgcttgcatactttttgtcgtagctgcctcgtgaaatacctcgaggagaataacacatgccccacttgtaggattgttattcaccagagtcaccccttgcagtacataggacatgatagaacgatgcaggatatcgtgtacaagctcgttccaggacttcaggaggctgaaatgaggaagcaacgcgaattctatcacaaattaggcatggaggtccctggagatatcaagggcgaaacctgtagtgccaaacagcacttagactcccacagaaatggagaaacaaaagcagacgacagcagcaacaaagaagcggccgaggagaagcccgaagaggacaatgattaccacagatctgacgagcaggtttctatttgtctggagtgtaacagctccaagctgagaggcctgaaacggaaatggatcagatgctccgcccaggccaccgtcctccatctaaaaaaatttattgcgaagaagttaaatttatcttcttttaatgagctggacattctttgtaatgaagaaattctaggcaaggatcatacgctaaagtttgtggtggtcactcgctggcgcttcaagaaagcccccctgctgctccactatcggcctaaaatggaccttttatag

SEQ ID NO: 20147 - DNA, 123 bp, Artificial Sequence
  Description of Artificial Sequence: Synthetic coding sequence
atgctgacccggaagatcaagctgtgggacatcaacgcccacatcacttgtcgactatgctctggttacctgattgatgccacaacagtgactgagtgtttacacacattctgccgttcctag

SEQ ID NO: 20148 - DNA, 189 bp, Artificial Sequence
  Description of Artificial Sequence: Synthetic coding sequence
atgctgacccggaagatcaagctgtgggacatcaacgcccacatcacctgccggctgtgttctggctatcttatcgatgcaactacggtgacagagtgtttacatactttctgccgttcctgtctcgtgaaatacctggaggagaataatacctgccctacctgtcgcatcgttatacaccagtcatag

SEQ ID NO: 20149 - DNA, 330 bp, Artificial Sequence
  Description of Artificial Sequence: Synthetic coding sequence
atgctgacccggaagatcaagctgtgggacatcaacgcccacatcacctgtaggctctgttctggttaccttatcgacgccaccacagtgaccgaatgcttacataccttttgtaggtcctgcctcgttaaataccttgaggaaaacaacacctgcccaacatgtcggattgttatccatcagtctcaccccctccagtacatcggtcatgacaggacgatgcaggacattgtgtataagctagtgcccggattacaggaggctgagatgcgaaaacaacgcgaattttatcacaaactgggcatggaggtgcctggtgacataaaatag

SEQ ID NO: 20150 - DNA, 729 bp, Artificial Sequence
  Description of Artificial Sequence: Synthetic coding sequence
atgctgacccggaagatcaagctgtgggacatcaacgcccacatcacgtgcagactctgtagcggataccttatcgatgccacaacagtgaccgaatgtcttcacaccttctgccgaagctgtctcgttaaatatctggaagagaataatacctgtcccacatgtaggattgtaattcaccagagccaccctctccagtatatcgggcacgacagaaccatgcaggatatcgtttataaattagtccctggtctgcaagaagctgaaatgcggaagcagagagagttctatcacaaactgggaatggaggtccccggagatatcaagggggagacatgtagcgctaagcagcacctcgattctcaccgcaacggcgaaactaaggccgacgacagctccaataaagaagcagccgaggagaagcctgaagaagacaatgactatcaccgttcggacgagcaagtgtctatttgtctggaatgtaacagtagcaaacttaggggtctgaagagaaaatggattcgctgctccgcccaagcaacggtgctgcacctcaaaaagtttatcgccaaaaagctcaatctgtcctcgtttaatgagctggacatcctgtgcaacgaggaaatcttggggaaagaccacacgctaaaatttgtggtcgtaacaagatggcggtttaagaaggcacccctgcttctgcactaccgccccaagatggatctgttatag

SEQ ID NO: 20151 - DNA, 729 bp, Artificial Sequence
  Description of Artificial Sequence: Synthetic coding sequence
atgctgacccggaagatcaagctgtgggacatcaacgcccacatcacctgccggctgtgtagcggatacctgatagacgcaacaaccgtgacagaatgtcttcacacattctgtcggtcatgcctcgtgaagtatcttgaagagaataacacatgccctacctgtcggattgtgatccaccagtctcatcccctccaatacattggtcacgatcgtactatgcaggacatcgtttataaactggtaccaggactccaggaagccgaaatgaggaaacaacgcgaattctaccacaagctcggcatggaggtgcctggcgatatcaagggggagacctgtagcgcaaaacagcacttggattcacatcgcaatggcgagactaaagctgacgatagcagcaataaggaggccgctgaggaaaagcccgaggaggataatgactaccacaggagtgatgaacaggtgagcatttgccttgagtgtaatagtagcaaactgaggggcctgaagagaaagtggatacgatgtagtgcccaggctaccgtcctccaccttaaaaaattcatagccaaaaaattgaacctgtcaagctttaatgaactggacatcctttgtaacgaagaaatcctgggcaaagatcacacccttaagtttgtggtggtcaccaggtggaggttcaagaaggcccccctgctccttcactatagacctaagatggacctcctgtag

SEQ ID NO: 20152 - DNA, 627 bp, Artificial Sequence
  Description of Artificial Sequence: Synthetic coding sequence
atgaccgtgtgccggagctgcctggtgaagtacctggaggagaacaacacctgtccaacttgccgcatcgtaatccaccagtcacacccgctccagtacattggtcacgaccgtacaatgcaagacatcgtgtacaaactggtgccaggcctgcaggaggccgaaatgcgaaagcagagagagttctaccacaagctaggcatggaggtccctggcgacattaaaggagaaacgtgtagcgccaagcaacatctagattcccatagaaacggagagactaaggccgatgacagtagcaacaaggaggccgctgaggagaaacccgaagaagataatgactaccaccggtcagacgagcaagtgtccatttgtctcgagtgcaactcatcgaaattgcgtgggctaaagcgcaagtggatccgatgtagcgcgcaggctactgttctgcacctgaagaagttcattgccaaaaagctaaacctcagctctttcaatgaactggacatcttgtgcaacgaggagattctcgggaaggaccacactctgaagtttgtggtggttaccagatggcggtttaaaaaggctcccttgctgctgcactatcgccctaagatggatctgctgtag

SEQ ID NO: 20153 - DNA, 3015 bp, Artificial Sequence
  Description of Artificial Sequence: Synthetic coding sequence
atggagaccgagagcgagcagaacagcaacagcaccaacggcagctcttcatctggaggaagcagccgcccccagatcgcgcagatgtcgctctacgagcgccaggctgttcaggcgcttcaagctttgcagcgacaacctaacgctgcccagtatttccaccaatttatgctgcagcagcagcttagcaacgcccagctacacagcctggccgcggtgcagcaggcaactattgcggcaagcaggcaggcttccagccccaataccagtacgacccagcagcagacaacgacaacccaggcatccattaacctggccacaacctctgccgcgcagctgatatctagatctcagtctgtcagcagtccaagcgcaaccaccctcacccagtcagtacttctgggaaatacaacctccccacctctgaaccagagccaggcccaaatgtacctgaggcctcagcttggtaatctgcttcaggttaacagaactctcggtcgcaatgtcccgcttgcttctcagctaatactgatgcctaacggggccgtagccgctgtgcaacaggaagttccctcggctcagagcccaggcgtgcacgccgatgccgaccaggtgcagaacctcgccgttagaaatcagcaggcctcagcccagggtccgcagatgcaggggtccacccagaaggcaatcccgccaggagcctcaccagtttctagtctttctcaggcgtctagccaagccctggccgttgctcaggcctccagcggcgcaacaaatcagagcttgaacctgtcgcaggcaggaggcggatccggcaattccattcccgggtccatggggccagggggcggcggccaagcccacggcgggctgggccagctccctagctcaggaatgggcggggggtcatgcccaagaaaagggaccggtgtcgttcagccgctacccgccgcgcaaacggttaccgttagccaaggctctcagacagaagctgagtcagctgccgctaaaaaagcagaagctgatggcagcggccagcaaaacgtgggtatgaaccttacaagaacagcaactccagctcccagccagaccctgatctcaagcgccacttacacccagatccaaccccattcgttgatacagcagcagcaacagattcatctgcaacagaaacaggtcgtcatacagcagcagatcgctatacaccatcagcagcagtttcaacatagacagtcccagttactgcacactgcaacgcacctgcaattagcccaacagcagcagcaacagcaacagcaacagcaacagcagcagcagcctcaggccaccactctaactgccccccaacctcctcaggttcctcccacccagcaggttccacccagccagagccaacaacaggcccagacactggtggttcagcctatgctccaaagctctcctctgtccctgcctccagacgccgctccaaaacctcctatccctatacagtccaagcccccggtggcgccgatcaagccaccgcagctaggtgccgctaagatgagcgccgcacagcagccccccccccacatccctgtgcaggtcgtggggaccagacagccagggacagcacaggcacaggccctggggctagctcagctagccgccgcggtgcctacctcacggggaatgcctggaactgtgcagagtgggcaggcacacctcgcgagctctcctccatctagccaagctccaggagctcttcaggaatgtccacctacattagcccctggcatgactttggcccccgtacagggtaccgcacacgttgtaaaaggcggagctaccactagctctccagtagtggcccaagtacctgcggctttctacatgcaaagcgttcaccttcctggcaagcctcaaactctggcagttaaacgaaaagcagacagcgaggaggagcgtgacgacgtttcgactttaggatctatgctacctgcgaaagcttcaccagtcgcagagtctccaaaagtcatggatgagaaaagctctctgggagagaaggcagaatccgttgccaatgtcaatgccaataccccctcaagcgagctggtggcacttacacctgccccgagcgtacccccacccaccttagccatggtctctaggcagatgggcgactccaaaccgccacaggccattgttaagcctcagatcctgacccacatcatcgaaggatttgtgattcaagaaggcgcggagccttttcctgtcggttgctctcaactcctaaaggagtccgaaaaaccccttcaaaccgggctcccgactggcctcacagaaaatcagagcggaggcccgttgggtgtggactcgccgagcgccgagcttgacaagaaggcaaacctcctgaagtgcgagtattgtggcaagtatgcaccagccgagcagttccgcggatctaaacgtttctgttctatgacctgtgctaagcgctacaacgtttcttgctcacaccagttcagactcaaacggaaaaaaatgaaagagttccaggaggctaattatgccagagtcaggcggcgcggaccccggcgcagttcttccgacatcgcaagggccaaaatccaaggcaaatgtcaccggggccaggaagattcctctcgaggctccgataatagttcctatgacgaggcactcagtccaactagccccggcccattatcagtgcgggccggacatggcgagagagatctgggaaatcccaacactgctccgcccacgccagagctgcacggtataaatcctgtctttctgagctccaatccttcaagatggtctgtcgaagaagtttacgagtttatcgcctcgctgcaagggtgtcaagagatcgctgaggagtttagaagccaagagatcgatggccaggctttgctgctgctaaaggaggagcacctgatgagcgcgatgaacataaaacttgggcccgctctcaagatttgcgctaagataaatgtcttaaaagaaacatag

SEQ ID NO: 20154 - DNA, 1833 bp, Artificial Sequence
  Description of Artificial Sequence: Synthetic coding sequence
atgcagggcagcacccagaaggccatcccccccggcgccagccccgtgtcaagtctatctcaggctagcagccaagctctggcggtggcacaggcttcgagtggggctacaaaccagtcactgaatctgtcacaggctggcggaggcagtggcaactccattccaggatctatgggcccaggcgggggtgggcaggcccatggcggattggggcagctgcccagtagcgggatgggtggaggtagctgcccgaggaaagggacaggggtcgtccagccactccccgctgcccagaccgtgaccgtgagtcagggctcacagacagaggccgagagtgccgccgctaaaaaagctgaggctgatggcagcggccaacagaacgttgggatgaacctgactaggacggccacacctgcaccgtcccaaaccctgatcagcagcgctacgtacactcagatccagcctcacagtttgatacaacagcagcagcagattcacctgcaacagaaacaggtcgttatccagcagcagatcgctattcatcaccagcagcagtttcaacacaggcagtcacagctattgcacacggctactcatctccagctggctcagcaacagcagcaacagcagcagcagcagcagcaacagcagcagcctcaggccaccaccctcactgctccacaacctccccaggtcccgcctactcagcagggaaagcctcagactttggccgtcaagcgaaaagctgatagcgaggaggagcgcgacgacgtgtctacactagggtctatgctgccggccaaagcttctcccgtcgcggaatctccaaaggtgatggacgagaagtccagcctcggcgagaaggccgaatctgtggcaaatgtaaacgcaaataccccaagcagtgagctcgttgccctcacacctgcaccttcagtcccaccacctactctagcaatggtgtctaggcagatgggtgactccaagcccccccaagctatcgtcaaaccgcagatattgacacacatcatcgagggcttcgtgatccaagaaggggcagagccgttccccgtcggatgctcccagttgctgaaagaaagcgagaaaccactacagacaggcctgcctacaggcctgacggaaaatcagtcagggggacccctgggggtagacagcccttcggctgaactggataaaaaggctaacctgctcaagtgtgaatactgcggcaagtatgcccccgccgagcagttcagaggaagcaagaggttctgctccatgacctgtgctaaacgctataacgtgtcttgtagtcaccagttcaggctcaagcgtaagaagatgaaggagtttcaggaagctaactacgcgagggttagacggagaggaccacgacgtagctcctccgatatagctcgtgccaagatccaggggaagtgccacagaggacaggaggattcttcacgaggctctgataacagtagctacgatgaggctttgtctcctacatctcctggtcccctaagtgtcagagctgggcatggcgagagagacctaggaaatccaaacaccgcccctcccacccccgagctccatgggatcaatccagtgttcctctccagcaatccctctagatggagcgtggaggaggtgtatgaattcattgctagtctacagggatgtcaggagatcgccgaagagttccggtcacaagagattgacggccaggcactgctcctgctcaaggaagaacacctgatgtcagcgatgaatatcaaactgggtccggctcttaagatctgcgctaagatcaacgtcttaaaggaaacctag

SEQ ID NO: 20155 - DNA, 519 bp, Artificial Sequence
  Description of Artificial Sequence: Synthetic coding sequence
atggagaccgagagcgagcagaacagcaacagcaccaacggcagctctagctccggtggttcatctcggccacaaatcgctcagatgagtctctacgaacggcaggcagtccaagccttgcaggccctgcagcgtcagccaaacgcagctcagtactttcaccaattcatgctccagcagcagttgtcaaacgctcaacttcatagcctggccgcagttcagcaggccactatagctgcatccaggcaggcttccagccccaacacgagcacaactcaacagcagacaaccaccacccaggcttccattaatctggccactacgtcagccgcgcagctgatttctcgtagccagagcgtctcaagcccatcagcgacaactcttactcagtctgtcctactgggcaacacaacaagtccaccactcaaccaatctcaggctcaaatgtacctgagaccgcaattaggcaacctgctgcaggttaacagaaccctcggaagaaatgtaccacttgcctag

SEQ ID NO: 20156 - DNA, 3015 bp, Artificial Sequence
  Description of Artificial Sequence: Synthetic coding sequence
atggagaccgagagcgagcagaacagcaacagcaccaacggcagctcttcctcagggggatcaagccgcccccagattgctcagatgagcctgtatgaaaggcaagcagtgcaggctcttcaagccctgcagcggcaaccaaatgccgcacaatatttccatcagtttatgctgcagcagcagctctcaaacgcccagcttcattccctcgccgctgtgcagcaggccaccattgcggcaagcaggcaagctagctcacccaacacctcaacgacccagcaacagaccacaaccacccaggcctccataaatctggcaacgacttcagcagcacagctcattagcaggagccagtcagtgtcaagccctagcgccactaccctcacccagtctgtactacttggtaatactacctcaccccctctcaatcagagccaggcgcagatgtacctgagaccacagctaggaaacctgctccaggtcaaccgaactctgggccggaatgtgcctcttgcgagccagctgatcttaatgcccaacggggcggtcgccgctgtacagcaggaggtcccatcggctcagtcgcccggtgttcacgcagacgccgaccaagtgcaaaatctggcagtgcgcaatcagcaggctagcgcccagggaccccagatgcagggtagcacacagaaggcaatacctcctggcgctagtccggtatctagtctgtcacaggctagcagtcaggcactcgccgtggcccaagcctcatctggcgccacaaaccagtccctcaacctgtcccaggccggcgggggcagtggcaattcaatccccggaagcatgggccccggcggcggcggccaggcccacggagggcttggacagctgcccagtagcgggatgggtggcggatcatgcccccgcaagggaacgggtgtcgtgcaacccttgcctgccgcacaaaccgtaacagtgtcacaggggagtcagaccgaggcagagtctgccgctgccaagaaagccgaggccgatggctcaggccagcagaatgttggaatgaatctaacccgaacagcgaccccagcacccagccagaccctgatcagtagcgccacctatacccagatccagcctcacagcctcattcaacagcagcagcagatacaccttcagcagaagcaggtagtcatccaacagcagatcgccatccatcaccaacagcagttccagcaccgccagagccaattgttacacaccgccacccatttgcagttagcccagcagcagcagcagcagcagcagcagcagcaacagcaacagcagcctcaggctaccaccttgacagccccccagccacctcaggtgcctcctactcagcaggtgccccccagccagagtcagcagcaggcgcaaaccttagtggtccaacccatgctgcagtcttccccgttgagtctgccccccgatgctgcacccaaaccccccatccctattcagtcaaaacctccagtggcccccatcaaaccgccacagctgggggccgccaaaatgtccgctgctcagcagcccccccctcatattcccgtccaggtcgtggggacaagacagcctgggacagcacaggcacaggcgttaggattggctcaactggctgcagccgtaccaacatcaagaggcatgcctggaactgtgcaatctgggcaagcccacctagcttcaagccctcccagttcgcaggcaccaggtgccctccaagagtgcccccctactctagcgcctgggatgaccttggctccggtccaaggtacggcccacgtggttaaaggcggcgccacaacgtcttcacccgttgtggcccaggtccctgcagctttttatatgcagtccgtacatctccccggcaagccccaaacactggcggtgaaacggaaagccgactctgaagaagaacgggatgacgtgtccactctcgggtctatgctgcctgcgaaggctagtcccgtagcagagagcccaaaggtgatggacgagaagtcaagcctaggcgaaaaagccgaaagcgtcgcaaacgtgaatgccaatacaccgtctagcgagctggtcgccctgacacccgcgcccagcgtgcctcctcccaccctagctatggtttcccggcagatgggcgactccaaacctccccaggcgattgtaaagccccagatcctgactcacatcattgaggggtttgtgattcaagagggcgcagagcccttcccagtgggctgctcacaactgctcaaagaatcagaaaaaccacttcagacaggtctgcctacgggcctcacagaaaaccagagcggcgggcccctgggggttgatagcccctccgcggagctggataagaaagccaacctgctgaaatgtgagtattgtggaaagtatgctcctgctgagcagtttagggggtctaagagattctgttccatgacctgtgccaaaaggtacaacgttagttgctctcaccagtttcggctaaaacgcaagaagatgaaggagttccaagaagcaaattacgctagagtgaggcgtagaggtccgagacggtcctcctctgacattgcacgggcaaaaatccagggtaagtgtcatagaggtcaggaggattcctcaagaggcagtgataactctagctacgatgaggctctgagccctaccagtcccggccctttgtcggtacgcgccggacatggggaaagagatctcgggaaccccaacaccgcccctccaacaccagagctgcatgggataaatcccgtgttcctgagcagcaatcctagccgctggtccgtggaggaggtatatgagtttatagccagcctgcaaggctgccaggaaattgcggaagaatttagaagccaagagattgacggacaggcgcttctactgctgaaggaggaacacctgatgagtgccatgaacataaaactggggcccgccttgaagatctgtgcaaaaataaacgtgcttaaggagacatag

SEQ ID NO: 20157 - DNA, 3015 bp, Artificial Sequence
  Description of Artificial Sequence: Synthetic coding sequence
atggagaccgagagcgagcagaacagcaacagcaccaacggcagcagttccagtggcggtagcagtaggccgcagattgctcagatgtcactctatgagaggcaagccgtccaagctttgcaggctcttcagagacagcctaatgcggcccagtatttccaccagtttatgctgcagcagcagctgagcaacgctcagcttcattccctggccgcagtccagcaagctacaattgctgcttcccggcaggcctcgtcacctaacacatcaactactcagcagcagacaaccactacacaagcgagcatcaatttagccactacctctgcagcccagttaataagcaggtctcagtcggtctcctcaccctcagcaaccaccttgacacagagcgtgttattaggaaatacgactagcccacccttgaatcagtctcaggcgcagatgtatttgcgcccccaacttggtaatctgctccaggttaataggaccctgggccggaacgtccccctggcttctcagctgatattaatgccaaatggggctgtggcagccgtgcaacaagaagttcctagtgcccagtcccccggcgtccatgcagacgccgatcaagttcagaacctggctgtgcgcaatcagcaggccagtgctcagggaccccagatgcaaggctcgacccagaaagccatcccgccgggcgccagccccgtctcctctctgtcacaggcatcgtctcaggcattagctgtggcacaggcttccagcggggccacaaatcagtcccttaatctgtcacaggccgggggtggttccggcaattcaatacctggctctatgggccctggaggtggcggtcaggcacacggcggtctgggccagctgccctcctctggaatgggcggtgggtcctgtccccggaagggaactggcgtggtgcaacctctgcctgctgcacagaccgtcactgtcagtcaaggctcccagacagaggccgaaagcgctgcggctaagaaggcggaggccgatgggagtgggcagcagaatgttggcatgaacttaacccggaccgccactccggcgcccagtcaaacgctcatatccagcgctacttatactcaaatacagccgcattctctgatacaacagcagcagcaaattcatttgcagcagaaacaagtggtgatacaacagcagattgcgatccaccatcagcaacagttccaacataggcagagccagttgctgcatacggcgacccaccttcagctggcgcagcagcagcaacagcaacagcagcagcagcaacaacagcagcagcctcaggctacaaccctaaccgcaccccagccgccgcaggttccccctacccagcaagtgcccccaagccagtcccaacagcaggcccaaaccctcgtagtccagccaatgctgcagagttctccactgtcattacctccagacgcagcacccaagcccccaattcctatccagagcaaacctccggtcgctccaattaagcccccccaactgggggcggccaaaatgtctgccgcccaacagccaccccctcacattcccgtgcaggtggtgggaacgaggcagccagggaccgcacaagctcaggctcttgggctggcccaactggccgctgctgtcccaaccagcaggggtatgccggggacagttcagtccgggcaggcacacctggcatcctccccgccatcttcacaggccccaggagcactgcaagaatgccccccgactctcgctcctgggatgactctggcacctgttcagggcacggctcatgtggtcaaagggggcgcgaccacctccagccctgtggtcgcccaggtgcccgcggccttctacatgcagtccgtacacctgcccgggaagccccagacactggcggttaaacgcaaggcagattccgaagaagagagggatgacgtgagtaccctgggctccatgttgcccgctaaggcctcccccgtggccgaatccccgaaagtaatggatgaaaaatcttccctgggcgaaaaggccgagtcagttgccaatgttaacgccaataccccttccagcgaattggtggcactaactcctgctccaagcgtgccaccacctacattagcaatggtgagccggcagatgggagactccaaaccccctcaggccatcgttaaacctcagatcctgactcatatcatcgaagggtttgtcatacaggagggtgccgagccttttcccgtcggctgcagccagctcctaaaagagtctgaaaagccccttcaaactggactgcccaccggccttaccgaaaatcagtctggcggtcctctcggagtggactctcctagcgcagagctggacaaaaaggctaatctgctcaaatgcgaatactgcggcaaatatgcacctgccgagcagttccgcggctccaaaagattttgttccatgacatgcgccaagagatacaatgtcagctgtagccatcagtttcgtctcaagcgtaaaaagatgaaagaatttcaagaagcaaattacgccagagttaggcggcggggccctcgcagatcttccagcgacatcgcaagagcaaagatccaagggaaatgccacagaggccaagaggattccagtcgggggtctgacaactcgagctatgacgaggccctcagccctacatcccccggtcctctctccgttagggcgggccacggagaaagggacttggggaaccccaacaccgcaccacccaccccagagctccatgggataaaccctgtttttttgtccagcaaccctagcagatggagtgtcgaggaagtttacgagtttatcgccagcctgcagggctgccaagagatcgcagaagaattcaggtctcaggagatcgatggccaggcgttgctactgttaaaagaagagcatcttatgagcgctatgaacattaagctcgggcccgcacttaaaatctgcgcaaaaataaacgtgcttaaggagacttag

SEQ ID NO: 20158 - DNA, 2577 bp, Artificial Sequence
  Description of Artificial Sequence: Synthetic coding sequence
atggagaacgagctgcccgtgccccacaccagcagcagcgcctgcgcaacttcaagtacgtctggcgcatcttctagctccggatgcaataacagttcaagcggtggcagcggacggccgacggggccacagatttccgtctatagcggcattcccgataggcagactgtgcaggtgatccagcaggctcttcaccgacagccttctacagccgcccagtacttgcagcagatgtacgccgctcaacagcagcacctcatgttgcagacagccgccctgcaacaacaacacctgtccagtgctcagttgcaaagcctggccgccgtgcaacaggcgtcattggtgagtaataggcagggttctacctcaggaagtaacgtttctgcccaggctccggcccagagtagttccatcaaccttgccgccagccctgcagccgcccaattactaaacagggctcaaagtgttaattcagccgcagcctccggaatcgcccagcaagctgtcctgttgggaaacacatcctctccagccctgaccgcatctcaagctcaaatgtatctccgggctcaaatgttaatctttactcccaccgctactgttgctactgtccagcctgagctcggaactgggagtcccgctcgcccacccactccagcccaggtccaaaatttgaccttacgaacccaacagactccagctgcagcagctagcggtcctactccaacacaaccagtcttgccctccttggcccttaaaccaactcctggaggatcccaacccctccccactccagcccagagtcgtaacaccgctcaagcaagcccagccggggcgaaacccgggatcgcggatagcgtcatggaaccccacaagaagggggacggcaatagcagtgtgccaggctctatggaggggcgcgcgggactgtcacggactgtacctgccgtagctgcccatccactcatcgccccggcctacgcacagctccaaccacaccagctgcttccccagccttccagtaagcacctgcagccacaattcgtaatccaacaacagccccagcctcagcagcagcagcctcccccacagcaaagtagacccgtgcttcaggcagaaccccacccccagctcgcttccgtgagcccatccgtggcactgcagccgtcttccgaagcccacgcaatgccacttgggcctgtgacacctgcgctgcctttgcagtgtccaaccgccaatctgcacaaacccggcggttcccagcagtgtcacccccctaccccagacactggaccccagaatggccatcccgaaggcgtgcctcacacgccccagcgcaggtttcaacacacatcagcggtcatcctgcagctgcagccagcgtcaccgccccaacagtgcgtgccagacgattggaaagaggtggctcccggggagaaatcggtgccagaaacaagatctggccccagcccgcaccagcaagccatcgtcacagcaatgccaggagggcttccagtgcctaccagtcccaatatccagccatcaccagcccatgagacaggacaaggtatcgtgcatgccctgactgacttatcaagcccgggcatgacaagcgggaatggcaacagcgcttcttcaatcgcaggtaccgccccccagaacggtgagaataagcctccccaagccatcgtgaaaccgcagatccttacccatgtaatcgagggtttcgtcatccaggaaggagccgagccatttcctgtcggccggtcatctctcctcgtggggaatctgaaaaaaaagtatgcacaagggtttcttccagaaaagctccctcagcaagatcacaccactaccaccgactcagagatggaagagccatacctccaggaatccaaagaagagggtgctcccctcaaactcaaatgcgaattatgtggccgcgtggatttcgcctataagtttaaacgctccaagagattctgttccatggcttgtgccaaacgctacaatgtcggctgcacgaagagggttgggctgttccattctgatcgctccaagctccaaaaggcaggtgccgcaacacacaaccgcaggcgcgccagcaaggctagcctgcctccgttgaccaaagatactaaaaagcagcctactggaactgtgccactgtcagtcactgcggcgttgcagctgactcactcccaagaggattcaagtagatgctctgacaattcctcatatgaagaacccctgtcccccatcagcgcctcctcaagcacaagtagaaggaggcaaggacagcgggacctggagttgcctgatatgcatatgcgtgatctagtgggtatgggacatcattttctaccaagtgaacctaccaagtggaacgtcgaggacgtttatgagttcatccgatcacttcccggttgtcaggagattgcagaggaatttagagcccaggagattgacggacaagctttgctgctattgaaagaggatcatctgatgtctgcaatgaatatcaaattgggccccgctttaaaaatctacgcccgaatatctatgctgaaagattcgtag

SEQ ID NO: 20159 - DNA, 1305 bp, Artificial Sequence
  Description of Artificial Sequence: Synthetic coding sequence
tgcctgcggggcggctgcagcccccgggcccccgccgcccgggcccgacagccccgacccccaccagccctgcccccgaggccccgcgctcctgtgcctgcatccagaccgggtcggccacttcttacaccagcacgcccctgcggccggatgcgtcgcgggtcccctgggccccgtctcggcgggagcagaggcgaacggcggccagcgcgggcccgcgacccggcccgagtcggccctggtgagggccttcggcgacctgcaagacctggccccgcaggcccctggacggaaacaggccagggaatagtgcacgcactcacagacttgtctagccctgggatgacctcaggaaacggaaacagtgcttcgagcatcgccggcacagccccccagaatggcgagaacaagcccccccaagcaatagtgaagccccagattctgacacatgttatcgaaggatttgtgatacaggaaggagcagagctaagtagatgggacgctaggttactggttggtaacctgaaaaagaagtacgcacagggttttctcccagaaaagctgcctcagcaggatcatacaaccactaccgactctgaaatggaagagccttatttgcaggagtccaaagaagaaggtgcccctctgaaactcaagtgcgaactgtgcgggcgtgtcgattttgcctataagttcaaaaggtcaaagcggttctgctccatggcctgcgcaaaacgatataatgttgggtgtacaaagagggtgggcctgtttcacagtgaccgatctaaacttcagaaggcaggggctgctactcacaacagacggcggcctgctaagccagtctgccatcacctcccgcggattcctaggagctcccagcaggccctatgcccatttcgtttgttgctcctctgcctgacccattcccaggaagattctagcaggtgctccgataacagctcgtacgaagaacccctcagtcccatcagtgcaagttcctccacaagcgccggcgacaaagcaagcgggacctggagcagtcctacgtgcatatgcggcacatggtgggcatgggataccacaagctgccaggtaagccaccaggtgaacgtggaggacgtttacgaatttattagatcattgcccgggtgtcaggaaatagcagaggaatttcgagctcaagaaattgacggacaagctctactgctgctgaaagaggaccatctaatgtcggccatgaacattaaattggggccagctctcaagatttatgcccgtatttcgatgctgaaagattcttag

SEQ ID NO: 20160 - DNA, 954 bp, Artificial Sequence
  Description of Artificial Sequence: Synthetic coding sequence
atgaccagcggcaacggcaacagcgccagcagcatcgccggcaccgcgcctcagaacggcgagaacaagcctccacaggctatcgtgaagccccagatactgacacatgttatcgagggcttcgttattcaagagggtgcagagccattccccgtaggcagaagttccctgctcgttgggaacctgaagaagaaatacgctcaggggtttcttcccgagaaactgccacaacaggatcacacaaccaccacagattccgaaatggaagaaccctacttacaggagtctaaagaggagggggccccactgaagctcaagtgtgaactctgtggacgcgttgatttcgcttacaagttcaagagatcaaaacggttttgctcgatggcctgtgccaagagatacaacgtcgggtgtactaaaagagtgggattgtttcactccgacagaagcaagctgcaaaaggctggcgctgctacccacaatcgccggcgcgcatctaaggcctccctgcctcccctgaccaaggataccaaaaagcagcccactggaaccgttcctctgtctgttactgccgccctccagctaacacactcacaggaggattcctctagatgcagtgacaattccagttatgaagagccgctgtcacctatatccgcctcctcaagcacttctagacggcgacagggacaaagagatcttgagctgcctgacatgcacatgagggacttggtcggtatgggacatcactttctgcctagtgagcctacgaagtggaacgtggaggatgtttacgaatttatccgctcactgcccgggctgccaagttctttcccaaaggggcacgaaacgtcaatctattccttatcaaaacatctgaggcacagtcgttttccacagagtcctagcggctcgtgcttatggccggtgctgcggcccagacctcacttgtag

SEQ ID NO: 20161 - DNA, 972 bp, Artificial Sequence
  Description of Artificial Sequence: Synthetic coding sequence
atgaccagcggcaacggcaacagcgccagcagcatcgccggcaccgcccctcaaaacggtgagaacaaacctccccaggctatcgtaaagccccagatcctgacacacgtgatagagggcttcgtcattcaggagggggctgagccattccctgtgggtcgaagcagcctcctggtcggcaatctgaaaaagaaatatgctcagggatttctccctgagaagttgccacagcaggaccatactacgacaaccgatagcgagatggaggaaccctatttgcaggagtccaaagaggagggtgcaccgctgaaattgaaatgtgagttatgtgggagggtggattttgcgtataaatttaagcgtagcaaacggttctgctctatggcatgcgccaagagatataacgtgggctgtaccaaaagagtgggattgtttcacagcgaccgttcaaagctccagaaagctggggctgcaacccacaatcggcgaagggcttccaaggcctccctcccaccgttgacgaaggatacaaaaaaacaacccacaggaacagtgcctttgagtgtaaccgccgcactgcagctaacccattctcaggaggattccagcaggtgcagcgataactcttcctatgaagaacctcttagtccgatctctgcctcaagcagtacaagtcgccggaggcaaggacaacgcgacctagaattgcccgatatgcacatgcgcgacctggttgggatggggcatcatttcctgccctcagagcccactaaatggaacgtagaagacgtctatgagtttattcgctcactgcccggctgtcaagaaatcgccgaagagttcagagctcaagagatcgacggccaggcccttctgctgcttaaagaggatcacctcatgagcgccatgaatataaaacttggtcccgcgctcaagatctacgccagaatcagtatgctgaaagattcctag

SEQ ID NO: 20162 - DNA, 1395 bp, Artificial Sequence
  Description of Artificial Sequence: Synthetic coding sequence
atgcccctgggccccgtgacccccgccctgcccctgcagtgccccacagccaatctgcataagccaggaggcagtcagcagtgccacccaccaactcccgataccggaccccaaaatggtcaccccgagggagtgcctcacaccccacagagaagatttcagcataccagcgctgtcatcttacagctgcagcccgccagtcccgtgcctcaacaatgcgtgcccgacgactggaaagaagtggcgcccggcgaaaaatctgtcccagaaactcgatccggacccagcccacatcagcaggcgatcgttactgcaatgccaggcgggcttccagtgcccactagtcctaatatccaacccagccccgcgcatgagacagggcagggcatagtccacgcattgactgatctgtcctcccctggcatgacaagcgggaatggcaactccgcgtcttccattgctggtaccgcaccccagaacggggagaataaaccaccgcaggccatcgtcaagcctcagattctgacccatgtgatagaggggttcgttattcaggagggagcagagcccttcccagtcggaaggtcatccctgcttgtcggcaatctgaaaaagaagtacgcccaaggctttctgcccgagaagctgcctcagcaggatcacaccactacgacggacagtgagatggaagagccgtacctgcaagaatccaaagaggagggcgcaccactgaagctgaaatgcgaactatgcgggagggtcgatttcgcctataagtttaaacgctctaagcgtttctgttccatggcctgcgctaagcggtataatgtgggatgtacgaagagagtgggcctgttccattctgatcgctcaaaactgcagaaggctggggccgccacccataacaggcgcagagccagtaaggcgtctttacctcccctgaccaaggacacaaaaaagcagccaacaggcaccgtgcccctgtccgtcaccgccgccctgcagcttacccactcccaggaggacagtagtcgctgtagcgacaatagcagctatgaagaacctttgtctcccatatcggcgtcttccagcacaagccggcgaaggcagggccaacgagacctggagttacccgatatgcatatgcgcgacctggtgggtatggggcaccatttcctgccatctgagcctacgaaatggaatgtagaggatgtttacgagtttattaggtctctgcccggttgtcaggaaattgccgaagagttcagggcgcaggagatcgatggacaggcactgttactcttaaaagaagatcatctgatgtccgctatgaacattaagcttgggcctgccctgaaaatatacgctagaatctcaatgctcaaagactcctag

SEQ ID NO: 20163 - DNA, 2580 bp, Artificial Sequence
  Description of Artificial Sequence: Synthetic coding sequence
atggagaacgagctgcccgtgccccacaccagcagcagcgcctgcgctacaagttctacgtccggggcctcctcctcttcggggtgcaataacagtagctcaggtgggagcggacggcctactggtccccagatcagcgtctactcggggatacctgaccggcagactgtgcaggttatccaacaggccctgcaccggcagccctcaaccgctgcccagtatttgcaacagatgtacgctgcccagcaacaacacttaatgctacagacagcagctcttcaacagcagcacctgagcagcgcccagttgcagtcgcttgctgctgtgcagcaagcttctttggtgtctaacaggcaaggtagtacgagcggaagcaatgtgagtgcccaggcgcccgcgcaatcctcatcaatcaacctggctgcttcacccgccgccgcacagctcctcaatcgtgctcagagcgtgaacagcgccgctgctagtggaatcgcccagcaggcagtcctgctggggaatacctcaagtcccgccctgacagcgagccaagcccagatgtacttgagagcgcagatgctgatttttactccgaccgccacagtcgcgaccgtgcagccagagcttggaacgggcagccccgcgcggccccctactccagctcaggtccaaaacttgactctccgaacacagcagacaccagctgccgctgcctcaggcccaacaccgacgcaacctgtattaccctctttggcccttaaacctacgcctggaggctcccagccactaccgacccctgcacagtcacggaatacggcccaggcaagtccagccggcgctaagccaggaatcgctgatagtgtgatggagccacacaaaaagggtgatgggaactcatcagtgcctggctccatggagggccgggccggtctgagccgaacggtgcccgctgtcgctgcccatcctctcatcgcaccggcatatgcccagctacagcctcatcagctcctgccgcagcccagtagcaagcacctacagcctcaattcgttattcagcagcaaccccaaccacagcaacagcaaccaccaccccagcagtcccggcccgtgcttcaagcggagccccacccacaactggcctcagtctcgccctccgtggctttgcaaccatcaagcgaggcacacgccatgcccctcggacctgtgacccctgccctcccattgcagtgtcctacagctaaccttcacaagcctgggggaagccaacagtgtcatcccccaacgcccgatactggcccccagaatggacaccccgaaggcgttccccataccccccagcgccggtttcaacacacgtccgcggtgatcttgcagctccagccggcctctccagtgccacagcagtgtgtgccagacgactggaaggaggtcgcccccggcgagaaaagtgtgccagagacacgcagtggcccctctcctcatcagcaagccatcgtcaccgcgatgcccgggggcttgcccgtgccaacgagtcccaatatccagccttctcccgcccacgaaacaggccagggtattgtgcacgctctcacggacctatccagcccaggaatgactagtgggaacgggaacagcgcaagctccatagctggcacagccccgcagaacggcgaaaataaacccccacaggccatcgtgaagcctcagattctcacacacgtgattgagggtttcgtgatccaagagggcgccgagccttttcccgttggccgttccagccttttggtgggtaatctgaaaaaaaaatatgcgcagggcttcttgccagaaaagcttcctcagcaggatcatacaactacgacagactcggaaatggaggaaccatatctgcaggagagcaaggaggaaggcgctccacttaagctgaagtgtgaattgtgtgggcgggtggactttgcatataaattcaagaggagcaagcggttttgttcaatggcctgtgcgaagagatacaatgttgggtgtaccaagcgtgtcggtctctttcattctgaccgcagcaagctgcaaaaagcgggggccgccactcacaacagacgtagagcatccaaagctagtctcccccccctcactaaagacactaaaaagcagccaaccggaacagtacccctgtctgtgacagcggcattgcagctcacacatagccaggaagattcttcaaggtgtagtgataattctagctacgaggagccattgtctcctatctccgccagcagctcaacgtctcggcggaggcagggccagcgcgatcttgagcttccggacatgcacatgagagatctggtagggatgggccatcatttcctgcccagtgaaccgacaaaatggaatgtcgaagatgtgtacgaattcatccgcagcctccccggctgccaagaaatcgccgaagagttcagagctcaggaaatcgatggtcaggctcttctgctgctgaaagaggatcatctgatgagtgccatgaatataaaactgggacccgctttgaaaatttacgcacggatctccatgctgaaggactcatag

SEQ ID NO: 20164 - DNA, 2490 bp, Artificial Sequence
  Description of Artificial Sequence: Synthetic coding sequence
atggagaacgagctgcccgtgccccacaccagcagcagcgcctgcgccactagtagcaccagcggagcctcaagctccagtgggtgtaacaatagctcctccggtgggtctgggcgcccaacagggcctcaaatctccgtgtatagcggtatcccggatagacagactgtgcaggtaattcagcaggctctgcaccgacagcctagtacagccgctcagtaccttcagcagatgtacgcggcgcagcaacagcatctcatgctgcaaactgccgcgctgcagcagcagcacctctcaagcgcgcagctgcagagtcttgccgccgtgcagcaagcgtcgttggtgtccaatcgccagggatccaccagtggctcaaatgtgagcgcgcaggcccccgctcaatcttcttcaatcaatctagctgcatcccccgcggcagctcagttattgaatcgtgctcagagcgtcaactcggcggcagctagcggcatagctcaacaagcagtgttgttaggaaacacatcctcaccggccctaactgccagtcaggcccagatgtaccttcgggcccaaatggtccagaacttgaccctgcggacacagcagacacccgccgccgccgccagcgggcctaccccaacccagccagtgctaccttccctcgctctcaagccaactccggggggcagccagccgcttccgacaccagcccaatcccggaatactgcccaggcttccccagccggcgcaaagccaggtatcgccgacagcgttatggagccacacaaaaaaggggatgggaacagctccgtgcctggctcgatggaggggcgcgcagggctgtcgcgaaccgttccagccgtagccgcacacccgcttattgcccccgcttacgcacagctgcaaccgcatcagctgctccctcaaccaagctctaaacacttacagccccaattcgtcattcagcagcaaccccaaccccaacagcaacaacctccgccccaacagtcacggccagtgttgcaggccgaaccccatccgcagctcgcctcagtgagtccctcagtggcgctgcaaccttccagcgaggcacatgcgatgcccttaggacctgtcactccggccctgccattgcagtgcccaacagctaatctgcataaaccaggaggttcccagcagtgccatcctccaacgccagatactgggccccaaaatggccatcctgagggtgtgccgcacacgcctcagagacggtttcagcatacaagtgcagtcatcctccagctccagcctgcaagtcccccacagcaatgtgtgccggacgattggaaggaagtggctcccggagagaagtctgtgccggaaacaaggtctggtccctctccacatcaacaggcaatagtaacggccatgccaggcggattgccagttccgacgtcccctaatatccaacctagtccagcccacgagaccgggcagggtattgttcatgctctgacagatctcagctctcctggcatgacatcaggtaatggaaattctgcttcttcgatagccggaacggcacctcagaatggagaaaataagcccccgcaggcaattgtgaagcctcagatccttactcacgtcatcgaggggtttgtgatacaggagggggctgagccgttccccgtcggacgaagctcactcctcgtgggaaaccttaaaaagaaatatgcgcaaggtttcctgccggagaaactgccacagcaagatcacaccactacaacagatagcgagatggaagaaccctacctccaggagtcaaaggaggagggagcccccctgaagctgaaatgtgagctgtgcggtcgagtggactttgcttacaaatttaagcggtccaaacggttttgttcaatggcttgtgcgaagcgctataacgtgggatgtacgaagcgcgtaggcctgttccattcagatcggagcaaattgcaaaaagccggcgcggctacacacaaccggaggcgggcatccaaggccagtcttcctcccctgacgaaagatactaaaaaacagcctaccgggacggtgcctctgtccgtcacggccgctcttcagctgacccattctcaagaagattcttcccgttgctccgacaatagtagttatgaagagcctctctctccaatttcagcctcttcttctaccagtcgccggcgccaaggccagcgcgatttagagctccccgatatgcacatgagggatctagtcggcatgggccatcattttctgccgagcgagcccacgaaatggaacgttgaggatgtgtacgagttcattagatccttacctgggtgtcaggagattgctgaagaattccgggcccaggagatcgacgggcaagccttgttacttctgaaggaggaccatctgatgtccgcaatgaacatcaagctgggcccggcactgaaaatttacgcgcggatttcaatgctcaaagatagttag

SEQ ID NO: 20165 - DNA, 561 bp, Artificial Sequence
  Description of Artificial Sequence: Synthetic coding sequence
atggacaccgagcccaaccccggcaccagcagcgtgagcaccaccacatctagcactacgacgactaccattacaacttcttccagccgtatgcaacagccccagatcagtgtctacagtggcagcgatcgtcacgccgtgcaagcccttcaccgaccccccagttccgctgcacagtatctgcagcagatgtacgccgcccagcagcaacacctgatgctccacaccgctgccctccagcaacagcaccttagcagtagtcagctgcagagcctggcagccgtccaggctagcctgtcttccggacggccctcaacatcgcccaccgggtcagtgacacagcagagctccatgagccagacctcaattaatcttagcacatcgccaacacctgctcagctgattagtcggtctcaggcaagcagctccacttcaggcagcatcacccagcagacaatgttactgggtagcaccagcccaactcttactgcttcccaggcacaaatgtatctgcgggcacagatggtgcggtacgaattacccaatttttttagcgtgtag

SEQ ID NO: 20166 - DNA, 744 bp, Artificial Sequence
  Description of Artificial Sequence: Synthetic coding sequence
atggccgaggccgagttcaaggaccacagcaccgccatggacaccgaacccaacccaggcacttctagtgtgtcgaccaccacgtcaagtaccaccacgaccaccattaccactagcagttccaggatgcagcagccacagatcagcgtgtacagtggaagtgataggcatgccgtgcaggtgattcagcaggccctgcaccgacccccttctagcgctgcccagtacctgcagcaaatgtacgccgcccagcagcagcatcttatgttgcacacagctgccttacagcaacagcacttatcaagttcgcagctgcagagcctagctgccgtgcaagcctccctgagcagcggtagaccatccaccagccctactggttcagtaactcagcagagtagcatgtctcagaccagcattaacctctcaacttcccctacccctgcacagctgattagccggtcccaagcctctagctccacatcaggttcaatcactcaacagactatgttgctcggaagtacgagtcctaccttaaccgcttcccaggcgcagatgtatttgagagcccaaatgctgatcttcactcccgcgactactgtggcagcagtacaatcagatatcccggtggtgagcagctcatcctcatctagctgtcagagcgcggccacgcaagttcagaatctgacgcttcgcagtcagaaactgggggtgttgagctccagtcagaacggcccgcctaagtag

SEQ ID NO: 20167 - DNA, 444 bp, Artificial Sequence
  Description of Artificial Sequence: Synthetic coding sequence
atggccgaggccgagttcaaggaccacagcaccgccatggacaccgagccaaatcccggcactagcagtgtgtctaccacaaccagtagcacaactactaccacaatcaccacatcatctagcagaatgcaacaaccccagatctccgtgtacagtggttccgataggcatgctgtacaggcccttcatcggccccccagttccgctgctcagtatctgcagcagatgtacgctgcccagcagcagcacctcatgttacacacagctgctcttcagcaacagcacctgagctcatcacaattgcagtccctggccgctgtacaggccagcctgagctcagggcggccaagtacaagccctactggatccgtgacccagcagtcttctatgtcacagaccagcgttagcagcctaaatttcttcttcctggacttaaaattctag

SEQ ID NO: 20168 - DNA, 486 bp, Artificial Sequence
  Description of Artificial Sequence: Synthetic coding sequence
tgacggtggaaccggaagcccgacaaccagagcctgggccaccggggccgccgaccaagcggaccagacggggctgcgcgcgaacacatactgcggcagttgcctatcacgtacccatccgcagaagaagacctcgcttctcacgaggacagtgtcccttccgccatgacaacacggcttcggaggcaatctgagagggagcgggagagagaactgagagatgtcagaatccgaaagatgcctgagaatagcgacctgttacctgtcgcccagacagaaccgtctatctggactgttgatgatgtgtgggccttcatccacagcctgcccggatgccaggacatcgctgacgagtttagagctcaggaaattgacgggcaggctcttcttcttctgaaagaggatcacctgatgtctgccatgaacatcaagttgggtccagctctgaaaatatgtgcgcgcatcaacagtttgaaagaatcatag

SEQ ID NO: 20169 - DNA, 2952 bp, Artificial Sequence
  Description of Artificial Sequence: Synthetic coding sequence
atggacaccgagcccaaccccggcaccagcagcgtgagcaccaccacgtcctctaccactactaccacaatcacgacctcttcaagccggatgcaacaaccccaaatcagtgtctattctggcagcgatcggcacgccgtgcaggtcatccagcaggccttgcatagaccgccgtcatcggctgcacagtacttacagcagatgtatgcggcacagcagcagcatctgatgctccacaccgccgccctgcagcagcagcatctgagcagctcacagctgcagtcccttgccgcggtacaagcaagcctgagctccggacgaccttctacttcacccactggcagcgtaacccagcagtctagtatgtctcagacaagcattaatttgtcaacctctccgactccggctcaactcattagtcgcagtcaagcctccagttccacctcaggcagtattacacagcagactatgctcttgggctcaacctcccctacgctcaccgcaagccaagcacaaatgtatttgagagctcaaatgctgatttttacgcctgcaactaccgtggcggctgtgcagagcgatattccagttgtgtcgagctcctcgtccagtagttgccagtcggcagcaacccaggtgcagaatttgaccctaagatcgcaaaagctaggagtgctgtcttcctcacagaatggtcctcccaaatccactagtcaaactcagtctctgactatttgtcacaacaaaacaacggttacttcgagcaagatatctcagcgggacccaagccccgaatctaacaaaaaaggtgaatccccgagcttggagtcaagatccacggcagtcaccagaaccagctctatccaccaactgatcgcccctgcatcctattctcccatccaaccccactcccttattaaacatcagcaaatccctcttcacagtccccctagtaaagtgagtcaccaccaactcattctgcaacagcagcaacagcaaattcagcctattacgctacagaattctacccaagatccacctccatcccagcactgcattcctctgcagaaccacggactgcccccagccccctctaacgcacagtcacagcactgctcccccatccagtcccatccttcccccctcaccgtttctccaaaccagagccagagtgcccaacaaagtgttgtggtctctcctcccccaccacactcaccatcacagtcacctacaatcatcattcacccacaggcgcttatccaaccacatccattagtgtcttccgccctccaaccaggaccaaatctgcagcagagcactgcaaaccaggtacaggccaccgcgcagctaaacctccccagccatctcccactgccagcatcacctgtggttcatatagggcccgtccaacaatccgcgctggtgagcccaggccaacagatagtctctcctagccaccagcaatatagcagcttgcagtccagtcctattcctatagcaagtccacctcagatgtcgacttcgccccctgcccaaatcccccctcttccactccagtctatgcagagtctgcaagtgcaacctgaaattctcagccagggtcaggtgttggtacagaatgccctcgtttctgaggaggaattgccagccgccgaggcattggttcaactgcctttccagaccctccctccccctcaaacagttgcggtgaatcttcaagtgcaacctcctgctccggtggacccaccagttgtgtaccaggttgaagacgtttgcgaggaagaaatgcccgaggagagcgacgaatgcgtgcgaatggaccggacacccccaccgcctactctcagccctgccgcgattaccgtgggtcgtggcgaggatttgactagtgagcaccctcttctagagcaggtggagctgccagcagtggcttctgtgtccgccagcgtgattaagagtcccagtgacccaagtcacgttagcgtcccaccaccccctctcctgctccccgctgccacaactcggagcaactctacaagcatgcatagttctatccccagcatcgagaacaagcctccgcaagctatcgtgaagccccaaattctcacccacgtgatcgagggtttcgttatccaggagggtctggagccctttccagtaagccggtctagcctgctgatagaacagccagttaaaaaacgacccctactcgacaatcaggtgattaatagtgtatgcgtccaacctgagctacagaacaataccaaacacgcagacaactcgtcagataccgaaatggaagacatgatcgccgaggaaaccctggaagaaatggatagcgagctgctgaagtgcgaattttgcggaaaaatggggtacgcaaatgagttcctgcgcagcaagcgcttctgtacaatgtcatgcgctaaacgctacaacgtttcctgttcgaaaaagttcgctctctcaagatggaaccggaagcctgacaatcagtccctgggccacaggggccgacgtcccagcggcccagacggtgcggcccgggaacacatcttgaggcagttacccatcacgtacccgagcgcagaggaagacctggcttcacatgaagattccgtcccctccgctatgaccacccgactccgccggcaaagtgaacgtgagagagaaagagagctgcgggacgttaggatccgaaagatgccagaaaattcagacctcctgcccgtcgcccagactgagcccagcatctggacagttgacgacgtgtgggcctttatccactccctgcctggttgtcaggacattgccgacgaattccgggctcaagaaattgacggccaggccttactgttgcttaaagaggaccacttgatgtctgcgatgaatatcaagctgggacccgccctaaaaatttgcgcaagaattaactctctgaaagagagctag

SEQ ID NO: 20170 - DNA, 2988 bp, Artificial Sequence
  Description of Artificial Sequence: Synthetic coding sequence
atggccgaggccgagttcaaggaccacagcaccgccatggacaccgagcccaatcctgggacctcgagtgtttctaccaccacgtcatcaacaacaacaaccacaatcaccacgtcctcaagtcgcatgcagcagcctcagatctcagtttattctggatcagaccggcacgccgtgcaagtgatacaacaggcgttgcaccgcccgcctagttctgccgcccagtatctacaacaaatgtacgcagcccagcagcagcatttgatgctgcacacggccgcactgcagcagcagcacttgtccagcagtcagctccagtccttggctgcagtccaagcctccctttcaagcggaagaccatccacctccccaacaggctctgtgacccagcagagctccatgtcccaaaccagtatcaacctgtccacaagtcctacacccgcccagttgattagtcgcagtcaagcatctagttcaaccagcggaagtattacccagcaaacgatgctgttaggcagcacctcccctacgctgacagcatcacaggcccagatgtacctgcgggcacagatgctgattttcacaccagcaaccactgtggctgccgtgcagagcgatattcccgtggtcagtagctccagttctagctcatgccagtctgctgccacacaagtgcagaatctcactctccggagccagaaattgggcgtgctcagttcatcccagaacggcccacctaagagcactagccagacgcaatctttaaccatctgtcacaacaaaacaaccgttacaagtagtaagatctcacagagggatccatcaccagagagcaacaaaaaaggggagtcaccgtccctcgaatcacggtcaaccgctgtgaccaggactagctccattcatcagctgatcgcacccgcttcatattcacctatacagccccactcactgatcaaacaccagcagatccctctgcatagccccccgagtaaggtcagccaccaccaactgattctccagcagcagcaacaacagattcagcctataaccctgcagaactccacccaagaccctcctccttctcagcactgcatccctttacagaatcacgggctcccccctgctcctagcaacgcgcagtcccaacactgctctccgatccagtcccacccgtctcctttgactgtctctcctaatcagagccagagcgcccagcagtctgtagtcgtctcaccacctccacctcactcgccatcacagtcacctaccattatcatccacccacaagccctgattcagcctcatccactggtgagtagcgcactgcagcccggacccaaccttcagcagtccacagccaatcaagtgcaggcaaccgctcagctcaacctaccatcacacctccctttgccagccagtcccgttgtacacattgggcccgttcagcaatccgccctggtgtcgccgggccagcagatcgtgagtccaagccaccagcagtactcaagcctccagtcaagtcctatacccatcgcctcccccccacaaatgagtacctcgcccccagcccagattccccctctccctttacagtctatgcagtcacttcaggtgcagcccgaaatcctgagccaaggacaggtgctggttcagaacgctctcgtgagcgaagaagaactacctgcagctgaagccctggttcagctgcccttccagactctgcccccaccccagaccgtggcagtgaacctgcaagtccaaccaccagcacctgtcgacccgccagtggtctatcaggtggaggacgtatgtgaggaggagatgccagaagagtctgatgaatgtgtaagaatggacaggacaccgcctcccccaactctgagcccggccgctatcaccgtcggaagaggggaagatctgacgagtgaacatcccctgctggagcaggtcgaactccctgccgtggcaagcgtatccgccagcgttattaagagcccatcggacccatcgcatgtgagcgtgcctccaccaccattgctgttgccagccgctacaaccaggtcaaatagtacctcgatgcactcgtctattccttcgattgagaacaagccgcctcaagccatcgtgaaaccacagatcctcacacacgtgattgagggttttgtgattcaagagggtttagaaccatttcctgtgtcccggtcctccctcctgatcgaacagcctgtcaagaagaggcctttgttagataatcaagtgatcaatagcgtgtgcgtgcaacccgagctacagaataatactaaacatgccgataactcatccgatacagagatggaagacatgatcgctgaggagaccctcgaagagatggattcagagctgctgaagtgtgaattttgcggcaagatgggttatgctaacgagttcctccgcagtaagcggttctgcaccatgtcctgcgccaaacggtataatgtctcttgctcaaagaaatttgccctctctcggtggaatcgcaagcctgacaaccagagcttaggccacagaggccgaagacccagtggccctgacggagcagcaagagagcatatccttcgccagcttccgattacttacccttcagctgaagaagacctggcctcacacgaagattctgtcccaagcgcgatgaccacccggttgcgtagacagtcagagcgtgaaagggaaagggagctgcgtgatgtgcgcattcgtaagatgccagagaactccgacctcctgccagtggcccagacagaaccttcaatctggacagtcgatgacgtctgggcttttattcacagtctgcctgggtgccaggacattgcagacgaattccgggcgcaagaaatagatggccaggcattactgttactgaaagaagatcacctgatgtccgccatgaacataaagcttggccccgctcttaagatctgtgctcgtattaattccttgaaggagtcctag

SEQ ID NO: 20171 - DNA, 456 bp, Artificial Sequence
  Description of Artificial Sequence: Synthetic coding sequence
atggccgaggccgagttcaaggaccacagcaccgccatggacaccgagccaaaccccggcacgtcgtccgtttctacaaccacaagctcgacaacaacaacaacgataaccacatccagcagtcgcatgcagcagccacagatctcggtgtactcgggcagcgatcgccatgcggtacaggtgattcaacaggcacttcataggcctccctccagtgccgcgcaatacttacaacaaatgtacgctgcccagcagcaacaccttatgttacataccgcagccctccaacaacagcatttgtccagtagccagctccagagcctagcagcagtccaggcttctctgtcaagcggcaggccttccacctctcccaccggctccgttacacagcagtcgtccatgagccagacgtcagtttctagcctgaatttcttttttctcgatctgaagttttag

SEQ ID NO: 20172 - DNA, 1797 bp, Artificial Sequence
  Description of Artificial Sequence: Synthetic coding sequence
atgagcgccagcgcccagcagctggccgaggagctgcagatcttcggccttgactgcgaggaggccctgatcgagaaactggtggaactgtgcgtgcagtacggccagaatgaggaaggtatggttggcgagcttatcgcattttgcacatcaacacataaggtgggcttgacgtcagaaattctgaacagcttcgaacatgaattccttagcaagagattatctaaagctaggcactccacttgtaaagactctggccacgccggcgcaagagacattgtcagcattcaggagctcatcgaggttgaagaagaggaggagatcctcctgaacagttacaccactccttctaagggatctcagaagcgggccatctccacgcccgagactccacttaccaaacggagcgtttccacgcggagtccccaccagctactatctcctagctcctttagccctagcgcaacacctagtcaaaaatataacagccgttcaaacagaggagaagtggtcacgagtttcggcctcgcgcaaggggtttcgtggagcggccgcggcggcgccggcaatatttcactaaaagtgctgggttgcccagaggctctgacgggctcatataagtcaatgtttcagaagctccctgatatacgcgaagtcttaacctgtaagatcgaggagctagggagcgaactcaaagaacactataagattgaggcttttacccctttgttggcaccggcacaggaacctgtgacactccttggccagattgggtgtgacagtaacgggaagctcaacaacaagtcagtgatcctcgaaggggatcgtgaacactccagcggagctcagatcccagtcgacttgagtgaattgaaagaatatagcttatttcctggtcaagtggtaatcatggaaggtattaacaccaccggccgaaagctggtggcgaccaaactatatgagggcgtgcctttgcctttctaccagcccactgaagaagacgccgatttcgaacaatccatggttttggtggcatgtggaccatatacaacatcagacagcataacttacgatcccctgctggatctgatcgccgtgattaatcacgaccggccagacgtgtgcatcctgtttggtcccttcctcgacgctaagcatgagcaggtggagaattgcctgttgaccagcccctttgaagatattttcaagcaatgtctgcggacgattattgaaggcacccgatcctctggatcccatctcgtttttgttcctagcttaagagatgttcatcacgagcctgtgtatcctcaaccaccatttagctactcagacctgtctagagaagataaaaaacaggtccagttcgtgtcggaaccctgcagtctgagtattaacggagttatctttggcttgacaagtactgaccttttgttccacctcggcgccgaagagatttccagctcctctggcaccagcgatcgattcagccgcatcctgaaacatatactgactcagaggtcttactacccattgtaccctccacaggaggacatggcaatcgattatgaaagtttctatgtgtatgcccagctgcctgttacccccgacgttcttattattccttcagagctgcggtatttcgtaaaggatgtcctgggctgtgtgtgcgtcaatcccgggcggctgaccaagggccaagtcggggggactttcgctagactctacctcagacggcctgctgccgacggggcggagcgacagagcccttgcatcgctgtgcaagtagtgcggatctag

SEQ ID NO: 20173 - DNA, 1086 bp, Artificial Sequence
  Description of Artificial Sequence: Synthetic coding sequence
atgttccagaagctgcccgacatccgggaggtgctgacctgcaagatcgaggaattgggatccgaattgaaagagcactataaaattgaggctttcacgccattattggcaccagcccaggaacccgtcactttgctcggccagatcgggtgtgattcgaacggtaaactcaacaacaagtccgtgatactcgagggcgatagggaacattcgagcggagcgcaaattcccgttgatttgagcgagctcaaagagtactcattatttcctggtcaggtcgtcatcatggagggcatcaacacaaccgggcgaaagctcgttgctactaaactttacgagggcgtgccgttgcccttttaccagcctaccgaggaagatgcagattttgagcagagcatggtgcttgtcgcttgcgggccttacactacctctgattctattacatatgatcccctgctcgacctcattgccgtgataaatcatgataggccagatgtatgtatactctttggccccttcctcgatgccaaacacgagcaagtcgaaaattgcctgttgacaagcccttttgaggacatcttcaagcagtgcctccgcactataattgaagggaccaggtccagtggcagccatttggtcttcgtgccatcactacgtgacgtgcaccacgagcctgtgtaccctcagccgccgttttcgtatagtgacctgagccgtgaagacaagaaacaggtgcagtttgtctctgagccctgctccctgagcattaacggagtgatatttggcctgacaagcacagaccttttgttccacctgggcgcggaggaaattagcagcagcagcggcacttctgacaggttctctaggatcctgaaacacatcctcacccaaaggagctattatccactttatccccctcaagaggatatggccatcgactacgagagcttttacgtatatgcccagctgcccgttacccctgacgtgcttataattccctcggagctgagatactttgttaaagtcggccttaactcagcattttcacagaagcatcaaaatcccgtgttcgattttcccttttag

SEQ ID NO: 20174 - DNA, 1485 bp, Artificial Sequence
  Description of Artificial Sequence: Synthetic coding sequence
atgctgcccaagcggcggcgggcccgggtgggcagccccagcggcgacgcggcttctagcacgccgcctagtaccaggttccccggcgtcgctatctatttagtcgagccgcgaatgggaaggtctcgcagagcttttctgacaggtctcgcacgttctaaggggtttcgagttctggatgcttgctcttccgaagcaacacacgttgtgatggaagagacctcggccgaagaggccgtttcatggcaagagcgcaggatggctgccgcccctcccggttgtacaccacccgctctcttggatatctcctggttgactgagagtctaggcgcaggacaaccggtccccgtggagtgtcgccatcgcctggaggtggcagggccccggaagggtcctctcagccccgcatggatgccagcgtacgcctgccagcgtcccactccattgacacaccacaataccggtttaagcgaggccttggagatcctggcagaggcagctggatttgaaggtagcgaagggcggttgcttactttttgtagagccgcatccgtcttgaaggccctgcccagccccgttacgacactgagccaactgcaagggttaccccattttggcgagcactcctctcgggtggtccaggaattgctcgaacacggtgtgtgcgaagaggtagaacgggtcagacgctctgaacggtatcagacgatgaagctgttcacccagatttttggcgtgggcgtcaagactgccgatcggtggtatcgggaggggcttcgcacactggacgacttgcgcgagcaacctcagaaacttacccaacaacaaaaggcaggcctgcagcaccaccaggatttatctacacccgtgcttaggtcagacgtggacgccctccaacaggtggttgaggaagccgttggacaagctcttcctggggcgaccgtcacactgaccgggggattcaggagggggaaacttcaggggcatgatgtcgacttcctgatcactcaccccaaagaggggcaggaggcaggtctcctgccacgggtcatgtgtaggctacaggatcaaggacttattttatatcatcagcaccagcatagctgctgcgagagtcccactagactggcacaacagtcccatatggacgcttttgagcgttctttctgcatattccggctgcctcagcctcccggtgcagcagtgggagggagcacccggccctgtcctagctggaaagccgtgagagtggatctggtagtggcacccgtctctcaattccccttcgccctcctcgggtggacgggctccaaattgtttcagagagaattacgccgatttagccgaaaggaaaagggactatggctgaactcccacgggctgttcgatcccgaacagaaaacttttttccaggctgcttctgaagaggatatctttcgacatctggggctcgaatacctgcccccagagcagaggaatgcttag

SEQ ID NO: 20175 - DNA, 1374 bp, Artificial Sequence
  Description of Artificial Sequence: Synthetic coding sequence
atgctgcccaagcggcggcgggcccgggtgggcagccccagcggcgacgcggcatctagcaccccaccatctaccagatttccgggggttgccatatatctggtggaacctcgaatgggacggagccgtcgcgcattcctgaccggactggccagaagcaagggctttagggtgcttgatgcatgctcctcagaagctactcatgtcgtcatggaggaaaccagcgctgaggaagcagtctcctggcaggaacgtcggatggctgctgccccgcccggttgcacccctccagctttgcttgacattagttggttgacagagtccctgggagccgggcagcctgtgcccgtggagtgtaggcacagactcgaggttgctggcccccggaagggacctctctcaccagcttggatgccagcctacgcgtgtcagcggcccaccccgctgacgcatcacaataccgggttaagtgaagctctggagattctggcggaagccgcaggtttcgaaggaagtgaaggaagactcctgaccttctgtcgtgccgcaagcgtgctgaaggccttaccctcccctgtgactaccctgtcccaactgcaggggctgccccacttcggcgaacattcctccagggttgtacaagaactgctggagcatggagtgtgcgaggaagtcgagagggtacgccggtccgagaggtatcagaccatgaagctgttcactcaaatctttggcgtgggagtgaaaacagcggaccgctggtatcgagaaggactccgcactctggatgacctcagagagcaaccacaaaaactgacacagcaacagaaagctgcccctcccggccctgaacacccatctcccgctgtgagatgccgctgtcctgcagcgggcgggggtggctcctgcggagcgggccccgcatggggtcatcgacatgctgataggaggttgcctcaaggcctgattctgtaccatcagcaccaacacagttgttgcgagtctcccactcgactggcccagcaatcacatatggatgctttcgagagatcattttgtatttttagactgccacagccacctggcgcagccgtgggtggtagcacacgtccatgtccatcctggaaagccgtaagagtggacttagtggtcgcccccgtttctcagtttccatttgctcttctcggctggaccggatcaaagcttttccaaagggagctgcgccgattcagccgaaaggagaagggcttgtggctgaatagccatggcctgtttgatccagagcagaaaaccttcttccaggctgcgagcgaggaggatatttttcgacatttggggcttgaatacctgcctcccgagcagaggaatgcctag

SEQ ID NO: 20176 - DNA, 1527 bp, Artificial Sequence
  Description of Artificial Sequence: Synthetic coding sequence
atgctgcccaagcggcggcgggcccgggtgggcagccccagcggcgacgcggcttcgtccactccgccttcaacacgcttcccaggagtggctatttacctggtggaacctaggatgggaagaagccggcgggcctttttgactggcctggctcggagcaaaggctttcgtgttctggacgcgtgttcctctgaggccacccacgttgtcatggaagagacctccgccgaggaggcagtgtcatggcaagagcggaggatggctgccgctccccccgggtgcacccccccagccctgctggatatcagctggcttacagagagcttgggcgctggccagcccgttccagtcgaatgtcgacaccgcctggaagtggcagggccaagaaaggggcccctgtctcccgcctggatgcccgcctatgcctgccagagacccacccccctcacccatcacaatactgggctctccgaagcattggagatcctggccgaggcagctgggtttgaagggtctgaaggtcggctcctgaccttttgtcgtgcagccagtgtcctgaaggcgcttcccagccccgttactaccctaagccagctccaggggctgccacacttcggggagcacagctctcgggtcgtgcaggaattactggaacatggggtctgcgaggaagtcgagcgggtgaggagatcagaacgggcccctgcaccccctgggcctgagcacccaagccctgcagtgaggtgtcggtgccctgctgctggcggcgggggctcctgtggagccggccctgcttgggggcatagacacgccgatcggcgtttgccccaaggcctaatcctgtatcaccagcatcaacacagctgttgtgagtcacccacaagactggctcaacagtctcacatggatgcctttgagcgctccttttgcatttttcgactgccgcaacctccaggcgctgccgtcggcgggagcactaggccttgtccctcctggaaggccgtgagggtggatctggtcgtggcccccgtgtcccagttcccctttgcgctgctaggttggactggatcaaaactgttccaacgtgagctgcggagattttccaggaaggagaagggcctgtggcttaactcacacggcctgtttgatcccgagcaagggtcatctagtggaaaaacaccacggtccaggaaaagttgtttctgctgcagacgacatttcagtaagcgtctgcaacggaagacatcctctgacacttgggccttgagcacattcctgcagagccgggagacaccagaacccgcctgcgttccacatttccattctggaaactgggcagccccgaatttggctactgaatgtctgcaagccgatatgcttccacccgacccgcacctccacccttcgccacctcgccctgggtcctcaggaggacagctgtgtctccaggaccagctcagtccctgctggtgcgcagccggttgtgacgaagtcggcgccctctccgcctccctgatcaccgtctag

SEQ ID NO: 20177 - DNA, 480 bp, Artificial Sequence
  Description of Artificial Sequence: Synthetic coding sequence
atgctgcccaagcggcggcgggcccgggtgggcagccccagcggcgacgccgcctcttctaccccaccttctacccgctttcctggcgtggcaatctacttggtggaaccaaggatggggcgtagcagacgggcgtttctgaccggcttggcaaggagcaaaggattccgggtactggatgcttgttcaagtgaagccactcacgtggtcatggaggagaccagcgctgaagaggccgtgtcttggcaggaacgaagaatggccgctgctccaccgggatgtaccccacccgccttgctggacatttcttggctcaccgagtccctgggggccggacagcccgttcctgtggagtgcaggcaccgcctcgaagaggcgctggagatcctggctgaggcagccggatttgagggctcagaggggagactcctcactttttgtcgcgcagcttccgttctgaaagcactgccgtccccttag

SEQ ID NO: 20178 - DNA, 729 bp, Artificial Sequence
  Description of Artificial Sequence: Synthetic coding sequence
atgctgcccaagcggcggcgggcccgggtgggcagccccagcggcgatgcagccagcagtacaccaccaagcacgagattccctggagtggcaatttatctggttgagccacgaatgggccgatcacgacgcgcctttttaacggggctggcacggagcaagggttttagagtcctggatgcttgttcatctgaagccacccatgtggtcatggaggaaacctcagcagaagaggccgttagttggcaggaaagacgcatggcagcggctccgccaggttgcaccccacccgctctgctggacattagctggctgacagagagcctgggtgctgggcaacctgtgccggttgagtgcagacatcgactggaagtcgcaggcccaaggaaggggcccctcagtcccgcgtggatgcccgcttatgcctgccagcggccaacaccactcacccatcacaacacaggcttgagcgaggccctcgagatactggccgaagccgcaggctttgagggcagtgaggggagactgctgaccttttgccgcgcagcctccgtactaaaggccctcccctctcctgtgacaacactctcgcagctccagggactgcctcattttggtgaacactcctctagagtcgtgcaggagctgcttgagcacggggtgtgtgaagaggtcgagagggtgcggaggtctgaatcttcaagcccacgatcctctgggtctgtgtag

SEQ ID NO: 20179 - DNA, 813 bp, Artificial Sequence
  Description of Artificial Sequence: Synthetic coding sequence
atgctgcccaagcggcggcgggcccgggtgggcagccccagcggcgacgctgcttcctctacaccgccctccactaggtttcctggcgttgcaatttacctggtcgagccaaggatgggccggtctcgcagggcgttcctgacagggcttgctcgatccaaggggtttagggtactagacgcatgctcttctgaagcaacccatgtggttatggaagaaacgtccgccgaggaagccgtcagttggcaggagcggaggatggccgctgcgcccccgggttgtacgcctcctgccctccttgatatcagttggcttaccgagagtttgggagccggacagcccgtaccggttgagtgtcgacatcgacttgaagtggctggcccaaggaaaggccctctcagtcccgcttggatgccagcatacgcatgccagcggcctactccccttacccatcataatactggcctgagcgaggccctcgagattctggcagaggccgcaggattcgaaggcagcgaaggaagactcctaaccttctgccgcgccgcatcggtgctgaaagctcttccaagtccagtcactacactgagccaactgcaggggctgccgcactttggagagcactccagcagagtggtgcaggaattactggagcacggcgtgtgtgaggaagtagagagagttcgtagaagtgagcgctaccagactatgaaggtccgcagagcaggacttggacctacacctggaatgtcatgtccaggaaatgacaacactgttcatactatgcacggagaggcgaatcggggatcttag

SEQ ID NO: 20180 - DNA, 5163 bp, Artificial Sequence
  Description of Artificial Sequence: Synthetic coding sequence
atgctgatcagcaagaacatgccctggcggcggctgcagggcatctcatttggcatgtattcagcggaagaactcaaaaagcttagcgtgaagagtatcaccaatccacggtatctggattccctcggtaacccttcagcaaatggcctatatgaccttgcactaggtccagccgactctaaagaggtgtgctctacctgcgtgcaggacttttcgaattgtagtggccacctaggacatattgagttgcctctaaccgtgtataatcccctcctcttcgataagctctatctgcttctccgggggtcatgtctaaactgccacatgctgacatgtccccgtgctgttatacacctgctgctatgtcagcttagggtgctggaagtgggcgcattacaggctgtctacgaacttgagcgtatcctaaatcgttttttggaggagaatccggatccctcggctagcgagatccgcgaggagctcgagcaatatacaactgaaatagtgcagaataacctgcttggcagtcaaggagctcacgtcaagaacgtttgtgaatctaaatcgaaactaattgcactgttctggaaagctcatatgaacgccaagcggtgtccccactgcaaaaccggtcgtagcgtcgtcaggaaagagcacaatagcaagctaacgattacctttcctgccatggtgcatcgcacagccgggcagaaagattcagaaccactcggcatcgaagaggcgcagattggaaaacgaggctacttgactcctacttctgcgagggagcacctgagtgccctgtggaaaaacgaaggcttttttctgaactatttgtttagcggcatggacgacgacggaatggagtctaggttcaatccttccgtctttttccttgactttcttgttgtgcccccatctcggtaccgccctgttagccgactgggagaccaaatgttcacaaatggacagaccgtgaatcttcaggctgtgatgaaggacgtagtgctgatacgcaagctgctcgcccttatggctcaggagcagaagctccctgaggaagttgccacccccaccaccgatgaggaaaaggactcactaattgccatagacaggtcttttctttctactctgccaggccagagcctcattgacaaactgtataacatttggattcgcctgcagagccacgtcaatatcgtgtttgactccgagatggacaaactcatgatggacaagtaccccgggattaggcaaatcctggagaagaaagagggcctgttccgaaagcatatgatgggaaaaagggtggattatgccgcccgatcagtaatttgcccagatatgtatattaacacaaatgagatcggcatcccaatggtgttcgccacaaagctgacctatccacaaccagtgacaccctggaacgtccaagaacttaggcaagcagtgataaatggcccgaacgtgcatccgggagctagcatggttattaatgaagatgggagtcgaacagctctgtcggctgtcgatatgactcagagggaagccgtcgcaaagcagctgctgacgcctgctactggggcccccaagccgcagggaaccaagatcgtctgcaggcatgttaagaatggagatatactgctgctgaatcgtcaacccacgttacatcggccttccatccaggcccaccgggcccgcatcttaccagaagagaaagtacttcgattgcattatgcaaactgcaaagcctacaatgcagacttcgacggagatgagatgaacgcacactttcctcaaagcgaacttgggcgtgccgaggcctacgtcctggcttgcaccgaccaacaatacctggtgcctaaggacggccagccccttgcagggttgattcaggaccatatggtgtctggggctagcatgaccacacggggctgtttcttcacccgtgaacactacatggaactggtttatagaggcttgaccgacaaggtgggccgagtcaagttgttatctccttccattctgaaaccattccccctgtggaccggcaagcaagtcgtctctacacttttgattaacattatcccggaggaccatattccgttgaatctaagtgggaaagcaaaaattaccggcaaggcttgggtgaaagagacccccaggtcagtgccaggttttaaccctgactccatgtgcgaatcgcaggtgatcatccgggagggcgagctgttatgtggagtactggacaaggctcattatgggagcagcgcctacgggctggtccattgctgctatgaaatctacggtggcgagacttcagggaaggttttaacatgtttggctagacttttcaccgcgtacctccagttgtaccgcggctttacactcggggtggaagatattctggtgaagccaaaagccgacgttaagcgtcagcgcatcatcgaagagtcgacccattgtgggcctcaggcagtgagggctgcattgaatctcccggaagcggcttcctacgacgaggtgaggggcaagtggcaggatgcccacctcggaaaggaccagcgggatttcaatatgatcgatctgaaattcaaggaggaagtcaaccactatagcaacgaaatcaataaagcctgtatgccttttggcctccacagacaattccccgagaattctctgcaaatgatggtgcaatcgggggcaaaaggctcgacggttaatactatgcaaatcagctgcttgctgggtcagatagagctggaggggaggcggcctccgctgatggcttccggaaaatccctgccttgctttgaaccatacgagttcacgccaagggcaggtggcttcgtcacaggccgcttcttgacaggcattaagccgcctgagtttttcttccattgcatggcaggccgagagggtctggtggataccgccgtcaaaacctcacggtcggggtatctacagagatgcattatcaaacacttggaggggctggtggtgcagtacgacttaaccgtaagagacagtgatggatctgtcgttcaatttctgtacggcgaggacgggctcgatatcccaaagacacaatttctgcagcccaagcagtttccattccttgcttccaattatgaggttattatgaagtcacagcatctccatgaggtattgagcagggctgaccccaagaaggcgctccatcattttcgggctatcaagaaatggcagagcaaacatccaaatacattactgcggcgaggtgcctttctctcctattcacagaaaattcaggaagcggtgaaagccctgaaattggaatctgagaataggaacggaaggtccccagggactcaggaaatgctgcggatgtggtacgagctggatgaggagagcagaagaaaataccagaagaaagctgccgcctgtcccgacccctccttgtcggtgtggcgcccagacatctactttgcctcggttagcgagaccttcgagaccaaggtagacgactactctcaggaatgggcagcacagacagaaaagtcgtacgaaaagtccgagctttccctggataggctgagaacgctgctgcagctcaagtggcagagatctctttgtgaaccgggcgaggccgtgggcttactggcagcccagagcattggtgagcctagtacccagatgacactcaacacctttcatttcgccggacggggtgaaatgaacgtgacgctcggtattccacgtctccgcgaaattcttatggtcgcctccgccaacatcaaaactcctatgatgtcagtgcctgtcctgaatactaaaaaagccttaaaaagggtcaaatccttgaagaaacagctgacaagagtgtgcttgggtgaagtgctgcagaagattgacgtgcaggagtcattttgtatggaggagaaacaaaacaagtttcaggtgtaccaactccggtttcagtttcttccacacgcctactaccagcaggagaaatgtcttcgtcccgaggacattctgaggtttatggaaactagattctttaagctcctaatggagagcatcaaaaaaaagaacaacaaggcttccgcttttcggaatgtgaacactcgccgggctacacaaagagacctcgacaacgccggcgagctgggcaggtccagaggagagcaggagggggatgaagaggaagagggacacattgtagacgctgaagccgaggaaggcgacgcggacgcctcagatgcgaagcgcaaagagaaacaagaagaggaagtggattatgaaagtgaggaggaggaggaacgggagggggaggagaatgatgatgaggatatgcaagaggagcgaaatcctcaccgcgaaggcgccagaaaaactcaggagcaggatgaggaagtggggttgggcaccgaagaggaccccagcctacccgcactgttgactcagcccagaaagcccacacacagccaggaacctcaaggccccgaggccatggaaagaagggtccaggccgtgagagaaatccacccttttatcgatgattatcagtacgatacagaggaatcactatggtgtcaggtcaccgttaaacttccacttatgaaaataaattttgacatgtcctcacttgtggttagcctggctcacggcgctgttatttatgcgacaaaaggtattactcgatgtttgttgaatgagaccaccaacaacaaaaacgagaaagagcttgtgcttaataccgagggaattaatctgccagagctcttcaaatacgccgaagtattggacctgcgccgtttatattcaaacgatatacatgctattgctaacacatatggtatcgaagctgctctgagagtgattgaaaaggaaatcaaggacgtcttcgcagtatatggcattgcagtggaccccaggcacctgtcactggtagccgattacatgtgctttgaaggcgtctacaagcctctcaaccggtttggaatccgtagtaattccagccctttgcagcaaatgaccttcgaaacctcctttcagtttctaaaacaggctaccatgctcgggtcccacgatgagttaaggagcccaagcgcgtgcttagtggtggggaaagttgtgagaggaggaaccgggctgtttgaactcaagcagcccctgagatag

SEQ ID NO: 20181 - DNA, 4980 bp, Artificial Sequence
  Description of Artificial Sequence: Synthetic coding sequence
atgctgatcagcaagaacatgccctggcggcggctgcagggcatctcgttcggaatgtattccgctgaagagcttaagaagctcagtgtgaaatctatcacaaatccgagatatttagattctcttgggaaccctagtgccaatggactgtatgatcttgctctgggaccagcggactctaaggaggtgtgttctacctgtgtccaagatttttctaactgtagtggacacctgggccacattgaactacccctaactgtatacaacccattgcttttcgataaactgtatctgctcttgagaggatcttgtttaaactgccacatgcttacctgcccaagagctgtgattcatctgcttctatgccagctcagggtgctggaggtcggggctctccaggctgtgtatgagctggagagaatattgaaccggtttctcgaggagaatcccgacccgagcgcctcagagattcgggaggagttagagcagtataccaccgaaattgtgcaaaacaacctgcttggcagccagggtgctcacgtaaaaaacgtgtgtgagagcaagtctaaactgatagccctgttttggaaagcacacatgaatgcaaagcggtgccctcattgcaagaccggacgatccgtcgtgcgaaaagagcacaattccaaactgactataacatttcccgccatggtccatcggactgccggccagaaggatagtgagcccctcggaatagaggaagcacagatcggtaaacgtgggtacttgaccccaacttccgctcgagaacatctgtccgcattgtggaagaatgaggggtttttcctgaattatctctttagcggaatggacgatgacgggatggaaagtcgattcaatccttcagtcttctttctcgacttcttggttgtacccccaagccggtaccgccccgtctctcgcctgggggatcaaatgtttaccaatggacagaccgtgaatcttcaggccgtcatgaaagatgtggtgctgattcggaagctgctcgcactcatggctcaggaacagaaacttccggaagaggtggccacacccaccactgatgaggaaaaggactcactcatcgctattgatcgcagtttcctttctacacttccaggacagagtttgattgacaagttatacaatatctggatccgtctccagtcccacgtgaacatcgtgtttgattcagagatggacaagctcatgatggacaagtatccaggtattcggcagattttagaaaaaaaggaaggtctttttaggaagcacatgatgggaaagcgggtagattatgcggcccgctcggtgatttgccctgatatgtacataaataccaacgaaattggcatccctatggtctttgccacaaagctgacataccctcagcccgtcaccccttggaatgtacaggagctaagacaagcagtgatcaacgggcctaatgtccatcccggcgcatctatggtgattaacgaggacggcagtcggaccgctctgtctgcggtagatatgacccaacgggaggcagtcgctaaacaacttttaactccggccaccggtgctcccaaaccgcaggggaccaagatcgtgtgtagacacgtcaagaatggagatattctgcttctcaatcgccagcctacactacataggccctcaatacaggcccatcgggcaagaattctacccgaggagaaagtgttaaggctccattatgctaactgcaaagcatataacgcggacttcgacggtgatgagatgaatgcacacttcccccaatccgagctcggaagagcagaagcttacgtgctggcttgtacagaccaacaatatctcgtgcccaaagatgggcagccgctggctggccttatacaagaccatatggtatccggggcctcaatgacgaccagaggttgtttcttcacccgagagcattatatggagctcgtctaccgcggtctcaccgataaagtggggagagtgaagttgctgagcccttccatcctgaaaccctttcctctctggacaggcaaacaggttgtatcaacattattgatcaacataatccccgaagaccatattccacttaatctgtctgggaaagcgaagatcactggcaaggcctgggttaaggaaacccctcggtccgtccccgggtttaaccccgacagcatgtgcgagtcacaggttattatccgcgagggcgaacttctgtgcggggtccttgataaggctcattatgggtcaagcgcatatgggctggtgcactgttgttacgagatctatggaggggagaccagcggaaaggtgctgacttgtctcgctcgtctgtttacagcctacttgcagctgtaccgaggctttacgttgggtgtcgaagacatactggtcaagcccaaggccgacgtgaaacgccagaggataatagaagaatccacccactgtggcccacaggcggtccgtgccgccttaaacttaccagaagccgcgtcctatgacgaagtgagaggcaagtggcaggacgcccatttggggaaagatcaaagggacttcaatatgatagatctcaagtttaaggaggaagtcaaccactacagcaacgaaattaataaggcctgcatgcctttcggactccaccgccagttcccggagaattccttacagatgatggtccagtcaggagccaaagggtccacggtgaataccatgcagatttcatgcttactcggtcagattgagctagagggccgccgcccaccgctcatggccagtggcaagtccctaccttgtttcgagccatatgagttcaccccccgggccggcggctttgtgaccggacgcttcttgaccggtatcaagccgcccgagttcttcttccattgcatggctggaagggaggggctggtggatacagctgttaaaacctcacgatcagggtacctgcaacgctgtataatcaaacacttagaaggtctagtcgttcagtacgatctcactgtccgcgatagtgacggttctgtggttcagtttctgtacggcgaagacggactggacatacccaaaactcagtttttgcagccaaaacaattcccattccttgcctcaaattatgaagtgatcatgaaatctcagcatctgcatgaggtcctgtctagagctgatcctaaaaaggcactccatcacttcagggctataaagaaatggcagagcaagcacccaaacactctactgcggcggggtgcctttctatcttacagtcagaagattcaggaggccgttaaggcattgaaactcgagtctgaaaacaggaacggacgatccccagggacccaggagatgctgaggatgtggtacgagctagacgaggaatccaggcggaagtaccagaagaaagcagccgcctgtcctgacccctccctgagcgtgtggcggcctgatatttacttcgccagtgtgtccgaaacattcgaaacaaaagtggatgactattctcaggagtgggctgcccagactgaaaagtcctatgaaaagagtgagctgagcttagaccgccttagaactctgctccaactcaagtggcagcgcagcttatgcgagcctggggaggcagttggcctcctggccgcccaatctattggagagcccagtacccagatgactctgaacacatttcattttgccggccggggagagatgaacgtgacactcgggatccccagattgcgcgaaatcttgatggttgcatccgccaatatcaaaacgccaatgatgtccgtccccgtgctaaacacaaaaaaggccctgaagagagttaagagcctcaagaaacagctcaccagggtatgcctgggcgaggtcctgcagaaaatcgatgtacaggagagtttttgtatggaggaaaagcagaacaagtttcaggtttatcaacttcgctttcagttcctgccacacgcttattaccaacaggagaagtgcctgagaccagaagacatcctgaggtttatggaaactcgctttttcaaattactaatggaatccatcaaaaagaagaacaacaaagcatccgccttccgcaacgtgaatacgaggcgcgctacccagagagacctggacaatgctggagagctgggaaggtcacgcggggagcaggagggtgatgaagaagaggagggacacatcgtggacgctgaggctgaggaaggtgatgccgacgccagcgacgccaaacgcaaagagaaacaagaggaggaggtggactacgagtctgaagaggaggaggaacgcgaaggagaagaaaatgacgatgaggacatgcaggaagagcgcaatcctcacagagagggtgccagaaagacacaagagcaggatgaagaggtcaccgtcaaacttccgcttatgaagataaattttgatatgtcgagcctagtcgtgagtctagcccacggggcagtaatctatgccaccaagggcatcactaggtgcttgctcaatgagactacaaataacaaaaacgagaaggaactcgtcctgaacacagaagggattaacctccccgaactgtttaagtatgcggaggtgcttgacctgcggcgcttatactcgaacgacatacacgctattgcaaatacgtatggcatcgaagccgccctccgcgtgattgagaaagaaatcaaagacgtgttcgccgtctacgggattgcagtggatccgaggcatctgagcctggttgccgattacatgtgtttcgaaggagtctacaagcccttaaaccgcttcggaatccggagtaacagctctcccctccagcaaatgactttcgagacatcattccagtttttgaagcaggccaccatgttgggttctcacgacgaattaagaagtccaagcgcctgtctggtggtgggaaaagtggtgcgcggtgggactggcctcttcgagctgaagcagcccctgagatag

SEQ ID NO: 20182 - DNA, 3408 bp, Artificial Sequence
  Description of Artificial Sequence: Synthetic coding sequence
atggaccccggcagccggtggcggaacctgcccagcggccccagcttaaagcatctgaccgaccctagctacggaatcccacgggaacagcaaaaggctgccctgcaggagttgactcgagcacacgttgaaagcttcaattacgccgtgcatgagggcctcggcttggcagtgcaggccatccctcctttcgagttcgcattcaaagacgagaggatctccttcactatcctggatgccgttatctctcctcctacggtacctaaaggtaccatctgcaaagaggccaatgtctacccagcagaatgccgcggccggcgctcgacctacagaggaaagctcactgccgatattaactgggcagtgaatggaatttcaaagggaataatcaaacagtttctcggctacgttccaatcatggttaaatccaagctttgcaacctgcgcaatcttcccccgcaggccttgattgaacaccatgaggaggcagaggaaatgggaggctatttcatcataaacggaatcgagaaagtgataaggatgctgatcatgccccgccggaattttcctattgccatgattcggccgaaatggaaaactcgggggcccgggtatacccagtatggcgtttccatgcactgcgtccgagaggagcacagcgccgtgaatatgaacttgcactacctcgagaacggcaccgtaatgctgaatttcatctacagaaaggagctgttttttctgcccctgggattcgcgctgaaggctttagtctcgttcagtgactaccagatttttcaggagctcattaaggggaaggaggacgacagtttcttacggaactctgtttcccaaatgctgcgcatagtcatggaagagggctgtagcacccaaaaacaggtcctcaattacttgggggagtgttttagagtgaagttgaacgtgcctgattggtatccaaacgagcaggccgcagagttcctatttaatcaatgcatatgcatacatctgaaaagcaacaccgaaaaattttatatgttgtgcctgatgacacgtaaactctttgctttagcaaagggcgagtgtatggaagacaatccggatagcttggtgaaccaggaagtcttgactcctgggcaattatttctgatgttcttgaaggagaagctggagggctggctggtgagtatcaaaatcgcttttgacaagaaagcacagaaaacctctgttagcatgaacaccgacaacctaatgagaatcttcaccatgggtatcgacctcaccaagccgttcgagtatctgtttgcaaccggaaatctccgctccaagaccgggctcggactgctacaggactctgggctctgcgtggtcgctgacaagttgaatttcataagatacctgtcacatttccggtgcgttcatcggggtgctgattttgctaaaatgcgcacaactacagttagaagactgttgccagaaagctggggatttctttgtcctgtgcatacccccgacggcgaaccatgcgggctaatgaatcatcttacggctgtatgtgaagtggtcacccagttcgtctatacagctagcatccccgcgttgctctgtaatctcggggtcacacccattgacggagccccccacaggtcctactccgagtgctatccagtgctgttagacggggttatggttggctgggtggacaaggatttggcccccggcattgccgattctctgaggcactttaaagtgttaagagagaaacgcatcccgccatggatggaggtcgtcctgattcccatgacaggaaagccatctttataccctggcctgtttctgttcacgaccccttgcagacttgtcagacccgtgcaaaatcttgcccttgggaaggaggaactaatcggcacaatggagcagatcttcatgaatgtagcgatttttgaggatgaggtatttgcaggagtgacaacacatcaggagttgttcccgcattcactgctgtctgtaatcgcaaacttcatacccttttctgatcacaaccagagtccacgtaacatgtatcagtgccagatggggaagcagaccatgggctttccactgctgacttatcaggatcggagcgataataaactgtatcgattgcagacccctcagagtccgttggtgaggccctccatgtacgactactatgatatggataattacccgattgggaccaatgcaatcgtcgctgttatcagctacacaggttacgatatggaagacgctatgattgtcaacaaagctagctgggagcggggattcgctcacggttcagtttacaagtctgaattcatagatctgagtgagaaaatcaaacagggggacagttccctcgtttttggaataaaacctggagacccgagggtgttacaaaaacttgacgatgatgggttgcccttcatcggcgccaagttgcagtacggagacccatattactcttatctcaatttgaacacaggggagagcttcgtcatgtattataaatcgaaggaaaattgcgtggtggataacatcaaagtatgcagcaatgacacgggaagtggaaagtttaaatgcgtttgcattaccatgagggtgccaaggaatcccacaatcggagataagtttgccagccgccacggtcaaaaagggatactctctagactgtggcccgccgaggatatgccatttactgaatcgggcatggtccctgacatcctcttcaatcctcacggctttccctctcgcatgacaatcgggatgcttattgagtcaatggccggcaaaagcgccgctctacacggactgtgccacgatgccactccattcattttctccgaagagaacagtgccttagaatactttggggagatgttgaaggctgcaggctacaatttctacggtacagagcgcctgtactccggaatttccggactcgaactggaggccgacatcttcatcggtgttgtttactatcaacggctgagacacatggtctccgataagttccaggtgcggactactggtgccagagacagggtgaccaaccagcctatcggggggaggaatgtacagggcgggattaggttcggcgagatggagcgggacgcattactggcccacggcacatcgtttctgctccatgatagactcttcaattgctcagatcgatccgtggcccacgtgtgcgtgaaatgtggaagtctgctcagcccattacttgagaagccgcctccgagttggtccgctatgagaaatcgtaagtataattgcactctgtgcagtcggagtgacactattgacactgtctctgttccttacgtcttccgatattttgtggcagagcttgcggccatgaatatcaaggtgaaactggacgtggtctag

SEQ ID NO: 20183 - DNA, 3240 bp, Artificial Sequence
  Description of Artificial Sequence: Synthetic coding sequence
atggaccccggcagccggtggcggaacctgcccagcggccccagcctcaaacatctaactgatccctcatacggcattccccgtgagcaacagaaggctgctttgcaggagctcacgcgcgcacatgtcgagtcatttaactacgctgttcacgaaggattgggattagcagtgcaagctgatattaattgggcagttaatggcataagcaaggggatcattaaacagtttcttgggtatgtgcctatcatggtgaagtccaaactatgcaacctccgcaatctgcctccgcaggcgttgatcgagcaccacgaggaggctgaggagatgggcggctattttatcataaatggaatcgaaaaggtcattaggatgctaatcatgcccagaagaaattttcctattgccatgatccgtcccaagtggaaaactagaggcccaggatacactcaatatggggtctcgatgcattgtgtgagagaagagcactccgcagtgaacatgaatctgcattacctcgaaaatggaacagtgatgctgaattttatttatcgcaaggagttattctttttacccctgggcttcgcactgaaggctctggtatcattttctgattatcagatcttccaggagctcatcaagggcaaggaagacgattccttcctccggaactcagtgtctcagatgcttaggatagttatggaagaaggttgttccactcagaaacaagtgttaaattacttgggcgaatgctttagggtcaaactcaacgtgcccgactggtatcccaacgaacaggccgccgaattcctcttcaatcagtgcatctgtatacacctgaaaagcaacaccgagaagttttatatgctgtgcctgatgactaggaagctcttcgcacttgctaagggcgagtgcatggaagataaccccgattccctggttaaccaggaagtactgacaccaggacaactattcctgatgtttttgaaggaaaaactggaaggttggctggtgtctatcaaaattgcatttgacaaaaaggctcagaagacctccgtatcaatgaacaccgacaatctgatgcgcatattcacaatgggtatagatttgacaaaaccattcgaatatttattcgccactggtaatttaagatctaaaactggccttgggttgcttcaggatagcggcctatgcgtcgtggccgataagctaaacttcatcaggtatctgagccactttcgctgcgtccatagaggggcagacttcgccaaaatgaggaccacgaccgtacgccgtcttctgcccgagtcctggggattcctgtgccctgtgcacactccagatggcgaaccctgcggactgatgaaccatttgaccgctgtgtgcgaggtggtgacccagttcgtgtacaccgcctctatccccgccttactgtgcaacctgggggttacccccattgatggtgccccacacagatcctattccgaatgctaccccgtcttgttagatggggtgatggttggctgggtcgacaaggatttggctccaggtatagccgacagtcttcggcactttaaggtactgcgtgaaaagagaatcccgccgtggatggaggttgtcctgattcctatgacaggcaagcctagcctgtacccagggctgtttctcttcacaaccccgtgtcggttagtgcggccagttcaaaatttggctttgggcaaggaggagttgatcggaactatggagcagatattcatgaacgttgccatttttgaggatgaagtgttcgctggcgttacgacccatcaggaattatttcctcattctctgctgtctgtcatagctaactttatccccttctctgaccacaaccagtcacccaggaacatgtaccagtgccaaatgggaaaacagaccatgggattcccactccttacctatcaagaccgtagtgacaataaactgtacagactgcagacaccacagtcccccctggtccgtccatccatgtatgactattatgacatggataactaccccatcggaacgaatgctatcgtggccgtgattagttacacagggtacgatatggaagatgcaatgatcgtgaataaggccagctgggagcgcggcttcgctcacggctcagtttataagagcgaattcattgacctgtccgagaaaattaaacagggggatagctctctggtctttgggatcaaacctggggacccgcgcgttctccagaagctggatgacgacggattgcctttcatcggcgccaagctgcagtatggtgatccttactactcttacctgaatctaaacaccggggagagttttgtgatgtattataagtccaaggaaaattgtgtggtcgataacattaaagtttgctctaacgatactggttctggcaaattcaaatgtgtctgtataaccatgagagtgcctcggaaccctaccatcggagacaagtttgcttctcggcacggccagaaaggaatcttgtctcggctgtggccagcagaggatatgcccttcaccgaatcgggtatggtgccagacattctgttcaacccccacggatttccaagccgcatgacaattggcatgctaattgagagcatggcgggaaagtctgccgcactgcacggactctgccacgacgctacaccatttatcttctccgaggaaaatagtgcgcttgaatattttggtgagatgttaaaggccgctggatataatttttacggcactgaacgcctctacagtggcataagtggattagagctggaagccgacatcttcatcggcgtagtgtattatcaacggctacggcatatggtgtctgataaatttcaagtgagaactactggcgccagagatagagtcacaaaccagcctataggcggccggaacgtccaaggtggcatccggttcggcgaaatggagcgcgacgccttacttgcccacggtacaagtttcttgctacatgaccgcctgttcaattgctctgacagatctgtggcacatgtttgcgtcaaatgtgggtctctcttatctcctctgctggagaaaccccctcccagctggagcgcaatgcgcaacagaaaatacaactgcacgctgtgtagtcgtagtgacactattgatacagtttcagtcccttacgtgtttaggtatttcgtagccgagctcgccgccatgaacattaaagttaagctggacgtggtttag

SEQ ID NO: 20184 - DNA, 345 bp, Artificial Sequence
  Description of Artificial Sequence: Synthetic coding sequence
atggaccccggcagccggtggcggaacctgcccagcggccccagcttaaagcacctcactgacccctcgtatggtatcccgagagagcaacaaaaggccgcactccaggagctgaccagagcacacgtggagagcttcaattacgccgtgcacgaggggctggggctagcagtccaggccatacctccattcgaatttgccttcaaggacgaacgtatctctttcacgatcctcgacgctgtgatttcacctccaaccgtacccaagggcactatttgtaaggaggcaaacgtgtatcctgctgagtgccgtggacgccggagcacataccgcggcaaactgtag

SEQ ID NO: 20185 - DNA, 387 bp, Artificial Sequence
  Description of Artificial Sequence: Synthetic coding sequence
atggaccccggcagccggtggcggaacctgcccagcggccccagcctcaaacaccttacagacccaagctacggcataccaagggagcagcagaaagcggcactgcaagaattaacacgggcccatgttgaatcattcaattatgccgtgcacgaagggcttggacttgccgttcaagccattccaccattcgagttcgcattcaaagatgagaggatcagttttaccatcctcgacgccgttatatcaccccctacagtgcctaagggaaccatctgcaaagaggccaatgtctacccagcagagtgtcgcgggcggcggtctacttatagaggcaaactgacagccgacataaattgggctgtaaacggcatttccaaagggtag

SEQ ID NO: 20186 - DNA, 1380 bp, Artificial Sequence
  Description of Artificial Sequence: Synthetic coding sequence
atgaacgtggccatcttcgaggacgaggtgttcgccggcgtgaccacacaccaggaattattcccccatagtttactgagtgtcatagctaacttcattccattcagcgaccacaaccagagccctcggaacatgtaccagtgccagatggggaagcagacgatggggttcccgctccttacatatcaggaccgtagcgacaacaagctgtatagactgcaaactccgcagtccccactagttcgcccaagcatgtatgactactatgatatggacaactaccccatagggaccaatgctatcgttgcagtgatttcctacactggatacgacatggaggatgcaatgatcgtaaataaagcgtcttgggagcggggcttcgcacatggatcggtatacaaaagcgaatttattgatttatctgagaagataaaacagggcgactctagtttggttttcggaataaagccaggggaccccagagtactccaaaagctggatgatgatggactgcctttcatcggcgccaaattacagtacggcgatccatactactcatatctgaatcttaacaccggtgaatcatttgtcatgtattataaaagcaaggaaaactgcgtcgtagacaatatcaaggtctgcagcaacgacacaggctctggcaagttcaaatgtgtttgtatcactatgcgggtaccccgcaaccccacaatcggcgacaagttcgcatcccgtcatggccagaaaggcatcttgtcaaggctttggccagctgaggacatgccatttacggagagcgggatggtacccgacattcttttcaacccacacggctttccctctagaatgaccatcggcatgttgatcgagtccatggccggcaagtccgccgcattgcacggactttgccacgatgctaccccctttattttctcagaagaaaatagtgcgctcgagtactttggcgagatgttgaaagcagccggttataacttctacgggaccgagagactttacagtggaattagcggtctcgagctggaggcggatattttcattggagtggtgtattaccaaaggctgaggcatatggtctcagacaagtttcaggtgcggaccactggcgctcgagaccgggttactaatcagcctatcggaggtaggaacgttcagggcgggatcaggttcggcgagatggagcgcgacgccctgctcgcacacggcacatcgttcctgctgcacgaccgtctgtttaattgctctgatcgatccgtggcccatgtgtgtgaggtgtggcagtttaccctgagtacagtgggggaagcgactccattcctggtgtgtcatgcccagcaaaagatccagctttactccgtgtag

SEQ ID NO: 20187 - DNA, 2775 bp, Artificial Sequence
  Description of Artificial Sequence: Synthetic coding sequence
atgcactgcgtgcgggaggagcacagcgccgtgaacatgaacctgcactacctggagaacggcaccgtaatgttgaactttatataccgcaaggagctgttcttcctacccctcggattcgcactcaaggctctggtttcatttagtgactaccaaatctttcaggagctgattaaaggaaaagaggatgacagctttcttaggaactcagtttcacagatgctgcgcatcgtgatggaagaagggtgttcaacccagaaacaggtattgaactacttgggggagtgctttcgagttaagctgaatgtgcccgactggtacccaaatgagcaggctgccgagtttctgttcaaccaatgtatttgcattcatcttaagagtaacactgaaaaattctacatgctctgcctaatgactcgtaagctgtttgcccttgcaaagggagagtgtatggaggacaacccagactctctggtgaaccaggaagtcctcactcctggtcaactgttcctaatgttcttgaaggagaagctggaggggtggctagtctcaatcaagatcgcgttcgacaaaaaggcacagaagaccagcgtgtccatgaacaccgataatctcatgaggattttcacaatgggtatcgatctcaccaagcccttcgaatatctgtttgccaccggcaatcttcgctctaaaaccggattggggctgctccaggactccggactgtgtgtggtcgcggacaagttaaatttcattcgctacctgtcacacttccgctgcgtccatcgcggtgcagattttgccaagatgaggacaaccaccgtgcgacggctgctgcccgaatcctggggattcttgtgtcctgtacatacccctgatggagagccttgtgggctgatgaatcatttaacagccgtctgcgaggttgtaacacagtttgtatacaccgcttctataccagccctcctgtgcaacctgggagttactcccattgatggcgcgcctcaccgaagttacagtgagtgttatccagtgctgttggatggcgtgatggttggctgggtggacaaagacctggcacctggcattgccgacagcctgcggcacttcaaggtgttgagggagaaacgcattcccccctggatggaagtggtgttgatccccatgactggaaagccttctctttaccctggactgtttctgttcaccacaccctgccgactggtgcgcccagtgcaaaatttggctttggggaaggaggagttaatcggcacgatggagcagatctttatgaatgttgctattttcgaggacgaggtgttcgccggtgtgacaacacaccaggagctgtttccccactccctgctctcagtgattgccaatttcattcctttctcagaccacaatcagtctccccgcaatatgtatcaatgccagatggggaagcagactatggggtttcctctgttgacataccaggacaggtcagacaacaagctgtacagactgcagaccccgcagagtcccctggtaagacctagtatgtacgactactacgatatggacaattatcccatcggcaccaacgccattgtggccgtcatctcttatactggatatgatatggaagacgccatgatcgttaataaggcatcatgggaacgcgggttcgctcacggatccgtgtacaaatctgagtttattgatctatctgaaaagatcaagcagggagactcttcgctggtgtttggaataaaaccaggggaccccagggttctgcagaaactagatgacgatggcctccctttcatcggcgctaaactccagtacggcgacccctactatagctatctgaacctcaataccggagagtcctttgtaatgtattacaaaagcaaggagaactgtgttgtcgataatatcaaagtctgcagcaatgataccgggtctgggaagttcaagtgcgtgtgcatcacaatgagagtacccagaaatccaacaattggtgataagtttgctagccgccacgggcaaaagggcattctttccagattatggccagctgaagacatgcctttcacagagagcggcatggttccagatattctctttaatccacacgggtttccctccagaatgaccataggaatgctcattgagtcgatggctggaaagtccgccgcattacacggactttgtcatgatgccaccccttttatcttttctgaggaaaattcagctctagagtactttggagaaatgttaaaagctgccggctacaatttctacggaactgaaagactctactcaggtatcagtggcctggagcttgaagcagatatattcattggggtagtgtactatcagagactgcgccatatggtaagtgataagtttcaggtaaggacaacaggagcacgcgacagggttaccaaccagcctatagggggccgtaacgtgcagggcgggattcgatttggagagatggagcgggatgccctcctggctcatggtacttccttcctgctccatgataggctctttaactgctcagaccgcagtgtggcacatgtgtgcgtcaaatgcgggtcccttcttagccctctgctggagaaacccccgccatcctggagcgccatgcggaatcggaagtataactgtacattgtgcagtagatcagacacaattgatacagtttctgtgccatacgtgtttaggtattttgtggccgagctcgcagccatgaatattaaggtaaaactggatgttgtatag

SEQ ID NO: 20188 - DNA, 3522 bp, Artificial Sequence
  Description of Artificial Sequence: Synthetic coding sequence
atgcgggccaaggaggccgccgagaccggcctgcggcccctgctgccggcctgtactgagagactagcctctggagtatacagagaaactggcgtgcggtgcgctggcggtcatatggaccctgggtccagatggcggaatctcccttccggaccttcactcaaacatcttaccgatccttcatatggtatcccaagggaacagcagaaggccgccctgcaagagctgaccagggcccatgttgagtcatttaactacgcagtccacgaaggactgggacttgccgtgcaagcaattccccccttcgagttcgccttcaaggacgaacggatatcctttactattcttgacgcggtcatctcacctcctaccgtacccaaaggcaccatctgcaaggaagcgaacgtttatcccgctgaatgtcggggcagacggtctacgtatcgggggaagttgacagctgacattaactgggccgtgaatggaattagcaagggcatcattaaacagttcctgggttatgtcccaatcatggtcaagtccaagctctgcaatctccgcaacctccccccacaggccttgatcgagcaccacgaggaggcagaagagatgggcggctacttcattatcaatggaattgagaaagtgatccggatgttgataatgcctcgccgaaatttcccaattgctatgattcgtcccaagtggaaaactcggggaccggggtacactcaatatggcgtctccatgcactgtgtgagggaagagcactcagcagtgaatatgaacctgcattacctggagaacgggactgtaatgctaaatttcatctacagaaaggagctttttttcctgcccctaggtttcgctctgaaggccttagtctctttctcagactaccagatctttcaggagctgatcaaaggaaaagaggatgattctttcctgaggaactcggtttctcagatgctgcgaatcgttatggaggaggggtgctccactcagaagcaagttctgaactacttaggagaatgtttccgcgtcaagttaaatgtgccggactggtatccaaatgaacaggccgccgaattcctgttcaaccagtgcatctgtatccacttgaagagcaacaccgagaaattctacatgctgtgcctcatgacaagaaagctgttcgctctggctaaaggcgagtgcatggaagacaaccctgacagcttggttaaccaagaggtgctgacacctggtcagctattcctgatgtttctgaaggagaaattggaagggtggctggtgagtatcaaaatagctttcgataaaaaggcgcaaaagactagtgtaagcatgaacactgacaatcttatgagaatatttaccatgggcattgacttgacaaaacccttcgaatacctgtttgccacgggcaacctgcggtccaagacggggctggggctgctgcaggactccggcttatgtgttgtggcagataagctcaacttcattagatatttatcacattttcggtgcgttcatcgtggggctgacttcgcgaagatgcgaacaactaccgtacgacgcctactgcccgaatcatggggctttctgtgtcctgttcatactccagatggtgaaccttgtggtcttatgaaccatttaactgctgtatgcgaagtggtaacccagttcgtgtacactgctagcatcccggctctgttgtgtaacctaggtgtgaccccaatcgacggcgcccctcatcggagctattcagaatgttaccccgttctcctggatggcgtcatggtggggtgggtggataaggatctcgccccagggatagctgactccctcaggcactttaaggtacttcgcgagaagagaatccctccatggatggaagtcgtgctgatccccatgaccggcaagccctctctctacccaggactgtttctgtttacaacgccatgcagactggtgcggcctgttcaaaacctggccttggggaaagaagagctgattggcaccatggagcagatctttatgaacgtggcgattttcgaggatgaagtgttcgctggtgtgaccacacaccaggaactattcccccacagtctactgtctgtcatcgcgaattttatacccttctccgaccacaatcaatcaccacggaatatgtatcagtgtcagatgggtaaacagacaatggggtttccactgttaacctatcaggatcgctccgataacaaactgtacagactacagaccccccagtcaccactggtgaggcccagtatgtatgactactatgacatggataattatcccatcggtactaacgccattgttgccgtcatcagctatacaggttatgatatggaggatgccatgatagtaaataaagccagctgggagcgtggcttcgcccacggatctgtctacaagagcgagttcatcgatctgagtgagaaaattaagcagggagattcttctctggtatttggcattaagcctggcgaccccagagtcttgcagaaactggatgatgacggactgccatttataggtgctaaactgcaatatggggacccctactattcctatctgaatctcaacaccggcgaatcatttgttatgtattacaaaagtaaagagaattgcgtcgtggataacatcaaagtctgctccaacgataccggcagcggcaagtttaaatgtgtctgcatcactatgcgcgtccctagaaacccaacaattggagataagttcgccagcagacacgggcagaagggtattttaagccggctttggcctgctgaagatatgccattcaccgagtctggtatggtgcccgacatactgtttaaccctcacggatttcctagtagaatgacaattggtatgttaatcgaatctatggccggcaagtcagccgccctgcacgggctctgtcacgatgccacccccttcatcttttctgaagaaaacagtgccttggagtatttcggggagatgctgaaagccgctggatataatttctatggtaccgaacggttatactctggaataagcggattagagctcgaggcagacatttttatcggagttgtatactaccagagattgagacacatggtgtcggataaatttcaggtgaggaccacaggagcacgggaccgcgtaaccaatcagcccattggagggcgcaacgtccagggagggatacgcttcggcgaaatggagcgagacgcacttctggcccacggaaccagcttcctgctgcacgacagactatttaactgcagcgatcgaagcgtggcacacgtatgcgtgaagtgtggctccctgctgagccctttgttggagaagcctccacctagttggagcgctatgcgcaaccgaaagtataattgcactctgtgctcaagaagcgataccatcgatactgtgtcagttccatacgttttcaggtattttgttgctgaactggctgccatgaatatcaaggtgaagctggatgttgtgtag

SEQ ID NO: 20189 - DNA, 3525 bp, Artificial Sequence
  Description of Artificial Sequence: Synthetic coding sequence
atgtacgacgccgacgaggacatgcagtacgacgaggacgacgacgagattacccctgacctgtggcaggaggcatgctggatcgttattagcagttacttcgacgaaaaagggctggtccggcagcaactggatagctttgacgaattcattcagatgtccgtgcagcgcattgtggaagacgccccgcccattgatttgcaggctgaagcccagcacgcaagcggcgaggtcgaagagccacctcgttatctgctgaagttcgagcagatctatctttccaaaccgactcattgggagagagatggggcccccagcccaatgatgcctaatgaggcgaggcttaggaacttaacgtatagtgcacccctctatgtggacatcactaagaccgttatcaaagagggtgaagagcagttgcagactcaacaccaaaaaaccttcattggcaaaatccctattatgctgcgttcaacatattgcttgctgaacggactgactgatagagatctgtgcgagctaaacgagtgtcccctggacccgggtgggtatttcatcattaacggttcggagaaagtgcttatagcacaggaaaagatggcaaccaacacagtttatgtgtttgccaagaaggactccaagtatgcatacacaggcgagtgcaggtcatgcctggagaattcttcccgccccacatccaccatctgggtgtcaatgttagcccggggagggcagggagctaaaaaatccgccataggccaacggatcgtcgctacattgccttatattaagcaggaggtgccaatcattattgtcttcagggctctggggtttgtctccgatcgggatatcctcgaacacatcatctacgattttgaagatcctgagatgatggaaatggtgaaaccttcactggacgaggcattcgtcatccaagaacagaacgtcgccctgaacttcattggtagccggggcgccaaacccggcgtgactaaagagaagcgcatcaagtacgctaaggaggtgcttcagaaggaaatgcttccacacgtcggggtcagcgacttttgcgagaccaaaaaagcctattttttgggctacatggtgcaccgcctgctgttggcggctttagggagacgagagctggatgaccgagaccactacggtaataaaagactcgacctagccggccccttgctggcatttctctttagaggtatgttcaaaaatctgctgaaagaagttcggatttacgcccagaaatttatcgatcggggaaaagatttcaatctcgagctggccatcaagactaggataatttctgacgggctcaaatactccctggctaccggcaattggggagatcaaaagaaggcccaccaggcaagggccggtgtgagtcaggtactgaaccggctaacctttgcatccacattgtcccatctgcggcggttgaatagccccattggacgggatgggaaactcgccaaacccagacagctgcacaacactctttggggtatggtgtgtccggccgaaacccctgaagggcatgctgttgggttggtaaagaacctcgctcttatggcttatattagtgtgggaagccaacctagtccgattttggaattcctagaggagtggagcatggaaaacctggaagagatcagccccgccgccatcgctgatgctaccaaaatctttgtgaacggctgttgggtaggcatccacaaggaccccgagcagctcatgaatacccttcgcaagctccgacgccagatggatattatcgtcagtgaagtcagtatgatcagagacattcgcgagagagagatccgcatttataccgatgcaggcagaatctgtcgaccactgctcatcgtggaaaagcagaagctgctcctaaagaagcgccatattgatcagctgaaggagagggaatacaacaactactcatggcaggatctggtcgctagtggcgtcgtggaatatattgacaccctcgaggaggaaaccgtgatgctggccatgacacccgatgatctgcaggagaaggaggtggcttactgcagcacttatacccattgcgagattcacccttccatgattttgggcgtgtgtgcgtccattattccttttccagaccacaatcaatcgcctcgaaatacttatcagagtgctatgggaaagcaagcaatgggcgtctatatcactaattttcacgtgcgcatggacacgctggcccacgtcctttattacccgcagaaaccccttgtgaccacacggagcatggagtacctgcgctttcgggagctccccgccgggatcaatagcatcgtcgcaatagcctcctacacagggtacaaccaagaagactctgtgatcatgaaccgaagcgcagtggacagggggttttttcggagtgtgttctacagaagctacaaagaacaggaatccaaaaagggctttgaccaggaggaagttttcgaaaaacccacccgggagacatgccaagggatgagacatgcaatttacgataagctggatgatgatggactgattgccccaggtgtgcgggtatccggagatgacgtcatcattggtaaaaccgttaccctgccagagaacgaggatgagctcgagtccactaaccgccggtatactaagagggactgtagcacgtttttgcgcacgtctgaaaccggcattgtagaccaggtgatggttaccctcaaccaggaagggtacaaattctgcaagattagggtgcgatccgtgcggatcccacagattggggacaaattcgcctccaggcatggacagaaagggacatgtggaatacagtatcgacaggaagatatgccttttacctgcgagggaatcaccccggatatcatcatcaatccacacgcgataccatcccgcatgaccattggccatcttatcgagtgcctgcagggtaaagtgtccgcaaacaagggggaaatcggggatgccacccccttcaatgatgccgtcaacgtccagaagataagtaacctgctctccgactacgggtatcatctaagaggcaacgaagtgctgtacaatggatttacaggccggaaaattacctctcaaatattcattggacccacatactaccagcggctgaagcatatggtggatgataaaatacactcgagggcaaggggccctattcagatccttaatcggcagcccatggaggggcgttcaagggacggaggactgcgcttcggggagatggagcgggattgccagatagctcacggagcagcccagttcttgcgagaacggttattcgaggccagtgatccctaccaggtgcatgtctgtaacctgtgcggtattatggctattgccaatactaggacccatacctacgagtgccgtggttgtaggaacaagacacaaatatccctagtccgcatgccttacgcttgtaaattactgttccaggaattgatgtccatgtctatagcgccccgcatgatgagcgtttag

SEQ ID NO: 20190 - DNA, 3525 bp, Artificial Sequence
  Description of Artificial Sequence: Synthetic coding sequence
atgtacgacgccgacgaggacatgcagtacgacgaggacgacgacgaaataacaccagacttgtggcaagaggcttgttggattgtgatcagctcctattttgatgagaagggcctagttcgtcagcagttagattctttcgacgaatttattcagatgagcgtgcagagaattgtggaggatgctccaccaatcgacctgcaagcagaagctcaacacgcttcaggtgaagtcgaagaacctcccaggtacctactgaagtttgaacagatatacctaagcaagcctactcactgggagcgggacggtgcccctagccccatgatgcctaatgaggctagattgaggaacttgacctactctgcgccactgtatgttgatatcaccaaaactgtgattaaggagggggaggaacagctgcagactcagcaccagaaaacattcatcggaaagattcctataatgctgaggtctacctactgcctccttaacgggttgactgaccgcgacctttgtgaacttaatgaatgcccactggatccaggggggtactttattatcaatgggtcagaaaaggtgctaatcgcccaggagaagatggctacgaatacagtgtacgtcttcgccaaaaaggattcaaaatatgcttacactggtgagtgccgtagctgcctggagaactccagcaggcctaccagcacaatatgggtgtcaatgctggccaggggcggccagggagccaagaaatccgcaatcgggcagcgaatcgtcgcaacactgccatacataaaacaggaagtccccatcatcatcgtgttcagagctttgggattcgtatcagaccgagatatcctggagcatatcatttatgatttcgaagatcccgaaatgatggagatggttaaaccatctctggatgaagctttcgtgattcaggagcaaaatgtagccctgaatttcatcggcagtcgtggggctaagccgggagtgacaaaagagaaacgcattaagtatgccaaagaagtgctgcaaaaggaaatgctccctcatgttggtgtgtccgatttttgcgaaacgaaaaaagcctattttctgggatacatggtgcacaggctgctcctcgcagccctcggtcgccgagagctagacgatagggaccactacgggaataaaaggctggatctggctggtccactcctggccttcctgtttcgcgggatgttcaaaaatctcttgaaagaggtccggatatacgctcaaaagtttatagatcggggcaaagatttcaatctcgaattggcaattaagacccgcatcatctcggatggactcaaatactctctggcgaccggaaactggggggaccagaagaaggcccaccaggccagagctggagtgtcgcaggttcttaaccgactgacttttgctagtactctgtcgcacttgcggcgcctgaacagtcctataggacgcgacggcaagctcgctaagccaaggcagctccacaatactctctgggggatggtttgccccgccgagacacccgagggccatgcagtggggttggtcaagaatcttgcactgatggcctacatctccgttgggagtcagcccagcccaatcctggaattcttggaggagtggagtatggagaatttggaagaaatttcaccagctgcgattgctgacgcaactaagatcttcgtcaatgggtgttgggtgggcattcacaaagatcccgaacaactgatgaatacgcttcggaagctgaggagacaaatggatatcatcgttagtgaggttagcatgattcgggacattcgcgaacgcgagattcggatttacacagacgcaggacgcatctgtagacctctactgatcgtagagaaacaaaagttgctcctcaagaagagacatatcgatcagttaaaggaacgggaatacaacaattattcctggcaagatctcgtcgcctcaggcgtggttgagtatatcgacacccttgaagaggagaccgtcatgctggccatgacccccgacgacctgcaggaaaaagaggttgcgtactgctccacgtacacacactgcgagattcatccttccatgatccttggcgtatgcgcctcaatcatcccctttcctgatcacaaccaatcccccaggaatacctaccaatccgccatgggcaaacaggcaatgggcgtgtacattacaaactttcatgtgaggatggacacccttgcacatgtgctgtattacccccaaaagcccctcgtgacgacccgcagtatggaatatttgaggtttcgcgagttaccagcaggaattaactcaattgtcgctattgccagctataccgggtacaaccaggaggattcagtcataatgaaccgatccgctgtagaccggggcttctttcgatctgtgttttataggtcgtacaaggagcaggagtcgaaaaagggctttgatcaggaggaggtattcgagaagcccacaagagagacgtgtcaaggaatgcggcacgccatctacgataaactggatgacgatggattgattgctcccggggtacgggtgagcggtgatgacgtgattatcggaaagacagtcaccctcccggagaacgaagacgaattagaaagtacaaatagaagatataccaagcgggactgttccacattcctgcgcaccagtgaaaccggcatcgtcgaccaggtgatggttactctcaaccaggagggttataaattttgtaaaatcagggtccgttcagtcaggatcccacaaataggcgataagttcgctagccggcacggacaaaagggcacatgtggtatccagtaccgacaggaggacatgcccttcacctgcgaaggcataacacccgacatcattatcaatcctcacgccatccctagcaggatgacaataggccaccttatcgaatgtctccaggggaaagtcagcgccaacaagggcgagatcggcgacgcgaccccttttaatgatgccgtgaacgtccaaaaaatatctaatctattaagtgattatgggtatcacctccgcggcaatgaggtgctgtacaatggttttactggccgaaaaatcaccagtcaaatcttcatcgggcccacttactatcagcgcttgaagcatatggtggacgacaagatccactcccgcgcccgaggccccatccagatcctgaaccgccaacccatggagggaaggtctagagatggggggctcagatttggcgaaatggagcgggactgccagatcgctcatggcgcggctcagtttttgagagaaaggcttttcgaagcatctgacccttatcaagtgcatgtctgtaatctgtgcgggatcatggcaattgctaatacaagaacccacacctacgagtgtaggggctgtagaaataagactcaaatctccctggttcgcatgccctacgcctgcaagttgctgttccaggaattaatgtctatgtccatcgcccctcgcatgatgagcgtttag

SEQ ID NO: 20191 - DNA, 429 bp, Artificial Sequence
  Description of Artificial Sequence: Synthetic coding sequence
atggccgccggcggcagcgacccccgggccggcgacgtggaggaggacgcctcccagttgatcttcccaaaagaatttgagacggccgagaccctcctgaattccgaggtacatatgctgctggaacacaggaagcagcagaacgaaagtgcggaagacgagcaggaactgtccgaagtctttatgaaaactctgaattacaccgcccggttttcacgtttcaaaaaccgggagacaattgccagcgtacggtcgctactcctgcagaaaaagctacacaagtttgagcttgcttgtctggctaacctgtgccccgaaacggcagaggaaagtaaggccctgatcccctcattggaggggcgattcgaagacgaggaactgcaacaaattctcgacgacatccagaccaagcggtctttccaatactag

SEQ ID NO: 20192 - DNA, 348 bp, Artificial Sequence
  Description of Artificial Sequence: Synthetic coding sequence
atgaacgccccccccgccttcgagagcttcctgctgttcgagggcgaaaagatcaccatcaataaggataccaaagtgcccaatgcgtgtctgttcactattaacaaggaggatcacacactgggtaacattattaagagccagctcctgaaagacccccaggtgctctttgccggttacaaagtccctcatcctcttgaacataagataataattcgcgtgcagacgacaccagattactctccacaggaagcattcacaaacgcaatcactgatctaatctccgaactgagtctgctggaggaaaggttcagaacgtgtctcctgcctctaaggcttttaccgtag

SEQ ID NO: 20193 - DNA, 348 bp, Artificial Sequence
  Description of Artificial Sequence: Synthetic coding sequence
atgaacgccccccccgccttcgagagcttcctgctgttcgagggcgagaaaatcaccatcaacaaagacactaaagtacctaacgcttgtttgttcaccatcaacaaggaagatcacactctgggaaacatcatcaaatcacagctgctgaaggatccccaggtactgtttgccggttataaggtgccgcacccactggagcataagatcattatccgggtgcagaccacacccgactactctccacaggaagcctttacaaacgctataactgatttaatttcagagctttcactgctggaggaacggttccggacctgcctgttgcccctgaggctgcttccctag

SEQ ID NO: 20194 - DNA, 1107 bp, Artificial Sequence
  Description of Artificial Sequence: Synthetic coding sequence
atgtgcagcctgccccggggcttcgagccccaggcccccgaggacctggctcagagatccctggttgagcttagagaaatgctgaaacggcaagaaaggctattgaggaacgaaaaattcatttgcaaactgcctgataaaggcaaaaagatttttgacagctttgccaagttgaaggcagccatcgctgaatgtgaagaagttaggcgcaagtccgagctgtttaacccagtctctctcgattgcaaactacgccagaaagcaatagccgaagtcgatgtgggtacagacaaggcgcagaattccgacccaatactggatacgagcagcctggtccctgggtgttcttcggtggacaacattaaaagtagccagacatcccaaaatcaaggccttggtaggcccacattagagggagatgaggaaaccagcgaagtcgaatacaccgtcaacaaagggccagccagctcaaatcgcgatagagttcctccaagcagtgaggcctctgagcaccaccctaggcatcgggtgtcatcccaggccgaggacacaagctctagcttcgacaatctgtttattgacagactgcaacgcatcacaattgctgatcagggggagcagcagtccgaggagaatgccagtaccaaaaatctgaccggactctcaagtggcacagagaaaaagccccactacatggaggtgctggagatgcgcgcaaaaaatccagtacctcaactcagaaaatttaagacaaatgttctgcccttcagacagaatgattcaagttcccactgccaaaaatccggctcgccaatctcatcagaggagagaagacgaagagacaagcaacatctcgacgatatcactgccgcacgcctgctacccttacaccatatgccaacccagctccttagcattgaggagtcactggctctgcagaaacagcagaagcagaattacgaggaaatgcaggccaaacttgccgcacagaaactagccgaacgcctcaatattaagatgagaagttacaacccggaaggggaatcttccgggcgatacagggaagtgcgggatgaagatgacgactggtcttcagatgaattttag

SEQ ID NO: 20195 - DNA, 636 bp, Artificial Sequence
  Description of Artificial Sequence: Synthetic coding sequence
atgtgcagcctgccccggggcttcgagccccaggcccccgaggacctcgcccagagatcactggttgaattaagggagatgctcaagagacaggagcgtcttcttcggaatgaactgcaaaggattaccatagccgatcagggggaacagcagagtgaagagaacgcctccactaagaatctgacgggactcagctcagggacggagaagaaaccacactatatggaagttctggaaatgcgggccaagaaccctgtcccacagttacgtaaatttaagacaaacgtgctgccatttcgtcaaaacgattcctcctcccactgccagaagagtggtagcccaatctcgagcgaagaaaggagaagacgggataagcagcacctggacgatattacagctgccaggctcctgcctctgcaccatatgcccactcaactcctgtccatagaagaatcactggcccttcagaagcagcagaagcagaactacgaggagatgcaggcaaaactagctgcgcagaaactggccgaacgtttgaacatcaagatgcggagctacaatccggagggggaatcatctggaagatatagagaggtgcgagacgaggatgacgattggagcagcgacgagttttag

SEQ ID NO: 20196 - DNA, 1092 bp, Artificial Sequence
  Description of Artificial Sequence: Synthetic coding sequence
atgtgcagcctgccccggggcttcgagccccaggcccccgaggacctggctcaaaggtcgcttgtggagctgagggaaatgctgaaaaggcaagagcgcctgctcagaaatgaaaaattcatctgcaagctacctgacaaagggaaaaaaatattcgacagctttgccaaacttaaggccgccattgctgaatgcgaggaggtacggagaaaatctgaactgttcaaccccgtgagtctcgattgtaagctgaggcagaaggcaatcgcggaggttgacgtaggcactgataaggcacagaactcagaccccatactggacacgagctctttagtgccagggtgctcatcagttgacaacataaaaagcagccagactagtcagaaccaaggtctaggaagacctactctggaaggagacgaagagacgagcgaagtagaatacacagtgaacaaaggtcccgcctcttctaatagagacagagtgcccccctcaagtgaagcttcagagcaccatccgagacaccgggtaagttctcaggcagaggatactagtagcagttttgacaatctatttatcgataggttacagaggattacaatcgccgatcagggagaacagcaatccgaggagaatgccagtacaaagaatctaacggggctctcttccggtactgagaaaaaaccgcattatatggaagtgttggaaatgcgggctaagaaccctgtaccccagctgcgcaaatttaagactaacgtgctaccctttcggcagaacgacagctcatcacattgccagaagagtggttcccccatttccagcgaagagcgtaggagacgagataagcagcaccttgacgatatcaccgcagcccgtctcctgcccttgcaccatatgcccacacagctactgtctattgaggagtctctggcacttcagaaacaacaaaagcaaaactatgaagagcgccctttctattcaccgcaatacagatcctccatgaacctcttatccctggccgctgctgcaaaggatacccgagggtcaaaaagtggcaagatgggaagtctcgccctgctcaccaaactgtag

SEQ ID NO: 20197 - DNA, 1605 bp, Artificial Sequence
  Description of Artificial Sequence: Synthetic coding sequence
atgacccaggccgagatcaagctgtgcagcctgctgctgcaggagcacttcggagagatagtcgagaagattggggtgcacctgattcggacaggctcccagcccctgcgtgtaattgcacacgatacagggacgtcccttgaccaggtgaagaaggctctatgtgtcttggtacagcataatcttgtatcatatcaggtgcacaagaggggggttgtcgaatatgaagcccaatgctccagggttttgaggatgttgcgctaccctcgctatatctacaccaccaagaccctgtattctgacactggcgagctgatagtagaagaacttctcctcaatggcaagctcaccatgtccgccgtggtgaagaaggtggctgacaggctaaccgaaactatggaggacgggaaaacaatggattatgctgaggtctctaatacattcgtgaggctagctgatacacactttgtgcagaggtgcccctctgtgccaaccacagagaacagcgaccctggacctcctccaccagcccccactctggtgattaacgagaaggatatgtatcttgtgcctaaattgagtctgatcggaaaagggaagcgccgaaggagtagtgatgaggacgctgcgggcgagccgaaagctaaaagacctaaatacaccactgacaacaaggagcccatccccgatgacggaatttattggcaggcaaatcttgaccgcttccatcaacacttccgggatcaggctatagtttcagccgtggcgaaccgcatggaccagacatcatctgagatcgttcgtacaatgttgcgcatgtctgaaatcactacgagctcatccgcccctttcacacagccactttcttctaacgagatcttccgaagcctgccagtgggatacaacatctcgaagcaggtgctcgaccagtatctcactctgctcgctgacgatccactcgaattcgtcggaaaatctggagacagtggcgggggtatgtacgtgataaaccttcacaaagctttggcctcccttgcaacggcaaccttagagtccgttgtgcaggagcggttcggatccagatgcgctcgcatcttccgcttggtgttgcagaaaaaacacatcgaacagaaacaggtggaggatttcgcaatgatcccagctaaggaagctaaggatatgctctacaaaatgcttagcgaaaatttcatgtcccttcaggaaatccccaagacacctgaccacgctccctcaagaactttttacctgtataccgttaacattttatctgcggcccggatgttactccaccgctgttataagagcattgccaatctcattgagcgcagacagtttgagacaaaagaaaacaaacgactattagaaaagtcccagcgggtggaagctatcattgcttccatgcaggccacaggggccgaagaagcgcagctacaggaaatcgaggagatgatcacagcaccagagcgccaacaactcgagaccctgaagcggaacgtcaacaagctggacgcctccgaaatccaggtggacgaaactatttttctactggagagttacatcgaatgcacgatgaaacgccagtag

SEQ ID NO: 20198 - DNA, 1236 bp, Artificial Sequence
  Description of Artificial Sequence: Synthetic coding sequence
atgacccaggccgagatcaagctgtgcagcctgctgctgcaggagcacttcggggagattgtcgaaaagataggagtgcatctgattaggacaggctcgcagccccttagagtgattgcgcacgacaccggcactagtcttgaccaagtgaagaaggcattatgtgtgcttgtgcagcacaatctcgtgtcttatcaagtgcacaagaggggtgtcgtagaatacgaagcccagtgtagccgggtgttgaggatgctccgatatccccgctatatctacactacaaagactctgtattcggatactggggagttaatcgtggaggaactactgctcaatgggaaactgacaatgtcagctgtggtcaaaaaggtggccgacaggctgacggagacaatggaagatgggaaaactatggattatgctgaagtgagcaatacattcgtccgattagcagacacacacttcgtccagcgttgccctagcgtcccaacgaccgaaaactcagatccaggcccgccacctcccgctccaaccttagtaattaatgagaaagatatgtatctggtgccaaagctgtcgctcattggcaaggggaaacgtcggcgttcctccgacgaggacgcggccggggagccaaaggcgaagagacccaaatatacaactgataacaaggaacctatacctgatgatggaatttattggcaggctaatttggaccggttccaccagcacttcagggatcaggccatcgtctccgctgtggccaatagaatggatcagacatcaagcgagattgttagaacaatgttgaggatgagtgagatcactacctctagctctgcccccttcacgcaacccctgtcatcaaacgaaatcttcaggtcattgccagtagggtacaacatcagcaaacaggttcttgaccagtatttgaccctgctggccgacgaccccctggagtttgtcggcaaatctggtgactcaggtggtgggatgtacgtcatcaacctccacaaagcactggcaagtctggccacagctacacttgaatctgtggtgcaagaaagattcggcagccggtgtgcgagaatctttcgtttggtcctgcagaaaaaacacatcgaacagaaacaggtggaggactttgccatgattcccgcgaaggaggctaaggacatgctgtataaaatgcttagcgaaaactttatgtcccttcaagttggatgtcaatag

SEQ ID NO: 20199 - DNA, 1197 bp, Artificial Sequence
  Description of Artificial Sequence: Synthetic coding sequence
atgagcgagggcaacgccgccggcgagcccagcacccccggcggcccaagaccactgttaacaggggccagagggctgatcggccgtagaccggcaccaccattgacgcctggaagactgccttctatccgtagtcgggacctgactctcggaggcgtgaagaagaagacattcacacccaacataattagcagaaagatcaaggaggaacccaaagaggaggtgaccgttaaaaaagaaaagcgcgaacgggaccgcgatcgacagcgcgagggccacggaaggggcaggggcaggcctgaagtgattcaaagccacagtattttcgagcaggggcctgccgagatgatgaagaaaaagggaaactgggacaaaacggtggatgtaagcgacatgggcccttcccatattatcaatatcaagaaggaaaagagggaaaccgacgaggaaacaaagcagatcctgcgtatgctggaaaaggatgattttctggacgatccaggcttaaggaacgacactaggaatatgcctgtccagctcccgttggcacactcaggctggctattcaaggaagaaaacgatgagccggatgtgaagccctggctggctggcccaaaagaggaagacatggaggttgacatacctgcagttaaagtgaaagaagagcctagagatgaggaagaggaggcaaaaatgaaggcaccccccaaggctgctcgcaaaacccctggactccccaaggacgtctctgtggcggagctgttacgagagctttccttaactaaggaggaagagcttctttttctgcagttgcccgataccctgccaggacaacctccaacccaagacattaagcctatcaaaacggaagtgcaaggggaggatgggcaagtggttctgattaaacaagagaaggaccgggaggccaagctcgcggaaaatgcttgcactctagcagacctgacagagggccaggtgggaaagctacttatcagaaaatctgggcgtgtccagctgctcttgggtaaagtcactcttgacgtaacaatgggcactgcctgctcctttctgcaggagctcgtcagtgtagggttgggagacagccggacaggagagatgactgtgcttggtcacgtgaagcacaaactggtatgttctccagattttgaatccttactggaccataagcaccgttag

SEQ ID NO: 20200 - DNA, 1197 bp, Artificial Sequence
  Description of Artificial Sequence: Synthetic coding sequence
atgagcgagggcaacgccgccggcgagcccagcacccccggcggcccccggccgctgttaactggggcaaggggcctgatcggaagacgcccagccccccccctgaccccagggcgcttgccatctatccgatccagagacctaacattaggcggagtgaagaagaagacattcacgccgaacatcatttccaggaagattaaagaggagcccaaagaggaggtgactgtgaaaaaggaaaaacgagaacgcgatcgagaccgccagcgtgagggacacggccgtggcagggggcgacctgaagtgatacagagtcacagcattttcgagcagggccccgcagaaatgatgaaaaagaagggaaattgggataagaccgtggatgtgagtgacatggggccctcccatattattaatattaagaaggagaaacgcgagactgacgaagagactaagcaaatattacggatgcttgagaaagacgattttcttgacgacccagggcttcggaacgacactagaaatatgcccgtgcagctgcctttggcccacagtgggtggctcttcaaagaggaaaacgacgagcctgatgttaagccatggttggcagggccaaaagaggaggatatggaggtggacattccagccgtgaaggtgaaggaagagccccgcgacgaagaagaggaagctaagatgaaagcgccccccaaggcagcccggaaaacgccgggcttaccaaaggatgtgagcgtcgcagagttgctgcgcgaactgtcgctgacgaaggaagaggagttgctcttccttcagctgcctgatacactgccaggccagccacccactcaggacataaagccaattaagaccgaagtgcagggcgaagacggccaagtggtgctcataaaacaggagaaggatcgggaagccaagctcgctgagaatgcgtgcactctagcggacctcactgagggtcaggtagggaagcttttgatacgcaagtccggacgagtgcagctgctgctgggaaaagtcacattagatgttactatgggtactgcctgttctttccttcaggagctggtgtcagtggggctcggagactcccgaacgggagagatgactgttctcggacacgtgaaacacaagctagtgtgttcacccgattttgagtccctcctcgatcataagcaccgatag

SEQ ID NO: 20201 - DNA, 2127 bp, Artificial Sequence
  Description of Artificial Sequence: Synthetic coding sequence
atggccaacgaggaggacgaccccgtggtgcaggagatcgacgtgtacctagccaaatcacttgccgagaagctttacctgttccaataccccgtcaggcccgcgtcgatgacctacgatgacattccccatctcagcgcaaagattaaacccaagcaacagaaagtggagctggagatggccatagatactctgaacccaaattattgtcgctcgaagggtgagcagatcgctctgaatgtggatggtgcttgcgccgacgagacctcaacctattcgagcaagttaatggacaaacaaaccttttgtagctctcaaaccacatccaacacttcgcgttatgctgccgctctgtatcgccagggagagctgcacctcacgcccctccacggtatcctgcagttgagaccgtcctttagctacctcgataaagcagatgcaaagcaccgcgagcgagaagcggcaaatgaggcgggcgacagttcccaagacgaagcggaagacgacgtgaagcagatcacagtgcgcttttctagaccagagtctgagcaggcccgacagagaagagtccaaagctacgaatttctccaaaaaaaacacgcagaggaaccatgggtgcacttgcactactacggtctgagggattctcggtctgaacacgagcgccagtatctgctttgcccaggaagcagcggcgtagaaaatacagagcttgtaaagtctccatctgagtatctgatgatgctaatgccaccttcccaagaggaagagaaagacaaaccggtagcaccctctaatgtgcttagcatggcgcagctccggaccctgccgctggctgatcaaattaagattctgatgaaaaacgtgaaagtcatgcctttcgctaaccttatgagccttctcggcccaagcatcgactcggtcgccgtgctgcggggaatccagaaggtagctatgctggtgcaaggcaactgggttgtgaaaagcgatattctatatccaaaggactcaagttccccacatagcggcgtcccggcagaagtcctgtgccggggacgagactttgtgatgtggaaattcacccaaagcagatgggtggtgcgaaaggaggtcgccaccgtgactaagttatgtgccgaagatgtaaaggatttcctggagcatatggctgtggtcaggataaacaagggctgggagtttatcctcccatatgacggcgagtttattaaaaagcaccctgacgtggtgcaacggcagcacatgctgtggacaggcatccaggctaaactggaaaaggtgtacaatctggtaaaggaaacgatgcctaaaaagccagatgctcaatcaggaccagctgggttagtgtgcggcgatcagagaatacaagttgcgaagactaaggctcagcaaaaccacgcactccttgagcgggagctacagcggcgaaaagagcagttgagggttcccgccgtcccacccggggttcggatcaaagaagaaccagttagcgaagagggggaagaggatgaggagcaggaagccgaggaggaaccaatggacactagtccctcaggtctccatagtaaattggcaaacggtctaccactgggacgagctgctggaaccgactcattcaacggacaccccccccaggggtgtgctagcacccctgttgctagagagctgaaggcgtttgtagaagccacttttcagcgccagtttgtgctgaccctttccgagcttaagcgactgtttaatcttcatctagcaagcctgccacccggccataccctgtttagcggtatttctgatcggatgctgcaagacacagtgctggcggccgggtgtaaacaaattctcgtaccattccctccccagaccgcggcttctcctgatgaacagaaggtatttgccctgtgggaaagcggggacatgagcgatcagcaccgtcaggtcctcctggaaatctttagtaaaaactatagagtgcgcaggaatatgattcagagtaggcttacacaggagtgcggagaagacctcagtaagcaggaagtcgacaaggtgttgaaagactgttgcgtgtcctacggaggaatgtggtatctgaagggcacagtgcaaagctag

SEQ ID NO: 20202 - DNA, 2001 bp, Artificial Sequence
  Description of Artificial Sequence: Synthetic coding sequence
atggccaacgaggaggacgaccccgtggtgcaggagatcgacgtgtatcttgctaaatccttagctgagaagctgtacctgtttcaatatcccgtcaggccagctagtatgacctatgacgatatcccacaccttagcgcaaaaatcaagccgaagcagcaaaaagtggaactagaaatggccatcgatacactaaatcccaactattgccgctctaaaggggagcaaattgcactgaatgtggacggggcctgtgcagacgaaacttcaacttattccagtaagctcatggataagcaaactttttgttctagtcagaccaccagcaacacctcccgctatgcagctgccctgtatcggcaaggtgaacttcacctgacccctctccatggcattctccagctgagaccgagctttagctatttagacaaggcggatgcaaaacacagggagcgcgaagccgcaaacgaggcgggagatagctctcaggatgaagctgaagatgacgttaaacagataacggtgagattttcacgccccgaaagcgagcaggctcggcaacgtagggtacaaagttacgaatttttacagaagaaacacgctgaggaaccatgggtccatctgcattactatgggctgagagactccaggtccgaacatgagagacagtatctcctctgtccaggcagctcaggggtggagaacaccgaactcgttaagagcccatcagagtatcttatgatgttaatgcccccctctcaggaagaggaaaaggataagcccgtggcacccagcaacgtgttatccatggcacaactgcggaccctgcccctggcagatcagattaaaatcctgatgaagaatgtgaaggtgatgccgtttgcaaacttgatgtccctgctcggtccctccatagattccgtcgccgttctccgggggattcagaaggtggccatgctggtccagggcaattgggtggtcaaatccgatatcctgtatccgaaggatagcagttccccccatagcggcgtgccagctgaggtgctgtgtagaggccgggacttcgtgatgtggaagtttacccagagcagatgggtcgtgcgcaaggaagtggcaactgtgacaaaactctgcgctgaggacgttaaggatttcctggagcacatggccgtggtacgtattaataagggctgggaattcattctgccctatgacggcgaatttatcaagaaacaccccgacgtggtccagcgccagcacatgctctggaccggcattcaggccaaattggaaaaagtatacaacctggtcaaggaaactatgccaaagaagccggacgcacaatcgggacctgctgggcttgtgtgcggtgaccagaggatccaagtcgctaagacaaaggcccaacagaatcatgctcttcttgagcgcgagctccagagacggaaggaacagctgagggttcctgctgtccctccaggggtgcgcattaaggaagagccagtatctgaagaaggcgaagaagatgaggaacaggaggccgaggaagagcccatggacaccagcccatcaggcctccatagcaagttagctaacgggttgcccctcggaagagccgccggcactgactcttttaatggccatccgccacagggatgtgcgagtacccccgtggcccgcgaactgaaagctttcgtagaagctacgttccagagacagttcgttcttaccctaagcgagcttaagcgcttgttcaaccttcatctggctagtctgcctccaggacataccctgttttccggcattagtgatcgcatgctgcaggatacagtcctggccgcaggttgcaaacaaattctggtacctttcccccctcaaacagctgcatcacccgacgaacaaaaagtattcgcattatgggaatctggcgatatgtcggaccaagactgctgcgtaagttacggagggatgtggtatttgaaggggacagtgcagtcttag

SEQ ID NO: 20203 - DNA, 2019 bp, Artificial Sequence
  Description of Artificial Sequence: Synthetic coding sequence
atggccaacgaggaggacgaccccgtggtgcaggagatcaagcccaagcagcagaaggtggaactggagatggcaatagataccctgaacccaaactactgccggtcaaagggagaacagatcgcgttgaatgttgacggcgcttgcgcagacgagacctcaacgtattcatccaagctgatggataaacaaactttctgttcctctcagactaccagcaacacatctcggtacgcagcagccctgtaccggcaaggtgagctacacttgacaccattacatggaatcctccagttgcgcccctctttttcctacctcgacaaggccgatgctaagcatagggagcgagaggccgccaacgaggccggagatagctcccaggacgaagccgaagacgacgtgaagcagatcactgtccgtttcagccgccccgagagcgagcaggctaggcagcgacgcgtccagagctatgaattcctgcagaaaaaacacgccgaagagccttgggtgcacctgcactattacggtctcagggatagccgatccgagcacgaacggcagtacctgctgtgtccgggatcaagtggggtcgaaaacacagaacttgtgaaatcacccagcgaatacctaatgatgttgatgccaccatctcaggaagaggagaaagataagccggtcgctcctagtaacgtgttgagcatggcccagctaagaacactgcccttagccgatcagattaaaatcctcatgaagaatgtaaaggtcatgccatttgccaacctcatgtcactgctcgggccctccatcgattcagtggccgtgcttagaggaattcaaaaagtggcgatgctggttcaaggaaattgggttgtcaaatctgatattctttaccctaaggatagctcttcacctcatagcggtgttccagccgaggtgctgtgcaggggtcgggattttgtgatgtggaagtttacacaatcgcgctgggttgttaggaaagaagtcgccacagtaaccaaactctgcgccgaagacgtgaaggattttctagagcacatggctgtggtgagaatcaataaaggttgggaatttattttgccttatgatggcgaatttattaagaagcatcccgacgtggtgcagaggcagcacatgctatggacgggaattcaggctaaactcgaaaaggtgtacaaccttgtgaaggagacaatgcctaagaaaccagacgcgcagtccggcccagccggactagtttgtggtgatcaacgaattcaggtggccaagacgaaagctcaacagaaccacgcccttttggaaagagagctgcagagacgtaaggaacagctccgcgtcccagccgttcctcccggggtccggattaaagaagagcccgtgagcgaggaaggagaagaggatgaggaacaagaggctgaggaggagcctatggacacatcaccttctggactccattccaaacttgctaacggactgccattgggacgagccgcggggactgacagctttaatggtcacccaccacagggttgcgcatccacccctgtggcacgcgaattaaaggcctttgtcgaagctactttccaaagacaatttgtcctgaccttaagcgaattgaagcgcctgtttaacctccacctggcttctctgcctcccgggcacactctcttcagcggtatatcggacaggatgttacaggacactgtcctcgccgctggttgtaagcagattcttgtaccttttccaccacaaaccgccgccagtcctgacgagcaaaaggttttcgcactctgggagtccggcgatatgtctgatcagcaccgccaggtactgctggaaattttttctaagaattatcgcgtgcgacgcaatatgatccagagccggctgactcaggagtgtggtgaagacttgtctaaacaggaggtggacaaagtgctaaaggactgctgtgtctcttacggaggcatgtggtacctgaaaggaacagtgcagtcatag

SEQ ID NO: 20204 - DNA, 2064 bp, Artificial Sequence
  Description of Artificial Sequence: Synthetic coding sequence
atggccaacgaggaggacgaccccgtggtgcaggagatcgacgtgtacctcgccaaatcacttgccgagaaattgtacctgttccagtatcctgtcagacctgctagcatgacttacgatgacatcccccatttgagtgccaaaataaagcccaaacaacaaaaagtcgagttagagatggccatcgacacactgaacccgaactattgcagatctaaaggcgagcagattgctctcaacgtggacggagcttgcgccgacgagactagcacttattcctctaagctgatggataaacaaactttctgctccagccagactacatctaacacctcaaggtacgcagccgcactgtaccgccagggggagctgcacttaacaccgcttcacgggatcctgcagctgcggcccagcttctcatatttggataaagccgatgctaagcatcgggagagggaagcagctaacgaggccggagattcttcacaggacgaggccgaggacgacgttaagcagatcaccgtccggttcagccgcccggaatcagagcaagcccggcagcgccgagttcaatcttacgagttcttacagaaaaagcatgctgaagaaccatgggtgcatctccattactacggcttaagagacagtcggtccgagcacgaacggcagtacttactctgcccaggaagctcaggcgtggaaaataccgagttggtcaaaagtccctccgaataccttatgatgctgatgcctccttcacaagaggaagaaaaggataaacccgtggccccatcaaacgttttaagcatggctcaactgcgtaccctgccattggccgaccagataaagattctgatgaaaaacgtgaaggtgatgccattcgcaaacctgatgtccttgctgggtccaagcattgattccgtggcagtccttaggggaattcaaaaggtggccatgctggtacagggcaactgggtagttaagtctgacatcctctacccgaaagactctagctcccctcattcaggtgtgcctgccgaagtgctgtgcagaggccgcgacttcgtaatgtggaagttcactcaatcgcggtgggtggtgaggaaggaagttgccactgtgactaagctctgcgcagaggacgtgaaagactttctggaacatatggctgtggtcaggatcaacaaaggctgggaatttatcctgccctacgacggggagttcatcaagaagcaccccgacgtggtgcagaggcaacatatgctctggaccgggattcaggctaagttggaaaaggtgtacaacctggttaaggaaaccatgccaaagaagcctgacgcccagtccggaccggcaggcctggtgtgcggcgaccagcggatccaggtagccaaaaccaaagctcagcagaaccatgcactactggagagagaattacagaggagaaaagaacagttgagggttcctgccgtgccaccaggcgtgaggataaaagaggagcccgtcagtgaggagggcgaggaggatgaggagcaggaagccgaagaagaaccaatggatacctcgcccagtggtctgcactccaagctggcgaatggactgccactagggcgagcggccggaacagattcgtttaatgggcaccccccccaagggtgcgctagtactcctgttgcacgagagttgaaggctttcgtggaggcaacattccagcggcagtttgtcctcacactgtctgagctgaagaggctgtttaacctgcacctggcatctctgccccccgggcacacacttttttctggcatctccgacagaatgctgcaggacaccgttctcgcagcaggatgtaaacagattcttgtgccctttccaccccagaccgccgcgtcccccgacgaacaaaaagtgttcgctctgtgggagtcaggcgacatgagtgaccagagcagattaacgcaggagtgcggagaagacctgtcgaagcaggaagtagataaagtcttaaaagactgctgtgtttcctatggcgggatgtggtacctgaaggggactgtccagagctag

SEQ ID NO: 20205 - DNA, 951 bp, Artificial Sequence
  Description of Artificial Sequence: Synthetic coding sequence
atggccgaggtgaaggtgaaggtgcagccccccgacgccgaccccgtcgaaattgagaacagaatcattgagctctgccaccagtttccacacgggatcaccgatcaggtcatccagaatgagatgccacacatagaggcgcaacagcgggcagtggccattaaccgtttactgtccatggggcaacttgacctcctacgctcaaatacaggtttgctctatcggataaaggactctcagaacgctggcaaaatgaaggggagcgataaccaggaaaaactggtgtaccaaataattgaggacgccggtaataaaggtatctggtcacgagatattagatataaatcaaatttgcccctgacagaaattaacaagattctgaaaaacctggaaagcaagaaactcatcaaagcagttaagagcgtcgcagcctccaagaaaaaggtgtatatgttatataacctccagccagatcgtagcgttaccggtggagcttggtactctgaccaggattttgaatcggagttcgttgaggtgctgaaccaacagtgctttaagtttctccagtctaaggcagagaccgcgcgcgagtctaagcaaaatccgatgatccagcgcaactcctcattcgcctcttcccatgaggtgtggaaatatatctgtgagctgggaatttccaaagtggagctctctatggaggatatagagacaatcctgaacaccctcatctatgatggtaaagtcgagatgactattattgccgcaaaggaagggacagtcggctctgtggacggccatatgaaactgtatagagcggtcaaccccataatacccccaacgggcctcgtccgagcgccttgcggcctctgcccagtgtttgacgattgccacgaaggcggggaaatatctcccagcaactgcatttacatgacagagtggttagagttctag

SEQ ID NO: 20206 - DNA, 672 bp, Artificial Sequence
  Description of Artificial Sequence: Synthetic coding sequence
atggccggcaacaagggccggggccgggccgcctacaccttcaacatagaggcggtggggttctccaaaggagaaaaactgcccgacgtggtgctaaaacctcctcctctgttcccggatacagattacaaaccggtacccctgaaaacaggagagggcgaggagtatatgctggctctgaaacaggagctacgggagaccatgaagcgcatgccatattttatcgagacaccagaagagcgacaggacatcgagagatactccaagcggtacatgaaagtatacaaagaggaatggattccagattggagacggcttccacgggaaatgatgcctagaaacaagtgcaagaaagctggccccaagccaaagaaggctaaggatgcaggaaaagggactccacttaccaacacagaagacgtgctgaagaaaatggaggaactggagaagcgcggcgatggagaaaagagcgacgaagagaatgaggaaaaggagggttccaaagaaaagtccaaggagggtgatgacgatgacgacgatgatgctgctgagcaagaagaatatgacgaggaggagcaggaagaggaaaacgactacattaactcctactttgaagatggtgacgattttggagctgacagtgatgacaacatggatgaggccacctattag

SEQ ID NO: 20207 - DNA, 672 bp, Artificial Sequence
  Description of Artificial Sequence: Synthetic coding sequence
atggccggcaacaagggccggggccgggccgcctacaccttcaacattgaggctgtaggcttttcaaaaggtgaaaaactgcctgatgttgtgttaaaacctcctcctctgtttcccgacacagactacaagcccgttcctttgaaaaccggcgagggggaagaatacatgttggctcttaagcaggaacttcgtgagacgatgaagcgcatgccatacttcattgagacgcccgaggagcgacaggacattgaacggtactccaagcggtatatgaaagtctacaaggaagagtggatacctgattggcgccgcctcccccgggaaatgatgcctaggaacaagtgtaagaaggccgggccgaaacccaaaaaagcgaaggacgccggtaaaggcacgcccctaactaatactgaagacgttctgaagaaaatggaggagctggaaaaacgaggagacggtgagaagagcgacgaggagaatgaggagaaggagggctctaaggagaagagcaaagagggggatgacgatgatgatgacgacgccgccgaacaggaggagtacgatgaagaggagcaagaagaggaaaacgattatatcaacagctacttcgaggatggagacgactttggagcagatagcgacgataacatggacgaagctacctactag

SEQ ID NO: 20208 - DNA, 528 bp, Artificial Sequence
  Description of Artificial Sequence: Synthetic coding sequence
atgttcgtgctggtggagatggtggacaccgtgcggatccccccctggcagttcgagcgcaagttgaacgacagtatagctgaggaactgaacaaaaaactggctaacaaggtcgtgtataatgtcgggctgtgtatctgtctgtttgatattacgaagctggaagacgcatacgtgttcccaggcgacggagccagccataccaaagtgtcactggggttctttgacgatatactgattccgcccgagagtctgcaacagccagcaaagttcgacgaggccgagcaggtttgggtctgggaatatgagactgaagagggagcccacgatttgtatatggacacaggggaagaaatcagattccgcgtcgtagatgagagctttgttgacacctcccctacaggaccttcctccgcagatgctacaacaagttctgaggagcttccaaaaaaagaggcaccttacacactcgttggatctattagcgaaccaggcctggggctcttaagctggtggacatctaactag

SEQ ID NO: 20209 - DNA, 615 bp, Artificial Sequence
  Description of Artificial Sequence: Synthetic coding sequence
atgttcgtgctggtggagatggtggacaccgtgcggatccccccctggcagttcgaacgcaaacttaatgattctatcgctgaggaactgaataagaagctggccaacaaggttgtttacaacgttggcctttgcatatgcttgtttgatattaccaaattggaggacgcatatgtcttcccgggagacggcgcatcacatacaaaggtgcatttccgatgcgtggtctttcacccgttcctagatgagatcctcatcgggaagataaagggttgcagtcctgaaggggtgcatgtctcactgggcttctttgacgacatcttgatcccacccgaatccctgcagcaacccgcgaagttcgacgaggcagaacaggtttgggtctgggagtacgagaccgaggaaggcgctcatgatctgtacatggacacaggcgaggagatccggttccgcgtggttgacgagtccttcgtggatacaagtcccaccggtccaagtagcgccgacgctacaacctcttccgaagaattgcctaaaaaggaggccccctatacccttgtgggcagtatttcagagcctggcttgggtctgctttcgtggtggacaagcaactag

SEQ ID NO: 20210 - DNA, 615 bp, Artificial Sequence
  Description of Artificial Sequence: Synthetic coding sequence
atgttcgtgctggtggagatggtggacaccgtgcggatccccccctggcagttcgaacggaaactgaatgactctattgcggaagagctcaataaaaagctggctaataaagtcgtatacaacgtcggcctctgcatctgcctgttcgacatcacaaagttggaagacgcttatgtattccctggcgacggagccagccatactaaggtgcacttccggtgtgtcgtgttccatccttttctggacgagatcttaattggtaagatcaaaggatgcagtcctgaaggagtgcacgtgtcgttgggctttttcgacgacatcctgatccctcccgagtctttacagcagccggcaaagtttgatgaagccgaacaggtatgggtctgggagtatgaaacagaggaaggggcacatgatctgtacatggatactggtgaggaaattagattccgggtggtggacgagtcgtttgtcgacacttctcctaccggcccatcttccgccgatgcgactacttcatcagaggaactgcctaaaaaagaggccccgtatacgcttgtgggatccatctcggagcctggcctcggtctcctgtcatggtggacttccaattag

SEQ ID NO: 20211 - DNA, 615 bp, Artificial Sequence
  Description of Artificial Sequence: Synthetic coding sequence
atgttcgtgctggtggagatggtggacaccgtgcggatccccccctggcagttcgagcggaagttgaatgattccattgctgaagagctcaacaagaaacttgcaaacaaagtggtttacaacgtggggctgtgtatatgccttttcgacattacaaaactcgaggatgcatacgtctttcccggcgatggggcttctcacacgaaagtgcattttcgctgcgtggtctttcaccccttcctggatgagatcctcattggcaaaattaaggggtgcagcccagaaggggttcacgtgtcactgggcttctttgatgacattttgatcccaccagaatccctccagcaaccggccaaattcgatgaagccgaacaggtttgggtgtgggagtacgagaccgaagagggcgcccatgatctttatatggacacgggcgaggaaattagatttagagtcgtggatgagtctttcgtggacactagcccgaccggccccagttccgcggatgcgacaacctcctctgaagaattgccaaaaaaagaagctccctatacacttgtgggtagtatttctgagccgggcctcggcctcttgtcttggtggacatcaaattag

SEQ ID NO: 20212 - DNA, 327 bp, Artificial Sequence
  Description of Artificial Sequence: Synthetic coding sequence
atgctgctgttctgccccggctgcggcaacggcctgatcgtggaggaggggcaacgatgtcataggttttcctgtaatacctgcccgtacgtacacaatatcaccagaaaagtgaccaatagaaagtacccgaagcttaaagaggtggacgacgtcctgggcggcgctgctgcctgggagaacgtggatagcactgcagaatcctgcccaaaatgcgaacacccccgggcttactttatgcagctgcagacacgtagcgccgatgagcctatgaccaccttttacaaatgctgtaacgctcagtgcggtcacagatggagggactag

SEQ ID NO: 20213 - DNA, 771 bp, Artificial Sequence
  Description of Artificial Sequence: Synthetic coding sequence
atgagccggaagaagacccccaagagcaagggcgccagcacccccgccgcctcaacactgcccaccgccaacggtgctcgccccgcccggtccggcactgctttgtccgggccagatgcacctcccaacggcccacttcagcccggtaggccttcactcggggggggcgtggacttctacgacgtggccttcaaagtgatgctggtgggggactctggtgtcgggaagacctgtttgcttgttaggttcaaggatggggccttcctcgccggaacctttatctccactgtggggatcgacttcagaaacaaagtgttagacgtcgatggagtcaaggtcaaactccaaatgtgggatacagctgggcaggagagattcagaagtgtaacccacgcttattatcgcgacgctcacgcgttactgctattgtacgatgtcaccaacaaagccagcttcgataatattcaggcctggctgacagaaattcacgagtatgctcagcatgacgtggctctaatgcttttgggcaacaaggtagacagcgcgcatgagcgggtggtgaagcgggaggatggagaaaagttggctaaggagtatgggctcccatttatggagaccagcgcaaaaacaggccttaacgtagacctggcattcacagccattgctaaagagctgaagcagaggtcaatgaaggcaccaagcgagccacggttcagattgcacgattacgtgaagcgggaaggtcggggcgcttcttgctgtaggccttag

SEQ ID NO: 20214 - DNA, 1668 bp, Artificial Sequence
  Description of Artificial Sequence: Synthetic coding sequence
atggacggcgtggtgaccgacctgatcaccgtgggcctgaagcggggttccgatgagcttctgagttcaggcattataaatggtccatttactatgaacagcagtaccccctccacaggtgtttacgctaatgggaacgattccaagaagtttaagagagataggccgccctgcagcccctcacgggttttgcatctaagaaagatcccatgtgatgtgacagaggcagaaatcattagcctgggcctgcccttcggaaaggtcaccaacctattgatgttgaagggcaaaagccaggcctttctggagatggccagtgaagaagcagctgttacaatggtgaattactacacacctatcactccacacttacgaagtcaacctgtctacatacaatactcaaaccaccgtgagctgaaaaccgacaatctgcccaatcaagcccgcgcccaagctgctctccaggccgtcagtgccgtgcagagcggctcgctagccctctctgggggccccagcaatgaagggacggtgctcccaggacagagccccgtgttgcgcatcattatagagaacttattctatcccgttacattggaagtactgcaccaaattttctcaaagttcggcacagttttgaagatcattacctttacgaagaacaaccagtttcaggctctactgcagtacgcagaccctgttaacgcacactacgccaaaatggctcttgacggacaaaacatctacaacgcctgctgcacactgcggattgatttttccaaactgacatcgctaaacgttaaatacaataatgataaaagtcgcgactttaccagactcgacctgcctacaggcgatggccagccgtccttggagcctccaatggctgcagcctttggagcgccagggattattagttctccgtatgctggtgcggctgggttcgctcctgccattggattccctcaggcaacgggcctttccgtccccgctgtgcccggagcactggggccattgacaataacctcctcagccgtcacgggcagaatggcaatcccaggcgccagcggcatcccaggtaacagtgtgctgttagtgactaacttgaacccggatcttatcacaccccacggtctgttcatcttgtttggggtgtatggtgatgtgcatcgggtgaagattatgtttaataagaaagaaaatgctctggtgcagatggcggacgcaaaccaggcacaactcgcgatgaaccatctcagcgggcagaggctgtatggcaaagtgctcagagccaccctgagcaagcaccaggccgtgcagctgccccgtgagggacaagaagaccagggactgacaaaggactttagcaactctccactccaccgatttaaaaaacccggatccaagaactttcagaatatatttccccctagcgccacgcttcacctgtccaatatcccacccagcgtcacagtggatgatctgaaaaacctgtttatcgaggctggctgctctgttaaagcttttaagttctttcagaaggaccgcaagatggcgctcattcagctgggctctgtggaggaagctattcaagccctgatagagttgcacaaccatgacctgggggagaaccaccatctacgcgttagcttttcaaagagcactatttag

SEQ ID NO: 20215 - DNA, 1374 bp, Artificial Sequence
  Description of Artificial Sequence: Synthetic coding sequence
atggccttcctggagatggccagcgaggaggccgccgtgaccatggtcaactactatacgccaatcaccccacacctgcgttctcagcccgtgtatatccagtattctaatcaccgtgagctcaagacggacaaccttcccaatcaggcgagggcccaggccgctctgcaagccgtgagtgccgtgcagtccgggtcacttgctctctcagggggaccctccaatgaggggactgtactgccgggtcaaagtcccgtcctcaggatcattatcgagaatctcttttatcctgtgaccctggaagtactgcatcagatcttctctaaattcggtacggtgcttaaaataattacgtttaccaaaaataatcagtttcaggctctattgcagtatgcggatccggtgaatgcacactatgccaagatggctcttgacggccagaatatttataacgcgtgttgcacacttcggattgacttctctaaattgacctctttgaatgtaaagtacaacaacgataagagtagggactttactcgcctagacttacccaccggagatggccagccctccctagaacctccaatggcagctgctttcggtgccccaggtattatctcctctccctacgcgggagcggcaggctttgcccctgccattgggttccctcaagccacggggctcagcgtgcctgcagtaccaggcgcgctagggccgctgaccatcacaagttccgccgtaaccggccggatggcaattccaggcgccagcggtatccctggcaatagcgttctgctggtgacaaacttgaatcccgacctgatcacaccacacggattgtttattttgttcggggtatacggggacgtccaccgggtgaagattatgttcaacaaaaaggagaatgctctggtacaaatggccgacgctaaccaggcccagctggccatgaaccatctaagcggccagaggctgtacggcaaagtcctacgcgccacactgtcgaagcatcaggcagtacaattaccaagagaggggcaggaggaccagggtcttacgaaagatttttccaattcccccctgcaccgatttaaaaagccaggaagcaagaactttcagaacatctttcccccatctgcaactctgcacctgagtaatatcccccctagtgttacagttgatgacctaaagaacctatttatcgaggccggctgttctgtcaaagcgtttaaattctttcagaaagataggaagatggctcttatacagttaggctcggtcgaggaggctatccaggccctgattgagctgcacaaccacgacctgggggagaatcatcacctccgagtctctttctctaagtcaacaatctag

SEQ ID NO: 20216 - DNA, 1659 bp, Artificial Sequence
  Description of Artificial Sequence: Synthetic coding sequence
atggacggcgtggtgaccgacctgatcaccgtgggcctgaagcgggggtcggacgaattgctttcatccggcatcatcaatggaccatttacaatgaactcatctactccatcaaccgctaatggcaacgactcgaagaagtttaagagggaccggcccccatgcagtccctctcgggtgctacatctgcgcaaaattccctgcgacgtcactgaggccgaaattatctccctcggattaccatttggaaaagtgactaacctcctcatgctgaagggcaagagccaggcttttctggagatggcttcagaggaggcggcagtcactatggtcaattactacacccccattacacctcacctccgctcccagccagtgtacattcaatattctaaccaccgggaactgaagactgacaacctgccaaaccaggcacgggcccaggctgctctgcaggcagtgtccgccgtgcagtcggggtccctggctctctcaggaggccctagcaacgaggggacagtgctgcccgggcagagccctgtcttgcgcatcatcattgagaacctcttttatcctgtcacactagaggttctgcaccaaatctttagcaagtttgggaccgtcctgaaaatcataactttcaccaagaacaaccagtttcaggcacttctgcaatacgccgaccctgtcaacgctcactatgcgaagatggccctggatggccaaaatatttataacgcctgctgtaccctcaggattgatttttcgaaattgacgtccctgaacgttaaatacaacaacgataagtcccgtgattttacgcgcctcgatttgccaacaggagacggccagccctctctcgaaccacccatggccgctgcttttggcgctccagggatcatttcttcaccatatgccggggctgcagggttcgctccagccattgggtttccacaggcaaccggcctgagtgtgcccgccgtacccggcgccctgggcccccttaccattacatcctccgctgtcaccggtagaatggcgatccctggcgcatctgggattccaggtaactcagttttgttagtcacgaacctaaatcctgacctgataactccccatgggctgttcattttgtttggtgtttacggggatgtccaccgcgtgaaaatcatgttcaacaagaaagaaaatgccctggttcagatggccgatgctaatcaggcccagttggccatgaaccacctctctgggcaaaggctgtatggaaaagtgttaagagccacacttagcaagcatcaggcagtccagctgccacgggagggacaggaggaccagggtttgactaaggatttctctaatagcccccttcataggtttaagaaaccaggaagtaagaacttccagaatatttttcccccctccgcgacactccacctcagcaacatacccccttctgtcacagtagacgatttgaagaacctttttatcgaggctggctgttccgtcaaagcattcaagtttttccagaaggacagaaagatggctttgatccagctgggatctgtcgaggaggccatccaggcactgatcgagctgcacaatcacgatctcggagaaaaccatcaccttagggtgtctttcagcaaatctactatatag

SEQ ID NO: 20217 - DNA, 1575 bp, Artificial Sequence
  Description of Artificial Sequence: Synthetic coding sequence
atgaacagcagcacccccagcaccggcgtgtacgccaacggcaacgacagtaaaaagttcaaacgagaccggcccccctgcagccctagtcgggttctgcacctgcgcaagattccctgcgatgtaactgaggcagagattattagcctggggctccccttcggcaaggtcacaaacctgctcatgttgaaaggcaaaagtcaggcctttctggaaatggcaagcgaagaagcggctgtcaccatggtgaattattatactccgataacaccgcacctccggtcccagccagtgtacattcagtactctaaccacagagagcttaaaacagacaacctgcccaatcaagcgagggcacaggcagcccttcaggctgtatcggctgtgcagagtggttcactggctctgtctggagggcccagtaacgaagggacagtcctgcccggccagagcccagtgttaagaataattattgaaaatctattctaccctgtcacattagaggtgctgcaccagattttcagcaaatttggtactgtgctgaaaattatcaccttcacaaaaaacaaccagttccaagcacttcttcagtatgctgaccccgtcaacgcccattatgccaagatggctctggacggccagaacatctacaatgcctgctgtaccttgagaatcgacttcagcaagcttacttctctgaacgttaaatacaataacgataagtcgcgggacttcacaaggctagaccttccgactggcgatgggcagccatctcttgagccaccaatggccgctgcctttggagcccctggaattatttctagcccctacgcaggggccgcaggatttgcccccgcaatcggtttcccacaggcaacagggctgtccgttcctgctgtccctggcgctctgggacctctgactattacttcttcagccgtgacagggcgtatggcaatacccggtgcttccgggatacccggtaactcggtccttctcgtgacaaacttgaatcctgatctgattacaccacatggcttgttcatcttgtttggtgtgtatggcgacgttcatcgggtgaagattatgttcaataagaaagaaaacgccttagtgcaaatggctgacgcaaatcaggcccagctggctatgaatcacctaagcggccagcgcctgtacggtaaagtacttcgggccaccctcagtaagcaccaggccgtacagctgccaagagaaggccaggaggaccagggattaacaaaggacttctccaattctcctctccatcggttcaagaaacccgggtccaagaattttcagaacatatttccaccatctgccactttacatctgtcaaacattccaccgtctgtcactgttgatgacttgaaaaacctatttatcgaagcaggctgttcagtcaaggcattcaagttcttccagaaggaccgcaagatggctttgattcagttagggagcgtggaggaggctatccaggctctgattgaactccacaatcacgatctcggagagaaccatcatctccgagtgtctttttctaaatcaactatatag

SEQ ID NO: 20218 - DNA, 234 bp, Artificial Sequence
  Description of Artificial Sequence: Synthetic coding sequence
atggacggcgtggtgaccgacctgatcaccgtgggcctgaagcgggggtcagacgaacttttatccagcggcatcatcaatggcccgtttactatgaattccagcaccccatccactggagtgtatgcgaacggaaatgattcaaaaaaattcaagcgcgataggcctccttgttccccctcgagggttctgcaccttaggaagatcccatgtgacgttactgaggccgagtag

SEQ ID NO: 20219 - DNA, 1677 bp, Artificial Sequence
  Description of Artificial Sequence: Synthetic coding sequence
atggacgccagccccagccccttcagcctgcccaagaagctgaacgagctttccgctcgtcgcggtagcgatgaactgctgtcatcaggtattatcaacggacctttcaccatgaacagctctaccccttctacagcgaacgggaacgatagcaaaaagttcaaaagggatcggcccccgtgcagcccgagtagggtgcttcatcttcgcaaaatcccttgcgacgtcacagaagcggagatcattagcttgggactgcctttcggaaaagtgactaatctcctaatgctcaagggcaaatcccaggcattcctggagatggcttccgaagaggccgccgttaccatggtgaattattacactcccatcactcctcacctcagatctcaacctgtctacattcaatactccaaccatagggagctcaagactgataaccttccaaatcaggcgcgcgcccaagccgccttacaggcagtgtccgccgtgcagtccggcagtctggctttgtcggggggaccttctaacgaggggacagtccttcccggccaatctccagtccttcgcatcatcatagagaatctgttttatcccgtcacactggaggtccttcatcagatcttctcgaaatttggaaccgttctgaaaatcataacgtttaccaaaaacaatcagttccaggctcttctccaatacgccgatccagtgaatgcccattacgctaagatggccctcgatgggcagaatatttataacgcctgctgtaccctccgcattgacttctctaagctgacctctctgaacgtcaaatataataatgacaagtccagggacttcaccaggctcgacctgcccactggagacggtcagccaagcctagaaccccccatggcagcggccttcggtgctccggggatcattagcagcccctacgctggagcagccggatttgcaccggctatcgggttcccccaggctaccggtctttccgttccagcagtgccaggtgccctggggccattgactatcacttcctcagctgtgacgggtagaatggcgatccccggggccagcggcattcctggaaacagtgtgctgcttgtgactaatctgaatcccgatcttatcacacctcatggcctgttcattctcttcggcgtctacggggacgtgcaccgggtcaaaattatgtttaataaaaaagagaacgctctggttcagatggccgatgcaaatcaagcccagctcgccatgaatcacctctccggacagagactgtacggcaaggtgctaagagccacactgtctaagcatcaggccgtccaacttcccagggagggccaggaagaccaggggcttactaaagatttctcaaattcccccttacacagattcaagaagcctggctctaaaaattttcagaacattttcccaccgagtgcgacattgcacctatccaatatccctccgtctgtcacagtggacgacctgaagaatctgtttatagaggcagggtgttccgtcaaagcgttcaagttctttcagaaagaccgcaaaatggctctgattcagctggggtccgtcgaggaggccatacaggccttgattgagctccataaccacgatctgggtgagaatcaccatctgagagtttcctttagtaagtctaccatttag

SEQ ID NO: 20220 - DNA, 1500 bp, Artificial Sequence
  Description of Artificial Sequence: Synthetic coding sequence
atggagaacggccagagcaccgccgccaagctgggcctgccccccctcaccccagaacagcaagaagctctacagaaggccaaaaaatatgcaatggaacaaagcatcaagtcagtactagtcaagcaaacaatcgcccatcaacagcagcagctgactaatttacagatggccgctcagaggcagagagctttggctataatgtgcagagtgtatgttggatctatctactatgaactgggagaggacacaataagacaggcattcgccccatttgggccgatcaaatctatcgatatgagttgggactcagtgactatgaaacataaggggtttgcctttgtggagtacgaggttcccgaggcagcgcaacttgccctcgaacagatgaacagcgtgatgctaggcggccggaatatcaaggtggggagaccgagcaacataggccaggcacagccaatcatagatcagttagccgaggaagcacgagcattcaacagaatctacgtggcctcggtacatcaagacttgtccgacgacgatatcaaatccgtgtttgaggccttcgggaaaattaaatcttgtacgttggctcgcgatcctactaccggtaaacacaagggttatgggttcatcgaatacgagaaagctcagagctcccaggacgcagtgtcttcgatgaacttgttcgatttaggtggacagtacctcagggtcggaaaagctgtaacgccgcccatgccactgttaacacccgccacccctgggggcctgccaccggccgccgccgtggccgccgcagccgctactgccaagattacagcccaggaggcagttgctggcgctgctgttctgggcaccttagggacccctgggctggtctctcccgcgctcaccctcgcacagcctctcggcactcttcctcaggccgtcatggccgctcaggcccctggtgttattactggagttacccctgcgaggcccccaatccctgtcacgatcccatccgtaggcgttgtaaatccaattttggctagccctcccacgttgggactcctggagcctaagaaggaaaaagaagaggaggagctttttcctgagtctgaaaggcccgagatgctcagcgagcaggagcacatgtccatttccgggtcctctgcccggcatatggtgatgcagaagttgctacgaaaacaggagtcaacggtgatggtgctacggaacatggtggatccaaaagatattgacgatgacttagaaggcgaagtaaccgaggagtgtgggaagttcggcgctgtcaatcgagtgataatctaccaggaaaaacagggcgaagaggaggatgccgagatcatcgtcaaaatatttgtcgagttctccatcgcatccgagacgcacaaagcaattcaggcgttgaatggccgctggtttgctggccgcaaagtcgtggccgaggtttacgatcaggagcgattcgataatagcgatctctccgcttag

SEQ ID NO: 20221 - DNA, 1629 bp, Artificial Sequence
  Description of Artificial Sequence: Synthetic coding sequence
atggccaccgccaccatcgccctgcaggtgaacggccagcagggcggcggcagcgagcctgctgcggccgccgcggtagtggccgccggagacaaatggaagcccccccaagggaccgattctataaagatggaaaatggccaatctaccgcagctaagttgggtctccctcctcttacccccgaacagcaggaggccctgcagaaggccaaaaagtatgcgatggagcaatccattaagtcggtcctcgtcaaacagactatcgcacaccaacagcagcagttgacgaacttgcagatggccgctcagcggcaacgcgctctagcgataatgtgccgagtatacgtggggtccatttattatgagctgggcgaggacaccatccggcaggcttttgctccgttcgggcccattaagagcatagatatgagctgggacagcgtgactatgaagcacaaaggattcgccttcgtggagtacgaagtccccgaagcggctcagctggcactggagcagatgaacagcgtcatgctcggcggccgcaatatcaaagtgggtaggccaagcaacataggccaggcccagcccattatagatcaactggctgaggaagctagagcattcaacaggatatacgtggcctctgtccatcaggatctctctgacgacgatatcaagtctgtgttcgaagcgtttggcaagatcaaaagttgcacccttgctagggaccctaccaccggtaagcataaaggctacggttttatcgaatatgaaaaggctcagtcaagccaagatgccgtctctagcatgaaccttttcgatctggggggtcagtatttacgcgtgggaaaggccgtcacccctcctatgccccttctaacacctgctacccctggagggctgcctcccgccgccgctgtcgcagccgctgccgcaactgctaaaattacagcccaggaggcagtggctggagcagccgtgctgggaactctgggtaccccaggtctggtgtctcctgccctgaccctggcacagccgctaggcaccctgcctcaagccgtgatggccgcacaagcccccggggtgatcacgggagtcacacctgctagacctcctattcccgtcactatcccctccgtgggcgtggtcaatccaatcttagcttccccacctaccttgggactgctcgaaccgaagaaagaaaaagaagaggaagaattattcccagagagtgagcgtccagagatgctgagtgagcaggaacatatgagcatatcaggctcctcagcacgccatatggtaatgcagaaactgctcagaaagcaggaaagcaccgtaatggtgctgagaaacatggtggacccgaaggacattgacgatgacctggagggggaggtgaccgaggagtgcgggaaatttggcgctgtcaatagagtgatcatctaccaggagaagcagggcgaagaagaagacgctgagatcatagtgaaaatctttgtcgaattctccatcgcatctgagacccataaggccatccaggccctgaatggtaggtggtttgccggcaggaaagtggtggctgaagtttatgaccaggagaggttcgataatagtgacttaagcgcttag

SEQ ID NO: 20222 - DNA, 1551 bp, Artificial Sequence
  Description of Artificial Sequence: Synthetic coding sequence
atggagaacggccagagcaccgccgccaagctgggcctgccccccctgacacccgaacagcaggaagctcttcaaaaggcaaagaaatacgccatggaacaatcgataaaatccgtcctagttaagcagactattgctcaccagcagcagcagcttacaaacctgcagatggcggccgtgaccatggggtttggcgatccactgtctcccctacagagcatggcagcgcagcggcagagagctttagctataatgtgccgtgtatacgtcggttcaatatactatgaactgggagaagacactatccggcaggccttcgccccttttggtcctattaagtccatcgacatgtcatgggactctgttacaatgaagcacaaaggtttcgcctttgtggagtacgaagtccctgaggccgcgcagcttgcactggagcagatgaactccgtgatgctcggtggacgaaatatcaaagtcgggcgcccctcaaatatagggcaagcgcagccaataatcgaccagctggccgaggaggcccgggcctttaatcgaatttacgttgcgtcagtgcaccaggatctatctgacgatgatataaagagtgtttttgaagcctttgggaaaatcaaatcatgcacacttgcaagggatcccacaactgggaagcataagggctatggatttattgaatacgagaaagctcagtcctcacaggacgctgttagttccatgaacttgtttgacttaggggggcagtacctaagggtcggcaaggccgtcactccacccatgccattactgactcccgctaccccgggggggctgcctccagcagccgccgtggcggccgccgccgctactgcgaagataacagcccaggaagccgtggctggcgctgccgtgttaggaaccctgggcacgccaggtttagtatcaccagcacttacgctggcccagcccctcggaaccctcccccaggccgtgatggccgcccaggccccaggcgtgatcaccggagtgaccccagctcgaccccccatcccagtgactataccatcggtgggggtcgtcaaccccatcctggcctcaccacccacactgggtctactggagcctaagaaagagaaggaagaggaagaactttttccggaaagcgaacgtccagagatgctcagcgagcaggaacacatgtcaataagtggcagctccgcacgccacatggtgatgcagaaattgcttcgcaaacaagagagcactgtgatggtgctgcgtaacatggtagatcccaaagatatcgacgacgatttagaaggggaggtcacagaggagtgtggtaaattcggcgccgttaatagagtgataatctaccaggagaagcagggggaagaggaggatgcagagatcattgtgaaaatcttcgtagaattttctatcgcttccgaaacccacaaagccatccaagcactgaacggaagatggtttgctggacggaaggtggtggcggaagtgtacgatcaggaacgattcgacaatagtgatctgtctgcctag

SEQ ID NO: 20223 - DNA, 1680 bp, Artificial Sequence
  Description of Artificial Sequence: Synthetic coding sequence
atggccaccgccaccatcgccctgcaggtgaacggccagcagggcgggggatcagagcccgcggccgctgccgcagttgtggccgccggcgacaagtggaagccgccacagggcaccgatagcataaaaatggagaatgggcagagcacagctgctaaacttggactgcctccactcacccccgagcagcaagaggccctgcaaaaagcaaagaagtatgcgatggagcaatccattaagagcgtgctcgttaaacagaccattgctcaccagcagcaacaactgactaacctccaaatggccgccgtgaccatggggttcggggatccactgtctcctctgcagagcatggccgcacagcgccagcgtgccctcgcaatcatgtgccgcgtttacgtaggcagtatatactatgaactcggtgaggataccattcgacaggccttcgctccatttggcccgatcaagtctatcgacatgagctgggactccgtgacaatgaaacataagggatttgccttcgtagagtatgaggtcccagaagcggctcaactggccttagagcagatgaatagtgtgatgttgggcggacgaaatatcaaagtggggcgccctagcaacataggacaagctcaacccatcatcgaccaactagcagaggaagccagggccttcaataggatctacgtcgcctcagtccaccaggacctgagtgatgatgatatcaaatcagtctttgaggcattcggtaagatcaaaagttgtacactggctagggaccctaccacaggcaagcacaaagggtacggctttatcgaatacgagaaagcccagtcatcgcaagacgccgtgtcttccatgaacctttttgacctcggtggtcagtacctgagggtgggcaaagcagtaacccctcccatgcccctgctgactccagcaacccccggtggcctcccaccagctgctgctgtggccgccgccgcagcaacggctaagataaccgctcaagaagctgtggcaggggctgctgtgctcggtaccctcggaacccctggcctcgtgtcccctgctctaactctcgcacagcctctcggcacgctgccgcaagccgtgatggccgctcaggcgccaggcgtgatcacaggcgtcactcccgcaaggcccccaattcccgtgacgatcccctcagtgggagtcgtgaacccaatcttagcatcacctcccacattaggactactggaacccaagaaggagaaggaggaagaggagttgtttcccgagtctgaaaggccggaaatgctgtccgagcaggaacacatgtcaatttctggtagcagcgcacggcacatggttatgcaaaagctgctgcgcaagcaggaatcaacagtaatggtgctgcgtaatatggtagatccgaaggacattgacgacgatctggagggtgaagtcacggaagaatgtgggaaattcggcgcggtgaaccgggttattatttaccaagaaaaacagggggaagaggaagatgccgagatcatcgttaaaatcttcgtcgaattctctatcgcgagtgagacccataaggcaatacaggccctgaacggaaggtggttcgcaggtcggaaagtggtcgccgaggtctacgatcaagagaggtttgataatagcgacctgtccgcatag

SEQ ID NO: 20224 - DNA, 2232 bp, Artificial Sequence
  Description of Artificial Sequence: Synthetic coding sequence
atgaacaaccccagcgagaccagcaagcccagcatggagagcggcgatggcaatacagggacacagactaatgggctggatttccagaagcagccggtccccgtgggcggtgcaatctcaacagcacaggcccaggcatttctgggccatctgcaccaggtccagctggccgggaccagcctgcaggctgccgcgcagtcacttaatgtgcagtctaagagcaacgaagaatctggtgactcacagcaaccctcccaaccttcccagcagccgtctgtgcaggccgctatacctcagacacaactgatgctagcgggcggtcagattactggcttgacactgactccagcccagcagcagctgctgttgcagcaagcccaagcccaggcacagctgttggcagctgccgtccaacaacactctgcatcccaacagcacagcgccgccggcgccaccatctcagccagtgctgcaacaccaatgacacagattcccttgagtcagccaatacagatcgcccaagatctacagcagttgcaacaacttcagcaacagaacctcaacctgcagcagtttgtcctagtgcaccccaccacaaatctgcagccagcccagttcatcatcagtcagactcctcaaggccagcaaggcctgctccaggcacagaacttgctgactcaattgccacagcagagccaggccaacttgctgcagagccagccaagtatcacccttacttctcagcccgcaaccccaacgcggacaatagccgcgacacccattcagactttgccacagtcccagtcaacacctaaacgcatagataccccctcacttgaggaaccctccgacctggaagagctcgaacagtttgcaaagacatttaagcagagacggatcaagttgggcttcactcaaggggacgtgggactcgctatgggcaagctttatgggaacgactttagtcagacaaccatcagccgatttgaggctctgaacttaagttttaaaaacatgtgcaagcttaagcccttgctcgagaaatggcttaacgatgctgagaatctgtcctccgactcttctcttagtagtccatctgcccttaactcccccggaatcgagggcctttcccgacgtaggaagaaacgaacctctatcgagacgaacattcgcgttgctctcgagaaaagttttttagaaaaccagaaacctactagcgaggagattacaatgatcgcagaccaactcaacatggagaaggaggtgatccgcgtctggttctgcaacaggcgacaaaaggagaaacggataaatcctccttcatccggtggcaccagttctagtcctattaaggccatattcccgagtcccacgagcctggttgctaccaccccatccctagttacttcttccgctgccactacactgactgtcagccctgtgctaccactcacaagcgccgccgtaaccaacctgagcgtcaccggcacctctgacacgacatcgaataataccgccaccgtcatcagtaccgcgccccctgcatcatccgccgtgacctctccgtccttgagtccttccccctctgcgtctgcgagcactagcgaagcatcatctgcgtctgagaccagcactactcagaccactagcacccccctgtcttcacccttaggcacctcccaggtgatggtgacagccagcggactccaaacagcagccgctgcagctctccaaggtgccgcccagttgccagctaacgcttcgttggccgccatggccgccgcagcggggctgaatccctctctgatggcaccaagtcagtttgctgccggaggtgcattgctgagcctgaatcccggtactctctccggagccctgtctccggctctgatgtccaattcaacactcgcaacgatacaagcgttggcctcaggggggagcctcccgataacgtccctcgatgccactggcaatctagtgtttgctaatgcaggtggtgcacccaacatcgtcaccgcccccctctttctgaacccccaaaatctctctttgctgacctctaacccagtgagtctggtatctgccgcagccgcttccgctggaaactctgccccagtggcctcgctgcatgccacctcaaccagtgcggagtccattcagaattccctgttcaccgtagcatccgcatctggcgccgcatccactacaactactgcctcgaaagcacagtag

SEQ ID NO: 20225 - DNA, 2268 bp, Artificial Sequence
  Description of Artificial Sequence: Synthetic coding sequence
atgctggactgcagcgactacgtgctggacagccggatgaacaacccatccgagacatcaaagccatccatggagagtggagacggcaatactggcacccagactaacggcctcgacttccagaagcaaccagtacctgtgggcggcgccatcagtaccgcgcaggcacaagcattcctgggccatctacaccaggtgcagttagccggcacatcccttcaggctgcagcacagtctttgaacgtccagtcgaagtcaaatgaggagtcaggtgactcccaacagccaagtcagccatctcaacaaccatcagtccaggcagctataccccaaacccagcttatgttggccggcggccagatcaccggactcactttgactccagcccagcaacagctgttgctgcagcaggcacaggcccaggcccagctgctcgctgccgccgttcagcagcacagtgcctctcagcagcatagcgccgcaggcgctaccatttcggcttccgccgccactcccatgacccagatccccctttcccaaccgattcaaatcgcacaggacctccagcagctgcagcaactccagcagcagaacctcaacctgcagcagtttgtcctggttcatcctaccacaaatctgcagccggctcagtttatcatctctcagacaccacagggccagcagggactccttcaggcccaaaacttactgacccagctgcctcagcagagtcaggccaatctgctccagtctcagccctccatcacccttacgagtcagcctgctaccccgactaggacaatcgctgccaccccgatccaaaccctgccacagtcacaaagcacgcccaagcgtattgatacaccaagcttggaggagccgtccgatctggaggagctcgagcagttcgctaagaccttcaagcagagacgcataaaactgggatttacccaaggtgatgtgggattggcaatgggcaagctgtatggcaatgatttttctcagacaacaatctctcggttcgaggcgttaaatctaagtttcaaaaatatgtgcaagttaaagccactactggagaagtggctgaatgatgccgaaaacctttccagcgacagctccctatcctctccctccgcccttaatagccccggcatcgaaggactcagcagaagacgaaagaagagaacatcaatagaaaccaacatcagagttgcacttgagaaatcttttttggaaaaccaaaaacccaccagtgaagagattaccatgatcgccgaccagttgaacatggaaaaggaagtgatcagagtctggttctgtaatagacgacagaaggagaagcgaatcaatcccccttccagcggcggcactagctcgtctccaatcaaagcgatctttccatcccctactagcctcgtcgccaccaccccctcacttgtaacgtcatctgccgccaccaccttaaccgtgtcacctgttctgccactgactagcgccgcagtcacaaatctcagtgtcacggggacctctgacactacctctaacaacactgccaccgtgatctctactgcaccgccagccagcagtgccgtgacgtccccatctctttctccttccccatcagcaagtgcctccacctccgaagcctcgtcagctagtgagacgtcaacaacacaaacaacctccacgccactctcctctcccctgggcacgtcccaagtgatggtgaccgcctccgggctgcagaccgcagccgcagccgcccttcagggagctgcccaactgcccgcaaatgcttccctcgccgctatggcagctgccgccggtctgaaccccagcctgatggccccctctcagttcgctgccggaggtgccttgctcagcctgaaccctgggaccctgtctggcgcactctctcctgcactgatgtcgaactccacactggccactatccaggctctggcgtccggcggaagtttgcccatcacctctttggacgcaacggggaatctcgtgtttgctaatgccggcggcgcacccaatattgttacagcacctctgtttctgaacccccagaatttatctctcctgacctccaatccagtgtcactggtaagcgccgccgcagcctcggcaggcaactctgctcccgtggcatccctgcacgctacctccacaagcgctgagtccatccaaaactctctgtttacggtggcatccgcttccggcgcagcttccacaacaactactgcctcaaaggcccaatag

SEQ ID NO: 20226 - DNA, 2226 bp, Artificial Sequence
  Description of Artificial Sequence: Synthetic coding sequence
atgaagacccggatgaagatcttcgtgatgatccacttccacctgatgaacagtactcagactaatgggctggacttccagaagcagccagtccccgtcggaggagcaatcagcactgcccaggcccaggcttttctggggcacctacatcaggttcagttagctgggacatcgctgcaggctgccgctcagagcctgaacgtgcagagcaagagcaatgaagagtctggagattctcagcagccttctcagccatcgcagcaaccgtcagtacaggccgcaatccctcagacccagctcatgctggcgggaggtcagataacgggcctgactcttacaccagctcagcagcagctactgctgcagcaggcacaagcccaggcccagcttctggcggctgcagtgcagcagcactcagcctcacagcaacattctgcagctggagccactatatcagccagcgcagcaacgcccatgactcaaattcctctctcccagccaatccagatagcacaggaccttcaacagcttcagcagctgcagcaacagaatctcaacctgcagcagtttgtgctggtgcaccctacaaccaatctgcagcccgcccaattcattattagccaaaccccccagggacagcagggactgctccaggcccagaatctactcactcagctacctcagcagtcccaggctaacctgttacaatcccaaccaagcatcacgttgaccagccagcctgctacacctaccaggacaatcgctgccactcctatccagactcttccgcagtcacagtctacacctaaaagaatcgacactcccagtcttgaggagccatccgacctggaggagttagagcagttcgctaaaacatttaagcaaaggcgaatcaagttaggtttcacacagggggatgtggggttggccatgggtaaactttacgggaacgatttttcacagactactatctctagattcgaagccttaaacctgtccttcaagaatatgtgtaaacttaagcctctgctggaaaagtggctcaatgatgctgagaatttgtcgtccgatagttctctttcaagcccctctgctctgaattcaccaggaattgaagggctaagtcgccggcgcaaaaagcggacttccatagagacaaatatcagggtcgccctggaaaaatcctttctggaaaatcagaaacctaccagtgaggagataacaatgatagctgaccaactcaacatggagaaggaagtgattagggtttggttctgcaatagaagacaaaaagagaaacgcattaacccaccgtcaagcggcggcacttccagtagcccgattaaggccatcttcccaagtcccacctctctagtggccactactccttcactcgtgacaagttctgcggcaacgacactgaccgtgtcaccggtgctgcctctaactagcgcagctgtcaccaacctgagtgttacaggaacttccgacacgactagtaacaataccgcaacggttatctcaacagctccccctgccagtagcgcagtgacctctccaagcctgtcccctagccccagtgcctctgcatcaaccagtgaagcttcctcagcttccgagacatccaccacccagacaacaagtacccctctgagctcccctctggggacctcgcaggtcatggtgacggccagtggactgcagacagctgccgcagccgctctgcagggagctgcccagctaccggccaacgcgtccctcgcagccatggccgccgctgctgggctcaatccttccttaatggctcccagtcagtttgctgcaggcggggcactgctgagcttaaatcccgggaccctcagtggtgcactgagccctgcacttatgtcgaattccactctggcgactattcaggctttagcgagcggagggtcgctgcctataacgtctctggatgccacaggaaaccttgtattcgcgaacgccgggggcgcccccaacatcgtgactgcacctctgttcctgaatccccagaatctctctcttctaacatcaaatcccgtgagtctcgtgtcagcagcagcggccagtgccggaaactctgcccctgtggcatctctacacgcaaccagtacaagcgctgagagcatacagaactcactgtttaccgtggcctcagcctctggcgccgcttccaccacaactaccgcgagtaaagcccagtag

SEQ ID NO: 20227 - DNA, 2301 bp, Artificial Sequence
  Description of Artificial Sequence: Synthetic coding sequence
atggccgacggcggcgccgccagccaggacgagagcagcgccgccgcagcagcagcagccgacagtaggatgaataacccctcagaaacttcaaagccctcaatggagtcaggcgatggcaatactggtacccagacaaacggtctggacttccaaaagcaacctgtgccagttggcggagcgatttctacagctcaggcacaggcgttccttggccacttgcatcaagtgcagttggccggaacctctctccaggccgcagcccaatccctgaacgtgcagagtaaatctaatgaagaatccggagacagccaacaaccatcacagccctctcagcagccctccgtacaagctgcgatccctcagacccaactgatgcttgcagggggtcagattacgggactaacgctgacgccagcccagcagcagcttctcctccagcaagcccaggcccaggcacaactcctggccgccgctgtgcagcagcattccgcatcacaacagcattcggccgcaggagctactatcagcgcatcagccgctacacctatgacacagatccctctctcccagcccattcagatagctcaagacctacagcagcttcagcagcttcagcagcagaatttgaacctccagcaattcgtcctggtgcacccaacgaccaacctccagccagcccagttcatcattagccagacaccccaaggccagcaggggttgttacaggcgcagaaccttctgacccagctgcctcagcagtcccaagccaacctgctgcaatcacaaccatctattaccctgacgtcgcagcccgccacccctacacggacaattgctgccacgccaattcagactctacctcaatcccaaagcacacctaagcgcatcgacacccccagcctcgaggagcccagcgatctagaagagctggagcaattcgctaaaacttttaagcagcgccgcattaagctgggctttacacagggtgacgttggcttggccatgggcaaactatacggaaacgacttctcacagactacgatcagccgatttgaggcactcaacctttcatttaaaaacatgtgtaagctgaagcctctgcttgagaaatggctaaacgacgctgagaatctcagcagtgatagttcactgtctagcccttctgccctgaatagtcctggaatcgagggcctcagtcggcgacgcaaaaaacgtactagcatcgagaccaacatccgcgtggccctggaaaaaagttttctcgagaaccagaaacccacaagcgaagagataactatgatcgccgatcagctaaacatggaaaaggaggtaatccgcgtgtggttctgtaacagacgccagaaagagaaacgcattaatccgccctcatcaggagggacctccagcagccctattaaggccattttcccatctcccaccagtctggtcgcgacaaccccgagtctggtgacctcttcggccgccaccactttgacggtgtcaccggtattgccgttgaccagcgccgcggttaccaaccttagcgtaacaggcaccagcgacaccacctccaacaatacagctaccgtgattagtaccgccccacctgcctctagcgccgttacttctccaagtttatcacctagcccttctgcatccgccagcaccagcgaggcaagctcagcttccgagaccagcacgacacaaacgacaagcaccccactaagtagccctcttggcacatcccaggtgatggtgacagcaagtggtttacagactgcagccgctgccgccctccaaggcgcagctcagctgccagctaatgctagcctggctgcaatggcagctgcagctggcttaaacccgtctttaatggccccatcacagtttgccgccggcggcgcgctcctctccctgaacccaggcactctgtctggcgcgttgtcacctgccctgatgtcaaattccacactcgccacaattcaggcgctggcttctggtggatcgctccctatcactagcctagatgccactggcaacttggtcttcgcaaatgctggcggggcgcctaacatagtgacggcccccctgtttctgaatcctcagaatctctccctgctaaccagtaatccagtgtctctcgtgagtgccgccgcagcctccgcaggtaattccgcgcctgtcgcgtctctacatgcaacatcaacaagcgcggagtcaatccagaattccctattcaccgtggcctcagcgagtggggctgccagcaccactaccacggccagcaaggcacagtag

SEQ ID NO: 20228 - DNA, 1962 bp, Artificial Sequence
  Description of Artificial Sequence: Synthetic coding sequence
atgaacaaccccagcgagaccagcaagcccagcatggagagcggcgatgggaacacaggcacccagactaacggcctggattttcagaagcagccggtgcccgtgggcggagccatatccaccgcccaggctcaagccttcttggggcacctacatcaggttcaactagctggcacttcattacaggccgctgcgcagtcgcttaacgtgcaatcaaagagcaacgaggagtccggtgattcccaacagccatcacagccaagccaacagccgtccgtgcaagcagctataccgcagacgcaactcatgttggcaggcggccagattaccggcctcaccctgacaccagcccagcagcagctcttgctccaacaggcacaagcgcaagcacagctgttggctgccgccgtccaacagcactctgcctcacagcagcactctgctgcaggcgctactatcagcgcatcggctgctacacccatgacacaaatccccctctcccagcctatccaaattgcccaggatttgcaacagctacaacaattacaacaacagaaccttaatctacagcaattcgtgctggtccacccgaccaccaacttgcagcccgcccagttcattattagtcagactcctcagggtcagcaaggcctgctccaggcccagaaccttctaacacagctccctcaacagtctcaggcaaacctcctccaatcccagccctcaatcacccttacttctcagcccgctacgcctactagaacaatagccgccaccccaatccagaccctgccccagtcgcagtctactcccaaacgcatagatactccatctttggaagagccctctgacctggaggaactcgagcagtttgccaagacctttaagcagcggcgcatcaaactgggcttcacacagggagacgtggggctggcaatgggaaaactgtatggaaacgacttctcccaaaccaccatatcccgcttcgaagctctgaatctctcctttaaaaatatgtgcaaacttaagccgcttttggaaaagtggctgaatgatgcagagaatctcagcagcgattcctccctttcttcacctagtgccctcaatagtcccgggatcgagggcttgagcaggagaaggaagaagcgtacttcgatcgagactaatatcagggttgctcttgaaaaatcattcttggagaatcagaaacctacgtctgaagagataaccatgattgccgaccagttgaacatggaaaaggaggtgattcgggtttggttctgtaataggcgccagaaagaaaagcgaataaaccccccaagtagtggcggaacttcctctagccccatcaaggcaattttcccatctcccacatcactggttgcaacgaccccttctttggtgacctcttcagcggcaactacactgacggtgagtccggtactaccactgactagcgcagccgtgacaaatctgtctgtgacaggtacaagcgatactacatccaataatacagcaactgtcatatcaactgccccaccggccagctctgcagtcacttcacctagtttatccccaagcccttccgcgagcgcctccactagcgaggcatcttcggcttctgagactagcacaacccaaaccacgagcacccctctgtcttcccccctagggaccagccaggtaatggtcaccgcgagcgggctgcagactgctgcagccgccgctctgcaaggtgccgcccagttgccagccaacgcatctctcgcggccatggcagccgccgccggtctcaacccctcgctaatggccccgtcccagtttgccgctggcggggctctcctgtccctgaatccaggtaccctgagcggggccctgtccccagctctgatgtcaaattctacccttgccaccattcaaggacttctccacggcctagaaaattttctgacaaagaattag

SEQ ID NO: 20229 - DNA, 2112 bp, Artificial Sequence
  Description of Artificial Sequence: Synthetic coding sequence
atggccgacggcggcgccgccagccaggacgagagcagcgccgccgccgcagccgccgcagacagcagaatgaataacccatctgaaacgagcaagcccagcatggagtctggcgacggcaacactggaacgcagaccaatggactggatttccagaaacagcctgtgcccgtcgggggcgcaatttcgaccgcgcaggcccaggcattcctcggacatttacaccaggtgcagctggcaggcacttcactgcaggctgctgcacagtccttaaacgtgcaatctaaaagcaacgaagaaagcggcgacagccagcagccatcacaaccatcccaacagccttctgttcaggccgccatccctcagacacagctgatgctagcagggggacagattaccggggacttgcagcaactacaacaactgcaacagcagaatttaaatttgcagcagtttgtccttgtccaccctacaaccaatctccaacccgctcagtttatcatttcccagaccccgcaagggcagcagggtttgcttcaggcccagaatttgctgacacaactccctcagcaatctcaagcaaatctgctgcagagccagccatccatcacgcttacatctcagcctgcaacgcccacacgtactattgcagccacacccattcagacccttcctcagtcccaatcgacaccgaagcgtattgacaccccctctctagaggagcccagtgacctggaagagctggagcaatttgccaagaccttcaaacagaggcgaattaaactgggcttcacacaaggcgacgttggtctcgccatggggaaactctacggcaatgatttttcccagactaccatttctcgcttcgaggccctgaatctgtcgttcaaaaacatgtgcaaattgaaacctttgttagagaagtggcttaacgatgcggaaaacctaagttccgactctagcctaagcagcccttccgctctgaacagccctggtatcgagggcctgagtaggcggagaaaaaaaaggacgtccatcgaaaccaacatacgcgtggcactcgagaagagcttcctggagaatcagaagccaactagtgaggaaataacaatgatcgcagatcagttaaatatggaaaaagaagtgataagagtgtggttttgtaacaggcggcagaaagagaagcgtataaaccccccctcatcggggggaaccagctctagtcccattaaagcaattttccctagcccaaccagcctcgtggccaccacacctagcttggtcacgtcttccgcggctaccacattgacggtaagtcctgtgctgccgttaaccagtgccgctgtgaccaacctcagcgtgaccggtacttcagacaccaccagcaataacacagccactgtgatctcgacagctccgcctgcctcgtccgcagtgacctcaccatccctaagcccctccccgagtgcgtccgctagcacatcggaggcttccagcgcctccgaaacgagcactacgcaaacaacctctaccccattaagtagtcccttgggtacttcacaggtcatggtgactgctagtggccttcagacggccgcggccgccgccctgcaaggcgcagcccaactcccggcgaacgcatctctggcagcaatggctgcagccgctggcttgaaccccagtctgatggcccccagtcagttcgccgccgggggagcacttctctcgcttaacccaggcaccctttctggcgcactgtccccagcgctgatgtctaactccacattggccacaatccaggctcttgccagcggcggcagccttcctattacgagtttggatgccacgggcaatttggtgtttgcaaatgctggtggggctcctaatattgtgacagctcctctgttcctgaatccccaaaatctatctttactcacaagtaaccccgtaagccttgtgtcggctgcggctgcctctgccggaaattccgctcccgtggcaagtctccatgcaacctccacaagcgccgaaagcatccagaactctctcttcacggttgcctcggcctcgggggcggccagcaccacaacaacagcaagcaaggcacaatag

SEQ ID NO: 20230 - DNA, 279 bp, Artificial Sequence
  Description of Artificial Sequence: Synthetic coding sequence
atgaacaaccccagcgagaccagcaagcccagcatggagagcggcgatgggaatactgggacgcagacaaatggtttggactttcagaagcagcctgtgccagtgggaggagctatcagcaccgctcaggcacaggcctttctcggccatctccaccaggtgcagttagccggtacctctctgcaggctgcagctcaatccctgaatgtccaatccaaaagtaatgaagagagtggggactcacaacagcccagtcagcccagccagcagccctcatag

SEQ ID NO: 20231 - DNA, 765 bp, Artificial Sequence
  Description of Artificial Sequence: Synthetic coding sequence
atgaacaaccccagcgagaccagcaagcccagcatggagagcggcgatggaaatactggcacgcagacaaatggcctggacttccagaagcaacctgttcctgtcggcggagcaatctcaacggctcaagcgcaggctttccttggccacctccatcaggttcagctcgcaggcacctccctgcaagccgcagctcagagcttgaacgttcagagcaaatccaacgaggagtctggcgattctcagcagccctcccaacctagccaacagccaagcgtacaggctgccatcccacagactcagctgatgctggccggaggacagattaccggactcaccctgacccctgcgcaacaacagttgcttttacagcaggcgcaagcgcaggcacagctgttggccgccgcggtgcagcagcatagtgctagccagcagcatagcgccgccggcgccaccatctcagcaagcgctgctaccccaatgacacagatccccctgagtcaaccgatacaaatagcacaggaccttcagcagttgcagcaactgcaacagcaaaatttaaacttgcagcagtttgtgcttgtgcatccaacaacaaacctgcagcctgcccagttcatcatttctcagaccccccagggtcagcaaggcttgcttcaagcccagaatctgctaactcagctgccacaacagtcccaggccaatctgctccagtcccagccttcaatcacactgaccagccagatatggccctcaccagcatag

SEQ ID NO: 20232 - DNA, 342 bp, Artificial Sequence
  Description of Artificial Sequence: Synthetic coding sequence
atgaacaaccccagcgagaccagcaagcccagcatggagagcggcgacggcaatacgggtacggggaccgccgcaggctgttgctccgccgcagccctacgccaaccggccgcgcagtgctgttggagccatcatttgagactgtgttgccatgcccacgatgcggatcctcccgttagcgctcacaccgaccgaacgggctcttctaccacagccactgcatccacagccgaaagccagccggctactgtttgtgtgggtgcgagcaatcaccagttcgccgcctcagcagtgtaccacctgaccgacgctccggggcccgccggtagtcctgccagctag

SEQ ID NO: 20233 - DNA, 2232 bp, Artificial Sequence
  Description of Artificial Sequence: Synthetic coding sequence
atgaacaaccccagcgagaccagcaagcccagcatggagagcggcgatgggaatacgggcacccaaacgaatggcctggacttccaaaagcaacccgtccctgtggggggcgctatatcaaccgcacaggcccaggcctttctaggccatctccatcaagttcagctggcagggaccagcttgcaggctgccgctcagagcctcaacgtgcagagcaagagcaatgaggaaagtggtgattcacagcagccatcacagccctctcagcaaccttccgtccaggctgcgattccgcagacccagttgatgctggctggcgggcaaattacagggctgacactcactcccgcacagcagcaactgctattacagcaagcacaagctcaggcccagctgttggctgccgcagtgcagcagcacagtgctagtcagcagcattcagcagccggggccaccatcagtgccagcgccgccacccctatgactcagatcccattgtcccagcctattcaaatcgctcaggatctacagcagctgcagcagctgcagcagcagaatcttaatttgcaacagttcgtgctagttcaccccacaaccaacctgcagccggcgcagttcatcatatctcagacgccccaaggccagcaaggactcctgcaggctcagaacttactcacgcagctgccacagcagagccaggccaatctgctgcagtctcaacccagcattacattgaccagccagcccgcaacccccacaagaaccatcgccgctacccctatccagacattgcctcaatcccaatccacacctaagcgaatcgacacccctagcctggaggagccgtccgatctggaagagttagagcagtttgctaaaacattcaagcagcgccgcatcaaactcgggttcactcagggtgacgtggggctggcaatgggaaagctctacggcaacgatttttcacagaccaccataagccggtttgaggcactgaacctgtcttttaagaacatgtgtaaactaaaaccattgcttgaaaagtggctcaatgatgcggaaaatctgtccagcgattcctccctcagctccccttccgcgctgaatagcccaggtatcgaggggctgtctcgccgtcggaaaaagaggacctcaatcgaaacaaacatccgtgtcgctttggaaaagagcttcttggagaaccaaaaacctacatcggaagaaatcactatgatagcagaccagctaaacatggaaaaagaggtgatccgagtttggttctgcaataggcggcagaaagagaaacggattaatcccccttcatcagggggcacctccagctcaccaataaaagccatttttccctcacctacatcattagttgcaacaacacccagcttggtaacgtcgagtgccgcgacaacgctgacagtgtctcccgtcctgccattaaccagcgctgcagtaactaatctgtccgtcaccggaactagcgacacaacttcaaataacactgctaccgtgatctcaaccgcacccccagcctcttcagcggtgacaagtccgtcactgtccccatcaccctcggccagcgccagcacctccgaggctagtagtgcttcagagaccagtaccacacagaccacctctaccccattatcttctcctctggggaccagtcaggtaatggtcactgctagcggactgcagaccgccgctgcagctgccctgcagggcgcagcccagctcccagcaaatgcctccctggccgctatggccgcagcagcaggtctaaatcctagcttgatggctcccagccagtttgctgccggtggggcactgctgagcctaaacccgggcactctgtctggggcactttctcctgcccttatgtctaacagcactttggctacaattcaagcgctagcttctggtggctcgctccctatcacctctctcgacgccacggggaatttagtgttcgccaacgccggaggagcccctaatatagtgactgctcctcttttcctgaacccacaaaaccttagtcttctcacctccaaccccgtgtccctggtgagcgcggccgcggcctcggccggtaattccgctcccgtggcaagcctgcacgctacttcgacgtcagccgagagtatccagaatagcctgtttacagtggcgtcagcttccggagccgcttcaacaaccaccacggcctcgaaggctcagtag

SEQ ID NO: 20234 - DNA, 411 bp, Artificial Sequence
  Description of Artificial Sequence: Synthetic coding sequence
atgaacaaccccagcgagaccagcaagcccagcatggagagcggcgacgggaatacaggcactcagaccaatggattggacttccagaagcaacccgttcccgtgggaggggccattagcactgcacaagcacaagcttttctaggccacctgcaccaggtccagctggccggaacctcattgcaggccgcagctcaatccctgaacgtgcagtcaaagtcgaacgaggaaagcggcgattcccagcagcccagtcaaccttctcagcagccaagtgttcaggcggccattcctcaaacacagttgatgcttgccggagggcagatcacaggactgacactgacaccggcccaacaacagcttctcttacaacaggcccaggcccaagcccaactgctggcggccgcttag

SEQ ID NO: 20235 - DNA, 1587 bp, Artificial Sequence
  Description of Artificial Sequence: Synthetic coding sequence
atggccgacggcggcgccgccagccaggacgagagcagcgccgccgcagctgcagctgccgactccaggatgaacaacccatcagagacgtctaagcctagtatggaatctggcgacgggaataccggtacccaaactaatggcctagatttccagaagcaaccggtccctgtcggaggggctatttctacggctcaggctcaggccttcttggggcacttgcaccaagtgcagttggccgggactagcctgcaggcggcggcacagtcactgaacgtgcagtccaagtctaatgaagaaagcggagattctcagcagccctcacagccgagccagcaaccaagcgtgcaggccgctataccccagacgcagctgatgttggcggggggccagataaccggactcacactcacccccgctcagcagcagttactccttcagcaagcccaggctcaggctcagttacttgctgcggcagttcagcagcacagcgcatcccagcagcattccgcagccggcgccacaatcagtgcgagcgctgcaaccccgatgactcaaattccactttctcagccaatacagatcgcgcaggatctgcagcagctgcaacaactgcagcagcaaaatctgaacctgcaacagtttgttctggtgcacccgacaactaacctgcaacccgcacagttcatcatctctcagacgcctcagggccagcaggggctgctacaggctcagaacctactcacgcagctgcctcagcagtcacaggctaatttgctccagagccagcccagcattacgctcactagccagccagctactcctactcgcactattgccgccactcctatccagaccctcccacagagtcagtccacccctaagcgaatagacacaccatcccttgaagagccctccgatcttgaggaacttgagcagtttgcaaaaacattcaagcagagacgaataaagctggggtttacccaaggcgacgtcgggttagccatggggaagctatatggcaatgattttagccagactaccatctcgaggttcgaagccctaaacctctcctttaagaacatgtgtaagttaaagccactacttgaaaagtggctgaatgacgccgagaatttaagcagtgatagctctttgagcagcccatcagccttgaatagcccaggtatcgaaggcttatctagaagacggaagaaacgtacgagcattgagacaaacatccgtgtcgccttggagaagtccttcctggaaaaccagaagcccacatctgaagagattaccatgatcgccgaccaactgaacatggaaaaggaggtcattcgcgtgtggttctgcaatcgtaggcagaaagaaaagcggataaaccccccaagcagcgggggaacaagctccagccctatcaaggccattttcccctctccaacatcccttgtggccactactcccagcttggtgacctcctccgccgccactactctgactgtgagcccagtcctgcctctgacatctgctgctgttaccaatcttagtgcccttcagacaccgccgcctacaacccaacagccgtag

SEQ ID NO: 20236 - DNA, 165 bp, Artificial Sequence
  Description of Artificial Sequence: Synthetic coding sequence
atgaacaaccccagcgagaccagcaagcccagcatggagagcggcgatgggaacacaggcacacagactaatgggcttgatttccagaagcagcctgtaccagtgggtggggctatttctacggctcaggcacaggccttcttgggacacttgcatcaggtgtag

SEQ ID NO: 20237 - DNA, 2268 bp, Artificial Sequence
  Description of Artificial Sequence: Synthetic coding sequence
atgctggactgcagcgactacgtgctggacagccggatgaacaacccgagcgaaacatctaagccatctatggaaagtggtgacgggaacaccggaactcagaccaacggcctagacttccagaaacaacccgtccccgtggggggcgcgatatccacggcccaggcgcaggcattcctcggccacttgcaccaggtacaacttgccggaacctcgctccaagccgccgcccagagcctcaacgtccagtctaaaagcaacgaggagagcggagactctcagcagccgagccagccatcccagcaaccatcagtccaggccgccatacctcaaactcagctgatgctggctggcggccagatcactggcctgactctaactccagcgcagcaacagctgctgctgcaacaagcacaagcacaggctcagctgctcgccgcagccgtccagcaacattccgccagtcaacagcactctgcggccggcgcaactatttccgccagcgctgctacccctatgacccagatccccctgagccaaccaattcagatagcccaggatttacaacaacttcagcagttgcagcagcagaacctcaacttgcagcagttcgtgttggtgcacccaactaccaacctgcagccagcacagttcatcatctcacagactcctcagggacagcagggactgctgcaggcccagaacttgcttacacagctgccccagcagagtcaggccaacttgctgcaaagccaaccatccatcacattaacaagtcagccagccacccccacccgcaccattgctgctacccctattcagacgttgccgcagagtcagagcacccccaagcgcattgacacccccagccttgaggaaccaagtgatctagaagagctggagcaattcgcgaagacttttaaacagcggaggataaaacttggctttacacaaggtgatgttgggttggcgatggggaaactttacggcaatgatttttcccagaccaccatttccagattcgaggccctgaatctgtcctttaaaaacatgtgtaaactaaagcctttgcttgagaaatggctgaacgacgcagaaaatctcagctctgacagctccctgagcagcccatccgccttgaatagccctgggatcgagggcctctcccggcgaagaaagaagcggaccagtatcgagaccaacatccgagttgccctagaaaagtcattccttgagaatcagaaacctacttcagaggagatcaccatgatcgctgaccagctgaatatggagaaggaggtgattagggtgtggttttgcaaccggagacagaaggagaagcggatcaatcccccaagcagcggcggcacctctagctctccaattaaggctatctttccgagtcctacctctctagttgccaccacaccctccctagtcacttccagcgcagccaccacactcacggtgtcgcctgttctccctcttacgtccgccgccgtcactaacttgagtgtgaccgggactagcgatactacaagcaataacactgctacggtcatatccacagcacctcctgcttctagcgcagttaccagcccctctttgtctccttcgccatccgcgtccgcatctacatccgaggcatccagcgcgagtgaaacctcgacaactcagaccacatctacacctctgtcctcacctctaggtacaagccaagtcatggtgactgcatcgggcctgcagactgctgctgcagcagctttgcagggcgcggcccaactccccgccaatgcgtcacttgccgcaatggcagccgccgcaggcctgaacccaagcctgatggcccccagccaatttgccgccggaggggcgctcttgagcctgaaccctggcacactgtcaggagctttgtccccagctttaatgtctaactccacactggccaccattcaggctttagccagcggaggctctctgccaattaccagtttggacgccacagggaatctcgtgttcgcaaacgccggaggtgcaccaaatatcgttacagctccactttttctgaatccacaaaacctgtccctgttgacatccaaccccgtttccttagtttcagccgctgcggcttccgcaggcaatagcgcaccggtggcctccctgcatgctactagcaccagtgctgagtccatccagaattctcttttcacagtggcgtctgccagcggagctgctagtactaccaccacagcaagcaaggcccagtag

SEQ ID NO: 20238 - DNA, 1230 bp, Artificial Sequence
  Description of Artificial Sequence: Synthetic coding sequence
atgatgatgatgagcctgaacagcaagcaggccttcagcatgccccatggtggctctctgcacgtcgagccaaaatactccgccttgcactctacaagtccaggctcaagtgcacccatcgcaccaagtgcctccagtccgtcatcctcctcgaatgcaggcggtgggggcggcggcgggggcggtggtggaggaggaggaggacggtcctcaagtagtagctcctccggctcttctggggggggcggttctgaggcaatgcgaagagcttgcttgcctaccccgccctctaatattttcggcggtttagacgagtctttgttggctagagcagaagcgctggctgccgtcgacatcgtgtctcagtctaagtctcaccatcatcaccctccccaccactctcctttcaagccagacgccacctaccacactatgaacaccattccatgtacctccgctgcttcttcatccagcgtgccaatttcccaccccagcgccctagccggcacccatcatcatcaccatcaccaccatcaccatcaccatcaaccacatcaggccctggagggcgaactgcttgaacacctaagcccaggtttggccctcggtgccatggcaggcccggacggcgctgtggtgagcaccccagcccatgcacctcacatggccaccatgaaccctatgcaccaggctgccctttctatggcccatgctcatggtctgccctctcacatgggttgcatgtcggacgttgacgcggatccacgggacttagaggcttttgccgagcggttcaagcagagaaggatcaaattaggagttacccaggcagacgtgggcagcgccctggccaatctaaagatccctggagtgggcagtctgagccagtcaaccatttgtcgctttgagtcacttacattaagtcataacaacatgattgctctgaagccaatcctgcaggcctggctcgaggaagccgaaaagtcccatagggaaaaactcacaaagccggagctcttcaacggcgccgaaaaaaagcgcaaacggacatctatagccgcccctgaaaaaagaagccttgaggcatattttgctatccaaccacgcccttcaagtgagaaaatcgccgccatagctgaaaagctggatctaaagaaaaatgtggtcagggtatggttctgcaatcagagacagaagcagaaaaggatgaaatattccgctgggatctag

SEQ ID NO: 20239 - DNA, 906 bp, Artificial Sequence
  Description of Artificial Sequence: Synthetic coding sequence
atgcccggcatcagcagccagatcctgaccaacgcccagggccaggtgataggcacactgccctgggtagtgaacagtgcttcagttgctgccccggcccccgcccaatccctccaggtgcaagctgtcacgcctcagcttctgctgaacgcccagggacaggttattgctacactcgcgtccagccccttgcccccacccgtggctgtgcgcaaacccagtacccctgaatcacctgcgaaatcagaagtgcagccgatacagcccacccctacggtaccacaacctgcggtcgttatcgctagccctgcaccagccgccaagccctcagcgtccgcccctatcccgataacgtgctcagagactcccactgtttcacagttggtttctaagccccacacccctagtctggatgaggatggaatcaatcttgaagaaatccgtgagtttgccaagaactttaagatccggcggctctcattgggcctaacacagacgcaagttggacaggctcttaccgccaccgaaggacccgcttattctcaaagcgctatttgtagatttgaaaagctagacattacccccaagtcggcccaaaagctgaaacccgtgctggaaaagtggctaaacgaagcagaactgaggaaccaggaagggcaacagaatctaatggaatttgtaggcggagagccctctaagaagcggaaaagacgtacatcctttacacctcaggccatcgaggccctcaatgcttacttcgagaaaaatcccctacctacaggtcaggagatcacagagattgccaaggagctgaattatgatagggaagtggtccgcgtgtggttctgtaacaggagacagacccttaagaacacaagcaagctcaacgtgtttcaaatcccctag

SEQ ID NO: 20240 - DNA, 906 bp, Artificial Sequence
  Description of Artificial Sequence: Synthetic coding sequence
atgcccggcatcagcagccagatcctgaccaacgcccagggccaggtcatcggcactctcccttgggtggtgaactcagcctctgtcgccgcacctgcgccggctcagtcactccaggtgcaagccgtgaccccccagctactgcttaatgcccagggccaggtgatcgccacactggcctcttcccctttaccacccccagtcgccgtaaggaagccttctacaccagaatcgccagctaagagcgaagtgcaacctatccagcctactcccactgtgccccaacccgcagtcgttattgctagccccgcccccgctgctaagcctagtgccagcgcgcccatcccaatcacttgctccgagacgcctactgtatctcagttagttagcaagccacatactccatcgcttgacgaggatggcatcaatctggaggagataagagaatttgcgaaaaattttaagatcagacgactttccctgggactgacacagacccaggtcggccaggcactaaccgccaccgaagggcccgcttactctcagtcagccatctgtagatttgaaaaactggacatcacccctaaatccgcacaaaaattgaagcccgtactcgaaaagtggctcaacgaggccgagctccgcaatcaggaaggtcagcagaaccttatggaatttgtcgggggcgaaccaagcaagaaaagaaagagacggacatcatttacccctcaagctattgaagctctgaatgcttactttgagaagaacccccttccaaccggtcaggagatcactgagatagcaaaggaattgaactacgatcgagaggtcgtaagagtgtggttttgtaacaggcgtcaaacactaaagaatactagcaaattaaatgtcttccagattccctag

SEQ ID NO: 20241 - DNA, 90 bp, Artificial Sequence
  Description of Artificial Sequence: Synthetic coding sequence
atgcccggcatcagcagccagatcctgaccaacgcccagggccaggtcattggaacactcccgtgggtggtcaattctgcgtctgtgtag

SEQ ID NO: 20242 - DNA, 906 bp, Artificial Sequence
  Description of Artificial Sequence: Synthetic coding sequence
atgcccggcatcagcagccagatcctgaccaacgcccagggccaggtgatcggcactcttccgtgggtggtgaattcagcatccgtggccgcacccgcccctgctcagtctttacaggtccaggctgtaactccacagcttctgctcaacgcccaagggcaggtgattgccaccctggccagctcgccccttcctcccccagtcgccgtgagaaaaccctccacccctgaatccccggctaagtcagaggtgcaacctatccaaccgactccaacagtgcctcagcccgcggtcgtcatcgcgagtcctgcccccgctgccaagccatccgcatccgcgcccatccccataacatgttcagaaactcccaccgtctctcagctggtgtcaaagccccacactccatcccttgacgaagacggcatcaaccttgaggaaatcagagagttcgccaagaatttcaaaattcgccgtctgtctctcgggctgactcagacgcaggtgggacaggctcttacagcgacagagggtcctgcctacagtcagagtgcaatttgtagattcgagaagttagacatcacgccgaagagtgcgcagaagctaaagcctgtcttagaaaaatggctaaacgaggcggaactgcgaaaccaggagggccagcagaacctgatggaatttgtggggggggagccctccaagaagcggaagcgccgcacttctttcactccacaggctatcgaagctctgaacgcctactttgaaaagaacccattgcctacaggccaagaaatcaccgagattgctaaggagctcaactacgatagggaagtggtgcgcgtgtggttctgcaaccgacggcagactcttaaaaacacttccaaactgaacgtgtttcagataccttag

SEQ ID NO: 20243 - DNA, 1020 bp, Artificial Sequence
  Description of Artificial Sequence: Synthetic coding sequence
atggccgccgccgccgccgccgccctggagagctggcaggccgccgcgccacggaagaggagatcagctgccaggcgtcctagaagacgggaggctgcccctcgcgggcgcgaagcggcgcctcgggggcgagaggctgcccctagaggtccagaagccgagttcgaaagcgattccggagtggttcttcggagaatttgggaggcagaaaaggatctgtttatttcagacttctggagcagcgccttggaaaccatcaaccggtgtctgaccaaacaccttgaacagctgaaggccccagtgggcactctaagtgatatctttggtaatttgcacctcgatagtttacctgaggaaagtgatgtagcgaccgactccatcccccgcgaaattctggtcactgggacctgtcatctgaaatgtgtgtgttatggcattggcaacttcgctacatgtattgttgcccgcaatcagcttacttttttactccttctgctggagaagtgtcaaatccctaggagccattgttgggtgtacgaccctctctttagccagttagaaatcgaggtactcaatacgctgggcgtgacagtcctcagcgagaacgaagaggggaaaagatccattcgaggcgaacccactatcttctatatgcttcactgtggcaccgctctttataacaacctcctgtggagtaactggagcgttgacgccctcagcaagatggtaattatcggcaattcttttaaaggcctagaagaacggttactggccaggatcttgcaaaaaaattacccatacatagctaaaatcctgaaaggactggaagagctagagtttcctcaaacaagccagtacatggatatctttaatgatacaagtgtccactggtttcccgttcagaaactggagcaactgagcatcgacatctgggagttccgggaagagcccgattaccaggactgcgaggacctggagattatccgaaacaaacgggaggatccttccgccaccgattag

SEQ ID NO: 20244 - DNA, 2064 bp, Artificial Sequence
  Description of Artificial Sequence: Synthetic coding sequence
atggagcgggtgaacgacgccagctgcggccccagcggctgctacacttatcaggtttcacgacacagtactgagatgctgcacaacctcaatcaacaaaggaaaaacgggggccgcttctgtgatgttctgctgcgagtgggagatgagagtttccctgcccaccgggcagtgctggccgcatgctcagaatacttcgaatcagtatttagcgcccagctgggggatggaggagcagctgatggcggcccggcggacgtcgggggggctacagcagccccgggcggcggtgcaggcggaagccgggagctggagatgcatacaatttcctcaaaagtattcggggacatccttgattttgcctacaccagcagaattgttgtgcgactcgagagctttcctgaattaatgacagcggccaaattcctccttatgaggagcgtgatcgaaatatgccaagaagtgataaaacagtcaaatgtgcagatcctcgttccacctgcccgtgcggatatcatgctcttccggcctcctggaactagcgatctaggctttcctctggacatgacgaacggtgccgccctagcagctaactccaacggtatagccggctcgatgcagcccgaagaggaagccgcccgggcggcgggggcagccatcgcaggacaggctagtttacctgtgctgcctggtgtcgacaggctgccaatggtggctggccccctgtctcctcagcttctcacaagtcctttcccttctgtggcctcctccgcccctccgctgactggaaagagagggagggggagaccgcgaaaggctaatcttctcgatagtatgtttggctccccagggggacttcgcgaggcaggtattttgccgtgcgggctgtgtggaaaggttttcacagacgccaacaggctgcggcagcacgaagcccagcatggagttacatcccttcagctaggctatatcgatctgccacctcctaggctcggagaaaacggtctgcctatttctgaagatccggatggtccaagaaagcgcagtcggacacgtaagcaggttgcttgtgaaatctgtggcaagatcttcagggatgtctatcatctgaaccgtcacaaattaagccattcaggcgagaagccatacagctgtccggtttgtggattgcggttcaagcggaaagaccgcatgagctatcacgtgagaagtcatgatgggagtgttggtaagccatacatctgccaatcttgcgggaaggggttctcaaggccggatcatctgaatgggcacataaaacaggtgcacacctccgaaaggccgcacaaatgtcaaacttgtaatgccagcttcgcgacacgggatcgattacggtcacacttggcttgtcatgaggataaggtaccctgtcaagtgtgcggcaagtatcttcgggctgcatatatggccgaccacctcaaaaagcactccgagggccctagcaacttctgctctatctgtaaccgtgggttttcatccgcctcctatctgaaggtgcacgtcaagacccaccacggagtccctctgccccaggtctcccggcaccaagagcctattctgaacggaggcgccgcatttcattgcgcgcgcacttacgggaataaggagggccagaagtgcagccaccaggatccaatcgaatctagtgactcctatggcgacctgagcgatgcctctgacttgaaaacccccgaaaaacagtctgccaatggttccttctcctgcgacatggcggtcccaaagaataagatggagagtgacggcgaaaagaagtacccatgccctgaatgtgggtcgttttttcggagtaagagctacctcaataaacacattcagaaggtgcatgtccgcgcactagggggccctcttggagatctggggcctgctctaggaagtccatttagtccacagcagaatatgtctttgctggagagcttcggctttcagattgtgcagtcggcgtttgcgtccagccttgtcgacccggaagtggaccagcagcctatgggccctgagggcaaatag

SEQ ID NO: 20245 - DNA, 1926 bp, Artificial Sequence
  Description of Artificial Sequence: Synthetic coding sequence
atggagcgggtgaacgacgccagctgcggccccagcggctgctacacctaccaggtatctcgacattccacggaaatgctgcataatctgaaccagcagaggaagaacggtggaaggttttgcgacgttctgcttagggttggggacgaaagtttccccgcccaccgcgcggttttggctgcctgtagtgagtacttcgaaagtgtcttttccgcacagctgggtgacgggggcgccgcagacggcggccctgctgacgtgggaggggccacagcggcccctggaggtggcgcaggggggtctcgcgagctggagatgcacaccatatccagcaaagtcttcggggacattctggacttcgcctatacctctcgaatcgttgtgagactagagtcttttcctgaactaatgaccgccgccaagttcttacttatgcgaagcgtaatcgagatttgtcaggaggtgatcaagcagtcaaatgtgcagattctggttccacctgcaagagctgacatcatgttatttcgccctcccggcacatcggatttaggttttccgctggatatgaccaacggcgctgctctcgccgccaactctaacgggattgccggcagcatgcagccagaggaggaagctgctagagccgctggagcagccattgccgggcaagcctctctccccgtgctacccggcgtcgaccgcttgccgatggtcgctggtccgctgagcccacagttgcttactagcccgttcccctctgtggcctcttctgcgccgcctctgaccggtaaacgaggtagaggccgccctcgaaaggctaatctcctagatagtatgtttggatcccctggtggactacgagaagctggtattctcccttgcgggttgtgcggaaaggtcttcaccgacgccaatcgactgcgtcaacacgaggcccagcacggtgtgacatctttacaactggggtacatagacctgcctcctccccggctcggagagaatggtctcccaatttccgaggatccggacggacccagaaaacgaagcagaacccgcaaacaggtcgcttgtgagatctgcgggaagatttttcgtgacgtttaccatcttaaccggcataagttgtcccacagcggggagaagccctactcgtgccctgtctgcggcctcaggttcaagagaaaagaccgaatgtcataccacgtccggtcccatgacggatctgtcggtaaaccatatatttgccagtcttgtggaaaagggttttctagacctgatcatctgaatggacacatcaagcaagtccacacctccgagagacctcataagtgtcagacctgtaatgccagctttgccaccagggatagactgagatcacatctcgcttgtcacgaagacaaggtgccctgccaagtctgcggcaagtatttgcgagcagcctatatggcggatcaccttaagaagcattcagaagggccgtcaaatttctgtagtatctgcaatagagaaggtcagaagtgttcccatcaggatcccattgaatcaagtgattcttacggagacctgagcgacgccagcgacctgaaaacacccgagaagcagagcgcaaatggttcattttcctgtgatatggctgtccccaaaaacaaaatggagtcagacggcgagaaaaaatacccttgtccagagtgtggaagctttttcagatcaaaatcatatctgaacaagcacattcagaaggtgcatgttcgcgccttaggggggcctctgggcgatctagggcctgccctgggcagccccttcagcccacaacaaaacatgtccctgctggagtcttttggcttccagatcgtccagagtgcgttcgccagcagtttggtcgatcccgaggtggatcagcaaccaatgggccctgaggggaagtag

SEQ ID NO: 20246 - DNA, 1614 bp, Artificial Sequence
  Description of Artificial Sequence: Synthetic coding sequence
atggagcgggtgaacgacgccagctgcggccccagcggctgctacacatatcaggtaagtcgccattctaccgaaatgcttcataatttgaatcagcaaaggaagaatggtgggaggttctgtgatgtgttactccgcgtgggtgacgagagttttcccgcccatagggccgtgttggctgcttgcagcgagtacttcgagtctgtattcagtgctcagttgggcgacggcggcgccgctgatggaggccccgcggatgtgggaggcgcaaccgcagcgcctgggggcggagccggcggtagcagggaattggagatgcataccatttcctccaaggtgttcggagatattttggactttgcctacaccagcaggatcgtagtgaggctcgaatcattccccgagctcatgacagctgcaaaatttcttcttatgagaagtgtcattgagatttgtcaagaggtcataaagcagtccaatgtacagatcctggtgccaccagcgcgtgcagacataatgctgtttcgtcctccgggcacctcagatttgggatttcccctggatatgacaaacggagcggcactggccgccaactcaaacggaattgccgggtcgatgcagccagaggaggaagccgccagggctgcaggggctgccatagcaggccaagcaagcctgcccgtcctgccaggtgtggatagactgcccatggtagctggcccactttcaccccagctcctgacgtccccatttccctccgtggcctcctcagcacctcccttgacaggcaagcgagggcgtggccgacccaggaaggcaaacttactggacagcatgttcggctcacctggcggtctgcgagaagctggtatcttaccgtgcggcctgtgcggcaaggtcttcaccgatgctaacaggctgcggcaacatgaagctcagcacggtgtcacttctttgcaactcggatacattgatctgccacctccgagactcggagagaatggcttgccgatctccgaggacccagacggccctagaaagcgcagccgtaccaggaagcaagtggcttgtgagatttgtggcaagatctttagggacgtttaccatctgaatagacataagctgtcgcactcgggggagaagccctacagctgtcccgtctgcggtctgcggttcaagcgaaaagatcgaatgtcatatcatgttagatcgcatgacgggagcgttggtaagccatacatctgccaatcatgtggcaaaggattttcaagaccagaccaccttaacgggcatattaagcaagtgcacacaagcgaaaggccccacaagtgccagacctgtaatgcaagcttcgcgacaagagatcggctgcgatcccatcttgcttgccatgaggataaggttccttgtcaggtatgcggaaaatacctgagagccgcctacatggcagatcatctgaaaaaacattctgagggccctagtaacttctgctcaatttgcaaccgaggcctccaggcaccaggtgcccacccagaatggggcagttctgtgccactccgtcaggatctttggcagcaacgcaggccagaaatgctgacttctgggagtgattag

SEQ ID NO: 20247 - DNA, 1104 bp, Artificial Sequence
  Description of Artificial Sequence: Synthetic coding sequence
atgatgggcagcgtgctgcccgccgaggccctggtgctgaagaccggccttaaagcaccaggcttggccctggcagaggtgattacaagcgacattttacacagctttctctacggaagatggagaaatgtgctgggcgaacagctgttcgaggacaaatctcatcacgcgtccccaaaaaccgcctttaccgcggaagttctggctcagtcattctccggcgaggtgcagaaactgtcatccctcgtcctgcccgctgaagtgatcattgcacaatcttcaattccaggcgaagggctgggcattttttcgaagacttggatcaaagccgggacagagatggggccttttacaggacgtgtgatagccccagaacatgtcgatatttgtaagaacaacaatcttatgtgggaagtctttaatgaggatgggacagtgcggtacttcatcgatgcttctcaagaagatcaccgatcatggatgacctacatcaagtgcgcgcgaaacgagcaggagcaaaacctggaggtggtccaaattggaacgtcaattttttacaaagccatcgagatgatcccgccagaccaagagctgcttgtttggtatggaaactctcataatacatttctgggcatccctggggtgcccggcctggaagaagaccaaaaaaagaacaaacatgaggactttcaccctgctgattccgctgctggaccagctggcaggatgcggtgtgtaatctgtcaccggggctttaattcacgctccaaccttaggtctcatatgcggattcacactctcgataagcctttcgtttgtcgtttctgtaataggcgcttcagtcagagttctactctcagaaaccacgtgcgcttacatacaggggagcggccctacaagtgtcaggtgtgccagagtgcttactctcagctggctggcctccgcgcacatcagaagagcgcaaggcacagacctccttctactgctctccaggcccactcccccgctctccctgcacctcatgcgcacgcaccagctctggccgcggccgctgctgctgccgctgcagcagccgctcaccatctgcccgcgatggtactgtag

SEQ ID NO: 20248 - DNA, 2154 bp, Artificial Sequence
  Description of Artificial Sequence: Synthetic coding sequence
atgcacggcgccgcccgggcccccgccaccagcgtgagcgccgactgttgtattcctgccggactcagactgggccccgtgccaggtacgtttaagctgggtaaatacctttctgatcgcagggaaccaggccccaagaaaaaggttctgactatccagacctctgcacaccaggtcagaatggtgcgcggggaactggttgatgagtccggagggtctcctctggaatggatcggccttattagagcggctcgaaattctcaagagcaaacgctggaggcaattgctgaccttcccggaggccagatcttctaccgtgcgctgcgcgacgtccagcccggcgaggagttaaccgtgtggtactctaattcccttgcccagtggttcgacatcccaactaccgctactccgactcacgacgaaaagggtgaggaacgttatatctgctggtattgctggagaacatttcgataccccaactctttgaaagcacacctccggtttcattgcgtgttctccggcggcggtgggggagcctttctgcatcatgagcacgccgcccgtcagggcgccgtgccagccgctgatgggctcggcctgtccccaaagcctccggctcccgacttcgccgctccctcccaggccggcactctgaggcctcaccctttaggaccaccaccggttcaagcctgtggggcccgcgaaggaatcaaacgtgaggcttctagcgccccgagcgctacgtctcctacccccgggaaatgggggcagcccaaaaaaggtaaagaacaactggacagggccctagatatgtctggggctgcccggggtcaaggccattttctggggatagtcggaggctccagtgctggagtcggatcactggccttctatccaggcgtcagatccgcctttaagccagctggcctggctcgtgccgcggcagccgctcatggcgacccctaccgggaagagtcctcctctaagcagggtgcaggcctagccttagggagactattaggcgggggccgagcttgtgggcgaccaggtagtggtgagaattctgctgccgggggagctgggcatcaccaccatcatcatgcgcatcaccatcatcacccaaaatgccttctggccggggatcctccaccacctccccctccgggactaccttgttcaggagctttaagagggttccctctcctcagcgtgccccctgaggaggcaagtgcttttaaacatgtcgaacgcgcacctcctgccgctgccgctctgcctggggcacgctacgcccagctccccccagccccaggtctgcccctcgaacggtgcgccctccctcccctggatcccggtgggctgaaggcctatccggggggtgagtgtagtcatctccccgccgtgatgcccgcgtttactgtctacaacggcgagctcctgtatgggtcacctgcaaccaccgcatattatcccctaaaactccattttggaggcctccttaagtaccctgagtccatttcttacttctctggtccggccgcagcagcgctgagtccagctgagttgggcagtcttgcaagcatcgatagagagatcgcaatgcacaaccagcagcttagtgagatggccgcgggcaaaggtcgaggtaggctcgattcaggaacgctcccgcccgcggtggccgccgctggggggaccggaggcggaggcagcgggggaagtggggccgggaaaccaaaaactgggcacctgtgtttatactgcggcaagctgtactctagaaagtatggcctgaaaatccacatgcgtacccacacaggctataagccactgaaatgcaaagtctgtttaagacctttcggtgacccttccaatctcaataagcacattcgtttacacgccgaggggaatactccatacaggtgtgagttttgtggcaaagttctggtccgacgacgggacctcgaacgacacgtcaagagccgccacccggggcagagccttctcgccaaggcaggcgatggtcccggcgccgaacccgggtaccctccagagcccggggacccaaagagtgatgactctgacgttgatgtgtgctttactgacgaccagagtgatccggaggtcggcggaggcggcgaaagagatctctag

SEQ ID NO: 20249 - DNA, 2124 bp, Artificial Sequence
  Description of Artificial Sequence: Synthetic coding sequence
atgcacggcgccgcccgggcccccgccaccagcgtgagcgccgactgctgcataccggccggcctccgcctgggacccgtgcctggcaccttcaagctcggcaagtacctgtccgatcgccgtgaaccgggcccaaaaaaaaaggtgcggatggtgaggggcgaattagtcgatgagagcggcggcagtcccttggagtggatcgggttgatcagagccgctaggaatagccaagaacagactcttgaggcaatcgctgatctgcccggagggcagattttctaccgggctctcagggacgttcaaccaggagaggaattaacagtgtggtatagtaacagtctggcacagtggtttgacatccccaccaccgccactccaacacatgacgaaaagggggaagagcgatatatttgttggtattgctggagaactttccgatacccaaactctctcaaagctcacctgcgttttcattgtgtctttagcggtggagggggcggggcctttctgcaccacgagcatgccgcccgccagggcgccgtccccgctgccgacgggctcgggttaagtcctaagcctcctgcccccgactttgctgccccttctcaagcgggaaccctgcggcctcaccccctgggaccacccccagtccaggcctgcggtgccagggaggggatcaagagggaggcaagctccgcaccttcggccacctcaccaaccccgggcaaatggggacaacccaagaagggtaaagagcagcttgacagggcattagatatgtccggggccgcccggggacagggtcattttctcggaatcgtgggcgggagcagcgctggagtcggcagtctggctttttaccctggggtacgcagcgctttcaaacccgcagggctggcaagggctgctgctgcagctcacggcgatccttaccgtgaagaatcctcctcaaagcagggggccggcttggccttgggacgcctactggggggaggccgagcctgcgggcgccccggttccggagaaaattccgccgccggtggcgcaggccaccaccaccatcatcacgctcaccaccaccaccatcctaaatgtctgctggccggggacccacccccccctccaccccctggcctaccttgtagcggcgctctcaggggatttcctctccttagtgtccccccagaggaggcttccgccttcaaacatgtcgaaagggccccgcctgctgcagccgctctgcctggtgctcgttacgcacagctgccccccgctccagggctgcccctggagagatgtgccctgcctcctttagatccaggtggcttgaaagcctatccaggcggcgagtgtagccatttacctgctgtgatgccggcttttaccgtttacaatggcgagctattatacggaagtcccgccacaaccgcttattatcctctcaaactccactttggcggcctgcttaaatacccagagagcatcagttacttttctgggcccgccgccgcggccctgtctcctgcagagcttgggagcctggcctcaattgatagggagatagcaatgcacaaccaacaactgagcgaaatggcagccggcaaggggcgcggcagacttgacagtggaacgctgccacctgccgtagcagcagccgggggcacaggggggggcggctccggagggtctggagctggcaagcctaaaactggccacctctgtctttactgtggaaagctgtactcccggaagtacggactgaaaatacacatgcgtacccatactggttacaaaccactgaagtgcaaggtatgtctcaggccattcggcgatccttccaatctcaacaaacatattcggctgcacgctgaagggaacacaccttatagatgtgaattttgcggcaaggtcctcgttaggcgcagggacctcgaacggcatgtaaaatcacggcaccctggccaatcccttcttgccaaagctggggacgggccaggagctgaaccagggtatccacccgagccgggagatcctaagtccgacgacagcgacgtggacgtttgtttcaccgatgaccagagcgacccagaggtaggcggggggggcgagcgggacttgtag

SEQ ID NO: 20250 - DNA, 4524 bp, Artificial Sequence
  Description of Artificial Sequence: Synthetic coding sequence
atgccccggcggcggccccccgccagcggcgccgcccagttccccgaaaggatcgctactagaagccctgatcctatcccattatgcacttttcagcgccaaccccgtgccgcacctgtgcagccaccatgccgactgtttttcgtcacctttgcaggttgtggacaccgttggcggagcgagtcaaagcccggttggatctcccgatcacgtagcgggatagccctcagggccgccaggccacctggatcttcccctccaaggcctgcagctcccaggcctccgccacccggcggtgtggtggccgaggcccccggagacgtagttatcccgagaccgcgggtccagcctatgcgggtagcccggggcggcccgtggactcccaacccggcattcagggaggctgaatcgtggtcccagatcgggaaccagcgcgtgtcagaacaactgctcgagaccagcctgggcaacgaagtcagtgacacagagccactgagtcctgcctctgccggattgcgaaggaatccggccctgcccccagggccgttcgcacagaatttctcttggggcaatcaggagaatctaccccctgctctgggtaagatcgccaacggaggcggtactggcgctgggaaggcagagtgcgggtatgagacggaaagccacctattagagccccatgagatccccttgaatgtgaacacacacaagttcagtgattgcgaatttccctacgagttttgtacagtatgcttctcgccatttaagctgctgggtatgagtggggttgaaggagtctggaaccagcactccagaagtgcctctatgcataccttcttaaatcactcagccacaggcatccgagaggcaggttgtagaaaagatatgcctgtatcagagatggccgaagacggctctgaggagattatgtttatttggtgtgaagattgttctcagtatcacgactcagagtgtcccgagctaggccccgtcgttatggtgaaagattcattcgtgttgagccgtgcccgcagttggccggcttccggtcatgttcacacgcaggccggacagggtatgcgcgggtacgaggatagggatcgagctgatcctcagcagctacccgaggcagtgcctgctggactcgtgcgtaggctaagcggccaacaactgccctgccgaagtacccttacctggggtcgcctttgccacctggttgcacagggccgcagctcactaccccccaacctagagatcagaagactcgaggacggagccgagggcgtttttgccataacccagttagtgaagcgaactcagtttggccctttcgaaagcagaagagttgccaagtgggaaaaagagtctgcttttcctctcaaggtctttcaaaaagacgggcatcctgtgtgttttgatacttcaaacgaggacgattgcaactggatgatgctcgtgagaccggccgccgaggcagaacatcagaatttaacagcatatcagcatggttccgacgtttacttcactacctctcgcgacatcccacctggaacagagctccgggtctggtacgcggccttttatgctaagaagatggacaaaccaatgttaaagcaggcaggatcaggggtccacgccgccgggacacccgaaaactctgctccagtggagtccgaaccaagccagtgggcatgtaaggtgtgttctgccaccttcctggaactgcaactgcttaacgagcatctcctcggtcatttggaacaggccaagtccctcccccccggatcacaatccgaggccgccgctcccgagaaggaacaggatactcctcgcggggagcctccagcggtaccagaaagcgagaatgtagcaacaaaggaacagaagaagaagccccggaggggaaggaagccgaaggtttctaaggctgaacagcccctggtcatcgtcgaggacaaggagcctacagagcaggttgccgagattattactgaggtcccaccagacgaaccggtgtccgccacgcctgacgaaaggatcatggagttagtcctcggaaagctggcgacaaccaccactgataccagtagtgtccccaagttcacccaccatcaaaacaataccattaccctcaaaagaagcctaatcctgtccagccgacatggaatacggagaaaactgatcaagcagttaggcgagcacaagcgtgtttaccagtgtaacatttgttctaaaatctttcagaacagctctaatttgtctaggcacgtcaggagccatggcgacaaactgttcaaatgcgaggaatgcgcaaaactcttttcccgcaaggaaagccttaaacagcatgtctcgtacaaacactcgaggaatgaggttgacggagagtaccgctatcgttgcggcacctgcgaaaaaacttttcgaattgagagcgctctggagttccacaattgcagaaccgacgataaaaccttccagtgcgaaatgtgctttagatttttctcgaccaattccaatctgagcaagcacaaaaagaagcacggggacaagaaattcgcttgtgaagtgtgctccaagatgttctacaggaaggacgttatgctggatcaccaaagaagacacctcgagggcgttaggcgtgtgaaacgcgaagatttggaagctggaggggaaaatcttgtgagatataaaaaggagccctctggttgtccggtctgtgggaaggttttctcctgtagaagcaatatgaacaaacatctcctgacacacggggacaaaaaatatacttgtgagatctgcggacggaagttctttcgtgtcgatgtgctaagggatcacatacacgtccattttaaagatatcgcactcatggacgatcatcagcgggaggaatttatagggaagatcgggatctcaagtgaagagaatgatgacaacagcgatgagtccgctgattctgagccacataaatactcatgtaagcgctgtcagttgaccttcggaagaggtaaagagtacttgaagcatattatggaggtccacaaggagaagggatacggatgcagtatatgcaataggcggtttgccttgaaggcaacctaccatgctcacatggttattcaccgcgaaaacctccccgaccccaacgtgcagaagtatatccatccatgcgaaatctgcggacgcatttttaactccattggaaacctagagcgccacaaactgattcataccggcgtcaaatcacatgcctgtgagcagtgtggcaagagcttcgctagaaaagatatgttaaaagagcatatgagagttcacgacaatgtgcgggagtacctatgcgctgaatgtggtaaaggaatgaaaaccaagcatgccctgcggcatcatatgaagctgcataaggggatcaaggaatatgaatgcaaggagtgtcatcggcggttcgctcaaaaggtaaatatgttgaaacattgtaaacggcacactggcatcaaagatttcatgtgtgagctatgcggaaaaaccttctcagagcggaatactatggagacacacaaactgatccataccgtcggcaaacagtggacatgttctgtatgcgacaaaaaatacgtcaccgagtatatgctgcagaagcacgtgcagctgactcatgacaaggtggaggcacagtcatgtcagctttgcggcacaaaagttagtacacgcgcaagcatgtccaggcacatgcggagaaagcatcctgaagtgctggccgttagaatcgatgacctggatcatttacctgagacaaccacaatcgatgccagttctatcgggatcgtgcagccggaactcaccctggaacaggaagatctcgccgagggaaagcacgggaaagctgccaaaagatcccacaagcgcaaacaaaaacccgaggaagaggctggagcaccggttcctgaagacgccactttctcagagtatagcgagaaagaaaccgagttcaccgggagcgtcggagacgaaactaattccgcagtgcagtcaattcagcaggtggtcgttactcttggagatccaaatgtgacgactccctctagcagcgtggggttgacgaatatcacagtgaccccaattacaactgccgccgccactcagttcactaatctgcagcctgtggcagtaggtcacctgaccacacccgagcggcagttgcagctagataattccatcctcactgtaacatttgataccgttagcgggagcgctatgctgcacaacaggcaaaatgatgtgcagatccatccacagccagaagcctccaaccctcagtcagtggctcacttcattaatctgacaacccttgtaaactctattacacctcttggcagccagctcagcgatcagcaccccctgacatggagagccgtcccacagacagacgttctcccacccagccaacctcaggctcccccgcagcaggctgctcaaccgcaggtgcaggccgagcagcagcagcagcagatgtactcttattag

SEQ ID NO: 20251 - DNA, 1557 bp, Artificial Sequence
  Description of Artificial Sequence: Synthetic coding sequence
atggccgaggacggcagcgaggagatcatgttcatctggtgcgaggactgctcacagtaccatgattccgaatgcccagaattagggcctgtagtcatggtaaaagattcatttgtactgtctagagcacgttctagcctcccgccaaatttggagattcggagactagaagatggggcggaaggcgtctttgccattacccagctggtgaaacggacccaatttggtcccttcgagagtaggagggtggcaaaatgggagaaagaatctgccttccccttgaaggtgttccagaaggatggtcacccggtgtgctttgacactagcaacgaagatgattgtaattggatgatgctggtccgccccgcagctgaggccgaacatcagaaccttacggcctaccagcatggttctgacgtgtacttcaccactagtcgagacattccacctggcaccgagctacgtgtctggtacgctgctttctacgctaagaagatggataaacccatgttgaagcaagccggctcaggggtgcatgcagccgggacgcccgaaaactccgccccagttgagtccgagccttctcagtgggcatgtaaagtctgctcggccacctttctggaattgcagctcttaaacgaacacctccttggacacctcgagcaggcaaaaagcttgcctcccggttctcaatcagaggcagccgcgccagaaaaagagcaagatacacccagaggggagcctcctgcagtgcccgaaagcgaaaatgtggcaacaaaggaacaaaagaaaaagccacgccggggacgtaaaccaaaagtctccaaggcggagcagccgcttgtaattgtggaggataaagagcccaccgagcaggtcgctgaaatcataacagaagtgccgcctgatgagcccgtttccgccacacctgatgaacggatcatggaactggtcttaggaaagttagctaccaccaccactgacacctcctctgtgcctaaatttacccatcaccagaacaataccattacactgaaacggtccctgattctctcttcccggcacggaatcagacggaagctgatcaagcaattgggggagcacaaacgggtctaccagtgtaacatctgcagcaagatcttccagaacagcagtaatctcagccgccatgtgaggtcccacggagataagcttttcaaatgcgaagagtgtgctaagctgttttcccggaaggaatccctgaaacagcatgtaagttataagcacagtagaaatgaagttgacggggaataccggtatcgctgcggaacctgcgagaagacttttcggatagagtcggcacttgagtttcacaattgcaggaccgggctgatagcccatcctggggaaggcgggcccgggggttctagactccgggacctcccagccacgtctccgagcacacgccgttcgacggcaacacgtagcctgcccgttagatcagctgcccgctgctccacggctaggacgtcctgctggactaccagcgccggcacctggaaaacgtgtgccgcctag

SEQ ID NO: 20252 - DNA, 3537 bp, Artificial Sequence
  Description of Artificial Sequence: Synthetic coding sequence
atgccccggcggcggccccccgccagcggcgccgcccagttccccgaacgaatcgccacaaggagccctgatccaatccctctgtgtacgttccagaggcaagtttccgagatggccgaagacggttccgaggagataatgtttatttggtgtgaggactgttcccagtatcatgattctgaatgccctgagttgggccctgttgtcatggtaaaagatagcttcgtcctgagtagggccaggagttccctgccacccaacttagagatccgaagactggaggacggcgcagagggagtgtttgcaattacccagttggtgaaaagaacgcagtttggtcccttcgagtcacgcagagtggccaagtgggaaaaggagtctgccttccctttaaaagttttccagaaggatggccatcccgtgtgtttcgacacatccaacgaggacgactgcaactggatgatgctagtaaggcccgcagccgaggccgaacaccaaaacctgacagcataccagcacggttctgacgtctacttcactactagcagagacatcccccctggaaccgaacttcgcgtgtggtatgcagcattttacgccaagaagatggacaaacccatgctgaaacaggcaggaagtggcgtacatgctgcaggaacgcctgaaaatagtgcccctgttgagagtgagccttcacagtgggcttgcaaagtgtgtagcgctaccttcctcgagttgcagcttctcaatgaacatctgctcggacacctggaacaggccaaatctttgcctcccggaagccagtctgaggctgccgctcctgagaaggaacaggacacacccaggggggagccaccagccgtgccagaaagtgagaatgtagcaaccaaagagcagaaaaagaagcccagaagagggagaaagcccaaagtgtccaaggcagagcaaccattggttatagtggaggataaggagcctactgaacaggtggctgaaattataacagaagtccctcctgacgagcctgtgagcgccacacccgatgagcgcattatggaactcgtgctgggaaagctagccacgactacgacagatactagttctgtacccaaattcacacatcaccagaacaacacgattactttaaagaggtcactgatcttgagttcaaggcacgggattcggaggaagctgatcaaacaattaggtgaacataagcgtgtgtatcagtgcaatatttgttccaaaatattccagaacagcagtaatctgtcccgacacgttaggagccatggagacaaacttttcaagtgtgaggaatgtgcaaaactgttcagtcggaaggaaagtctgaaacagcacgtctcatacaaacactcgcgaaacgaagtcgatggagagtaccgatatcggtgtggtacttgtgagaagactttcagaattgagagcgccttagagttccacaactgccgcaccgacgacaaaactttccagtgcgagatgtgcttccgctttttctccactaatagtaacctgtccaagcacaaaaaaaagcacggcgataagaagttcgcttgcgaagtttgctcgaaaatgttctaccgcaaggatgtgatgctcgaccaccagcgacggcaccttgaaggggtgagacgggtgaaacgagaagaccttgaggcaggtggagagaacctggtgcgctacaaaaaggagccaagcggctgcccagtgtgcggaaaggtattctcgtgtcgaagtaatatgaataaacatctgctgacccatggcgacaaaaaatacacctgcgagatttgtggccggaagtttttccgggtcgatgtacttcgtgaccacatccacgtgcacttcaaagatattgccctgatggacgatcaccaacgtgaggagttcattggcaagattggaattagctccgaagaaaatgacgacaactctgatgaaagcgccgactcagagcctcataaatactcatgtaagcgctgccagcttaccttcggccggggcaaagagtatctcaagcacataatggaggtgcacaaggaaaaggggtatggctgcagtatctgcaacaggcggtttgccttgaaggccacttatcacgcgcacatggtcattcatagagaaaacttgcccgaccctaatgttcagaaatatattcatccatgtgaaatttgtggccgtattttcaactctattggcaatctcgaaagacacaagctgatccataccggggtgaaatctcacgcttgtgagcagtgcgggaagagttttgcgagaaaagatatgcttaaagaacatatgagagtacatgacaacgtccgggaatatctatgtgccgaatgcgggaagggaatgaaaactaaacacgccctgcgccatcacatgaaactccacaaaggcattaaggaatatgaatgtaaagagtgccacagaaggtttgctcagaaagtcaacatgttgaaacactgcaagagacatactggaataaaagacttcatgtgtgaactctgcggtaagaccttttccgagcggaacactatggaaacacacaaattgatccataccgtgggcaagcaatggacatgtagcgtctgcgacaagaagtatgtgaccgaatacatgctacaaaaacacgtgcagctcacacatgataaagtagaagcacaatcttgccaattgtgcggtacaaaggtttcgacaagggccagcatgagcagacacatgcgccgcaagcatcccgaggttctggccgttagaatagatgacctggatcatcttcctgaaactaccaccattgacgctagttcaatcggcattgttcagccggagttgaccttagagcaggaagacctcgcggagggcaaacacggtaaggctgccaaacggagccacaaaagaaaacaaaagcccgaagaggaagccggcgctcctgtgccggaggacgccactttttcagaatacagtgaaaaagaaactgagtttaccggatccgtcggtgacgagacaaattccgcggtacagagtattcagcaggtggtggtgaccttgggcgaccccaacgtcacaaccccttcctccagcgtaggactcactaatataacagtcactcccattacgactgcagcagctacacagttcacaaatttgcagccagtggcggtcggacacctcacaacccctgagagacagttacagctcgataatagtatcctgaccgtcacattcgataccgtcagcggtagcgccatgctccataacaggcagaatgatgtgcaaatccaccctcaacccgaggcatccaaccctcaaagcgtcgctcatttcatcaacctgaccacgctagtgaactccataacacccctaggatcccaactgagtgaccagcaccccttgacatggcgggccgttccgcagaccgacgtcctgcctccatcccaaccacaggcccccccgcaacaggctgctcagccccaggtgcaagcagaacagcagcagcagcagatgtattcatactag

SEQ ID NO: 20253 - DNA, 4524 bp, Artificial Sequence
  Description of Artificial Sequence: Synthetic coding sequence
atgccccggcggcggccccccgccagcggcgccgcccagttccccgaaaggatcgcaacacgatcccccgaccctatcccattgtgcaccttccagaggcaaccccgcgcggctcctgtgcagccaccttgtagacttttcttcgtcacctttgccggctgcggtcaccggtggcgaagcgagtctaaacccggttggatcagtagatctcgctcaggcattgccctgcgcgccgcacggccgcccggaagttcaccccccagaccagctgcccctagaccgccgcccccagggggggtcgtggcagaggcccctggagacgtcgtaatccctaggccccgagtgcagcccatgcgtgttgcaaggggcgggccctggacacccaacccagccttcagagaggccgagtcctggtcccagattggcaaccagagggtctctgagcagctgctggagacctcccttgggaacgaggtgagcgataccgaacctctgtccccagcatccgccggcctgcgccgaaatcccgcactgccgcccggacctttcgcccagaactttagttggggcaaccaggagaacctacccccggcactgggaaagatcgcaaacggcggtggtaccggagccggcaaggcagaatgtgggtatgagacagaatctcatctgttggaacctcacgagatacccctgaatgtgaacacacataaattcagtgactgcgagtttccttatgagttttgcactgtgtgtttctcccccttcaagctccttggcatgtcaggtgtggaaggagtatggaaccaacactccagaagcgcatccatgcataccttcttaaaccactccgccactggaatccgcgaggctggctgccgtaaagatatgcctgtgtcagagatggctgaagacgggtccgaagagatcatgtttatatggtgcgaggactgcagccagtaccacgactctgaatgtccggaactcggccctgtggtcatggtgaaagactctttcgttctttccagagctagaagctggccggccagcgggcacgtccacacccaggctggacagggtatgcgaggatatgaggatagagatcgggccgatccacagcagctccccgaggccgtccctgctggactggtccgtcgcctgtctggccagcagctgccgtgtagatctactctcacgtggggccgcctgtgtcacctcgtggcacaggggcgctcttcattgcccccaaacctcgaaatacgccgattagaggatggcgccgagggggtttttgctattacccagctggttaaaagaacacagttcgggccattcgagtccaggagagttgctaaatgggaaaaagagtcggcattccccctcaaagtgtttcagaaggatgggcacccagtgtgtttcgacacctctaacgaggacgactgcaactggatgatgctcgttcggccagctgctgaggccgaacaccaaaatcttaccgcttaccagcacggatctgatgtttactttaccacttcacgtgatatacctcccggcaccgagcttagagtatggtatgcagctttctacgccaaaaagatggataaacctatgctgaaacaggccggatccggggtacacgctgccggtaccccagaaaatagtgcacctgtagagagtgagccatctcaatgggcctgcaaagtgtgttctgctacgtttctggagttgcagctattaaacgagcacctgctggggcatcttgagcaggccaaaagtctgccccctggcagccagtccgaagcggccgctcctgagaaagagcaggacacccctcgcggcgagcctcccgcagtccccgagtctgagaatgttgccaccaaggaacagaagaaaaagccccgcagaggacgtaagcctaaggtctctaaggcggaacagcccctcgtgatcgtggaagataaggagccaaccgagcaagtggctgagattattaccgaggtgcctcctgacgaaccagtgagcgccacccccgatgaacgcataatggaactggttctgggtaaactggccacgactactaccgacaccagctctgttccaaaatttacccatcaccagaataatacgatcaccctaaagagatccctcattctcagcagccggcatggtattcggagaaaactgataaaacaacttggagagcataagcgcgtctaccagtgcaacatatgttccaaaatttttcagaactcatctaacctgtccaggcacgtgagaagtcacggagacaagctttttaaatgcgaagagtgcgcaaagctgttctctcgtaaggagagcctgaaacagcacgtttcttacaaacacagcagaaatgaagtcgacggggagtataggtatcggtgcggtacatgcgaaaagacatttcggatcgaatccgccttggagtttcataattgccggaccgacgataaaacctttcagtgcgagatgtgctttcgcttcttctctaccaacagtaatctttcaaagcacaagaagaagcatggtgacaagaagtttgcatgcgaggtgtgcagcaaaatgttttaccgcaaggacgttatgctggatcatcaacggaggcatctagaaggcgtgagacgcgtcaagagagaggatttggaagcaggaggcgagaacttggtgagatataagaaggaaccatccggctgtcctgtctgtggcaaggtctttagctgccgctcgaacatgaacaagcacctcttgacacatggcgacaaaaagtatacatgcgaaatctgcggcaggaaatttttccgggtggatgtcctgagggatcacattcacgtgcactttaaggatatagctctaatggatgaccaccaaagggaggaatttatcggaaaaattgggatttcttccgaagaaaacgacgacaatagtgacgagagtgcagactctgaaccccataagtattcttgtaagcgatgccagttaaccttcgggcgaggtaaagagtacctcaagcacatcatggaggtgcataaggagaagggctacggatgcagtatctgcaaccgtcgtttcgccctcaaggcaacataccatgctcacatggtgatccatagagagaatctgcccgacccaaatgtgcagaagtacattcacccttgcgagatttgcggccggatctttaacagcatcggaaatctagagaggcacaagctgatccacaccggagtgaagtctcacgcatgcgaacagtgcgggaaaagtttcgctcgaaaggatatgctcaaagaacacatgagggtgcacgataacgtcagagaatacctgtgcgcagagtgtggaaaaggaatgaagactaagcacgccctgaggcaccatatgaaactacacaaggggatcaaggagtatgaatgtaaagaatgccataggagatttgcccagaaagtgaatatgctgaaacactgtaagcgccatacaggcatcaaggatttcatgtgcgagctatgtggtaagacatttagcgaacgcaacactatggaaacccacaagttaattcatactgtcggcaagcagtggacctgcagcgtttgtgacaagaagtacgtcacagaatacatgctccagaagcatgtgcagctcacccacgataaagtcgaggctcaatcttgccaactgtgcggcaccaaagtgtcaactagagcatccatgtccaggcacatgcgcagaaagcatcccgaggtcctggctgtacggattgatgatcttgaccatcttccagaaactaccacgatagatgccagcagtattggaattgtgcagcccgaacttacattggagcaggaggatcttgcagagggcaagcacggtaaggccgctaaacggtcacataagcgaaaacaaaagccagaggaagaagctggggcgcccgtcccagaggacgcaaccttctcagagtattccgagaaggagactgaatttaccggctccgttggggacgagaccaacagcgccgtacaatccatccaacaagtggtcgttacgctcggagatcctaacgtcacgactcccagctcctcagtgggacttactaatattacagttacccctatcactacagccgctgccacccagttcactaatttacagccagtcgccgtcgggcatctgaccacacctgagaggcagctgcagctcgacaatagcatccttaccgtgacttttgataccgtgtcaggctctgctatgctccacaacaggcagaatgacgtgcagatccacccacaacccgaggcctctaacccccaatccgttgcacattttattaatctgacaactctggtcaatagcatcacgcccttaggctcccaactctccgaccagcatcccctgacctggcgtgctgtgccacagacagatgtactgccgccgtcccagccacaggcccctcctcagcaggcagcccagccccaggtgcaggccgagcagcaacagcagcagatgtactcttattag

SEQ ID NO: 20254 - DNA, 1437 bp, Artificial Sequence
  Description of Artificial Sequence: Synthetic coding sequence
atggccgaggacggcagcgaggagatcatgttcatctggtgcgaggattgctcgcagtaccatgacagcgagtgtcccgaattaggtcctgttgtgatggtcaaggattctttcgtattgtccagagccaggtccagcctgccacccaatctggaaatccgccgcctcgaggatggcgccgagggtgtgttcgcaataacacaactggtgaagcgaacacaatttggcccattcgagagccggcgggttgcaaagtgggaaaaggaatccgccttcccgctgaaggtcttccagaaagatggccacccagtttgcttcgacactagcaacgaagacgattgcaattggatgatgttggtcaggcccgctgcagaggccgagcaccagaatttaacagcgtatcagcatggatctgatgtgtatttcaccacgtccagagatattcctcccggcaccgagctgagggtgtggtacgccgctttctacgccaaaaagatggataaaccgatgttaaagcaggcgggaagcggggtgcacgccgcagggactcccgagaattcggcaccagtggagtccgaaccatctcaatgggcctgtaaagtatgttcggctacctttttggagctccagctcttaaatgagcacttactaggtcaccttgaacaagcaaagagcttgccaccaggaagccaatccgaggcagccgcaccggaaaaagagcaggatacacctagaggggagccccccgcagtccctgaatcagagaatgtcgccaccaaagagcagaaaaaaaagccccgccgtggaagaaagcctaaggtgtcaaaggccgagcaacctcttgtgattgtcgaggataaggaaccgaccgaacaggtggccgagattatcacggaagttcctcccgacgaacccgtgtccgccacccccgatgaacgcatcatggaactggtgctgggcaaactcgctactacaactactgataccagttctgtccctaagcacggcattcggaggaagcttatcaaacagctgggagaacacaaacgagtctaccaatgtaatatctgtagtaagatattccagaacagttcaaatttgtcaagacacgttcgatcccatggcgataagctgttcaagtgtgaggagtgtgccaagctgttttccaggaaggagagtttgaaacaacatgtcagttataaacactcaaggaacgaagttgacggagaatacaggtatcgctgtggtacctgcgagaagaccttccgaattgaatcggcacttgaattccacaactgcagaaccgcgacttctccttctaccaggcgctcgactgctaccagatctcttcccgtccgcagtgcagcccgctgcagcactgcccggacctcttgttggactacctctgctggtacctggaaggagtgtggcgaatag

SEQ ID NO: 20255 - DNA, 3426 bp, Artificial Sequence
  Description of Artificial Sequence: Synthetic coding sequence
atggccgaggacggcagcgaggagatcatgttcatctggtgcgaggactgcagtcaataccacgattctgagtgcccagaactgggtccagtagtgatggttaaggacagttttgttctgtcacgggcacgcagctctctgccaccaaatctggaaatccgccgtctggaagacggtgccgagggtgtttttgctatcacacagcttgtgaaacgcacccaattcggacccttcgaatcacgtcgagtcgcaaaatgggaaaaagaatctgcgttcccattgaaagtgttccagaaagatggtcaccctgtgtgcttcgacacaagtaacgaggacgactgcaattggatgatgctcgtaaggccagctgctgaggccgagcaccagaacttaacggcttaccagcatggttccgatgtctacttcacgacaagccgtgatatccctccaggaacagagttgagggtttggtacgcagccttctatgccaaaaagatggacaagcctatgttaaagcaggcagggagtggagttcacgccgctgggaccccagagaactccgccccagtagagtcggagccgagccagtgggcttgcaaagtctgttcagctacttttctagagctccaactgctgaatgagcacttattggggcatctggagcaagccaaatcactaccacccggtagtcagagcgaggcggcagctccagaaaaggaacaggacacacctagaggtgaaccccccgccgtacccgagtctgagaatgttgctaccaaagaacaaaagaagaagcctcgtaggggccgcaagccaaaagtttccaaggccgaacagccactggtgatcgtggaggacaaagagcccacggagcaggtcgctgagataattacagaggttccacccgacgagccagtttctgctacgccagatgagcgtatcatggagcttgtcctggggaagctcgcgacaacgacaacagacacttccagtgtgcccaaatttacccatcaccaaaataacaccatcaccctcaaacggagtctgatcctctcaagccgtcacggtatccgcagaaagctcatcaagcagctgggggaacataagagagtttaccagtgcaatatctgcagtaagatcttccaaaattcctccaacctgagccggcacgtaagatcacacggggacaaactgtttaagtgcgaggaatgcgccaaactgttttcccgtaaagaaagcctgaagcagcatgtctcctataagcactccagaaacgaagtcgacggcgagtatcgctataggtgtggcacgtgcgagaaaacattcaggatcgagagcgcccttgaatttcataactgccgtacagacgacaagacattccagtgtgagatgtgctttcgattcttttcaactaatagcaatctcagtaagcacaaaaaaaagcacggagacaaaaaattcgcctgtgaagtgtgtagcaagatgttttatcggaaggacgtgatgctggaccaccagcgacggcacctcgaaggggtcaggcgagtgaagcgtgaggacttagaagcaggtggcgagaatctggtgcgctataaaaaggagccttctggatgccctgtgtgcggaaaagtctttagctgtagatccaacatgaacaagcatctgcttacacatggtgacaagaagtacacgtgcgaaatctgcggtcgcaagttttttcgcgtggacgtattgagggaccacatccatgtgcacttcaaagatatcgccttgatggatgaccatcagcgcgaagagttcattggcaagatcggcatttcctcagaagaaaatgacgacaatagtgacgagtcagccgacagcgagccacacaaatactcctgcaaaaggtgtcaactcacattcggtaggggcaaagagtatttgaaacatataatggaagtccacaaggaaaagggctacggatgtagcatttgcaatcgcaggttcgcactgaaggcaacatatcacgctcacatggtcattcatcgggagaatctgcctgaccccaacgttcagaaatacattcacccttgtgaaatctgcggccgcatatttaatagcatcgggaacctcgaaagacacaagctgatacacacaggcgttaagtctcacgcttgtgagcagtgtgggaagtcttttgcaaggaaggacatgctgaaagaacatatgcgagtgcatgacaacgtgcgcgagtacctttgtgccgagtgcggaaagggcatgaaaactaaacatgctttgaggcatcatatgaagctacataaaggaatcaaggagtatgagtgtaaggagtgccaccgccgtttcgcgcagaaagtaaacatgctaaaacactgcaaaaggcatacggggataaaggacttcatgtgtgagctgtgtggaaaaactttctctgagaggaacactatggagactcacaaactgatccacacggtgggaaaacagtggacctgcagtgtttgtgacaagaaatatgtgaccgagtacatgttgcagaaacacgtccagctcacgcacgacaaggtcgaggcacagagctgccaattgtgcggaactaaggtttctacccgggcgtcaatgtcccggcacatgcggaggaagcacccggaggtgctggctgttcggatcgacgacctggaccacctgccagagactacgacaatcgacgcatcgtcgattggcattgtccaaccagagctgacacttgagcaggaagatctcgctgaaggcaagcacggaaaggcggccaagcgttcccataagaggaaacaaaaacctgaggaggaagccggcgctccagtccccgaggatgcaaccttctcggagtactctgagaaggagactgaattcaccggttccgtcggagatgaaactaattctgcagttcaatcaatacagcaggtcgtggttactctgggcgaccctaatgttacaactccatcatcatctgtcggactcactaacattactgtgacacctatcaccacagctgcagcgacccagttcactaacctgcaacccgtagcagtgggccatttgaccacccctgagaggcagctgcagttggacaatagcatcctgaccgttacttttgatacagtttccgggagtgccatgttgcataaccggcagaatgatgtccagatccatccacagcccgaggcctctaacccgcagagtgtagctcatttcatcaacctcacaaccctggtgaacagtattactccactcgggtctcagctctccgaccaacaccctctcacttggcgcgccgttccccaaaccgacgtgctgccaccgagccagcctcaggcaccaccccagcaggccgcgcagccgcaggtgcaggccgagcagcagcaacagcagatgtattcgtattag

SEQ ID NO: 20256 - DNA, 1668 bp, Artificial Sequence
  Description of Artificial Sequence: Synthetic coding sequence
atgccccggcggcggccccccgccagcggcgccgcccagttccccgaacgcatcgcaaccagaagtcctgatcccataccactgtgtacctttcaacgccaggtcagcgagatggcagaagatggctctgaggaaataatgtttatttggtgtgaagactgttctcagtatcacgatagcgagtgtccagagctgggccccgtggtgatggtgaaagactccttcgttctgtcccgcgcgcgctcctctctgccccccaatctggagatccgacgactcgaggacggcgcagaaggtgtgtttgccataactcagctggttaagcgcacccaattcggtccttttgaatcaagacgagttgctaagtgggaaaaagaatccgcttttccgttaaaggtgttccagaaggatggtcaccctgtttgctttgatacctcaaacgaagatgactgcaactggatgatgttggtccgccctgctgctgaagccgagcaccaaaacctgactgcctatcaacatgggagtgacgtgtactttacgacaagcagagacatcccccccgggacagagctaagagtgtggtacgcagctttttacgctaagaagatggataaacccatgcttaaacaggcgggttctggtgtccacgcagcaggcacacctgagaatagcgccccagtggagtctgagccttctcagtgggcttgcaaagtgtgttctgccacctttttagaactacaattgttgaatgaacacttgctggggcatttggaacaagctaaaagtctgccaccgggcagtcagtccgaggctgcagctcccgaaaaggagcaggacacaccccggggggaaccacccgccgtgccggagtcggaaaatgtagcaactaaagagcagaaaaagaagcccaggagaggacggaagccgaaagtctccaaagctgagcaaccactggtgattgtcgaggacaaagaacccacagagcaggttgctgaaatcatcacagaagtgccccctgatgagccagtgtccgcaactcctgacgagcgcataatggaactcgtgttgggaaagctggccacaactacaaccgacacctcttccgtccctaagttcacgcaccatcaaaacaacactatcaccctcaagcgatcgttgatactctcaagtagacatggaattagacgcaagttgatcaaacaattaggagaacataaacgcgtttatcagtgcaacatttgctcaaagatcttccaaaactcaagtaatctcagtcgtcacgtgcgctcccatggcgacaagctttttaaatgtgaggaatgtgccaagctttttagtcggaaggagtccctcaagcagcatgtgagttataagcactccagaaatgaggtggatggcgaatatagatatcgctgcggcacgtgtgaaaaaaccttcaggatcgaatcagccctggaattccacaactgcagaacggggctgattgctcaccccggggaaggtgggcctggagggtccaggctccgcgacctgccagctacctccccgtcaactaggaggagcaccgctacgcggagcttaccagttcgctctgccgcacggtgtagcacagccagaacttcatgctggaccacctcagcagggacctggaaagaatgcggagaatag

SEQ ID NO: 20257 - DNA, 3486 bp, Artificial Sequence
  Description of Artificial Sequence: Synthetic coding sequence
atggccgaggacggcagcgaggagatcatgttcatctggtgcgaggattgtagtcaataccatgattctgagtgcccagagctaggacctgtcgtaatggtgaaggacagcttcgtcctttcccgggccagaagttccttgccccccaatctggaaatacggaggttggaggatggcgctgagggcgtgttcgctatcacccagcttgtcaagaggacgcagttcggcccttttgaatcccggcgcgtggcaaaatgggaaaaagaaagtgcattcccccttaaagtgttccagaaagatggacacccagtctgtttcgatacaagcaacgaagacgattgtaactggatgatgcttgtgagacctgctgccgaagcggagcaccagaaccttactgcttaccagcatggatccgacgtgtattttacaaccagtagagatatccctcctggcaccgagctgagggtatggtacgccgcattctatgccaaaaaaatggataagcccatgctgaagcaggcgggatccggggtgcacgccgcaggaactcctgagaattccgcccctgttgagtccgagcccagtcagtgggcctgtaaagtctgtagcgccacttttctcgaactacaattgctaaatgaacatcttctcggccacttggagcaagccaagagtctgcccccaggaagtcagagcgaagctgctgcccctgagaaggagcaggacactccgaggggcgagccaccagccgtgcccgagtccgaaaatgtggctacaaaagaacagaaaaagaagcctagaaggggaaggaagcccaaggtcagcaaggctgagcagccgctcgtaattgtggaggataaagagccaacagagcaagtggctgagattatcaccgaggttcctcccgatgagccagtttcagccacacccgacgagagaatcatggagctggttttgggtaaactggcaactaccaccactgacactagctccgtccctaagttcacccatcaccagaataacacaatcacgcttaagagatccctgattctgagctcacggcacggcatacggagaaagttgattaaacaattaggcgagcacaagagggtctaccagtgtaatatctgttccaagatcttccagaatagctccaatctgtcacggcacgttagatcccacggcgacaaattgttcaagtgcgaagaatgcgcaaagctctttagtagaaaggaaagcctgaagcaacatgtgtcttataaacactccaggaatgaggtcgacggcgagtaccggtaccgatgcgggacatgcgagaaaacttttcgtatcgaaagcgccctggagtttcataattgtcggaccggtttgatcgcacaccccggggagggaggtccgggaggttctcgtttgcgggacttacccgatgataagacctttcagtgtgaaatgtgttttcggttcttctctaccaactcaaacctgtcaaaacacaaaaagaagcatggcgataagaaattcgcttgtgaggtttgttcaaaaatgttctaccgcaaagatgtaatgctagaccaccagcggcgccatctcgagggagtgcgacgagtcaaaagagaggacttagaggcaggcggcgagaatctggtgaggtacaagaaggaaccctcgggatgccccgtctgtggaaaggtcttttcatgcagaagtaacatgaacaaacatctgttaacccacggcgacaaaaaatatacgtgcgaaatttgcggaaggaaattttttcgcgtggacgtcctgagagatcatattcatgtgcatttcaaggatatagcgctgatggatgatcaccagagagaggagtttattggcaagataggcatttcttcggaggagaacgatgacaacagtgacgagtcagccgattcggaaccccacaaatacagttgcaagaggtgtcagttgacatttggccgcggtaaggaatatctcaagcacattatggaggtccataaggagaagggctatggatgttcaatatgcaatagaagatttgcacttaaggccacttatcacgcacatatggtgatacaccgagaaaacctgccagaccctaacgtccagaaatacatccacccctgcgagatctgtggacggattttcaactccatcgggaatctggagaggcacaagttgatacacacaggggtcaagagccacgcttgcgaacaatgcggcaagtcttttgcccgaaaggacatgctgaaggaacatatgcgggtccacgacaacgtgagggagtatctgtgcgccgagtgtggcaagggaatgaagacaaagcacgccctgagacaccacatgaaactccataagggcatcaaagaatatgagtgcaaagagtgtcaccggaggttcgctcagaaagtcaacatgcttaagcactgcaaaagacatacaggaattaaggactttatgtgcgaactgtgcggtaagacattctcagagagaaatacaatggagacgcataagcttatccacacggtgggaaaacaatggacttgttcagtgtgtgataaaaagtatgtaactgagtatatgctgcagaaacatgtacagctgacccacgacaaagtggaagcccagtcttgccaactctgcggaactaaggtctccacccgcgcgtctatgtccagacacatgcggagaaaacaccctgaggtgttggcagtccgcatcgacgaccttgaccatctcccagagacaactacaatagacgcatcatcaataggcattgtgcaacccgaactgacactggagcaggaagatctggctgaaggcaaacatggcaaggccgccaagcggtcgcacaaaagaaagcagaaacctgaggaggaggccggtgctccagttccagaggacgcaacattcagtgaatacagtgaaaaggagacggagtttacaggatcggttggggacgaaacaaacagcgctgtgcaatccattcaacaggttgtcgtgactttgggggatccaaatgtaaccacccccagctcatcggtggggctcacaaacatcactgtcacccccatcacaactgccgcggccacccaattcacaaacttgcaacccgtagccgtgggccacctgaccactccagaaagacagctgcagttggataattcgattctgacagtcacatttgatacagtatctgggtcagctatgctgcataacaggcaaaatgatgtgcaaatccatcctcagccagaagcgtcaaacccccagtccgttgcccacttcatcaatctaacaactttggttaactccatcacacctctcggttcacaactctctgatcagcatcccctgacatggagagccgtaccccaaaccgacgtactgccaccctcccagccccaggctcccccccagcaggccgcccagccccaggtgcaggctgagcagcaacagcaacagatgtactcttattag

SEQ ID NO: 20258 - DNA, 1788 bp, Artificial Sequence
  Description of Artificial Sequence: Synthetic coding sequence
atgctgaagcccggcgaccccggcggcagcgccttcctgaaggtggacccagcatatctccagcattggcagcagttgtttccccacggtggggccggcccactcaaaggttccggagcggcggggctgctttctgcgccacagccacttcagcccccgccccctcctcctcctcctgagagagccgaaccaccgcccgacagcctcaggcctcgcccagcttctctatccagcgctagttccacccctgccagctcgagcacaagcgcctcctcagcatcctcctgtgcggccgccgcggctgcggcggctctggcagggttatccgcattgcccgtcagtcagctgccagtgtttgctccattggccgcggctgctgtggccgccgagcccctgccaccgaaggaactgtgcctgggagcaacctccggccccggccccgtaaaatgcgggggaggcggggggggtggaggggagggccggggagcccccagattcagatgttcagcagaagaactcgattactatctgtatggccagcaaaggatggaaatcatcccacttaatcagcacactagtgatccaaataacaggtgtgacatgtgcgcagataacaggaatggtgaatgcccgatgcacgggcctctgcactctctccgccgcctggtggggacatcatccgcagccgccgcagcccctccgcctgagctgccagagtggctcagggatctgccacgagaggtctgcctttgcacttccacagtgcctggcctggcttacgggatctgtgccgctcagcgaatccaacaaggtacttggatcggcccattccaaggagtcctgctgccgccagaaaaggtacaggcaggtgcagtgaggaacactcaacacttgtgggagatctacgatcaggatggtaccctccagcatttcattgatggaggggagccctccaagagctcatggatgagatatatacggtgcgcgcgccattgtggcgagcaaaatctgacagttgttcagtaccgctccaatatcttctacagagcttgtatcgatatacccaggggtaccgagctcctggtgtggtacaatgatagctacacttcattctttgggattcccctccaatgtatagcccaggacgaaaatctcaatgttcctagtacagtcatggaggccatgtgccgccaagacgcattgcagcctttcaataagagctctaagcttgctcccaccacgcagcagcggtccgtcgttttccctcaaactccttgctcccgtaatttctcgcttttggataaaagcggtcctattgaatctggatttaatcagatcaacgtcaagaaccagagagtcctcgcttctccaacgtccacctcccagcttcacagtgaatttagtgattggcacctgtggaaatgcggacaatgcttcaaaacttttacccagaggatcctgttacagatgcacgtctgcacccagaaccctgacagaccttaccagtgtggtcactgcagccagagcttcagccagcctagtgaactccgtaatcatgttgtgacccatagcagcgatcgaccttttaagtgcggatactgcggcagggcattcgctggcgccaccacgcttaataaccatattaggactcacacaggcgagaagccttttaagtgcgaacgctgtgagagatcctttacccaggccacccagctaagcaggcaccagcgcatgcctaatgaatgcaagcccatcacagaaagccctgagtcaattgaggtggattag

SEQ ID NO: 20259 - DNA, 516 bp, Artificial Sequence
  Description of Artificial Sequence: Synthetic coding sequence
atgtgccagaacttcttcatcgacagctgcgccgcccacggcccccctacctttgtgaaagactcagccgtcgataaggggcacccaaaccggtccgcactgagcctcccccccggcttgagaatcggaccctcaggcattccccaggccgggcttggtgtgtggaatgaggcttctgacctcccattaggtctccacttcgggccatacgaaggccggatcacagaagatgaagaggctgccaactccggctattcttggctcatcaccaaggggcgcaactgctacgagtacgtggatggcaaggacaagtctagcgccaactggatgcgaacgaaagctcgggaccctagtatgtcgctcatgctgtctggtttgtttaagagcaagatcagtcagagcacttgtggaacacagtctctgctgtctgagttaccccgcaccatctgcaagaaaacgagccctactagggagtctctaccgagaggctcagagtctggcgcagctattttttag

SEQ ID NO: 20260 - DNA, 516 bp, Artificial Sequence
  Description of Artificial Sequence: Synthetic coding sequence
atgtgccagaacttcttcatcgacagctgcgccgcccacggcccccctacttttgtaaaagactcagcagttgacaaaggccaccctaacagaagtgcactaagtcttccccctgggttgcggatcgggccttctggtataccacaagctggcttgggcgtttggaatgaggcaagcgatctgcctctcggattacacttcggaccgtacgaagggcgcattaccgaggacgaagaggcagcgaacagcggatactcctggttgattacgaaaggcaggaactgctacgaatacgtggacggaaaggacaaaagcagcgccaattggatgcgaaccaaggcgagagatccctctatgtctctcatgttgagcggactgtttaaaagtaaaatctctcaaagtacttgtggtacacagtccctgctgtcagagctgcctcggaccatctgcaaaaagaccagcccaactcgggagtctttgccaaggggcagtgaatctggagcagctatcttctag

SEQ ID NO: 20261 - DNA, 417 bp, Artificial Sequence
  Description of Artificial Sequence: Synthetic coding sequence
atgagccccgagcggagccaggaggagagccccgagggcgacaccgaacgtaccgagcgcaagccaatggtgaaggacgcattcaaagacatatccatctacttcacaaaggaggagtgggctgaaatgggagactgggagaagacacgatatagaaatgttaagatgaattataatgccctcattaccgtaggcctgagggctacccgcccagcgttcatgtgccacagaagacaagcaattaaactgcaagtcgacgacacggaggacagcgacgaggagtggacgccccgccagcaggtgaagccaccttggatggcattccgaggggagcagtcgaagcatcagaaaatcgtgcgctgtgtgcgaacatcaagcctgaccgccgtactcctcatgggaccgctacacctttag

SEQ ID NO: 20262 - DNA, 1479 bp, Artificial Sequence
  Description of Artificial Sequence: Synthetic coding sequence
atgagccccgagcggagccaggaggagagccccgagggcgacaccgagcggacggagagaaagcccatggtgaaagatgccttcaaagacatttctatctattttaccaaagaagaatgggccgaaatgggagattgggagaagactcgctaccgtaacgtgaagatgaactataatgccttaatcactgtgggtctcagggccacgagaccagcttttatgtgccacagaaggcaggcaatcaagcttcaggtagacgatacggaggacagcgatgaagagtggacacctcgccagcaagtcaagcccccctggatggcgtttagaggcgaacagtccaagcaccaaaaaggtatgcccaaagcctctttcaataatgagagtagcctccgagagttgtctgggacccctaatctcctgaacacctctgattccgaacaagcccagaagcctgtgagtcctcccggtgaggctagcacatcaggccagcactccaggctcaaactggaactgaggaggaaagaaacggaggggaagatgtattcactccgggaaagaaagggccacgcttacaaagagattagcgagcctcaggacgacgattacttatactgtgagatgtgtcagaattttttcatagatagctgcgctgcccatgggccccctacgttcgtgaaagattctgccgtggataaggggcaccctaatcgctccgcactttccttgcctccagggctccgaatcggcccctctggcattccacaggcaggactcggggtctggaacgaggcctctgacttacctttggggcttcacttcggaccttatgagggacggataactgaggatgaagaggcagccaattccggatacagttggctcattactaagggtcggaactgttacgagtatgtggatggaaaagacaagtccagtgccaattggatgagatacgttaactgcgcccgcgacgatgaggagcagaatctcgtggcgttccaatatcaccggcaaattttctatagaacctgtagagtgattcgtcccggctgtgagctgcttgtgtggagcggcgacgaatatggccaggagttgggcatccggtcatctatcgagccagccgaaagtctcggccaagctgtaaactgctggtccggaatgggcatgtctatggctcgaaactgggctagttcaggagccgcatccggacgcaaatcttcttggcagggagaaaaccaatcacagagatctattcatgtcccacatgccgtgtggcctttccaagtaaaaaatttctctgttaatatgtggaacgctatcacgcctttgcggactagccaggaccatttacaagaaaatttttccaaccagagaatcccagcccagggtatacgaataagaagtggaaatatattaatccacgccgctgtgatgacaaagccaaaggtgaaacggagcaagaagggccctaattcttag

SEQ ID NO: 20263 - DNA, 2070 bp, Artificial Sequence
  Description of Artificial Sequence: Synthetic coding sequence
atggaggacaccggcatccagcggggcatctgggacggcgacgccaaggcagtgcagcagtgcctaactgacatcttcacgagcgtgtacactacatgtgacattccagagaacgcaatctttggcccatgcgttctgtcccacacctcgctgtatgactcaatcgccttcatcgccctaaaatctactgacaaacggaccgtgccctacatctttcgggtggacaccagtgcagcaaacggcagttccgagggcctcatgtggttgcgccttgttcaaagtgctcgcgataaagaggaacagaatctggaggcttatatcaagaatggccagttgttttacaggtcgttgaggcggatcgctaaggacgaggaattgctcgtttggtacgggaaggaactgaccgagcttttgctcctgtgcccctcgaggtcgcataacaagatgaatggaagcagtccatatacttgcctggagtgctcccagcgctttcagttcgaattcccctacgtcgctcatctgcgtttcagatgtccaaagcgcctccactcggccgacatttcgccacaggatgagcaagggggaggggttgggacaaaggatcatggaggcggcggcggcggtggaaaggatcaacaacaacagcagcaggaggccccactgggcccgggtcccaaattttgcaaggctggcccgcttcaccattaccctagcccatctcccgagtcgtctaacccttcggccgccgcaggtgggtcgagcgctaaaccaagcacggactttcataacctagcccgggagctagaaaactcaagaggaggcagcagctgtagccccgctcagtcactatccagtggatccgggagtggaggtgggggagggcaccaggaggctgaactctcacccgatggcattgccactggcggcggcaaggggaaacgaaagtttcccgaggaagcagctgaaggaggtggcggcgccggacttgtcggtggacgtggcaggttcgttgagcgaccgctccctgcgagtaaggaagacctggtgtgcactccacaacaatacagagcttccggctcctacttcggactcgaagaaaacggcagactattcgcccccccttcacctgagaccggagaggctaaaaggtctgcgttcgtggaggtgaaaaaggcagctcgggcagcttcgctccaggaggaaggaacagctgacggcgctggggtcgcttcagaagaccaagatgccggaggcggcgggggctcgtcaacccctgccgctgcttcaccagtgggggcggaaaagctgctggctcccaggccaggcggaccccttccttcccgtcttgaaggcgggtctccagcaagaggaagcgcttttacttcggtgccacagctggggagcgcgggcagcacaagtggggggggagggaccggggctggggccgccggaggcgccggagggggccagggtgctgccagcgatgagcgtaagtccgcattctctcagccggcacgatccttctcacaactttctccactggtgctcggccaaaagctgggcgccctggagccctgccacccagcagacggtgtcgggccaacgcgcttatatcccgcggctgccgatcccttggcggttaagcttcagggggcagcagacctcaatgggggttgcggcagcctaccgtcagggggcgggggattgcctaagcagagcccctttctctatgcgactgctttctggcctaagtcaagcgctgcagccgccgccgccgccgcggcagcagccgccggcccactacagctacaactcccatccgctttaaccttgctacctccaagttttacctcgctgtgcttgcctgcccaaaattggtgcgccaaatgcaacgcctcttttcgcatgacttcagacttggtctaccacatgaggtcccaccataaaaaggaatatgctatggaacctctcgtgaagcggcgtagggaggagaaattgaaatgccctatatgcaacgagtcatttcgagagcgtcatcacctctcaaggcacatgacttcccataactag

SEQ ID NO: 20264 - DNA, 2070 bp, Artificial Sequence
  Description of Artificial Sequence: Synthetic coding sequence
atggaggacaccggcatccagcggggcatctgggacggcgacgccaaggctgtgcagcagtgtctgaccgacatctttacatccgtgtatacaacatgtgacattcccgaaaatgccatcttcggtccatgcgtgttatcacacacctccctatatgacagcattgccttcattgccctgaaatcaaccgacaagaggaccgtaccatatatctttcgggtagataccagtgccgcaaatggaagcagcgaagggctcatgtggctaagactcgtgcagagcgcacgggacaaggaggagcagaatctggaagcttatatcaaaaatggccagctcttttatcgctccttgaggagaatagcgaaggacgaggaactattggtttggtacgggaaagaactgaccgaacttctgctgctatgccctagccggagccataataaaatgaacggatcatctccctatacatgcctggagtgttctcagagatttcaatttgaatttccttatgtggcacaccttagatttaggtgccccaagagattgcattccgcggatatcagtcctcaggatgagcagggaggcggcgtgggtaccaaagatcacggggggggcgggggcggaggcaaagaccagcaacagcaacagcaagaagcccccctcggcccgggccccaagttctgtaaagctggaccattgcatcattatccttcccctagtcccgagagttctaaccccagcgctgcagccgggggtagttcggctaagccatcaaccgactttcataacctggcgcgcgagctggagaactctcggggaggaagctcttgttcacctgcacagtccctgagcagtggctccggcagtgggggaggaggaggtcatcaggaggcagaattgagcccggatgggatcgcaactggaggagggaaaggtaaaaggaagttccctgaggaagccgctgagggtggcggcggtgctggactggtaggcgggaggggccgctttgtggaaaggcccctgccagcttctaaagaagatctggtttgcactccccagcaatatcgtgctagtgggtcttacttcggacttgaggagaacggcagactcttcgcacccccctcccctgagacaggggaagccaagcggagtgcatttgtagaggtcaagaaggctgcccgcgctgcctctctgcaggaggagggtaccgctgatggagctggggtcgcttctgaggaccaggacgcggggggtggcggcggatctagcaccccagctgccgccagtccggtcggagcagagaaattgctggcgccgagacctggcggacctctcccctccagacttgaaggaggaagtcccgcaaggggttccgcgtttacatctgtgcctcagttaggcagtgctggaagcacttccggcggaggcggaacaggtgcaggggcggccggaggtgcaggcggcggccagggagccgcctctgatgagcgaaaaagtgcattttcccagcctgctaggtcctttagtcagctgagccctctcgtcctcggccagaaactgggcgccctcgaaccgtgccacccagccgacggtgtgggccctaccaggctctaccctgctgccgccgaccctcttgcagtgaagcttcagggagccgccgacctgaacggcggttgtggctctctccccagcggtggcggcggactgccaaaacagtctcctttcttgtacgcaactgcattctggcctaaatcttccgccgccgccgcagccgccgcagctgcagccgctgcggggccgctacagcttcagctgccaagcgcgcttacgcttctgcccccaagttttacctcactgtgcttgcccgcgcagaactggtgcgcaaagtgtaatgccagcttccgaatgactagcgacctcgtgtatcacatgaggagccatcacaagaaggaatacgccatggaaccgctggtaaaacgcaggcgggaggaaaaattgaagtgtcccatatgtaacgagagctttcgggagagacatcatctctccaggcatatgacgagccacaattag

SEQ ID NO: 20265 - DNA, 2070 bp, Artificial Sequence
  Description of Artificial Sequence: Synthetic coding sequence
atggaggacaccggcatccagcggggcatctgggacggcgacgccaaagccgtgcagcagtgtctgacagacatctttaccagtgtatatactacatgtgacatcccagagaatgctattttcggcccttgcgtgctctctcacacctcgctgtatgacagcatcgcatttatcgcgctgaagtccaccgacaagcgaaccgtcccctacatattccgagtggataccagtgccgcgaacggatctagcgaggggctcatgtggcttaggctggtacagtccgctagagacaaggaagaacagaatctcgaggcttatatcaaaaacggtcaactgttttaccgctccctgcggcggatcgctaaggacgaggaactgctggtgtggtatggaaaggaactgacggaacttcttttgctctgcccaagccgatctcacaacaagatgaatggctcttcaccttatacatgcttggaatgttctcagcggttccagtttgaatttccatatgtggcacacctgcggttccgatgtcccaaaaggctccattcagcagacatatctccacaggacgagcagggtggcggggtcggcaccaaggaccacgggggagggggcgggggagggaaggaccaacaacagcaacaacaggaggctccactggggccaggacctaaattctgtaaggcagggccactccaccactacccctcaccctcgcccgagagtagcaatcctagtgcagcagctggcggatcctcagccaaaccatccaccgacttccacaatctggcccgcgaactggagaacagcagaggtggctccagctgttctccggcccagagcctgagctctggaagcggatccggggggggagggggccaccaggaggcagaactgagtcccgatggaattgccaccggcgggggtaaggggaagcgcaagtttccagaagaagctgctgagggagggggcggtgccggtctggtaggagggcggggcagattcgttgagagacccctccccgcaagcaaagaagatctggtgtgcactccacaacaataccgggccagtggctcatacttcggcttggaagaaaatggaagattgtttgcgcctccttcacccgagaccggagaggctaagaggagcgctttcgtggaggtgaagaaggctgctcgcgccgcatcgctgcaagaggagggcactgccgacggtgccggtgtggctagtgaggatcaagacgccggaggaggaggaggttcatcaactccggcagcagctagcccagtcggcgcagagaagcttttggccccaagacctggtgggcccctgccctccaggttggaaggcgggagtcctgcccgcggaagtgccttcacttctgttcctcagctaggctctgccggctcaaccagtgggggtggcgggacgggcgctggcgccgcaggcggcgctggaggcggtcagggcgccgcgtcagacgaaagaaagagcgcatttagccagcctgctaggtccttctctcaactctccccactggtgttaggccagaagctaggcgcactggagccttgtcacccggctgatggcgtgggaccaacccggctgtacccggctgcagcagaccccttagctgtgaaactacagggcgccgctgacctcaacggaggatgtgggagtttacccagcggcggaggaggactgccaaagcaatctcctttcctgtacgcgacagcgttttggcccaaaagctctgcggccgctgcagcagctgcagcagcagctgcagcaggcccactgcagctccagctcccatccgcccttactctgctcccaccctcctttacaagcttgtgtctgccggcccaaaactggtgtgctaagtgcaatgcgagttttcgtatgaccagtgatttggtataccacatgcgctcccaccacaagaaggagtatgccatggagcccctagtcaaaaggcgcagggaagagaagctgaagtgtcctatttgtaacgagtccttcagggaacggcaccacctaagcagacacatgaccagccacaattag

SEQ ID NO: 20266 - DNA, 1287 bp, Artificial Sequence
  Description of Artificial Sequence: Synthetic coding sequence
atggaggacaccggcatccagcggggcatctgggacggcgacgccaaagctgtgcagcagtgtctgacagacatcttcacctctgtgtatacaacatgcgacatcccagaaaacgctatttttggtccttgcgtgctgagtcatacgagtctgtacgatagtatagcgttcatcgccctcaagagcaccgacaaacgcacagtgccttatatctttagggtcgacacatcagcagctaacggctcgtccgaaggcctgatgtggttgcggctcgtgcaatctgcgcgggataaagaggagcagaacctggaagcctacatcaagaatggacagttattctacagaagtctgagacggatcgccaaagacgaggaactgttggtgtggtatggaaaggagctcactgagctcctccttttgtgccccagcaggtcccataacaaaatgaacggaagttccccttatacgtgcctggaatgttcccagaggtttcagtttgaattcccgtacgtggcacaccttagattccgctgcccaaagcggctgcattctgcggatatatcccctcaggacgaacagggaggtggtgtgggcacaaaggatcatgggggcggcggtgggggcgggaaggatcagcaacagcagcagcaggaagccccattaggcccgggccctaagttctgtaaggctggaccattgcatcattatccttcaccatcaccggaatcctcaaacccaagcgctgcagccggcggatcgagcgcgaagccatccaccgactttcacaacctcgctagggaactggagaatagcaggggaggcagcagctgctctcccgcgcagagcctgtccagtggaagcggatccggagggggtgggggtcaccaggaggcagagttgagcccagatggcatcgccactggaggcgggaaagggaaacgtaaattccccgaagaagccgcggagggggggggtggtgctgggctcgtcgggggcagaggtaggttcgtagaaaggcccctgcccgcttcaaaagaggacctggtctgtacaccacagcaatacagggccagcggtagctactttggtctggaagagaacggccggctttttgctccgccttcacccgaaacaggagaggcaaagcgttccgctttcgtcgaggtgaaaaaagctgccagagctgcaagtcttcaggaagaagggacggccgatggggctggagtggcctctgaagaccaagatgcaggaggtggcggagggagctccacaccagctgcagcttag

SEQ ID NO: 20267 - DNA, 1125 bp, Artificial Sequence
  Description of Artificial Sequence: Synthetic coding sequence
atggccgcccccccccggcccgcccccagcccccccgccccccggcgactggatacctctgatgttcttcaacaaatcatggcgattactgaccagagcctcgacgaagctcaggctagaaaacatgcacttaattgccaccgaatgaaacccgccctgttcagtgtgctctgcgaaatcaaggagaagactgtggtctctatcaggggaatacaggacgaggacccgccggatgcccaattgttgcggctggataacatgttgctcgccgagggtgtctgtcggccagaaaaaaggggtaggggtggggcagttgccagggcaggcactgccacccccggcggctgtccaaatgataactctattgaacacagcgattatcgggccaagctcagccagattaggcaaatttaccactcagagttagaaaaatatgaacaggcctgcagagaatttacgactcacgtgaccaacctgttacaggaacaatcacgcatgcggccagtgagccctaaggagattgaacggatggtcggcgctatccatggcaaattttcggctattcagatgcagctgaaacagtctacttgcgaggcagtgatgaccctgagatcaaggctgcttgacgcacgtaggaagcgcaggaactttagcaagcaggcaactgaggtcctcaatgagtatttttactctcacctgaataatccatacccgagtgaggaagctaaagaagagctggctaggaagggcgggttgacgatctctcaggttagcaattggtttggaaataagaggatcagatataagaaaaacatggggaagttccaagaggaagcaacaatctatacgggtaagacagctgtcgacactacagaagtgggggttcccgggaaccacgcctcttgtttatcaacaccctcttctggcagttccggcccatttcctctgccatcagccggggacgccttcttgactcttcgaactctcgcatctctgcagcctccgcctggcggtggttgcctccagtcccaggcccagggctcttggcagggagcgacgccgcagcccgctactgcttcgcccgccggggaccccggcagcattaattccagcacaagcaactag

SEQ ID NO: 20268 - DNA, 945 bp, Artificial Sequence
  Description of Artificial Sequence: Synthetic coding sequence
atgctggtgagcggccggcggcggctgctgaccgtgctgctgcaggcacagaaatggccattccagccttccagggatatgcgactggtccagtttcgtgcacctcaccttgttggaccgcacttaggattagagactggtaatgggggaggtgtaattaacctcaatgctttcgacccgacactgccaaagacaatgactcaattccttgagcaaggcgaggcgacattgtcagtggccaggcgggccctggcggcccagctccccgtcctcccacgctctgaggtgacgtttttggcgcccgtgactcggcctgataaagtcgtttgcgtgggcatgaattatgtggaccactgtaaggagcagaacgttcctgtgcctaaagaacccataatctttagtaagttcgcttcaagcattgtgggcccatatgatgaagttgtcctccccccacagagtcaggaagtggactgggaagttgagctggcagtggtgataggcaagaaaggtaaacatatcaaggccactgacgctatggcacacgtggcaggatttactgtcgcgcatgatgtcagtgcgcgtgattggcagatgcggcggaacgggaaacagtggctgctgggtaagaccttcgacactttctgtccgctaggacccgcgctggtgacgaaggacagtgtggctgacccacataatctcaagatatgctgccgagtgaacggcgaggttgtccagtccggcaacactaaccaaatggtctttaaaaccgaggatctcattgcttgggtgagccagttcgtgaccttctaccccggcgacgtgatcctcacaggaacccctcctggtgtaggagtctttaggaagcctcccgtgttcctcaagaaaggcgacgaggtgcagtgcgagatagaagaattgggcgtgatcataaataaagtcgtgtag

SEQ ID NO: 20269 - DNA, 1059 bp, Artificial Sequence
  Description of Artificial Sequence: Synthetic coding sequence
atgagcgtgcagaacagcggctggccccaccaggaggacagccccaagccgcaggatccgggtccacccgcaaatagcgacagcgatagcggtcacctgcccggggaagatcctgaggatacgcacgcccagggtcccgcagtacttagcctgggctcgctctgcctggatactaatcaggcgccaaactggaccggtcttcagaccttgctgcagcagctcccaccccaggacattgatgaacggtactgcctcgctctcggcgaggaggaacgcgctgagttgcagctcttctgtgcccgccgcaagcaggaagcgctgggccagggtgttgcacgtctggtcctgccgaagcttgaggggcacacttgtgagaaatgtcgtgaattgctgaaacccggggagtacggcgtattcgctgcgcgagcaggagaacagaggtgctggcaccagccttgtttcgcatgtcaggcttgtggacaagcactcattaatctgatctacttttaccacgatggccagctctattgtggcagacaccatgccgaactgcttcgccccaggtgccccgcgtgcgatcaactgatattcagttggaggtgtacagaggccgagggccaacgctggcatgagaaccacttttgctgtcaggactgtgccggacctctggggggtggcagatacgccctccctgggggcagcccctgctgcccatcctgtttcgagaacaggtattccgacgcgggatcttcatgggcgggagctctcgagggacaagcattcctgggcgcaccccctccccatcctcccgacccttctctgggggcacgctcgtcgcatcgggcctcactcgccggcgcatttcagggcccccccgagccaacaccccgtcgaggtcgcggttgcggcgccagactccctcccagacgagggagacggaccccctcaggaggaggaggaggtccttggagaggcctttcggccgccgctgccgcacggaccgcccagggtcttgggggtgcaggcggttgggctagcccgccactggcagcagtgtag

SEQ ID NO: 20270 - DNA, 939 bp, Artificial Sequence
  Description of Artificial Sequence: Synthetic coding sequence
atgagcccccagggccccgccgtgctgagcctgggcagcctgtgcctcgacacaaaccaagcccccaactggacgggcctccaaacactgctacagcaattgccgccgcaggacattgatgaacggtactgcctggctttaggcgaggaggaaagggcagagctgcagctcttttgcgcacgtcgaaagcaggaagccctcggacaaggggtcgcacgactggttttgcccaagctagaggggcacacttgtgagaagtgtagggagctgctgaaacccggcgaatatggggtgtttgcagcccgggctggtgaacagagatgttggcaccaaccttgcttcgcctgtcaggcttgtgggcaggctctaataaacctcatctacttctaccacgacggccagctatactgcgggagacatcacgccgaactgcttcgcccccggtgtcctgcttgtgatcagctgatcttcagctggcgatgcacagaggctgagggccagcgatggcacgagaatcatttctgctgtcaggactgtgcaggtccgctggggggaggtagatacgcacttcctggaggcagtccctgctgcccaagctgtttcgaaaacagatatagtgacgccggcagctcctgggccggcgccctggaaggccaagcttttctgggcgcacctcccccccacccgcccgaccctagtctgggcgctcgctcatcgcatagggctagcctggcgggtgcttttcagggtccgcccgagccaaccccccgccggggcagaggatgtggcgcacggctgcccccaaggcggggacgtcggacccccagcggaggcggcggcgggccgtggcgagggctatcagctgccgccgcagcacgaactgcccagggactgggcggagccggcggctgggcaagcccccccctggcagccgtgtag

SEQ ID NO: 20271 - DNA, 1035 bp, Artificial Sequence
  Description of Artificial Sequence: Synthetic coding sequence
atgagcccccagggccccgccgtgctgagcctgggcagcctgtgcctcgacaccaaccaggcccctaattggaccggattgcagacactgcttcagcagcttcctcctcaggatattgacgaaaggtattgcttagctctgggagaagaagaacgcgccgagttacaacttttctgtgcacgccgcaagcaggaagctctcggccagggagtcgctaggctggtactcccaaagctggagggacacacctgcgagaagtgtcgcgagctgctgaaacccggtgaatacggagtctttgccgcacgcgccggcgaacagaggtgttggcatcagccctgcttcgcttgccaagcctgtggacaggccctaatcaacctgatatacttctaccacgatggacagttatattgtggacgccaccacgccgaactgctaaggccccggtgtccagcatgtgaccagcttatcttttcttggagatgtaccgaggccgaggggcagcgctggcacgagaaccatttttgctgtcaggattgtgcgggaccattaggtgggggtcgttacgcactgcccggtggatcgccatgctgcccaagttgcttcgaaaataggtactcagacgctggaagtagttgggctggtgccctcgagggacaggcattcctgggggaaacggggttggataggaccgagggtcgcgaccagacttctgtgaattcggcaaccctctctagaactcttctggccgcggcaggaggctcgagcctccagacccaaagaggactgcctggctcctctccccaacaggaaaatcgtcccggcgacaaggccgaagccccaaaaggccaggagcagtgcaggcttgagactatacgcgatccaaaggacactccattttctacatgtagcagttccagtgattccgaacctgagggattcttccttggcgaaagactgccccaatcttggaagacaccagggtccttgcaggctgaggacagcaatgcgtctaagacccattgcaccatgtgctag

SEQ ID NO: 20272 - DNA, 1155 bp, Artificial Sequence
  Description of Artificial Sequence: Synthetic coding sequence
atgagcgtgcagaacagcggctggccccaccaggaggacagccccaagccacaggaccccggacccccagccaattctgacagtgactccggacatcttccgggagaagaccctgaagatacacacgcccaggggcctgcagtgctgtccctagggagcctgtgcttggatacgaatcaggccccaaattggaccgggctgcagaccctcctgcagcagctgcctccacaagatattgatgagcgttattgcctcgctctgggcgaggaggaaagagctgagctgcagcttttttgcgccaggaggaaacaggaagccttgggacagggcgttgcacgtctcgtgctgccaaagctcgaaggccacacttgcgaaaagtgtagggaactcctcaagcctggagagtacggagtgttcgcagcccgagcaggcgaacagagatgctggcaccagccttgcttcgcatgtcaggcttgcggacaggcactcataaatctcatctatttttaccatgatggccaactatactgtggacgccatcacgcggagctgcttagacccaggtgtccagcctgcgaccagctcatattttcatggcgctgtactgaggcagagggtcaacggtggcacgagaatcatttctgctgccaggattgcgcagggccactgggcggaggaagatatgctttgcccggcggatctccatgctgtccctcctgtttcgaaaatcggtattccgacgctggtagtagttgggccggcgccctggaaggtcaggcctttttgggggaaacagggctggaccgaactgaggggagagaccagactagcgtaaacagcgcaacactaagccgaacattgctggctgctgctggggggtcttcacttcagactcagcgagggctccccggatccagtccccagcaagagaaccggccaggtgacaaggccgaagctcccaaaggccaggagcagtgcagattggagacgatccgtgaccccaaagacactcccttttcaacctgtagtagctcttctgatagcgagcccgagggcttctttctcggcgagaggctgccacaatcctggaaaacccctggctcattgcaggccgaagattccaatgcaagtaagacacattgcacaatgtgctag

SEQ ID NO: 20273 - DNA, 213 bp, Artificial Sequence
  Description of Artificial Sequence: Synthetic coding sequence
atgagcgtgcagaacagcggctggccccaccaggaggacagccccaaaccacaggatcccggtccaccagctaatagcgattccgatagcggccatctccccggcgaagaccccgaggatacccacgctcaggaattcttgagtctccatctcctaagaacttggggattcgacttcaaactgatccacatgtctatccactatttatcctag

SEQ ID NO: 20274 - DNA, 474 bp, Artificial Sequence
  Description of Artificial Sequence: Synthetic coding sequence
atgaagaaccccgacaaggccgtgcccatccccgagaagatgagcgaatgggccccacggccacctcctgaatttgtcagggatgtaatgggttcttcggccggcgccggcagcggcgaattccacgtttaccgccacttgagacgcagggagtatcaaaggcaggactacatggatgccatggcggaaaagcagaaacttgatgccgagtttcaaaaaagactcgagaagaacaagatcgctgctgaggaacaaaccgccaagcgccgcaagaagagaacgcgtagcgcccagggtgccggggtgcagcagctgtgcgggggaatctggaaccggggcggtggaggtagtgctcagtttcatcatggcgcaatgactatgttcgccacagcttccgcctggaatttagctcgggctgtgactcgcagagaacggagactgtttggaagtttttcacctgctcggacccggtag

SEQ ID NO: 20275 - DNA, 555 bp, Artificial Sequence
  Description of Artificial Sequence: Synthetic coding sequence
atggccagccccgccgccagcagcgtgcggcccccccggcccaagaaggagccacagaccctggtcatccctaagaacgccgccgaggagcagaagctcaaattggaacgcctcatgaaaaatcccgataaggcggttccaatccctgagaagatgtcagaatgggccccccggccacctcccgaatttgtcagggacgttatgggttcttccgctggggccgggtcaggcgagttccacgtctatcggcacctaaggcggcgagagtaccagcggcaggactacatggacgccatggctgaaaaacagaagctggatgcagagttccaaaaacgtttagaaaaaaataaaatagcggccgaagaacagaccgccaaacgcaggaagaagcgccagaagcttaaagagaagaagctgcttgcaaagaagatgaaattagaacagaagaagcaggaaggtcctggccaacctaaggagcaggggtccagctctagtgcggaggcgtccggtactgaagaggaggaggaagtgcctagttttaccatgggccgatag

SEQ ID NO: 20276 - DNA, 555 bp, Artificial Sequence
  Description of Artificial Sequence: Synthetic coding sequence
atggccagccccgccgccagcagcgtgcggcccccccggcccaagaaggagccccagaccttggtgattcctaaaaacgctgcggaagagcaaaaactgaaattggagcggctgatgaagaatccggataaagcagtacctatacccgagaagatgagcgaatgggcccccaggcccccacccgaattcgtgcgcgatgtgatggggtcatccgctggagctgggtctggcgaatttcacgtctaccgtcaccttagaaggcgtgaataccagcggcaggattatatggacgccatggcagaaaagcagaagttggatgctgaattccagaaaagacttgagaagaacaaaatagcagctgaagaacagaccgcaaagcgcaggaagaagaggcaaaaactcaaggaaaagaagctcctggcaaaaaaaatgaaattagaacagaagaagcaagagggccccgggcaacccaaagaacagggttcaagcagctccgcggaagcctcaggtaccgaggaagaagaggaagtccctagcttcacaatggggcggtag

SEQ ID NO: 20277 - DNA, 3075 bp, Artificial Sequence
  Description of Artificial Sequence: Synthetic coding sequence
atgagcaacgccaaggagcggaagcacgccaagaagatgcggaaccagccgaccaacgtgacactatcttctgggttcgtcgccgatcgcggagtgaagcatcattccggaggcgaaaagcccttccaggcacagaaacaggaaccgcaccccggaacatccaggcaaagacagacacgtgttaacccacactccctgccagaccccgaggtgaacgaacagtcgtcttcgaagggcatgttcaggaagaagggaggatggaaggctggaccagagggtactagccaggaaataccgaagtatatcaccgcaagcacatttgcccaggctagagcggccgagatcagcgcgatgctcaaggccgtgactcagaagagtagcaacagcctcgtgttccagaccctgccaagacacatgcggcggagggccatgagccataatgtcaaacggttgcccaggaggttacaagagatagcacaaaaagaggccgagaaggccgtccatcagaagaaagagcactcaaagaataagtgccataaggccagaaggtgccatatgaacagaacactggaatttaatagaaggcaaaagaaaaacatttggcttgaaacccatatctggcatgccaagcgctttcacatggtgaaaaaatggggatattgcctgggtgaacgaccaacggtgaagtctcatagggcctgttatagagccatgaccaacaggtgcctgctccaggatttatcatactactgttgtctggagctgaaaggtaaagaagaggagattctgaaagcattatctggtatgtgcaacatcgataccggcctgaccttcgccgctgtgcattgcctttcaggcaagaggcagggctcactggtgctctaccgcgttaataagtaccccagagaaatgctaggaccagtgacattcatttggaagtcacagaggacgcccggcgacccaagcgaatcccgacagctgtggatatggttgcaccctaccctaaagcaggacatcctggaggaaatcaaggcggcttgccagtgtgttgagccaataaagagcgctgtctgtattgccgatccccttcccacccccagccaagagaaatctcaaacggagctaccagatgagaaaatcggaaaaaagaggaaacgaaaggacgacggcgagaacgccaagcccatcaagaagatcataggggacggtaccagagatccctgcctcccttatagctggattagtccgaccactggtatcatcatatctgatctgacgatggagatgaataggttcaggctgatcgggcctctctcccattccatattgacagaagccatcaaagctgcatctgtccacacagtaggggaggacactgaagaaacacctcacagatggtggattgaaacttgcaagaaacccgatagcgtgagccttcattgccggcaggaagccatctttgagctgctgggcgggataacctctcctgctgaaattccagctggcaccatcctgggtttaactgttggtgaccctagaatcaatctgccccagaagaagtctaaggccctgcccaatcctgagaaatgtcaggacaacgagaaggtcaggcagctcctccttgaaggtgttcctgtggagtgtacccattcttttatctggaatcaggacatatgcaaatcagtcacagaaaacaagatcagcgaccaagacctcaaccgcatgcgttcagagctgctggtgcctggaagccagcttattttgggacctcacgaaagcaaaataccaatccttctaatacagcagcccggcaaggtcaccggagaggaccggctgggttggggatctggctgggatgttttgctccctaaagggtggggcatggcattttggattccattcatttacagaggagtgcgagtaggcggtctcaaagagtcggctgttcactcccagtataagcgtagcccaaatgttcccggggatttcccagactgtccagccggcatgctcttcgcggaagagcaagccaaaaatctgctcgaaaagtacaaaagacgcccgccagccaagaggcccaattatgtaaagttaggcaccctggcccccttctgttgcccttgggagcagcttacacaggactgggaatcccgtgttcaggcttacgaggagccttccgtcgctagtagcccgaacggtaaagaatcggacctgaggcggtcagaagtaccatgcgccccaatgcctaaaaaaacccatcaaccctctgatgaggttggtacctccatcgaacatccgagggaggctgaggaggtcatggatgcgggctgccaggagagtgcaggtcctgagcgaattactgaccaagaagcctccgagaatcatgtcgccgcaaccggatcacacttgtgtgtcctgagaagcaggaagcttttaaaacaactctccgcatggtgcggtccttcgtctgaggacagcagggggggcaggagggcgcccgggaggggacaacagggccttaccagagaggcctgtctcagcatattaggccacttcccgcgcgcactggtttgggtatctctttccctactctcgaagggttcccccgagcctcacaccatgatttgcgtaccagccaaagaggactttctgcaactccacgaggactggcactactgtggtccccaagaaagcaagcatagtgacccctttaggtctaagattcttaagcaaaaagaaaagaagaagcgagaaaagcgccagaagccaggacgcgctagctctgacgggcctgcaggtgaggagccagtcgccggacaggaggctcttacactcggcctttggagcggccctttacctcgcgtcactctccactgctcccggacacttctggggtttgtcactcaaggggatttctctatggccgtcggatgcggggaggccctcggatttgtttcactgactgggttactggacatgcttagtagccaaccagccgcgcagcggggacttgttctgctgagaccccccgcgtccttgcaatatcgctttgctcggatcgctatagaggtatag

SEQ ID NO: 20278 - DNA, 3075 bp, Artificial Sequence
  Description of Artificial Sequence: Synthetic coding sequence
atgagcaacgccaaggagcggaagcacgccaagaagatgcggaaccagcctactaatgtgactttatcctcagggtttgtcgcagacagaggagtaaaacatcactccgggggcgagaaaccttttcaggcgcagaagcaggagccgcaccccgggacttctcgacaacgccagaccagagtcaatccccactccctaccggatcccgaggtaaatgagcagagttcttctaagggcatgttcagaaaaaagggtggttggaaggcgggaccagaagggacctctcaagaaattccgaagtacataaccgcctcaaccttcgcccaggcaagggccgcagaaatttcggcaatgctaaaggccgtgactcagaagagtagcaactccctggtattccagacattgccaaggcacatgaggaggagagctatgagccacaacgtcaaaaggctaccacggcgcttgcaagagatcgctcagaaggaggccgaaaaagctgttcatcagaaaaaggagcactcaaaaaacaaatgccataaagcacggcgctgccacatgaataggactcttgagtttaatagaaggcaaaaaaagaacatttggttagagacccacatttggcacgctaagagattccatatggtcaagaaatggggatattgcctgggtgagcggccgacagtgaaatcacaccgggcctgttaccgagctatgaccaaccgatgtctactccaggacctctcttactactgctgtttagagcttaagggcaaggaggaggagattctgaaagctttatctggcatgtgcaatatcgataccgggctgactttcgccgccgtccattgcctaagcggcaaaaggcaaggctcattggttttataccgggtgaataaatatcctagggaaatgttaggccctgtaacgttcatttggaaatcccagagaactcccggagacccttccgagagtaggcagctttggatctggctccatcccacactgaaacaagatatcctggaggagatcaaggctgcgtgccaatgcgtagaaccaattaaatctgctgtttgcatcgccgacccactcccgacaccctctcaggaaaaaagccagacggagctgccagatgaaaaaatcggcaagaaacggaagaggaaagatgacggtgaaaacgcaaagccaattaagaaaatcatcggagatgggactcgtgatccttgtcttccctacagttggatctccccaaccacagggataatcatctcagatctcacaatggagatgaaccgctttcgcctgatcggaccattaagccatagcatcctgaccgaggcgatcaaagccgcgtctgtgcacaccgtcggggaagatactgaggagaccccccatcgttggtggatagagacttgtaaaaaacccgacagcgtgagtctgcactgtcgtcaggaggccatattcgagctgttggggggaatcacatccccagcggagattccggcgggcactatactggggctgaccgtgggtgaccctaggattaacctgcctcagaaaaagagcaaagccttgcccaatccggaaaagtgtcaggataatgagaaggtccgacagctgctgttggagggagtacctgtggaatgcacccattcgtttatatggaatcaggacatatgtaagtctgtaaccgagaacaaaatctctgatcaggatctcaacaggatgcggtctgagctgctggtgcccggtagccagttaatcctgggtcctcacgaatctaagatacctatcctgcttatacagcagcctgggaaggtgaccggcgaagaccgattaggatggggaagtgggtgggacgtgctgctgccaaagggatggggcatggctttctggatccccttcatctacaggggcgtccgggtaggtggattaaaggaaagtgctgtacactcacagtacaagaggagcccgaatgtgcctggagactttcccgactgtccagcagggatgctgttcgcggaagagcaggcaaagaatctgcttgaaaaatataaacgccgtccccctgcaaagagaccaaactatgtaaaactcgggaccctggcacccttctgttgcccttgggaacaactgacacaagactgggaatcacgcgtccaggcctatgaggagccaagcgtggcaagtagtcctaacgggaaagaatccgaccttcgcagatctgaggttccgtgcgcccccatgcctaaaaaaacacatcagccctccgatgaagtgggaaccagcatagagcatcccagagaagcagaggaggtcatggatgcaggatgtcaggagtccgcaggtcctgagcggattacagaccaagaggccagtgagaatcatgtcgcagccactggctctcacctctgcgtgctcaggtcccgaaagctgctcaaacagttgagtgcgtggtgtggccctagctccgaggattcccgcgggggtagaagagctcccggtcgaggccagcagggactgacacgtgaggcctgtctttcgatactaggccattttcctcgtgctcttgtttgggtatctctgtcactactgtccaaaggcagtcccgagccacataccatgatctgtgtgccagctaaggaagacttccttcaactgcacgaggattggcattattgtggtcctcaggagtccaagcatagtgacccttttcggtccaagatcctcaagcagaaggagaagaaaaagagagagaagagacaaaagcccgggagggcatcttccgatggccctgctggtgaagaacccgtcgccggacaggaagcattaacactgggcttgtggtcaggcccgttaccccgggtgacactccactgctccagaactttgctgggctttgtcactcagggggatttttctatggctgtaggatgtggcgaggctcttggtttcgtgtccctaaccggtttacttgatatgctttctagtcaaccggccgctcaaaggggcctggttttactgagaccacccgcgtccctccagtaccggtttgctcgcattgctattgaagtgtag

SEQ ID NO: 20279 - DNA, 552 bp, Artificial Sequence
  Description of Artificial Sequence: Synthetic coding sequence
atgagcaacgccaaggagcggaagcacgccaagaagatgcggaaccagccaaccaacgttacactctcatccggctttgttgctgaccgaggggtgaagcatcactccgggggcgagaaaccgttccaagctcaaaagcaggaaccacaccccgggaccagccggcaacggcagactagagtcaatcctcatagtctacctgatcctgaagtgaacgagcaatccagtagtaagggtatgttcagaaagaaaggcggctggaaagctggacccgaaggaaccagtcaggaaattccgaagtacatcaccgcctctacctttgctcaagcgcgcgctgccgaaatttcagctatgctcaaggcagtgacccaaaagtcatcaaatagcctagtgttccagaccttgccacggcatatgaggcgtcgggccatgagccacaatgttaagaggctcccgaggaggctgcaagaaatcgcccagaaggaagcggaaaaggccgttcaccagaagaaggagcactccaagaacaagtgccataaggcgcgtaggtag

SEQ ID NO: 20280 - DNA, 297 bp, Artificial Sequence
  Description of Artificial Sequence: Synthetic coding sequence
atgtggaaccccaacgccggcggccccccccaccccgtgccccagccgggttaccccggctgccaacctcttggaccttatccccctccgtacccacctcccgcaccaggaattccccccgtcaatcccctggccccaggcatggtggggccagcggtgatcgtggacaaaaaaatgcagaagaaaatgaagaaggcccacaaaaagatgcataaacaccagaaacaccacaaatatcacaaacacggcaaacattcatcatcctcctctagctcaagctcctcagactctgactag

SEQ ID NO: 20281 - DNA, 447 bp, Artificial Sequence
  Description of Artificial Sequence: Synthetic coding sequence
atgtggaaccccaacgccggccagcccggccccaacccctacccccctaatataggctgtcccggtgggagcaatccggcgcatcctcctccgattaaccctcctttcccgccagggccttgtcctccaccgcctggagctcctcatgggaaccccgcatttccccctggaggtcctccccaccctgttccgcaacccggttacccaggctgccaacccctagggccctacccccctccatacccgccccccgcccctggtattcctcctgttaaccctctcgccccaggtatggttggccccgccgtgatcgtggacaagaaaatgcagaaaaagatgaagaaggcacacaaaaagatgcacaagcaccaaaaacatcacaagtatcacaagcacggtaaacattcttcctcaagctcttcaagttcaagctccgattccgactag

SEQ ID NO: 20282 - DNA, 489 bp, Artificial Sequence
  Description of Artificial Sequence: Synthetic coding sequence
atgggctacctggacagcatcggctggcggacccacctgaacatgtggaaccccaatgcaggacagcccgggccaaacccctatcccccgaatattggctgcccaggagggagtaatccagcccatcctccacccattaatccacccttccctcccgggccatgcccccctccccctggggcaccacatggcaaccccgccttccctccaggtggacccccgcacccagtgccccaaccaggatacccaggctgtcagcctctgggtccctatccgcctccttaccctccccccgccccaggaatcccccctgtgaatccactcgccccgggcatggttgggcccgccgtcatagttgataaaaagatgcagaaaaagatgaagaaagcccacaaaaagatgcacaagcatcaaaaacatcataagtatcacaagcacggcaagcatagttcctcaagctcatcctcaagctcctctgatagtgactag

SEQ ID NO: 20283 - DNA, 447 bp, Artificial Sequence
  Description of Artificial Sequence: Synthetic coding sequence
atgtggaaccccaacgccggccagcccggccccaacccctacccccccaatattgggtgtcccgggggttcaaaccctgctcatcctccccctataaaccctccattcccacctggtccttgtccgccacccccgggggccccacatggtaatcctgcttttcccccaggtgggccaccacatcctgttccacaacccggctatccagggtgccagccccttggtccttatcccccaccctatcctcctccagcaccgggtattccacctgtcaatcccctggcccccggcatggtcgggccggctgttatcgtggataagaagatgcagaaaaagatgaaaaaagcacataagaaaatgcacaagcaccagaagcaccacaagtatcacaagcatggcaaacattctagctcaagctcatcaagctcatctagcgactcagattag

SEQ ID NO: 20284 - DNA, 447 bp, Artificial Sequence
  Description of Artificial Sequence: Synthetic coding sequence
atgtggaaccccaacgccggccagcccggccccaacccctacccccccaatatcggttgccctggcggtagtaaccccgcccaccccccccctataaatccgccttttccacctggaccatgtcctcctcccccgggggcaccacacggaaaccccgcattcccccctggtggacctccgcatcccgtgccacagcccggctatcctggctgtcagcccctgggtccctatccccctccctatccccctcctgcacccggtatacctccggtcaaccccctagcaccagggatggtcggtccggcggtgatcgtggataaaaaaatgcagaagaagatgaagaaggcacacaaaaaaatgcacaagcatcagaaacaccacaaataccacaagcacggcaagcacagttcaagcagctcatcaagctcctcctcagactcagattag

SEQ ID NO: 20285 - DNA, 1779 bp, Artificial Sequence
  Description of Artificial Sequence: Synthetic coding sequence
atggaccccaacagcatcctgctgagcccccagccccagatctgcagccatctcgccgaagcttgtaccgagggcgaaaggtcgagctcacctcctgagctggaccgagactctccttttccatggagccaggtcccaagcagttcacccactgatccagaatggttcggcgacgaacatatacaggctaaacgagcgcgggtcgagaccatcgtaagagggatgtgtctatctccaaatccactggtgcctggaaacgctcaggccggggtgagtccacgttgtcctaaaaaggcgcgtgaacggaagagaaagcagaacttgcccacaccacagggactgctgatgcctgccccggcgtgggatcaggggaaccgtaagggcggcccacgtgtgcgcgaacagttacacctcctgaaacagcagctccgccatcttcaagaacacattttacaggcggcaaaaccacgggacaccgcccagggcccgggaggctgcggcaccggcaagggccctctgagcgccaagcagggcaacggctgcggtcccagaccctgggttgtggatggggatcaccagcagggcacttccaaagatctatccggtgcagagaagcatcaggagtcagaaaaaccctcattcctgccctctggcgcccctgcctccctggagatcctgcgtaaagaattgacgcgggctgtctctcaggctgtggactcggtgttacaaaaggtgctcctggatccccccggccacctcacccagcttggaagatcgtttcagggccaagtggcggaggggagatccgaaccatccccccccgtgggaggagcctgcaaagacccactcgcccttgccgccctaccgcggagggtccagctgcaggccggggtgcccgttggtaatctgagcctggcgaaacgtctggacagcccgagatacccaatcccccctcggatgactcccaaaccttgtcaggatcctccagcgaacttcccactcaccgccccctcacatatccaggagaatcaaatcctcagccagctcttgggacatcgctacaataatgggcactggagtagctcccctccccaggacagcagtagccagcggcaccctagtagtgagcctgcgctccgcccatggaggaccacaaaaccgcaacccctcgtcctctcacagcagcagtgccctctgccctttacgtcagcgcatctggagtctttgccattgctgccaagcgttaagatggagcaacgtggtctgcatgctgtgatggaggccctcccctttagtttggtgcatatttcagagggtctgaatcctggacacctaaagaaggccaagcttatgttctttttcacccgttatcctagcagtaacctcttaaaggtttacttccccgatgtccagtttaatcggtgcataacatcccagatgattaaatggtttagtaactttcgcgagttctattatattcagatggaaaaatccgccagacaagcaatttccgacggcgtcacgaaccccaagatgttggtcgtgcttagaaactcagaattatttcaggcacttaatatgcattataacaagggcaacgatttcgaggtccctgactgcttcctggaaatcgccagcctcacgttgcaggaattctttagagccgtttctgcagggagggactccgacccctcctggaagaagcccatatacaaaattatatctaagctggactcggacatcccggaaatctttaaatctagcagctacccgcagtag

SEQ ID NO: 20286 - DNA, 1779 bp, Artificial Sequence
  Description of Artificial Sequence: Synthetic coding sequence
atggaccccaacagcatcctgctgagcccccagccccagatctgctcacatttggccgaggcatgtaccgaaggggaacggagcagttcgccccctgaacttgaccgagactcaccattcccctggagccaagttcccagcagctctccaacggatcctgagtggtttggggacgagcacattcaagctaagcgagcccgggtggagaccattgtcagggggatgtgtttgtctccaaatcccctggtacccggcaacgctcaggcaggtgtgtcgccacgatgccctaagaaagcacgggagcggaagaggaagcagaacttgcctacaccccagggcttactgatgcctgcacctgcctgggaccaggggaaccgcaaaggcggtccacgcgtccgagagcagctgcacttactaaaacaacagctacggcatttgcaggagcatattctgcaggctgcgaagccgagagacactgctcaagggcccgggggctgtggtactggaaaggggccattatcagctaagcagggaaacggatgcgggccccgtccctgggtggtcgatggggatcatcagcagggaacaagcaaagacctaagtggagctgagaaacaccaggaatccgagaagccatccttcttacccagtggagcccctgcgtcactggaaattctgcggaaagagcttactcgtgccgtcagccaggccgtggattctgtgttgcagaaagttctactggaccctcctggacatctgactcagttgggtaggtcatttcaaggacaggttgcagaaggacgatctgaaccgtccccccccgtgggaggcgcttgcaaagaccccctggcacttgcggcgctgcctcgtagggtgcagttgcaggctggcgtccctgtcggaaacctctccctagcaaaaaggttagatagtcccaggtatcctatcccaccaagaatgactcccaaaccctgtcaggaccctcccgcaaactttcctcttactgccccatcgcatatacaggagaaccagattctgtctcagctcttggggcatcggtataataatggacactggagctcctctcctcctcaagactcttctagtcagcggcatccatcttctgagccagcccttcgcccatggcgaaccactaagccacagcccctcgtgctgtcacagcaacaatgtcccctgcctttcacaagtgcccaccttgagtccttgcctctacttcccagcgtgaagatggagcagagggggttgcacgcggtcatggaagctctccccttcagtctattgcatatccaagagggcctgaacccgggtcatctgaagaaggcaaaactcatgtttttttttaccagatacccctcctcaaatctgctgaaggtctatttcccagatgtccagttcaataggtgtataacgagccagatgatcaagtggttttcgaatttccgcgaattctattacattcagatggagaaaagtgccaggcaggctataagcgatggggtgactaaccctaaaatgttagtcgtgttaaggaactctgagctgtttcaggcgctcaatatgcattacaacaaggggaacgactttgaggttcctgattgctttcttgagatcgccagccttacccttcaggagtttttcagagcagtctccgccgggcgtgacagcgatccttcatggaaaaagccgatttacaagatcatctcaaagctggactctgatatacctgaaatttttaaaagcagcagttatccccaatag

SEQ ID NO: 20287 - DNA, 1779 bp, Artificial Sequence
  Description of Artificial Sequence: Synthetic coding sequence
atggaccccaacagcatcctgctgagcccccagccccagatctgcagtcacctggctgaggcatgcacagagggggaacggtcctcatctccccctgagctcgacagggactcccccttcccttggagtcaggtcccttcctctagtccaactgatcctgagtggtttggggacgagcacattcaggccaagcgagctcgggttgaaacaatcgtgagaggaatgtgtctgagcccaaatccgctggttcctggaaacgcccaggctggagtctccccacggtgtccgaagaaggcccgcgagagaaaacgaaagcagaacctgccgacccctcaaggcctgctgatgcccgcaccagcctgggaccaaggtaacaggaaaggcggacctcgcgtcagggagcagctccacttgctgaaacagcagttgagacacctccaggagcatattctgcaggcagccaagcctagggataccgctcagggacctgggggatgtggcaccgggaaggggcctctttctgcgaaacagggaaatggctgtgggccccgaccctgggtagtggatggtgatcaccagcagggtacatctaaggacttgtcaggtgcggaaaaacaccaggaatccgagaaaccatcgttccttcctagcggagcccctgcttctctcgagatactgagaaaagagctcacccgggcagtgtctcaggcagtagacagcgttctccagaaagtgctactggatcctcctggacacttgacccagctcggacggagttttcaaggccaggtagctgagggcagaagtgaaccatctcccccggtgggaggcgcgtgtaaagaccccctggcattagcagccctgccgagaagagtccagcttcaagctggggttcccgtggggaacctttctcttgcaaagcgactcgactcacctcggtaccccatccctccgaggatgacccccaagccttgccaggaccctccagcaaattttcctctgacagcacccagccatatccaggagaatcagatcctaagccaacttctgggtcataggtataataacggccattggagttcaagtccaccacaggactcttccagccagaggcacccgtcctccgaacctgctctgagaccttggaggaccaccaagccccaacccctggtcctgtcacaacagcagtgtccactgccatttacttccgcacacctggagtctctgccccttctgccaagtgtgaaaatggaacagcgggggcttcacgctgtgatggaggctctgccttttagcctcgttcatatacaggagggattgaaccctgggcatttgaaaaaagctaagctgatgttttttttcaccaggtatcccagttccaatctgctcaaagtctacttcccagacgtgcagtttaaccggtgtattacatctcagatgatcaagtggttcagcaacttccgcgagttctattacattcagatggagaaaagcgcacgacaggctatttccgacggcgttaccaaccccaaaatgctcgttgtgctgaggaatagcgaactgtttcaagccctgaacatgcattataacaaagggaacgacttcgaggtgcccgactgtttcttggagatagcatctctgactcttcaggaattcttcagagccgttagcgccggccgcgactctgatcccagctggaagaagcccatctataaaatcatcagcaagttagattctgacatccctgagattttcaaatcctctagctaccctcagtag

SEQ ID NO: 20288 - DNA, 174 bp, Artificial Sequence
  Description of Artificial Sequence: Synthetic coding sequence
atgctgtgcgcccacttcagcgaccagggccccgcccacctgaccacttccaaatctgccttcctgagcaacaagaaaacaagcacactcaaacacttgttaggcgaaacccgaagcgacggctctgcatgcaatagcggcatcagtggcgggaggggccggaagatcccctag

SEQ ID NO: 20289 - DNA, 5439 bp, Artificial Sequence
  Description of Artificial Sequence: Synthetic coding sequence
atggccgtggacagcgccatggagctgctgttcctggacaccttcaaacatccttctgctgaacagtcttcacatatagatgtagtgaggttcccatgcgttgtgtacatcaatgaggtgagagtcataccacctggcgtgcgggcccattcatccctccccgataatcgggcatatggcgaaacatcacctcacaccttccaactggacctctttttcaacaatgtgtcaaaacccagcgcacctgtcttcgataggctcggatctcttgaatatgatgagaatacaagcataatctttcgccccaatagtaaggtgaacaccgatggtctcgtgctgcgcggatggtacaactgcctcacccttgctatttatggatcagtggatagagtgatctctcacgatagagattccccccctcctcctcctcccccgccccctccaccgcaaccacagccatccctcaagaggaaccctaagcacgcggacggcgaaaaagaggaccaatttaacggatcccctcccagaccacagcctagagggccacggacaccgcccgggcccccacccccagatgatgatgaagacgatcccgtgccattgcctgtttccggcgataaggaagaagacgcaccccaccgggaagactattttgaaccgattagtcccgaccgcaacagcgtaccccaggaaggacagtattctgatgagggcgaggttgaggaggaacaacaggaggagggcgaggaagatgaagatgatgtggacgttgaagaggaggaagatgaagatgaagacgatcggcgcaccgtcgactcaattcctgaggaggaagaagaagacgaggaggaggaaggtgaggaggatgaagagggagaaggcgacgacggatacgagcagatctcaagcgacgaagatggaatcgccgacctggaacgtgagacgttcaaatatccaaactttgatgtggagtacactgcagaggatctcgcatcagttccccccatgacgtatgatccctatgaccgggaacttgtgccgctgctgtacttcagctgcccgtacaagaccacatttgaaattgagatctctcggatgaaggatcagggtccagacaaagagaattccggggcaattgaagcttccgtgaagttaactgagctgcttgacctgtaccgcgaggatcgcggcgccaagtgggtgaccgccttggaggaaataccttctctgatcatcaaaggactttcgtacctccagctgaagaacacgaagcaagacagcttaggacaattagttgactggacaatgcaggcccttaatttacaggtggcccttcgccagccaattgctctaaatgtgcggcaactaaaagccgggacaaaacttgtgagtagcctggccgagtgcggggcccagggagtgacgggactcttacaggcgggtgtgatctccggtctattcgaattactgtttgcagatcacgtcagctcttccttaaagctcaatgcctttaaggcgttggacagcgtgatttcgatgaccgagggaatggaagcattcttgcgtggaagacaaaatgagaagtcaggctatcagaagttgctggaacttatactactggaccagacagtgcgagtggttaccgcaggctctgccatccttcagaagtgccatttttacgaagtactcagtgaaattaagcgactaggcgatcacctggctgagaaaaccagtagccttcctaaccactccgaaccggatcacgacacggacgccgggcttgagcgcacaaatccggagtacgaaaacgaagtagaagcttctatggatatggacctgctcgaaagcagcaatatttccgagggagaaatcgaacggctgataaacctgcttgaggaggtgttccaccttatggaaacagcaccgcacactatgatccaacagccagtcaaatccttcccaactatggcccggatcactggaccaccggaacgcgatgacccatatcccgtgttgtttaggtatctgcactcccaccactttctggaactagtaactttgctgctgtccatccccgtgacatctgcacacccaggagtgctgcaggcaaccaaagatgtgctgaaattcctcgcccagtcccagaaaggacttttgttctttatgagcgaatatgaggctaccaatctgctaatccgtgccctttgccacttttatgaccaggatgaggaagagggcctgcagtcggatggtgtgatcgacgacgcgtttgctctttggctgcaggacagcacccagaccttacagtgtataactgagctgttctcccattttcagcgatgtaccgcctcagaagagaccgaccactccgatttgttaggaactctccacaatctctacttaatcacattcaaccccgtaggaagatctgccgttggccacgttttctcattagagaagaatctacaaagtctgataactctgatggaatattatagcaaggaggcacttggcgacagcaagagcaagaaaagcgtggcttataactacgcatgcatactgattctggtagtggtgcagagcagtagcgatgtccagatgctggagcagcacgctgcgagcctgttaaagctgtgtaaggccgatgaaaacaacgccaaactacaggaactgggtaaatggctagaaccgctgaagaaccttcggttcgagatcaactgcatccctaatctgatcgaatatgtcaagcagaacatcgataatttaatgacacctgaaggtgtgggtttgaccacagcactgcgggtgctgtgtaacgttgcatgtcccccccctcctgtggagggccagcagaaagatctgaaatggaatttggcagtgatccagttgttctctgcggagggcatggacaccttcatccgagttctacaaaagctgaattcaattttgacacagccatggcgcctgcacgtgaatatgggaactaccctgcaccgtgtaacaacaatttccatggccaggtgcaccctgacactgctgaagacaatgctgacagaactgctccgagggggatcatttgagttcaaggatatgagggtaccgagcgctctggttacactccacatgctgctgtgctctatacctctgtcgggaagactggattccgatgagcaaaaaatccaaaacgatatcatcgatatccttctgactttcacccagggtgttaacgaaaaactcactatctccgaagaaacgctggccaacaatacatggtccctcatgttaaaggaggtgttaagtagcatccttaaagtgcccgagggtttcttctcagggctcatactgttgtcggagctgctgccacttcctctgccaatgcaaactactcaggtcattgaaccccacgatatctctgtcgccctaaacactcgcaaactttggagtatgcacctccacgtccaggcaaagctcctgcaggagatcgtacggtcattttctggcacaacctgtcagcctatccagcacatgctgcgtcggatctgcgtccaattatgtgatctggccagcccaacagcattactcatcatgaggaccgtgctggaccttatagttgaagatttgcagagcacgtccgaggacaaagagaagcaatacacgtctcagaccacccgtcttctggctttgctggatgcactggcctcccacaaggcatgcaaactggctattctccacttaataaatggcactataaagggggacgagcgctacgcagaaatatttcaagatctgctggccttggtccgaagccccggagactccgtcattaggcagcagtgtgtggaatatgtcactagcatattgcagagcctgtgcgaccaggatattgccctcatactacccagttcatcagagggctcaatcagcgaactggagcagctgagtaatagtttgcccaacaaggagttgatgaccagtatttgcgattgcttgcttgcaaccctggcaaattctgagtcctcatacaactgtctgctgacctgtgtgcgtaccatgatgtttttagctgaacacgactacggcctgtttcacctgaagtctagtctgcgaaagaattcgagtgctctgcactcacttcttaagcgggtggtaagcactttctccaaagacactggagaacttgccagttcttttttagaattcatgagacagattctcaattccgacacaataggctgttgcggagatgacaatggcctaatggaggtagagggagcacatacctcacgaacaatgtctatcaatgccgcagagttaaaacagcttttacagtccaaggaagagagcccggagaacctgttcctggaacttgaaaaattggtgttggagcactcaaaggacgacgataatctagacagcctgcttgacagcgtcgtgggacttaaacagatgctcgaatcatccggcgacccactacccctgtccgaccaggatgtggaaccagtattaagtgcccccgaatcgctgcagaacctgtttaacaatcgtacagcttatgtcctcgctgacgtaatggatgaccagttgaaatccatgtggtttacacctttccaggccgaggagatagacacggacctcgatttggtcaaggttgacttgattgagctgtccgagaaatgctgctcagacttcgatctgcactctgagcttgaaagatctttcctgtccgaaccctcctctcccggtcggactaagaccactaaaggcttcaagctgggcaagcacaagcatgaaaccttcattacatctagtggtaaaagtgagtacatcgaacccgccaaacgggcccatgtggtgcctcccccgcgtggacgggggcgaggcggctttgggcaggggatccgacctcatgatatctttaggcagaggaaacagaacaccagtcggccaccatcaatgcacgtagatgattttgtggccgccgagtccaaggaggttgtccctcaggacgggatcccaccgcccaaacgcccacttaaggtgtcgcaaaaaatcagcagtcgtggtggcttttcgggaaaccggggaggcaggggagccttccactcgcagaacaggtttttcactccacccgcaagcaagggcaactatagtcgcagagaaggcactcgaggctcaagttggtctgcccagaacacacctagagggaattataatgagagcaggggaggccagagcaactttaacaggggacctctgcctcccctgaggccactgtcctccacaggctatcgcccaagcccgcgcgatagagcatcgaggggtcggggcggtctgggcccaagctgggcaagcgccaattcaggcagcggaggctcaagggggaaatttgtttccggcgggtcaggcagaggtcggcacgtccggtctttcacccggtag

SEQ ID NO: 20290 - DNA, 1038 bp, Artificial Sequence
  Description of Artificial Sequence: Synthetic coding sequence
atgaagcagctgaagcggaagcggaagagcaacttcagcgtgcaggagacacaaacactccttaaagagatcaccaagaggaaggaggtcattttctccaagcagttaaacaccacgatcaacgtgatgaaacgcatggcgtgggaagagattgcacagtgtgtaaatgctgtgggagagggggagcaacgtacagggacagaggtgaaacggcgctacctagactggcgtgctctgatgaaacgcaagcggatgaaggcgaatattaagctggtgggcagcggatttccattgccctcttcggacctggacgatagcctgaccgaggaaatcgacgaaaagattggttttcgaaacgatgccaatttcgattggcagaacgtagccgattttcgggacgctggcggatccctgacggaggttaaagtagaggaggaggaacgagatccacaatccccagagtttgagatagaggaagaagaggagatgctctcatccgtgattcctgactcccgtcgcgaaaatgagctgcctgactttccgcatatcgatgaattttttacactgaattccacacctagccggtcagcttacgatgaaccccatttgctcgtgaacatcgaaaagcaaaagctggaattagaaaaaagacggctggatatagaagctgagaggctgcaggtggagaaggagcggttacaaattgagaaggagagactgcgacatctggatatggaacatgaaagactgcagttggagaaggagcggctgcagattgagcgtgagaaattgcgtctgcagatcgtcaattcagaaaagcctagccttgaaaatgaactcggacagggtgaaaaatcgatgctacagcctcaggatatcgagacagaaaagcttaagctggagcgagaacgtcttcagcttgaaaaagacaggctgcagttcttaaaattcgagtctgaaaagctccaaattgagaaggagcggcttcaggtggaaaaggatcggctgagaattcagaaggaggggcatctccagtag

SEQ ID NO: 20291 - DNA, 6738 bp, Artificial Sequence
  Description of Artificial Sequence: Synthetic coding sequence
atgcccgagatgaccgagaacgagacccccaccaagaagcagcaccgaaagaagaacagagaaacccataatgctgtcgagaggcatcgcaagaagaagatcaatgccggtatcaacaggattggagaactgataccctgcagccccgccctgaaacagagcaagaacatgatcttggatcaggcgtttaaatacataaccgagctcaagcggcagaacgatgaactcttgctgaatggtggcaataacgaacaagctgaagaaatcaagaaactccggaagcaattggaagagattcaaaaggagaatgggaggtacattgagctgctcaaggccaacgatatctgtctgtacgatgatcctacaatccactggaaagggaacctaaaaaattcgaaagtgagcgtggttatacccagcgatcaggtgcagaaaaagatcatcgtgtacagcaacggaaatcagcctgggggcaatagccagggaactgcagtgcaaggaattacctttaacgtgagccataatctgcagaagcaaacagccaacgtcgtcccagttcagagaacttgcaatctggtgacaccagtcagcatctccggcgtctacccctctgagaacaagccatggcaccagacgaccgtgccggctctggctaccaaccagcccgtcccactgtgcctgcccgccgcaataagtgcgcagagcatactggaacttcccacttccgagagcgagtccaacgtccttggtgccacaagcggctccctcattgctgtgtccatcgaatccgagcctcaccagcaccatagcctgcatacctgcctgaacgatcagaactcatccgagaacaaaaacggccaggagaaccctaaggtcctaaagaaaatgacaccctgtgttaccaatatacctcacagcagttcggcaaccgccacaaaagttcatcacggcaacaagtcctgtttgagcatccaggacttcagaggagacttccagaatacattcgtcgtgtctgtcacgaccaccgtttgttctcagccaccccgaacggccggcgactccagtcccatgtcgatcagcaagtcagcggacttgacatccaccgccacagtcgtggcaagcagcgctcccggcgttgggaaggcaaccatccctatctccacactgagcggtaatccactggacaatggctggactctgtcctgcagcttgccatcatcgagtgtatctaccagcgatctgaagaacatcaactcacttactagaattagtagcgctggtaacacccagacaacatggaccacgctccaactggcgggtaatacaattcagccgctctctcagaccccttcctctgcggtgaccccggttctaaacgaatcgggcaccagtcctaccacttctaatcacagccgttatgtggcgaccgatattaaccttaacaatagtttccctgccgatgggcagccagtcgagcaagtcgttgttaccctcccgagttgccctagcctgccgatgcaaccgttaattgcacagccgcaagtgaagagccagccacccaaaaatatactccctttgaattctgcgatgcaggtaatccaaatggcccagcccgtaggcagtgccgtgaacagtgctcctacaaaccagaatgttattatcctccagcctccaagtaccactccatgccccactgtgatgagggctgaggtctccaatcaaacagtcggccaacagatcgtcatcattcaggccgcaaatcagaatccgctccctctgctgcctgccccccctcctggatctgtccggctgccgataaacggcgcgaacaccgtgatagggtctaacaattcagtacagaacgtcccgacaccccagacatttggggggaagcacctcgtgcatatactgccccgcccaagttcactgtcagcgtcgaacagcacccagacattttcggtgactatgtctaatcagcagcctcaaaccatctcactgaatgggcaattatttgctcttcagcccgtaatgagttcctccggcacaacaaatcagactcccatgcagatcatccagccaacaacttctgaggatccaaataccaacgtggcactgaatacattcggggcactcgcctctttgaatcaaagcatttcccaaatggctggccagtcctgcgttcagcttagtatctcccaacctgccaattctcaaaccgctgcgaactcccagacaacaacagccaattgcgtttctctcacgaccacggcggcaccccctgtgactacagatagctctgctactttggctagtacctacaacctcgtctcaacatcttctatgaataccgtggcttgcctgcccaatatgaagagtaagcgtctcaataaaaaacctggaggtaggaagcacctggcagccaacaagtctgcttgccctctaaattctgtgagggacgtgtccaagctcgattgtccaaacacagaggggtcagccgagcccccctgcaacgatggactactcgagagtttccccgcggtgttaccttctgtgtctgtcagtcaggccaacagcgtgtcggtgtctgctagtcatagcctgggtgtcctgtctagcgaaagtcttattcctgagtccgtgagtaagtcaaaatcagccgagaaatcatctcccccttcccaagaaagtgtgacttcggagcactttgccatggctgcagccaaatctaaggattctacccctaatttacaacaggagacttctcaagataagccccccagcagcctcgcactgtcagatgccgcaaagccatgcgccagcgctaacgtgttaataccatcacccagcgatcctcatattctggttagccaggttcccggactttcttctacaacctctaccacgagcaccgattgtgtgtcagaagtagagatcatagccgagccctgtcgagtggaacaggattcctctgacaccatgcagaccacaggacttttgaagggtcaggggctcacaacactgttatcagatctggctaagaaaaaaaacccccaaaagtcttctctttccgaccagatggatcaccctgacttctccagcgagaatcccaaaattgtggattcctccgtgaacctgcatcctaaacaggaactgctgctcatgaataatgacgatagggatccaccccagcaccacagctgcctgccagatcaggaggttatcaatgggtctttaattaacggaaggcaagccgatagcccaatgagtacatcaagcggctcttcccgaagcttttccgtggcttctatgcttcccgaaacgacgcgcgaggacgtcacaagtaacgcgacaactaatacctgtgactcctgcaccttcgtagaacagaccgacatcgtggcgctggctgccagagctatcttcgaccaagaaaatcttgagaaaggaagagtcggcctgcaggcagacattcgcgaggtcgccagcaagcccagcgaggcatccttgctcgaaggagacccacctttcaaatcacagattccgaaggaatccggtaccggacaggccgaagctacaccgaatgagttcaactcacagggctccatcgaggctaccatggagagaccgttggaaaaacccagctgttccctgggaattaagaccagtaacgcgagcttacaggattcgacctcccagcctccgtccataacctccctctctgtcaacaatctgatccatcagtcatctatcagtcacccactggctagctgtgcaggcttaagtcccactagcgagcagactaccgtgccggccactgtcaacttgaccgtgtcctccagctcctatgggagccaaccacctggacctagcttgatgactgaatattcccaagagcagttgaacacaatgacaagcaccatccccaactctcaaatccaggagcctctgttaaaacccagtcacgagagtagaaaggattccgctaagcgggcagtccaagatgatctgctgctctcatcggccaaaaggcagaagcactgtcagcccgcgcctttgaggctggaaagcatgagcctcatgagtcgtactcctgatactattagtgatcagacgcagatgatggtcagccaaattcctccgaactctagtaattccgtggttcctgtatccaacccagctcatggcgatggactgacacgcttattccccccctcaaacaacttcgtcactcctgcactacgacagactgaggtgcaatgcgggtctcagcccagcgtagccgaacagcagcagacacaggcctcccaacacctgcaagccctgcaacagcatgtccctgcccagggagtctcacatctccactccaatcatctgtatattaagcagcaacagcagcagcaacaacagcagcagcagcagcagcaacaacaacaagcagggcagctgagggagagacaccatctgtatcagatgcagcatcatgtaccgcatgccgagagtagcgttcatagccaaccacataacgttcaccaacagcgaacactccagcaggaggtgcagatgcagaagaaacggaacctggttcagggcacacagacttcccagctgagcttgcagcctaagcaccacggcaccgatcaatcccgatcaaagaccggccagccacatccccaccaccagcagatgcaacagcagatgcagcaacacttcggatcctctcagacagagaagagttgcgagaatcctagcacaagccgcaaccaccataatcacccacagaatcatctcaatcaagatatcatgcaccagcaacaggacgtcgggtctcggcaacaaggatctggagtttcatctgaacatgtgtcgggacacaatcccatgcagagactcctgacttctcggggattggagcaacaaatggtgagtcagccttcaattgtgacgcgctcctccgatatgacttgcactccccaccgccccgagcgcaaccgcgtttcatcgtattctgctgaagctctgatcggcaagacgagttccaacagcgagcagagaatgggaattagtatccaaggctctagagtatcagaccagctagaaatgaggtcttatttagacgtcccccgcaataagtctctggccattcataacatgcaaggtcgggtggatcacaccgtggcgagcgatatccgtctgtctgattgtcaaacttttaaaccatcgggagcctcccagcaacctcagagtaatttcgaggtgcagtcatcacgcaacaatgagatagggaatcccgtctcctctctcagatctatgcagtcacaggccttcaggatctctcagaatactgggcccccacccatcgacagacaaaaacggttatcctatccaccagtgcaatcaatccctacgggaaatggaattcctagcagggatagtgaaaacacctgtcaccagtcctttatgcaatcgctcctggccccgcacctttcggaccaggttataggatcccagcgcagcctgagcgaacatcagcgcaacactcaatgtgggccttcttccgccattgaatataattgtccccctacacatgaaaacgtccatattaggcgcgaatcagagagtcagaacagggagtcatgcgatatgagtctcggggcaattaacactcggaacagcacattaaatatccccttttcctcttcttcttctagcggggatatccaagggcggaataccagtccaaatgtctcggtccaaaagagcaaccccatgagaatcaccgagtcccatgcaaccaaagggcacatgaatcccccggtgaccaccaacatgcacggggtggctaggccggctctcccacatccctcagtaagccacggcaacggtgatcagggtcccgcagttaggcaggctaacagctcagtgcctcagcgctctcgacatcctttgcaggatagctctggttccaaaatcagacagccagagagaaaccggagcggcaaccaaagacagagtaccgtgttcgatcctagtctgccccacctcccactttccaccggtggttccatgattctcggccgtcaacagcctgccacagaaaaaagaggctccatcgtgcggtttatgcctgattctccacaggttccaaacgataatagcggtccagatcagcacaccctgagccagaattttggcttttccttcatccccgagggtggtatgaacccccctatcaacgcaaatgcttcgtttatacctcaggttacccagccgtccgcgactcggacacccgcactgattccagtggacccccagaataccctcccctctttctaccctccgtattccccggctcacccaaccctgtctaatgatatatctatcccatatttcccgaatcagatgttctctaatccgagcaccgagaaagtcaattccggatctctgaacaaccgctttggtagcattctcagccccccacggcccgttgggtttgcccagccttcatttcctctgctccccgacatgccacctatgcacatgacaaacagccatctcagcaactttaatatgaccagcctgttccctgaaattgctaccgtcctcccagatggctcagccatgtctccgttgctcactatcgccaacagcagcgcctcggatagctctaaacagtcatccaaccggcctgcacataatatctctcatatcctgggacacgactgcagctccgccgtgtag

SEQ ID NO: 20292 - DNA, 3444 bp, Artificial Sequence
  Description of Artificial Sequence: Synthetic coding sequence
atggccgtggacagcgccatggagctgctgttcctggacaccttcaaacacccaagcgccgagcagtcctcacacatcgatgtagttagatttccctgcgtagtgtatatcaatgaggtgcgcgttatccctccgggtgtgagggcacattcgtctttgccggataacagagcctatggtgagacatccccccataccttccagctcgacctattctttaacaacgtctcaaagcccagtgctccagtgttcgatcggctggggagcctggagtacgatgagaacacaagtatcatcttccgccccaactccaaagtcaacaccgacgggctggtcctaagagggtggtacaactgtctcactctcgccatctacggcagcgtcgatcgggtcattagccatgaccgggattcaccccctccaccccctccccctccccccccccctcaaccccaacccagtcttaagcgcaaccccaaacacgccgacggggaaaaggaagatcagtttaacgggtcaccaccaagaccacagcccagaggtccccggacaccacccggacctccaccccccgacgatgatgaggatgatcccgtccctttgcctgtttcaggagacaaagaggaagacgctccacaccgcgaggactattttgagcctattagtcctgaccgaaactcagtcccacaggagggccagtactctgatgagggggaagtggaagaggagcagcaagaggagggggaagaagatgaggacgacgtggatgtggaggaagaggaggatgaagatgaagatgatcggagaacagtcgactccatccctgaggaagaagaggaagatgaggaggaggaaggagaggaggatgaggagggggaaggcgatgacggttatgagcagatatctagtgacgaagacggcatagctgatttagagagggaaactttcaagtacccaaatttcgacgtggaatacacagccgaggatctcgcttcagtcccacccatgacctatgacccatacgatcgggagctggtgccgttgttatatttctcttgcccatacaagaccacattcgaaatcgaaatctccagaatgaaggatcaggggcccgacaaggaaaacagcggagctatcgaggccagcgtgaagctcactgagctcctggatttgtatagggaagacagaggcgccaagtgggtcacagccttggaggaaatcccaagcctgatcatcaaggggctgtcctatttgcagttgaagaacacaaaacaggatagccttggtcagttagtcgactggaccatgcaggccttgaaccttcaagtggccctccggcaaccgattgccctcaacgtcaggcaactgaaggcaggaaccaagcttgtatcttccctggcagagtgtggtgcccagggggttacgggtttactgcaggctggggttatcagtgggctgttcgagctgctgtttgcagatcacgtctcaagttcattgaaactgaacgcctttaaagcactggatagcgtcattagtatgaccgagggaatggaagcgttcctccgcggacgacaaaacgagaagagtggctaccagaaacttctggagctgatccttttggaccagacagtgcgagtagtcaccgccgggtccgcgatcctgcagaaatgccatttctacgaagtgctcagcgagatcaagcgtcttggcgaccatctggccgaaaagaccagctctctgcccaatcattccgaacccgaccacgacactgacgctgggttggaacgaaccaatcctgagtacgagaacgaggtagaagcaagcatggatatggaccttttggagagcagcaacatcagcgaaggggagatcgagaggctgatcaaccttctcgaggaagtgtttcacctcatggagacagccccgcatactatgatacagcagcccgtgaaaagctttccaactatggccaggattactggtcccccggaacgcgatgatccttaccccgtgctgttccgttatctgcacagtcaccactttctggagttggtaactttactgctgtccattcccgtgacgtccgcccacccgggcgtgcttcaagccacaaaagacgtgttgaaattcttggctcagtcacagaagggcctgctgttttttatgtccgagtacgaagccactaatcttcttattcgggctttgtgtcatttttatgaccaagatgaagaagagggcctgcagtcagatggcgtcattgatgatgcatttgctctttggctgcaggacagtactcaaaccctccagtgtataaccgaactcttctcgcactttcaaagatgcacggcctcagaggagactgatcactccgacctccttggaacactgcataacctctatctgatcacctttaatcccgtgggcagaagcgccgtgggccacgtgttttctctggagaagaatctacagagcctcattaccttgatggagtactacagcaaggaggctctcggcgattccaaatctaagaagagcgtggcatataactacgcatgcattcttatccttgttgtggtgcagtcttcttcagatgttcagatgctagagcagcacgccgcctcacttctgaaactgtgcaaagccgacgaaaacaacgcaaaactccaagaactggggaagtggcttgagcctctgaagaatttgcgcttcgaaataaactgtatccctaatctcatcgagtatgtgaagcagaacatcgacaatcttatgaccccagaaggagttggcttgacaaccgccctgcgagtgctgtgtaacgttgcctgcccaccacccccggtagaggggcagcagaaagacttaaagtggaacctggctgttattcagctgttcagtgcagagggcatggatacatttattagagtcctgcagaaattaaactcaatcctgacccagccatggaggttacatgtgaacatgggcaccactctgcatcgcgttaccactatctcgatggcaagatgcacactgaccctgcttaaaaccatgttgaccgagctgctcagaggaggctctttcgagttcaaggatatgagggtgccctccgcactggttacgctgcatatgctgctgtgctctatacccctcagcgggcgcctggattctgacgagcagaagatacaaaatgacataattgacattttgctgacttttactcaaggagtgaatgagaagcttactatctcagaggaaacactggctaacaatacatggtccctcatgctgaaagaagtgctgagctcaattctaaaagttccagaggggttctttagcggactaatcttactaagcgagctcttacctctgcccctaccaatgcaaactacccaggtgagcctgccctacaatatgcacctcattaacgactgttcgaatactttctag

SEQ ID NO: 20293 - DNA, 4134 bp, Artificial Sequence
  Description of Artificial Sequence: Synthetic coding sequence
atggccgtggacagcgccatggagctgctgttcctggacaccttcaagcatccttctgctgaacaatctagtcacattgatgtggtcagattcccctgcgttgtctacatcaacgaggtccgggtgattccgcctggcgtgcgggctcactcctcattaccggataaccgcgcctacggcgaaacatcaccccacaccttccaactggatctgttcttcaacaatgtgagcaagccaagtgcgcccgtattcgacagattgggctccctggagtatgatgagaataccagtataatctttagaccaaacagtaaggtgaatactgacggccttgtcttgcggggatggtacaattgcctgaccttggctatctatgggtctgttgacagagtaatttcacatgaccgagattctcctccacctccaccaccacctccgccgcccccccagccccagcctagcctgaaaaggaatccgaaacacgcagatggagagaaggaagaccagttcaatggcagtccaccacggcctcagcccaggggcccacggacgccccccggtcctcccccaccggacgacgacgaagacgatcctgttccgctacctgtgtctggcgataaggaggaggacgccccgcatcgcgaagactatttcgagcccattagtcccgacaggaacagcgtccctcaggagggtcagtattccgacgagggtgaagttgaggaggaacagcaggaagagggggaggaggacgaagatgatgtggatgtggaagaggaggaggatgaggacgaagacgataggcgaactgtggactctattccagaagaagaggaggaggatgaggaagaagagggggaggaagacgaagagggggagggagacgacggctacgagcagatatcgagcgacgaagacggcatcgccgatcttgagcgcgaaacttttaaataccccaattttgacgtggagtataccgctgaggaccttgcatcagttcctccgatgacatacgatccgtacgatagagagttggttccactgttatacttttcatgcccgtataagacaacatttgagattgaaatttcccgcatgaaagaccaaggtccagataaggagaatagcggggccatcgaggcctccgtgaagttaaccgagttgctcgatctctatcgcgaggaccggggcgccaagtgggtcacagctctggaagagattccatctttaattatcaaggggctgtcctacctccagctgaagaatactaagcaggactctctcggccagttagtcgattggactatgcaagcccttaacctccaggtcgcattgcgccagcccatagcgcttaacgttcgacaacttaaggctggtactaagcttgtctcttctttggccgaatgcggggcccagggcgtgacaggactgctccaggcaggagtgatctccggtcttttcgaactcctatttgctgaccacgtctcctcttcacttaagctgaatgcatttaaggccctagattccgtgatctctatgacagaggggatggaggcgtttctgcgggggcgtcagaacgaaaaaagcgggtatcagaagcttcttgaactcatactcctcgaccagactgtcagggtggttaccgcaggcagtgccatcctccagaagtgccatttttatgaggtgctctctgaaataaaacgacttggcgaccacctggctgaaaaaacaagcagtctgcctaaccactctgaaccagatcacgataccgatgccggcctcgagaggaccaaccccgaatacgagaacgaagtagaggcatctatggacatggacctattagagtcttccaacatttccgagggcgagatcgagcgcctgatcaacttattggaggaggtctttcacctgatggagactgcaccgcacaccatgatccagcagcccgtgaagtcgttcccaacgatggcccgaataacaggcccgcccgagagagacgacccctatcccgtactctttagataccttcatagccaccacttcctggagttggttacactcctgctcagtattcccgtgacaagtgctcatccaggagttctccaagcaactaaggacgtcctgaaatttcttgcccaatctcagaaaggcttacttttttttatgtctgagtacgaagccactaaccttctcattagagccttgtgtcacttttacgatcaagatgaagaagaggggttacagtcggatggagtcatcgacgatgccttcgctttgtggctgcaggacagcacacagactcttcagtgtattactgaactgttttctcacttccagcgctgtactgcatccgaggaaaccgaccattccgatctgttaggaactcttcataacctctacctgatcacattcaatcctgttggccgcagcgccgtcggccatgttttctccttagagaaaaaccttcaaagccttatcaccttaatggagtattattccaaggaggccctgggagactcaaagagcaaaaagtcggttgcctacaactatgcgtgtatcttgatactggtagtggtgcaatccagcagcgatgtgcagatgttagagcaacacgctgcttctttgctcaagctgtgtaaagccgatgaaaacaacgccaagctccaggagctgggaaaatggttggagccattaaagaacttacgattcgagatcaattgtatccctaatctgatagagtacgtgaaacagaatattgacaatcttatgacacccgagggggtggggctgaccactgccctcagggtcctctgtaatgtagcctgtccacccccgcctgtggaaggtcagcagaaggatctgaagtggaacctcgccgtcatccagctgttcagtgcagaaggcatggatacctttatccgcgtgcttcagaagcttaattccatcttgactcaaccttggcggctgcacgttaacatggggaccaccctgcaccgcgtgacaaccatctctatggccagatgtaccttgaccctgctgaagacgatgctaactgagctactcaggggagggtcattcgagtttaaggacatgcgggttcccagcgccctggttaccctgcatatgctcttgtgctcaattccgctctctggaaggctagactcagacgaacagaaaatacaaaatgatataattgacatactgctcacttttacacagggcgtgaatgagaagcttacgatttctgaggaaacgctggccaataatacctggagcttgatgctcaaggaagtactgagtagtatcctgaaggtccctgagggctttttcagtggcttgatactgttgagtgaattgctaccgctccccctgcctatgcagacaacacaagttatcgaaccccacgacatcagcgtagccctcaacactagaaagctgtggagtatgcatcttcacgttcaggccaaactacttcaggagatcgtccggagtttctccggaactacgtgtcagccaattcagcatatgctaagacggatctgtgtgcagctctgcgacctcgcgagccccacggccctgctcatcatgaggaccgttctagaccttattgtggaggatttacagtccactagcgaagacaaagagaaacagtatacctcccagaccacgcgcctgttagctctgctagacgctctggcctctcacaaggcttgtaagttggctatacttcacctgattaatggcacaattaaaggggatgagcgatacgctgagatcttccaggatctgttagctttggtgcggtcccctggtgacagcgtcatccgtcagcagtgcgtagaatatgttacctcaattctgcagagcctttgtgatcaggacattgcgcttattctgccgtcctccagtgagggatcaatcagcgaattagagcagctgtctaattctctgccaaacaaggagcttatgacctctatttgcgactgcctgctcgctacgcttgcaaatagtgagtcttcctacaattgcctcctcacctgcgttcgtacaatgatgtttctggctgagcacgactacgggcttttccatcttaagcgggatgcagttgagatgataatggtctcctggaagtag

SEQ ID NO: 20294 - DNA, 288 bp, Artificial Sequence
  Description of Artificial Sequence: Synthetic coding sequence
atggccgacgagaagcccaaggagggcgtgaagaccgagaacaacgaccacatcaacctgaaggttgctggccaggatggatcagtggttcagttcaaaattaaaaggcatactccgctgtccaaactgatgaaagcatactgcgaacgacagggcttgtccgttcgacaaatccgttttcggtttgacggacaaccgattaacgagacggacacccccgcacagctcgagatggaggatgaggataccatagacgtctttcaacagcagacaggaggtgtgtactag

SEQ ID NO: 20295 - DNA, 6738 bp, Artificial Sequence
  Description of Artificial Sequence: Synthetic coding sequence
atgcccgagatgaccgagaacgagacccccaccaagaagcagcacagaaagaagaatcgggagacacataacgcggtcgagcgccaccgcaagaagaaaataaatgcgggaatcaaccgcattggggagctcatcccgtgctcccccgccttgaagcagagtaaaaatatgatcttagaccaggcctttaaatacataacagagttaaagcgacagaatgatgaactgctcctgaatggcggtaataacgagcaggccgaagagatcaagaaactgaggaagcagttagaagaaatacagaaagaaaatggcaggtacatagagctgttgaaggctaacgacatttgtctctacgacgacccaaccattcactggaagggaaatctcaagaacagtaaagtgtccgtcgtaatccctagtgaccaagtgcagaaaaagataattgtgtactccaacgggaatcagccaggtgggaacagtcagggcactgccgtccagggtatcacgtttaatgtttcccacaacctccagaagcaaacggccaatgtggtccctgtccagaggacttgtaacctagtgacacccgtgtctatttccggcgtgtacccttcagagaacaagccgtggcatcagactaccgttccagcccttgccactaaccagccagtaccactgtgtctcccagctgcaattagtgcgcagagtatcttggagctgcctacatccgaatccgaatcaaacgtactaggcgccacctcaggatccctgatcgctgtgtccattgaatccgaaccgcaccagcaccacagtctccacacctgcttgaacgatcagaatagtagcgagaataagaacggccaggagaaccccaaggtgctgaaaaaaatgaccccgtgcgtgaccaacattccacacagcagtagcgccaccgcaacaaaagttcaccacgggaacaagtcatgcctctctatacaggactttcgcggcgattttcagaacacatttgtagtgtctgtgacaacgacggtgtgttctcagccaccaagaactgcaggcgattcctctccaatgtccattagcaagtcggctgacctgacgtctacagcgaccgttgtggcgtcttccgccccgggggtagggaaggccacaattccaatctccaccctgagtgggaatccactggataacggctggactctcagttgtagtcttccgtcctcgagtgtgtccacctcagacctgaagaatataaacagtctgaccagaatttcgagtgctgggaatacccagaccacgtggacgaccctccagctcgcaggaaacaccattcagcctctgtcccagacacccagttccgcagtcacccccgtgttgaacgagagtggcacttcccctactacatctaaccacagtagatatgtggccaccgacatcaacctgaacaattcatttcccgcggatgggcaacctgtagagcaagtggtcgtgacactcccctcatgcccttcccttcctatgcaacccttgatagcccaaccgcaggtgaaatctcagccacctaagaatatcctccctcttaacagtgccatgcaagtgatacagatggcacagccagtgggatcagccgtgaattccgcaccgacaaatcagaatgtgatcatactgcaaccaccatcgaccacaccttgtccaacggtcatgagggctgaagtgagtaatcagactgtcggccagcagatcgtgatcatccaggccgccaatcagaatcccctgccccttctcccagcccctcccccggggagtgtgcgtttaccaattaatggcgctaacactgtgatcggcagtaataattcagttcaaaacgtcccaacaccacagacctttggaggcaaacatctggtacatatcttgcctcgcccatcttccctttccgcatcaaatagcacccaaacattctctgtcaccatgtccaatcagcaacctcagacaatttcattgaatggacagcttttcgctctccagccagtaatgagctcctccggtactaccaaccagactccaatgcagataattcaaccaactacctccgaggatcccaatacaaatgtggccctgaacacgtttggagctctcgccagcttgaaccagagtattagccaaatggcagggcagtcctgcgtacagctatctatcagccagccagcgaattcccaaaccgcagccaactcacagaccactacagcaaactgcgtgtctctcaccacaacagcagctcctcccgttacaacagactctagtgctaccctggccagtacctacaatttagtctcaacctcaagcatgaacacagttgcttgcctgccgaatatgaaaagtaagaggctgaataagaagcctgggggaaggaagcatctagcagcgaataagtcggcgtgcccactcaatagcgtacgcgatgtttctaaactcgactgtccaaacacagaaggatctgccgaacctccttgcaatgatggtctattagagagctttcccgctgtgctgccctcagtgagcgtgagccaggctaatagtgtcagtgtgtcagcaagtcactctttgggcgtcctgtctagtgaatccctgataccagaatcagtaagtaaatctaaatcagccgagaaaagctcccctccgtcccaggaaagcgtaacttccgagcacttcgcaatggcagctgcaaagtcaaaggactccacccccaatctgcaacaggaaacatcccaggacaaaccaccctccagtctggctctgagcgatgcagcaaaaccttgtgcctctgctaacgtgctgatcccatcaccaagcgacccccatatactcgtttctcaggttccaggcctgtcctccaccacctccaccacctccaccgactgtgtcagtgaggtggaaattatcgcagaaccctgccgggtggagcaagactcgagtgacactatgcaaaccacagggctgttaaaaggacaaggtcttacgaccctgctgtcagatcttgctaagaagaaaaacccacagaaaagctcccttagtgaccagatggaccaccctgattttagcagtgagaatcccaagattgtggatagcagtgtgaatcttcatcctaagcaagaactgttgcttatgaacaacgatgatagagatccgcctcagcatcattcgtgtttaccagaccaagaggtgattaacgggagcttaatcaacgggaggcaggctgacagccccatgtccacatccagtggatcatccaggtcttttagcgtggctagtatgctaccagaaacaactcgcgaggacgttacttcgaatgccacaaccaacacctgcgatagttgcaccttcgtagagcaaactgatattgttgcactggcagctagagccatcttcgaccaggagaacttagaaaaagggagggtggggctccaagccgacatccgcgaggtagccagtaaacctagcgaggcaagcctgttggagggggatccaccgtttaaaagccagattcccaaagaaagcggcacaggccaggccgaggcgactccaaacgaattcaacagccagggatctattgaggccactatggagaggccgttggagaagccaagttgcagcctgggtattaagacaagcaacgcttctctgcaggattcaacctcacagccaccatctataacatccttatcagtgaacaaccttatacatcagagctcgatctcacacccgttagcatcttgtgctggactaagtcctacgtctgagcagactaccgttcccgctaccgtaaatcttaccgtcagttcatcctcttacggctctcaaccacccggccccagcctaatgacggaatattcccaggaacaactgaacacaatgactagtacgatccccaatagtcaaattcaggagcctttgctgaaaccctcccatgagtctcgcaaagactccgccaagagagccgtgcaggacgacctgttactgtccagcgcaaaaaggcagaaacactgccaaccagctcccttgagattagagtctatgagcctcatgagtcggacaccagacaccatttccgaccagacacagatgatggtgtcacagataccgcccaattcttcaaattctgtggtaccggtgtcaaaccccgctcacggcgacgggctaacccgcctgttcccaccatcaaacaacttcgtcacgcccgccttgcggcagacggaagtgcagtgcggtagtcagccatcggtggcagagcaacaacaaacccaggccagccagcacctgcaagccctgcagcaacacgtacccgcgcagggtgtctcccacctgcattctaaccacctgtatataaagcaacaacaacaacagcagcagcagcagcagcagcagcagcagcagcagcaagccggtcagctgagggagcgccatcacctttaccaaatgcaacaccacgtgccacatgccgaatcctctgtgcactcacagcctcacaatgtccaccagcagaggactctccaacaggaagtgcagatgcagaagaagcgaaatctcgtccaagggacccaaaccagccagctgtccctacagcctaaacatcatgggactgatcagtcccggtctaaaaccggccagccccacccacaccaccagcagatgcagcagcagatgcagcagcatttcggcagcagccaaaccgagaaaagctgcgagaatccctcaacatcccgaaaccatcataatcatccacagaatcacttaaatcaggatattatgcatcagcaacaagatgtgggcagtaggcagcagggttccggcgttagctcagagcatgtgtcgggccataatcccatgcagcgactgctcactagcagaggcctggaacagcagatggtgagtcagccctctatcgtgaccaggtcatcagacatgacttgtactccgcacagacccgagagaaatcgcgtttccagctattctgctgaagcgttaatcgggaagaccagcagcaactccgagcagagaatgggcatctcgatccaagggtccagagtgagtgaccagctggaaatgagaagctacctggacgtgccgcggaacaagtcacttgccatacataatatgcagggcagagtggaccacaccgtcgcaagtgacattcgactcagcgattgccaaacttttaagccctcaggggcctcgcagcagcctcagtccaacttcgaggtccagagtagccggaacaatgaaataggaaatcctgtcagcagcctgaggagcatgcagtcccaagccttcagaatatcccagaataccgggccaccccccatcgaccgccagaaaagactctcttatccgcccgtgcagagcattccaaccggtaacggtataccttcccgagactccgagaatacgtgccatcagagcttcatgcagagcttgctggccccccatctgtctgatcaagtgattggatcgcagagatctctgagtgaacatcagcgcaacacacaatgcggcccttcatccgccatcgaatacaactgtccacctacgcacgagaatgttcatatccgtagagagtcagaatctcagaaccgggaaagctgcgacatgagtctcggcgccattaatacacgaaattccactctgaatatccctttctcttcgtcatcctcaagcggggacatacagggaagaaacacatcacccaatgtatccgtgcaaaagtctaatcctatgagaataacagaaagccacgccaccaaaggacacatgaaccctcctgtcactacaaacatgcatggagtggcaaggcctgccctaccccatccaagcgtgagccacggaaatggagaccagggacctgccgttaggcaggctaacagctcagtgccccagagatctcggcatcccctccaggatagctccggcagcaaaatcaggcaaccagaacgaaatcggtcaggcaaccagcgtcaaagcactgtgttcgacccatctttgccacaccttccgctaagcactggtggctctatgatacttggtcgacagcagcctgccaccgagaaaagggggtcaatcgtgcgatttatgcctgactcacctcaggtcccaaacgacaactcagggccagaccagcatactttgagccagaacttcggattctcattcatcccagagggagggatgaacccaccaataaacgctaatgcatcttttatcccccaagttacccagccgtcagccactcggacaccggcactgatcccagtggatccccaaaatacattgccttccttttatccaccctattccccagcacatccaacgctgtcgaacgacatatctataccatatttccctaatcaaatgttcagtaacccctcaacagagaaggtgaactcgggctctctaaacaacagatttgggtcaattctgtcccctccaagaccggtcggtttcgctcaaccttcgtttcctcttcttcccgatatgccaccaatgcacatgactaactcacacctgagcaacttcaatatgaccagtttattcccagagatcgccactgttctgcctgatggatctgcaatgagtcctctcctcacaatcgcgaactcttcggccagcgacagttcaaagcagtcatccaaccgaccggcccacaacatttctcacattctggggcacgattgcagcagcgccgtgtag

SEQ ID NO: 20296 - DNA, 216 bp, Artificial Sequence
  Description of Artificial Sequence: Synthetic coding sequence
atgaagcagctgaagcggaagcggaagagcaacttcagcgtgcaggaaactcagaccttactcaaggagatcaccaagcgtaaggaagtgatcttctcaaagcagctgaataccacgatcaatgtgatgaagagaatggcatgggaggaaattgctcagtgtgtgaacgccgtcggtgaaggcgagcagagaaccggaaccgaggtcaagcgctag

SEQ ID NO: 20297 - DNA, 591 bp, Artificial Sequence
  Description of Artificial Sequence: Synthetic coding sequence
atgaagcagctgaagcggaagcggaagagcaacttcagcgtgcaggagacccaaacacttcttaaagaaatcacaaaaagaaaagaggttattttttccaagcagctaaacacaaccattaacgtcatgaagagaatggcctgggaggaaatcgcccagtgtgtaaatgcggtgggtgagggggaacagcggacaggtaccgaggtgaaacggagatatctggactggcgcgccttaatgaagagaaagcgcatgaaagctaatattaagctggtgggctccggattccccctgccgagctcagaccttgatgactccctcacagaagaaatcgacgagaagatcggttttaggaatgatgccaactttgactggcagaatgtggccgatttccgggatgctgggggctctctgacagaggtgaaggtcgaagaggaagagagagatccccaatctcccgaattcgaaatcgaggaggaggaggagatgctatcttcagtgatccccgattctcggagggaaaacgagctcccagatttcccccacatcgacgagtttttcacacttaactctacaccttccaggtcctag

SEQ ID NO: 20298 - DNA, 336 bp, Artificial Sequence
  Description of Artificial Sequence: Synthetic coding sequence
atgaagcagctgaagcggaagcggaagagcaacttcagcgtgcaggagactcagacactgctaaaggagattacaaagagaaaggaggtcattttctccaaacagctgaataccacgattaacgtgatgaagaggatggcttgggaagaaatcgctcagtgtgtgaacgcagtgggagaaggggagcagaggacagggaccgaagtgaagaggagatatctcgactggagagcacttatgaagaggaagagaatgaaggccaacatcaagctggttggcagcggtttcccactcccatccagcgatcttgacgactcccttacagaggaaatctag

SEQ ID NO: 20299 - DNA, 1158 bp, Artificial Sequence
  Description of Artificial Sequence: Synthetic coding sequence
atgcaggcctgcggcggcggcgccgccggccggcgggccttcgactcaatctgccccaacaggatgctagcactgcccggccgggcactgctgtgcaagcctggcaagcccgaacgcaagttcgcaccaccccggaagttctttcctggttgtactggagggagccctgtatctgtatatgaagaccctcccgatgcagagccaacagccctaccggctttgacgactattgacctgcaagatttggcagactgttcaagcctgctgggctctgatgccccccctggaggagatttggccgccagccagaaccactctcatcagaccgaagctgacttcaatctgcaggacttcagggatacagtggacgacctaatttctgactcttcctcgatgatgtcacctacactggcgagcggagattttccattcagcccctgcgatatttcgcccttcgggccttgcttgtcccccccacttgacccccgggcactgcagagcccccccttgcgcccccctgatgttccacccccagagcagtactggaaggaggtggcggaccaaaaccagcgtgccctgggggacgccttggtggagaacaatcaacttcatgtgactctcactcaaaaacaggaggagattgcaagtctgaaggagaggaacgtccagttgaaggagctggcctcgcgtacacgacaccttgccagcgttctcgacaagctgatgattacccagtccagggattgcggcgctgcagccgagccatttctcttaaaagccaaagccaaaagaagtctcgaagagctggtgtctgctgctggccaggattgcgctgaagtggatgctatcctgcgggagatatcggagcgatgcgacgaggcgctccagtcgagggatcccaagagacctcggctcctgccagaaccggctaacaccgatacacggcccgggaacctccacggagccttcaggggtctcaggacggactgttctcggagtgctctgaacttaagccatagcgaactggaagaaggcggtagcttttccacgcgcatccgctcgcactccaccatccgtaccctggcgttcccgcagggaaatgcattcacaattagaaccgccaacggcggttacaagttccgatgggtgccatcttag

SEQ ID NO: 20300 - DNA, 1866 bp, Artificial Sequence
  Description of Artificial Sequence: Synthetic coding sequence
atggccgacttcgaggagctgcggaacatggtgagcagcttccgggtgagcgaactgcaagttttgttgggttttgcaggccggaataaaagcgggcgaaaacacgatctgttgatgcgcgccctgcacctccttaaatcaggctgctctcccgccgtccagatcaagataagagagctgtatcgacgccgctatccacgcactttggaaggcctgtccgatctgtctactatcaaatcaagcgtatttagcctagacggcggctcaagtcccgtagaaccagacttggctgtggccgggatccatagcctgccaagtacctctgtgacaccacactccccttcttccccagtggggtcggtcctgctccaagacaccaaaccaacttttgagatgcagcaaccgtctcctcctatcccaccagtacatcctgatgttcagctgaaaaacctgccattttatgacgtccttgatgtcctaataaaacccacctccctggtgcagagtagtatacagagattccaggagaagttcttcatcttcgcactaactccacagcaggtgagagagatatgtatctcaagggactttttgccaggaggaagaagggattataccgtccaggtacagctgcggctgtgcttggctgaaacctcctgcccacaagaggataactacccgaattccctttgtattaaggtcaacggcaaactttttcccctgcctggctacgcccctccccctaagaacggaatcgagcagaaacgcccaggaaggccactgaatatcacctctctggtcaggctgagctctgccgtccctaaccagatctcaattagctgggcatcagagattgggaaaaattactccatgagtgtttacctggtccgtcagctgacaagtgccatgcttctgcagcggctcaagatgaaagggatccgcaaccccgaccacagccgggctttgattaaagaaaaactgacagccgatcccgatagcgagattgccactacctcgctgcgggtgagtcttatgtgtccactgggaaagatgagacttaccattccctgcagggccgtgacttgcactcatctgcaatgctttgatgccgcactttacttgcagatgaatgagaagaaacccacttggatctgcccggtgtgtgataaaaaagctgcgtacgagtccctgattctagatgggctgtttatggaaatcctgaatgattgcagcgatgtggatgagatcaaatttcaggaggatggctcttggtgtccaatgcgaccaaaaaaagaggctatgaaggtttctagccaaccatgtacgaaaatcgaatcatcatctgttttaagtaagccttgttccgtaacggttgcttcggaagccagcaaaaaaaaagtagatgtcatagatctgacaatcgaatctagttccgacgaggaggaagaccctcccgctaagaggaagtgtatattcatgtccgagacacaaagcagccctaccaagggcgtactgatgtatcagccctcctcggttcgggtcccctcagtaacttccgtcgatcccgcagcaatcccaccatccctgacggactactccgtcccgttccatcatactcctatctcctcgatgagctctgaccttcccggcctggattttctgtctctgattcccgtcgatccccagtactgcccacctatgtttttggatagtttgacaagcccactgaccgcatccagtacctccgtgaccaccacttccagccacgagtcgtctacacatgtttcctcctcttcgagtaggtccgagacgggggtcataacttcttctggctcaaatattcccgatatcatttcccttgactag

SEQ ID NO: 20301 - DNA, 1866 bp, Artificial Sequence
  Description of Artificial Sequence: Synthetic coding sequence
atggccaacttcgaggagatcatcaacatggtgagcagcttccgggtgtcagagctccaggtgctgttaggctttgcggggaggaacaaatccggccgaaagcatgatttgctgatgcgggcgctacatctcttgaaaagtggctgctctcctgccgtccagattaagatcagggagctataccgccggcgctaccctcggacactcgagggactctccgaccttagcaccattaagagctctgttttcagcctagatggcggctccagtcctgtcgagcctgacctggctgtggccggcatccattctctccccagtaccagcgtgaccccccattcgccctccagccccgtgggatccgtgctgcttcaggacactaaacctactttcgagatgcaacaacccagcccccccataccaccagttcaccccgatgtccagctgaaaaaccttccattttatgatgtactcgatgtacttataaagcctacaagcctggttcagtccagcatccaacggtttcaggaaaagttcttcattttcgcactgacaccacagcaagtgagggagatctgcattagcagagatttcctgccggggggtagacgagattataccgttcaggtccagctgagattgtgtctcgctgagaccagctgtcctcaggaagacaactatccaaactcactctgcattaaagtaaacggaaagctcttcccattaccaggctacgccccacctcctaaaaacggaatagaacagaagaggcccggacggcccctgaatattacatctctggtccgcctgagctcggcagtcccgaatcaaatttctatctcctgggctagcgagatcggcaaaaactactccatgtccgtgtatctggtgcgccagttaacgagtgccatgctcttgcagcgcctaaagatgaagggaatccgcaatcccgaccattcccgggcactgatcaaggaaaagctcactgccgatcctgatagcgagattgccaccacaagcctgagggtctcgttgatgtgtccgctgggtaaaatgagactgacaatcccatgtagagcagtcacatgtacacacctccaatgttttgatgcagcactctatctgcagatgaatgaaaagaaaccgacctggatttgtccagtctgcgacaagaaggccgcgtacgagagtctcatcctggacggactgttcatggagattctaaacgattgtagcgatgtcgacgagattaagtttcaggaggacggatcgtggtgccctatgagaccgaaaaaagaggcaatgaaggtttcaagccagccatgcacaaagatcgaatcttccagcgtgttaagtaaaccttgcagcgtcactgtggcaagcgaagctagcaaaaaaaaagtcgatgtcatcgacctgaccatcgaatcctctagcgacgaagaagaggacccaccggccaagaggaagtgtatttttatgtctgagactcaatcatctccaacaaagggcgtgctcatgtatcagccctcaagcgtgagggtcccaagcgttacatccgtggaccccgcagcgatccctccaagcctcactgactactcagtgccattccaccacactcctatatcttccatgtccagcgatctcccaggactggattttctcagcttgattccagttgatccgcaatattgccctccaatgtttttggactccctgaccagtcctctgactgcaagctctacaagtgtgacaaccacctcttcacacgagtcatctacacacgtgtcgtcttccagcagcagaagcgagacaggtgtgatcacttcctcagggagcaacatccccgatatcataagtttggattag

SEQ ID NO: 20302 - DNA, 1719 bp, Artificial Sequence
  Description of Artificial Sequence: Synthetic coding sequence
atggccgacttcgaggagctgcggaacatggtgagcagcttccgggtcagcgaacttcaggtgctcttgggatttgccggtcgtaataagtccgggcgtaaacacgacctccttatgagagctctccacctgttaaagtcaggctgcagccctgctgtccagatcaagattcgtgagttgtacagaagacgttaccctcgaacactcgaaggcctttctgacctgagcacaattaagtcatccgtgttctcgttagatgggggctcgagtcctgtggagccggacctggccgtcgcaggcattcattctctcccctcaactagcgtaactccccatagtccatcatcacctgtcggaagcgtactactccaggataccaagccaacattcgaaatgcagcagcccagtccgccaattcctcctgtacatccagatgtacagctgaaaaacttaccattttatgacgtactcgatgtgttgattaagccgacctcactggtgcagtcgtccatccagcgcttccaagagaagtttttcatcttcgcactaacgccccagcaagtgcgagaaatctgtatctcccgcgactttctccccggcgggaggcgcgattatacagtccaggtccagctaaggctatgcctcgcagagacttcatgcccacaggaagacaattaccccaattccctttgtatcaaagttaacggcaagctgttccctctcccagggtacgcacctcctcccaaaaacggcattgagcaaaagcgtcctggtcgtcctctcaacatcacaagtcttgtgaggctgagctcagctgttcccaatcagatcagcatatcttgggcttcagagatcggtaaaaattattctatgagtgtttacctggtcaggcaactgacatccgccatgctcctgcaacgcctgaagatgaagggaattagaaatcctgaccactcacgcgcattgattaaggaaaagctgacagccgaccctgactccgagattgcaactaccagcctccgagttagcctcatgtgccccctggggaaaatgaggctgacaattccatgccgggcagttacatgtacgcacctacagtgttttgacgctgcactctacctccaaatgaatgagaaaaaaccaacctggatctgtcccgtctgtgacaagaaggccgcctatgaatccctgattttggatggcctgttcatggagatcctcaacgattgctcagatgtggacgaaatcaagttccaggaggacggtagttggtgccctatgcggcccaagaaagaagcgatgaaagtgagttcacagccctgcacaaagatagagtcatccagcgtgctgtcaaaaccttgctcagtcacggttgcctctgaggccagcaagaagaaggtggatgtaatcgatctgactatcgagtcctcctcagacgaggaggaggaccctccagctaagcgaaagtgtatctttatgtctgagacccaatctagtccaaccaagggggttctgatgtaccaacccagcagcgttagggtgccttccgtgacttcggttgatcctgcggcgatcccgcccagccttaccgactactcagttccattccaccacacccccattagcagcatgtcatctgacttgcctggcgagcagcgaagaaatgacatcaataatgagcttaagcttggcacttccagtgacaccgtgcagcagtag

SEQ ID NO: 20303 - DNA, 1191 bp, Artificial Sequence
  Description of Artificial Sequence: Synthetic coding sequence
cggaacctgaacaacatggtgagcagcttccgggtgagcgagctgcaagttctcctcgggtttgctggccgcaacaagtcagggaggaaacacgacttgttgatgcgggcgctgcaccttctgaaatcaggctgctcccctgccgttcagataaagatcagagaactctaccggaggagatatccccgaacactcgaggggctgtccgacctgtcgactattaagtcctctgtcttttccctggacggcggttcgtctcccgtggagcctgacctcgctgtggcaggaattcattctctccccagcacaagtgtcacacctcattcaccaagcagtccagtggggagcgtcttgcttcaggacaccaaacctactttcgaaatgcaacagccttctccgcctatcccacctgttcaccctgacgtacagctcaagaacctaccattttacgatgtgctcgacgtgctcatcaaacctacttcactggtgcagagtagcatccagcggttccaggagaagttctttatctttgccttgacaccccagcaagtcagagagatatgtatttcacgcgacttccttccgggtggacgccgagattatacggtgcaggtacaactgcgcctatgcctggccgaaacctcttgtccccaagaggacaattatccgaatagcctctgcatcaaagtaaatggaaagctttttcctctgcctggatatgccccacctccaaaaaatggcatcgaacagaaacgacccggcagacctctgaatatcacgagtctggttcgcctaagcagcgctgtcccaaaccagattagcatctcctgggctagcgagattgggaagaattatagtatgtcggtgtatttggtgcgacagctaacgtcagccatgttgcttcagcgcttgaaaatgaagggcatccgaaaccccgatcattcccgtgcacttatcaaggagaaactgacagccgatcctgactctgaaatcgccaccacatcactgagagtcagcttaatgtgccccctcggaaaaatgagactcaccataccctgtcgggccgtgacgtgtacccaccttcagtgcttcgatgcagccttatacctgcagatgaacgaaaagaagcccacatggatttgccccgtctgtgataagaaagccgcttatgagtccctgatactagattag

SEQ ID NO: 20304 - DNA, 1866 bp, Artificial Sequence
  Description of Artificial Sequence: Synthetic coding sequence
atggccgacttcgaggagctgcggaacatggtgagcagcttccgggtctccgagttgcaggtgctactggggttcgctggccgcaacaaatccggcagaaaacatgacctgctcatgcgagcattgcacttgctgaaatcaggatgctctcctgctgtccagataaagatacgtgagttgtaccgccggagataccccaggaccctggagggattaagcgacctgtcaactatcaagtccagtgttttcagccttgatggcgggagctcccctgttgaaccagatctcgcagtggccggcattcattcattgccctccacgtccgtcaccccacattccccgtcctcacctgtcggaagcgtgctgctacaggacaccaagcctacattcgaaatgcagcagccctcaccaccaatccccccggtgcacccagatgtgcagctcaagaacctgcctttttatgacgttctcgatgtgctgattaaacccacctcgctggttcagtcctccattcagagatttcaggagaaattttttatattcgccctgaccccacagcaggtgcgagagatctgcatcagcagggacttcctcccaggaggaaggcgcgactacaccgtgcaggtgcagttgagattatgccttgcagagacttcttgccctcaggaagacaactatcccaactctttatgtattaaggttaacgggaaactctttccattgcccggctacgcgccacctccaaaaaacggtatcgaacagaaaagaccaggaaggcccctgaacattacctctctcgtccgcctctcttccgcagtgcccaaccagatatcgatttcctgggcttccgaaattggaaaaaattactccatgagcgtctacttggtgcgtcagctaacatccgctatgctcctccagcggctcaaaatgaagggcatccgcaacccagatcatagtagggcccttattaaggagaagcttaccgcagaccctgactctgagatagccaccaccagcctccgagtaagcctgatgtgcccacttggaaaaatgagacttaccataccctgtagagctgtcacctgtacgcatctccagtgtttcgacgccgcgctgtacctgcagatgaatgagaagaaacccacctggatttgtcctgtgtgcgacaagaaagccgcctacgaatcactcatcctggacggactgtttatggagatactcaatgactgcagcgatgtcgacgaaatcaaatttcaggaagacggctcttggtgccccatgagaccaaagaaggaagcgatgaaagtgtcatctcagccttgcacaaaaattgaatcttcaagtgtgctgagtaagccttgttcggtgacagtcgccagcgaagcgagtaaaaaaaaagtcgacgtgattgatctcaccattgaatcctcaagcgatgaggaggaggaccccccagccaaacgcaagtgcatcttcatgagcgaaacgcagtcaagtcccaccaagggagtgctgatgtatcaaccctcctcagtgagagtgccctccgtgaccagcgtcgacccagcagctatcccccccagtctgaccgattacagtgtgcctttccatcacacccctatctcatctatgagtagcgatttgcccggactggactttctgtcactcatccctgtggatcctcagtactgtcccccaatgtttctcgactcactgacatcaccacttactgcctcttccacttccgtcactactactagtagccacgaaagcagcacacacgtgagctcgtctagctcacgatctgaaaccggcgtcattacatcctcagggtccaatataccggacattatctcgctggactag

SEQ ID NO: 20305 - DNA, 849 bp, Artificial Sequence
  Description of Artificial Sequence: Synthetic coding sequence
atgagcgtgtacctggtgcggcagctgaccagcgccatgctgctgcagcggctgaaaatgaagggtatccgcaacccagaccatagccgtgctcttattaaagagaagctcaccgctgatccagactcggagattgccactacatctctgagggtgtccctcatgtgtcccctgggaaagatgcggcttaccatcccctgcagagctgtgacttgtacacacttgcaatgttttgatgcggccctctatctgcaaatgaatgagaagaagcccacatggatttgtccagtgtgcgataagaaggccgcttatgagtctctaatcctcgacggactgttcatggaaattttgaacgactgtagtgacgtggatgagatcaaatttcaggaagacggttcttggtgcccaatgcgccccaagaaagaagcgatgaaggtgagttcacagccatgtactaagattgagtcgagttcagtgctgtccaaaccttgctccgtgaccgtggcctccgaagcttctaagaaaaaagtagacgtaatcgacctcaccattgaatctagctctgacgaagaagaagatccccccgcaaaacgtaagtgcatcttcatgtccgagacacaaagttcacctacaaagggggtactgatgtaccagccctctagcgtacgcgtgccatcagtgacgtccgtggatcccgccgcgatacctccgtcgttaacagactactcagtgccctttcaccacacccccatatcttcaatgagctcagacttacctggcgagcagcgcagaaatgatataaataatgagcttaaacttggaaccagttcagatactgtgcagcagtag

SEQ ID NO: 20306 - DNA, 1023 bp, Artificial Sequence
  Description of Artificial Sequence: Synthetic coding sequence
atggagaccgtgatcagcagcgacagcagccccgccgtggagaacgagcatccacaggaaactccagagtcaaataacagcgtctacacttcgtttatgaaatcacacaggtgctatgaccttattcctacatcttctaagcttgtcgtttttgacaccagtttacaggttaaaaaggctttctttgctctggtgaccaatggcgtgcgggctgcgccactgtgggactccaagaaacagtccttcgtggtgttgagagcgctcagttgcccactgggcatgcttacaatcaccgacttcatcaacattctgcacagatattacaagtccgctttggttcagatttatgaactcgaggaacacaagattgaaacctggagggaggtgtacctgcaggacagttttaaacccctcgtgtgtatcagcccaaacgcctccctcttcgacgccgtctcatcgctgatcagaaacaagattcatcgcctccctgtgatcgaccccgagagtggaaacactttatatatcctaacgcataagcggattcttaaattcctgaaactttttataaccgagtttccaaagcccgagttcatgagcaaatctctggaggaactccagatcggcacttatgcgaacatcgctatggttagaacgactacgcccgtgtatgtggccctggggatttttgtccagcatagagtgtctgccctacccgtcgtggatgagaagggacgagtggtggatatctattctaaattcgacgttattaacttggctgctgagaaaacctataacaacctggatgtgagcgtgaccaaggcactccagcatcgttctcactacttcgagggagttttgaagtgttatctgcatgagaccctcgagacgattataaatagacttgtggaggcggaggtccacagactcgtggtcgttgacgagaatgacgtcgtgaaggggattgtctctctttctgacattttgcaggcgctcgttctgaccggcggggagaagaaaccatag

SEQ ID NO: 20307 - DNA, 900 bp, Artificial Sequence
  Description of Artificial Sequence: Synthetic coding sequence
atgaagagccaccggtgctacgacctgatccccaccagcagcaagctggttgttttcgacaccagtcttcaagtgaagaaagccttttttgccctcgtgaccaatggcgtcagagccgctcctctttgggacagcaagaaacagtcttttgtcgggatgcttacaataaccgatttcatcaatatccttcataggtactacaagagcgcattggtacagatctacgagttggaggagcataagattgagacctggagagaagtctaccttcaggattcttttaagccacttgtgtgtatctctcccaatgccagtctttttgatgccgtgagtagcctgattcgtaacaaaatccaccgtcttcctgtgatcgatcccgaatccggcaacactctatatatcctgactcacaagagaattctgaagttcctaaaactgtttatcactgagttcccgaaaccagagttcatgtccaaatctttggaggagctccagatcggtacctacgccaacattgcaatggtcagaaccacaacgcccgtttatgttgcccttggcatttttgtacagcatagggtttcagccctgcccgttgtcgacgagaaggggcgagttgtggacatatactccaagtttgatgtgatcaatcttgcagcggaaaagacatacaacaatctcgacgtgtccgtgaccaaagctctgcagcaccgctctcattacttcgagggtgtcctcaagtgttaccttcatgaaacactggagaccattatcaacagactggtggaggccgaagtgcacaggctggtggtggtcgacgagaacgacgtagttaaaggcatcgtgtcactctcagacatcttacaggctctagtcttgactggcggagaaaaaaagccatag

SEQ ID NO: 20308 - DNA, 2823 bp, Artificial Sequence
  Description of Artificial Sequence: Synthetic coding sequence
atgggcagcggccccatcgaccccaaggagctgctgaagggcctggacagctttcttaaccgcgatggtgaagtgaaatccgttgatggcatcagcaaaatcttttccctgatgaaggaggctcgtaaaatggtcagccgttgcacgtacctgaatatacttctgcaaactagatcccctgagattttagtcaaattcattgacgtcggtggatacaagctcctaaacaactggctcacgtacagtaaaacgacgaacaatataccactcctccagcagattctcttaaccctgcagcacctgccattgacagtcgaccacctgaagcagaataacaccgccaagctggtcaaacaactttcaaagtcgagcgaagacgaggagttgaggaaacttgcaagcgtgcttgtgagcgattggatggcagtgattcggtctcagtcaagtacccagcccgctgagaaagacaaaaagaaacggaaagacgagggcaagagtagaacaacccttccagagagaccattaaccgaggtgaaagctgaaacccgagctgaagaggctcctgagaagaaacgagaaaaacccaagtccctaagaaccaccgcaccatcacacgccaaatttcgctccaccggcctggagctcgaaacgcctagcctggtccccgtgaagaaaaacgcaagcactgtcgttgtgtctgacaagtataacctaaagcctatcccactcaagcgacagagcaacgttgccgccccgggcgatgccactccccccgccgaaaaaaaatacaagcctctaaatactacccctaacgccaccaaggaaatcaaagtgaagatcatacccccacaacccatggaaggcctgggcttcctggatgccttgaattccgcaccagttcccgggatcaaaatcaaaaagaaaaaaaaagtgctatctcctaccgcagccaagcccagtcctttcgaagggaagacctcgactgaaccatctaccgctaagccttccagccccgaacccgcaccccccagcgaagccatggacgcggacagacccggtacgcctgtccctccagtggaggtacccgagttaatggacacggcatctctggagccgggagcactggacgctaaacctgttgaatccccaggggatccaaaccagttgactcgcaaaggtcgcaagcggaaatctgtgacttggcctgaggaagggaagctgagggagtacttctacttcgaactggacgagaccgagcgggtcaacgtaaataagattaaggatttcggcgaggcggccaaaagggaaatactgtcagatcgccacgcattcgaaaccgcgagacgcctctcgcacgacaatatggaagagaaggtgccctgggtttgcccaagaccacttgttctcccatccccacttgtcactcctggttccaacagccaggaaagatatattcaagcagagcgcgagaagggtattttgcaggagctcttcctgaataaagagtcaccgcacgagcccgatcctgagccctacgaacccataccaccgaagctcatcccactggatgaggaatgcagcatggacgaaacaccttacgtggaaaccttggagcctggaggctccgggggctctcccgatggggctgggggaagcaagctgccgccggtcttagctaatctgatgggtagcatgggcgcgggaaagggcccacaaggacccgggggcggcggcatcaatgtgcaggaaattttgacctccatcatgggatcccctaacagtcatccgagcgaagaactcttaaagcagcccgactactcagataagattaagcaaatgctcgtgccccacggattgctgggcccaggaccaatcgcaaacggattcccccccggcggacctggcgggcccaaaggcatgcagcactttccccccggccccggtggccccatgcccggcccccatggtggccctggcggcccggtgggtcccaggctgctgggcccacctccccctcctagggggggcgaccccttctgggacggtcctggcgaccccatgcgaggagggccaatgcggggagggccaggcccaggtccaggcccataccaccgagggagaggtgggcgcggtggtaatgaacctcctccccccccccccccatttagaggcgccaggggtggcaggtcaggaggcggcccaccaaatgggaggggtgggccgggcggtggaatggtgggcggcggaggccacagaccccacgaaggccccggtggcggcatgggcaatagcagtggacataggcctcacgaggggccggggggcgggatgggtagtggccaccgccctcacgagggacccggcggaagcatgggcggtggaggaggacaccggcctcacgagggacccggggggggcataagtggtggtagtggacacagaccccatgaaggtcccgggggcggcatgggggctggcgggggacaccggcctcacgaaggccctggtggctccatgggtgggtcaggcgggcatagaccccacgaggggccggggcacggtggcccacacggccacaggccacacgacgtgccaggacaccgcggccatgaccatcgtggcccaccgccacacgaacaccgggggcatgacggcccaggccatggcggaggaggtcaccgaggacatgacgggggacatagtcacggtggggatatgagcaatagacctgtgtgcagacactttatgatgaagggtaattgcagatacgagaacaactgtgctttttaccaccctggtgttaatggacccccgctgccctag

SEQ ID NO: 20309 - DNA, 2823 bp, Artificial Sequence
  Description of Artificial Sequence: Synthetic coding sequence
atgggcagcggccccatcgaccccaaggagctgctgaagggcctggacagtttcctcaaccgggatggcgaagttaaatctgtagacggaatctccaaaatcttttcactaatgaaggaggcccgtaagatggtgtcaaggtgcacatacttgaatatcctcctgcagacacgctcacccgagatattagttaagttcattgacgtgggcggatataaattacttaataactggcttacctacagtaagaccacaaacaacattcctctgttgcaacagatactgttgacactgcagcacctgccgttgactgtggatcaccttaagcagaacaatacagcaaaacttgtcaagcagttaagcaaatcttctgaggatgaagaacttagaaaattagcttccgtcctggttagcgactggatggccgtcatccggtcacagtcctctacacagcccgcagagaaagataagaagaagcgaaaagatgaggggaaatctagaaccacgctgcctgaacgccctcttactgaggtgaaggcagaaacacgagcagaggaggccccagagaagaaacgcgagaagcctaagtctctacgaacaaccgcgccaagccacgcaaagtttcgctctactggtttagaactcgaaacccccagtttggtgcccgtgaagaagaatgccagtaccgttgtcgtatcggataagtataacctgaagcccatcccgcttaagcgccagtccaatgtggcggcccctggtgatgctaccccccctgccgagaagaagtataagccactcaatacaacacctaatgccaccaaggagatcaaggttaagattatacctccacagccgatggagggtctaggctttctggatgctcttaacagcgcccccgtacccggtattaagataaagaaaaagaaaaaggtgctgagccccacagccgcaaagccatcccccttcgaggggaaaacgagtacagagccaagtactgcgaaaccgtcatccccagaacccgcacctccaagcgaagccatggatgctgatcgacccggtacccccgttccacctgtagaagtaccagagttgatggatacagccagtctagagccaggggcccttgacgctaagccagtggagtctcccggagatcccaaccagctgaccaggaaaggccgtaagaggaaatcagtgacttggcctgaggagggcaaacttagagaatatttctacttcgaactcgacgagaccgagagagtgaatgtcaataaaattaaggactttggagaggcagccaaaagggagatactgagcgacaggcacgcttttgagaccgcccggcgtctgagccacgacaacatggaggagaaagtgccatgggtttgcccccggccgttggttctgccatctcccctggtgactcccggaagcaactctcaggaacgatatatccaggcggagcgcgagaaaggaattttgcaggaattgttcttaaataaagaaagcccgcacgaaccggatcccgaaccctatgagcccatccctccaaaattaattcccctggatgaagaatgtagcatggatgaaactccttacgttgaaacattagaaccaggtgggtcaggcggctcaccggacggcgcaggcggctcaaagttaccccctgtcctagctaatctgatgggctctatgggcgcagggaaaggccctcagggaccaggtggcgggggtattaacgtccaggagatcttgacaagcattatgggcagtccaaactctcacccgagcgaggaactattgaagcaaccagactatagcgacaaaatcaagcagatgctggtacctcacgggttactcggccctgggcccattgctaatggcttccccccaggtggcccaggagggccaaagggcatgcagcacttcccccccggaccgggaggacctatgcctggtcctcatggcggcccaggtggccccgtaggaccgcgattactgggaccacctccccccccacgggggggcgacccgttttgggatggccctggcgaccccatgagaggaggaccaatgagaggcggacctggccctggccctgggccttatcataggggacggggagggcgggggggcaatgaaccaccacctcctcctcctccgtttcggggtgcgcgcggagggaggagtggcgggggaccaccaaacggcagaggcggccccggaggtggaatggttggtggaggcggccatcgaccccacgaggggcctggagggggtatgggaaatagttcagggcacagaccccatgaaggccccggcggcgggatgggctccggccatcggccacatgaagggcctggtggcagtatgggagggggtggcggccatcgccctcacgaaggccccggaggggggatctccggtggctccgggcaccgcccacacgaaggacccggtggaggtatgggcgccggaggaggacatcgcccccatgagggacccggaggatctatgggagggtcaggaggtcatagacctcatgagggaccaggacacggtggcccccacggccatcgtcctcatgatgtgcccgggcatcgcggacacgatcacagaggtccgccccctcacgaacaccgaggacacgacggacctggacacggcgggggcggacacagaggtcatgatggaggccattcgcacggaggcgatatgtcaaacagaccggtctgtagacactttatgatgaaagggaactgccggtatgaaaacaactgtgccttctatcaccccggggtgaacggacctccactgccttag

SEQ ID NO: 20310 - DNA, 2823 bp, Artificial Sequence
  Description of Artificial Sequence: Synthetic coding sequence
atgggcagcggccccatcgaccccaaggagctgctgaagggcctggacagcttcctcaatcgcgatggagaggtgaagtctgtggacggaattagtaagatcttctctctgatgaaggaagctagaaaaatggtctcacgctgcacctatcttaatattctgttgcaaaccaggagccccgaaattttggtgaagtttatcgatgtagggggatataagttacttaacaactggcttacatattcaaagacgacgaataacatcccactgttgcagcagatcctgctcaccttgcagcatttacctctgaccgtggatcaccttaagcaaaacaatactgctaaactcgtgaaacagctatccaaatcttccgaggacgaagagctgcgcaaactcgcctcagtgcttgtgagtgactggatggcagtgatcagatcacagtcttctacacagcccgctgagaaggacaaaaagaaaaggaaggatgagggcaagtctcgaaccacacttccagagaggcctctcacagaggtgaaggccgagacaagagccgaggaggctcctgaaaagaagcgcgagaagcctaagtcattgcgcaccacagccccttctcacgcaaaattccggtccaccggccttgaactagaaactccttcactggtgcctgtaaagaagaatgcttcaaccgtggtggtctccgacaagtacaaccttaaacctatcccgcttaagcgccaatctaacgtggctgctcctggtgatgccactccgcccgcagagaaaaaatacaaacccctgaataccaccccaaacgccaccaaggagatcaaagtcaaaatcattccgccacagcccatggaagggcttggctttctggatgcacttaacagcgcacctgtgcccgggataaagatcaaaaaaaaaaaaaaggttctgtctcccactgccgcgaagccttccccatttgaaggaaagacaagtacagagccttcaacagcaaagcccagctcgccggagccggctccaccaagtgaagcaatggacgcggatcggccaggcacacccgtgccccccgtagaagttccagaacttatggatacagcatcccttgagcccggcgcactggacgctaagcccgttgaaagccccggcgacccgaaccaacttactcggaaaggacgcaagcgcaagtccgtgacttggcccgaagaaggcaaactgagggaatacttctattttgagctggacgagacagagagggtgaacgtcaacaagatcaaggacttcggcgaagcggccaaacgagagatcctcagtgaccggcacgcctttgaaaccgccaggaggctgtcccacgacaacatggaggagaaagttccctgggtgtgcccacggcctcttgtgctaccatcgcccctcgtcacacctgggagcaacagtcaagaaaggtacatccaggctgagagggagaaagggatcctgcaggaactctttctcaacaaggaaagcccacatgagcctgacccagagccatacgagcccattcccccaaaactgatcccattggatgaggaatgtagtatggatgaaaccccctatgtcgaaaccctggagcctggaggctccgggggttcacccgatggtgccggtggctcaaagctgccccctgtgctggcaaacctgatgggctccatgggagccggtaaggggccacaaggcccaggtggaggagggattaacgttcaggaaatattgactagcatcatgggttcacccaacagccatccttccgaagagctcttgaagcagcccgactactctgataagataaagcagatgctcgttccccatggcctgctcgggcccgggcccatagcaaatggcttccctccaggggggccaggtggtccaaaaggaatgcaacattttcctcccggtcccggcggccctatgccgggtcctcatggcggacctggcgggcctgtgggtccaaggctgctcggaccgccaccacctcccaggggtggcgaccccttctgggacggacctggtgacccgatgcgaggagggcctatgcggggcggacccgggcccggcccgggcccctaccacagaggaaggggcggcagggggggcaacgagccccctccaccgccccctcctttcaggggagctcggggaggccgaagcggcggtggtcctcccaatggccgcggcggccccggcggaggcatggttgggggcggcggacatagaccacatgaaggacccggcggggggatggggaacagtagcggccataggccccatgagggtccggggggtgggatgggatcaggtcaccgcccccacgagggcccaggcgggagcatgggcggaggaggagggcacagaccgcacgagggtcctggtgggggcatttccggaggcagcggacataggccgcacgaaggtccaggcggagggatgggtgccggaggcggccacagacctcacgaagggcctggcggctcaatgggcggcagcggtggccacaggccacatgaggggcccggccacggcggaccccatggccaccgcccccatgacgttcccggccataggggccacgaccacaggggacctccccctcacgaacacaggggccacgacgggcctgggcacgggggaggaggccatcggggtcacgacggggggcactcacacggcggcgacatgtccaacagaccggtgtgcaggcacttcatgatgaaaggaaattgccgatacgagaataattgtgccttttaccaccctggggtcaacggaccgccattaccatag

SEQ ID NO: 20311 - DNA, 2823 bp, Artificial Sequence
  Description of Artificial Sequence: Synthetic coding sequence
atgggcagcggccccatcgaccccaaggagctgctgaagggcctggattcattcctcaaccgggatggggaagtcaagagcgtcgatggcatatccaagatcttctctctgatgaaggaggccaggaaaatggtgtcccgctgcacttacctgaatatcctcctccaaacccgatcccctgaaatcctcgtcaagtttatagatgttggggggtataagctcctcaataactggctgacgtactccaaaactactaataatataccactcctgcaacaaattctgttaactctccaacatctcccactgacagtggatcacctcaagcagaataataccgccaaacttgtcaaacaactgagcaaaagctcagaggacgaggaattgcgcaagcttgcctccgtgttggtttccgactggatggccgttatcagaagccagagctccactcaaccagcagaaaaagacaaaaagaaaaggaaggacgaggggaagtcgaggaccaccttgcctgagcggcccctcaccgaggttaaggcagaaacaagggccgaggaagctcccgaaaagaagagggagaagcctaagagtctccggactacggccccttcgcatgccaagttcaggtcaacaggcctggagctagaaaccccttctctcgtccctgttaaaaaaaacgcaagtactgtagtcgtctctgacaaatacaatttgaagcccatcccactgaaaagacagtccaatgtggccgctccgggcgacgcaacaccccctgctgaaaagaaatacaaacccctgaataccacgcccaatgcaacaaaggagatcaaggtgaaaataattccacctcagccaatggagggtttaggattcctggacgcgctcaacagcgcccccgtccctggtattaagataaagaaaaagaagaaggtgctctctccaaccgcagccaaacctagtcctttcgaaggcaaaacatcaacggagccctccacggcgaagccttcgtcccctgagcccgctccaccctccgaggctatggatgccgacagacccggcaccccggtccccccagtggaggtgcccgagttaatggataccgcatcactggaacctggagcccttgacgctaagcccgtcgagtctccgggggacccaaatcagttaactaggaagggccgaaaacgcaagagcgttacatggcctgaggaggggaaactgagagaatacttttattttgagctagatgagacagagcgcgttaatgtgaataaaattaaagattttggagaagcagccaagcgggaaatcctttccgacagacacgcatttgaaactgcccgacggctgagccacgataacatggaggagaaggtcccctgggtgtgccccagaccacttgtgctaccctccccacttgtgacccccgggtcaaattcacaggagaggtatattcaggctgaaagagagaaaggcatcctgcaagagctttttctgaacaaagaaagtcctcacgaacccgatcctgagccgtacgagccaattcccccaaaattaatcccgctggatgaggaatgttctatggatgagacaccatatgtggagactctagaaccaggcgggtcgggtggaagcccagatggagcaggtggatccaagttgccgccggttttagctaatctcatgggaagcatgggcgctggaaaggggcctcaagggccagggggagggggaatcaatgtgcaagaaattctcacgagtatcatgggttccccaaactctcaccccagtgaggagttgttgaagcaacctgattattcggacaagattaaacagatgctggttcctcatggtctgctgggccccggccctattgcgaacgggtttccccccgggggccctgggggacctaaggggatgcagcattttcctccaggacctggaggacccatgccaggaccacatggagggcccgggggaccagtaggacccaggctgctagggcccccccctcctcccagggggggggacccattttgggatggacctggggacccaatgagaggaggtcccatgcgagggggcccaggtcccggtcccggcccctaccacaggggacggggcggtcgcggcggtaacgagccccctcctcccccaccccccttccggggggctaggggaggacgcagcggcggcggtccgcctaacggcaggggaggccctggcggagggatggtgggaggaggcggccataggcctcacgaaggccccggcggcgggatgggaaattcttcaggccatagacctcacgaagggccaggtggaggcatgggcagtggccatcgccctcatgaaggccctggtggatcgatggggggcggcggaggccaccgcccccacgaggggcctggcggcggcatttccggcgggtccggccatcggcctcatgaagggccaggaggcgggatgggtgcaggagggggacacaggccgcatgagggtcctggcggcagtatggggggtagtgggggacatcgacctcatgagggtcctgggcacggaggtcctcatggccatcggcctcacgacgtcccaggacaccgtggacatgatcatcgaggtccacctccccatgaacatcggggacatgatggaccaggacatgggggcggcgggcaccgaggacacgacggtgggcactcacacggaggcgatatgtctaaccggcctgtatgcagacacttcatgatgaagggcaactgtagatacgagaacaactgcgccttctaccatcccggcgtgaatgggcctccattgccgtag

SEQ ID NO: 20312 - DNA, 2823 bp, Artificial Sequence
  Description of Artificial Sequence: Synthetic coding sequence
atgggcagcggccccatcgaccccaaggagctgctgaagggcctggactcattcctgaatcgcgatggggaggtgaaatctgtcgacggtattagtaagattttttccttaatgaaagaggcaaggaagatggtgtcgcgatgcacatacctcaatatcctactgcagactagaagcccagaaatccttgtgaaatttatcgacgttggagggtacaagctgctgaacaactggcttacctattctaaaacaacaaacaacatacccctgttgcagcagattctgcttactctgcagcacctccccctgaccgtggaccacctgaagcaaaataacaccgcgaaacttgtgaaacagctctccaagtccagtgaagacgaagagctccggaagctcgcctctgtgttggtcagtgactggatggcggtgatccgctcacagagctccacccagcctgctgaaaaagataaaaaaaagagaaaggatgaaggaaaaagccgcacaacgctgcccgaacgccctctcaccgaggtgaaggccgaaacccgggccgaagaggcacctgaaaaaaagagggagaaacctaagtctttgagaacgaccgccccatcccacgccaagttcagatcaaccggccttgaacttgagacccctagtctcgtcccagtgaagaagaacgcgtcaaccgttgtggtgtctgataagtacaaccttaagcctatccctctgaaacggcagtcaaatgtggccgctcccggcgatgcaaccccgccagcggagaagaagtataagcccctgaacaccacaccaaacgcaaccaaagagatcaaggttaagataattccccctcagcccatggaaggtttgggattcctagatgcactgaatagcgctcctgtccctggcattaagataaagaagaaaaaaaaagtcctctctcccacggccgcaaaaccctctccattcgagggcaagaccagtaccgaaccttctacggccaagccctcaagtccagagcccgcgccaccttctgaagcgatggacgcagatcggcccgggacccccgtgccccccgtggaggtgcccgaactgatggatacggccagcctggaacctggagctctggacgcgaaacctgtcgaatcccccggagaccccaaccaattgacacgaaaaggccgtaaacggaagtccgttacctggccagaagaagggaagctccgggagtacttctacttcgaactggatgaaactgagcgcgtcaacgtcaataagattaaagattttggcgaggcggctaaaagagagatcttgagtgacaggcatgccttcgaaactgccagaagactctcgcatgataatatggaagagaaagtcccctgggtgtgccctcgccccctcgtcctcccatcccccttagtgacccccggaagcaacagccaggagcgctacattcaagccgagcgagaaaaggggatcctccaggagctgtttctcaataaagagtctcctcacgagccggaccccgagccctacgagcccataccccccaagcttatcccccttgatgaggaatgtagcatggatgaaactccttatgtggagaccttggagcctgggggatccggcggatcccccgatggtgcaggaggctcaaagctgcctcctgtgcttgccaatctcatggggtctatgggggctggtaagggaccgcaaggtccagggggcggcggtataaacgtccaggaaattctcactagcattatggggagccctaacagccatcccagtgaggagctcttgaaacagcccgactacagcgacaagatcaaacagatgctggtgccacatggcttgctcggtccaggacccatcgctaacggatttccacccggaggacctggaggacctaagggcatgcaacactttccacctggccctggcggaccaatgcccgggccccatggcgggccagggggacctgtgggcccaagactcctgggcccacctcctccaccgagaggcggtgacccattttgggacggccccggtgatcctatgcgaggtgggccaatgcgcggcggacctggccccggccctggcccctaccatcgcggcagaggtggacgcggcgggaacgagccacctccccctcccccaccatttagaggggcccgggggggcagaagtggcggaggcccccctaacggtcggggaggaccgggtggagggatggtgggcggaggaggtcacagaccccacgaaggccccggtggcgggatgggaaacagttcagggcaccgcccccacgagggcccaggggggggcatgggtagcggccacagacctcatgagggccctggcggctcaatggggggcggagggggtcatcggccgcacgagggaccaggtggaggcatcagtggcggatctgggcatcggcctcacgagggtccaggaggcggtatgggtgcgggcggtggccatcggcctcacgagggacctggcgggagtatgggcggaagcggaggtcaccggcctcacgaaggccctggccacggcggaccacatggccatagaccacacgatgtccccggtcaccgggggcatgatcatcggggtcctcctccacacgagcataggggtcatgatggacccgggcatggcggagggggccatcggggacacgatgggggacattcacacggtggagacatgagtaacagacctgtgtgccggcattttatgatgaaggggaattgcagatacgagaataattgcgcattttatcaccctggcgttaacgggccaccattaccatag

SEQ ID NO: 20313 - DNA, 2823 bp, Artificial Sequence
  Description of Artificial Sequence: Synthetic coding sequence
atgggcagcggccccatcgaccccaaggagctgctgaagggcctggatagcttcctcaatagggacggcgaggttaagtctgtagatggaatcagcaaaatcttttctttgatgaaggaggcacggaaaatggtgtcccgctgtacctacctcaacatattgttacaaacccgttcccctgaaatcctggtgaaatttattgacgtcggagggtacaagctgctgaataattggctgacctatagcaagacaaccaataatattccactactgcagcaaatactcctgacacttcagcacctgcctctcaccgtggaccatttaaaacagaacaacacggccaaacttgtgaaacagctctcaaagtctagcgaagatgaagaactcagaaaactggcatcagtgctggtgtctgattggatggcggtgattaggagccagagtagcacacagccagccgaaaaagataaaaaaaagagaaaagacgagggaaagagcagaaccacgttgccagagagacccctgactgaagtcaaggcagaaaccagagcagaggaggcccccgaaaaaaagagagaaaagcctaagtccctgaggacaaccgctcccagccatgcaaaatttcgctctaccggactcgaactcgagacaccctcactcgttccggtgaagaagaatgcttctacggtggtggtatccgacaagtacaatttaaagccaattcccttgaagaggcagtcaaatgtggctgcccccggtgatgctaccccgcctgcagagaagaaatacaaaccgttgaacactactccaaacgccaccaaggagattaaggttaaaattattccaccacaaccaatggaaggtctgggcttcctggatgctctcaactcagcccctgtgcccggaatcaaaattaaaaagaagaagaaagtactgtcccccactgccgccaagcctagcccctttgaaggaaagactagcaccgagccctctaccgctaagcccagttccccagagcctgctcccccatctgaagccatggacgctgataggccaggcacccctgttcctccagtggaagtgccagagctcatggacaccgcgagccttgagcctggggcactggacgcgaagcccgtagaatcgcctggagatcccaatcagttgaccagaaagggcaggaagcgcaaatcagtcacctggcctgaggagggcaaattgagggagtacttttatttcgaactggacgaaacggagagggtgaacgttaataaaatcaaggacttcggcgaggctgccaagagagaaattctgagtgacagacacgccttcgaaaccgcccgacgattatcccatgataatatggaagagaaggtcccttgggtgtgtcctagacccctggtgctgccaagtcctctggtgacccctgggtcaaattcacaggagaggtacattcaggccgagagagaaaagggaatacttcaagaattgttcctgaataaggagagtccacacgaacctgacccagaaccttatgagcccattccccctaaactgattcctttagatgaagagtgtagcatggatgaaactccttacgtggagacattggaacccggcggaagcggagggagtccagacggcgccggaggaagtaagctaccaccagtgctcgcaaatcttatgggctccatgggggccggcaaaggcccccagggcccaggcgggggcggtattaatgttcaggaaatactgacttcaataatgggatcaccaaattctcacccatccgaggagctgctgaaacagccagattatagcgataaaatcaaacagatgctggtgcctcacggactcctggggcctggtcccatcgcaaatgggtttccccctgggggacctggcgggccgaagggcatgcagcacttcccgcctggccccggcggcccaatgccagggccgcacgggggcccagggggccccgttgggccgcgtctgttgggcccacctcccccacctcgggggggcgaccccttttgggatgggcctggcgaccccatgcgaggaggccctatgcgaggcgggcctggaccaggtccaggtccttaccaccgcgggcggggtgggcgcggaggaaatgaaccaccgcctccccccccccctttccgcggggccaggggaggccgatccggaggtggacctcctaacggtcggggcgggcccgggggtggtatggtaggaggcggagggcatcggccacacgagggcccagggggtgggatgggcaattcctccggtcaccgccctcatgagggccccggagggggaatggggagcggccacagaccacacgagggacccggcggcagcatgggagggggaggaggccaccgcccccacgagggaccgggtgggggaattagcggaggatccgggcataggccacatgagggtcccggaggcggaatgggagccggaggaggccacaggccccacgaggggccgggcggtagcatggggggatccggaggccataggccacacgagggaccgggccacggcgggccccatggacacaggcctcacgacgtaccgggccaccgcgggcacgatcatcgcggaccacccccccacgaacatcgaggccatgatggacccggtcacgggggcgggggccatcgggggcacgatgggggacattcccacggcggcgacatgtctaacagacccgtctgtcgtcacttcatgatgaaagggaactgtcgctacgaaaataattgtgccttttaccacccaggtgtaaatgggcctcctcttccttag

SEQ ID NO: 20314 - DNA, 2823 bp, Artificial Sequence
  Description of Artificial Sequence: Synthetic coding sequence
atgggcagcggccccatcgaccccaaggagctgctgaagggcctggactcattcctgaacagggatggagaggtgaaaagcgttgacggcatttccaaaattttcagcctcatgaaggaagctaggaaaatggtgtctcgttgtacttacttaaacatccttctccaaactaggtccccagaaatcctagtaaagttcatcgacgtgggcgggtacaagttgctgaataattggctcacatactcaaaaacaaccaataacattcctctccttcagcaaatcctgttgacccttcagcacttgcctctgaccgtagatcacctgaagcaaaataacaccgccaagctggtgaaacaactgtctaaaagttcagaggacgaagagctcaggaagctcgccagcgttttggtgagcgactggatggcagtcattaggagtcagtcctccactcagcccgcagagaaggacaaaaaaaaaaggaaggatgaaggcaaaagtcgtactactttaccagagagaccactcaccgaagttaaggcagagacacgcgccgaagaagcacccgagaagaagcgtgagaagcccaagagtttaaggaccaccgcaccctctcatgcaaagtttagaagtaccggcctggaattggagaccccgtccctcgtaccagtaaaaaaaaacgcaagcaccgtcgtcgtcagcgataaatacaacttaaaacctattcctctgaaacggcagagtaacgtggctgcccccggtgacgctacgcctccggccgagaagaaatacaagcccttgaacacgacacccaacgcaacgaaggagattaaggtaaaaataatacccccccaaccaatggaagggttagggttcctggatgctctgaattctgcccctgtgcccggtattaagatcaaaaaaaaaaaaaaagtgctttctccgaccgctgctaagcctagcccattcgagggaaaaacctcaactgagccatctacagccaaaccgtccagcccagaaccggctcccccttctgaggccatggatgccgatcgacccggtacccccgtccctccagttgaagtgcccgaactgatggacaccgccagcctcgaacctggggccttggacgccaaacccgtagagtctcctggtgatcccaaccagctgacacgcaaggggcgcaagcgaaagtctgtgacctggcccgaggagggaaagctccgcgaatatttctacttcgagttagatgaaactgagcgagtcaatgtaaacaaaattaaggacttcggcgaggctgccaagagagaaattctgtcagaccgacatgcctttgagacagcgagaaggctgagtcatgataatatggaagagaaagttccatgggtgtgtccccgacccttggtactgcctagtcctctggtcactcctggctccaattcacaggagcggtacatccaggctgaacgggagaagggcatcctgcaagaactgtttctgaataaggagtcccctcatgagccggaccctgaaccctacgagcccatccctcccaagctcattccactcgatgaagaatgctctatggacgagacaccttacgtcgaaaccttagagccagggggctcgggaggcagccccgatggcgccggggggtccaagttgccccctgttctggcaaacctcatgggatcaatgggagcgggcaagggccctcaagggccgggcggcggtggcattaacgtccaggaaatcctaacctccataatgggatcgccaaactctcatccttccgaggaactgctgaaacaacctgactacagtgacaaaataaaacagatgcttgttccccatggtttgttgggcccagggcctattgcgaacggctttccgccgggcgggcccggtggcccgaagggcatgcagcactttccaccgggccctggtggccccatgcctggtccacacggagggcctggggggcccgtggggccccgcctgcttggacctccccctcctccacgggggggtgatcccttctgggatggtccaggggacccaatgcgcggcggccctatgcgcggcggccccggacccgggcccggaccataccataggggccgagggggcagagggggcaatgaaccccccccccctcctccaccatttaggggcgcacgtgggggtaggtcaggaggcggcccaccaaacggcagggggggccccggcggcggcatggtcgggggcgggggccaccgtccccacgaaggaccgggcggaggaatgggcaattcgtccggccatagacctcacgagggaccaggcggcgggatggggagcggtcaccggccccatgaggggccagggggcagcatgggcggcggcggtggccaccgcccccacgaggggcccgggggcgggattagtggaggaagcggacaccgtccccatgaaggtccaggagggggaatgggggccggcggcggccacagacctcacgagggaccaggcggctcaatgggggggagtggagggcatcgaccccatgaaggccccgggcacggcggcccccacggccacaggccccatgatgtccctggtcaccgaggacatgaccacaggggccctcccccacatgaacacaggggccatgatggccccggccacggcgggggcggacacagaggacacgatggcggccattcccatggtggagatatgtctaatcgccctgtgtgccgtcacttcatgatgaaagggaattgccgctacgagaataactgcgccttttatcaccctggagttaatggacccccgcttccttag

SEQ ID NO: 20315 - DNA, 939 bp, Artificial Sequence
  Description of Artificial Sequence: Synthetic coding sequence
atgggcagcggccccatcgaccccaaggagctgctgaagggcctggatagctttctgaaccgagacggcgaagtgaagtccgtggacggtatttccaaaattttttccctcatgaaagaggcacgaaagatggttagccgctgtacgtaccttaatatacttctgcagactcgatcacctgagatcctcgtaaaattcatcgatgtcggtggatacaaactgttgaataactggctaacgtatagcaagactactaataacatccctctgttgcagcagattttgctgacacttcagcacttgccgctgactgtggatcatctgaaacagaacaacaccgccaagttagtgaaacagcttagcaagtcctctgaagatgaagagcttcggaaactcgcctccgtgctggtctctgattggatggcagtgatccgctctcagagttccactcagccagcagaaaaggacaagaagaagcgaaaggacgaggggaagtcccgcacgacactcccagagcggcctttgaccgaagtgaaggcagaaactagagctgaagaagctcctgagaaaaaacgggagaagcctaaatcacttcgcactactgccccctcacatgcaaaatttcgttccacaggccttgagttggaaaccccttccttagtccctgttaagaaaaacgccagcacagtagtggtctctgacaagtacaatcttaagccaattccgttgaagaggcagtcaaacgtcgccgcccccggtgacgccactccccccgctgaaaaaaagtacaaaccgctgaatacaacgcccaacgccacaaaagagatcaaggtgaagattattcctccacagcctatggaaggcttaggatttctagacgccttgaatagtgctccggtccctggtatcaagataaagaaaaagaagaagaaaaaatag

SEQ ID NO: 20316 - DNA, 939 bp, Artificial Sequence
  Description of Artificial Sequence: Synthetic coding sequence
atgggcagcggccccatcgaccccaaggagctgctgaagggcctggactcctttctaaaccgtgacggcgaggttaagtccgtcgacggcatttccaagattttcagccttatgaaagaagctaggaagatggtgtctagatgcacttatctcaacatcttactgcagactcgtagtcctgaaatcttggtgaaattcattgatgtcggcggctacaagttgcttaataactggctcacatactctaagactacaaacaacatcccgttgctccagcagatactgctgacactacagcacctgcccttgaccgtcgaccaccttaagcagaacaataccgctaaattggtgaagcagctgagcaaaagcagcgaggatgaggagctacgcaagctggcctccgtcttagtgagcgattggatggctgtaatcaggtcccaatcgtctactcagcccgcagagaaggataaaaagaaaagaaaggacgaaggcaagagtagaacgacacttccggaacggccattgacagaggtaaaggccgagactagggcagaggaagcccctgagaaaaaaagggaaaaacctaagtccctgaggaccaccgccccaagtcacgccaaatttagatcaaccggccttgagcttgagaccccgagtcttgtgccagtcaagaagaacgcctctactgtcgtagtgtctgataagtataatctcaagcctattccgctgaagcggcagagtaacgtagcagcacccggcgatgccaccccgcccgcagaaaagaagtataagccactcaataccacgcctaatgcaacaaaggaaattaaggtgaagatcattccccctcagcctatggaaggtttagggttcctggatgccctgaacagtgcccccgtccccggcatcaaaattaaaaaaaaaaagaagaaaaaatag

SEQ ID NO: 20317 - DNA, 939 bp, Artificial Sequence
  Description of Artificial Sequence: Synthetic coding sequence
atgggcagcggccccatcgaccccaaggagctgctgaagggcctggactcatttctcaaccgagacggggaggtaaagagtgttgatggaattagcaagatcttcagcctcatgaaagaggctaggaagatggtttccaggtgtacatacttgaatatccttctgcagacccgatcgcccgagatactcgtcaagttcatagatgtgggtgggtacaagttgctgaataactggctgacctattcaaagaccacgaacaatatacccctgctgcaacagattctcctaacgcttcagcacctcccattaacggtggatcacttgaaacagaataatacagctaaacttgtgaaacagctgagcaaatcaagtgaggatgaagagcttaggaaactggccagcgtcttggtctccgattggatggccgtgatccgctcacaatcaagcactcagccggctgagaaagataaaaagaagcggaaggacgagggtaaatctagaactactctgccagaacgccctctaaccgaggtgaaagcggaaacaagggctgaagaagccccagagaagaagcgagagaaaccaaagagtctgcgaaccaccgccccctctcacgcaaaatttaggagtacgggccttgagctggagacaccctcactggtgcctgtgaagaaaaatgcaagcaccgtcgttgtctctgataaatataacctgaagcctataccacttaaaagacagtctaatgtggccgcgccgggagatgccacaccaccggctgaaaaaaaatacaaaccgctgaacaccacccctaatgccacaaaggagataaaagtgaagattatccccccacagcccatggaaggtctgggcttccttgatgccctcaatagtgcacccgtcccaggcattaagattaagaaaaagaaaaagaagaaatag

SEQ ID NO: 20318 - DNA, 939 bp, Artificial Sequence
  Description of Artificial Sequence: Synthetic coding sequence
atgggcagcggccccatcgaccccaaggagctgctgaagggcctggactctttcctcaacagagacggggaggtgaaatcagttgatggtatctcgaagatattctccctgatgaaagaagcacggaaaatggtgagtcgttgtacctacctgaacatcctcctccagactcgctcaccggagatcctggtcaaattcattgatgtgggcggctacaagctcctcaacaactggttaacctactcgaaaaccactaataacatcccattactccagcagatcctcctgactctccagcacctccccctcacagtggatcacctgaaacagaataatactgctaaactggtgaagcagctgagcaagtcctcggaggatgaagagctgcggaagctcgcctcagtgctcgtttcggactggatggcagtgatacgatcgcagtcatctacccagcctgcggagaaagataagaagaaacggaaggacgaagggaagtctaggaccacattgcctgagaggccactgaccgaggtgaaggcggagacccgcgcagaggaggcacctgagaaaaaacgggaaaaacctaagtctttacggacaacagccccaagccatgcaaagttccgctcaacaggactggagctggagacccccagcctggttccggtcaaaaaaaatgcttcgactgtggtggtatcggacaaatacaatttgaagccaattcccctcaaacgccagtccaatgttgccgcccccggggacgctacaccccctgcagagaaaaaatataaaccgcttaatactacacctaacgccaccaaagaaattaaagttaaaattatccccccacaaccgatggagggcctggggtttttagacgcactgaattccgcccctgtccccggcatcaaaattaagaaaaaaaaaaagaaaaaatag

SEQ ID NO: 20319 - DNA, 939 bp, Artificial Sequence
  Description of Artificial Sequence: Synthetic coding sequence
atgggcagcggccccatcgaccccaaggagctgctgaagggcctggactccttcctcaatagagacggggaagtgaaatccgtggacggaatatctaaaatcttttctctgatgaaggaggctcgaaagatggtttctagatgtacatatctcaacattctgttgcagactaggagtccggagattctggtgaaattcattgatgtgggagggtataaactgctgaataattggctgacctactccaagacgaccaacaacatcccactgttgcagcaaatcctgctgaccttacagcatttaccactcacagtcgaccaccttaaacagaacaacaccgcaaaattggtgaagcagctctcgaagtcaagcgaggacgaggagctccgcaaactagccagtgtacttgtgagcgattggatggcagtgattcggagtcaaagctccacacagcccgcagaaaaagacaagaaaaagagaaaggacgagggcaagtcccgaacaacactgcctgagcgcccccttacagaagtgaaagccgaaacgagggccgaggaggccccagaaaagaaaagagagaagccaaagtcactcaggacaaccgctccttctcacgctaaatttcgttctacaggactggaactcgagacaccaagcctcgttcccgtgaagaagaatgcatccactgtcgtggtcagtgataaatataacttgaaacctatacccctcaaacggcaatcaaacgtcgccgctcccggagatgcaacaccaccagcagaaaaaaaatataaaccactgaataccaccccgaatgctaccaaggagattaaggtcaagattattccccctcaacctatggagggactaggctttctggacgcgttaaactccgccccagtgccagggataaagataaagaagaaaaagaaaaaaaaatag

SEQ ID NO: 20320 - DNA, 939 bp, Artificial Sequence
  Description of Artificial Sequence: Synthetic coding sequence
atgggcagcggccccatcgaccccaaggagctgctgaagggcctggactcattccttaatcgggacggggaagtcaagtctgtggacggtatctccaagatcttcagccttatgaaggaggccaggaagatggtcagtagatgcacatacctcaatattctgcttcaaacccgcagtcccgagatactggtaaagtttattgatgtcggggggtacaagctgttaaataactggctcacttatagtaaaaccacaaacaatatcccactcctccagcaaatccttctgacccttcaacatctgcctttgacagtggatcaccttaagcagaataatacagctaaactagtgaagcagctttccaagagctctgaggacgaggagctcaggaaactggcgtcagtgttggtgtcggattggatggctgtcattcgatcccagtcttctacccagcccgctgaaaaagataagaaaaagcgcaaggacgagggcaaatctagaacgacgttgccggagcgaccattaaccgaagtgaaggccgagaccagggctgaagaggcccccgaaaaaaagcgcgagaagcccaaatctctgcgaaccaccgcaccttctcacgccaagttcaggtccaccggcttggagctagagacccctagtctagtgcccgtaaaaaagaatgcttcaaccgtggtcgtgtccgataagtacaacctcaagcccattccactgaagcgacagtctaatgtcgcagctcccggagatgctacccccccagctgaaaagaaatacaagcctctaaacacgacccctaatgcaacaaaagagattaaagttaaaatcattcctcctcagcctatggagggcctgggcttcctggacgccctcaattctgcacccgtccctgggatcaaaattaagaaaaaaaaaaagaagaagtag

SEQ ID NO: 20321 - DNA, 939 bp, Artificial Sequence
  Description of Artificial Sequence: Synthetic coding sequence
atgggcagcggccccatcgaccccaaggagctgctgaagggcctggattccttcctgaacagagatggagaggtcaagagcgtagatggaatctccaaaatcttcagtctcatgaaggaggcccgaaaaatggtctcacgctgtacgtatctgaatattctcctccaaacaaggtcgcccgaaattctcgtgaagtttatagacgtaggggggtataagctgctgaataactggctaacctattccaagaccaccaataacatccctctgctccagcagatcttgttaacattgcaacacctaccattgacggtcgaccacctgaagcagaacaatacagccaagctggtaaaacagctgtctaaaagctccgaagatgaggaactccggaagttggcttctgtcttggtaagtgattggatggccgttatcagatcacagagctcaactcagcctgcagagaaagacaagaaaaagcgcaaggacgagggcaaatcccggaccaccctgccagagagaccgctgactgaagtgaaagccgagacaagggcagaggaggctcctgagaagaaaagggagaagcccaaatccctgcgtaccactgcacccagccacgccaagttcagatctactggactggagcttgaaactccatccttagtgccagtgaaaaagaatgcctccactgttgtcgtgtccgacaaatacaatctgaaaccaataccactgaaacggcagtctaacgtggctgcccctggggatgccacacccccggccgaaaagaaatataagccgttgaatacaacacccaatgcaacaaaggagattaaggtgaaaatcatacctccccagcctatggagggactgggatttttagatgcgttaaacagcgcccctgtgcctggcatcaagataaagaaaaagaaaaagaaaaaatag

SEQ ID NO: 20322 - DNA, 3630 bp, Artificial Sequence
  Description of Artificial Sequence: Synthetic coding sequence
atgttcctgatgaacgccagccccgtggtggccctgcagagcaagtgggaggcgttcggcccccccggctcatgccgtttcccgagatgcttcagtgaggccgacgaaggagtcgagtctgcttctgtttccgcaagagtacagatgctgataagcactctgcaacgcgacggagccgctcggggcacatctgatgagcgagcggcgcaacgggggcatcgggccgaaggatgtcatgatgcccgcccagcggccaaacctactgtgcacaaagagccaccagctctggccgtgtgcggtcttgtcgccgacttcgatccgatgggcgaggaggagaccactgattttggcccccttgtgctggattcagactccgatgactccgtcgatcgagatatcgaagaagccatccaagaatacctcaaggctaaaagcggggcggctcaaccaggggccgggggggcgcaaccgggggcagcacagccatcgagggctgctggcggaggcagtagatgcaagcctgaaccagcacacggaagtgctcctaccgccctctgccctccaaagctggtgcctgggtctggaggagggccaggcagccaagtgggctccagtaaggaccaggggtccgcgagtcctgtgagtgtcagtagtgacgattctttcgaacagagtatccgcgctgaaatcgaacagttcctcaatgagaagaggcagcacgagacccagaagtgtgatgggagtgtcgaaaaaaagcctgacacaaacgaaaacagcgcaaaaagtctactgaagagtcaccaggagcctcctaccaaggttgtgcaccgacagggcctattgggcgtccagaaggaattcgcatttaggaagcccccacggctggcaaagatgaatgtccagcctaggtctctgaggagtaaggtgacaaccacacaagagaatgagggatccaccaagccagccaccccctgtagaccatccgaggccgctcagaacaagggtggaatcaaacggtcagcctcagctgcccggagggggaagcgagtcatgtccgccgctcaggcttccgaggcctcagactcttcctcggatgacgggattgaggaagctatccagctgtatcagcttcagaagacaagaaaagaggccgacggagatcttccgcagagggtgcagctgcgggaagagcgcgcgcccgatccacccgcacacagtacctcaagtgcaacaaagagtgcgctgcccgaaactcaccgcaaaacaccttccaaaaagaagctggttgccacaaagaccatggacccaggcccaggcggtctggataccgaccatgcacctaagctcctcaaagaaacaaaagcacctccccccgcgtcacctgcctcacggtccgagttcgttgagagatcatcatgccgcgccgatacctccgctgagctgatgtgtgccgaggcaatactggacatttccaagacaatcctgccagcacctgttgagggtagcgatggaagtctgtccgcatccccgctcttctactcccccaatgtaccttccagatccgatggagatagtagcagcgtggattcggatgattccatcgaacaggagatccggaccttccttgccttgaaggcccagagcggttctttgctggctcgaggcgagtcgtgcccacaggcggcccaaggcccactgctgcccccaggtctgaactcgcagacaggcgggcacaagacgccccttagtaagaccccagaccccctgttgggttgcaagcgaaaaaggcgcggaggggggcatgtgcgaccatccactcctaagaaaatgcaggaggttgtgaaggacggatcccaagatgccgatcacagccagggtcgcgctgaaccggggcacgagagaagggaccttccaattcaaggcaaggcttccgaggccttgggcggggaaggaacggctagaggacccggagatacccgaatgtcgcagggtcagggaaagacagatgaggcaagaaggttagacgagaaagaatctagcgaggataagtcttcttcacttgacagtgatgaggacttggacacagccattaaggacctgcttcgcagtaaacgcaagctaaagaaacgctgccgggagccccgggctgcttgccgcaaaaaggtgaggtttagtactgcccaaacacacttcctagagcagctgggtggtctgagacgggactggaaggaccgggggcctcccgtgcttaagtcttgcttgagtaagagcaaaagagatagcggggagggacccggcaagaagcccccatcggtatttggatctaccgcggagcggatgcgacaggaaggggcggccagtcaagacgcagcactggcctttcgagtgcgccggcccgctagcgcatcagcgtccgaaggaaatccctttccgcgcgaatctcagggccctgcccctagccccggatctctgtcagatgatagcagctctgtagactccaatgactcaatcgagttagagatccgcaaatttttggcagaaaaagccaaggaaagtgtgagcagcagtgaagttcaggcagagggccccaccgccctgggcaccggcgggcctgccagacctgaggttctgtgtagaaaggagcccgccccgcccccgggggtgtgtacgcgatctcaacgagctcgtggggttccgcacctggccgaaggactccgtggcacagagtctgccggagctcaggggacagcagggttattcagtcagggtgggaaaggcctgcctgccgcccccgctcgcggtgatcccgtgccaccacgaagtacaagcgggggggtgagtgccaagggcctttcagtctcccgaagaaatgtgtacgttcacaaagaccagagccctaggggagccgagcccgccgctaagtccgcttttgggcaactgccgtcatgcgccaccgccggcaccgaggccggtggagctaggggcacgttccatatgggatgtggatccccgagtttccttacaccctctccaggagctgagcgggacgccggggcgcaagcggataggactccgccctggagtgactttgcccatcaatctagactcccaagtccatgggttttgcgatcagaggggcgggacgccgtgtggcgcgggggcgtcggctcagaacgtgacaagggcagcgagggtccggcgagggggctgccctctcttcctctggccggattttcaccccttctgtccactcagcttttccacttcgggaagggagtttcatggggtggccgccaggccggcttattttctccccatctcggactccctctccaaggcccctccttctccgcattcagagaagcacaggccggtccaagccctgtttttggatccccccacttattagcaaaaaaagacggtggtccatggcccactcggaaagcacaggccggtttgtctctgcacgataggaggtcatctggatccgaggaatccattctggatctgcgatacagacgtcgagtgaatagggacgatcaggagcaggatgctctcggatcagatgcatcagatttcagcgatacgagcactgaagacagcgggggatcaagcgtcgtgaaggtgtag

SEQ ID NO: 20323 - DNA, 327 bp, Artificial Sequence
  Description of Artificial Sequence: Synthetic coding sequence
atgttcctgatgaacgccagccccgtggtggccctgcagagcaagtgggaagctttcgggccaccgggctcttgtagatttcctaggtgtttcagtgaggctgatgagggtgtggaaagtgcttccgtgtccgccagagtccagatgctgatcagcactctgcaacgtgatggagctgccaggggaacttctgacgagcgcgccgcccagagggggcatcgggccgaaggctgccacgacgctagacctgccgccaagcccactgtccacaaagaacctcccgcactggcagtatgcggattggtagcagacttcgatcccatgtag

SEQ ID NO: 20324 - DNA, 1728 bp, Artificial Sequence
  Description of Artificial Sequence: Synthetic coding sequence
atgccccccggcaaggtgctgcagcccgtgctgaagatgaaggtggacgaacttttcctgtactggctctctgaggccagcactcaacggatgctgcaggattgtctgcgacggataaaagcgcctggcagggaccagcctacaccgggagacggagaacagcccggtgcctggccaaccgcgcccctagcggccccccgaccatcaggtttggagcctccgggaacccctgggcccggccccgcgctgccgctgggcgcagcaagtagtcccaggaatgccccccatgtaagggggacccggaggtcagccggcacgagagtcgtgcagacaaggaaggaggaaccacttccacccgctaccagtcagtctattccaaccttctacttccctcgcggcaggcctcaggattcagtgaacgtggatgcagtaatctcgaagatcgagtccacttttgcccggttcccccacgagagagccacaatggacgatatgggacttgtcgcaaaagcctgcggttgtcccctgtactggaaaggacctctcttttacggggcagggggagaaagaaccggcagtgtatcagtgcacaagttcgtggccatgtggcgcaagattttgcagaactgccatgacgacgccgcaaagttcgttcacctgctcatgtcgcccggatgtaattacttagtgcaggaggacttcgttcctttccttcaggacgtcgtgaacactcacccagggctatcattcctgaaggaagcatctgaatttcactccaggtatatcactacggttatccagaggatcttttatgcagtgaatcggtcttggtcagggcggataacctgcgcagagctaaggaggagcagctttctgcaaaacgtggcactgttggaagaggaagcagatattaaccaactcactgagttcttctcgtatgaacatttctatgtgatttactgcaagttttgggaattggacactgaccacgacttgctaattgacgccgacgacctcgccagacataacgaccacgctttaagcactaaaatgatcgacagaatcttctctggtgcggtgactcggggccggaaagttcagaaggaaggcaaaataagctacgctgactttgtctggtttctgatttctgaggaggacaagaaaacccccaccagcatcgagtactggttcaggtgcatggatctggacggcgacggagctctgtcaatgttcgaactagagtatttttatgaggaacaatgtcgtcgtctcgattctatggcgattgaagccctgcccttccaagactgtctctgtcaaatgctcgatctggtgaaacctagaactgaaggcaagattacgctccaagacctgaagaggtgtaaactcgccaatgtgttttttgacacttttttcaacattgaaaaatatctagatcacgaacaaaaagagcaaatctccctgctgagggacggcgactccggggggccggaactgtctgattgggaaaagtacgccgccgaggagtatgacattctagtcgccgaagagaccgccggggagccttgggaggatggattcgaagctgaattaagcccagtggaacaaaaactgtccgccctgaggtctcctcttgcccaacgccccttttttgaagcgccgtcgccgctgggtgcagtggacttgtatgagtatgcgtgtggagacgaagacctggaaccgctgtag

SEQ ID NO: 20325 - DNA, 2286 bp, Artificial Sequence
  Description of Artificial Sequence: Synthetic coding sequence
atgcccaacttctgcgccgcccccaactgcacccggaagagcacccagagcgacctggccttcttcaggtttccgcgggatcccgcccggtgccagaaatgggtcgaaaattgccgtcgcgcggacttggaggacaagactcccgatcagctgaataagcactacagactgtgtgcaaagcactttgagacctccatgatatgcaggacctctccataccggaccgtcctccgtgacaacgccatccctactatctttgacttgacaagccacctcaacaaccctcatagtagacaccgtaaacggatcaaggaactgagtgaggacgagatccgcaccctgaaacagaaaaaaatagacgaaacctcagagcaggaacagaaacacaaagagaccaataacagcaatgcccagaatccctctgaggaggaaggggagggacaggacgaagatattctgcccctgactctggaagaaaaagagaacaaagagtacctcaaatccctgttcgaaatactgatccttatgggtaaacaaaacattcctcttgatggccatgaagccgacgagatcccagagggactgttcacccccgacaatttccaggcactcctcgaatgccgtatcaactcgggggaagaggtgctcagaaaaaggtttgagaccaccgccgtgaatacactattctgctccaaaacgcagcaacggcagatgctggaaatatgtgagagttgcattagagaagagacacttagagaggtgagggactcacactttttcagcattattaccgatgacgttgtcgacatcgcgggtgaggagcacctacctgttctcgttcgctttgtagacgaaagtcacaacctaagggaggaattcatcggatttctgccatacgaagcagatgctgaaatcctagccgtcaagttccacaccatgatcactgaaaaatggggtctaaatatggaatactgccgaggccaggcctatatagtctcctctggattttctagtaagatgaaagtggtggcctcccggctgctcgagaaatatccgcaggcaatttatactctttgcagctcctgtgctcttaacatgtggctggccaagagtgtgccagtgatgggcgtttccgtggcgctgggtaccatcgaagaggtatgctccttttttcacaggtcccctcagctattactggagctggataatgtgatcagcgtactttttcagaatagcaaggaaaggggaaaggagctcaaagaaatttgtcacagccagtggacaggaaggcatgatgccttcgaaatccttgtcgaactcctccaagccctggtgctttgcctcgacggcatcaacagtgatacgaatattagatggaacaactatatcgccggccgggcatttgttctttgctctgcggtctcagattttgacttcatcgttaccattgtcgttctgaaaaacgtgctgtccttcacccgtgcattcgggaaaaacttacaagggcagacttcagatgtctttttcgcagctggcagcctcaccgccgtcttacatagtttgaacgaggtgatggagaatattgaggtgtaccatgagttttggtttgaggaagccaccaatttggccaccaagctagacattcagatgaagttgccaggaaagttcagacgagcccaccagggaaaccttgagagtcagttgacttcagaatcttactataaggaaaccctgtccgtccctactgtggaacatatcatccaggagctgaaggatattttcagcgaacagcacttgaaggctctcaaatgcctgagcttggtgccaagcgtgatgggccagctcaaatttaacacttctgaggagcatcacgctgacatgtatcgatctgacctacccaaccccgataccttgtcggcagaactgcattgctggagaatcaagtggaagcataggggaaaagatatagagttgcccagcactatatatgaggccctgcacctgcccgacattaagtttttcccgaacgtgtacgccctcctgaaggttctgtgtatcttgcccgtcatgaaggtggagaacgagaggtatgagaacggtcggaagcgactgaaagcttatctccggaataccctgacagaccagcgatctagcaacctggccttgttgaacatcaattttgatataaagcatgacttagacttgatggtcgacacctacattaagctgtatacctctaagtctgagctgccgacggataactcagagacagtcgagaacacatag

SEQ ID NO: 20326 - DNA, 1761 bp, Artificial Sequence
  Description of Artificial Sequence: Synthetic coding sequence
atgggcaagcagaacatccccctggacggccacgaggccgacgagatccctgaaggtctgtttactcctgacaacttccaggccctgttagagtgccggatcaactcaggcgaggaagtactgcggaagaggttcgaaaccacggcagtgaacaccctgttctgcagtaaaactcagcaacgccaaatgctggaaatatgcgaatcctgcatccgggaagagacactgcgagaagttagagactcccacttttttagtatcatcacagacgatgttgtggatattgccggcgaggagcatctgcctgttttagtgaggttcgtggacgaatcccacaacttgcgggaagagttcattggcttcctcccgtacgaggctgatgccgaaatcctggcagtcaagttccataccatgattacagaaaagtggggccttaatatggagtattgccgggggcaggcctacatagttagctctgggttctctagcaaaatgaaggtggtagcttcgcgactgctggaaaaataccctcaggctatctacacactttgcagtagctgtgccctgaatatgtggctcgcgaagagcgtccctgtgatgggcgtttctgtggccctgggaaccattgaggaggtatgctccttcttccaccggagccctcagcttctcctagaattagataatgtgataagcgtactgtttcagaactcaaaggagcgcggtaaagaactgaaggagatctgtcactcccaatggactgggcggcatgacgccttcgagatactggttgagctactccaggccctggttttgtgcttagatggcatcaattccgacacgaatattcgatggaataattacattgctggtcgggcttttgttctctgttcagctgtctccgattttgatttcattgtgactatcgtggtcctgaaaaacgtcctgtctttcactcgggcctttggcaaaaatctgcagggccagacttcagatgtgttctttgccgctggatcgcttaccgccgtgctgcacagcctgaacgaggtcatggaaaacattgaggtgtatcacgaattttggtttgaggaggccacaaacctggctacgaagctggatattcagatgaaacttccagggaaattccgaagggctcatcagggaaacttagagagtcagctcacaagtgagtcatattacaaggagacgctgtctgtgccgactgtagagcacatcatccaggagttgaaagacatcttttccgagcagcatctgaaggcactaaaatgcctgtcgcttgtaccgagcgtaatggggcagctcaaattcaatacctccgaggagcaccacgccgacatgtaccgctccgatctccctaatccagatactctgtcggctgagctgcactgctggagaatcaagtggaaacaccggggcaaagatatcgaactgccctcaaccatttacgaagctttacacctccccgatattaaatttttccctaatgtatacgccttgctgaaggtcctgtgcatcttgcccgtaatgaaagtggagaacgagaggtatgaaaatggaagaaagaggttaaaagcttacctgcgcaacacgcttactgatcagcggtctagtaaccttgctctgctcaatatcaactttgacattaaacacgatctcgacctgatggtggatacttacatcaaactgtatacttcaaaatctgagctgcctacagacaactcagaaaccgtagagaacacctag

SEQ ID NO: 20327 - DNA, 939 bp, Artificial Sequence
  Description of Artificial Sequence: Synthetic coding sequence
atggccaaccggaccgtgaaggacgcccacagcatccacggcaccaacccccagtacctggtcgaaaagatcatccggacaaggatatacgagtctaagtattggaaggaagagtgtttcggattaacagcggagttggtggtcgacaaagccatggaactaagattcgtgggaggggtttatggcggcaacattaagccaacaccatttctgtgtcttacgcttaagatgctgcagattcagcccgagaaggacattattgtagagttcatcaagaacgaagattttaaatatgtccgcatgcttggcgctctctatatgaggctgacaggtacagctatagactgttacaaatacctggaaccactttataatgactataggaagatcaaatcccagaacagaaacggcgagtttgaactcatgcacgtggacgagtttatcgatgaactgctgcacagcgaaagagtgtgcgatataatcttgccacgcctgcaaaaacgctacgtcctggaagaagcggagcaactcgagcctagagttagcgcattggaggaggacatggacgatgtcgaatcctccgaggaggaggaagaagaagatgagaaattagaaagggttccatcccctgaccaccgtcggagatcctacagagatctagataagcctcgccggtccccaaccctccgataccggcggtccagaagccgttctcctaggagacgatcccggtcgcctaagaggagatcgccgtcccccaggcgcgagcgccatagatcaaagtctccacgaaggcatcggagccggagccgggacaggcggcacagaagcaggtcaaagtcccccggtcatcataggtcccacaggcatcggtcacacagtaagagtccagagaggtcaaagaaaagtcacaaaaagtcccggagaggaaatgaatag

SEQ ID NO: 20328 - DNA, 1308 bp, Artificial Sequence
  Description of Artificial Sequence: Synthetic coding sequence
atgtgcggcggcgtgcggggcgtgggcaccggcggcatcgtgagcacagccttctgtctcctgtacaagctgtttaccctcaaattaacgcgcaagcaggtgatgggactgattacacataccgactcaccttacattagagctcttggatttatgtatattcggtatacccaacctcctacggacctctgggattggtttgagtcctttttggatgacgaggaggacttggacgtgaaggcgggaggtggttgtgttatgacaatcggagagatgctcagatcatttctgacaaagcttgagtggttttctactctctttccccgcatacctgttcctgttcaaaaaaacatcgatcagcaaattaagactcgaccaagaaagattaaaaaggatggcaaagaaggcgcagaggagatcgataggcacgtggagagacgaagatctagaagccctaggcgaagtctatcgcctcgtcgatctccgcggaggagcagatctcgctctcaccatagagagggtcacggatcctctagtttcgaccgcgagctggagagggaaaaggagaggcagcggttggaacgcgaggcgaaagagcgagaaaaggaaagacggcgcagtcgatccattgaccggggcttagagaggcgcagaagtcgcagtagagagaggcataggagccgttcccgctctcgtgataggaagggtgatcgacgggatagagatcgcgagcgggagaaagagaacgagcgcggacggaggcgggatcgcgattatgataaggagagaggcaacgaacgggagaaagagcgagaacggagccgcgagagaagcaaggagcagagatcacggggcgaggtggaagagaaaaaacacaaagaagacaaagatgatcgccggcatagagacgacaagagagactcaaagaaggaaaagaagcactcccgaagcaggtctcgtgagaggaaacaccgatctcggagtagaagtaggaatgcaggcaaaaggtcaagaagtaggtccaaagagaaatcgtctaaacataaaaatgaatctaaggagaagagcaacaaaagaagccgatcaggcagtcagggacgaaccgactcggttgagaaatcaaaaaagcgagaacactccccttcaaaggaaaaaagtaggaagcgttcccgttcaaaggagcgcagtcataaacgggaccacagtgatagcaaagatcagtcggacaaacatgaccgaagacggagccagtccattgaacaggaatcacaggagaagcagcataaaaataaggatgagacagtgtag

SEQ ID NO: 20329 - DNA, 573 bp, Artificial Sequence
  Description of Artificial Sequence: Synthetic coding sequence
atggccaacaacagccccgccctgaccggcaacagccagccccagcatcaggccgccgccgcagccgcacaacagcagcagcagtgtggcgggggcggggccaccaagccagccgtttcgggaaagcagggcaatgtcctgcccttgtggggcaatgagaaaacaatgaacctgaaccccatgattctcaccaacatattaagctcaccatatttcaaagtgcaactctacgaacttaagacataccatgaggtggtcgatgagatttattttaaagtgacacacgtggagccctgggaaaaaggatccagaaagaccgctggacagacgggaatgtgcggcggagtgagaggggtgggtacaggcggcatcgtatcaacagcattctgtttgctttacaagcttttcacccttaaactgacaaggaagcaagtgatggggcttatcactcacactgactccccatatatcagggccctggggtttatgtacatccgctacacacaacccccgaccgacctgtgggactggttcgagtcgttccttgacgacgaggaattctttacattgtag

SEQ ID NO: 20330 - DNA, 1641 bp, Artificial Sequence
  Description of Artificial Sequence: Synthetic coding sequence
atggccaacaacagccccgccctgaccggcaacagccagccccagcaccaggccgctgctgcagctgcacagcagcagcagcagtgtggtggaggaggggcaaccaagccggcagtttctggaaaacagggcaacgtgttgcccctgtggggaaacgagaaaactatgaatttaaatccaatgattctgactaacatactgagcagtccctactttaaggttcaactctacgagctcaaaacgtaccatgaggttgtagacgagatctactttaaggtcacacacgtggagccttgggagaaagggtccaggaaaactgccgggcaaacagggatgtgtggtggagtgcggggggtaggaaccggaggtatcgtgagcaccgcgttctgccttctctacaaactgttcacacttaaactgacgcggaagcaggttatgggcctgatcacgcacaccgattcaccctatatccgggctcttggtttcatgtacattcgctacacacagcctccaaccgatctgtgggactggttcgagtcatttttagacgacgaggaggacttggacgtgaaggccggcggcggttgtgtcatgacaattggcgagatgctccgcagctttttaacaaaacttgaatggttctcaaccctctttccacggattccagtcccagtgcagaagaatatcgaccaacagatcaagacccgcccccgtaaaatcaaaaaagacgggaaggagggtgctgaggagattgaccgccacgtggaaagacggagaagtcgatcacccagaagatcgctatcgcctcggaggtcaccccgcagaagtcggtctcgaagccatcacagggagggacatgggagctcttcgttcgacagagaattggaaagggaaaaggagcgacaaaggctcgaacgagaagctaaggagcgagaaaaggagcggaggcggtcacggagcatcgaccggggcctggaacgccggcggtctaggtcgcgcgagagacataggtctcgctctaggagcagggatcggaagggcgacaggagagacagggaccgggaacgtgagaaggagaacgagcgcggccgacgtcgcgatagggattatgataaggaaaggggcaatgagcgagagaaggagagagagagaagcagagaaagatcgaaagagcaacgctccagaggcgaggtggaggagaagaagcacaaggaggacaaagatgatagacgacacagagatgacaagagggattctaaaaaggaaaagaagcattcacggtcccgatcaagagaacgcaaacaccgatccagaagccgcagtcgtaatgcgggtaaaagatcacggtcgcgcagcaaggaaaagagcagtaaacacaaaaatgaatctaaggaaaaaagtaacaagcgctcccgctccggtagccagggcagaaccgatagtgtcgagaaatctaagaaacgggaacacagcccctctaaagagaagagtaggaaaaggagcaggtccaaggaaaggagccacaaaagagaccactccgattccaaggatcagtcggacaaacatgatcgaagacgttcacagagtatagaacaagagtctcaggaaaaacagcacaaaaacaaagatgaaacagtgtag

SEQ ID NO: 20331 - DNA, 2010 bp, Artificial Sequence
  Description of Artificial Sequence: Synthetic coding sequence
atgcagaacagccacatggacgagtaccggaacagcagcaacggctctaccggaaatagtagcgaggtggtggtagagcatccaacagatttctccaccgaaataatgaacgtcaccgaaatggaacagagcccggacgacagccccaatgtcaacgccagtacagaggaaacagaaatggccagtgcggtggatctgcccgtgacccttactgagacagaagccaatttcccccctgagtacgagaagttttggaaaactgtcgaaaataatccgcaggatttcacagggtgggtgtatctgttgcagtacgtggaacaggaaaaccatctcatggccgccagaaaggcctttgatcgatttttcatacactatccctattgctatggctactggaagaaatacgcggaccttgaaaagcggcacgataatataaaaccttcagatgaagtataccggcgtggcttacaggctattcccctaagtgttgacctctggattcattatatcaactttctgaaggaaacactcgaccctggagatcccgagaccaataataccatcaggggcacctttgagcatgccgtactggcagccggaaccgattttaggtcagatagactatgggaaatgtacattaactgggaaaatgaacagggcaatctgcgagaggtgacagcaatctacgatcgaatcttgggaattcctactcaattgtactctcaccactttcagcggtttaaagagcatgttcagaacaatctcccacgggacttactgacaggcgagcaattcatacagttgaggcgcgagctcgcctccgtgaatggccattccggcgatgatgggccgcctggagatgacctgcctagtgggattgaagatatcaccgacccagccaaactcattacagaaattgagaacatgagacacagaattatagaaattcatcaggagatgttcaactacaacgagcacgaggtcagcaaacggtggacattcgaagaggggatcaagagaccatactttcacgtgaaacccctcgaaaaggcacagcttaaaaattggaaagagtacttggaatttgagatagagaatggaacccacgagcgcgtagtggtattattcgaaaggtgtgtgattagttgcgctctgtacgaggagttctggataaagtatgctaagtatatggaaaatcacagcatcgagggcgtcagacacgtttttagcagggcttgtacaatacacctgccaaaaaagcctatggtgcatatgctatgggccgccttcgaagaacagcagggcaacataaatgaagctcggaacatccttaaaactttcgaggaatgcgttctgggactggccatggtcagactcagaagggtgagtctcgagaggcgtcatggcaacctggaagaggccgagcatttgctacaggacgctattaagaatgccaagtcgaacaatgagtcatcattctatgctgttaaactggcacgtcacctgttcaagatccaaaaaaacctgcctaaaagtcgaaaggtgctgctggaagctatcgaacgcgataaggagaatacaaagctttaccttaatttgttggagatggaatatagcggagacctcaaacagaatgaggaaaacatcttaaactgcttcgataaggcagtgcacgggtctcttccaatcaagatgagaatcactttcagccaacgcaaggtggagtttttggaagacttcggctcagatgttaacaaactgctgaatgcatatgatgagcatcagacacttctgaaagagcaggacagcttgaagaggaaggccgagaacggctctgaagagccagaggagaaaaaggctcacaccgaagacaccacatcttcatcaactcagatgattgacggagatctccaagctaatcaggcggtatacaactactctgcctggtatcagtataattaccagaatccgtggaattacggccagtattaccctcctcctcctacttag

SEQ ID NO: 20332 - DNA, 723 bp, Artificial Sequence
  Description of Artificial Sequence: Synthetic coding sequence
atgcagggcctgctgcggttcgaggaccaggacagcgcccggggcgaccagaacatcgcgatgttttaccctacttccacgcagatggtttatcgaaggggactgcaggcgatcccattgagtgtcgatctgtggattcactacattaacttcttaaaggaaactctcgatcctggagacccagaaacaaacaatacaattagaggcaccttcgaacatgctgtcctcgccgccgggacagatttccggtctgacagactctgggagatgtacatcaattgggagaacgagcagggcaatcttcgggaagtgaccgctatttatgaccgaatccttggaatccccacacagctgtacagccaccacttccagagattcaaagagcacgtgcagaataacctgcctagggatcttctgaccggggagcagttcattcagctgaggagagagctcgcttctgtgaatggtcattctggcgacgatggacccccaggcgatgatcttcccagcggtattgaggatataaccgaccccgccaagctgatcaccgagatagagaacatgcgccatcggatcatcgagatccaccaagagatgtttaactacaacgagcatgaagttagcaaacgttggacgttcgaagagggaatcaaaagaccctatttccacgtgaaacctcttgagaaagcgcaaaagaagctggagagaatcttacggatctag

SEQ ID NO: 20333 - DNA, 2577 bp, Artificial Sequence
  Description of Artificial Sequence: Synthetic coding sequence
atgcccccccccggcatccccccccccttcccccccatgggcctgccaccaatgagtcagcgtcccccggcaatccctccaatgccgccaggcatcttaccccctatgctaccccctatgggggctcccccccccttgacccagattccaggcatggtgccaccgatgatgccaggtatgctcatgcccgctgtgccggtcactgccgccaccgctcctggtgcggacacagcgtcatccgctgtcgccggaaccggaccccctcgagccttgtggagtgaacacgtagctcctgacgggcgcatatactactataatgccgacgacaaacaatccgtctgggagaaaccttccgtgcttaagagtaaagcagaattactgctgagccaatgtccatggaaagagtacaaaagtgacacaggaaagccctattattataacaatcagtccaaggagtcccgatggacccgccctaaggaccttgatgatctcgaggtgttggtcaaacaagaggccgctggcaagcaacagcagcagctcccccagactttacaacctcaacccccacaaccacagcctgacccaccccccgtgccgcccggccctacccccgtccctaccgggctgctcgaacccgagcccgggggcagtgaggactgcgatgtactcgaagctactcagcctctggaacagggattccttcagcagctagaagaaggccctagttcatccggccaacatcagccgcagcaagaagaggaagaatcaaaacccgaaccggagcggtccggcctgagttggtctaatagggagaaggcaaagcaggcatttaaagaactgctgcgagataaggcagtgcctagcaatgcctcttgggaacaggctatgaagatggttgtgactgatccaaggtatagcgctctccccaaactctctgaaaaaaaacaagccttcaatgcttacaaggcccaacgcgagaaagaagagaaggaagaggcgcggctccgggcaaaggaagccaaacagactttgcaacacttcctggagcagcacgaacgcatgacatctacaactcgatatcggagagctgagcagacatttggggagcttgaggtgtgggccgtcgttcccgaaagagatcgcaaggaagtgtacgacgacgtgcttttttttcttgcaaagaaagagaaggaacaggcgaaacagttgcgccgcagaaacattcaagcgctgaaatcaatacttgatggcatgagttcggttaactttcagacaacctggagtcaagcacagcagtacctgatggacaatcccagttttgctcaggatcaccagctccagaatatggacaaggaggatgccctgatttgctttgaggaacatatccgagccttggaacgcgaagaagaggaggagagggaaagggccagactccgggagcggcgtcaacagaggaagaacagggaggcattccagaccttcttggatgagctgcacgaaaccggacagctccactctatgagcacctggatggaactctatcctgctgtgtctacagacgtccggttcgccaacatgctgggacagcctgggagcaccccattggacttgttcaagttttatgtagaggagttaaaggcaaggttccatgatgaaaagaaaatcatcaaggatattctcaaggtgaatacagcttttgaagattttgctcatgtgatcagctttgataagcgcgccgccgctttggatgctggaaacattaaattgacctttaatagccttttggaaaaggccgaagctagggaaagggagagggagaaagaggaagctcgacgcatgaggagacgcgaggcggctttcaggtctatgctgaggcaggccgtgccagcactcgagctgggcaccgcctgggaagaggtgcgggagcgctttgtctgtgactcagctttcgagcagataaccctcgagtccgaacgtatcaggttgtttcgtgaatttctccaagtcctggagcaaacagagtgtcagcatctgcacactaagggtagaaagcacggaagaaagggaaaaaagcaccaccacaaaaggagccactcaccatctgggtctgagtcagaggaagaggaactgcctccgccctctttgcgcccccccaaacgcaggcgcagaaacccctctgaaagcggctcagagcctagcagtagccttgatagcgtggagagcggtggagcagctttgggaggcagagggagtccctcttcccacctattaggggcggaccacggcttgcgaaaagctaaaaaaccaaagaagaaaaccaaaaagcgaagacataagagcaattctccagagtcagagactgacccggaagaaaaggcaggtaaggaatctgatgagaaggaacaggagcaagacaaggaccgggaacttcagcaagcagagctgcctaatcggtctcccgggtttggtataaaaaaggagaagactggttgggacaccagcgagagcgagctttccgaaggggagctagagaggaggaggaggacattgctccaacagctggacgatcatcagtag

SEQ ID NO: 20334 - DNA, 2616 bp, Artificial Sequence
  Description of Artificial Sequence: Synthetic coding sequence
atgatgcccccccccttcatgcccccccccggcatcccccccccctttccccccatgggactcccacccatgagccagcgtcctccagcaattccacccatgcctcctggcatcctccctccaatgctgcccccaatgggcgcccctccccccctgactcagattcccggtatggttccccctatgatgcctgggatgttgatgccggccgtcccagtgaccgctgctacggcccctggggccgacacggccagctccgcggttgcggggacagggccaccccgagcactgtggagcgaacatgtagcgcccgacggccggatatattactacaacgcggatgataaacaatctgtgtgggagaaacccagcgttctgaaaagcaaggctgagcttctcttgagtcagtgtccttggaaggaatacaaatctgacaccggcaagccctactattacaacaaccagtctaaggagagccgatggacccggcctaaggatttagatgatctagaagtcctcgtcaaacaggaggcagctggaaaacagcagcaacaattaccacaaactctgcagccccagcccccacagccccagcccgacccgcccccagtgcctccaggccctactcctgtgccaacaggcctgctcgaacctgaaccgggaggaagtgaggattgtgatgtgttagaagctacacagccgctcgagcaagggtttctgcagcagctggaagaaggcccaagttcaagtggacagcatcagccgcagcaggaagaggaagaatcaaaacctgagccagagcgctcgggcctgtcttggtcaaaccgagaaaaggccaagcaggcttttaaggaacttctccgcgacaaggcggttccatctaacgcctcctgggagcaggccatgaagatggttgttaccgacccaaggtattccgctttacccaagttgagtgagaaaaagcaagcgtttaatgcctataaagcccagcgggagaaggaggagaaggaagaggcccggttgcgagccaaggaggcaaaacagacgctgcaacacttcctggagcaacatgagcgaatgacatctactacacgctaccgtcgggctgaacagacctttggagaactcgaagtatgggccgtagttccggaacgagatcgtaaagaagtatacgacgacgtactgttcttcctggcaaaaaaggagaaggagcaagccaagcaactcagaaggaggaacattcaggctctcaaaagcattctggatggcatgagctctgtcaattttcagactacctggagtcaagcccagcaatatctcatggacaatccctcctttgcccaagaccaccagctccaaaacatggataaggaagatgccctgatctgctttgaggagcacatcagagcattggaaagggaggaggaggaggaacgagaaagagctaggctccgggaacgccgccagcagcgtaaaaaccgtgaagctttccagacattcctggatgaattgcatgagaccgggcaactccacagtatgagcacgtggatggagttatatccagcagtttctacagacgtgcgttttgcaaacatgctggggcaacccggctcgacaccactggacctgttcaaattctacgtcgaagaactgaaggcaagattccacgacgagaagaagatcatcaaagacatacttaaagacagaggtttttgcgtagaagttaatactgccttcgaagatttcgcccatgtgatctcgttcgacaaaagagctgccgccctcgatgcagggaatattaaacttacattcaatagcctccttgaaaaggccgaagctcgagaaagagagcgggaaaaagaggaggccagacgaatgcggcgtcgtgaagctgccttccgttcaatgctgagacaagccgtcccggcactggaattggggacggcctgggaggaggtgagggagcgtttcgtgtgcgactctgcattcgaacaaataacactcgagtcggaaagaatccgcctctttcgcgaattcctacaggtgcttgaacaaaccgagtgccagcatctgcacactaagggtaggaagcatggccggaaaggaaaaaaacatcaccataagagatcgcactcaccatccggatccgagtcggaagaggaggagctgcctccccctagcctcaggccacccaagagaaggcgacgcaatccatcagagtctggaagtgagcctagcagctctctagacagtgtggaatctggaggcgccgcgctcggcggccggggatcaccctcctcccatctcctcggggcggaccatggactgaggaaagctaagaagccaaaaaagaagacaaagaagcggagacataagtccaactccccggaatctgaaaccgatcccgaggagaaagctggcaaagagtccgacgaaaaggagcaggagcaagataaagatagagagcttcagcaggccgaactacctaacagatcccccggcttcgggataaagaaggagaaaactggctgggatacgtccgaaagtgagctgagtgagggagagctggagcggcgtcgaaggacactgttgcagcagctggacgatcatcagtag

SEQ ID NO: 20335 - DNA, 21 bp, Artificial Sequence
  Description of Artificial Sequence: Synthetic coding sequence
atgatgcccccccccttctag

SEQ ID NO: 20336 - DNA, 1791 bp, Artificial Sequence
  Description of Artificial Sequence: Synthetic coding sequence
atggaggccgagccccccctgtaccccatggccggcgccgccggcccacagggagatgaagacctgctcggagtgcccgacgggcctgaggcaccactggatgagctggtgggcgcttatccgaattataacgaggaggaagaagaacggcggtactatcggaggaaacggctcggcgtcctgaagaatgtgctcgccgcatccgctggtggaatgctcacttatggagtttatctcggccttttgcaaatgcagctcatcctgcactacgatgagacgtaccgggaggtcaagtacggcaacatgggtctaccggacattgacagtaaaatgctgatggggattaacgtgaccccaatcgccgctttgctctatacgccagtgctgatacgatttttcggcactaagtggatgatgtttttggccgtgggtatatatgccctgtttgtatctacaaattactgggaacgttattacacccttgtgccctcggccgtggcacttgggatggctatagtccctttgtgggccagcatggggaattacatcactaggatggcccaaaagtaccacgagtattcgcactacaaggagcaggacggacaagggatgaagcagagaccacctcggggatctcacgccccttatctccttgtgttccaggctattttctatagtttcttccacctgagtttcgcctgcgcacaactccctatgatctacttcttgaatcactacctttacgatctgaaccatacgctatacaatgtacagtcatgtgggacaaattcacatggtatcctctcagggtttaataagacagtgcttcggaccctcccaagaagcggaaacctgattgtggtcgaatctgtgctcatggctgttttcctcgctatgctcttagtgctggggctttgcggggcagcctatagaccaactgaggaaatcgacctgaggtctgtcggctggggaaacatcttccagctcccttttaaacatgtgcgggattatcgcctccggcaccttgttcccttcttcatttattctggattcgaagtccttttcgcttgcacagggatcgcactcggatacggagtgtgctccgtgggcttggaacgtctcgcgtacctgctggtggcctactctctcggagcatctgctgctagcctgctcggactgcttgggttatggctgccccggcccgtgcccctggtggccggcgccggcgttcacctcctgttgaccttcattttatttttctgggctcctgttcctcgtgtccttcagcattcgtggattctctacgtggcggctgctctctggggtgtgggttccgccctcaataaaactgggctgtccacacttctgggcatcctttacgaggataaggagcggcaggactttattttcacaatctatcattggtggcaggccgtggctattttcaccgtttatctgggcagttccttgcatatgaaagcaaaattggctgtgttactggtgaccctggtggcagccgctgttagctatctgcgcatggagcagaagttaagaaggggcgtagcccctaggcagccccgcattcccaggcctcagcacaaggtgaggggataccgatacctcgaagaggataactccgacgaatcagatgctgaaggagaacatggagacggcgccgaagaagaggcgccccccgctggaccacgacctggtccagaacctgcgggccttggcagacgaccctgcccatacgagcaggcccagggcggagatggccccgaggaacagtag

SEQ ID NO: 20337 - DNA, 1446 bp, Artificial Sequence
  Description of Artificial Sequence: Synthetic coding sequence
atggcctacaacgacaccgaccggaaccagaccgagaagctgctgaaaagggttcgggaactagaacaagaagtccagagactcaaaaaagagcaggccaaaaataaggaggatagtaatattcgagagaattctgccggggcaggaaagactaagcgggcgttcgatttctcggcccacgggcgccgacatgtagccctgcgtatcgcgtatatgggctggggctaccagggtttcgctagtcaggagaacaccaataatacaatcgaggaaaagttgtttgaagcactgaccaagacccggctggtggaatcacgacagacttccaactatcatcgctgtggaaggacagataaaggggtgagtgcttttggccaagtgataagcctggatctccgctctcagtttcctcgtggtagagatagtgaagatttcaatgttaaagaagaggctaacgctgccgcggaagaaatcagatacacccacattttgaatagggtgctcccacccgacatccggattctggcatgggcaccggtcgagccaagtttcagtgcacggttctcttgtctggagagaacctaccggtacttctttccacgggccgacttggacatcgtgacgatggattacgcagcacagaagtacgtgggtacccacgactttcgaaatctgtgcaaaatggacgtagccaatggcgtgataaacttccagaggactatcctgtcggcccaggtgcaactcgtgggccagagccccggcgagggaagatggcaggaaccttttcagctgtgtcaattcgaggtgacaggtcaggcctttctgtaccatcaggtccgttgtatgatggcgattctgtttctgatcggtcagggtatggaaaaacctgagattatcgacgaattactgaatattgagaagaacccccagaaacctcagtactcaatggccgtcgagtttccccttgtgttgtacgattgcaagtttgaaaatgttaaatggatctacgatcaagaggcacaggagttcaacattactcatctccagcagctctgggccaatcacgcagtgaagacacatatgctttacagtatgctgcaggggctggacaccgtgccagtgccctgtggcatcggacctaaaatggatggcatgactgaatgggggaacgtaaaaccctctgtgatcaagcaaacatctgcattcgtagagggcgtgaaaatgagaacttacaagcctctaatggataggcctaaatgtcagggactcgaaagcagaatacagcacttcgtaaggcggggtcgcatcgaacaccctcatctatttcatgaggaggaaacgaaagccaagcgggactgtaatgacaccctcgaagaagagaatactaatctcgagacgcccaccaaaagggtgtgcgtggatactgaaattaagtcaattatctag

SEQ ID NO: 20338 - DNA, 939 bp, Artificial Sequence
  Description of Artificial Sequence: Synthetic coding sequence
atggccgacggcgacagcggcagcgagcggggcggcggcggcggcccgtgtggcttccagccggcgagtaggggcggtggggagcaagagacacaagagctggcatccaagcgccttgacattcaaaacaaaaggttctatctcgatgtgaagcagaacgctaaggggcgattcctcaaaattgctgaggttggtgcaggaggcagcaagtcacggctgacgttgtctatggccgttgcggcagaattcagagatagtttaggcgatttcattgaacactatgcccagttaggccccagctcaccagaacaacttgcagctggagcggaggaggggggggggcccagacgggccctgaagagcgaattcctggtccgggaaaaccgcaagtattacctggaccttaaagagaaccaaaggggcagattcctgaggatcaggcagacagtcaaccgcggtggcggcggttttggagcaggtcccggccccggcggactgcagagcgggcagactatcgcgctgccagcccaggggctgattgagttcagagacgctcttgccaaactgatcgacgattatggcggagaggatgatgaacttgccgggggtcccgggggaggcgcaggcggccccggcggcggcctgtatggtgaactgcctgagggaacgtctattactgtagatagcaaacggtttttctttgatgtagggtgtaacaagtacggtgtttttctcagagtgtccgaggtcaaaccttcctacaggaacgccatcaccgtcccttttaaagcttggggtaagttcggcggcgccttttgtcgctatgctgacgagatgaaggagattcaggagagacagagagacaagttgtacgaacgtagggggggaggatccgggggcggcgaagagagcgagggggaagaggtggatgaggattag

SEQ ID NO: 20339 - DNA, 969 bp, Artificial Sequence
  Description of Artificial Sequence: Synthetic coding sequence
atggagcgggcccggcggcggggcggcggcggcggccggggccggggggggaagaatgtgggtggtagcggtttaagcaagtctcgcctctatccgcaagcacagcacagtcactacccccactacgcagcgtcagccacccctaaccaggctgggggggctgcagagatccaagaacttgcgagcaagagagtcgacattcagaagaaacggttttacctcgacgtcaagcagtcttccagaggccgattcctgaagatcgctgaggtttggattgggaggggaagacaggataacatccgaaagtccaaactgaccctgtcattgtcggtagccgccgagctcaaggattgtctcggcgacttcatcgagcactacgcacaccttggtttaaagggccatcggcaggaacatggacatagcaaggagcaagggtctcgaagacggcagaaacatagtgcaccctctccccctgtgagcgtcggatccgaggagcaccctcacagcgtgttgaaaaccgactatatagaaagagacaaccggaagtattatttagatctgaaggagaaccaacgcggccgattcctgagaatccgtcagactatgatgaggggcactggcatgatcggctattttgggcattccctgggccaggaacagaccattgtactgcccgcccagggtatgatcgagtttcgggacgcactcgttcagctcatcgaagactacggcgagggggatatagaagaacggcgcggcggcgatgatgatcccttggaactgcccgaggggacctctttccgggttgacaacaagagattttattttgacgtcggatcaaacaaatatggtatctttctaaagctgacaaattaccccaagtctcgtgagaacattaacctgttccattgctgccaaatcaaacacaaggaacaaccacacgacaccaccaagaccgtggaggaatag

SEQ ID NO: 20340 - DNA, 1044 bp, Artificial Sequence
  Description of Artificial Sequence: Synthetic coding sequence
atggagcgggcccggcggcggggcggcggcggcggccggggccggggggggaagaatgtgggcggcagcggcctgtctaagtctcgcttatacccgcaagctcaacattcccattaccctcattatgctgccagtgccactcctaaccaagcgggaggagcagccgaaatccaggaattagcatctaaacgcgtggacatacagaaaaaaaggttctatttggacgtgaaacagtcaagccgcgggcggttcctaaaaatcgctgaggtctggatcggccgtggtcgccaggacaacatcaggaagagcaaattaactttaagcctgtccgtcgctgcagagctgaaggactgcctgggcgactttatcgagcattatgcacacttaggccttaagggacaccgccaggagcacggccactccaaggaacagggatcaagaagaagacagaaacactcagccccaagtccgcctgtgagcgttggtagtgaggagcatccacactccgtgttgaaaaccgattatattgaacgcgataaccgaaagtattaccttgacttgaaggaaaatcagcgcgggagattcttgcgcatccgccagaccatgatgagaggaacgggcatgataggttacttcggtcatagcctgggacaagagcagaccatcgtcctccccgcccagggtatgatcgagttccgcgacgccctcgtgcagttaatagaagattatggcgagggtgacattgaggagcggcgaggtggtgatgatgatcccctagagctgcccgagggcactagcttcagagttgacaacaagaggttctacttcgacgtgggtagcaacaaatatggaatatttttgaaggtgtccgaggtaagaccgccctatcgaaatacaattactgtgccctttaaggcatggacacgattcggggagaatttcattaagtacgaggaggagatgcgaaagatttgtaacagccacaaggaaaaacgcatggacgggcgtaaggcgtccggcgaggaacaggagtgtctcgattag

SEQ ID NO: 20341 - DNA, 429 bp, Artificial Sequence
  Description of Artificial Sequence: Synthetic coding sequence
atggcccccgtgaagatcagccacgtggtgagcttcagcagccaggaccccaagtacccagtggaaaacttgctgaaccctgattctccccggaggccctggctgggatgcccgcaagataagtccggacagctgaaagttgagctgcagctagaaagagccgtccctaccggttacattgatgtgggcaattgcggctgtgccttcctccaaatcgacgtggggcacagtagctggcccctggataggcccttcatcacattgcttcccgcgacaacactgatgagtttgaccgattctaagcagggcaaaaaccggtctggagtgcgaatgtttaaggatggtaaggaggggaagagcaggaaggacggaggcggactgtacgagaaacagcggtgttccaccaaagaggactgtgagtgctattag

SEQ ID NO: 20342 - DNA, 1506 bp, Artificial Sequence
  Description of Artificial Sequence: Synthetic coding sequence
atgaaccggagccggcaggtgacctgcgtggcctgggtgcggtgcggggtcgccaaggaaacacccgataaagtcgagcttagcaaggaggaggttaagcgactgattgcagaggccaaggagaaattgcaggaggaaggtggtggctccgatgaggaggagacgggttcaccctcggaggatgggatgcaaagcgcccgtacccaagctcggccccgggaaccactagaagatggagaccccgaggatgatcgcacattggatgacgacgagttggcagagtacgacttggataaatatgatgaagaaggcgatcccgacgcggaaacccttggagaaagcctgttaggcttaacagtgtacggttctaacgaccaggatccttacgtcaccctcaaggataccgagcagtacgagcgcgaggacttcttaatcaaaccctctgacaatctgattgtgtgtggtcgggcagaacaagaccaatgtaatcttgaggttcatgtctataaccaggaggaggatagcttttacgttcatcatgatattctcctgagcgcctatcctctctccgtcgagtggttaaactttgatccttcacccgatgattcaacgggcaactacatcgctgtgggtaacatgacgccagtgattgaggtgtgggatctggatattgtggatagtctggagcctgtgtttacactgggatcaaagcttagcaaaaagaagaagaagaagggcaagaaatcatcaagcgcagaagggcacaccgatgcggtgctagacctctcgtggaacaagctgataagaaatgtgctggcctccgcgtccgccgacaatactgtcatactctgggacatgtctctggggaaaccagccgccagcttggccgtccatacagataaggtccagaccctgcagttccaccccttcgaagcccagaccctaatttccggcagctatgataagtccgtggcactttatgattgccggagccccgacgagtcccacaggatgtggcggtttagtggacagatcgagcgtgttacctggaatcatttcagtccctgccactttttagccagcactgacgacggctttgtttacaatctggatgccagatcagataagcccatcttcaccttaaacgctcacaatgatgaaataagtggcctagatttgtccagccaaattaagggctgtttagttacggcaagtgcggacaagtacgtgaagatttgggacattctcggggataggccttctctggtccatagtcgggatatgaagatgggggttctgttttgtagcagttgctgccccgacttgccatttatctacgcgtttggcgggcaaaaggaaggcctgcgtgtgtgggacatatctacagtgagctctgtaaatgaggcgtttggcagaagggaacgccttgtcctcggtagtgccaggaactctagtatctcaggaccattcggcagcaggagctccgacacacccatggaaagctag

SEQ ID NO: 20343 - DNA, 762 bp, Artificial Sequence
  Description of Artificial Sequence: Synthetic coding sequence
atgaaccggagccggcaggtgacctgcgtggcctgggtgcggtgcggggtggccaaagaaacgccagataaagtagagttgtccaaggaggaggtgaagagattgattgctgaggcaaaggagaaactccaggaggagggcggcggctccgatgaggaagagaccggttccccttccgaagatggcatgcagagcgctcggacgcaagcgaggcctcgcgagccactggaggatggcgatccggaggacgaccgcacgctggacgacgacgagctggccgaatatgatcttgacaagtacgatgaggaaggcgatcccgatgccgaaacactgggagaaagcctgcttggcctaaccgtttatggtagcaacgaccaggatccatacgtgaccctgaaggacacagagcagtacgagagggaggatttcctgatcaaacccagcgacaatctcatcgtctgcggacgggccgaacaagatcagtgtaacctcgaggtgcacgtttataatcaggaagaagattctttctatgttcatcacgatatactgctcagcgcttacccgctgtccgttgagtggctcaatttcgatccctcaccagatgacagcaccggcaattatatcgccgttggtaatatgacccctgtgatcgaggtgtgggacctggacatagtggattccctcgaacccgtgttcaccctgggttccaagctttcgaagaaaaagaagaaaaaggggaaaaaggtcaagaaaaagcgatag

SEQ ID NO: 20344 - DNA, 750 bp, Artificial Sequence
  Description of Artificial Sequence: Synthetic coding sequence
atgaaccggagccggcaggtgacctgcgtggcctgggtgcggtgcggagtggctaaagaaactcctgacaaggtggagttgtccaaagaagaggttaaacgtctcatcgctgaagcgaaggagaagcttcaggaagagggaggtggcagcgatgaggaagagacaggctccccatccgaggacggcatgcagagcgcccggacacaagccagacctagagagcccttagaggacggtgacccagaggacgacaggaccctagacgacgatgaactagcagaatacgacctagataaatatgacgaagaaggggacccagacgccgaaaccttgggggagtctctgcttggcttaactgtgtacggtagcaacgaccaggacccatacgtcactctgaaggatacagagcagtacgagcgggaagacttcctgattaaaccctcagacaaccttattgtctgtggaagagccgaacaggaccagtgtaacctcgaggtgcatgtgtacaatcaggaggaagatagtttttacgtgcaccacgacatcctgttgtccgcataccctctgagtgttgagtggctcaatttcgacccttcacctgacgactccacgggcaattacattgccgtgggcaatatgacacccgtgatcgaggtgtgggacctggacatcgttgacagcctggagcctgtcttcactcttgggagtaaattgtctaaaaaaaagaagaaaaagggcaagaaaaagtag

SEQ ID NO: 20345 - DNA, 297 bp, Artificial Sequence
  Description of Artificial Sequence: Synthetic coding sequence
atgcagagcgcccggacccaggcccggccccgggagcccctggaggacggagacccagaggatgacaggaccctggacgatgacgagctggcagagtacgacctcgacaaatacgacgaggagggcgatccagatgctgagaccttgggggaaagcctgcttggtttgaccgtttatggaagtaatgaccaggatccttacgtgacactgaaggacacagaacaatacgaaagagaagactttctgatcaaacctagtgataatcttatcgtctgtggaagagccgaacaagactag

SEQ ID NO: 20346 - DNA, 1260 bp, Artificial Sequence
  Description of Artificial Sequence: Synthetic coding sequence
atgcccgccgagaacagccccgcccccgcctacaaggtgagcagccatggtggggattctggccttgatggcctgggtggaccgggagttcagctcgggtcaccagataagaagaaaagaaaagcaaatacacagggaccatcattcccaccactgtctgaatatgcacctcctcccaatccaaatagcgatcatctggtggctgccaacccattcgacgacaactataacacgatatcgtataagcccctcccttcgtccaacccttacctcggcccagggtaccccggctttggtggatacagcacattccgtatgcctccccacgtgccaccaaggatgagttcaccatattgcgggccttacagtctgaggaaccagccccatccattcccccagaatcccctggggatgggcttcaatcggccacacgcatttaacttcggaccacatgacaactctagctttgggaatccatcctataacaacgctctgtctcagaatgtgaacatgccaaaccagcactttcgtcaaaatcctgccgagaactttagtcagatccccccccaaaacgcaagccaagtctctaatcctgacctggcctctaacttcgtgcccggcaacaattcaaatttcacatctccgctcgaaagcaatcacagcttcatccctccccccaacacttttggccaagctaaggccccaccgccgaaacaggattttacacagggagccaccaaaaacacgaatcagaactcttccgctcacccaccgcatttaaatatggacgataccgtcaatcagtctaacatagagcttaagaacgttaatagaaataatgccgttaatcaggagaactctagatcttccagcacagaggccaccaataacaaccctgccaatgggacccaaaacaaacctagacagccaaggggcgctgctgatgcctgcacgaccgagaaatcaaacaaaagttcactgcacccaaataggcatggccacagcagttccgaccccgtgtatccgtgtgggatctgcaccaacgaggtcaatgacgaccaggacgctattctgtgcgaagcctcatgccagaagtggtttcaccgcatttgcaccgggatgacagagacggcctatggcctcctgaccgcggaggcttcggcggtctgggggtgtgacacatgtatggcagacaaagatgtgcagttgatgaggacccgggaaacattcggcccatcagccgtcggcagcgatgcttag

SEQ ID NO: 20347 - DNA, 1260 bp, Artificial Sequence
  Description of Artificial Sequence: Synthetic coding sequence
atgagcgccgagcaggagaaggaccccatcagcctgaagcgggtgagaggcggtgacagcggcctagacggactcggtggacccggagtccagctggggtcaccagataaaaaaaaacggaaagcgaacacccagggcccctctttccccccattatccgaatacgcaccacccccgaaccctaattccgaccacctcgtagctgctaatccatttgatgataattacaacaccatctcttacaagccacttccgagttcaaacccctacctgggaccaggatatcctggattcggaggatactccacatttagaatgccccctcatgtccccccgaggatgtctagtccctactgcggcccttacagtctgagaaaccagcctcacccttttccacagaacccactcggaatgggctttaaccggcctcatgcctttaacttcggtcctcacgacaactcatcctttggcaacccttcctacaacaatgctctgtcacagaatgtaaacatgcccaaccagcatttccgacagaatccagccgagaacttctctcaaatccctccccagaacgcgtcacaggtgagtaaccctgatttagcgagcaactttgtgcctgggaataacagcaacttcacctccccattggagtctaaccactccttcattcctccaccaaatacattcggacaagccaaagccccccctcccaaacaggactttactcagggagctaccaagaacacaaatcagaactcttccgcccatccccctcacctaaacatggacgatactgtaaaccagagtaatattgaattgaagaatgtcaatcggaataacgctgtgaatcaggaaaattcacggagctctagcactgaagccactaataataaccctgccaacggcacacagaacaagcctagacagccgagaggagctgcagatgcgtgcacaaccgagaagagtaacaagagctccctgcaccctaatagacacgggcactcctccagcgatcccgtctacccttgtgggatatgtactaacgaagttaatgatgaccaggacgccattctttgcgaagcttcttgccagaagtggttccaccgcatctgtaccggcatgacagagaccgcctatggcctcctcacagctgaagccagcgcagtatggggttgtgatacttgtatggcggacaaggatgttcaacttatgaggacgagagaaacatttggacccagtgccgttggctccgatgcctag

SEQ ID NO: 20348 - DNA, 2931 bp, Artificial Sequence
  Description of Artificial Sequence: Synthetic coding sequence
atgagcaacagcaacaccacccaggagaccctggagatcatgaaggagtccgagaaaaagctggtagaagagagcgtcaacaaaaacaaattcatctccaagacacccagtaaagaggagatcgagaaagagtgtgaagacactagcctgaggcaagagacccaaaggagaactagcaaccacggccacgctcgaaaaagagctaagtccaatagcaaattgaagcttgtacgatctctggctgtctgcgaagaaagtagcacacccttcgcagatgggcctcttgaaactcaggacataatccagctgcatatctcatgcccaagcgacaaggaggaggagaaatccacaaaagacgtctctgagaaggaagataaggataagaacaaagaaaaaataccacggaaaatgctgtctagagacagcagccaggagtacaccgactctacaggaatagatttacacgagtttcttgttaatactctcaagaaaaatccaagagatcgcatgatgttgctcaagctggagcaggaaattctggaatttataaatgacaataataatcagttcaagaagttcccacaaatgactagctatcacaggatgttactgcacagagtggccgcgtatttcgggatggaccataacgtagaccagacaggcaaagcggtcatcatcaacaaaacctccaatacccgaattcctgaacagcgtttttccgagcacatcaaagacgaaaagaataccgagtttcagcagcggttcatactcaagcgcgatgacgcttccatggatagggatgacaatcagacgggacaaaacggatacctgaacgatatcagactctctaaggaggccttctccagcagcagccataagagacggcagatttttagaggtaatcgtgaaggtctgagcagaacaagctcaagccgtcagtccagcacagattctgaacttaagagtttggaaccgcggccatggagctctaccgattccgatggatcagtgcggtctatgcgccctcctgtcacaaaagcctcgtcattcagcggcatcagcattctgaccagaggcgatagtatcggaagttctaaaggcggctctgccggacggatatcgaggcctggtatggctctgggtgcacccgaagtctgcaatcaggtgacttctagtcagtccgtccggggtttactaccatgcaccgcacagcaacagcagcagcagcaacaacagcagctgcccgctctgccacctacaccccagcagcagccccccctaaacaatcatatgatttctcaagccgatgacttgagcaaccccttcggtcagatgtctctttccaggcaaggcagtacggaagcagcggatccatccgcggcgctgttccaaactccactgatttcgcagcatccccagcagacttccttcattatggcctccaccggacagcccctacctacaagcaattattccacctcgagccacgcaccacctactcaacaggtgcttcccccacagggctacatgcagcccccgcagcagattcaggtgagctattatcctccagggcagtacccaaattccaaccagcaataccgtcctctgagtcacccggtggcttactcaccccagcgaggtcaacaattaccacagcctagccagcagccaggattgcagcccatgatgcctaatcaacaacaggccgcttaccagggaatgatcggggtacagcagccacaaaatcagggtctcctgtcaagccaacgctcaagtatggggggtcagatgcagggcctggtagtgcagtataccccattaccatcttatcaggtgcccgttggatctgactcccaaaacgtagtccaacctcccttccagcagcctatgttagtaccagtgagccagagtgtccagggtggattgcccgccgctggcgtccccgtgtattatagcatgatccctcctgcacagcaaaacgggactagtccttccgtaggcttcctgcagccgcccggcagcgaacagtatcaaatgccacagagccctagtccctgttctccaccacaaatgccccagcaatacagcggagtcagccctagcggcccaggagtggtggtgatgcaactgaacgtcccaaatggccctcagccgccacaaaacccatccatggtacagtggagtcattgcaagtattattctatggatcaaaggggtcaaaagccaggcgacctctactccccggatagttccccccaggccaatacgcaaatgtctagtagtcctgtgacatcacctacacagagccctgccccttcccctgtcacatctttgtcatctgtgtgcacgggcctgagcccgcttccagtgctgacgcagttccctaggcccggggggcctgcacagggagacggccgctacagcctattaggtcagcctctacaatataacctgagcatctgtccaccattgcttcatggccagtctacctacaccgtgcatcaggggcagagcggactcaaacatggaaaccgggggaaacgccaggcgctgaagtccgcgagtaccgatctcgggaccgcagacgtggtgttaggccgtgtgttagaggtcaccgatctacccgaaggaattacaagaacagaagcagataagttatttacccaactcgcaatgtcaggggctaaaattcagtggctgaaggatgcacagggcttgcccggcggaggggggggcgataatagcggcaccgccgagaatggaagacacagcgaccttgctgccttatatactatcgtggccgtttttcctagtcccctggccgcgcaaaacgcctccctgcggctaaataactcagtgtcacgtttcaaattgcgaatggctaaaaagaattacgatcttagaatattagagagggcatctagccagtag

SEQ ID NO: 20349 - DNA, 2931 bp, Artificial Sequence
  Description of Artificial Sequence: Synthetic coding sequence
atgagcaacagcaacaccacccaggagaccctggagatcatgaaggagagcgaaaagaaacttgtagaggaatcagtgaacaaaaacaagtttatcagcaaaacaccttccaaggaggagattgagaaggaatgtgaagacacatcattgcgacaggagacacaaaggagaacatcgaatcatggacatgcccgtaaaagagctaagtctaacagcaaactcaaactggtgcggtcactagccgtgtgtgaggaatccagcactcccttcgcagatgggccactggagactcaggatattatccagctgcacatttcttgcccttcggataaggaagaagaaaagtccaccaaagatgtaagtgagaaggaggataaggacaagaacaaagagaagatccccaggaagatgttatctcgcgatagctcccaagagtacacggattccaccggcatcgaccttcatgaattcctcgtgaacactctgaagaaaaacccccgggatcggatgatgctgcttaagctcgaacaggaaatcctagagtttatcaacgataacaacaaccaattcaaaaagtttccccagatgacgagctaccacaggatgttacttcatcgggttgcagcctacttcggcatggatcacaacgtggaccagacagggaaagcagtcattatcaataagacaagcaacacccgaatcccagaacagcgtttctccgagcacataaaagacgaaaaaaatactgagttccagcaacgcttcatcctgaagcgagacgatgcttctatggaccgtgatgacaatcagacgggccaaaacggttatctcaatgatatccggctgagcaaagaagcgttctcgagctcctcacacaaacggaggcagatctttcggggcaacagggagggtctgagtagaacttcaagttccaggcaatcgtccactgatagcgagctaaagtccctggagccaagaccatggtcgtccacagacagtgatgggagcgttaggtccatgcgacccccagtcactaaagctagcagtttttcggggatctcaattttgacgcgtggagattccatcgggagtagcaaagggggatccgccggccgcatttcccgacccgggatggcactgggtgcacccgaggtttgcaaccaagtgacctcttcacagagcgttagaggcttgctgccttgcaccgcacagcaacagcagcagcaacaacagcaacaacttcccgccctccctccgacgcctcagcaacagcctccactaaataaccacatgatcagccaggctgatgatttatccaaccccttcgggcaaatgtcgcttagccgtcagggctccaccgaggccgccgacccgtcagctgccctgtttcaaaccccattaatctcccaacatcctcagcagacatccttcatcatggctagcactggtcaaccactgcccacatcaaattatagtacctcttcgcacgcccctcctacccagcaggtgctgcctccccagggttacatgcaacctcctcagcagattcaggtgtcatactaccccccagggcagtaccccaatagcaatcagcaatatcggccattgagccacccagtggcatacagtccccagagaggtcagcagctccctcaaccttctcagcaaccaggcctccaaccaatgatgccaaaccaacagcaggccgcatatcagggaatgatcggagtgcaacaaccgcagaatcaaggcttgctcagctctcagagatccagcatggggggtcaaatgcagggtctcgtcgtccagtatacccctctcccttcctaccaagtcccagtcgggagcgattctcaaaacgtcgttcagccaccgttccaacaaccaatgctggtgcccgtcagccaaagcgtgcagggcggcctgcccgcagctggggtccctgtttactacagtatgatcccgccagcgcaacaaaatggaactagcccatcagtggggttccttcagcctccaggatctgagcagtatcagatgccccagagcccttcgccatgttctccaccccagatgccccagcagtattcaggcgtgagcccttctggcccaggcgtggtggtgatgcagctcaatgtccctaacgggcctcaaccgccgcagaacccttcaatggttcagtggtcccattgtaagtattactccatggaccagcggggccagaagcccggggacctctactcaccagacagctctcctcaggctaatacacagatgagtagctcaccggtgaccagccctactcagagccctgcaccttcgcccgtgacttctctgtccagcgtttgcactggcctatctcctctccctgtccttacgcagtttccccggccgggagggccagcccaaggggacggacggtacagtttactcggccagccactgcaatacaatctgagcatctgcccgcccctgctgcacggccagtccacctacacagtccatcaaggccagtctggactcaagcacggaaatagaggtaaaaggcaggcccttaaatcggcatctactgatcttggcaccgctgatgtggtgttaggccgagttctggaggtaacggatctccctgaaggaatcacacgaactgaggcagataagcttttcacacaactagcaatgtcaggcgctaagatccagtggctcaaggatgcccaaggtctgccaggagggggcggcggcgataacagcgggacagctgaaaacgggcgacattctgacttggccgccctgtatactattgtggctgtcttcccttcacccttggctgcacagaatgcttcactacgccttaacaactccgtgtcccgctttaagctcagaatggccaaaaagaattacgacctccggatactagaaagggcctcaagtcagtag

SEQ ID NO: 20350 - DNA, 2112 bp, Artificial Sequence
  Description of Artificial Sequence: Synthetic coding sequence
atgcggcggatccagaacttcaaccggggcagcttcagccgggagatgatgcctgtatggacagaaatgatcacaaggggcaatagagagggactttctcggaccagctctagcaggcagtcgagcacagacagcgagctcaagtctttggaaccaagaccatggagcagcactgattcagatgggagcgttagaagcatgagaccgcctgtcacgaaggctagcagttttagcgggatatccattttaactaggggcgatagtatagggtcttccaaaggtgggagcgctggtaggatctctagacctggcatggcccttggagcccctgaagtgtgtaaccaggtgaccagtagtcagagcgtgcggggcctactgccctgtacggcacaacagcagcagcagcagcagcagcaacagctgcccgctctcccacccacaccgcaacagcagccaccgctgaacaaccacatgatctcccaagccgatgatctgtcaaacccgttcggacagatgtccctgtcccgccaaggctcaaccgaggcggctgacccatccgccgcactgttccagaccccactgatttcgcaacaccctcagcaaacatcctttatcatggcatcaacaggccaaccactgcccacgtccaactacagcacatcctctcacgcgccccctacccaacaagttctgcctccccaggggtatatgcagcctcctcagcagatacaggtctcatattaccctcccgggcagtaccctaatagtaaccagcagtacagaccgctgagccaccctgtcgcctacagcccccagagaggtcagcaactgccacagccctcccagcaacctggcctgcagccaatgatgcctaaccagcagcaagcagcataccaaggcatgatcggcgttcagcagccacagaatcagggcctactgtcctcacagaggtccagcatgggaggccaaatgcagggtctggtggtgcagtacacaccacttccttcttatcaggtgcctgtaggatctgactcacagaatgttgtgcagccaccatttcagcagcccatgctggtaccagtgagccagagcgttcagggcggtctccccgccgccggcgtgccagtgtattacagcatgatccccccagctcagcagaacggaaccagcccctccgtaggcttcctgcagccacctggcagcgaacagtaccagatgccccaatcaccatctccctgtagcccaccgcagatgccacagcaatactccggagtctccccaagtggaccgggagtcgttgtgatgcaacttaatgttcccaacgggccccaacccccacagaacccaagtatggttcaatggtcacattgcaagtattattcaatggaccagcgaggacagaaacccggggatctgtactcccccgattccagcccccaggccaacacgcagatgtcttcctcccccgtgacctcaccaactcagagccctgctccgtctcctgtcactagtctgagttccgtgtgtaccggactgtctccgctacctgtattgacgcagtttcctcgacctggcggtccagcccagggagatggcagatacagcctgttgggtcaacccctgcagtacaatctgtccatctgtcccccgttactgcacggccaatctacgtataccgtacaccaaggccaaagcggtctgaaacacggaaaccgcggaaagagacaagcactcaaaagcgcctccacagacctgggcaccgcagatgtggtcctgggccgggtgttggaagtgaccgatctgccagaaggtatcacaaggaccgaggccgacaaactgttcactcagttagccatgtccggtgcgaagatccaatggctgaaggacgcgcagggtcttccagggggtggcggcggggataattctggaactgcggaaaacggacggcactcggacctggccgcactgtatacaatcgtggccgtgttcccaagtcccctggcagcacagaatgcttcgctgcgtctgaataatagtgtcagcaggttcaagctcagaatggccaagaaaaattacgatctgagaattctcgagcgcgcgagctcccaatag

SEQ ID NO: 20351 - DNA, 1791 bp, Artificial Sequence
  Description of Artificial Sequence: Synthetic coding sequence
atgcggcggatccagaacttcaaccggggcagcttcagccgggagatgatgcccgtttggaccgaaatgatcacacgtgggaatcgggaagggctctcacggacctcatcttcgcgccagtcttctacagacagcgagctgaagtccctcgagcccagaccatggagctcgactgactccgacggttctgtgcgctccatgcggcctcccgtgacgaaagcatcatccttctcagggatctcaattctcaccagaggtgacagcatcgggagcagcaaaggaggaagtgccggaagaatatctcgccctgggatggccttaggagcccccgaggtgtgtaatcaagtgacttctagccagtccgtgagagggctgctgccatgcacggcacaacaacagcagcaacagcaacagcaacagcttccagcattaccaccgacaccacagcaacagccccctctcaacaatcacatgattagtcaggccgacgatttgtccaaccccttcggtcagatgagtttaagccgtcagggctctactgaggccgccgacccatcagctgctctcttccagacacccctcatttctcagcatccgcagcagacctcttttatcatggcttctaccggccagccgctccctacatccaattattccactagttcacacgcgcctcctacgcagcaggtcctaccaccgcagggctatatgcagccaccgcagcagattcaagtgagctactatccccctggacagtatcccaatagcaatcagcagtaccgacctctatcacatcctgtggcatattctcctcaaaggggccagcaactaccccaaccttctcagcaacctggattacaacctatgatgccgaatcagcagcaggctgcctatcagggaatgattggtgttcagcagccccagaatcagggccttctttcttcacagaggtctagcatgggtgggcaaatgcagggtctggtggtacagtacactccattgccctcctaccaggtacctgttgggagcgacagtcagaatgtagttcagccacccttccagcagcccatgctggtcccagtgagtcaatcggtccaggggggactccctgcggctggcgtgcccgtgtactattccatgatccctcctgcacagcagaacggaaccagtcctagtgtggggttcctgcagcctccgggctccgagcagtatcagatgccacagtcgccctcaccatgttcaccacctcaaatgcctcaacagtactcaggagtttctccatcaggtccgggggttgttgtgatgcagctcaacgtgcctaatggcccccagcccccccagaacccctcaatggtgcaatggtcccattgcaaatactactcaatggaccagcggggccagaagccgggtgacctttacagcccagactcctccccccaggctaacacacagatgtcatcctccccagtgacttcacccacgcagtcgcccgctccttcacccgtaaccagcttgagctcggtctgcacgggtctaagccccctgcccgtacttacacagttcccccgtcccggaggcccagcacaaggtgatggcagatattctctcttgggccagccactgcagtataatctctccatttgtccaccgttgctgcacgggcagtcaacctacacagtgcaccagggccagagcggactgaagcacggcaataggggaaagcggcaggctctcaagagcgcaagtactgatcttggaactgccgacgtggcactctcctttcagccatag

SEQ ID NO: 20352 - DNA, 2016 bp, Artificial Sequence
  Description of Artificial Sequence: Synthetic coding sequence
atgcggccccccgtgaccaaggccagcagcttcagcggcatcagcattctcactaggggcgattccataggctcatcaaaggggggcagcgctggacgcatatctcgcccggggatggcactcggcgccccggaggtgtgcaatcaggtgacatcatcgcagtcagtgcggggcctcctgccttgcacagctcagcagcaacagcaacagcaacaacagcagctccctgcccttcctcccacccctcagcagcagccccccctgaacaaccacatgatctcacagccggtgcccgccctgcagccaagtccccagccagtgcagttctccccatcatcctgcccacaggtattgctgcctgtctctcccccccagcagtataatatggccgacgatctaagtaacccttttggacagatgtccctcagcagacaaggcagtacagaagcggcggatccttctgctgcattgtttcagacacctttaatcagtcagcacccacaacagacgtcatttattatggcaagtactgggcaacccttaccaacaagtaactatagtacatcttcacatgccccgccaacccagcaggtacttccgccgcagggatacatgcaaccacctcagcagattcaagtcagctattaccctcccgggcagtaccccaattccaaccagcaatacaggcctctatcccacccagtggcttacagtccccagcgcgggcaacagctgccacagccctctcagcagcccggactacagccaatgatgcctaatcaacagcaggcagcgtatcagggaatgatcggagtgcaacagccccagaatcagggactgttgagctcacagcgtagtagtatggggggccaaatgcaggggctggtagtgcaatacacaccattgccctcctaccaggttccagtgggttccgactcccagaacgtggtgcagcccccttttcagcagcccatgcttgtgcctgtatcacagtctgtgcaaggcggattacccgccgccggggtccccgtgtattactccatgattcctcctgctcaacagaacgggacatccccctctgtagggttcttacaaccccccggcagtgaacagtatcagatgccacaatcaccatctccatgcagcccgccacagatgccccaacaatactcaggcgtaagcccttctggacctggtgtcgtcgtcatgcagttgaacgtgcccaatggaccacagccgcctcaaaacccttcaatggtccaatggtcacattgtaaatactattccatggaccaacgaggccaaaagccaggggacctgtatagtcccgatagcagcccacaggctaacactcagatgtcctcatcccccgtgaccagccctacccagagccctgccccttcacctgtaacctccctcagctcagtgtgtacaggactctcaccactgcctgtcctgactcagttcccaagacctggggggccagcccagggcgatggacgctattcactactaggccagccgttacaatataacctgagtatctgtccccccctgcttcacggccagagcacatataccgtgcaccaaggtcagagcggactcaaacatggaaaccggggaaagcggcaagctctgaaaagtgcttctacggaccttgggaccgccgacgtggtacttggaagagtccttgaggtgactgatctccctgaggggatcacaagaacagaagcagataagttgtttacccagttagctatgtcgggggctaaaatccagtggttgaaggatgctcaggggctccctgggggtggcggtggcgataactcagggaccgctgagaatggcagacattcggacttagcagcgctgtacactattgtggcggtgtttccttccccccttgctgctcagaatgccagcctgcggcttaataactctgtgtctcgtttcaagctgcgcatggcgaagaagaattacgatcttaggattctggagcgagccagctcccagtag

SEQ ID NO: 20353 - DNA, 90 bp, Artificial Sequence
  Description of Artificial Sequence: Synthetic coding sequence
atgagcaacagcaacaccacccaggagaccctggagatcatgaaggagtccgaaaaaaaactcgttgaggagagcgtgaacaaaaattag

SEQ ID NO: 20354 - DNA, 198 bp, Artificial Sequence
  Description of Artificial Sequence: Synthetic coding sequence
atgttctacacccacgtgctgatgagcaagcggggccccctggccaaaatctggctagccgcacattgggaaaagaaattaaccaaggcccacgtgttcgaatgcaacctggaaatcaccatcgagaaaatactctctcctaaagtgaaaatagctttacgcacctctggacacttacttctcggagtggtgcgctag

SEQ ID NO: 20355 - DNA, 1566 bp, Artificial Sequence
  Description of Artificial Sequence: Synthetic coding sequence
atgttctacacccacgtgctgatgagcaagcggggccccctggccaagatctggttagctgcccattgggaaaagaaactgaccaaagcgcatgttttcgaatgtaatttggagatcacgattgagaagatactgtcccctaaggtcaaaattgccctgagaacatctggtcaccttttattaggtgtggtgcggatctacaatagaaaggcaaagtatctgcttgctgattgttccgaggcctttctgaagatgaaaatgacattttgcccaggtttagtggatctacccaaggagaatttcgaagcttcttacaacgctatcactcttccggaggagttccacgactttgacacgcagaacatgaatgctatcgatgtgagcgagcactttacacagaaccagtctagaccagaagaaattactctccgggagaatttcgacaatgacctgatctttcaggcagagagctttggggaagaaagcgaaatcttacgccgtcattcgttcttcgacgataatatactactaaactcatcgggcccgctgatcgagcacagttcaggttcgctgaccggtgaacggagcctgttctacgattctggcgatggttttggcgatgaaggtgctgcgggcgagatgatcgataacttgctgcaggatgaccagaacatcctgctggaggacatgcaccttaatagggaaatcagtctacccagcgagccacctaacagcctggctgtcgaaccagacaacagcgagtgcatatgcgttcctgaaaatgaaaagatgaacgaaacgattttgctctcaacggaggaggagggctttaccttggatccaatcgatatcagtgatattgccgagaaaaggaagggcaagaaaaggcgtctgttaattgatccgatcaaggagctctcaagtaaggtgatccacaagcagttgacctcatttgcggacacactgatggttctggagttggcccctcccacccagaggttgatgatgtggaaaaagcgcggcggggttcacacattgctcagcacggccgcacaggatcttattcacgcggagttgaagatgctgttcacaaaatgtttcctctcttctggtttcaaactgggtaggaaaatgattcaaaaggaaagtgtgcgggaggaggttggaaaccagaacatcgtggagacaagtatgatgcaggaaccaaactaccaacaggagctcagtaaacctcagacatggaaggacgtaataggagggtcccaacactcttcccatgaagacacaaacaaaaacatcaactccgaagaaagcctctccaacgaagagaacatcgaaaccgaaagatggaacggacgtattctccagatgctcaatcggctaagggtagccgatcagggccaggccgccgcggccgcaaccgccgaggcactgagacaggcgggacctgaatggtgcgagcctgcgggtctgcggagagcgtctgggctgtctcctcgagacaccgctcatccaacgccgtactcagatccacagccccatggtcatgtgcctgccagaaagtag

SEQ ID NO: 20356 - DNA, 1566 bp, Artificial Sequence
  Description of Artificial Sequence: Synthetic coding sequence
atgttctacacccacgtgctgatgagcaagcggggccccctggccaaaatttggctagccgcccattgggaaaaaaagctcaccaaagcacacgtgtttgagtgcaacttggaaataaccattgagaaaatccttagtccaaaggtaaaaatcgcactacgaacctccgggcacctgcttctcggggtagtgcgaatttataaccggaaggccaagtatttactggccgactgttcggaagcatttctcaaaatgaaaatgaccttctgtcctggcctggtggacctgcctaaggaaaattttgaagcctcatacaatgccattaccctccctgaggaattccacgacttcgacacacagaacatgaacgctatcgatgtgagcgaacactttacacaaaaccagagccggcctgaggaaatcacactccgcgagaactttgacaatgatctcatttttcaggccgagagctttggggaggagagcgaaatcctgcggcgccactcgtttttcgatgataacattctcctcaactcctcgggtcctctaatagagcacagttcggggtcattgacaggggaaagaagcttattttacgattctggagatggcttcggggacgagggggccgccggcgagatgatcgataatctgcttcaggacgatcagaacatcctcttggaagacatgcacctgaaccgcgagatctccttgccctctgaacctccgaactcgctggcagtcgaaccggacaacagcgagtgcatctgcgtgcccgaaaacgagaagatgaatgagaccattcttcttagcacggaagaagaaggcttcacacttgatcccatcgatatttcagatattgcggaaaagcggaagggtaagaaacgaagactcttaatcgatcctatcaaggagctgagctcaaaggtgattcacaaacagcttactagcttcgccgacaccctgatggtgctggaattagcgccacctacccagagactgatgatgtggaagaaacgcggaggagttcatactctgctctccaccgctgcacaagatctgatccacgcagagctcaagatgctgtttaccaaatgcttcctcagtagcggtttcaagttgggtcgtaagatgattcagaaagaatcagtgcgagaggaagtcgggaatcagaacatcgttgagaccagcatgatgcaggaacccaactaccagcaggaactgagtaagcctcaaacatggaaggacgtgatcggggggtctcagcattcgtcccacgaagacaccaacaaaaacattaactctgaggaatccctgagtaacgaagagaatatagaaacggagcgctggaacggccggatcctacagatgctaaatagactcagagtggctgaccaggggcaggccgcagcggcagccactgctgaggcactccgccaggccgggccagaatggtgcgagcccgccggccttagacgcgcctccggtctgtcaccgagagatactgcacatccgacgccctacagcgatccgcagccccacggccatgtgcccgccagaaaatag

SEQ ID NO: 20357 - DNA, 1671 bp, Artificial Sequence
  Description of Artificial Sequence: Synthetic coding sequence
atgttctacacccacgtgctgatgagcaagcggggccccctggccaagatttggctagcagctcattgggaaaaaaaactgaccaaggcgcatgtctttgagtgcaacctcgaaattactatcgaaaagatcttgtcgcccaaagtgaaaattgctctgagaacatccggtcacctgctgttgggagtggtaagaatctacaatcgcaaagcaaagtatctcctggccgactgttccgaggcattcctcaaaatgaagatgaccttctgccccggcctggtcgatctgccaaaggagaactttgaagcttcatacaacgcaatcacactccctgaggaatttcacgattttgatacacaaaacatgaatgcgatcgacgtctccgagcacttcacacaaaaccagtcaaggccggaggagatcaccttaagagaaaacttcgataacgacctgatatttcaggccgagtcctttggggaagagtctgaaatcttgcgaagacactcgtttttcgatgacaatattctgctgaatagcagcgggccactaatcgagcacagttccggatcgctcacgggcgagcggtcactgttttacgactcaggagatgggtttggagacgaaggcgccgccggggagatgattgataatctcttacaagatgaccagaacatcttgctcgaagatatgcacctcaacagagagatctccctgccctctgagcccccaaatagtctggcggtggagcctgataattccgaatgtatctgcgtgccagaaaatgagaagatgaatgagacgatcctgctgagtactgaggaggaaggattcaccttagacccaattgatattagcgacatcgcggagaagcggaaaggcaagaaacggaggctgctcattgaccctattaaggaactgtcctccaaagtgatccataaacagctcacctccttcgcagacaccctgatggttttggagctggcccctcccacccaacgacttatgatgtggaagaagcgaggcggagttcacactttactgtccacggctgctcaagacctcattcacgcagaattgaagatgctgttcacaaaatgcttcctttctagtgggtttaaactgggcaggaaaatgatccagaaagaaagcgtgagggaagaggtgggaaaccaaaatatcgttgagacctctatgatgcaggaacctaactaccaacaggaactctccaagccgcagacctggaaagacgtgattggcggatctcagcactcctctcacgaggacaccaacaagaacataaactccgagcaggatatagtggaaatggtgtcgcttgccgccgaggaaagcagtctaatgaacgacctcttcgcccaggaaatcgaatattcgcctgtggaacttgagtctctatcaaacgaagagaacatagagacagaaaggtggaatggccgcattctgcagatgctgaacaggctgagggaatcaaataaaatgggaatgcagtccttttcactgatgaaactgtgccgcaattcagaccgcaaacaggcggcagccaagttctacagcttcctcgtactgaagaaacaactcgccatcgagctgtcgcaatctgccccatacgctgacattattgccacaatggggcccatgttttataacatttag

SEQ ID NO: 20358 - DNA, 3486 bp, Artificial Sequence
  Description of Artificial Sequence: Synthetic coding sequence
atgggcctgggcaagaccctgcaggtgatcagcttcatcgacgtgctctttcggcacacacccgcaaagactgtgttagcgatagtgccggttaatacactccaaaactggttggccgagtttaacatgtggctgccaccaccagaagcactcccagcagataataaaccggaggaggtccagcctcgtttttttaaggtgcacattcttaacgatgagcacaagaccatggcctcacgcgcaaaggtgatggccgactgggtctcggagggtggcgtgctcctaatggggtatgagatgtatcgtcttctgacactcaaaaaaagcttcgccacaggtcggcccaaaaaaactaaaaaacggagtcaccccgttatcattgacctggacgaagaggaccggcagcaggaattccggcgggaattcgaaaaggccctgtgtaggcctgggcccgatgtagtaatctgtgatgaggggcatcgcatcaaaaattgtcaggctagtacaagtcaggcactcaagaacatccgtagtagacggcgtgtggtactgactggctatcccttgcagaacaatctcatcgaatattggtgcatggttgacttcgtacgccccgactttcttggaacaaggcaggagtttagtaatatgtttgagcgacccatccttaacggacagtgtatcgattcaacaccacaggacgtgcgtctgatgagatataggagtcacgttctgcattcactcttggaaggattcgtgcaacggcgcgggcatacagtgctgaagatccacctccctgctaaagaagaaaatgtgatcctagtacgcctcagtaagattcagagagacctttatacacaattcatggaccgctttcgcgactgcggctcatcagggtggttaggactgaatcccctgaaggcattttgtgtttgctgcaaaatttggaaccatcctgacgtgctttacgaagccctgcagaaagagtcactggccaatgagcaagaccttgacgtggaggagctgggctcggcaggaacatcagctaggtgtcctccacagggcaccaagggaaagggggaagattctaccctggcgtccagcatgggagaagccacaaactcaaaattcctgcaaggagtcggcttcaatccgtttcaagagagaggtaacaatatagtcacctacgagtgggccaaggatctgctgacgaattatcagactggggtgttagaaaacagccccaaaatggtgctactatttcacctcattgaagagagcgtgaagcttggggacaaaattttggttttcagtcaatctttgtctacgcttgctctcatcgaagaattcttagggaagagggaagtcccgtgtccccccgggacagaagggcaaggcgcccaaaaatgggtaaggaacatctcctatttccgcttagacgggagcactcctgcatttgagcgggaacgccttattaaccagttcaatgatcccagcaaccttaccacatggttattcctcctctcaacacgggccggctgcctaggagttaatttgatcggtgctaatcgcgtggtcgtgtttgacgctagctggaacccttgccatgatgcccaggcagtgtgccgagtgtatagatacggccagaaaaagccatgttacatttatcgtctcgttgctgattatacactagagaagaaaatctatgacagacagataagtaagcagggcatgagcgacagggtggttgatgacctgaaccctatgttgaactttaccagaaaggaggttgaaaatctgttgcacttcgttgaaaaggagcccgctccacaagtaagtttgaacgtcaagggaatcaaggagagtgttctgcaattggcctgcctgaaatacccacacctgattaccaaagaacccttcgagcacgagtccctgctgctaaataggaaagaccacaaattgaccaaagccgagaaaaaagcggctaagaagagctacgaggaggataagagaacatctgtgccctacacgcgcccttcatatgcacagtactaccctgcttcggatcagtctttgacctccatccccgcattttcccagcgaaattggcagcctaccctcaagggcgatgagaagcccgtggcctccgtacggcctgttcagtccaccccaattccaatgatgcctagacatgtgcccctaggtggatcagttagctctgccagttcaaccaatccttctatgaacttccctattaactatctacagcgagcaggtgtcctggtacaaaaggtggtgacgactactgatattgtgattcccggtttgaacagctccactgacgttcaggccagaatcaacgccggggaaagcattcacatcattagaggcaccaaaggaacgtacatcagaacctccgacggcagaatattcgcggtgagagcaaccggaaaacctaaggttccagaggacgggaggatggctgcatcaggctcacagggcccatcatgcgagagtacctctaatgggagacactccgcttcgagtccaaaagcacccgaccccgaggggttggctcggcccgtaagcccagactctcctgaaataatctcggagcttcagcagtatgctgatgttgccgctgccagggagagcaggcaatcttccccctccacgaacgcagccctgcccggtccccctgctcagctgatggactcgagtgctgtaccaggaaccgcccttggcactgaaccacgactgggcgggcattgtctcaacagtagtctgctggtgaccggtcaaccttgcggcgatcgacatccggtgctggaccttagggggcacaagcgcaagctcgcaactcctcccgctgcccaggagagttccaggcggcgtagtaggaaagggcaccttcccgcaccagtacagccttacgaacatgggtatcctgtgagcggaggatttgctatgcctcctgtctccttgaaccacaacctgactacccctttcacttcacaggccggtgaaaatagcctgtttatgggatccactccaagctactatcagttgtccaatctcctggctgatgctcgattggtctttccagtcacgacagacccactggttcccgctgggccagtcagtagtagctccacagccacctctgtgacagcaagtaatcccagttttatgttgaatccgagtgttcccgggatattgccatcttactcactgccattttcccaacctttactgagcgagccacgtatgttcgccccattcccaagccccgttctcccctcgaacctctcccggggaatgtctatctacccgggatatatgagccctcacgcgggttaccctgcaggcggacttttaaggtcacaggtacctcctttcgattcccacgaggtggccgaagtgggattcagctcaaacgatgatgaagacaaggatgatgacgtgattgaggtgaccggtaagtag

SEQ ID NO: 20359 - DNA, 4404 bp, Artificial Sequence
  Description of Artificial Sequence: Synthetic coding sequence
atgagcgacgagagcgccagcggcagcgaccccgacctggaccccgatgtggaattggaagatgcggaggaagaggaagaggaggaggaggtcgctgtggaggagtgtgatcgcgacgatgaggaagatctgctagacgacccctcattggaagggatgtgtggcacggagcatgcccaactgggtgaagatggacagcagcctcctcgctgcaccagcaccacatcgtctcaaagcgaaccctcagaacagctgaggcgccatcagggcaaaaatttagcctctgaggacccaaagaaaaaacgcgcacaaaagccctctcatatgagaagaaacattaggaagcttctgagggaagaccagctggagccagtcactaaagcagctcagcaggaggagctggagaggcggaagcgcctggaacaacaacgtaaggattatgcagcccccataccaacagtcccgctggagtttcttccggaagagatcgcactgcgtgcctccgacggaccccagcttcctccacgggtgctggcccaagaggtaatttgcctggatagcagctctggatctgaggatgaaaaatctagccgtgacgaggtcattgaactgtctagcggtgaagaagataccctacacatagtggacagcagcgaatcagtgtcagaggacgatgaagaggaagagaagggtggcactcacgtgaatgacgtgcttaaccagcgcgacgcactcggtcgggtgctggtcaatcttaatcaccctccagaagaggagaacgtatttttggctccacaattggccagggctgtgaaaccgcatcagatcggtgggattaggtttctttatgacaatctcgttgaatcacttgagagattcaaaaccagtagcggctttggctgtatcctcgcccattctatgggactggggaaaaccctccaagttatttcgtttatagatgttctgtttagacacacacccgcaaaaaccgtactggctatcgtgcctgtcaacacattacagaactggcttgccgaatttaacatgtggctgccaccaccagaggccctgccggctgacaacaaacctgaggaagtccagccgagattcttcaaagtccacattctgaatgatgaacacaaaacgatggctagtcgcgcaaaggtgatggccgactgggtgtcggagggaggggtactcctgatgggctatgagatgtatagactactcaccctaaagaagtcctttgccacagggcggcctaaaaagaccaaaaagaggtcgcatccggttattattgacctggatgaggaagataggcagcaagagttccgacgggagttcgaaaaagcactgtgtcggccgggccccgatgtggtcatttgtgatgagggacaccggataaagaactgccaggcatctacgtctcaggccctgaagaatatccgatctcgaagacgcgtcgtgttgactggctacccattacagaacaacctgatagagtactggtgtatggtcgattttgtcaggccggacttcttgggaacgaggcaggaatttagtaacatgttcgaaaggccaatcctgaacggacagtgtatcgattctacaccccaggatgtgagacttatgaggtatcgctcccacgtgttgcacagcctgctggaaggctttgtccagcggaggggtcacactgtattaaagattcacctgcccgccaaggaggaaaatgtaatcctagtgcgcctgtctaaaattcagagggacctatacactcaatttatggaccggtttagagactgcggtagctccgggtggctgggtctgaacccactgaaagccttttgcgtgtgctgcaagatatggaatcatccagatgtcctctacgaagcactgcaaaaagaatccctcgcaaacgagcaggatctggatgtggaggaattggggagcgcaggtacaagcgcccgctgccctcctcaaggcactaaaggcaagggagaggacagcaccctggcttcatcaatgggggaggcaacaaactctaaatttctacagggagtggggtttaacccattccaggaacgcggcaataacatcgtcacatatgaatgggccaaagacctcctcacgaactatcagactggtgtattggagaattcccctaagatggtgctcctgtttcacctgatcgaggaatcagtgaagctcggggataaaattcttgtatttagtcagtccctttctaccctggctttgatcgaggaatttctggggaagcgcgaagtcccatgtcctcctggaacagagggacagggggctcagaaatgggtacggaacatatcctacttcaggctggacgggagtacacccgcattcgaaagagagcggctgattaaccagttcaacgacccatccaacttaacaacctggttgttccttctgagcacacgtgccggttgcctgggtgttaaccttataggggccaaccgcgtcgtggtgtttgatgccagctggaacccctgtcatgacgcccaggccgtatgcagagtgtataggtacgggcaaaagaagccctgctacatctatcgcctagtagccgattatacgcttgagaaaaaaatctacgacagacagatctccaagcagggaatgtctgaccgtgtggtggacgatctgaatccgatgctgaacttcactcgcaaggaggtggaaaatctattacacttcgtggaaaaggaacccgcaccacaagtgagccttaatgtgaaaggtatcaaggagtccgtgctccagctggcctgtctgaaatatccccatttgatcaccaaagagcccttcgaacacgaatcactgctgctgaatcgaaaggaccacaagttgactaaagctgagaaaaaagccgccaaaaaatcgtatgaagaagataagcgaactagcgtgccctatactcgaccttcctacgcacagtactatccggcatctgaccagtcattgacttcgatcccggctttctcacagcgaaattggcaacctaccctcaagggcgatgaaaagcctgtcgcatctgtgcgtcctgtccagtccacccccatcccgatgatgcccagacatgtcccgctgggcgggagcgtgtcgtcggcctcttctaccaacccttctatgaacttcccaattaattatctgcagagggcgggcgtccttgtgcagaaagtggtaaccaccacggatatcgtcattccaggcctaaactccagtacggacgttcaggctcgaatcaacgctggcgaaagcattcacattatccggggtactaagggaacttacatccggacatctgacgggaggatttttgctgtcagggccacgggaaagcctaaggtccccgaagatggcaggatggccgctagtggctcccagggccccagctgcgaatcaacgtcaaacggcagacacagcgcctccagccccaaggctcctgatcccgaaggcctggcgcggcctgtcagtccggatagcccagagatcatttccgagctgcagcagtacgcagacgtcgctgcagcgcgtgagtcaaggcagtcctcaccttcaaccaatgcggccctgcccggacctcccgcccaactgatggactcaagtgcagtgcctgggaccgctctgggtacggaaccacggctgggaggccattgcctcaattcatcactgttggttactgggcagccttgtggcgaccgccaccctgtgctggacttgcgaggtcataagcgaaaacttgccaccccacccgcagcccaggaatcatccaggcgacgctctaggaagggccacttgcccgcaccggtgcagccatacgagcatggttacccggtttcgggcgggttcgcgatgccgccggtctcccttaaccacaaccttaccaccccttttacgtcgcaggccggtgaaaactccctattcatggggtccaccccctcttattaccagttgtccaatctgctggcggatgcaagactcgtcttcccggtgaccactgacccccttgtgccggccggccccgtttcctccagctccactgccacgtctgttaccgcgagtaacccctccttcatgctcaatccgagtgtgcccggaatactgcctagttactcacttcctttttcacagccgctcctgagcgagcctcggatgtttgccccatttccttctcccgtgctcccatctaacctgagtcggggcatgagcatctacccgggatatatgtcgccccatgccggctaccccgccggaggccttcttagatctcaggttccccccttcgactctcacgaagtggcagaagtcggattttccagtaatgacgatgaggataaggatgacgacgttatagaggtgaccggtaaatag

SEQ ID NO: 20360 - DNA, 675 bp, Artificial Sequence
  Description of Artificial Sequence: Synthetic coding sequence
atgcccccccggaagaagcggcggcagcccagccagaaggcccccctgctgttccatcagcagcctttagaagggcctaagcacagctgcgcttctacgcagctgccgattacacacaccagacaggtaagccccgattttgacaccgcagctggctcactgtttccagcataccagaaacatcagaatcgggctagacacagctcacggaagccaaccacttcgaaatttccacacctgacattcgagtccccgcagagctcatcgagtgaaacactgggaatccctctgattagagagtgtcccagtgaatccgaaaaagacgttagccgccgcccgttggttcccgttctgagtccgcagagttgcgggaatatgtctgtacaggccctgcagtctctgccatacgtgtttattccacccgacatccagactccggagagttcctctgtgaaagaggaattaataccccaggaccagaaagaaaacagtctgctgtcctgcaccctccatacgggcaccccaaatagtcctgagcccggacctgtactcgtgaaggatacccctgaggataaatacggtataaaagtcacttggcgcaggaggcagcacctcctggcatacctgagagagagaggaaagttgagcaggtctcagttcctggtgaaaagttag

SEQ ID NO: 20361 - DNA, 1335 bp, Artificial Sequence
  Description of Artificial Sequence: Synthetic coding sequence
atgggcagcagccggctgcgggtgttcgacccccacctggagcggaaagactctgccgcagcactgtcagatcgcgagctgcccctcccaacgtttgatgtcccctattttaaatatattgacgaagaggatgaggatgacgaatggtcttcccgatcgcaatctagcactgaggatgatagcgtggacagcctgttatctgatcgttatgtggttgtctcaggcaccccagagaagattctcgaacaccttctgaatgatctgcacctggaagaagtccaggataaagagacagagaccctgctggatgactttctgctgacgtacaccgtcttcatgacaacagatgatctgtgtcaggccctacttcggatttactccgcgaaaaaataccaagggaaggaggagaatagcgacgtgcccaggagaaagaggaaagtgctacacctagtgtcccagtggattgcattgtataaagattggctgccagaagacgagcacagcaagatgttcctgaagacaatctatcgcaacgtacttgacgatgtctatgagtaccccattcttgaaaaggagctaaaggagtttcaaaaaatcctcgggatgcatcgtcggcataccgtagatgagtatagcccccaaaaaaaaaacaaggctctgtttcaccagttcagcctgaaggaaaactggctgcaacatcgaggaaccgtgactgagactgaggaaatattttgtcacgtatacatcaccgaacacagctatgtgtcggtgaaagcaaaggtgagctctattgctcaggaaattctgctgtgcagtcagttggggaaaagagtccagctagtgaagaaatttatcaagatcgctgcgcattgcaaggctcaaagaaacttgaactcgttcttcgccatcgtaatggggctaaacactgcatccgttagccgcctgtcccaaacttgggagaagatcccgggtaaatttaagaagctatttagcgagctggaaagcctaaccgaccccagcctcaaccataaagcctatagagacgcgttcaaaaaaatgaagccgccaaagattcccttcatgccattgctcctgaaagatgtgacatttattcacgagggtaataaaacatttctggacaatctggtgaattttgagaagcttcacatgatcgcagatactgttagaacccttagacactgccgtaccaaccagttcggagatttgagccctaaagaacaccaagagctgaagagctatgtcaatcacttgtacgttatagactctcagcaggccctcttcgagctgagtcataggattgagccccgagtctag

SEQ ID NO: 20362 - DNA, 2193 bp, Artificial Sequence
  Description of Artificial Sequence: Synthetic coding sequence
atggccatcggcgtgtggcagctgctgctggacatgggcatcatgcttagtgtagatcaacatctctactttcaagatacctatgttttttatcagttttcctccgatgaatgtagctacctgtactgtgagtttgagcgggaagaggaatggcaaaatggggtgaagctcctgctgcagctggtgcctctgattcccgcccgtgggggcatctgtgaattgagtcaccagaagatcgaggattcggaagagagtagcgacgagatcctggtgagactgacaagcgccgtacagcgggaactcgcagcagtcatcgctcttaaagcccgtaaaagcgctattgagcaagacgaagaaaataacgataaacatgtggccgtgacagaagccgagtcagtaccagattcccaagccggggttatgtgtaagctgcaagagagagacgagattggacgtattgagctcgtgcaaaagttggccaaggagaactatcagttcctccagacagataagaaggaacaggagaagtccgaacaccaagatgatgaggtgactactgtccaggtgaaggagcaagatcaatctgtcctcgtcctcaagaaggtgcagtgctgcggcccagcccccacggccggtagcgcagagtcccactggcgttacgtcgtcgtctccggcacaccagaaaagattctggagcacttacttaacgacctgcacttggaggaggttcaggataaggaaacggagacccttctggacgatttcctattgacctacaccgtgttcatgacgaccgacgatctctgtcaagccctgctgcggcattatagcgctaagaaatatcaaggcaaagaggaaaactccgacgtgccaaggcgtaagcgtaaggtcctacacttagtgtctcaatggatagcactgtacaaagattggctgcctgaagacgaacattccaaaatgttcctcaaaaccatttatcggaacgtacttgacgacgtctacgagtaccctatcttggaaaaggaactgaaagagttccaaaaaattctcggaatgcaccggcggcatactgtcgatgaatactctccccaaaagaaaaataaagctctgttccatcagttcagcctcaaagagaactggctccaacacagggggaccgtaacagagaccgaggaaatcttttgtcatgtgtacattactgagcactcttacgtcagcgtgaaagccaaggtgagttctatcgcacaggagatcttaaaagtagtagccgaaaagatacagtacgcggaagaagatcttgctctcgttgcaattactttttctggggagaaacacgagctgcagcctaacgatctggttattagtaagagtctggaagcaagcggacgtatctacgtctaccggaaggacttagcagacacgttgaacccatttgctgagaatgaggagagccaacagagatccatgaggattctcggcatgaatacgtgggacctggcactggagctgatgaactttgactggtccttgtttaatagtatccacgaacaagagctcatttatttcactttctccagacaggggagcggcgagcacacagcaaatctgtcactgttgctgcagcggtgtaatgaggtccagctgtgggtggcaacggagattctgctctgctcgcaactcggaaagagggtgcagctagtgaagaaattcatcaaaatcgctgcgcactgcaaggcccagcgaaacctcaatagcttcttcgcaattgtcatgggattgaataccgcgtcagtcagcaggttgtctcagacatgggaaaaaatcccagggaaatttaagaagttgttctctgaactcgagagtttaactgacccctctctcaatcataaggcatatagagacgccttcaagaaaatgaagccccccaagattccctttatgcccctgttgctgaaggatgtcactttcattcacgaaggcaataaaacattcctggacaatttggtaaatttcgaaaagctgcacatgatcgcagatacagttcgcactctgagacactgtcgtaccaatcagttcggcgaccttagcccgaaggagcaccaggaactaaaatcctatgtgaatcatctctacgtaattgatagtcagcaagcgcttttcgagctcagccaccggattgagccaagagtctag

SEQ ID NO: 20363 - DNA, 1743 bp, Artificial Sequence
  Description of Artificial Sequence: Synthetic coding sequence
atgggcagcagccggctgcgggtgttcgacccccacctggagcggaaagactcagctgcagccctttccgacagggaactgcctctgccaacatttgacgttccgtacttcaaatatatcgacgaagaagacgaagatgatgaatggagttcaaggtctcaaagcagcacggaagacgactcagtagactcattgttatccgatcgctacgtggtggtgtctggaacccccgagaaaattctggaacatctcctgaatgatttgcatctagaggaagtccaagacaaggagacagagacccttttagatgacttcctactgacttacacagtgttcatgaccacagatgacctctgtcaggctttgctgcggcattattctgccaaaaagtaccaggggaaggaggagaatagtgatgtgcctaggcgtaaaaggaaagtattgcatctggtcagccagtggattgcattgtataaggattggctgccagaggatgagcactctaaaatgtttcttaagaccatatacagaaatgttctggatgacgtttatgagtatcctatactggaaaaggagctgaaagaatttcagaaaattctgggcatgcaccgacggcatacagtggatgagtacagtccacaaaagaagaataaggccctgtttcaccagtttagcttgaaggagaactggctgcagcatcggggcacagtgactgagaccgaggagatcttctgccacgtatacatcaccgaacactcttacgtgtctgtgaaagctaaagtgtcatcaatcgctcaggagatcctgaaagtggtggcggaaaagatccagtatgctgaggaagatttagccttggttgctataacattctctggagaaaagcatgagctgcagccaaatgatctagtaattagtaagtcattggaagctagcgggaggatatatgtataccgaaaggacctcgcggatactcttaatcccttcgccgaaaacgaggagtcccagcagcgatcaatgagaattctgggcatgaatacctgggacctggctctggaattgatgaatttcgactggagcctgttcaactcgattcacgagcaggagctgatctattttacattcagtcgtcagggctctggtgaacacacagctaacctgtcactcctgctgcagcgttgtaatgaggttcagctgtgggtggctaccgaaattctcctatgctcccagctcggaaagcgggtacagctggttaagaaatttatcaaaattgcagcccactgtaaggcacagaggaacttgaatagttttttcgccatcgttatgggcctgaatactgccagcgttagccgactgagccaaacttgggagaaaattccgggcaagttcaaaaagctcttttcagagctggaaagccttaccgacccgagcctgaatcacaaggcatatagggatgcttttaaaaaaatgaaacccccgaaaatcccatttatgccgctgctcctcaaggatgttactttcatccatgagggtaataagaccttcctggataacctcgtcaattttgagaagttacacatgatagccgatacagtgcgaaccctccggcattgcagaaccaatcagttcggcgaccttagccctaaagagcaccaagaactcaagagctacgtgaaccatctctacgtgatcgattcacagcaagcactcttcgaactcagtcaccgtattgaacccagagtgtag

SEQ ID NO: 20364 - DNA, 1749 bp, Artificial Sequence
  Description of Artificial Sequence: Synthetic coding sequence
atgggcagcagccggctgcgggtgttcgacccccacctggagcggaaggactccgctgccgcgctgagtgaccgagaactccctctgcccacatttgatgttccttacttcaagtatatcgatgaagaggatgaagacgacgagtggtcctcacggagccaaagttctacagaagacgatagcgtggacagcttgttgtccgacagatacgtggtggtctccggcacaccggaaaaaattctggagcacctgctcaatgatctgcacctggaggaagtgcaggataaagagaccgagacattacttgacgatttcctgcttacatacacagtctttatgacgaccgatgatctgtgccaggctctactgaggatctatagcgccaagaagtaccagggcaaagaagaaaattcggacgtccccagaaggaagagaaaagtcctccacctggtgtctcagtggatagccctctacaaggattggcttcccgaggatgaacattccaaaatgttcttgaagactatttacagaaacgtcttggatgatgtgtatgagtacccaatcctcgagaaggaactgaaagagtttcagaaaatcctggggatgcaccggaggcacacggttgacgagtattccccccagaaaaaaaacaaagcactgttccaccagttttcccttaaggaaaactggctccagcacaggggcaccgtgaccgagacagaggaaatcttttgtcatgtctacattaccgagcactcctacgtgtccgtaaaagccaaggtttcttcaatcgctcaggagatactcaaggtggttgccgagaagatacaatacgcagaggaggatctggctctggttgcaatcacgttcagcggggacaaggagaaacatgaactgcagcccaacgatctggttatcagtaaaagcctggaagcttctggacggatatacgtctatcgtaaagatcttgcggacacccttaaccccttcgccgaaaacgaggagagccagcaacggtctatgagaatactgggtatgaatacctgggatctggcgctggagctgatgaattttgattggagcttgtttaacagcattcatgagcaagaacttatctattttaccttcagtcggcagggctcaggggaacataccgccaacctcagcctacttctgcagcggtgtaacgaagtccagctttgggtggccactgagattctgctgtgttctcaactgggcaagcgcgttcagcttgtgaagaagtttatcaaaatcgcggcacactgtaaggcgcagaggaacctcaattctttcttcgcaattgtcatggggctgaataccgccagcgtgtcacggctctcccagacatgggaaaagattcccggtaaattcaagaaacttttttctgagcttgaatcactaaccgatccatccctgaaccacaaggcgtacagggatgcttttaaaaaaatgaagccacctaagattcccttcatgcccctcttgctcaaggatgtcacctttatccatgaaggcaataagacctttctcgataacttggttaacttcgagaaactccatatgatcgctgacactgtgagaaccctgcgccattgccgcaccaaccagtttggcgacctaagcccaaaagagcaccaggagctgaagtcatacgtgaaccacttgtacgtgattgattcgcagcaagccctttttgaactctcacacagaattgagccaagagtgtag

SEQ ID NO: 20365 - DNA, 1122 bp, Artificial Sequence
  Description of Artificial Sequence: Synthetic coding sequence
atgctgctgggcctggccgccatggagctgaaggtgtgggtggacggcattcaacgagtggtgtgcggggtatctgaacaaacaacttgccaggaggtcgtcatcgctctggctcaagcgatcggccagacaggccggttcgtgcttgtccagaggctcagggagaaagagcgccaactcctgccacaggagtgtccagttggagcccaggctacctgcgggcagtttgcgagtgacgtgcaattcgtcctgcgacgcacaggaccaagcctcgccgggcggccctcctcggattcctgccctcctccagagaggtgcttaatcagagcctctcttccagtgaaacccagggctgccctaggctgcgaacccagaaaaaccttgaccccagaacccgcccctagcttgtcccgtcctggtcccgccgccccagtgacacccacccccggatgttgtaccgatttgcggggtttggagcttagggtgcaacggaacgcagaagaactgggccacgaggccttttgggagcaggagttgagacgcgaacaggcgcgggagagagaaggccaggctcggctgcaggcattgtcggccgccacagctgaacacgccgcgcgtttgcaggcgctcgatgctcaagccagggccttggaagctgagctccagctggcggccgaagcgccaggaccccccagtccgatggcaagtgccacagaaagacttcaccaggatcttgccgtgcaggaacgccaaagcgccgaggtgcagggctctttagctctggtgtctagggccctggaagctgctgagcgcgccctgcaggcccaagctcaggagcttgaggaactcaacagagaactgcggcagtgcaatctccagcagttcatacagcaaacgggtgccgctctcccaccaccgcctagacccgacagagggccacctggaactcaagggcctttaccccctgcccgagaagagagcttactaggggccccctccgagagccatgcgggggcccaaccccggcccagaggaggtcctcacgatgccgaactgcttgaggttgccgcggcgccagcccccgagtggtgcccgcttgcagctcagccacaggcactgtag

SEQ ID NO: 20366 - DNA, 1014 bp, Artificial Sequence
  Description of Artificial Sequence: Synthetic coding sequence
atgctgctgggcctggccgccatggagctgaaggtgtgggtggacggcattcagcgcgtagtctgtggtgtgtccgagcagaccacttgccaggaagtggtgatcgcactggcacaggcaatcggacagaccggtcgcttcgttctggtacaacgccttagggagaaggaaaggcagctgttaccacaggaatgtcccgtcggggcccaggctacatgcggtcagtttgcgtcagatgttcagttcgtgctgcgtcggaccggtccatcactggcaggacggcccagttcagactcttgcccccctccggagcggtgcctcattagagcttcacttccagtcaaaccacgggccgccctcggttgtgagccaagaaagacattaacacctgagccagctcctagcctttcaaggcccggcccggcagcacccgtgacaccaacccctggctgctgcaccgacttaagaggtcttgaactccgcgtccagcgcaacgcagaggagttgggacacgaagccttctgggagcaagaactgaggcgagaacaggcccgcgaaagggaaggtcaggccagacttcaagccctgtcagcagcgacggctgagcatgctgccaggctccaggcacttgatgcccaggcccgggcattagaggcagaacttcagttggccgcggaggccccagggcctcctagccctatggctagcgcaacggaacgcttacaccaggacctcgccgtacaggagcggcaaagcgctgaggttcagggctctctcgcactcgtctctagggccctggaggccgccgagcgggccctccaggctcaagcccaagagctggaggagttaaatcgggagctgagacagtgcaacctccagcaattcatccagcagaccggcgccgcgcttccaccacccccaagacccgacaggggaccccccggcacgcaggttggggtcgtgctgggcggaggttgggaggtgaggacctggccttctccaaccccgtcatag

SEQ ID NO: 20367 - DNA, 1122 bp, Artificial Sequence
  Description of Artificial Sequence: Synthetic coding sequence
atgctgctgggcctggccgccatggagctgaaggtgtgggtggacggcattcagagagtcgtctgcggcgtctcggaacagaccacatgccaggaggtggtcatcgccctggctcaagctatcggccagactggtaggttcgtgctcgtccagagactgagagaaaaagagaggcagctgctaccacaggagtgtccggtgggtgcacaagcaacctgcggtcagtttgcatccgacgtgcagttcgtgttgaggaggactggcccctctctggcggggcgcccctcttctgacagctgccccccgcctgaaaggtgtcttatacgagcttcgctgccagttaagcctagagcggccctgggatgcgagccccgtaaaaccctcactcctgaacccgccccttctttaagcaggcctggcccagccgctccagtgacccccacaccgggctgttgtacagatctacgtggcctggaactccgggtgcagcggaacgccgaggagctgggtcacgaggccttctgggagcaggaactgagacgggagcaggcccgggaacgggagggtcaggcacgcctccaggccctcagcgcagctacagctgagcacgccgccagactgcaggccctggatgcacaggcccgggcactcgaggccgaattgcaactcgccgccgaagcgcctggccctccctcacctatggcatccgccacggagcgcttacatcaggaccttgctgtccaggagaggcagtccgccgaggtccagggcagtttggcactcgtgagcagagcactcgaagctgctgaacgcgcattgcaagcgcaggctcaggagctcgaggagctcaatagggaattaagacaatgtaacttacagcagttcatacagcagaccggcgctgcgctgccacccccgcctagaccagaccgaggaccacctgggacccaaggccctctgccaccagccagggaggaatctctcttgggggcaccatcagaaagtcacgcaggcgctcagcccaggccccggggtggccctcacgacgcagagctgttggaagttgcagccgcacctgccccagaatggtgcccgttggccgcacaaccccaagcgctgtag

SEQ ID NO: 20368 - DNA, 1014 bp, Artificial Sequence
  Description of Artificial Sequence: Synthetic coding sequence
atgctgctgggcctggccgccatggagctgaaggtgtgggtggacgggatccagcgcgtggtgtgcggagtatccgagcagactacatgtcaggaggtggtgattgctcttgcccaggctatcggccagaccggaaggtttgtgttagttcagcgcctgagggaaaaagagaggcagctactccctcaggaatgccccgtcggagctcaggccacatgtggacagtttgcatccgatgtacagtttgtgctgaggcgcacgggcccaagcttggccggacggccttcctctgactcctgccctccaccagagcgctgtttaatcagggcctctttgcccgtgaagcctcgcgcagcactcggctgcgagcccagaaagacactgactcctgagcccgcaccatccctctccaggccgggcccagctgcacctgttacacctactcctggatgctgtacggacctgaggggcctcgagcttagggtccagcgcaatgccgaggagttaggccatgaagccttctgggagcaggagcttaggagggagcaggccagagagcgggaagggcaggccaggttgcaggccctctccgccgccactgccgagcacgctgcccggctgcaggctctcgacgctcaagcaagggccctcgaggcggaattacagctcgctgcagaggcacctggcccaccatcccctatggcttccgccaccgagagacttcatcaggatttggctgtacaggagcgccagtcagccgaagtccaaggttccctcgctctcgtgtctcgggccctggaggctgccgagcgcgctctgcaggcgcaggcacaggaattggaggaactgaatagggagctgcggcaatgcaatttgcagcagttcatccagcagacaggcgcagccctgcctcctcctccgcggccagaccgaggcccccctgggactcaggtaggcgtggtcctaggtggcggatgggaggtgcggacttggccatcccctacaccctcctag

SEQ ID NO: 20369 - DNA, 963 bp, Artificial Sequence
  Description of Artificial Sequence: Synthetic coding sequence
atgctgctgggcctggccgccatggagctgaaggtgtgggtggacggtatccagcgtgtggtgtgcggcgttagcgagcagacaacttgtcaggaggtggtgattgcactggcacaagctataggtcagactggacgttttgtcctggtgcagagactgcgtgaaaaggaaaggcagcttttacctcaggagtgccccgtcggcgctcaggctacctgcggccaattcgccagcgacgtccaattcgtcttgagaaggacgggccccagcctggctgggcggcccagttcagatagctgccctcccccggaaagatgtctgattcgagcatcactgccagttaagcctcgtgccgctctggggtgcgaaccccggaaaaccctgactcccgagccagctccaagtctctccagaccgggaccagctgctcccgtgacgccgactcccggttgctgcactgacctccgcggactcgagctgcgggtccagcgcaacgccgaagagctcggccacgaggccttctgggaacaggaactaaggcgtgaacaggcccgggaaagggagggccaggcccgcctccaggcgctatccgcagcaactgccgaacacgcggccaggctacaggctctcgatgctcaagcacgggctctcgaagctgaattgcagctggcggcagaggccccaggaccaccctctcctatggctagcgccacagagcgtttgcaccaagatctcgccgtacaagaacgtcaatccgcagaagttcagggcagtctagccttagtgtccagagccctagaagctgccgagcgcgccctgcaggcccaagcacaggagctggaggaactcaatcgagagcttcgacagtgtaatctacagcagtttatccaacagacaggtgctgcacttcctcctcctccacggccagaccggggccctcccggaactcagtggcctccctag

SEQ ID NO: 20370 - DNA, 255 bp, Artificial Sequence
  Description of Artificial Sequence: Synthetic coding sequence
atgctgctgggcctggccgccatggagctgaaggtgtgggtggacgggattcagagagtggtctgtggcgtcagcgagcagaccacatgtcaggaggttgtgattgccctggctcaagccatcgggcaaaccgggcggtttgtactggttcagcgacttcgggaaaaggaaaggcagctcttgcctcaggaatgccccgtgggggcccaggccacatgtggtcaatttgccagtgatgtgcagttcgtgctctag

SEQ ID NO: 20371 - DNA, 2145 bp, Artificial Sequence
  Description of Artificial Sequence: Synthetic coding sequence
atgaacaccctgcagggccccgtgagcttcaaggacgtggccgtggacttcacccaagaagaatggcagcagctggatcctgacgaaaagatcacctatcgcgatgtcatgttagagaactactcacatttggtgtctgtcgggtacgacacgactaagcctaacgtgattattaaattagaacagggcgaagagccttggattatgggcggcgaatttccatgccaacacagtcccgaggcttggcgagtggatgatctcatcgagcggatccaggagaatgaggacaagcatagccgacaggcagcctgtatcaacagcaaaaccttaacagaagaaaaagagaacacctttagtcagatatacatggagacctctctcgttccgtcctctattatcgcacataactgcgtctcctgtggaaaaaatttggagtctatcagccagctgattagctccgacggatcttacgcccggacaaagcctgatgagtgtaatgagtgtggtaaaacctatcatggcgagaaaatgtgtgaattcaatcagaacggggacacttacagccacaacgaggagaatatcctgcagaaaattagtatactggaaaaaccatttgagtataatgagtgtatggaggcattagacaatgaagcagtttttatagcccacaagcgcgcctatattggtgagaagccttacgagtggaatgatagtgggccagatttcatccaaatgagcaactttaacgcttaccaacgaagccagatggaaatgaagccgtttgagtgcagcgagtgtggcaagtccttttgcaagaaatccaagtttatcattcaccagagggcgcatactggagagaaaccttacgagtgtaacgtgtgtggaaagagcttctctcaaaagggaacgctgaccgtgcaccgccggtcacatctggaagagaaaccttacaaatgcaatgaatgtggaaaaacgttctgtcagaagcttcacctgactcagcacctaagaacccattctggtgagaaaccatatgaatgtagcgagtgcgggaagaccttctgtcagaagactcacctcacactccaccagcggaaccactctggcgagaggccatatccctgtaacgagtgtggtaaaagtttctcgagaaagtccgcattatctgatcaccaacgaacgcatactggggagaagttgtacaagtgcaacgaatgtgggaagtcctactaccgtaaatcaacattgatcacacaccaacgaacccacacaggggaaaaaccttatcagtgcagcgaatgcggcaaattcttcagccgcgtgtcttacctgacgattcactacagaagccacctcgaggaaaaaccctacgaatgcaacgaatgtgggaagaccttcaatctcaactccgctttcatacggcataggaaggtgcatacagaagagaagtcccacgagtgttcagagtgtgggaagtttagtcagctgtatcttactgatcaccacacggcccaccttgaggagaagccctatgaatgcaatgagtgcggtaaaacctttctggttaattcggccttcgatgggcaccagccactccccaagggggaaaaatcctatgaatgtaacgtctgcggcaagctctttaatgagctgtcctattatactgagcattaccgctctcactccgaggagaagccgtatggatgctccgaatgcgggaagactttttctcacaacagctccctgttccgacaccaaagagtgcatactggagaaaaaccctacgagtgctatgagtgtggcaagttcttttcccagaaatcatacctcacgattcatcacaggatccattcaggcgagaagccgtacgaatgctcaaagtgtggtaaagtctttagcaggatgtcgaatttaacagttcattaccgctcacatagtggcgagaaaccttacgagtgtaatgagtgcgggaaggtattttcccagaagagctatctgaccgtgcactaccgcacccactcaggcgagaaaccctatgaatgtaatgaatgcggaaagaaatttcatcatagaagcgcctttaactcccaccagcggattcacaggcgggggaatatgaatgtgttggacgtggaaaatctgtag

SEQ ID NO: 20372 - DNA, 2145 bp, Artificial Sequence
  Description of Artificial Sequence: Synthetic coding sequence
atgaacaccctgcagggccccgtgagcttcaaggacgtggccgtggactttacgcaggaagaatggcagcagctagacccagatgagaagattacttaccgagatgtaatgctagagaattatagtcacctagtatcggttggctacgatacaacaaaacccaacgttatcatcaagctagaacaaggggaggaaccctggattatgggtggtgaattcccctgtcagcactcacctgaagcctggagggttgacgacctgattgaacggatccaggaaaatgaagataagcactcccgccaggcagcttgtatcaatagcaagaccctgaccgaagagaaggagaacaccttttctcagatatacatggagacttccctagttccaagcagcattattgcccacaactgtgtgtcctgcggtaaaaacctcgaatcaattagccagcttatctcgtccgacggttcctacgccaggactaagcccgacgagtgtaatgagtgtggcaagacttaccacggagaaaaaatgtgtgagttcaaccagaatggcgatacatatagccataatgaagagaatatcctccagaagatatctatcctggagaaaccgttcgaatacaatgaatgtatggaagctcttgacaatgaggccgtgttcatcgcacacaagcgcgcctatatcggtgagaagccttatgagtggaatgactctggccctgactttatccagatgtccaattttaatgcgtatcagaggtcccagatggaaatgaaacccttcgagtgtagtgagtgcgggaaaagtttttgcaagaagtctaaattcatcatccatcagagagcccacaccggcgaaaagccttatgaatgcaacgtgtgtggaaagtccttctcccagaaaggtaccctcaccgttcacaggcggagccatttggaagagaaaccatacaaatgtaatgagtgtgggaaaaccttttgtcaaaaactgcatctcacacagcacctgcgaacccattctggcgagaagccctacgagtgtagtgagtgcggaaagaccttctgccagaagacacatttgacactccatcagcgcaatcactccggagaacgaccttacccttgtaatgaatgtgggaaaagcttttctagaaaatctgctttgtcagaccaccagcggacacataccggcgagaagctgtacaagtgtaatgagtgcggtaaatcgtactacaggaagtccactttgatcacacaccagaggacacacacgggagaaaaaccataccagtgcagtgaatgtggcaaattcttttcacgtgtttcttacttaaccatccattatagatcgcacttagaggaaaagccatacgaatgtaatgagtgcggtaaaacttttaatttaaactccgcttttattcggcatcgcaaagttcacacagaggaaaagtcacacgaatgtagcgagtgtggaaaattttcacagctgtatttgaccgaccatcacactgctcatctcgaagaaaaaccctacgaatgtaatgaatgtggaaagaccttcctcgtgaacagtgccttcgatggccatcagcccttgcccaaaggggagaaaagctatgaatgtaacgtctgcggcaaactcttcaatgagctgagctactataccgagcactatcgaagccactctgaagagaagccttatggatgttccgagtgtgggaagaccttcagccacaacagttctttgtttcggcatcagcgcgtgcatactggggagaagccctacgagtgctacgagtgtggtaagtttttttcccagaaatcctatttaactatccatcatcggattcactctggagaaaagccctatgagtgctcaaaatgcggaaaagtcttttccagaatgtcaaatctgactgtgcattaccggtcccactctggggagaagccttacgagtgtaatgaatgtggaaaggttttcagccagaagtcatacctcaccgtgcattatcggacccatagtggtgaaaagccttacgaatgcaacgagtgcgggaagaagttccaccacaggtctgccttcaactcccatcagcggattcatagacggggaaacatgaatgtactcgatgtagagaatctatag

SEQ ID NO: 20373 - DNA, 732 bp, Artificial Sequence
  Description of Artificial Sequence: Synthetic coding sequence
atgaacaccctgcagggccccgtgagcttcaaggacgtggccgtggatttcacgcaggaagagtggcaacagctggaccctgatgagaaaattacctatcgggacgtgatgttggagaattacagccacttggtgtcagtaggttatgacaccactaagcctaacgttatcattaaactggaacaaggggaggagccatggatcatgggcggagagttcccatgccagcattcacccgaggcctggcgcgtggatgacctgattgaaaggatacaggagaatgaagataaacattcatcacggcctgcaagacggccttgcggaccccggtgctgctgttgctgttgttgcagccggccccctagaagcccccctcccaaaccccttccaaccagaatgctgaccccaagaaaggctttcaggacctgctctaaagagtccgggctggccgagacggagtcctgtggccaaacgcatacttggccccgagccctggctgttcttatgggtttatggtggccccgcgaccagaaagcaggggaggaggaccttaggttccgcgaaaggagaccaggtctgcaggctacggctactgggtcaggcgagcatggcgctttccctgtacacagccaaggggtctgggcaagcacacattggcagggtactgccgtctgccccttacaaacaccaccaccggacgcttttatccgcaacaacaaggtgctgtcatag

SEQ ID NO: 20374 - DNA, 342 bp, Artificial Sequence
  Description of Artificial Sequence: Synthetic coding sequence
atgaacaccctgcagggccccgtgagcttcaaggacgtggccgtggactttacccaggaggagtggcaacagcttgatccagacgagaagattacgtacagggatgtaatgttggaaaactacagtcacttggtcagtgtgggctacgacacaacaaaacctaatgtaattatcaagctggagcaaggcgaggagccatggattatgggaggagagttcccctgtcagcactccccggcggccctgccggccggtcatgtggctcctgctgtcgctgcagccgcagctgcaccaggaagacctggccctcatcgccagtcacgcagccccccgggatgctag

SEQ ID NO: 20375 - DNA, 1554 bp, Artificial Sequence
  Description of Artificial Sequence: Synthetic coding sequence
atggaccccgccggcgccgccgaccccagcgtgccccccaaccccctcacccacctgagtctccaagatcggtccgagatgcaacttcagtcagaggccgatcgccgctccctacccggcacatggacaagaagctcccctgagcacaccactattcttcgaggaggcgtgcggcgctgcctgcagcagcagtgcgaacagactgtgcggatcctacacgcaaaagtggcacagaagagttacggcaatgaaaagagattcttttgcccccccccctgcgtgtacttgagcggccctggctggcgcgttaagccagggcaggaccaggcccaccaggccggcgaaacaggccccacagtttgcggatacatgggactggactccgcttccggctctgctactgagacgcagaagcttaacttcgaacaacagccagattcgagggagttcggttgtgccaagacactctacatttccgacgccgacaagcgcaaacactttcgtcttgtgttaaggttggtgctccggggtgggcgggagcttgggaccttccactccagattgattaaggtgatctcaaagccatcacagaaaaaacagagcttaaagaacaccgacctgtgcatctcaagcggatccaaagtgtctttgttcaaccgactgagaagccaaacggtctccactaggtacctgtcagtggaagacggcgcattcgtggctagtgctagacaatgggcggcctttacactgcacttagcagacggtcattcggcccagggcgacttccccccccgggaaggatacgtacgctacggctctttggtgcaactggtgtgtaccgtgaccggtatcacactgcctccaatgataattaggaaagtcgctaaacagtgcgccctcctggacgtcgacgagccaatcagccagctgcacaaatgcgcatttcagttccccggaagccctcccgggggtgggggcacttatttgtgtctcgcaacagaaaaagtagtgcaatttcaagcctctccctgcccaaaggaagcgaacagagctctccttaatgacagtagctgctggactatcatagggacagagtctgttgagttttctttctccacctctctggcctgtacactagagcccgtaacgccagtaccactgatcagtaccctggagctttccggcggaggcgatgtggccaccctggaactgcacggggaaaactttcacgccggtctcaaggtttggttcggagatgttgaagcagaaacaatgtacagaagcccaagatctctggtttgtgtagtcccagatgtagctgctttctgttccgactggcgctggctgagggctcctatcaccatcccgatgagtctcgtccgggcggatgggctgttttacccgagcgccttttctttcacctacacacctgaatactctgtgcgacctgggcacccaggagtgccagaaccagcaactgacgccgatgcactgctcgagtccattcatcaggagtttacaagaactaatttccacttatttatccagacctag

SEQ ID NO: 20376 - DNA, 1416 bp, Artificial Sequence
  Description of Artificial Sequence: Synthetic coding sequence
atggaccccgccggcgccgccgaccccagcgtgccccccaaccccctaacacacctatctcttcaggaccggagtgaaatgcagctccagagcgaggccgaccgacgctccctgcccggaacttggacccgcagttccccagagcatactacaatcctcagaggtggcgtgcgccgctgcctgcaacaacagtgtgagcagaccgtgcgaatcctgcacgctaaggtggctcagaagagctacgggaacgaaaaacggttcttctgcccacccccatgcgtttatctgtctggccctggttggcgggtcaaacctggacaggaccaggctcaccaggcaggagagactggaccaaccgtttgtggctacatgggcctcgattctgccagcggttccgccacagagacacagaagcttaattttgaacagcagcctgattcacgggagttcggatgcgcaaagacactgtacatctctgacgcagataagaggaagcactttagactcgttcttcgcctcgtcctccgaggaggccgagaactgggaacgtttcattctcggctgattaaggtgattagtaagccgtcacagaaaaagcagagccttaaaaataccgatttgtgcatatcctcgggctccaaggtctcactgtttaatcgcctgcggtcgcaaacggtcagcactcgctacctatccgtagaagacggggccttcgttgctagcgccaggcagtgggcagcattcactcttcatctcgccgatggacattctgcccaaggggactttcctccgcgggaagggtatgtccggtacgggtcactggtgcagttggtttgcactgtgacgggaattacccttcctccaatgatcatcagaaaagtcgccaagcagtgtgcccttttggacgtggacgaaccaatcagccaactgcacaaatgcgccttccagttcccgggctcgccaccaggcggtggtggcacatacctgtgcctggcaacagaaaaggtggtgcaatttcaagcctcaccatgcccaaaagaggcaaatcgcgccctcttgaacgactcctcctgttggacaataataggtaccgagagcgtggaatttagtttctccaccagcctggcttgtacgttggagccggtcaccccggtgcccctgatctcaacgctagagttatccggaggtggggacgtggctaccttagaactacacggagaaaatttccatgccggactcaaagtttggttcggcgacgtggaggccgagaccatgtacaggtacggggtcgaacctgcagtgcctggcgtccgaggagccggaaggggaggtctgctgcaacgactggctctggcagctcgatcacaccacaaccctcatgagccaggggcacggagacgagccctgctgccatag

SEQ ID NO: 20377 - DNA, 1551 bp, Artificial Sequence
  Description of Artificial Sequence: Synthetic coding sequence
atggaccccgccggcgccgccgaccccagcgtgccccccaaccccttgactcatctatcccttcaggatcgctctgaaatgcagttgcagtctgaggcagataggagaagcctgccaggaacatggactcggtccagcccagaacacactacaattctccgtggcggcgtgcgaaggtgcctccagcagcagtgtgagcagaccgtccgcatcctccatgcgaaagtggcgcaaaaaagctacggcaacgaaaaacgattcttctgcccccctccatgcgtttacctgtccggccccggctggcgggtgaaacccgggcaagatcaggctcaccaggctggggagaccggcccaactgtgtgcggctacatgggtctcgatagcgccagtggatctgccactgaaacacagaaactaaatttcgaacagcagcctgattcccgggagtttggatgcgctaaaactctgtatattagtgacgccgataagagaaagcattttaggctggtgttacgcctagtattgcggggcgggcgcgagctgggtacattccacagccgcctgataaaagtaataagcaaaccaagtcagaaaaaacagagtctcaagaatacagatctgtgcatctcttcggggagcaaggtgtctctgtttaatcgcctgcgctctcagacagtttctactagatacctgtcagtcgaggacggcgcatttgtggcaagcgctagacagtgggccgcttttactttgcatctggcagacggtcacagcgcacagggggactttccaccccgggagggatatgtcaggtatgggtccttggtacagctggtgtgtacggtgactggcattactttgccacctatgatcatcagaaaagtggccaagcagtgtgccctcctggacgtagatgagccgatatcccagttacacaagtgcgcatttcagttccccggcagccctccgggaggcggcgggacctatctgtgccttgccaccgaaaaggttgtgcagttccaggcttcgccatgtccgaaagaggccaaccgggccctgcttaacgactcaagttgctggacgattattggcacggaatccgtggagttctccttttcaacttctctcgcatgcacgttggagccagtcacccctgtccccttaatcagcacgctcgagctgagtgggggaggtgacgtcgcaaccctcgaactacacggcgagaatttccacgcgggactcaaagtgtggtttggagacgttgaagctgaaacgatgtatagcccgagatcgttggtgtgtgtggtaccggacgtagctgccttctgctctgattggcgatggttacgggcccctatcactattcccatgtctctggtaagagccgacgggcttttttacccaagtgccttttccttcacatacacccccgagtatagcgtaagacctggacatccgggcgtgccagagcctgccactgacgccgatgccctgttggagagtatacaccaggaatttactagaaccaattttcatctttttatacaaacctag

SEQ ID NO: 20378 - DNA, 2124 bp, Artificial Sequence
  Description of Artificial Sequence: Synthetic coding sequence
atgcagaccagcgagaccggcagcgacaccggcagcaccgtgaccctgcaaacaagcgtggcctcccaggccgctgttccaacccaagttgtgcagcaagtaccggtgcagcagcaggttcaacaggtgcaaaccgtccaacaagttcagcatgtgtacccggcacaggtgcaatatgtggagggctccgataccgtctatactaatggagccatcaggacaaccacgtatccttatactgaaacccaaatgtattcgcagaacaccgggggtaattacttcgatacccaggggtcctcggctcaggttaccacagtggtgagcagccactctatggtgggcaccgggggcatccagatgggggtgaccggaggacagctgatttcaagttctggggggacatacttaattggaaacagtatggaaaattctggacatagcgtcactcacaccactcgggcttctcctgcgactatcgagatggctattgagacactccagaagagcgacgggctttcaacgcataggtcgagtctcctgaattcccacttgcaatggctgctggacaactacgagacagctgagggggtgagcttgcctcgtagcactttatataatcattatcttagacactgtcaggaacataagcttgacccagttaacgccgcatccttcggcaagttgattaggtcaatttttatgggtcttcgtactaggagactgggaactagaggtaactcaaaataccattactatggtatccgagttaagccggattcaccgttgaacaggctgcaggaggacatgcaatatatggcaatgcgccaacagcccatgcagcaaaagcaaagatacaagcccatgcaaaaagtagatggcgttgccgacggctttacaggaagcggccagcagacgggtacttctgtagagcaaaccgtgattgctcaatcacaacatcaccagcagttccttgatgcttctagggcccttcccgagttcggggaggtggagatctctagtctgcccgacggaactacttttgaggatataaagtccctacagagcctctatcgagaacactgtgaagccattctggatgtcgtggtgaacttacagttttctttgatagaaaagctgtggcagactttctggaggtactctccttctacccccaccgatgggaccactatcactgaatccagcaacctgtcggagatcgagtcaagactgcccaaggccaaactgatcacgttatgcaaacacgagagcattctcaagtggatgtgcaactgcgaccacgggatgtaccaagcgctcgtggagattcttatcccagatgtgctccggccaatcccatcggccctgacccaggcgatccgcaatttcgcaaaatcactcgagggctggctgagcaacgcaatgaataatatccctcaaaggatgatacagacaaaagtggcggcagtttccgctttcgcgcagacactgagacgctacacctctctgaatcacctggctcaggccgctcgggcagtattacagaatacgtctcaaatcaatcaaatgctgtccgatcttaatagagttgacttcgccaatgtgcaggaacaagccagttgggtgtgccagtgcgacgacaacatggtgcagagactggagactgatttcaagatgacacttcagcagcagtctactctcgaacagtgggctgcctggttagacaacgtaatgatgcaggccctgaagccctatgaagggcgaccgtcctttccaaaagccgcccggcagttcctcctcaagtggagcttttactcctccatggtgatccgagacctcacactgagaagcgctgccagtttcgggtccttccatttaattagattactgtatgatgaatatatgttctacctggtcgagcaccgggtcgcccaggccacaggagagacacccatcgccgtcatgggcgaggttcgggaagccgagcgcgctgtgacccactgggtgatcaagaataagcccgaactccacttcagccttaacaccctgctcatcaagactatggtgcctaaccaggtgtctctgcgggcacgccgcgactgtggcgtgatcgcacgcgtgccatag

SEQ ID NO: 20379 - DNA, 2124 bp, Artificial Sequence
  Description of Artificial Sequence: Synthetic coding sequence
atgcagaccagcgagaccggcagcgacaccggcagcaccgtgaccctccagacctctgttgcatcccaggccgctgtgccaacccaagtggttcaacaggttcccgtccagcagcaggtgcaacaggtgcaaactgtgcagcaggtacagcacgtctacccagcccaagtccagtacgtggagggctctgacacagtgtacactaacggggcgatcaggaccaccacttatccatatactgaaacccagatgtactctcagaacacaggaggcaattacttcgacacacagggctcaagtgcccaagtgactaccgtggtgagctcacattccatggtagggacggggggaatccaaatgggtgtgacaggaggacaactcatctcatccagtggcggtacgtacctgataggcaacagtatggaaaacagcggccacagtgtgacccataccactagggcatccccagcgaccatcgagatggccattgagacactgcagaaaagcgacggcctgagtacccaccgctcttcactcctgaattcccatttgcagtggctgctggataactatgagaccgcagaaggagtatccctgccccgcagcaccctttacaatcactacctgagacactgtcaggaacacaaattggatcccgtgaatgccgcaagctttgggaagcttatccgtagtattttcatggggctcagaaccagaagacttggcacgaggggaaatagcaagtaccactactacgggattcgagttaagcctgactcccctctcaaccgcctccaggaagacatgcagtatatggccatgcgccagcaacccatgcagcagaagcagagatacaagccaatgcaaaaagtggacggcgtggctgatgggttcaccgggtctgggcagcaaaccgggaccagcgtagaacagaccgtaatagcacaatcccagcatcatcagcaatttcttgatgctagccgggccctcccagaattcggtgaggtggagattagctccctgccagatggtactacattcgaggatataaagtccctccagtctctatatcgtgagcattgcgaagccatactcgatgtcgtcgttaatcttcagtttagtctcatcgagaaactttggcagaccttttggcgctatagcccatcaaccccgacggacggcaccaccatcacggagagcagtaatctctctgagattgagagcagactgccaaaggccaagctgatcactctctgtaagcatgaaagtattctaaagtggatgtgcaactgtgatcatggcatgtaccaggcattagtagagatcctcatccccgacgtgctaagaccaataccatctgcgctgacacaagccatcaggaacttcgctaaatcactggagggctggttgtccaacgcaatgaataatatcccacagcgcatgatccaaaccaaagtcgctgctgtgtcagctttcgcccagacactgaggcggtacacctctctcaaccaccttgcccaggcggcccgggccgtcttacagaacacgtctcaaatcaatcagatgctctccgacctgaaccgtgtggatttcgctaatgttcaggagcaggctagttgggtgtgccagtgcgacgataacatggttcaacgcctagaaactgacttcaaaatgactcttcaacagcaaagcaccctcgaacaatgggctgcttggctggacaacgtcatgatgcaagctctgaagccctatgagggcaggccatcatttcccaaggctgcaaggcaatttctgctcaagtggtcattctattccagcatggttatacgcgacctaactctccgttcagcggcaagcttcggctcattccacctgataaggctgctgtacgatgaatacatgttctatctggtcgaacatagagtggcccaggctaccggcgaaaccccaatcgccgtaatgggcgaagttagggaagccgagagggcagtgacccattgggtgatcaagaacaagcccgagctgcactttagcctgaataccctcctgatcaagaccatggtgcccaaccaagtttctctgcgagccaggagagactgcggggtcattgcccgtgttccctag

SEQ ID NO: 20380 - DNA, 258 bp, Artificial Sequence
  Description of Artificial Sequence: Synthetic coding sequence
atgcagaccagcgagaccggcagcgacaccggcagcaccgtgaccctgcagactagcgtcgcctcgcaagcagcagtgccaactcaagtggtgcagcaagtgcctgtgcagcaacaggtccaacaagtgcaaacagtgcagcaagtccagcacgtctacccggcacaagtccaatacgtagaggggtcagacactgtttacactaacggagccatgtctagagctccatggtccatgatcctggagtcttcgccatag

SEQ ID NO: 20381 - DNA, 588 bp, Artificial Sequence
  Description of Artificial Sequence: Synthetic coding sequence
atgcagaccagcgagaccggcagcgacaccggcagcaccgtgaccctccagacgtctgtggcttcacaagccgcagtccctacacaagtcgtgcagcaagttccagtgcagcagcaggtacagcaagtgcagacggtgcagcaggtccagcacgtgtatcccgcacaggtccagtacgtcgagggttcagatactgtttacactaacggcgctattagaaccaccacttatccgtacactgagactcaaatgtacagccagaacaccggagggaattatttcgacacccagggctcaagtgctcaggtgaccacagtggtgtccagtcactccatggtgggcactggcggcatacaaatgggtgtgactggtgggcaactgatctccagttctgggggtacctatcttattggcaactctatggaaaactctggtcacagtgtgactcatacaacccgcgcctctcccgctactgcgaattcagtgcctgaaatgaaactcctgcgccagatcacaatgaatcgactattcccaacattgaatcacaaactgactgaggggtcaggaccccacttccagtcgatttag

SEQ ID NO: 20382 - DNA, 417 bp, Artificial Sequence
  Description of Artificial Sequence: Synthetic coding sequence
atgctgagcgacctgaaccgggtggacttcgccaacgtgcaggagcaggccagttgggtgtgccagtgtgacgataatatggttcaaaggctggaaactgacttcaagatgacattgcagcagcaaagtaccttggagcagtgggctgcttggttagataacgtcatgatgcaggctctcaaaccctacgagggccgtccatcgtttccgaaagccgctcgacagttccttctcaagtggtccttctattcctccatggtgatcagggacctgactctgagaagtgctgcttcttttggttccttccatctcatcaggttgctctatgatgagtacatgttttacctggtggagcacagagttgcgcaggcaacaggggagaccccaattgctgtcatgggcgaggtcccgatgtag

SEQ ID NO: 20383 - DNA, 651 bp, Artificial Sequence
  Description of Artificial Sequence: Synthetic coding sequence
atgcagaccagcgagaccggcagcgacaccggcagcaccgtgaccctccagacttctgtggcatcccaagccgccgtgcccacccaggtcgtgcaacaagtgccagtgcaacagcaggtccaacaggttcagaccgtgcaacaggtacaacacgtatatccagcacaggtacaatacgtcgagggttcagacacggtgtatactaatggcgcaattcggacaactacatacccatacaccgagacacagatgtatagtcagaatacggggggcaattatttcgatacacaggggagtagcgcacaggtgactactgtcgtctccagccactccatggtgggcaccggaggcattcaaatgggtgtcacgggtgggcagttgatttcctcttcgggcggtacatacctgatcggtaattctatggagaactcggggcattcagtgacacacactacacgggccagtcctgccaccctgcagtggttgttagataactatgagacggccgaaggggtgtccctccctaggagtacgttgtataaccattatctgcggcattgtcaagagcataagttggaccccgtaaatgccgcgagctttggcaaactcatcaggtctatctttatgggcctgagaacacggcgactctag

SEQ ID NO: 20384 - DNA, 2250 bp, Artificial Sequence
  Description of Artificial Sequence: Synthetic coding sequence
atgcagaccagcgagaccggcagcgacaccggcagcaccgtgaccctgcagacaagtgtcgcgagccaggctgccgtgcccacgcaagtcgtgcagcaggtgcccgtccagcagcaggtgcagcaggttcagactgtccaacaggttcaacacgtctatcccgcccaggttcagtacgtggaaggttccgacacagtctacacaaatggagctatccgcactaccacctacccctacaccgaaacgcagatgtattctcagaatacgggaggcaactactttgacacccaaggtagctccgctcaggtgactaccgtggtgtcctcccatagcatggtcggcactggcggtattcagatgggggtcactggtgggcaattgattagctcgagcggcgggacatatttaatcggcaattcaatggaaaattctggtcattccgttacccatacaacccgggctagccccgcgaccatagaaatggccatcgagacattgcagaagtccgatggactgtctacccaccgcagcagtctgctgaactcccatctccagtggctcttagataactacgagacagccgaaggagtgtcgctgcctcggtctacactgtataatcattatctgagacactgtcaagaacacaaattagatcctgtgaatgctgcctctttcggtaagttgattcggtctatttttatgggcctccgcaccaggagacttggaacacgcgggaactctaagtatcactactacggaattagggttaagcccgactcaccactcaacagattgcaagaggatatgcaatatatggccatgcggcaacagccaatgcagcagaagcagagatataagcccatgcagaaggtggatggagtcgcggatgggttcaccggctctggccagcagactggcactagcgtggagcagacagtcattgcccaatctcaacaccaccaacagttcctggatgcgtctcgcgccctcccagaattcggggaagtggagatttcctctctgcccgatgggaccacttttgaggacatcaaatcgcttcagagcctgtaccgggagcactgcgaagcgatcttggacgtagtagtgaatttacagttttctctgatcgaaaagttgtggcagaccttttggcgatattcacctagcaccccaaccgacggcacgacaattacagaatcctctaatttgtctgagatcgagtcacggctgcctaaagccaaacttatcactctctgcaaacatgaaagcattctcaagtggatgtgcaactgtgatcatggcatgtatcaggccctggttgagattctgattccagatgtccttcggcctatcccctcagcattaactcaggccatccgcaattttgcaaagagtcttgaaggctggctatcgaatgccatgaataacatcccacagcggatgatccagaccaaggtggcggccgtgtctgcgttcgctcaaaccctccgacgctacactagcttaaatcatctggcccaggccgctcgcgcggtgcttcagaacacttcccagataaatcaaatgctctcagaccttaatagggttgattttgccaatgtccaagaacaggcatcatgggtttgtcagtgcgatgacaacatggtgcagcgcttagaaactgattttaagatgacgctccagcagcagtccaccctggaacaatgggcagcttggctggataacgtgatgatgcaggctctgaaaccatatgagggtcggccttcctttccaaaagctgcacgccagttccttctcaagtggagtttctactcgtctatggtcataagagatctgactctcagatctgctgccagtttcggaagcttccaccttattagactgttgtacgatgagtatatgttctacttagttgagcacagagttgcacaggcaacgggggagaccccaatcgccgtgatgggggagttcggtgatctgaacgctgtcagcccgggaaatctggacaaggatgaaggttcagaggtggagtctgagatggacgaggagttagacgactctagcgaaccacaggcaaagagggagaaaacagagctatcccaggcatttccagttgggtgtatgcagcctgtgctggagaccggagttcagccctccctgctcaaccccatccactcagagcatattgttaccagcacccagactatcaggcagtgctcagctactggcaatacttataccgcagtttag

SEQ ID NO: 20385 - DNA, 471 bp, Artificial Sequence
  Description of Artificial Sequence: Synthetic coding sequence
gtgcagcaggtgcagaccgtgcagcaggtgcagcacgtgtaccccgcccaagtgcagtatgtggagggtagcgatactgtctataccaacggcgcaatacggactacaacctacccttacacagagacgcagatgtacagccagaacaccggtggaaactatttcgatacccaaggatccagtgcccaagttaccacggttgtgagcagccattccatggtggggaccggaggaatccagatgggggttacagggggacaactcatctcttccagcggtggcacctatttgataggcaactctatggagaactccggccactccgtcacgcacacaactcgcgcttccccagccactgctaactcagtcccagaaatgaagttgttgcgccaaatcacaatgaaccggctcttcccaacgctgaatcataagttgacagagggcagtggcccacacttccagagcatatag

SEQ ID NO: 20386 - DNA, 408 bp, Artificial Sequence
  Description of Artificial Sequence: Synthetic coding sequence
gtgcagcaggtgcagaccgtgcagcaggtgcagcacgtgtaccccgcccaggttcaatacgtggagggctccgacacagtctacacaaatggggccattaggacaaccacttacccgtataccgagacacagatgtactcacagaatactggcggcaattatttcgacacgcagggcagcagtgctcaggtaacgaccgtggtgagcagccactctatggtaggcaccggaggcatacaaatgggcgtcactgggggtcaactaatatccagtagcggagggacctacctcattggtaactcaatggaaaattccggacattcagtcacccatacaaccagagcctcaccagcaacattattcttattcagctgcgtcccattcagcctgggtcagctgtccccctag

SEQ ID NO: 20387 - DNA, 417 bp, Artificial Sequence
  Description of Artificial Sequence: Synthetic coding sequence
atgcagaccagcgagaccggcagcgacaccggcagcaccgtgaccttgcagacatccgtggcctcacaggctgccgttcccacacaggttgtgcagcaggtgccggtgcagcagcaagtgcagcaggtgcagacggtacaacaggttcagcacgtttaccccgcccaggtccagtacgtggagggcagtgatactgtctatactaatggtgccattcggacaaccacttacccttacacagagacccagatgtacagccaaaacaccggcggtaactacttcgatacacaggggtcaagcgcacaggtcactactgtagtatccagtcactcaatggtgggaactggaggaatacagatgggggtgaccggcgggcagcttatatcaagtagcgggggcacttatctcatcggttag

SEQ ID NO: 20388 - DNA, 375 bp, Artificial Sequence
  Description of Artificial Sequence: Synthetic coding sequence
gagcaggccagctgggtgtgccagtgcgacgacaacatggtgcagcgcctagaaacggacttcaagatgacactacaacaacagagcactctcgaacagtgggcagcatggctcgacaatgtgatgatgcaagccctcaaaccatacgaaggtaggccttcgttccctaaggccgcccggcaatttctactaaagtggtctttctattcatccatggtgatcagggacttgacattaaggagcgccgcctcattcggttcattccatcttatcagactcctgtatgacgaatatatgttctatctggtcgagcacagggtagcacaggcaactggcgaaactccgatagcggtaatgggagaagtgccaatgtag

SEQ ID NO: 20389 - DNA, 555 bp, Artificial Sequence
  Description of Artificial Sequence: Synthetic coding sequence
atgcagaccagcgagaccggcagcgacaccggcagcaccgtgaccttgcagacgtcggttgcctcgcaagcggccgtgccaacacaagtggtgcagcaagtgcctgtgcagcaacaggtgcaacaggttcagaccgttcaacaagtacagcacgtgtatcccgcacaagtgcagtatgtagagggatctgataccgtgtacactaatggagccatccgaacaactacttacccttacacagagacacagatgtactcccaaaacacaggcgggaattactttgacacacaggggtcatccgcgcaggtcactactgtggtctcctcccactcgatggtaggcacaggggggattcagatgggcgtgacagggggacagctgatttcctcctcaggcggtacatacctcataggcaattcgatggagaacagcggccattctgtgactcacactacaagggcttcccccgccacaatagagatggccattgaaaccttgcagaaatccgacggcctgtcgactcacagaagctccttacttaactctcacgtgtag

SEQ ID NO: 20390 - DNA, 651 bp, Artificial Sequence
  Description of Artificial Sequence: Synthetic coding sequence
atgcagaccagcgagaccggcagcgacaccggcagcaccgtgaccctacagactagtgtcgcttcccaagccgccgtcccaactcaggtcgtgcagcaggtccccgtgcaacagcaggtgcaacaggttcaaactgtgcagcaggtgcagcacgtataccccgcccaggtgcagtatgtcgagggctcagatacagtgtacaccaacggtgcaatccgtactaccacctatccttatacagaaacccaaatgtattcccagaataccggcgggaattatttcgatacccaaggaagctcagctcaagtgaccaccgtggttagcagccactccatggtgggcacaggcgggatacagatgggcgtgaccggtggccagcttatctcttcatctgggggcacgtatctgattgggaacagtatggaaaacagcggtcactcagtgacacacacaacgcgagctagtccagccactttgcaatggctgctggacaattacgaaacggccgaaggggtgtcccttccaaggagcaccctctataatcactacttgcggcattgtcaggaacacaagctcgatccggtcaatgcggccagcttcggtaagctcattcgcagcatttttatgggcctaaggacgcgccgactgtag

SEQ ID NO: 20391 - DNA, 525 bp, Artificial Sequence
  Description of Artificial Sequence: Synthetic coding sequence
atgtgcaactgcgaccacggcatgtaccaggccctggtggagatcctgattcctgacgtactcagacccatcccatcggctctgactcaggccatccgaaactttgcaaagtcacttgagggctggctttcaaacgccatgaataacatcccccaaaggatgatccagacaaaggtggccgccgtgagcgcctttgcgcagaccctgcgacggtacacctcacttaaccacctggcccaggctgctcgagcggtgctgcaaaatacctcacagatcaatcaaatgctcagcgaccttaacagggtggactttgccaatgtgcaggaacaagcctcctgggtctgccaatgcgacgacaatatggtccagcgtcttgaaacggatttcaaaatgacattacagcagcagagcaccttggagcagtgggccgcgtggctggacaatgtgatgatgcaagccctaaaaccttatgagggtcggccctcatttccaaaagcggctaggcaattcctactcaagtggtag

SEQ ID NO: 20392 - DNA, 330 bp, Artificial Sequence
  Description of Artificial Sequence: Synthetic coding sequence
atggccgtggtgggcgtgagcagcgtgagccggctgctgggccggagccgcccacaacttggtaggccgatgagcagcggagcccacggcgaagaagggtcggcacggatgtggaaaaccctgactttctttgttgcccttcccggcgttgctgtcagtatgctcaacgtatatctgaaatcgcatcatggagagcacgagcgccccgagtttatcgcctatccccatttgaggattaggacgaaacccttcccctggggtgatggtaatcacaccctgttccataatcctcacgtgaaccccctcccaactggctatgaggatgagtag

SEQ ID NO: 20393 - DNA, 2235 bp, Artificial Sequence
  Description of Artificial Sequence: Synthetic coding sequence
atgatcaagcggcgggcccaccccggcgccggcggcgaccggaccagacctagacgtagacggtccacagaatcctggattgaaaggtgcctgaacgagtccgaaaacaagaggtatagcagccacacctctctcgggaacgttagcaatgatgagaatgaggaaaaggaaaacaatcgggcatctaaaccccactctacacctgcaaccctgcagtggttggaagagaattacgagatcgcagagggcgtgtgcattcccaggtcggccctgtatatgcattatctggatttctgtgagaagaatgatactcagccagttaatgctgccagctttggaaaaattatcaggcagcagtttcctcaactgacaacaaggagacttggtacgcgtggccagtccaagtaccattattacggcattgctgttaaagaatcatcccagtattacgacgttatgtactccaagaaaggagctgcctgggtgagcgaaaccgggaagaaagaggtttccaagcagaccgtcgcctactctcccaggtctaaactaggaacactgcttccggagttcccaaacgtgaaggacctgaacctcccagctagcctaccggaggaaaaggttagtaccttcatcatgatgtatcggacgcactgccagaggatcctagatacagtaatacgggccaatttcgacgaggtgcagagcttcctgctgcacttctggcagggcatgccacctcacatgttaccagttttagggagcagcacagtggttaatatcgtcggcgtttgtgacagcatcttgtataaagccatttccggggtgctcatgccaaccgtactgcaagccctgcccgattcccttactcaagtgatacgcaaattcgcaaaacagctagacgaatggctgaaggtcgccctacatgatctgccggagaatctgcggaacatcaaatttgagctaagccgcaggttttcccagatactgcggaggcagacaagtctgaaccacctctgtcaggcttcccggactgtgatccattcagccgatataacatttcagatgctagaggattggcgtaatgtcgatctgaattctatcactaagcagacgctgtacacaatggaggactctcgagacgagcatcgtaagctcatcacacagctttatcaggagttcgatcacttgctggaagagcaaagccccattgaatcatatattgagtggctggacacaatggttgatcggtgcgtggttaaagtggcggccaagcgccagggttctttgaagaaggtcgcccagcagtttctgttgatgtggtcctgcttcggaactcgtgtcatccgcgacatgacactgcattctgctccttcattcggctcttttcacctgattcatcttatgtttgacgactacgtcctttatttgttggagagtctgcactgccaggaacgcgccaatgagctaatgcgcgctatgaaaggcgaaggatctaccgctgaagtgagggaggagatcattcttactgaggccgctgcccctacacccagtccagtccccagcttttcacctgccaaaagcgcgacatcagtggaagtgccacctccctctagtccggtcagcaacccttcccccgaatacaccggcctgagcaccaccggcgctatgcagagttatacatggagtcttacctataccgtcaccactgcagctggcagcccagcggaaaattcgcaacagctaccatgtatgcgtaacacacacgtgcccagcagctccgtaacacatcgcattcccgtctacccccaccgggaggaacacggatacacgggcagctacaactacggctcctacggaaaccaacatccccatcccatgcagtcgcagtaccctgcattacctcacgataccgcgatctccggaccccttcattatgccccctaccaccgctcttcagcccagtatcctttcaacagtccaacaagtagaatggagccctgcctgatgtccagcacgcctagactgcatccgacccctgttactcccagatggcccgaagtgccatccgccaacacctgttacacgagtcccagtgtgcacagtgcccggtacggaaattcctccgacatgtataccccactgacaactcgtcgtaactcagagtacgaacatatgcaacatttccccggtttcgcatacatcaatggcgaggccagcaccggatgggccaagtag

SEQ ID NO: 20394 - DNA, 2208 bp, Artificial Sequence
  Description of Artificial Sequence: Synthetic coding sequence
atgcactgcggcctgctggaggagcccgacatggacagcaccgagtcttggatagagcgatgcttgaacgaatccgagaacaaacggtactcatctcacacatctctgggcaatgtctcaaacgacgagaacgaggaaaaggaaaacaatcgggcttccaaaccccactcaaccccagccactttgcagtggctcgaagaaaattacgaaattgccgagggggtttgtatcccaagaagcgccttgtatatgcactacctagacttttgtgaaaaaaatgacacacagccagttaacgccgcaagtttcggaaagattataaggcagcagtttccccagctcaccaccagacgcttgggaacaagggggcaaagtaagtaccattattatggcattgccgttaaggaatctagtcaatattacgatgtaatgtactctaaaaaaggggcagcttgggtcagcgaaacaggaaagaaagaagtgagcaagcaaaccgtggcatattctcccaggagtaaacttgggactttgctgccagagttcccgaatgtgaaggacctgaacttacccgcctcactgcctgaagaaaaggtgtccacatttataatgatgtaccgcacacattgtcaacggattctggacactgtcatcagagctaactttgacgaagtgcagagcttcctgcttcatttttggcagggcatgccaccccacatgttgccggtgctaggaagcagcacggtagtgaacatcgtcggcgtgtgcgactcaattctgtacaaagccatcagcggtgtccttatgcccaccgttcttcaggctctccctgattccttaacgcaggtgattcgaaagttcgctaagcaactggacgagtggctgaaagtggccctgcatgacctgcctgaaaatttgcgaaacatcaaattcgagctttccagaagattctctcagattctcaggcgccagacaagcctcaatcatctttgccaagcatctcggacagtcatccattccgctgacataacattccagatgctggaagattggcgaaacgtggacctgaactctattacaaaacaaacactctatacgatggaggactccagggatgaacaccgcaaactaatcacacaactgtaccaagagttcgaccacttgctggaagagcagtcccctatcgagtcatacattgagtggctggacaccatggttgaccgctgcgtggtcaaggtcgcggcaaagaggcagggcagtctgaaaaaggtcgcacagcagttcctgctcatgtggtcatgcttcggtacccgggtcatccgagacatgacattacatagcgcccccagtttcggatcctttcacctgatacatctcatgtttgacgattacgtgctctacttgcttgaatctctccactgtcaggaaagagcgaacgaactgatgagagcaatgaagggtgagggatccaccgctgaagtgcgggaagagatcattctgacagaggcagctgccccgacccctagcccagttccttccttctctcctgctaaatccgccacctctgtcgaagtgcctccacctagttctcccgtaagtaatccaagccctgaatatacaggactgagcaccacgggagcaatgcagtcatacacctggtcactaacctacacggtaaccaccgctgctgggtcccccgccgagaattcgcagcagcttccctgtatgcgtaatacacatgtgccgagctcttccgttacccatcgcattcctgtgtatcctcacagggaagaacatgggtacactgggtcctataactatgggagttacggtaatcaacatccccatcccatgcagtcacaataccctgctttaccgcacgacacagctatcagcgggccgttgcactacgccccttatcatcgttcttccgctcagtacccttttaattcaccgacctcacgcatggagccctgcctgatgtcttccaccccacgactccaccctacgcccgtgaccccgagatggccggaggtgccctcagccaatacatgctacacctctccaagcgtgcatagcgctaggtacgggaactcgtcggatatgtatactcccctgacaactcgccgaaacagcgaatacgaacacatgcagcacttccctggtttcgcttacatcaatggagaagccagtaccggatgggccaaatag

SEQ ID NO: 20395 - DNA, 1761 bp, Artificial Sequence
  Description of Artificial Sequence: Synthetic coding sequence
atggccgagggcgtgcccgccagccccagcagcggcgagggcagccggggcccccacagtggcgttattcagtggttggtagataatttttgtatatgtgaggagtgcagcgtcccccgatgtctgatgtacgagatttacgtggagacttgtggacagaacactgaaaaccaagtgaatccagcaacttttggcaagctggttcgacttgtatttcccgatctgggaacaaggcgtctggggacgcggggatccgctcgctaccactacgacggcatatgcatcaaaaaaagctctttcttttacgcccagtattgctaccttataggggagaaaagatatcactctggagacgccatcgcattcgagaaatccaccaattataactcaatcatccagcaggaagctacttgcgaggaccattcacctatgaaaacggaccccgttgggtcacctttatctgaattcaggagatgtccgttcttagaacaagagcaggctaaaaagtactcctgcaacatgatggccttcctggccgatgaatactgcaactattgtcgcgacatcctgcggaacgttgaagacttactcacgagcttctggaagagtctacagcaggacacagtcatgctcatgtccttgcccgacgtttgtcagctcttcaagtgctacgatgtgcagttgtacaagggaattgaggacgttttacttcacgacttcctggaggatgtaagcattcagtaccttaaatccgtgcagctgtttagcaagaagttcaagctgtggctgctcaatgcactcgaaggagtgcccgccctcctccagatttctaaactaaaggaggtgacacttttcgtgaagcgtctccgccgaaagacctacctttcgaatatggctaaaaccatgcgaatggtgctgaagtccaagcggcgcgtaagcgtgctgaagagcgacttgcaggccattataaatcagggtaccttggctaccagcaagaaagctctggcaagcgatcgatccggggcggatgagctggaaaacaatcctgagatgaaatgcttgagaaacctcatctcactgttgggaacatctaccgatttgagggtgtttctttcctgcctgagcagccatctccaagccttcgtcttccagacaagccgtagcaaggaagaatttacaaagctcgcggcaagctttcagctccggtggaacctcctgttaaccgctgtgtccaaagccatgaccctgtgccatcgtgactctttcgggtcatggcatctgttccaccttcttttgctggagtacatgatacacatcctgcagtcgtgtcttgaagaggaagaggaagaagaggacatgggaaccgtcaaggaaatgttgcctgacgatcccactctgggacaaccagatcaggcgctgtttcacagcctgaacagctctctcagtcaggcctgtgcaagtccctccatggagcctctgggagtgatgccaactcacatgggtcagggacggtaccctgtgggcgttagcaatatggtccttagaatacttggatttctagtggacaccgccatggggaacaagctcatacaggtactcctcgaggatgagacaacagaatcagctgtcaagctatccctgcctatgggccaagaggccctaatcactctgaaagatggccagcagttcgtgatccagattagcgatgtaccgcaatccagtgaagacatatacttccgggagaacaatgccaacgtgtag

SEQ ID NO: 20396 - DNA, 1422 bp, Artificial Sequence
  Description of Artificial Sequence: Synthetic coding sequence
atgtacgagatctacgtggagacctgcggccagaacaccgagaaccaagtcaatcccgccaccttcggaaagtgtgaggatcattcccccatgaagacagacccggtcgggagtcctttgtccgaatttagacggtgcccatttttggagcaggagcaggcgaaaaagtatagctgcaacatgatggccttcttggccgatgagtattgcaactattgcagagatattctacgcaacgtagaggacctgttgacatccttttggaagtcacttcaacaggacacagtgatgcttatgtccctcccagacgtctgccagctgtttaagtgttacgacgtgcagctgtacaaggggatcgaggacgtgttgctgcatgatttcttggaggatgtgtctatccagtacctgaaatctgtgcagcttttttctaaaaaatttaaattgtggctgctaaatgccctcgagggcgtccctgccttgctgcaaatttccaagcttaaagaggttacgttgtttgtcaagaggctgcggagaaaaacttacctctcaaacatggccaaaacaatgcggatggtcctgaagtccaagaggcgggtgagcgtcctcaagtcagatttacaggcaatcataaaccaggggaccctggccacctccaaaaaagccctggctagcgatcgttccggggctgatgaattggagaacaaccccgaaatgaagtgtcttaggaacctgataagcctgttgggtactagtacagacttgcgggtttttctctcctgtctcagttcacacttgcaggcattcgtctttcagacatctagatcaaaagaggaattcacaaagctcgcggcttccttccagctgcgctggaacttactgctcaccgccgtttcgaaagcaatgactttatgccacagagattcattcggatcctggcatctatttcatctactcctacttgagtatatgattcacatactgcagagctgtctcgaggaggaggaagaggaggaagacatgggcacagtcaaagaaatgcttcccgacgaccctactttgggccagcctgatcaggctctctttcattccctgaatagtagcctttcccaggcttgtgcctcaccttccatggaacccctcggagtgatgccaacacacatgggccaggggcggtaccctgtaggggtgtccaacatggtcctcaggatcttggggttcctcgtagatactgccatggggaataagctaattcaggtgctcctggaagatgaaacaaccgagagcgcagtgaaattgtcgctgcctatgggtcaagaggctctgatcaccctgaaggatggccaacagtttgtgatccagatttcagacgtgccccagtcgagcgaagacatctattttcgcgagaataacgccaatgtgtag

SEQ ID NO: 20397 - DNA, 138 bp, Artificial Sequence
  Description of Artificial Sequence: Synthetic coding sequence
atgtacgagatctacgtggagacctgcggccagaacaccgagaaccaagtcaatcctgcaaccttcgggaagatggcatttctggccgatgagtattgtaattactgccgtgacatcctccgcaacgtgaggaactag

SEQ ID NO: 20398 - DNA, 1704 bp, Artificial Sequence
  Description of Artificial Sequence: Synthetic coding sequence
atgctggagcggcggtgccggggccccctggccatgggcctggcccagccacggctgctgtcaggccctagccaggaatcaccacagaccctgggcaaagagtccagaggcttaagacaacaggggacatcagtggcgcaatcgggcgcacaagcccccggccgcgcccatagatgtgcccattgtaggcgtcacttccccggctgggtggcgctgtggctgcataccaggcgatgccaggctcgccttccactgccttgtccggagtgcgggaggaggtttaggcacgcacctttcctcgccctccataggcaggtgcatgcagcagctactcctgatcttgggttcgcatgccatctctgtggccaatccttcaggggatgggtggcgctggtgctccatctccgggcccattccgctgcaaaaagaccaattgcgtgccctaagtgcgaaaggcgattttggcgacgcaaacaactgagagctcatctgcgacgatgtcatccgccagcccccgaagccagacctttcatctgcggaaactgcggccgcagcttcgcccaatgggatcaattggtggctcacaagagagtgcacgtcgccgaggccctggaggaggcagctgcaaaagccttgggcccaagaccccggggcagacctgctgtcaccgcccctcgtcctggaggcgacgccgtggacagaccgttccagtgcgcgtgttgtggcaagcgattccgtcataagcccaatcttatcgctcatagaagggtgcacaccggcgagcggccacaccagtgccccgagtgtggcaagagattcaccaataagccctatcttacaagtcatcgaagaattcacacaggagaaaagccatacccctgcaaggaatgcggcagacgcttccgccacaaacccaatcttcttagtcactcaaaaatccataaacgaagcgagggatctgcccaggctgctcccggccctggttctccccaactccccgccggacctcaggagtcagccgctgagcccactccagccgtgccacttaagcccgcccaggagcccccacccggtgcacctcccgagcacccacaagatccaatcgaggctcctccctctctgtatagctgcgatgactgcggcaggtcatttcgactcgagaggttcctccgggcacaccagcgtcagcatacaggagaacgtcccttcacatgcgccgagtgcggaaaaaattttggaaagaagactcacctggtggcccacagtagagtgcacagcggcgaacggcctttcgcctgcgaagaatgcggaagaaggttcagccagggatctcatctcgctgctcacaggcgggatcacgcccccgaccggccctttgtgtgcccagattgcgggaaggctttcaggcataaaccttacttggctgcccaccgccgcattcacactggcgaaaagccctatgtgtgccctgactgcggcaaagcctttagccagaaatctaatctcgtgtcccataggcgaattcataccggagagcggccatacgcctgcccagattgtgataggagcttcagtcaaaaatccaacttgatcacacacaggaagagccatatccgcgatggagccttctgctgtgcaatttgcggacaaacatttgacgacgaagagcgcctacttgctcaccagaagaagcacgacgtctag

SEQ ID NO: 20399 - DNA, 1704 bp, Artificial Sequence
  Description of Artificial Sequence: Synthetic coding sequence
atgctggagcggcggtgccggggccccctggccatgggcctggcccaaccacgcctgctgtctggcccttcacaggaatcccctcagacgcttggcaaggagagcagaggcctgcgccaacagggtacctctgtagcacagagtggcgctcaagcacctggaagagcgcatcgttgcgcacactgccgccggcacttcccggggtgggttgcactgtggttgcacactagacgttgtcaggctagattacctctgccttgcccagagtgcgggaggcgcttccgtcacgccccctttcttgcgttacatcgtcaagttcacgcggccgccacacccgacttgggttttgcctgccacctgtgtgggcagtccttccgcggatgggttgcactggtattgcaccttagagcccactccgccgctaagagacctatcgcgtgtccaaaatgtgaacggaggttctggcggcggaaacagctgagagcacacctgcgacggtgtcacccccctgccccagaggctagaccattcatctgcgggaactgcggaaggtcctttgcgcagtgggaccaactggtggcccataagagagtacatgtagcggaggctttggaagaagcagcagctaaagcccttggcccccggccgagagggcggccagctgtgacggcgccgagacccgggggcgacgctgtcgatcgccccttccagtgcgcctgttgtggcaagagattccggcataagcccaacttgattgcccatagaagagtgcataccggagaaaggccacaccagtgtccggaatgcgggaaaaggtttaccaataagccttacctgacatcacaccggaggatccacactggggaaaaaccatacccttgcaaggagtgtggaaggcggttccgtcacaaacctaatctactgagccacagcaagatccataaacgttcagaggggtctgctcaggccgctcctggccccgggtcacctcagctgcccgccggccctcaggagagtgctgcggagcctacgccagcagtcccactgaagcctgcgcaggagcctccgccaggtgctcctccggagcatccacaagaccctattgaggctcccccctccttatactcatgtgacgattgcggtaggtcctttcgcttggagcgattcctaagagcacaccaaaggcagcatactggcgaaagaccgtttacctgtgcagaatgtggtaaaaactttggtaaaaagacccatttggtggcacatagccgcgtgcactcaggagagcgcccatttgcctgcgaggaatgcggccggcgctttagccagggctcccacctggccgcccacaggcgggaccatgcgcctgatagaccgttcgtttgtccagactgcggcaaagcttttcgccacaaaccctatttggccgcccaccgccgaatacacactggagaaaagccttatgtgtgccctgattgcgggaaggcattttctcaaaagagtaatctagtgagtcatcgacggatccacacaggggagcggccatacgcatgtccggactgtgatagaagttttagccagaagtctaacctaattacacaccgtaaatctcatatccgtgatggtgcattttgctgtgccatatgcggccagacttttgacgatgaggaaaggcttctggctcaccagaagaagcatgatgtgtag

SEQ ID NO: 20400 - DNA, 1704 bp, Artificial Sequence
  Description of Artificial Sequence: Synthetic coding sequence
atgctggagcggcggtgccggggccccctggccatgggcctggcccagccaaggctcctgtccggcccgtcacaggagtccccacagactctggggaaagagtcccggggactgagacagcaggggactagtgtggcacagagtggggcccaggctccaggcagagctcatcgctgtgctcattgcaggcgccatttccctggatgggttgcgctgtggttacatactaggcgttgccaagctagactgccattgccgtgcccagagtgcgggagacgctttaggcacgcgccgttcctcgctctgcatagacaggtccatgccgctgccacgccagatctcggcttcgcgtgtcacctatgcggccagtcatttcgtggttgggttgcattggtgctgcacttgcgcgcacacagcgcagccaaacggcctattgcctgtcctaagtgcgagaggcgcttctggcggagaaagcagttaagagcccatctaagaaggtgtcaccctccagcacccgaagcccggccatttatatgcggtaattgcggccgcagttttgcccagtgggaccagttggtcgcccacaaaagggtgcacgtcgcagaggctttagaagaggcggccgccaaagcacttggacctcgcccacgcggccgcccggccgtaaccgccccccggccagggggagacgccgtggacaggcccttccagtgcgcttgttgcggtaagaggttcaggcacaagccaaatttgattgctcaccgaagagtacacacaggcgagcgaccgcatcagtgccccgaatgtgggaagcgctttactaacaagccctatctcacgtcccatcgcaggatccacaccggggaaaagccatacccatgtaaagagtgcgggcggagattccgtcacaagccaaatcttctgtctcacagcaagatccacaagagatcagagggcagcgcccaggcggcccccggacccgggagccctcagcttcccgccggtccccaggagtccgccgcagaacctacccccgctgtccccttgaagcccgcacaggaaccaccacccggtgcccctccggaacacccccaggatccaatcgaagcccctccatccctttatagctgtgacgactgcggccgttccttcaggttggaaagattcctgagagcccatcagaggcagcatactggggagcggccatttacatgtgccgagtgcggcaagaattttggcaaaaaaactcaccttgtcgcgcatagtcgcgtccacagcggagagcggccttttgcttgcgaggagtgtgggagacgttttagtcaggggtcccatctcgccgcacatagacgggaccacgcgcccgacagaccctttgtctgtcccgactgtgggaaagccttccgacataaaccatacctggccgcccacaggcgaatccatacaggcgagaagccgtacgtgtgcccagattgcggaaaggctttctcccagaaatctaacctggtgtctcacagaaggatccatactggagagaggccctacgcatgtcctgactgtgataggtcattctctcagaaatccaatctcatcactcatcgtaagtcacatatccgcgacggggccttttgctgcgccatctgcggacagacgttcgacgatgaggagagacttctcgctcatcagaagaagcacgatgtgtag

SEQ ID NO: 20401 - DNA, 615 bp, Artificial Sequence
  Description of Artificial Sequence: Synthetic coding sequence
atgggcatcggcgtgagcctgctgctgcagttcagcctgacccccggcggctatcgtagcgtaggcagaagccggcggtgcagccgcggatcgataccccgtaatattcctaagcgttcgtggaagaagccgcacccccagctgtgctcactccaggccgaagaagagcccatgcttgaacggaggtgccgcggccccctagccatgggactcgcccagccccggctgctgagcgggccttcacaggagtccccacaaactttaggcaaagaatcccggggactgcgacagcaagggacctctgtggcacagagtggcgcccaggcccccgggcgcgcccacaggtgcgcccactgtcggagacattttcccggctgggtggcattgtggctccatacacgcaggtgccaggctaggctgcctctcccttgtccggaatgtggtaggagatttcggcacgccccgttcctggctctccatcggcaggtgcacgccgccgccacacccgacctcggcttcgcatgccacttatgtggtcagagtttcaggggctgggtggccctggtgctgcacctgagggctcactctgcagccaagcggccgatagcctgctag

SEQ ID NO: 20402 - DNA, 1875 bp, Artificial Sequence
  Description of Artificial Sequence: Synthetic coding sequence
atgggcatcggcgtgagcctgctgctgcagttcagcctgacccccggaggataccggtctgtgggacgctcccgaaggtgctcacggggatccattccacgaaatatacctaaacgctcttggaagaagcctcatccacagctttgttcactgcaggcagaggaagagcctatgttggaacggagatgtcgcggccccctggccatggggctagcacagcctagactcctgtctggacctagccaggagagccctcagaccctgggtaaggagtcgaggggcctgagacagcaggggacatctgtagcccagtcaggcgcacaggcccctggccgagcgcatcgatgcgcacattgccggcggcacttcccaggttgggtggcactatggcttcacacgagacggtgtcaggcgcgattaccactgccatgccctgagtgcggccgcagattcaggcatgctccattcttagccttgcatcgacaggtccacgccgccgctacccctgaccttggatttgcctgccatctttgcggacaaagttttcgaggctgggttgccctggtcctgcatttacgagcccacagcgcagccaaacggccgatagcctgtcctaagtgcgagaggaggttttggcgaaggaaacaacttcgcgcgcatctgagacgctgccaccctcccgcaccggaggcacggccgtttatttgcgggaattgcggacgtagcttcgcacagtgggaccagcttgtagcgcataaaagggtgcacgttgccgaggcactggaagaagcagctgccaaggctttagggcctaggcccagaggccgaccagccgtaacagccccccgacctggaggtgatgcagtggacaggccattccagtgcgcctgttgtggaaaaaggtttagacacaaacccaatctaatcgcccaccgccgcgtccacacaggagagagaccgcaccagtgccctgagtgtgggaagcgctttactaacaagccgtacctcacgtcccacagacgtatacatacaggggagaagccgtacccctgcaaagaatgtggcagacgctttcggcataaacccaacctcctctctcactctaagattcacaaacgctcagaaggttctgcccaggctgccccagggcccggatccccacagttgccggccggcccccaagagagtgcagctgaaccgactcccgctgtccctctgaagcctgcacaggaacctcctcctggcgcccccccggaacacccccaggaccccatcgaagcgcctccttccctgtattcctgcgatgattgcgggaggagcttcagactggaacgcttcctccgtgcgcaccagcgccagcacactggcgagaggccattcacatgcgctgaatgcggcaagaatttcggaaaaaagacacatttggtcgcccactcaagggtgcattccggtgagcggccatttgcttgcgaagaatgtggcaggcggttcagccaggggtcccatcttgccgctcaccgcagggaccacgcccctgatcggccattcgtttgtccagactgcgggaaggcattcaggcataagccttacctcgccgctcaccgcaggattcacacaggagagaagccatatgtgtgccccgactgcgggaaggcattttcacagaagtccaatctcgtgtctcatcggagaatacataccggagagcggccttatgcatgtccagattgtgataggtcgttctcacagaagtccaatctgatcacccatcgtaaatcacatatccgcgatggcgccttctgttgcgccatatgcggccaaaccttcgacgacgaggagcgcctgctcgcccaccaaaaaaaacacgatgtttag

SEQ ID NO: 20403 - DNA, 441 bp, Artificial Sequence
  Description of Artificial Sequence: Synthetic coding sequence
atgctggagcggcggtgccggggccccctggccatgggcctggcccagcctagactgttgtctgggccctcgcaagaaagtccacagacgcttggaaaggaaagccgggggctgaggcagcagggcacaagcgttgcccagtcaggagcccaagccccaggaagagcacatcggtgtgctcactgccgtagacattttccaggctgggtcgcactctggctccacacacgtagatgtcaagcaaggttgccactgccctgccccgagtgtgggcgtcgcttcagacatgcaccattcctagctcttcacaggcaggtgcacgcagccgcaacacctgatttgggatttgcatgccatctctgcggccagtcttttcggggctgggttgctctcgttttacacctgagggctcattcagccgcaaagcgtccaatcgcctag

SEQ ID NO: 20404 - DNA, 1704 bp, Artificial Sequence
  Description of Artificial Sequence: Synthetic coding sequence
atgctggagcggcggtgccggggccccctggccatgggcctggcccagcctcgcttgcttagcggcccatcacaggagtccccgcagacgttgggcaaagagtcccgggggttgaggcagcaaggcacctctgtcgcccagagcggtgcacaggcccctgggcgggcccacaggtgcgcccattgccgcagacattttccagggtgggttgcgctttggctgcacaccagaagatgccaagcccgactgccattgccatgccccgagtgcggacggcggttcaggcacgccccttttttagctctgcatagacaggtacatgcggccgccacaccagacctgggatttgcatgccacttgtgtgggcagtcttttcggggttgggttgctctggtcctgcacctgcgggcccacagcgccgcgaagcggccgatcgcttgcccaaagtgtgaacgcagattttggcggagaaagcaactccgggctcacctcagaagatgccatcctcccgcccccgaggctagacctttcatttgcggcaactgtgggcggtcctttgctcagtgggatcagctcgtcgcccataaaagggttcacgtggctgaggcgctcgaagaggccgcagccaaggccctgggcccaaggccccgggggcggccggcagtcaccgctcctcggcccgggggagacgcagttgataggccctttcagtgcgcgtgctgtggaaagcggttccgtcataaacctaacctgatcgcccatcgcagagtccatacaggggaacgcccccaccagtgccccgaatgcggcaagagattcacaaataagccttatttgacatctcacagacggattcatacaggtgaaaaaccctatccctgcaaagagtgcggcagacgctttcggcataaaccgaacctgctgtctcattctaagatacacaaacggtctgaaggaagcgcgcaggctgcgccaggccccgggtccccacagctacccgcaggtccacaagagagcgccgccgaaccaactcccgcggtgccccttaaaccagcacaggagccacctccaggcgctccgcccgaacatccgcaggaccccatcgaggccccgccttctttatattcttgtgatgactgcggcaggtccttcaggcttgaacgcttcctccgggcccatcaacgccagcacactggcgagcggccatttacatgtgctgaatgtggaaaaaatttcggtaaaaagacacatttggtggcacactctagggtgcattccggggagcgcccattcgcatgcgaagagtgtggcagaaggtttagtcagggaagtcacttggccgcacatcgacgggatcacgcccctgaccgtccctttgtgtgccctgattgcgggaaagcattccgacataagccctacttggccgctcacaggcggattcataccggagagaagccctacgtttgcccagactgcggtaaggctttctcccaaaaatccaaccttgtttcccaccgtcggattcacacaggagagcgcccttatgcctgtccagattgcgacagatcttttagccaaaagtctaacctgataacgcaccgaaaatcgcacatacgagatggggcgttctgttgcgcaatatgtggacagacgttcgacgatgaggaaaggctacttgctcatcagaagaagcacgatgtttag

SEQ ID NO: 20405 - DNA, 1449 bp, Artificial Sequence
  Description of Artificial Sequence: Synthetic coding sequence
atggtggagaagggccccgaggtgagcggcaagcggcggggccggaacaatgcggccgcctcagctagcgccgccgccgcttccgccgcggcgtctgcagcctgtgccagccctgctgctacagcagctagcggcgccgccgcctcaagtgcgtccgccgccgctgcttccgccgccgccgcaccaaacaatggccagaataagagtctagcggccgcggcaccgaacggcaattctagttccaattcctgggaagagggcagttccggatccagttctgatgaagagcacggcggaggcggtatgagagtgggtccccagtaccaggctgttgttccagactttgatccagccaagctagcacggaggtcacaagaacgagataatctggggatgttagtctggagccccaaccaaaatctgtcggaagccaaacttgacgaatatatcgctatcgccaaggagaagcacgggtataacatggagcaggccttgggcatgctgttttggcacaaacataacatagaaaaaagtctggccgacctgccgaattttacccccttccccgatgaatggaccgtggaggacaaagtcctgttcgagcaagcattcagcttccacggaaaaacttttcaccggatccagcagatgttgcccgacaagagtatagcttccctggtgaagttttactattcttggaaaaagacacggaccaagacaagcgtcatggaccggcatgcaaggaagcagaagcgagaacgagaggaatcagaggacgaattggaggaggccaatggtaataaccccatagacattgaagtcgatcagaacaaggaatcgaagaaggaggtcccccctacagaaaccgtgccccaagtgaagaaagagaagcacagcacacaggcaaagaacagggccaagagaaaaccccccaaggggatgtttctatcccaggaggacgttgaggcagtgtctgccaacgccactgccgccactactgtgcttcgccagctggacatggagcttgtcagtgtgaagagacagatacaaaatataaaacaaacaaactccgcgttgaaggagaaactggacggtgggatagaaccctaccggctacctgaagtgatccaaaaatgtaacgcaagatggaccaccgaggaacagctgctggcagtgcaggcgattcgaaaatacggccgcgactttcaggcaattagtgacgtgattggaaacaagtcagtggtgcaggtcaagaacttttttgtgaattataggcgccgcttcaatatcgacgaagttttacaggagtgggaggcagagcacggtaaggaggagaccaatggacctagtaatcaaaaacctgttaagtcacccgataattcaataaagatgccggaggaagaggatgaggccccagtcttggatgtgaggtacgcatcagcgagctag

SEQ ID NO: 20406 - DNA, 1449 bp, Artificial Sequence
  Description of Artificial Sequence: Synthetic coding sequence
atggtggagaagggccccgaggtgagcggcaagcggcggggccggaacaatgccgccgcgagcgcctctgctgccgcagcctctgcagcagccagtgcagcttgtgcgtcaccggcagccacagccgcgtccggggccgccgcatcctcagcctctgccgccgccgcatccgcagcggccgcacctaacaacggtcagaataaaagtctggcagctgcagccccaaatggaaactcatcgtctaactcatgggaggagggctcctctggcagctcatccgatgaggagcacgggggaggcggcatgcgagtgggtcctcagtaccaggccgtggttcctgacttcgatccagcaaaactggcgcgcagatcccaggagcgtgataacctgggaatgctggtgtggagccccaatcagaatctgtctgaggccaagttggatgaatatatcgccattgcaaaggaaaagcacggctacaatatggagcaggctctggggatgctgttctggcacaaacacaacatcgagaagtccctggccgatttaccgaatttcaccccatttccagacgaatggacagttgaggacaaggtactcttcgagcaggctttctcattccacggaaaaacattccacagaatccagcaaatgctgccagacaaatctatcgctagcctggtcaaattttactattcctggaagaagacacgtacaaagactagcgtgatggaccggcacgcccggaaacagaagagggagagggaagaaagcgaagacgagttagaagaagccaatggaaacaatcccatagacatagaagtggaccaaaataaggagtcaaaaaaggaagtccctccaacagagactgtgcctcaggttaagaaggaaaaacacagtacccaggcaaagaatcgggcaaagcggaagccccctaaaggcatgttcctgtcgcaggaggacgtcgaagccgtctctgcaaatgctacagctgctacaaccgtcttacggcagctggatatggaacttgtgagtgtaaagcgccagattcaaaatatcaagcaaaccaatagcgcactgaaagagaaattggatggagggattgagccgtacaggctgcccgaggttatccagaagtgtaatgctcggtggacaacagaggaacagttgttagccgttcaggcaatccggaagtacggaagagacttccaggccatctcagacgtgattgggaacaagagcgtggtccaggtgaagaacttttttgtaaactaccgccgacgatttaacatcgacgaggttctccaggagtgggaagctgaacacgggaaggaagaaacaaacggaccgtccaatcagaagccggtgaagagccccgacaatagtatcaaaatgccggaagaggaggacgaggcacctgtgctagatgttcgctacgcgtcggcttcgtag

SEQ ID NO: 20407 - DNA, 1572 bp, Artificial Sequence
  Description of Artificial Sequence: Synthetic coding sequence
atgcccagcgtgatggagaagcccagcgccggcagcggcatcctgtccagaagtcgagcaaaaaccgtccctaatggcggacagccacattccgaagatgactcttccgaggaggaacactcccatgatagcatgatccgggtggggaccaactaccaggcagtgatcccagagtgtaaacccgagagccccgctaggtacagtaacaaggaactgaagggaatgctggtgtggtctcctaaccactgcgtgtccgatgcaaagctggacaagtacattgccatggctaaagaaaaacatggatataacatcgaacaggccctgggaatgttactgtggcataagcacgacgtggagaaatcgctggccgatttggcgaatttcaccccttttcccgatgagtggaccgtagaagataaagtcttgtttgaacaggcattcgggttccacggcaagtgcttccaacggattcagcagatgctgcccgataaactcattccctctctggtgaagtactactattcttggaagaaaactagaagccggacctccgtcatggatcgtcaggccaggaggctcggaggacgcaaagacaaggaggacagcgatgagttggaggaggggcggggtggggtctctgaaggcgagcctgatccagccgatcccaaacgggagccacttccttctcggcctttgaacgccagaccaggccctgggaagaaagaggtgcaggtctctcagtatcgtcaccatcccctgagaacccgccgaagacccccaaagggtatgtacctctcaccggagggcctgactgcagtgagtgggtctccagacctcgcaaatctcacgctgagaggcctggacagccagctgatatcattgaaaagacaagtccagtcaatgaaacagacaaacagcagtttgcgtcaggctctggagggagggattgaccccctcagaccgcctgaggccaatacgaagtttaactctaggtggacaaccgacgagcaacttctcgccgtgcaggccatcagaagatatggcaaggactttggggcgatcgctgaggtgatcggaaacaagaccctgacacaggttaagaccttttttgtgagctatcggcgacgattcaaccttgaagaggtactgcaggagtgggaagcagaacaagatggagcccctggagccccagtgcctatggaggaagctaggcggggggccccactgcccgctcccgcactcgaggaagatgatgaggtgcaaatcacctccgtaagcacttccgtgccccgatccgtgccccctgcccctcctcctccgcccccgcctacatcgttgagccagcccccacccctccttcgccctcctctgccgactgcacccactctgctgcgacagcccccgcctctccagcaggggagattcttacaacccaggttagccccaaaccagccccctccccctctcatcaggccagcactagcggcaccaagacatagtgccaggcccggcccacagccccctcccacactgatcgggacccccctggaacctcccgccccatccctatag

SEQ ID NO: 20408 - DNA, 1488 bp, Artificial Sequence
  Description of Artificial Sequence: Synthetic coding sequence
atgcgggtgggcgccgagtaccaggcccggatccccgagttcgacccaggcgcgactaagtatacagataaggataatggaggcatgctcgtctggagcccctatcactcaattcctgatgcaaaacttgatgagtatatcgcaatagccaaggaaaaacacgggtataacgttgagcaggctctcggaatgctcttctggcacaagcacaatattgagaaatctcttgcagatttgccaaacttcacgccgtttccagacgaatggaccgtggaagataaagtgcttttcgagcaagcctttagctttcatggaaagagctttcatcgcattcagcagatgctgcctgataagacaatagctagtctagttaagtattactattcctggaaaaagactagaagccgcacatccttgatggatcggcaggcccgaaagctggccaaccgccacaaccagggtgactccgatgacgatgtggaggagacgcatcccatggacggcaacgacagtgactatgacccaaagaaggaagctaagaaagaaggcaacaccgagcagcccgtgcagacgtctaaaattggcctgggaaggcgagaataccaaagcttgcaacatcgacatcacagccagagatcaaaatgcaggccgcctaagggaatgtacctgactcaggaggatgtggtcgcagtgtcgtgcagtccaaacgccgccaacacaatcctcaggcagctcgatatggagctaatctctcttaagcgacaggtgcagaacgcaaagcaggttaatagcgccctgaaacagaagatggagggggggatagaggaatttaagccaccggaatctaaccaaaaaattaatgccagatggaccaccgaggagcagcttctggctgtgcagggtgtcagaaagtatgggaaggactttcaggccatcgctgatgtcattggcaataaaactgtagggcaggtgaagaactttttcgtgaattacagacgccggtttaatctggaagaggtgctgcaagagtgggaggcggagcagggcacgcaggccagcaatggcgacgccagtaccctcggcgaagagacaaagagcgccagtaatgtgcctagcggcaagtccactgacgaggaggaggaagctcagactccgcaggctccacgtacacttgggccgtccccacctgcccccagttctacacccaccccgactgctccaattgcaacgctgaaccagcccccacctctgttgaggcccacactgccggccgcaccagctcttcatagacagcctcccccactccaacagcaggcacggtttattcaaccacgacccacccttaatcaacctcctcctccgctgatcaggcccgccaactctatgcccccacgcctgaaccccaggcctgtgttgagcaccgtgggcggccagcagcccccatccctcatcggcatacagacagattctcagtcctctctgcattag

SEQ ID NO: 20409 - DNA, 1311 bp, Artificial Sequence
  Description of Artificial Sequence: Synthetic coding sequence
atgcccggcatgatggagaagggccccgagctgctgggcaagaacagatctgctaacggctccgccaagagtcccgccggaggaggaggttcgggtgctagcagtactaacggaggtctgcactacagcgagcccgaaagtggatgttctagtgacgatgagcatgacgtaggcatgagagttggagcagaatatcaggcaaggatcccagagttcgacccaggggctactaagtacaccgataaggacaacgggggtatgctggtatggtctccataccacagtatcccagatgctaagcttgatgagtacatcgccatcgcgaaggaaaaacacggttataatgtggagcaggctctggggatgctgttctggcacaaacataacatcgagaagtccttagctgatctgcctaacttcactccatttccagatgaatggaccgtggaagacaaggtgctgttcgagcaggcattttcattccatggtaagtcattccataggatacagcaaatgctacccgacaaaacaatagcatccttagtgaagtattactattcttggaagaagacccgatcaagaactagcctgatggatcgtcaggcaagaaaactggctaaccggcataaccagggcgacagtgacgacgatgtggaggagacacatcccatggacgggaacgacagcgattacgatcctaaaaaggaagctaagaaggagggaaataccgagcagccggtccaaacaagcaaaatagggctgggtcggcgcgaataccagtcgttacagcaccgacaccacagtcagagaagtaagtgcaggcctcccaaaggtatgtatcttacccaggaagatgtggtcgctgtgagttgcagcccaaacgccgccaatactatcctgcgacagctggacatggagctcatcagcctcaagcgtcaggtgcagaatgcaaagcaggtcaattccgcccttaaacagaagatggagggcgggatcgaggaattcaaacctcccgagagtaatcaaaagattaatgcccgttggacgactgaggagcagttactagcagtgcagggcactgatcccacaggaagctcagataccggtagcatcacctcttgtcctattatccactcaaatacgaactcaccttattgccatagcgagccagcttccacaacttcatcttctaatactgcttgctgtcctggctcctcgccagccgcgtcctcaacccctgcagctgggagcgtccacccagcaccggccaacttcaaaagcgctagtaccacctcctattccccttgttag

SEQ ID NO: 20410 - DNA, 1662 bp, Artificial Sequence
  Description of Artificial Sequence: Synthetic coding sequence
atgcccggcatgatggagaagggccccgagctgctgggcaagaacagaagcgctaacggaagcgccaaatcccctgctggcggcggcggctccggcgctagcagcacaaacggcggcctccactactcagagccagaatcaggttgttcaagtgatgatgagcatgatgttggaatgagggtgggagccgagtatcaggctcggattcccgaatttgatcccggcgccaccaaatataccgacaaagataatgggggtatgcttgtgtggtccccttatcacagtattcctgacgcaaagcttgatgaatatattgccattgccaaggaaaaacatggatacaatgtggagcaggcgttgggcatgctgttctggcataagcacaacattgagaaaagtttggctgatttgcctaacttcacccccttccccgatgagtggactgttgaggataaggttctcttcgagcaggctttttccttccacggaaagtcattccacagaatccagcagatgctgccagacaagactattgcaagcttggtcaaatactactactcctggaaaaaaacacgctctagaaccagtctgatggatcgccaagcgaggaaactggctaatcggcataatcagggcgactccgacgacgacgtggaagagactcacccaatggacggaaacgattcagattacgatccaaagaaagaggctaagaaggagggcaacactgagcagcctgttcaaaccagtaaaatagggctgggaaggcgggagtaccaaagccttcaacaccggcaccactctcaacgaagcaaatgccgcccacctaagggtatgtacctgacccaagaggacgttgtggctgtgagctgctccccaaacgcagccaacacgattctgcgtcagctggatatggagttgatctctctcaaacgccaggttcagaatgccaaacaggtcaatagtgccctgaaacagaagatggagggtggtatcgaggaatttaagccacctgagagtaaccagaaaatcaacgccagatggaccaccgaggaacagctgctcgcagtgcagggggtccgcaaatacggaaaggatttccaggcaattgccgacgtaattgggaacaagactgtggggcaggttaaaaactttttcgtcaattaccggcggcgctttaatctcgaggaagtccttcaagagtgggaggctgagcagggaacgcaggccagcaatggcgatgcaagcacactgggggaagagacaaagagcgcgagtaatgtgcctagtggtaaaagcactgacgaagaagaagaggcccaaaccccgcaggcccctcgaacccttggcccaagtcctccagcgccgagctctacccctacccccacagctcccatcgctactctgaatcagccaccaccgctgcttcggccgacactgcctgctgctcccgctcttcatagacagccacctccgttgcagcagcaggcacgatttatccagcccaggcccacccttaatcagccacctccacctttgattcgtcccgccaatagcatgcccccccggcttaatccccgtcccgttctcagtacggtagggggtcaacagcctcctagtttgatcggtattcagactgactctcagtcgtcactgcactag

SEQ ID NO: 20411 - DNA, 1350 bp, Artificial Sequence
  Description of Artificial Sequence: Synthetic coding sequence
atgcccggcatgatggagaagggccccgagctgctgggcaagaacagaagtgccaatggcagcgccaaatctccagccggagggggcggcagcggcgctagctcaacgaacggtggacttcactactccgagccagagtccggctgcagcagcgatgatgaacatgacgtgggaatgagagtcggcgcagagtaccaggcgaggattcctgaatttgatcctggagcaaccaaatacaccgacaaagacaacggcggaatgctcgtatggagtccataccacagcattccggatgccaagctagacgagtatattgcaatcgcgaaggagaagcacgggtataacgtggagcaggcattaggcatgctgttttggcacaagcataacatagaaaagagcctcgccgatctacccaatttcactccgtttccagacgagtggaccgttgaagataaggtgcttttcgagcaggcgttctctttccatgggaagtcgtttcacagaatacagcagatgttgccagacaagaccattgcctcacttgtcaagtactactactcttggaaaaagactagatctcggaccagcctcatggacagacaggccagaaagctggcaaaccggcacaatcagggcgactccgatgacgacgtggaagaaacccaccctatggatggcaatgattcagattacgatcctaaaaaagaggcaaagaaggagggtaataccgaacaacccgtccaaacgtctaagatcgggctcggaaggagggaataccagtcccttcagcatcgacaccattctcagagaagtaaatgcagaccccccaagggaatgtacctgactcaggaggatgtagttgcggttagttgctcccccaacgccgctaatacaattttaagacagctcgacatggagctgatcagtttgaagaggcaggtccaaaacgccaaacaggtgaatagcgcactgaagcagaaaatggaggggggcatcgaggagtttaaacctccggagtcaaatcagaaaatcaatgctcgctggaccacagaggagcagctcctggccgtccagggtgtgcgtaagtatggaaaggacttccaggccattgcggacgtcataggtaataaaacggtggggcaagtgaaaaatttctttgtcaactatcgcagaaggtttaacttggaggaggttttgcaggagtgggaagccgagcagggaacacaagcctcaaacggcgatgcaagcacactgggggaagaaacaaagtcagcttccaacgtcccctccgggaaaagcaccgacgaggaagaggaggtgtgcctgtgtatggagttcgagctgatctag

SEQ ID NO: 20412 - DNA, 450 bp, Artificial Sequence
  Description of Artificial Sequence: Synthetic coding sequence
atgcgggtgggcgccgagtaccaggcccggatccccgagttcgaccctggtgccactaagtatacggacaaggataatggtgggatgctcgtgtggagcccatatcatagcatacccgatgcgaagctagacgaatatatcgccatcgccaaagagaagcatggctacaacgtggagcaggctttgggcatgctattttggcacaaacataatatcgagaaaagtcttgccgacctccccaatttcacccccttccctgacgagtggaccgtcgaagacaaagtactgtttgagcaggcctttagctttcatggaaaatctttccaccgcatccagcagatgttacctgacaaaacaatcgcctctctggtgaagtactactactcttggaaaaaaacacgatcccgtacctccctcatggaccgccaggctaggaagctggccaactag

SEQ ID NO: 20413 - DNA, 261 bp, Artificial Sequence
  Description of Artificial Sequence: Synthetic coding sequence
atgcgggtgggcgccgagtaccaggcccggatccccgagttcgaccctggagcaaccaagtatacagataaggataatggtggtatgctggtctggagtccttaccattcaatccccgacgcgaagctcgatgaatacatcgccatcgcaaaggagaaacatggctataatgtggagcaggccctgggaatgctgttttggcacaaacacaatatcgagaaatccctggcagacctgcctaactttaccccttttccatag

SEQ ID NO: 20414 - DNA, 555 bp, Artificial Sequence
  Description of Artificial Sequence: Synthetic coding sequence
atgttcctgagccccggcgagggccccgccaccgagggcggcggcctggggcccggagaagaggctcctaagaaaaaacatcgcaggaatcgcactactttcaccacctaccagttacaccagcttgagagagccttcgaagcctcacactatcccgatgtgtacagcagggaggagctcgcagccaaggtacacctcccagaagtccgagtgcaggtttggtttcagaataggcgggctaagtggagacggcaggagcggttggagtccgggtcaggcgcagtagccgcccctagactgcccgaagctccagcccttccattcgcacgacccccagctatgagcctgccgctggagccgtggctcgggccagggccgccagcagttccgggtctgcccaggctgctcggccccggtccaggactacaggcttcattcgggcctcacgccttcgcgccaacgtttgccgacggtttcgctctggaggaagccagtttgagactgctagcgaaggaacacgcgcaagctctggacagagcctggccccccgcatag

SEQ ID NO: 20415 - DNA, 693 bp, Artificial Sequence
  Description of Artificial Sequence: Synthetic coding sequence
atgcccgcccccgtggagggcaccgacttccccggcgccggccggcaggcatgggggtcaccagctctcagcctccccgtcgctcccccagctgtgtctccccctagcgtaccactgccttcacaccaggtgggagccatgttcctatcccctggggagggtcccgccacggaaggaggcggcctgggccctggggaagaggcacctaagaagaagcatcgccggaaccgcaccaccttcaccacctatcagctgcatcaactggaacgggcgttcgaggcgtcccactatcctgacgtgtatagccgggaagagctggccgccaaggtgcatcttcccgaagttcgtgtgcaagtgtggttccagaatcgtagagctaaatggcggcgccaggagcggctggaaagcgggagtggggcggtggcagctccacgtctgccagaagcgcccgccctgcccttcgccaggcctcccgccatgtccctgcccttggaaccatggctggggccaggaccgcctgccgttcccgggctgcccaggcttcttggccccggccccggactacaggcatctttcggcccacatgccttcgcccctaccttcgcagacggcttcgccttggaagaggcatctttacggctactcgctaaagagcatgcacaggccctggatagagcatggccacccgcctag

SEQ ID NO: 20416 - DNA, 615 bp, Artificial Sequence
  Description of Artificial Sequence: Synthetic coding sequence
tgagccggcgccggcgtgccctggaagagcaccgagggcctgccctgggcagtgggagccatgtttctgagccccggagagggtcctgcgacagaggggggcggactgggcccgggcgaggaggcaccaaagaaaaagcatagacggaaccggacgactttcaccacataccagctgcatcagctcgaaagagctttcgaggctagccactacccagatgtgtattccagggaggagctggctgccaaagtccacctgcccgaggtgcgagtgcaggtgtggtttcaaaaccggcgggcgaaatggaggaggcaggagagacttgagagcggaagcggcgccgtggcagctccccgcctgcctgaagctcctgccctgccgttcgcacggccacccgcaatgtctctccccctcgagccctggctgggacctggcccacccgcggtgccgggtctgccccgcctgctgggcccggggcccggcctgcaggcgtcattcggtccacacgcctttgctcccacattcgcagatggttttgccttagaggaggcctcgctgcggctactggccaaggaacacgcccaggctcttgatagggcttggccacctgcttag

SEQ ID NO: 20417 - DNA, 1278 bp, Artificial Sequence
  Description of Artificial Sequence: Synthetic coding sequence
atggccgacaaggaggccgccttcgacgacgccgtggaggagcgggtgatcaacgaagaatataaaatttggaagaaaaataccccgttcttgtatgatctggttatgacacacgcccttgaatggccttctctgacagcacagtggttgcctgacgttacccgccctgaagggaaggactttagcatccacaggctggttctagggactcacacttccgacgaacagaatcaccttgttatcgctagcgtgcaacttccaaatgacgacgcgcagttcgatgccagccactatgatagcgagaaaggtgagtttggggggtttggaagcgtcagtggtaaaattgaaattgagattaaaattaatcatgagggggaggtcaacagagcccgttatatgccacagaatccctgcatcatcgccactaagacgccctcctccgacgtcctggtgttcgactatacaaaacatccctcgaaacccgaccctagcggagagtgcaatcctgacctgagattacggggacaccagaaagagggctatggactgtcctggaatccaaacctgtcaggtcacttactgagcgcctcagatgaccataccatctgcttgtgggatataagcgctgtgcctaaagagggcaaagtagtggatgccaaaactatattcactggccacactgctgtggtcgaagacgtctcttggcacttgctacacgaatctctattcggttccgtggcagacgaccaaaagctcatgatttgggacactagaagcaacaacaccagcaaaccatctcatagcgttgatgctcacactgctgaggtgaactgtttaagctttaacccgtactctgaattcatactagccaccggttccgctgataaaaccgtggccttatgggacttgagaaatctcaagctgaaacttcattcttttgaatcacacaaggacgagatctttcaggtacagtggtctccacacaacgagactattctagccagcagtggaacagaccggcggctgaacgtgtgggacttgtctaagataggagaggaacagtctcctgaggatgcagaggacggcccgcctgaactgctatttattcatggagggcatacggccaagattagcgatttttcctggaaccctaatgaaccgtgggtgatctgctccgttagtgaggacaacatcatgcaagtatggcaaatggccgaaaatatatataatgatgaggatcctgagggaagcgttgatccagagggacaaggaagttag

SEQ ID NO: 20418 - DNA, 1275 bp, Artificial Sequence
  Description of Artificial Sequence: Synthetic coding sequence
atggccgacaaggaggccttcgacgacgccgtggaggagcgggtgattaacgaggaatataagatctggaaaaaaaacacccctttcctctacgacctagtgatgacccatgccctcgaatggccttctcttacagcacagtggctcccagacgtgacacgaccagagggcaaggacttttcaatccaccgccttgtcttggggacacatacgtctgacgaacagaatcacctggtgattgcatccgtgcagctgccaaacgatgacgctcagttcgacgcaagccactacgactctgaaaaaggcgagtttggtggcttcggtagcgtgtcaggcaaaattgaaatagagataaagataaatcacgagggagaggtcaacagggctagatacatgccccaaaacccatgcataatcgcaacgaaaaccccatcatccgacgtgctggtctttgattacaccaagcaccctagcaagccggacccgtctggggagtgtaatccagatttgagactgcgtgggcatcaaaaggagggctacggactctcgtggaatccaaatcttagtggccacctgctttctgcaagcgacgaccacaccatttgtctgtgggatatcagcgccgttcccaaggaaggaaaggtcgtggacgcgaagaccatcttcactggtcatactgccgtggtggaagatgtgagctggcatctcttacacgaatctctgttcggctcagtggccgatgaccaaaagttaatgatatgggatacacgttccaataacactagcaagccttcacactctgtggacgctcatacagctgaggtcaactgcttaagcttcaacccctatagtgagttcatcctagcgacaggctccgccgacaaaacagtcgccttgtgggatctccggaatcttaaactcaagctgcacagttttgagtcacataaagatgagatatttcaggttcagtggtcaccacataacgagactatcctcgcatccagcggaaccgatcgtagattaaacgtatgggacctatccaaaatcggagaagagcaaagtccagaggatgcagaggatgggccgcccgagctgctcttcatccatggcggtcatactgcaaagatcagtgacttcagctggaacccaaacgaaccttgggtgatatgctctgtgtccgaagataatatcatgcaagtgtggcaaatggctgagaacatctataacgacgaggacccagagggatctgtggatcctgaagggcagggtagttag

SEQ ID NO: 20419 - DNA, 264 bp, Artificial Sequence
  Description of Artificial Sequence: Synthetic coding sequence
atgacccacgccctggagtggcccagcctgaccgcccagtggctgccggatgtgaccagaccagaagggaaggatttctcgatacaccggctcgtgctgggaacacacacctccgacgaacagaatcatctcgtgatcgcctcagtgcagttgccaaacgacgatgctcagtttgatgcaagccattatgattctgaaaaaggtgagtttgggggttttggctccgtgtccggcaagatcgaaatagagattaagatcaactag

SEQ ID NO: 20420 - DNA, 1173 bp, Artificial Sequence
  Description of Artificial Sequence: Synthetic coding sequence
atgacccacgccctggagtggcccagcctgaccgcccagtggctgccggatgtgacacgcccggagggcaaggactttagcattcacaggctggttctagggactcacactagcgacgagcagaaccacctggtgattgctagcgtgcagctgcccaacgatgacgcccagttcgacgcaagccattacgacagcgagaaaggtgaattcggtggcttcgggtccgtatctggaaaaattgaaatcgagattaaaatcaatcatgaaggcgaggtgaacagggcccggtacatgcctcagaatccatgtatcattgccacaaagaccccctctagtgatgtactcgttttcgattacaccaagcatccttcaaaaccagacccttccggtgagtgcaaccccgacctgaggctgcgggggcaccagaaagaaggctatggcctgagctggaatcctaacctgtcaggtcacctgttgtctgcatcagacgatcatactatttgtctgtgggacattagcgccgtgcctaaggagggcaaggtcgtcgacgcaaagaccatctttactggccacactgccgtggtggaggatgtgtcctggcaccttctccatgagtccctattcggcagcgtggccgacgaccagaaactgatgatctgggatacccggagtaacaacactagtaagccttcgcacagcgtggacgcccatactgccgaggtcaactgcttgagctttaacccctacagcgaatttattctggccactggttccgctgacaaaacagtggccctttgggatttgaggaacctgaagctgaagttacacagcttcgagagccataaggacgaaatcttccaggttcagtggtccccccataacgaaactatcctcgccagcagtggcactgaccgaaggttgaatgtgtgggacttatccaaaatcggcgaagaacaatctcctgaggacgctgaggatgggccaccggagcttctgttcatccacggtggccacacagccaaaatttccgatttctcgtggaacccaaacgaaccttgggtaatttgtagcgttagcgaggacaatataatgcaggtgtggcagatggccgaaaatatctacaatgatgaggaccctgaagggtcagtcgaccctgaaggtcagggctcctag

SEQ ID NO: 20421 - DNA, 543 bp, Artificial Sequence
  Description of Artificial Sequence: Synthetic coding sequence
gtggccgacgaccagaagctgatgatctgggacacccggagcaacaacactagcaaaccttcgcactctgtggacgcacacaccgccgaggtgaactgtctgtcctttaatccctactccgagttcattctagctacggggtcagcagataaaacagtagctctgtgggacctcagaaatttaaaattaaagctgcacagtttcgagagccacaaggacgagatatttcaggtccaatggtcaccccataacgaaacaattctggcaagcagcggaacggaccgtcggctcaatgtctgggatctatccaagatcggcgaggagcagagccccgaggatgctgaagacgggcctccggaactgttgttcatccatggcgggcacacggccaagatttcagattttagctggaatcccaacgaaccctgggtgatctgttcagtatcggaggataacattatgcaggtttggcagatggcggaaaatatctacaacgatgaagacccagaaggatcggttgatcccgagggacagggcagctag

SEQ ID NO: 20422 - DNA, 207 bp, Artificial Sequence
  Description of Artificial Sequence: Synthetic coding sequence
atgacccacgccctggagtggcccagcctgaccgcccagtggctgcctgacgttactagaccagaaggtaaggatttcagcatccataggctcgtactcggcacgcacacatcagatgaacagaatcacctggttattgcctccgtgcagctgccgaacgatgatgcacaattcgatgcctctcactatgacagcgaaaagggatag

SEQ ID NO: 20423 - DNA, 522 bp, Artificial Sequence
  Description of Artificial Sequence: Synthetic coding sequence
atgatctgggacacccggagcaacaacaccagcaagcccagccacagtgtggatgcacatacagcagaggtgaactgcctctcattcaatccatacagcgaattcattctcgccaccggcagtgcagataaaaccgtggccctatgggatctgaggaacctcaagctgaaattacatagcttcgagtcccacaaagatgaaatatttcaggtgcagtggagcccacacaacgaaacgattttggcctcatctggcaccgatagacggctgaatgtgtgggacctatccaagatcggtgaagagcagagccccgaggacgctgaagatggaccccccgagttattgttcattcacggcggacacacggctaagatcagcgatttctcctggaaccccaatgagccttgggtcatctgtagcgtgtctgaagataacattatgcaggtctggcagatggcagagaatatatacaacgatgaggatcctgagggcagtgtggaccctgaggggcaggggagttag

SEQ ID NO: 20424 - DNA, 588 bp, Artificial Sequence
  Description of Artificial Sequence: Synthetic coding sequence
atggccgccgaggacgtggtggccaccggcgccgaccccagcgacctcgagtccggcggactccttcatgagatatttacaagccctctaaacctgctgcttctgggcctctgtatatttctgctgtacaagatcgtgaggggagatcaaccagccgcaagcggcgattctgatgatgacgaacctcctcccctgcccagactcaagcgtagagatttcacacctgcagagctgcggaggtttgacggcgtgcaagatcctagaatcctgatggcgatcaacggtaaagtgttcgatgtaacgaaggggcgaaagttttatggccccgaaggaccctatggtgtgttcgccggtcgcgatgctagcagaggattggcaactttctgtctcgacaaggaagctctaaaagatgagtatgacgacctgtcggacctgaccgccgcccagcaggagactctctccgactgggagtctcagtttacatttaagtaccaccatgtgggtaaattgcttaaggaaggggaggagccaacggtttactcagacgaagaagagccaaaggatgagagcgccagaaagaacgactag

SEQ ID NO: 20425 - DNA, 867 bp, Artificial Sequence
  Description of Artificial Sequence: Synthetic coding sequence
atggagccccccgaccagtgcagccagtacatgaccagcctgctgtcacccgccgtggacgacgaaaaagaactacaggacatgaacgccatggtgctaagcctgaccgaagaagtgaaagaggaagaagaggacgcacaaccagagccggagcagggcacggccgctggggagaaactgaagtctgccggggcacagggtggcgaggaaaaggacggaggtggtgaggaaaaagatggcggcggcgcaggcgtgccggggcacctgtgggaaggcgatcttgagggcacttcaggttctgatggcaatgtcgaagattctgatcaaagtgaaaaggagcccgggcaacagtactcaagaccacagggggccgtaggggggcttgaacctggcaacgcacagcagcctaatgttcacgctttcacaccactccagctgcaggagctagaaaggattttccaaagggaacagttcccaagcgagtttttgaggaggaggctcgccaggtcaatgaacgtcacagaattggccgtccagatctggttcgaaaataggcgtgctaaatggcgaaggcatcagagagcgctcatggcacgaaatatgctgccattcatggccgtcggacagccggtcatggtgacagcggctgaggccattactgcacctttattcatcagcggcatgagggatgattatttttgggatcatagccatagctcttctttgtgctttcctatgccccctttccctcccccaagcctgcccttaccactgatgttgttgccgcctatgccaccagctgggcaagccgagttcggacctttccccttcgttattgtgcccagcttcactttcccaaatgtgtag

SEQ ID NO: 20426 - DNA, 867 bp, Artificial Sequence
  Description of Artificial Sequence: Synthetic coding sequence
atggagccccccgaccagtgcagccagtacatgaccagcctgctgtctccagcggttgacgatgagaaggagctgcaggatatgaatgccatggttctgtcactgacggaggaggtaaaagaggaagaggaagacgcacaacctgagcccgaacagggcaccgcagctggcgagaagctgaagtcagccggggcacagggcggagaggaaaaggacggtggtggggaggagaaagacggggggggcgccggggtccctgggcatctctgggagggaaacctcgaggggacatccggctctgatggaaatgtcgaagactcggaccagtctgagaaagaacccggacagcagtactcgaggccacagggcgctgttggcggcttagaaccaggtaatgcccagcagcccaacgtgcatgccttcacacctctccagctccaggagttagaatgtatcttccagagggagcaatttccatctgagtttcttcgtcgtagacttgccaggtccatgaacgttaccgaactcgcggtacagatatggtttgaaaatcgacgcgctaagtggcgacgccaccagcgggccttgatggcgcgcaatatgttgccctttatggcagtcggccagcccgtcatggttacagcagccgaagccattaccgcacctctctttatttccggcatgagggacgattacttttgggatcattcccacagctcttctctctgttttccaatgccaccattcccccctccatctcttcctctgcccctgatgctgctgcccccaatgcctccggctggacaggccgagtttggtccctttccctttgtgatagtcccgtcctttacttttcccaatgtctag

SEQ ID NO: 20427 - DNA, 375 bp, Artificial Sequence
  Description of Artificial Sequence: Synthetic coding sequence
atgcccgcccccgccgccacctacgagcgggtggtgtacaagaaccccagtgaatatcactacatgaaagtgtgtctggagtttcaggactgcggggtcggcctgaatgcggctcagttcaaacagttactgatcagtgcagtcaaggatcttttcggagaagtcgacgcggcactgcccctcgatatactgacatacgaagagaagactctgtcagcaatcctgaggatctgttcctccgggcttgtgaagctgtggtcttccctcactcttctgggcagctataaaggcaagaaatgcgcttttagggtaatacaggtctctcccttcttgcttgcgctgtccggcaatagtcgcgagttagtgttggattag

SEQ ID NO: 20428 - DNA, 375 bp, Artificial Sequence
  Description of Artificial Sequence: Synthetic coding sequence
atgcccgcccccgccgccacctacgagcgggtggtgtacaagaacccttcggagtaccactacatgaaagtgtgcctcgaattccaggattgcggggtcggactcaatgcagcccagttcaagcagctgttaattagcgctgtgaaagacctttttggagaggtggacgcagcactcccccttgacattctgacctacgaagagaagactctatcggcaattttgaggatttgctcttccggactcgtgaagctctggtcatctctcacgttgctgggctcttataagggaaagaagtgtgccttccgggtcatccaggtgtctcccttcctgctggcgcttagcggaaactcccgagagctagtgctcgactag

SEQ ID NO: 20429 - DNA, 375 bp, Artificial Sequence
  Description of Artificial Sequence: Synthetic coding sequence
atgcccgcccccgccgccacctacgagcgggtggtgtacaagaacccttctgagtaccactacatgaaggtgtgtttggagtttcaagactgcggagtcggcctgaatgcagcccagttcaaacagctgttaatcagcgccgttaaagacctgttcggtgaggtggacgctgcactgccgctagatattctcacctatgaagaaaaaactctgtcagcaatattgcggatctgctcctctggtctggtgaaactctggagcagtctgacacttctaggcagttacaaggggaagaagtgcgctttccgggtgattcaggtgtctcctttcctgttagctttgtctgggaacagtagggagctggtcctcgactag

SEQ ID NO: 20430 - DNA, 600 bp, Artificial Sequence
  Description of Artificial Sequence: Synthetic coding sequence
atggagaacttccggaaggtgcggagcgaggaggcccccgccggctgcggtgcggaggggggcgggcctggcagtggccccttcgccgacttggccccaggggctgtgcatatgagggtaaaggaaggatctaaaattcggaatctgatggcctttgcgacggccagcatggcccagcctgcaaccagggcaatcgtattttccgggtgcggcagggctacaacaaaaaccgtcacatgtgcagaaatcttgaagaggagattggccggactccaccaagtaacacgcctgaggtaccgatctgtgagagaggtctggcaaagccttcccccaggacccactcagggccagaccccaggtgaacccgcagcctctctttcagtcttgaaaaatgttccaggtctggccatcctccttagcaaggatgcgctcgatccccgacaacccggctaccagcctccaaacccacatccaggcccctcatcaccgccagctgcaccagcttctaaaaggtcgctgggagagccagcggctggcgaggggtcagctaaacgaagccagccggagcccggcgtggccgatgaggaccagaccgcatag

SEQ ID NO: 20431 - DNA, 600 bp, Artificial Sequence
  Description of Artificial Sequence: Synthetic coding sequence
atggagaacttccggaaggtgcggagcgaggaggcccccgccggctgcggcgccgagggaggtggacctggctcagggccttttgccgacctggcgcccggtgctgtacacatgcgggtaaaggaaggatccaagataaggaatctgatggctttcgcaaccgcgtctatggcccagccggccaccagagccatagtgttcagtggctgcggtcgtgccaccaccaagacggtaacttgcgcagagatcctgaaaagacggctcgccggcctgcaccaagttacaaggctgagatatcgaagtgtccgcgaggtgtggcagtcactgccccctggcccaacccagggtcagacccctggggagccggcagcgtcattgtctgtcctgaaaaacgtgcccggcctagccattctgctttctaaagacgctcttgaccctcggcagccggggtatcaaccacccaacccgcaccccggcccgtctagccccccagcagccccagcctctaagcgtagcctgggtgagcccgcagcaggcgagggttccgccaagagaagtcagcccgaacccggggtggctgatgaggaccagactgcctag

SEQ ID NO: 20432 - DNA, 1386 bp, Artificial Sequence
  Description of Artificial Sequence: Synthetic coding sequence
atggtgagccgggtgcagctgccccccgagatccagctggcccagcgcctggctggcaatgagcaggtgacgcgggacagggccgtacgtaagctacgcaagtacatcgtggctcggacccaacgcgctgcaggtgggttcacacacgatgagctgctgaaggtgtggaaaggactgttttattgtatgtggatgcaggacaagccactcctccaggaggagctgggcagaacaataagtcagctagtccatgctttccagaccaccgaagctcaacacttattcttacaggcattctggcagacaatgaaccgcgagtggactggcatagacaggctgcgtctcgacaagttttatatgctcatgcggatggtgctgaacgaatctctcaaagtgctgaaaatgcaggggtgggaggaacgccaaattgaagagttgctggaactgctaatgacagaaatcctgcaccctagcagccaagcacctaacggggtcaaatcacatttcatcgagatcttcttggaagagctgaccaaggtcggggcagaagagctgacggctgaccaaaatctcaagttcattgatccattttgtcgtattgccgctcggacaaaggactcccttgttctaaacaatattacccgaggtatctttgaaaccatcgttgaacaggctcctttagctatcgaggaccttcttaacgaactagatactcaagatgaggaggtcgccagcgatagtgatgaatcaagcgaaggaggagagagaggtgacgccctgtcccagaagaggtctgaaaaacctcccgctggatcaatctgccgtgctgaacctgaggccggggaagagcaggccggtgacgaccgcgattccggtggtcccgtgctgcaatttgactacgaagctgtggctaaccgcctcttcgagatggcctcacgacagtcaaccccaagccagaatcggaaaagattgtacaaagttattagaaagctgctcccttggttttcagggatcttcccagaggatgaaattccagaaaaggcctgccggcgcctcctggaaggcagacggcagaagaaaacaaagaagcaaaagcggctgttacggctgcagcaggaaaggggaaagggggagaaggagccaccatctcccgggatggagcgaaagcggtctcgacgaagaggtgtcggcgcagatcctgaagcaagagccgaagcaggcgagcagccaggtaccgccgagcgggctcttctacgcgaccagccccgcggcagaggacagcgaggtgcccgacagcgaagacgaactcccaggcccctgacatctgcccgggcaaaagctgccaatgtccaagaaccggaaaaaaaaaagaagagacgagaatag

SEQ ID NO: 20433 - DNA, 1386 bp, Artificial Sequence
  Description of Artificial Sequence: Synthetic coding sequence
atggtgagccgggtgcagctgccccccgagatccagctggcccagaggctcgctgggaatgagcaggttacaagggatcgtgctgtaaggaagcttagaaagtatattgtcgcgcgaactcagcgggccgccggtgggtttacgcacgacgaattgcttaaggtttggaagggtcttttttattgtatgtggatgcaagacaagcccctgttgcaggaggagttggggcggacaatctcacagcttgtgcatgcctttcaaaccactgaggctcagcacttattcctgcaggctttctggcagactatgaatagagagtggaccggaatcgaccgtctcaggctggacaaattctacatgcttatgcgtatggtgttgaatgaatctctgaaagtgctgaagatgcagggatgggaagagaggcagattgaagagctgctcgagctcctgatgaccgagatcctccaccccagcagccaggcaccaaatggagtgaagagccattttatagaaatttttttggaggaactgacgaaggtcggggccgaagaacttacagcagatcagaatctgaaatttatagacccgttctgcagaatagccgcgagaacgaaggattccctcgttttgaacaacatcacacgggggatattcgaaactatcgtggaacaggcccccctcgcaatcgaagatctgttgaacgagcttgacacccaagatgaagaggtggcgtcggatagcgacgaaagctctgaagggggggaacgtggcgatgccttgagccagaagaggagcgaaaaacctcccgctggcagcatctgtcgcgccgaaccagaggccggagaagagcaggctggggacgaccgagattccggcggtcccgtcttgcagttcgactatgaagccgtggctaaccggctgtttgagatggcatccagacagtctactccaagtcaaaatcgaaaaaggctttataaggtgattagaaagctacaagacctggccgggggaatatttcctgaagacgagattccagagaaggcctgccgtagattgttggagggtagaagacaaaagaaaacaaagaagcagaagcgactccttcgactgcagcaggagaggggcaagggcgaaaaggaacctccaagcccgggtatggaaagaaaaagatcccggagacgcggagttggggccgaccctgaggcccgggccgaagcaggggaacaacccggtactgcggagagagccctgttgagagaccagcccagaggacgtggtcagagaggggcccgccaacggcgccgtactcctcggccattgaccagcgcaagggcaaaggcagctaatgtgcaggagcccgaaaagaaaaaaaaacgccgagagtag

SEQ ID NO: 20434 - DNA, 1371 bp, Artificial Sequence
  Description of Artificial Sequence: Synthetic coding sequence
atgttcgaggagcccgagtgggccgaggccgcccccgtggccgccggtttgggtcccgtgatttctcgcccgcctcctgcagccagcagtcagaacaaaggctcgaagaggagacagctcttggctactctgcgggcactcgaggccgcctccttgtctcagcatccaccatctctctgcatttctgacagcgaggaagaagaggaggagcggaagaagaagtgtcctaaaaaggcatcttttgcttccgcttccgctgaagtggggaaaaaaggtaagaaaaaatgccagaaacaggggcctccctgttctgacagtgaggaggaagtagagcggaagaaaaagtgtcacaaacaagctcttgtgggtagcgacagcgccgaagatgagaagaggaagcgaaagtgtcagaaacacgccccaattaattccgcccagcatctggataacgtggaccaaactgggcccaaggcgtggaagggctctaccacgaatgatcctccgaaacaatctcccggctccacctcacccaaaccaccccacacgctatcacggaagcagtggagaaatagacagaaaaacaaacgtaggtgcaaaaataagtttcagccacctcaggtgcccgatcaggcacctgctgaagcacctactgagaaaactgaggtcagtcccgtaccacgcactgattcccacgaggcacgcgctggagccctgcgggccagaatggcacagaggttagatggcgctaggttccgctacctgaacgaacagctctacagcggaccctcatcagccgcacagcgtctgttccaggaggacccagaggcgttccttctgtaccatcgagggtttcagtcccaagtcaagaagtggccgctccaaccagtcgatcgcatcgcacgcgatctgcggcaaaggccagcctctctagtcgtggctgacttcggctgcggtgactgtcgtctggcaagtagcatccggaatcccgtgcactgtttcgatctggcctcgctggacccacgcgtgaccgtatgtgatatggcacaggtgcctttggaggacgaatcagttgacgttgctgtgttttgcttgtccctgatggggacgaacattagagacttccttgaggaggccaatcgggttcttaaaccaggagggctgctcaaagttgcagaggttagctcacgctttgaggacgtcagaacattcctgcgcgccgttaccaagctcgggtttaaaattgtctcgaaggacttgacaaacagccacttcttcttattcgatttccagaaaacgggcccccctctcgttgggccgaaagcccagctctctgggttgcagttgcaaccttgcctatataaaaggcgatag

SEQ ID NO: 20435 - DNA, 1017 bp, Artificial Sequence
  Description of Artificial Sequence: Synthetic coding sequence
atggagctgtggggccggatgctgtgggccctgctgagcggccccggccggcgtggttccacaaggggctgggctttctctagctggcagcctcagcctccactagctgggctaagctctgccattgagcttgtttctcactggacaggcgtttttgagaagaggggaattcccgaagctcgggaatctagcgagtacatagtcgctcatgttttgggcgcaaagacatttcagagtctgagacccgcattgtggactcagccactgacctcacagcagcttcagtgcattcgggaactgtcgtccagaagactgcagcgaatgccggtgcaatacattctgggtgagtgggactttcagggtctctcattgagaatggttccacctgtgttcatcccaagaccagagacggaggagttagtcgagtgggtgctggaagaggtggcccagaggagtcatgccgtcggatcccccggctcaccattaatattagaggtgggatgcgggtctggagcgataagtctatccctcctgtctcagctgccccaatctagggtgattgccgtcgataagcgcgaagccgcaatttctctgacacatgagaacgcccagagacttaggctgcaggaccggatatggattatccacttggatatgacttctgagaggtcatggacccacctaccctggggccctatggacctgatagtctccaatcctccatatgtcttccaccaggatatggagcagctcgcccccgagattcgcagctacgaggatcctgcagcactggatggcggcgaagagggcatggacataattactcatattctggcactcgcacctagactgctgaaagacagcgggagcatctttctagaggtcgaccctagacacccagaactggtgtccagctggctgcagagccgcccggatctgtatctgaatttggtggccgtgcggcgtgatttctgtggcagaccacggttccttcatatcagacgttctggtccatag

SEQ ID NO: 20436 - DNA, 1050 bp, Artificial Sequence
  Description of Artificial Sequence: Synthetic coding sequence
atggccaaggccggcgacaagagcagcagcagcggcaagaagagcctgaagagaaaagctgctgccgaggagcttcaagaggcagcaggcgccggtgacggcgcaactgaaaatggggtgcagccgcccaaagctgcagcctttcccccaggcttcagtattagcgagatcaaaaataaacagcggagacatcttatgtttacacgatggaagcagcagcagcgaaaagagaagcttgccgcaaaaaaaaaactgaagaaagagcgcgaggctcttggcgacaaagccccaccaaaaccagtgccaaaaacgatagataaccagcgggtgtatgacgaaacgactgtagaccctaacgacgaagaggtcgcatatgatgaagcaactgacgaattcgccagttacttcaacaaacagacaagccctaaaattctcataaccacctctgacaggccccatggccgcactgttagactttgtgaacagctttcaacagtcatccccaacagccatgtctactaccgtaggggcttggctctcaagaagattatcccccagtgtatcgcccgcgactttaccgacctcatcgtgataaacgaagaccgcaaaacacccaacggcctgatcctgagtcacctgccaaacggcccgacagctcattttaaaatgtcaagtgtgaggttgcgtaaggagatcaagcgcagaggaaaagacccaactgaacacattcccgaaatcatactcaataatttcacgacacgcctgggccacagcatcggcaggatgtttgcctcattgttcccgcacaacccacagtttatcggcagacaagttgccaccttccacaatcagagggactacatcttctttcgttttcacaggtacattttcaggtctgaaaagaaggtggggatccaggagcttggaccccgattcaccctcaaattgaggtctctgcagaagggaactttcgactccaagtacggcgaatatgagtgggtgcacaagcctagggaaatggatacatcacggcgcaagtttcacctttag

SEQ ID NO: 20437 - DNA, 390 bp, Artificial Sequence
  Description of Artificial Sequence: Synthetic coding sequence
atggccaaggccggcgacaagagcagcagcagcggcaagaagagccttaaaaggaaggccgctgcggaggaactgcaagaagcagcaggggctggcgacggggctacagagaacggggtgcagccacccaaggccgccgcatttccgccaggtttctctataagcgagatcaaaaacaagcaacgacgacacctcatgttcacacgctggaagcagcaacagcgcaaagagaaactggccgccaagaagaaactgaagaaagaaagggaggccctgggtgataaagctccacctaaacctgtcccaaagacaatcgataatcaaagagtctacgacgaaacaacagtcgacccgaacgatgaggaggttatgttggaagttctgaattag

SEQ ID NO: 20438 - DNA, 627 bp, Artificial Sequence
  Description of Artificial Sequence: Synthetic coding sequence
atgtgcttcgtgctgaaggccatcaacttcgtgctgcagtacgccctcaagaaaccttatggagtgctgtacaaaaaaaagaatatcaccagaccatttgaggaccagacatccctggaatttttcagcaagaagtccgactgttctttattcatgttcgggtcccacaataaaaaacgccctaacaatcttgtgattggacgaatgtacgactatcacgtcctggatatgattgagctgggcattgaaaatttcgtttcactcaaagatataaagaattccaagtgtcccgaaggcacgaagccaatgctgatcttcgcaggcgacgattttgacgtaactgaagattatcgccggctgaaatctctgctgatagatttcttcagaggtccgactgtgtcaaacatcaggctcgcagggttggaatacgtattacatttcacagctctgaacggaaagatttactttcgatcatacaagcttttgcttaagaaatccggctgtagaaccccgagaatagagttggaggagatggggccctcattagatctcgtgctgaggcggactcacctggcttctgatgatctctacaaactgagcatgaaaatgcctaaggctcttaagtag

SEQ ID NO: 20439 - DNA, 645 bp, Artificial Sequence
  Description of Artificial Sequence: Synthetic coding sequence
atgctgatcaagggcggcaacgccaacgccaccgtgaccaaggtgttgaaggacgtgtacgctcttaaaaaaccatacggagttttatataagaagaaaaatatcacaagaccctttgaagaccagacaagtctggaatttttcagcaaaaagagcgactgctccctattcatgtttggatcccataataaaaagcgtcctaataacctggtgattgggagaatgtatgattaccacgtgctggacatgatcgagttaggcattgaaaacttcgtaagtctcaaggatattaaaaactcaaaatgtcctgaaggcaccaaaccaatgctcatatttgccggtgatgactttgatgtcacggaagattatagaaggttgaagtcccttctcatagactttttcagaggccctaccgtgtccaatatacggttggctggtctggagtatgtgctgcattttacggctttgaacgggaagatctactttcgaagttataaattattgttgaagaagagtgggtgtcggactcccagaatcgaattggaagaaatggggccatctctcgacttagtgctgcggcggactcatctggcaagtgacgacctgtacaaactctccatgaagatgccgaaagcgctgaagtag

SEQ ID NO: 20440 - DNA, 921 bp, Artificial Sequence
  Description of Artificial Sequence: Synthetic coding sequence
atggacaccctggaccgggtggtgaagcccaagaccaagcgggccaagcgcttcttggaaaagagagagccaaagctcaacgaaaatatcaagaatgctatgctgattaaagggggcaacgccaacgcaaccgttactaaagtgcttaaggacgtctacgctctgaagaagccctacggcgtcctgtataagaaaaaaaatattaccaggccttttgaagatcagactagcttggaattctttagcaagaagagcgattgcagtctgttcatgtttggatcccacaacaagaagagacccaacaacctggtgattggacgaatgtatgactatcacgttctcgatatgatcgaactggggatcgagaacttcgtcagcctgaaggacattaagaactccaagtgccctgaggggacgaaacctatgttaatttttgccggggatgatttcgacgtgaccgaggactatcgccgactgaagtcactattaatcgatttcttcagagggccaactgtcagtaacattcgcttagcgggacttgagtatgtgctccattttaccgcactgaacggcaagatttactttcggagctataaactcctcttgaaaaaatctggctgcaggaccccgcggattgaactcgaagaaatgggcccaagtctggatctggtgcttcgccgtacccacctcgcaagcgacgacttatataaattatccatgaaaatgcccaaagcactgaagcctaaaaaaaaaaaaaatataagccacgatactttcggcactacctatggtaggatccacatgcaaaaacaggacctttcgaaactgcagacccggaagatgaagggtttgaaaaaaaggccggctgaacgcataactgaggatcatgagaagaagtctaagcgaatcaagaaaaattag

SEQ ID NO: 20441 - DNA, 546 bp, Artificial Sequence
  Description of Artificial Sequence: Synthetic coding sequence
atgagcggcatcggcaacaagcgggccgccggcgagcccggcaccagcatgcctccagagaagaaggcagccgtggaagattctggaacaaccgttgagaccattaaactgggaggcgtttcctcaactgaagagctggatatacgcactctccagactaaaaaccggaaactagcagaaatgctcgaccagcggcaagctattgaggatgagttgagggagcacatcgagaagctggaacgacgtcaagccacggatgatgcttcccttttaatagtgaaccggtactggtctcagttcgatgagaacattagaataatcctgaaacgatatgaccttgagcagggcctgggggacctactaactgagcggaaagccttggtagtaccagaaccagaaccagattccgactccaatcaggagcgcaaggacgatcgtgaaagaggggagggccaggagccggctttttcgttcttggctactctggcatcttcttcatctgaagagatggaatctcagttgcaagagagagtcgagtcaagttag

SEQ ID NO: 20442 - DNA, 2928 bp, Artificial Sequence
  Description of Artificial Sequence: Synthetic coding sequence
atgagcggcatcggcaacaagcgggccgccggcgagcccggcacctcgatgccacctgagaagaaagctgctgtggaggattctggcaccacagtcgaaactattaagttggggggagtgtcctccaccgaagaactcgatatcagaacactgcagactaagaaccggaagctggccgagatgttggatcagaggcaggccattgaagacgaactccgagagcatattgagaaattggaacgtcggcaggcaaccgatgacgcgtccctcttaatcgtaaacagatactggtcccagttcgacgagaacatcagaattatactcaaaaggtatgaccttgaacagggtctgggggatctgcttacagagagaaaagcactggtcgtccctgagcccgaaccagacagcgatagcaaccaggagaggaaggacgaccgggagagaggagagggacaggaacccgctttttcctttctcgcaactctggctagtagttctagcgaagaaatggagtctcagctgcaggaacgggtcgaaagctcacggagagcagtcagccagattgtaacagtgtatgacaagcttcaagagaaggtcgaactgttgtcccggaagttgaattctggggataacctgattgtagaagaggccgtgcaggagctgaactcttttctggctcaagagaatatgaggcttcaggaactgaccgaccttctgcaggaaaaacacaggacgatgagccaagaatttagcaaattgcagagcaaggttgaaacagccgaaagccgtgtcagcgtgctggagagcatgatagacgacctccaatgggatattgataagatccgtaagagagagcagaggctgaatcggcatctggccgaggtgctggagagggtgaatagcaagggctacaaggtgtacggggccggctcctccctttacgggggaaccattacaattaatgctcggaagttcgaggagatgaacgcagaactggaggagaacaaagagctggcacagaaccgcctttgtgaactagagaagcttcgtcaggactttgaggaagtcacaacccagaatgagaaactgaaagtcgagctacgatctgcagtggagcaagtggtcaaggagacccctgaatatagatgtatgcagagtcagttttctgttttgtacaacgagagtctgcaattgaaagctcacctggatgaagcgaggacactgttgcacggcacacgaggcacacaccagcatcaggtagaactgatagagagagacgaggttagcttgcataaaaaactacgaaccgaagtgatacaactggaggacactctggcccaggttaggaaagagtatgagatgctgcgtatcgaattcgagcagactctggccgccaatgaacaagctggcccaatcaatcgcgagatgcggcacctcataagctccctgcagaatcataatcaccagctgaaaggtgaagtgctgaggtacaagcgtaaactgagagaagcccagtctgatctgaacaagactcgacttcgcagcggatccgccctgctgcagtctcaatcttctaccgaagatccaaaggatgagccggccgaactaaagcccgatagcgaggatctctcctctcagagctctgcaagtaaggcatcccaggaggatgctaacgaaataaaatctaaacgcgatgaagaggagcgcgaaagagaacgccgcgagaaagaaagggagcgcgagagagaacgagaaaaagagaaggagcgcgagcgggaaaaacagaaattgaaagagtccgagaaagagcgggattctgcaaaggataaagaaaagggcaaacatgatgatggcaggaaaaaagaggccgagatcattaagcagttgaaaatagaactgaaaaaagctcaggaatctcagaaggaaatgaaacttttgcttgatatgtacaggtctgcaccgaaggagcagcgagacaaagttcagttgatggcagcggagaagaaatctaaggctgagctcgaggatctcaggcagcgtttaaaggacctggaggataaagaaaagaaagagaataaaaagatggccgacgaggacgccttgagaaaaattcgcgccgttgaggagcagatcgaatacttgcaaaagaagctggctatggctaagcaggaggaagaggcactcctgagtgagatggacgtgaccgggcaggcatttgaagacatgcaggagcagaacattcgactgatgcagcagcttcgcgaaaaagatgacgccaacttcaaacttatgtccgaaagaatcaagagcaaccaaatccacaagctgcttaaggaggaaaaggaagagctggcagatcaggttctgactcttaagacacaggttgatgctcaactccaggtcgtcagaaaattggaggagaaggagcatttactccaatccaacatcgggactggtgaaaaggaattggggttaagaacccaagcactagaaatgaataaaaggaaagcaatggaagcagctcagctggctgacgacctcaaggctcaactggagctggcccagaaaaaactgcacgacttccaggacgagatcgtggagaactctgtgactaaggaaaaggacatgttcaattttaaaagggcacaggaggatatctcccggcttaggcgcaaactcgagacaaccaagaagccggataatgtcccgaagtgcgacgagatcttgatggaggagataaaggattataaggcccggctcacttgcccctgttgtaatatgagaaagaaagacgccgtgctgactaaatgtttccatgtcttttgcttcgagtgcgtaaagacccggtacgataccagacaaaggaagtgtcccaaatgtaacgcggcattcggggcaaacgacttccatcggatctacatcggttag

SEQ ID NO: 20443 - DNA, 438 bp, Artificial Sequence
  Description of Artificial Sequence: Synthetic coding sequence
atgagcggcatcggcaacaagcgggccgccggcgagcccggcacctccatgccaccagaaaagaaggcagccgtggaagactctggtacaacagtggaaaccatcaagttgggaggtgtctcctccaccgaagagttggatattcgcaccttgcagacaaagaataggaagctggcggagatgcttgaccagcgtcaggccatcgaagatgaactaagggagcacattgaaaagttggagaggagacaggctacggacgacgcatctctgcttattgtgaacaggtattggagccagttcgacgaaaatatcagaattatcctgaagcgctacgatctcgaacaaggcctgggtgacctgcttaccgagcgcaaagccctggtggtgccggaaccagagcccgattctgacagcaatcaggagcgcaaagacgattag

SEQ ID NO: 20444 - DNA, 300 bp, Artificial Sequence
  Description of Artificial Sequence: Synthetic coding sequence
atgagcggcatcggcaacaagcgggccgccggcgagcccggcaccagtatgccccctgagaagaaagcagccgtggaggattccggtaccaccgtggaaactattaaattaggcggggtgagcagcacagaggagttagatatccggacactacagaccaagaaccgcaagctagccgagatgctcgaccagagacaggctattgaggacgagttgagagagcatatcgaaaaacttgaaaggagacaggctaccgatgacgcatccctactgatcgtgaacaggtactggtctcaatag

SEQ ID NO: 20445 - DNA, 1878 bp, Artificial Sequence
  Description of Artificial Sequence: Synthetic coding sequence
atgaacgtgaccagcatcgccctgcgggccgagacctggctgctggcagcctggcacgttaaagtgcctcccatgtggctggaagcttgtatcaattggatccaggaggagaataataatgtcaatctgtcccaggcccagatgaacaagcaggtttttgaacagtggcttcttacagacctaagggatctggagcaccctctactccccgacggcatactggagatcccaaagggggagttgaacggattttacgcactacagattaactctttagtcgacgtatctcagcccgcttactcgcagatccagaagcttagaggtaagaacaccactaacgacttggtaacagccgaagcccaggttacacccaaaccatgggaggcaaagcccagcaggatgctgatgcttcagctcacagatgggattgtccagattcagggtatggagtatcagcctatcccaattctgcatagcgatctgcctcccggaacaaagattctgatctacggcaacatctccttccgtctcggtgttctgctcctgaaacctgaaaacgtgaaagttctgggtggggaagtggatgccttgctagaggaatacgcccaggaaaaagtgcttgccagactcattggggagcccgaccttgtggtcagcgtcatcccaaataatagtaacgaaaacattccccgagtcaccgacgtcttagatccagctctgggacccagcgacgaagagttactggcaagtctagacgaaaacgacgaattaacagcaaacaacgatacctctagtgaacgctgttttaccaccgggtcttccagcaacaccatacctacaaggcagagcagtttcgagccggagtttgtgataagtccccggcccaaggaagaaccgtctaatctgtctatccacgttatggacggggaactggacgatttttcactggaggaggcattgctacttgaagagaccgtccaaaaagaacagatggaaacaaaagagctgcagcccctgacgtttaatcgcaacgccgacaggagtatcgaacgcttttctcacaaccccaacactacaaacaatttcagtttaacatgtaaaaacggaaacaataattggagcgagaaaaacgtctccgagcaaatgacaaatgaggataagagctttgggtgtccttctgtgagggaccagaacagatctatattttcggtccactgcaacgtgcctctcgcccatgatttcactaacaaagaaaagaaccttgaaaccgacaataaaatcaaacagacctcgagctcagatagccactcgttgaacaacaaaatcctgaacagggaagtcgtcaattatgtgcaaaaaaggaatagtcaaatttctaatgagaacgactgtaatctccagtcatgcagtcttcgctccagcgagaactccatcaatctttctattgcgatggatctgtactctccgccttttgtctacctatccgtcctgatggcaagtaaacccaaggaagtgactactgttaaggtaaaggcctttattgttacattaaccggcaatttatctagttccgggggcatatggagcattacggccaaggtgagcgatggcacagcgtatctggacgttgattttgttgacgaaatactgacctcactgataggtttctcagtgcccgaaatgaaacagagtaagaaggatcctctccagtatcagaagttcttggaagggcttcagaagtgccagagggatctcatcgatctatgttgcctcatgacaataagcttcaacccctccctgtcaaaagcaatggtgttagctctgcaagacgtaaacatggagcacttggaaaacctcaagaaacgactgaacaaatag

SEQ ID NO: 20446 - DNA, 2196 bp, Artificial Sequence
  Description of Artificial Sequence: Synthetic coding sequence
atgcccagcatcccccccatccccgtgcccccccccgtgcccaccttaccccccgtaccaccagtgccccccatccccccagtccccagcgtgccaccaatgacaccactcccccctatgtccggcatgccgccactgaatccacccccagtggccccactgcctgctggtatgaacggctcaggcgcccctatgaatctgaacaataatctcaaccccatgtttctgggtcctcttaatccagtaaatccaatacagatgaattcacagtcctctgtcaaacctcttccaattaatcctgatgacctgtatgtaagtgtgcatggtatgccatttagtgctatggagaacgatgtccgggatttcttccacggattacgggtggacgccgtgcatttgcttaaggatcatgtaggacggaataacggcaatggcctggtgaagtttcttagccctcaggatacgttcgaggccctgaagcggaataggatgttaatgatccaaaggtatgtagaagtttcccctgccaccgagaggcagtgggtagctgcgggcggacacatcacgtttaaacagaatatgggccctagcggtcaaacccatcctcccccacagacattaccgcgatctaagagcccatcaggtcaaaaacggtctaggagccgttcccctcacgaggctgggttttgcgtctacttgaagggattacccttcgaggccgaaaacaagcacgtcatcgacttttttaagaagttggacatagttgaagactctatctacattgcatatgggcctaacggcaaggctaccggagagggcttcgtcgagtttagaaacgaggccgattacaaggccgcactttgtaggcacaagcagtatatgggcaacagatttatccaagtccaccctattactaaaaagggaatgctggaaaagatagatatgatccgaaagagactgcagaatttttcctatgatcagcgcgaaatgattttaaatcccgagggagatgtgaacagtgccaaagtatgcgcccacatcaccaatattcccttctcgatcaccaaaatggacgtcctgcagtttctggaggggatcccggtggacgaaaacgccgtccatgtactagttgacaacaacggccaggggcttggccaggcattggtccagttcaaaaatgaggacgacgcccgtaaatctgagagattgcaccgtaaaaaattgaatgggagggaggctttcgtgcacgttgtgactctggaagatatgagggagatcgaaaagaatcccccagcccagggcaagaagggccttaagatgcctgtgccgggtaatccagctgtccccggcatgcccaatgcaggactcccaggcgtgggccttccttcagccgggctgccaggagccggattgcccagtactggcctgccgggctcagcgataacctccgcagggttgcctggggccggtatgccttctgcagggatcccctctgctgggggcgaagagcacgcttttctcaccgtgggctccaaagaggctaataatggcccaccttttaacttcccaggtaactttggcgggagcaacgcttttggaccgcctattcctcctcccgggctgggggggggcgcgttcggcgacgcaagaccaggaatgccgtcagtggggaatagtggacttccaggcctcggccttgacgtgccgggtttcggcggcggacccaacaatctaagcgggccatcgggattcggcggggggccacagaactttggtaacgggcccggaagcttggggggacctccgggatttgggtctggcccccccgggctaggttccgcccccgggcacctgggaggccctccagcctttggtcctggaccggggcccggccctggtccaggcccaattcacatcggaggcccccctgggtttgcctcgtccagtggtaagcctggacccacagtgataaaggtgcagaacatgcctttcacagtgagtatcgacgaaattctggactttttttatgggtatcaggtgatccccggctctgtctgcctgaaatacaatgagaagggcatgcccactggagaggctatggtcgcgtttgagtcacgagacgaggccaccgctgccgtgatagacctgaacgaccgccccattggcagtcgtaaagtcaagctggtgctgggatag

SEQ ID NO: 20447 - DNA, 2799 bp, Artificial Sequence
  Description of Artificial Sequence: Synthetic coding sequence
atggccgtggtgatccggctgcagggcctgcccatcgtggccggcactatggacatccgccattttttctcaggtctgactattcccgacggcggcgttcacattgtgggcggggaacttggagaggcctttattgtatttgcaacagacgaggacgcgcggttgggtatgatgagaaccggtgggactattaaaggaagcaaagtcactcttctgctgtcctccaagactgaaatgcagaacatgatcgagctatcacggcggagattcgaaacagccaatctagatattccacccgcgaacgcatccagaagcggcccacccccaagcagcgggatgtccagcagagtgaatctgccgaccaccgtgagcaactttaacaacccgtcaccatctgtagttaccgcaacaacctcagtgcatgagtccaacaagaacattcagacattttccaccgcctcagtgggcactgctcctcccaatatgggcgctagtttcgggagtccaaccttcagctccaccgtgccaagcaccgctagtcctatgaataccgtccctccacccccaattccccctatccccgcaatgccgagcttacctcctatgcccagcattcccccaattcctgttcctccacctgtgccaacgctgcccccagtccctcccgtaccacccataccccctgtgccatccgtgccccctatgacgccgctgccacccatgagtggaatgccccctctgaaccccccaccggtagccccactacctgctggcatgaatgggtccggggctcctatgaatctgaacaacaatctaaatcccatgttcctgggccctctgaatcctgtgaaccccatccagatgaactcccagtcatcggtgaaacccctcccaatcaaccccgacgatctgtatgtcagcgtgcatggcatgccgttcagtgcaatggagaacgacgtcagagattttttccacggactgcgagtcgatgcagtccacttactcaaagaccacgtggggcggaataacggcaacggcctggtgaaattccttagcccacaggacacattcgaagcactaaaacgtaaccggatgctgatgatccagcggtacgtggaggtaagccctgccactgagaggcagtgggtcgccgctggcggtcacatcacatttaagcaaaacatgggcccaagcggacagactcatcccccaccacagactcttcccagaagcaaatcaccttcaggccaaaagcggagtcgatcccggagcccacatgaggcaggattttgtgtttacctgaagggactcccctttgaggcagagaacaaacatgtgatagatttcttcaaaaagctggacatcgtggaggactccatctacattgcatatgggccaaatgggaaagccaccggcgagggcttcgtggagttccgcaacgaggctgactacaaagctgctttgtgccggcataaacagtacatgggaaaccgttttatacaggtgcatcctataacaaagaagggaatgttggagaagattgacatgattaggaaaagactacagaatttcagttacgaccaaagagagatgatactgaaccctgaaggagatgttaactctgcaaaggtttgcgcccatatcactaatattcctttttcgataaccaagatggacgtcctgcagtttctcgagggcattcccgtcgacgaaaacgcggtacatgtgcttgtggacaataacggccaaggactgggtcaggccctagtccagttcaaaaatgaagatgacgccaggaagagtgaacgcttgcatcgtaagaaactgaacggacgagaggcgttcgtgcacgttgttaccttggaagatatgagagagattgaaaaaaaccctccagcacaaggcaagaaggggttgaagatgcccgttccaggaaatcccgcggtgcctggaatgccaaatgccggattgccgggagtgggtcttccatccgccggtctccctggtgcaggcctacctagcaccggactgcccggttccgccatcaccagcgcgggccttccaggcgctggcatgcccagcgccggcataccgtccgcgggcggggaggagcacgccttcctcactgtcggctcaaaagaggctaacaatgggcccccattcaatttccccggcaatttcggagggtcgaacgcgttcggcccaccgattccaccccctggcctgggcggcggcgccttcggggatgcccgtcctggtatgccaagtgtgggtaacagcggattaccaggcctgggcctggacgtccctggatttgggggcggccccaacaatctgtctgggccctccgggttcggtggtggacctcaaaacttcgggaacgggccaggcagcctgggcgggcctccagggttcggtagcggcccaccgggactcgggtccgctcctgggcacctgggaggtccaccggccttcggtcctgggcccgggcccggtcccggtccaggtcccatccatattgggggcccaccaggattcgcgtcatctagcggtaagcccggacccacggtaataaaggtccagaacatgccattcacagtctcgattgacgaaattctggacttcttttatggataccaggtgattcccggtagtgtctgcctcaaatataatgaaaaagggatgcccaccggcgaggctatggtggcattcgagagcagagacgaagctacagccgccgtgatagacttaaacgataggcctattggttccagaaaggtcaagttggtcttgggctag

SEQ ID NO: 20448 - DNA, 2799 bp, Artificial Sequence
  Description of Artificial Sequence: Synthetic coding sequence
atggccgtggtgatccggctgcagggcctgcccatcgtggccggcaccatggatattaggcactttttctcaggcctgacgatccccgatggcggcgtgcacatcgtgggaggggaactgggtgaggcatttatcgtattcgctactgacgaagacgcccgcttgggaatgatgagaacgggtggcacaatcaagggcagcaaggtcactctgcttctgtccagcaagacagagatgcagaacatgatcgagttaagtaggcgccggttcgaaaccgccaacttagatatcccacccgcgaatgctagtaggagcgggcctcctccatcttcagggatgtcttcccgcgtcaatctaccaactacggtctccaatttcaacaacccaagccccagcgtggtcaccgctaccacctcagtacatgagtccaataagaacatacaaaccttttctacagcttctgtgggcacagcacctccaaatatgggcgcttcatttggatcccctacgttttcgtccaccgtcccgtctactgcatcacccatgaacactgtgccccccccacctattcctcctatcccggcaatgccctctctgccaccaatgccttcgatccccccaatcccagtgcccccacccgtgccgaccctcccacccgttccaccggtacctcctatccccccggtgcccagtgtcccccccatgacgcccttgccccccatgagcgggatgcctcccctcaatcctcctcctgtggctccccttccagcaggaatgaacggatccggagctcccatgaatctcaataacaatctaaacccaatgttcctcggacctctcaatcctgtcaatcccatccaaatgaacagccaaagctccgtgaaacctctgcccatcaatcccgatgatctctatgtctctgtgcacggaatgccttttagcgccatggagaatgatgtcagggatttttttcatggcctgcgtgtggacgccgtgcacctgctcaaagaccatgttggccggaacaatggtaacggactcgtgaagttcctttctccccaggacacgtttgaggcccttaagcgcaaccgtatgttgatgatacagcggtatgtggaggtgtcacctgctactgagcgccagtgggtcgccgcaggaggccatattacattcaagcaaaacatggggccttctggccagacccatcctccgccacaaactctccctagaagcaagagcccatccggtcagaaacgtagcaggtcacggagcccgcatgaggcgggattctgtgtatacctgaaaggtttgcccttcgaggcagagaataaacatgtgattgatttctttaagaaacttgacatcgtggaggattcaatttatatcgcatatggcccaaacggtaaagctacaggcgaagggttcgtggaatttcggaatgaagcagattacaaagccgcattgtgtagacataaacagtatatgggcaatcgatttatccaggtgcacccaattaccaagaagggtatgctcgaaaagattgatatgatcagaaaaaggctgcagaactttagctacgatcagcgggaaatgattctgaatcctgagggggacgtcaactctgctaaggtatgtgcacacatcactaatatccccttctccatcacaaagatggacgtgttgcagtttctggagggtattcctgtcgatgaaaatgcagtgcatgtgctggtggacaacaacggccagggcctcggacaggcactggtgcaatttaaaaatgaggacgacgcccggaaaagcgaaagactgcaccgcaagaagctcaacggaagagaggcatttgtgcacgtcgttaccttggaggacatgagggaaattgaaaagaacccccctgcccaggggaagaaggggctcaaaatgcctgtccccggcaatcctgcagtccccggtatgcccaacgctggtctgccaggcgtgggattgccgtccgctgggctccctggggctgggctccccagcacgggccttcccggctctgcaatcacctctgccggactgccgggtgccgggatgcccagcgctggcattccttctgccggcggggaagaacacgcctttttgacggtgggttccaaggaggccaataacggtcctccatttaactttccaggtaattttggagggagcaatgctttcggcccccctatccccccacctggtttgggcggtggggctttcggcgacgcccgacccggaatgccgagtgtcgggaattcaggtttacccggattgggcctcgatgtgccggggttcggtggcggccctaacaacctctcagggccatccggcttcggcggcggcccacagaacttcggcaatggacccggcagcctggggggaccaccaggcttcggtagtggccctcccgggttaggcagtgccccaggccacctgggtggaccccccgcatttggtcccggacccggacccgggcccggccccggtccaatacatattggcggccctccgggattcgcgtccagctcagggaagcccggaccaaccgtgattaaggtgcagaatatgcctttcaccgtttcgatagatgagatcctggacttcttttatgggtaccaggtaattccagggagcgtttgcctgaagtataatgagaagggcatgcctaccggcgaggcgatggtggccttcgagtcccgggacgaggccactgctgccgtcatagatctgaatgaccggcctatagggtcacggaaggttaaactcgtgttgggctag

SEQ ID NO: 20449 - DNA, 2799 bp, Artificial Sequence
  Description of Artificial Sequence: Synthetic coding sequence
atggccgtggtgatccggctgcagggcctgcccatcgtggccggcactatggatatacggcacttcttctccggactgaccatacccgatgggggagtgcacatcgtgggcggcgagcttggcgaagccttcatcgtcttcgctacggatgaagatgctagactcggcatgatgagaactgggggtactattaaagggtcaaaggtcactcttctgctgagcagcaagacagaaatgcagaatatgatagaactttcccggcgccgctttgaaacagccaatctggatattccccccgccaacgcttctcgctctggcccacctccgtcttccggcatgagctcgcgcgtgaacttacctactactgtttcaaattttaataaccccagtccgtcagtagtcaccgctacgacgtcagtccacgagagcaacaagaatatccagacattttccactgctagtgttgggacagcacccccaaacatgggggcttcctttggaagtcctactttcagcagtacagtaccctcaaccgctagtccaatgaatactgtgccccctcccccaatccctcccattccggctatgccctctttgcccccgatgcccagcatccccccgatcccagttccccctcccgtgccaacattgccgcccgttcccccggttccccccatcccccccgtgcccagcgtgccgccaatgacaccgcttccgcccatgtcaggtatgccacccttgaatcctccaccagtcgcacccctgccagctggtatgaacggttctggtgcacctatgaacttgaacaataacctgaacccgatgtttcttggacccctcaaccctgtgaatcctattcagatgaattcacaaagctccgtgaagcccctccctattaaccccgatgatctgtacgtgagtgtgcacgggatgccgttctccgcaatggagaatgatgttagagactttttccacgggttgcgcgtggacgctgtccacctgcttaaggaccatgtcggacgcaacaatggcaatggcctggtcaaattcctgtctccgcaggacacctttgaggctcttaaacgcaatcggatgctgatgatccaacgttacgtggaggtctcccctgctaccgagaggcagtgggtggctgccggaggtcatattacttttaagcagaacatgggcccttctgggcagactcacccacctcctcaaactctgcctagatcaaaaagccccagtggtcaaaaacgcagccggtcacgctcccctcacgaagcaggcttctgtgtgtatctgaagggactaccttttgaggctgaaaacaagcatgtgattgacttctttaaaaagctcgatatagtcgaggacagcatctatatcgcatacgggccaaacggaaaggctacaggggagggctttgtcgagtttaggaacgaggctgattacaaagcggctctatgccgtcataaacagtatatgggcaacagattcattcaggtgcaccctattacaaaaaaggggatgcttgagaagattgatatgatccgtaagcgattgcaaaatttctcttacgatcagagggaaatgattctcaatcctgaaggggacgttaactcagccaaggtgtgcgcccatattactaacatccctttcagtataaccaaaatggatgtgctgcaatttctggagggcatacccgtggacgagaacgcggtgcacgtgctggtggataacaacggccagggattgggacaggctctggtacaattcaagaacgaggatgatgctaggaagagcgagagactccataggaaaaagttgaacggacgtgaagctttcgtgcatgtggttactctggaggatatgcgcgagatcgaaaaaaaccctcctgctcaaggcaagaagggtctgaagatgcccgtgccggggaatccagcagtgccaggcatgcccaatgccggccttcccggagtaggacttcccagtgcaggcttgcccggagctggactgcccagcaccggacttccaggaagcgcaattacgagtgccgggctccctggagctggcatgccaagtgctggcatccctagcgctggaggcgaggagcacgcctttctgactgtggggagtaaggaagccaacaacggtcctcctttcaatttccctggaaacttcggagggagtaatgctttcgggccccccattccacctccgggtctcgggggtggagcttttggagacgcccggcctgggatgccatccgtgggcaatagtggcctcccgggactgggcctggatgtgccagggtttggaggaggccctaataacctgtctgggccttccgggttcggaggtggaccacagaatttcggcaacggtccgggctccctaggaggaccccctggtttcggatcaggccccccaggcctgggatctgcaccaggccatttgggcgggcccccagcattcggccctggaccgggtcctggaccgggaccagggcccatacacattggaggcccgccgggctttgcgtcctcatctggaaaacccggaccgacagtgatcaaggtgcagaacatgcccttcaccgtgagcatagacgagatcttggatttcttttacggctaccaagtgattccagggtctgtgtgcctgaaatataacgagaagggcatgcctaccggagaggcaatggtagcattcgaatcccgcgatgaggctacagccgcggtaatcgatcttaatgaccgccctatcggctcccggaaggttaagcttgtgctgggatag

SEQ ID NO: 20450 - DNA, 876 bp, Artificial Sequence
  Description of Artificial Sequence: Synthetic coding sequence
atggccgtggtgatccggctgcagggcctgcccatcgtggccggcactatggatatcagacattttttttcaggtctgaccatcccagatggtggcgtgcatattgttggaggtgagctcggagaagcattcatcgtgttcgccactgatgaagacgcccgcctggggatgatgcgcacaggaggcacaatcaaaggctcaaaggtgactctgcttttaagcagtaagacggaaatgcaaaatatgattgaactcagcagaagacggttcgagaccgccaacctcgatattcccccggcaaacgcgtctagatcgggtcctcccccaagttcgggcatgtctagccgtgtgaaccttccaacaacggtttcaaactttaataatcccagtcccagcgtggtaacagcaacaacttcagtgcatgaatcaaataagaacatccagactttcagtaccgcgagcgtgggcacagctcctcctaacatgggcgcgtcttttggctctcccacgttctcaagcaccgtgccaagcacagcctctcccatgaacaccgttccgccccccccgatccccccaatcccagcaatgccaagtctgccgccgatgcccagcatcccgcccataccggtcccacccccggtgcctaccctgcctcccgtgccccccgtgccacccatccctcccgtacccagtgtgcctccaatgacacccctgccaccaatgagcggtatgccgcccctcaatccccccccagtggcgcccttgcctgccgggatgaatggctccggagcacccatgaatctgaacaacaatctgaatcctatgtttctagggcctctcaatcccgtgaacccaattcaaatgaactctcagtag

SEQ ID NO: 20451 - DNA, 432 bp, Artificial Sequence
  Description of Artificial Sequence: Synthetic coding sequence
atggccgtggtgatccggctgcagggcctgcccatcgtggccggcacgatggacatccggcatttcttctccggactgactatccccgacggaggggtgcacatagtgggtggcgaattgggggaagctttcattgtgtttgctactgacgaggacgctcggctgggcatgatgcggaccggcggcactattaaggggtctaaggttactctactgctgagttcaaaaactgagatgcagaacatgatcgagctttcgcggaggcggttcgagacagctaacttagacatccctcccgctaacgccagccggagtggacctccccctagctctggaatgtcctcacgcgttaatctccccacgaccgtctctaattttaataaccccagcccatcagtggtcactgcaactacatcggtgcacgaatcttag

SEQ ID NO: 20452 - DNA, 405 bp, Artificial Sequence
  Description of Artificial Sequence: Synthetic coding sequence
atggccgtggtgatccggctgcagggcctgcccatcgtggccggcactatggatatccgtcacttcttttctggcctgaccattcctgacggcggagtccacatcgttgggggagaactgggggaagcgttcatcgttttcgcaaccgatgaggatgctagactcgggatgatgcggactggggggaccatcaagggaagcaaagtcacacttctgctgtcatctaagactgaaatgcagaatatgatcgaactgagtcgtaggcgctttgaaacggctaaccttgatatcccgcccgcaaatgcatctcgaagtgggccaccaccgtcgtcgggtatgtcctctagagtgaacttacctaccaccgtgagtaactttaacaatccaagccctagtgtagtgtag

SEQ ID NO: 20453 - DNA, 1251 bp, Artificial Sequence
  Description of Artificial Sequence: Synthetic coding sequence
atgagcaacaagggcaagaagctgaagcggatcatcctggccatccctcctgccgctccggccaccgtggcaatgcgaccggtggaggctgctccaagtgggcggcaggcacggcggcggggagtgggtgctattatcaaggctggtatcgaaagcgcggtggtcgtggagatcgggatcggtattgatggagagattgtcggggcagaagtgcaggttgggtctgtcgtacgctctcgttcttgggatcgacgtcatgggagcgaatctcggtcacgcgatcaccgacgagaggacagagtccactaccggagtcctcccctcgctaccggttatcgatatggccacagcaaatctccccattttcgagaaaaatctcctgttagggaaccagtggacaatttgtccccagaggaaagagatgcacggacagtcttttgcatgcagctggctgccagaatccggccacgtgaccttgaagactttttttcagccgttgggaaagtgcgggacgtccgcattatttccgaccgcaatagccggcgttctaagggcattgcttatgtcgaattctgtgaaattcagtccgttcccctggctattgggctgacaggtcagaggctcctgggcgtacctatcattgtacaggcgagccaggccgagaagaaccggctagctgcgatggcaaataacctgcagaaaggcaatggcggccctatgagactgtatgttgggtccctgcacttcaacatcactgaggacatgcttaggggaatttttgagccattcggcaagatagacaatatcgtgttgatgaaggacagcgatacggggcggtcaaagggctatggttttattacttttagcgactccgaatgcgcacgcagagccctggaacagctcaatggattcgaattggctgggcggcctatgcgcgtggggcacgtgactgagagactcgacggcggtaccgatatcacatttccagacggcgatcaggagctggatttgggttcagcaggaggtcggttccagctgatggcaaagctggctgaaggagcaggcatccagcttccatccacagctgccgccgccgctgcagcagccgcccaagccgctgctctgcagctgaatggggcagtcccgctcggcgccttgaatcccgctgccctgacagcattgtcccctgcccttaatctagcttcccagtgttttcagctttccagcctcttcaccccccagacgatgtag

SEQ ID NO: 20454 - DNA, 1218 bp, Artificial Sequence
  Description of Artificial Sequence: Synthetic coding sequence
atggccagcgacgacttcgacatcgtgatcgaggccatgctggaggccccatataagaaggaggaggacgaacagcagagaaaggaagttaagaaggactacccttcaaacaccacatcaagtacttccaatagcggtaatgagacctccgggtcatccaccatcggcgagacgtcgaacagatcccgcgatcgggaccggtaccgcagaagaaactccagatcccgctctcccggaaggcaatgccgccacaggagccgaagctgggataggcgacacggctccgagtctcgatctagagatcaccgtcgggaagaccgggtgcactatcgctcaccccctctggccactggggagcctgtagataacctgtcgccagaggagcgggatgctaggacagtattctgcatgcagttggctgcccggattagaccccgtgatctggaggacttcttctctgcagtgggaaaggttagggacgtgaggattattagcgacaggaattcacgccgaagtaagggaattgcatacgtggagttctgcgagatccagtccgtgcctctggccattggactgaccgggcaacgcctcttgggggtgcccataatcgttcaggcaagtcaagcagagaagaatcgcctcgcagcaatggcaaacaatttacagaagggcaacgggggccccatgcgactatacgtggggagcctacattttaatataactgaagacatgctgcgggggatctttgaacccttcggtaagattgacaacatcgtgctgatgaaagactctgacaccggcaggagcaagggctacggcttcataacatttagtgattccgaatgtgctcgtcgggcactggaacagttgaacggcttcgagttggccgggagaccaatgcgcgtaggccatgtgaccgagcgactagatggtggtactgatatcacatttcccgacggagaccaggagcttgatcttggcagcgccggtggcagattccagcttatggccaaactggccgagggtgctggcattcagctcccaagtacagctgcagctgcggccgctgcagcggcccaagcagccgccctgcagctgaacggagccgtgcctctgggggcgctcaaccctgctgctctcaccgcattgtcccctgccttgaaccttgcgtcccaatgtttccagctgagctcactttttaccccacagaccatgtag

SEQ ID NO: 20455 - DNA, 1320 bp, Artificial Sequence
  Description of Artificial Sequence: Synthetic coding sequence
atggccagcgacgacttcgacatcgtgatcgaggccatgctggaggctccttacaaaaaagaagaggatgaacagcaaagaaaggaagttaagaaagactacccatcaaacacaaccagcagcacttccaacagcggtaacgagacttccggctcatctaccatcggagagactagtaaaaaaaaacgctctcggtcccacaacaagagccgggataggaagcggtctcgcagcagggaccgcgatcgataccgcaggagaaacagccgctcaaggagccctggacgacagtgtcggcaccgctcccgctcctgggaccgccgacatggctcggagagcaggagcagggatcaccgtcgcgaggatcgagttcactacaggtctccaccacttgctacaggataccggtatggacatagcaagagtcctcactttcgtgagaaaagtccagtgagggagccagtagacaacttaagccctgaagaaagagacgctcgaactgtgttctgcatgcaattggcagcccggattagaccgcgggacttagaggattttttctctgccgtcggcaaggtgcgggacgtccggatcatttccgatagaaattccaggcggagcaaagggattgcctacgtggaattttgcgagattcagagcgtgccactcgccatcgggctgacagggcagaggttgctgggcgtgcccatcattgtgcaggcttcgcaggccgaaaaaaatcgattggcggctatggcaaacaacctccaaaaaggcaatggaggccccatgcggctgtatgttgggagcttgcactttaacattacagaggatatgctgagggggatcttcgagcccttcggaaagattgacaacatcgtattgatgaaagacagcgataccgggcggtccaagggatacggctttattacgttttcagactccgagtgcgctcgcagggcacttgagcagctgaacggcttcgaattggctggtaggcctatgcgcgtaggacacgtgaccgaaaggctggatggcggaaccgatatcacatttcctgatggcgaccaggaacttgacctgggctctgctggcggtagatttcagctgatggccaagttggctgagggggctgggattcagttaccttcaaccgcggcagccgcagccgccgccgccgcacaggcagcagcactccaactcaatggtgccgtgcctcttggcgctctcaacccagccgcgctcaccgctttgtcccctgctctgaatttggcctcacagtgctttcagctctccagcttgtttactcctcaaaccatgtag

SEQ ID NO: 20456 - DNA, 1272 bp, Artificial Sequence
  Description of Artificial Sequence: Synthetic coding sequence
atggccagcgacgacttcgacatcgtgatcgaggccatgctggaggctccttataagaaagaagaagatgagcagcagaggaaggaagtgaagaaggattatccttccaataccacatcctccacaagcaatagcggcaatgagacctccggaagttccacaatcggagaaacatccaatcgatcccgcgatcgggaccgatacagaaggagaaattcacggagccgcagtcccggtaggcagtgccgtcaccgatcacggtcttgggaccgcagacatggcagcgaaagccgatccagggatcaccgaagggaggatcgtgtgcattaccgtagtcctccgctcgctactgggtaccgctacggccactctaagtcccctcatttccgcgaaaaaagcccagtaagggagccagtggacaatctgagtcctgaggagcgcgatgcccgcacagtcttctgtatgcagcttgcagcgaggatcaggcccagagatctggaagacttcttctctgcagtcgggaaggttagagacgtcaggataatttctgatcgcaatagcagacgaagcaaggggatcgcatatgtagaattctgcgaaattcaaagtgtgcccctcgccatcggactcactgggcagcgactccttggcgtacccattatcgttcaggcaagtcaggccgaaaagaatcggcttgccgcaatggccaataatcttcaaaaaggcaacggagggcccatgcggctgtatgtggggagcttgcactttaatataaccgaggacatgcttcgggggatttttgaaccatttggaaaaattgacaatattgttctgatgaaggatagtgacactggccggagtaaggggtacggttttattacattcagcgactctgagtgtgccaggcgggcgttggaacagctcaacggatttgagctggctggacgccccatgcgtgttggtcacgtgactgaacgtctcgacggcggcaccgatatcacgtttccggacggtgaccaagagctggacctgggtagtgctggaggcaggttccagttgatggccaaactcgcggaaggggctggcatccaattgcccagcaccgccgccgccgctgccgctgccgccgcgcaagcagccgccttacagctgaatggggctgtccccctgggagccctgaatccagccgcactcaccgcactgtcccctgctctcaatctggcgagccaatgttttcagcttagctccttgtttaccccacaaacaatgtag

SEQ ID NO: 20457 - DNA, 183 bp, Artificial Sequence
  Description of Artificial Sequence: Synthetic coding sequence
atggccagcgacgacttcgacatcgtgatcgaggccatgctggaggccccttataaaaaggaggaggatgagcagcaacgaaaagaggtgaaaaaagattatcccagcaacactacttcgagcacctctaactccggcaacgaaacttccgggagttccaccatcggcgaaacctccaaatag

SEQ ID NO: 20458 - DNA, 435 bp, Artificial Sequence
  Description of Artificial Sequence: Synthetic coding sequence
atggccagcgacgacttcgacatcgtgatcgaggccatgctggaggcgccgtataaaaaggaggaagatgaacagcaacgtaaagaggtcaaaaaagactacccgagcaacaccacaagtagtacgagcaacagtggtaatgaaacatcaggcagctccacaattggcgagacctctaagaaaaagcggagcaggagtcataataaatctcgtgatcggaaaaggtcacgctctcgggatcgcgaccggtataggcgacgcaactccagaagcaggagtccaggaaggcagtgccgccacaggagccggtcttgggacagacgccatggaagcgagtcccggtcccgggaccatcgtagagaagatcgcgtgcattaccgcagtccaccactcgctacgggtgagcccgtggacaatctatccccggaggaatag

SEQ ID NO: 20459 - DNA, 228 bp, Artificial Sequence
  Description of Artificial Sequence: Synthetic coding sequence
atggccagcgacgacttcgacatcgtgatcgaggccatgctggaggccccatacaaaaaagaagaggacgagcagcagcgaaaagaggtgaagaaagactatccatccaacactacatcaagcacaagtaatagtggtaacgaaacatcagggtcaagtaccattggcgagacatcaaagaaaaaaaggagccgctctcacaacaagagtagagaccggaaacgctag

SEQ ID NO: 20460 - DNA, 303 bp, Artificial Sequence
  Description of Artificial Sequence: Synthetic coding sequence
atggccagcgacgacttcgacatcgtgatcgaggccatgctggaggctccctacaaaaaggaggaggacgagcagcagcgcaaggaggtcaagaaggactatccaagcaataccacgtcctccacatccaactccggaaacgaaaccagtggttcctcaactatcggggagacttccaatcgcagtcgtgacagggaccgataccggcgtaggaactcaaggtcaagatcccctgggaggcagtgcaggcaccgaagcaggagctgggacagaaggcacgggtctgagtccaggagtcggtag

SEQ ID NO: 20461 - DNA, 174 bp, Artificial Sequence
  Description of Artificial Sequence: Synthetic coding sequence
atggccagcgacgacttcgacatcgtgatcgaggccatgctggaggctccatacaagaaggaggaggacgagcaacagcgtaaggaggtgaagaaggattatccaagcaataccacaagcagcacgtcaaactctggaaacgaaacatccggctcttccacaattggggaatag

SEQ ID NO: 20462 - DNA, 279 bp, Artificial Sequence
  Description of Artificial Sequence: Synthetic coding sequence
atggccagcgacgacttcgacatcgtgatcgaggccatgctggaggccccatacaagaaagaagaggacgagcagcaaaggaaggaggtgaaaaaagattacccatccaacactacgtcgtcgacaagcaattctggaaacgaaacctcagggtcgtcgaccattggtgagacttctaagaaaaaacgcagccgctcgcataataagtcccgtgacagaaaacggtctaggtcgcgagacagggatcgttatcggcgacgtaactctcgttcccgctag

SEQ ID NO: 20463 - DNA, 201 bp, Artificial Sequence
  Description of Artificial Sequence: Synthetic coding sequence
atggccagcgacgacttcgacatcgtgatcgaggccatgctggaggcgccttacaagaaggaggaggacgaacagcaacgaaaggaggtcaaaaaggactatccctccaatacgacctcttcaacttccaactctggaaacgaaacctccggatccagcactatcggagaaaccagcaatcgctcacgggaccgagattag

SEQ ID NO: 20464 - DNA, 306 bp, Artificial Sequence
  Description of Artificial Sequence: Synthetic coding sequence
atggccagcgacgacttcgacatcgtgatcgaggccatgctggaggcgccttataaaaaggaggaagatgagcagcagagaaaagaagtgaagaaggactatcccagcaacaccacttcttcaacctcgaattctggaaacgagaccagcggctcaagtacgattggtgagacctcgaaccgttctcgagaccgcgatcggtaccgccgaaggaacagccggtcacgcagcccggggagacaatgtcggcacagaagccgaagttgggatcgcagacacggttctgagtcccggtcccgggactag

SEQ ID NO: 20465 - DNA, 276 bp, Artificial Sequence
  Description of Artificial Sequence: Synthetic coding sequence
atggccagcgacgacttcgacatcgtgatcgaggccatgctggaggccccttataagaaggaagaagacgaacagcagcgcaaggaagtgaagaaagactacccttcaaacacaacgtcctcaacgtccaattctgggaacgagactagcggatctagtacaattggagagacttctaatagaagccgcgatcgggatagatatcgccgcaggaactcccgaagcagaagtcccgggcgccagtgccgacacagatccagaagttgggacaggtag

SEQ ID NO: 20466 - DNA, 636 bp, Artificial Sequence
  Description of Artificial Sequence: Synthetic coding sequence
atggccctggagggcatgagcaagcggaagcggaagcggagcgtgcaggaaggagagaatcccgacgatggagttaggggctctccccccgaagactaccggttgggccaggtcgcctcctctctgttccgtggggagcaccattctcgtggggggacaggacggctggcttctctttttagtagtctcgaacctcagattcaacccgtgtacgtgccagttccgaaacagactattaagaaaaccaagaggaacgaagaggaggagagcacgtctcagatcgaacgtccgcttagccaggagccggccaaaaaggttaaagccaagaagaaacacacaaacgcggagaagaagctggccgattctagccccttcagattgatgcttcggccgtgcctgtcgatcagcagcaacactctctattgcatatataggtttaccatttatttttgggaaagcgctcttgcgtcagctgatctggaagaagaaattcatcaaaagcagggtcagaaacggaagaattcccagcctggcgttaaagtcgcagataggaaaatcctggacgatactgaggacacggtagtgagtcagaggaagaagattcagatcaatcaggaggaggagcgccttaaatag

SEQ ID NO: 20467 - DNA, 1293 bp, Artificial Sequence
  Description of Artificial Sequence: Synthetic coding sequence
atggccctggagggcatgagcaagcggaagcggaagcggagcgtgcaggaaggagagaatccggacgacggagttcgtgggtcacctcctgaagattatagactgggccaagtagcctcatctcttttcagaggtgagcatcattccagaggcgggacgggtaggcttgcatccctgttctcttctctggaaccgcagatccaacccgtctacgttcccgtgcctaaacagaccattaagaagacgaagaggaatgaggaagaggaatcaacctctcagatagagagaccactctcccaggagcccgcgaagaaagtgaaagccaaaaagaaacatactaacgccgagaagaaactagcagacagagaatccgcccttgctagcgctgacttagaggaagaaattcaccagaagcagggccagaaacgaaagaattcccaaccgggcgtgaaggttgcagatcggaaaattcttgacgacacagaggataccgtcgtgagccagagaaagaaaatccagattaatcaggaagaggaaaggctgaagaacgaaagaacggtgttcgtgggcaacttgcctgtcacttgcaataaaaaaaagctgaagtctttcttcaaagagtatggacagattgagtcagttagattccgaagtcttattcctgccgaggggacgctgagcaagaaacttgcagcaattaaaagaaaaatccaccctgatcagaaaaacatcaatgcttatgtcgtgttcaaggaagagagcgcagccacccaggctttaaaaaggaacggggctcagatagccgacggatttagaatcagagtggaccttgcgagcgagacctcaagtagagataaacggagcgtgttcgttggtaatctgccctacaaggtggaagaatccgccattgagaagcattttttagattgtgggtctatcatggctgtccgcatagtccgagacaagatgacaggaatcggtaaaggcttcggctatgtgctgttcgaaaacaccgatagtgtccacctagcgttaaaactcaacaacagtgagctgatgggccgtaagctcagggtcatgcgtagtgtgaacaaggaaaaattcaagcagcaaaattcaaatcctcgattgaagaacgtgtcaaagcccaagcaggggttaaatttcacttcgaagacagctgagggtcatcccaagtcattatttatcggagagaaagccgtattgttaaagaccaaaaaaaaaggacagaagaagtccggacggcctaaaaaacagagaaagcaaaaatag

SEQ ID NO: 20468 - DNA, 636 bp, Artificial Sequence
  Description of Artificial Sequence: Synthetic coding sequence
atggccctggagggcatgagcaagcggaagcggaagcggagcgtgcaggagggtgagaaccctgacgacggcgtccggggcagtcctccggaagattatagactgggacaggtcgcctctagcctgtttagaggggagcaccactcaagaggcgggaccggaagactggcgtcactattctcctcccttgaaccccagatccagcccgtgtatgtacctgtgccaaagcagacaatcaaaaaaaccaaacggaacgaggaagaggagtcgacttctcagatagaacggcctctgtcacaagagccggcgaaaaaggtaaaagccaagaagaaacatacgaacgctgaaaaaaaattggccgactcgagtcccttcaggcttatgttacgaccatgcctgtcaatttcatccaacacgttatactgcatataccggttcaccatttacttttgggagtctgcccttgcctccgctgacctcgaggaggaaatccaccagaagcagggacagaagcgcaaaaatagtcaacccggggtcaaagtggcagacaggaaaatactagacgataccgaagatacggtggtctctcagcgcaaaaaaatacagatcaaccaggaagaggagcggctgaaatag

SEQ ID NO: 20469 - DNA, 1074 bp, Artificial Sequence
  Description of Artificial Sequence: Synthetic coding sequence
atggccagcgtgctgaacgtgaaggagagcaaggcccccgagcggaccgtagtggtcgctggcctccccgtggacctgtttagcgatcagctgctcgcagtcctggttaagtcacattttcaggacatcaagaatgaggggggcgatgtagaggacgttatctacccaacgagaacaaagggagtcgcatatgtgatctttaaagaaaagaaagtagctgagaatgtcattcgccagaagaagcattggctcgctaggaaaacccgacatgcagagcttactgtgagcttaagagtttctcatttcggagacaaaatctttagcagtgtgaacgctatcctggatctgtccgtcttcggaaaagaagtaaccttagagactttagtgaaggacctcaaaaaaaaaatccccagcctgagtttcagcccactcaaacccaacggccggatctcagtggaaggaagtttccttgctgttaagcggcttcgcgagtcactgctggctagagcttgttctctgttagaaaaggaccggaatttcacgtctgaggaaaggaaatggaaccggcaaaacccccaacggaacctgcagcgtagtaacaacagtctggcgtccgtgaggaccttagtacccgagaccgcgcggtctggcgaaatgctggtgctcgatactgacgtctttctgtatctgaaacataaatgcgggtcttatgaatctaccttaaaaaagtttcacattctctcacaagaaaaggtcgatggcgagattactaccatctgtttgaagagcattcaggtgggttcccagccaaataacgccaagcacgtaaaagaacttatcgaggagtggagtcacgcgctctatctcaagctccgcaaggaaactttcatccttgagggaaaggaaaacagggagaagcgcatgataaagcgcgcatgcgagcagctgagttcaagatacttggaagtccttatcaacctgtacaggacgcatattgatatcattggcagcagcagcgacacctacctctttaaaaagggggtgatgaaactgattgggcaaaaggtaagttag

SEQ ID NO: 20470 - DNA, 1782 bp, Artificial Sequence
  Description of Artificial Sequence: Synthetic coding sequence
atgaccgccgaggacagcaccgccgccatgagcagcgacagcgccgctggcagttctgccaaggttcctgagggcgtggctggcgcccccaatgaggcagcgttactggccctgatggagagaaccggctatagtatggttcaagaaaacggccagcgtaagtatggcggaccaccaccgggctgggagggaccacacccccagaggggatgtgaagtttttgttgggaagattccacgcgatgtatacgaagatgaactcgttccggtctttgaagctgtaggtagaatctatgagctcagactgatgatggattttgacgggaagaatagaggatacgcctttgtgatgtattgccataagcacgaggcaaaaagagctgttcgtgagctgaacaactacgagatccggcccggccgccttttgggggtgtgttgttcagtggacaactgtcgcctgtttatcgggggcatccccaaaatgaaaaagcgggaggaaatcctcgaggaaatcgcgaaagttaccgaaggtgtgctcgacgtgatagtctacgcctcagcagcggacaagatgaagaatcgtggctttgccttcgtggagtacgaaagccaccgcgccgcagcaatggctaggcggaagctgatgcccggtaggatccagttatggggccaccagattgccgttgactgggccgagcccgagattgatgtggacgaagatgtgatggagacagtaaaaatcctttatgtccgcaacctgatgatagaaactacggaggacaccatcaaaaagagctttgggcagtttaacccgggctgcgtcgagagagtcaaaaagattcgcgactatgccttcgtccactttacttcccgggaagacgcagttcacgctatgaacaacctgaacgggaccgaattggaaggctcctgtcttgaggtaacccttgcgaagcctgtggataaggagcagtattctcgctatcagaaagccgccagaggtggcggcgctgcagaggctgcacaacagccttcatacgtgtactcttgcgatccctacacgttggcctactacggctacccctataatgcccttatcggccctaatagagactatttcgtcaaagccgggtctatccggggccgcggtcgcggagccgccgggaatagagctcctggaccccgcgggtcttacctgggcggttacagtgccgggcgtgggatctatagcaggtaccacgaaggcaagggcaaacagcaggaaaaaggatatgagctggtgccaaacttagaaatcccgactgttaacccagttgctatcaaacccggtacagtcgccattccagcaataggtgcgcaatactcgatgtttccagccgcaccagccccaaagatgatcgaagacggcaagatacacacagtggaacacatgattagtcccatcgctgttcagccggatcctgcatcagcagctgctgcagccgccgccgccgcagccgccgcagccgctgtgatccctacagtgtcaactcctccgccattccaaggtagacctatcactcctgtttacacagtggcaccaaatgtgcagcgtattccaacggcaggcatctatggagcctcatatgtgcccttcgccgcccccgccacagccacaatcgctacactacaaaagaacgcagccgccgccgcagctatgtatggcggctacgccgggtacattccccaggccttccctgctgctgccattcaggttccgattccggacgtttaccagacatattag

SEQ ID NO: 20471 - DNA, 1575 bp, Artificial Sequence
  Description of Artificial Sequence: Synthetic coding sequence
atgaccgccgaggacagcaccgccgccatgagcagcgacagcgccgcaggatcttcagcaaaagtgcctgagggcgttgccggcgcccccaatgaggctgctctgctggccttaatggagagaacaggttatagtatggtccaggaaaatggacagcgcaaatatggaggaccgccacccgggtgggaaggaccgcacccccaacgaggatgtgaggttttcgtggggaagattccgcgggatgtttatgaggacgagcttgtacctgtcttcgaggccgtgggccgtatttacgaattgaggttgatgatggacttcgatggcaagaacagggggtatgcttttgtcatgtactgccataagcatgaggctaagcgagccgtgagggagctgaataattatgagattcggcctggtcggctcctgggcgtttgctgcagcgtggacaactgtcggctgtttattggcggaatacccaagatgaaaaagagggaggaaatcctggaggaaattgccaaggttacggagggcgttttggatgttatcgtctacgcatccgccgctgacaaaatgaaaaatcgaggcttcgcctttgtggagtacgagagtcaccgggccgcagccatggcgcgcaggaagctcatgccgggtagaatacaactatggggccatcaaattgccgtggattgggccgagcccgagatcgatgtcgacgaggatgtgatggaaacagtcaaaattctatatgtcaggaatttgatgattgagacaaccgaggacactatcaaaaagagcttcggacagttcaatccaggttgtgttgagcgtgtcaaaaagattcgcgactacgcattcgtgcactttacgagtcgggaggacgccgtgcacgccatgaacaatctcaatggaaccgaactggaaggatcttgcttggaggtgactctggctaagccagtggataaggagcagtattctcgataccagaaggcagcacgcgggggcggcgccgccgaggccgcacaacagccttcatacgtttactcatgcgacccatatacgctggcatattatggctacccatataacgctctgataggtcccaatagagattacttcgtgaaggtggccatcccagctatcggggcccagtatagtatgttccccgctgcccctgcacccaagatgatcgaggatggaaaaatccacacagttgaacacatgatctctcccattgccgtgcagccagaccccgcatccgcagccgcagctgctgcggccgctgccgctgcggccgctgcagtgatcccaactgtgtctaccccacctccatttcaggggagacccatcacccctgtctatacagttgcccctaatgtgcagagaattcctactgcagggatctacggagcaagttacgtgcccttcgccgccccagccactgccactatcgcaactctccagaagaacgcagcggccgccgccgcaatgtacggtggatatgcaggttatattccgcaggccttccctgcagccgctattcaggttccaatcccagacgtgtatcaaacatattag

SEQ ID NO: 20472 - DNA, 1782 bp, Artificial Sequence
  Description of Artificial Sequence: Synthetic coding sequence
atgaccgccgaggacagcaccgccgccatgagcagcgacagcgccgccggaagtagcgccaaagtaccggaaggagtggccggagctcccaatgaggcggccttgctcgctctcatggaacggacgggttattcaatggtgcaggaaaatggacagcgcaaatatggcggaccgccccccggttgggaggggccccatcctcagcgcggctgcgaggtgttcgtaggcaaaattcccagagacgtctacgaagatgagctcgttccggtttttgaggctgtgggacgcatctacgagttacggctcatgatggactttgacggcaagaatagaggttatgctttcgtgatgtattgccataagcatgaggcaaaaagggcggtgcgcgagctgaacaactacgagatccgaccgggccgcttgctcggcgtgtgttgttctgtggataattgccggctcttcatcgggggcatccccaaaatgaaaaaaagagaagagatactggaggagattgcaaaagttacagagggcgtccttgatgtcattgtttatgcctccgcagctgacaaaatgaagaacaggggatttgccttcgtagagtatgaatcccatagagcagctgcaatggccaggagaaaactgatgccgggccgcatacagctctggggacaccaaatcgccgtggactgggcagagccggagatcgatgtcgacgaagatgtgatggagactgtgaagatattgtacgtcagaaatttgatgatcgagactacagaggatactatcaagaaatctttcggacagtttaaccctggctgcgttgaacgtgtaaaaaagattcgagattacgcctttgttcacttcaccagcagagaagacgctgtccacgctatgaacaacctgaacggaactgaattggaggggtcctgcctggaggtgaccttggcaaagccggtggataaagagcagtattctagataccagaaggcggctcgtggcggtggggctgccgaggctgcacagcagccctcatatgtgtattcatgtgacccctacaccctggcctattatggatatccttacaatgccctgatcggacccaacagggattatttcgtgaaggccggcagcatccgcggcagaggccgaggagccgccggaaatagggcaccgggaccccgcggcagctatcttggcggttacagcgccgggcgcggcatatacagtcgctaccacgagggcaaagggaagcaacaggaaaaggggtacgagctggtgcccaatctagaaatcccgaccgtgaatcccgttgccattaaacccggtaccgtggctatccccgcgattggtgcccagtactcaatgttccctgcggctccagcgcctaaaatgatcgaggacggcaaaatccatactgtcgaacacatgatatcacccattgcggtgcaacctgaccccgcctctgctgcggccgcagcagctgctgcagcagccgcggccgctgccgtaatccctactgtctctaccccccctcctttccagggcaggccgattactcccgtgtacacagtggcccccaatgtgcagcgcattcccactgcgggaatctacggcgcatcgtacgtccctttcgcagcgccggctactgcaacgattgcaactctgcagaaaaacgcggcagcagccgcagcaatgtatgggggctacgcaggatacatcccccaggcgttcccggcagctgctatccaggtgcccattcccgacgtgtaccagacatactag

SEQ ID NO: 20473 - DNA, 1575 bp, Artificial Sequence
  Description of Artificial Sequence: Synthetic coding sequence
atgaccgccgaggacagcaccgccgccatgagcagcgacagcgccgccgggagcagtgccaaagtgcctgagggcgtcgcgggcgcccccaacgaagcagcactgctggccctcatggagcggaccggatatagtatggtgcaggaaaacggccaaagaaaatatggagggcctcctcctggctgggaaggcccacacccgcagcgcggttgtgaggtgtttgtgggcaagattccaagagatgtgtacgaggacgaactcgtgcccgtgttcgaggcagtgggtcgcatttatgagctgagactcatgatggacttcgacggtaagaaccgggggtacgcattcgtcatgtattgtcacaaacacgaggcgaagcgggccgtgagagaactcaacaattatgaaatacgccccggccgcctccttggcgtgtgttgctcagtggacaattgtaggctgttcatcggcggaatccctaagatgaaaaagcgagaagaaatacttgaagaaattgcaaaagtcaccgagggagttctcgacgttatcgtgtatgcaagtgcagcggataagatgaaaaatcgcgggttcgcctttgtagagtacgagagtcaccgcgccgctgcaatggcgcgtcgaaaattgatgcccggccggatccagctgtggggtcaccagatcgctgtggactgggccgagcctgagatagatgttgacgaagatgtgatggagactgtgaagattctgtatgtgcgaaatttaatgattgaaacaacagaggacaccattaaaaagtcatttggccagtttaatcccggatgcgtggagcgtgtgaaaaagataagggattacgcattcgtacatttcactagccgcgaagacgctgtccatgcaatgaataacctgaatggaactgagctggaaggtagctgtcttgaagtgaccctcgccaagccagtggacaaggaacagtactccaggtaccaaaaagcagctagggggggcggagcagcggaggccgcccagcagcccagttacgtctactcctgcgacccatatacactggcttactacggctacccttacaatgcactgatcggcccaaacagagattacttcgtgaaggtggccattcccgccattggagcccagtacagcatgtttccagcggctccggcgccaaaaatgattgaggatggaaaaatacacaccgtggaacacatgatttctcccattgctgtgcaaccggacccagcctctgctgccgcagctgccgccgccgccgccgctgccgctgctgccgttatccctaccgtaagtactcccccacctttccaggggaggcccataactccagtgtacacagtagcgccgaacgtacagcggatccccactgccgggatttatggcgctagttacgtgccctttgccgctccagccaccgcaacaattgctacgctgcagaagaacgccgctgccgctgccgccatgtacggcggctacgctggctacatcccccaagcattccctgctgccgcaatacaggtgcccatccctgacgtctaccagacgtattag

SEQ ID NO: 20474 - DNA, 180 bp, Artificial Sequence
  Description of Artificial Sequence: Synthetic coding sequence
atgaccgccgaggacagcaccgccgccatgagcagcgacagcgccgctgggagttcagcaaaagtacctgaaggagtagctggagcgcccaacgaagccgcactgctcgccctaatggagagaactggctattccatggtccaagagaacgggcagaggaaatacggcggtccaccctag

SEQ ID NO: 20475 - DNA, 480 bp, Artificial Sequence
  Description of Artificial Sequence: Synthetic coding sequence
atgaccgccgaggacagcaccgccgccatgagcagcgacagcgccgcagggtccagtgctaaggtgcctgagggcgtagctggcgctccaaacgaggcagcgctgttggcactgatggaaaggacaggctatagcatggtacaggagaatggccagaggaagtatggagggcccccacccggatgggaggggccccatccacagagagggtgtgaggtcttcgtgggcaaaattcctcgagacgtctacgaggacgagttggttcctgtgttcgaggcggtaggacgcatctatgagcttaggctcatgatggatttcgacggcaaaaaccggggctacgcatttgtcatgtactgccataagcatgaggctaaacgcgccgtgcgggaactgaacaactatgagatacgaccaggtcgcctcctcggagtgtgctgcagcgtggataactgcaggctatttataggcggcattccttag

SEQ ID NO: 20476 - DNA, 375 bp, Artificial Sequence
  Description of Artificial Sequence: Synthetic coding sequence
atgaccgccgaggacagcaccgccgccatgagcagcgacagcgccgcgggcagctccgcgaaagtacccgagggtgtggcaggcgccccaaacgaagctgcactgttagccctcatggaaagaaccgggtactccatggttcaggaaaatggtcagcgcaagtacgggggtccaccccctggctgggaaggcccacacccacagaggggatgcgaggtgttcgtgggaaagattccaagggacgtgtacgaagacgagctggtgccggtcttcgaggcggtgggccgcatttatgaattgaggctgatgatggacttcgatggtaagaaccggggatacgcctttgtcatgtactgccacaagcacgaagcctag

SEQ ID NO: 20477 - DNA, 345 bp, Artificial Sequence
  Description of Artificial Sequence: Synthetic coding sequence
atgaccgccgaggacagcaccgccgccatgagcagcgacagcgccgcaggatcttctgcaaaggtgccagagggcgtggccggggctccaaacgaggctgcgctgttagccttaatggagagaacaggctattcaatggtccaagaaaatgggcagagaaagtatggaggacctccccctggctgggagggaccccaccctcagagaggttgtgaagtgttcgtgggcaaaattccgagggatgtatatgaagacgaattagtgccagttttcgaggctgtcggtcggatttatgagctccggcttatgatggacttcgacggtaaaaatcgaggctatgcctag

SEQ ID NO: 20478 - DNA, 180 bp, Artificial Sequence
  Description of Artificial Sequence: Synthetic coding sequence
atgaccgccgaggacagcaccgccgccatgagcagcgacagcgccgcaggatcttcagcaaaagtaccagaaggcgtggccggagctcctaatgaggctgctttactggctctgatggagcgaactggctacagcatggtgcaagaaaatgggcagcgaaaatacggtgggccgccctag

SEQ ID NO: 20479 - DNA, 582 bp, Artificial Sequence
  Description of Artificial Sequence: Synthetic coding sequence
atgaccgccgaggacagcaccgccgccatgagcagcgacagcgccgccggcagctctgcaaaggtgccagaaggagtggcaggagcccctaatgaggccgctctgctggcacttatggagagaacagggtattctatggtccaggaaaacggccaaagaaaatatggaggcccgccaccaggctgggaaggtccgcaccctcagagaggttgcgaggttttcgttggtaaaattccacgggacgtgtacgaagacgagctcgtgccagttttcgaggccgtcgggcgtatatatgagttgcgattaatgatggacttcgatggaaaaaatagggggtatgcatttgtcatgtattgtcacaagcacgaggccaagagggcggtgcgggagctcaataattacgagatcagaccaggacgactattgggggtatgctgttctgtggacaactgccgactttttatcggaggtatcccgaagatgaagaaacgggaagaaattctggaggagattgcaaaggtgacagagggggtactagacgttattgtgtatgcatcggccgccgacaagatgaaaaattag

SEQ ID NO: 20480 - DNA, 414 bp, Artificial Sequence
  Description of Artificial Sequence: Synthetic coding sequence
atgaccgccgaggacagcaccgccgccatgagcagcgacagcgccgctgggtcttcggccaaggtgcctgaaggagtggctggggccccaaatgaagccgcgttgcttgcattaatggagcggacaggttacagcatggtccaggagaatgggcagaggaagtatgggggacctcctcccgggtgggagggtccccacccacagcgagggtgtgaggtctttgtgggcaagatccccagagatgtctacgaagacgaacttgtaccggtattcgaagcagtgggtcggatatatgagttacggctgatgatggactttgacggaaagaatcgtgggtatgccttcgtgatgtattgccataaacacgaggcaaagagggcagtcagagagctcaataactatgaaatacgctag

SEQ ID NO: 20481 - DNA, 654 bp, Artificial Sequence
  Description of Artificial Sequence: Synthetic coding sequence
atgaccgccgaggacagcaccgccgccatgagcagcgacagcgccgcaggcagcagtgcaaaggttcccgagggggttgcgggggcccctaacgaagccgccctgcttgcgctgatggaacgtacgggctactcaatggtccaggagaacgggcaaaggaaatatggtggccccccccctgggtgggaaggccctcacccccaaaggggctgtgaagtgtttgtcggcaagataccacgggatgtttatgaggacgagcttgtgccagtgttcgaggcagtggggcgaatatatgaactccggctcatgatggacttcgacgggaagaatcggggctatgccttcgtaatgtactgccataaacacgaggcaaaacgggccgtccgggagctgaacaattacgagatccgccccggacggctgcttggcgtgtgctgttctgtcgacaactgtagactttttattggcgggattcccaagatgaaaaagcgggaggagatattagaggaaatcgcaaaggtgaccgagggagtgttggacgtaatcgtctacgcatccgctgccgacaagatgaaaaatagaggcttcgcctttgtggaatatgagagtcatagagccgccgccatggctaggcgcaagcttatgccgggctag

SEQ ID NO: 20482 - DNA, 1080 bp, Artificial Sequence
  Description of Artificial Sequence: Synthetic coding sequence
atggtgaagctgttcatcggcaacctgccccgggaggccaccgagcaggaaatccgttctctgttcgagcagtacggaaaggtgctagagtgtgacattattaaaaattacggatttgtgcatatagaagacaaaaccgcagctgaggatgccatccgtaacctccaccactacaaactgcacggcgtgaacatcaatgtggaagcctcaaaaaacaagtccaaggccagcacaaaacttcatgtgggaaacatctcgcccacttgcaccaaccaggagctgcgagcgaagtttgaagagtacggacccgtgatagaatgcgacatcgtgaaggattatgcctttgtccatatggagcgcgcagaggatgccgttgaggccataagaggccttgataacaccgagtttcagggcaagcggatgcacgttcaactctccaccagtcgcctcagaactgcccccggaatgggagatcaatcaggatgctataggtgcggaaaggagggccattggagtaaggagtgtcctgtggatcgaacgggtagagtggcagacttcaccgagcagtacaacgagcagtacggggccgtacgcaccccatatacaatgggctatggcgaaagcatgtactataacgatgcatacggcgccctcgactattataaacggtacagggtccgctcctatgaagccgtagccgccgcagcggcagcctctgcttacaactatgcggagcagaccatgtcacacctcccccaggtgcagtctactacagtgacctcgcatttgaattccacctctgtagatccctacgacagacacctcctcccgaacagcggagctgcagctaccagcgccgcaatggcagctgccgcggcgaccacgtcctcttattacgggcgggacaggagtcctctacgtcgcgctgctgccatgctgcccaccgtcggggagggctatggatacggtcctgagtctgagctgtctcaggcgagcgccgcgacgcgcaattccctctacgatatggcacgctacgagcgtgagcagtatgtcgatcgagccaggtatagtgccttttag

SEQ ID NO: 20483 - DNA, 1080 bp, Artificial Sequence
  Description of Artificial Sequence: Synthetic coding sequence
atggtgaagctgttcatcggcaacctgccccgggaggccaccgagcaagagatcaggagtctatttgagcaatatgggaaagtcctcgagtgcgatataattaaaaattacggcttcgttcatatagaagataaaactgcagccgaggacgcaattagaaacttgcatcactacaagctgcacggtgtgaacatcaatgtcgaggcatcaaagaataaatctaaagcctccaccaaactgcacgtcggcaacattagtcctacatgcacaaaccaggaactgagggctaaatttgaggagtatggaccagtgattgaatgtgacatcgtcaaggattacgcctttgtgcatatggagcgtgctgaagatgccgtggaagcaatacgggggttagacaatacagagtttcagggcaaaagaatgcatgtgcagctaagcacatcacgcctacgaactgcaccaggaatgggcgaccagtcaggttgctatagatgtggcaaggagggacactggtctaaagagtgccctgttgatagaacaggtagagtggccgactttaccgagcagtacaatgagcagtatggagctgttaggactccttacacaatggggtacggtgagtcaatgtattacaacgatgcgtatggggccctggattactataaacggtatagagttaggtcgtacgaggcagtggcggctgccgccgctgcttcagcatataactatgcagagcaaaccatgagccacctccctcaggtccagtcaactactgtcacgagtcacctcaattcaactagtgtcgatccatatgataggcatctgctgcccaattctggagccgcagccaccagcgctgctatggctgccgcagccgcaaccactagcagttattatggacgggatcgaagcccccttagacgtgctgccgccatgctgcccactgtgggggagggctatggatacggaccagaatcagaattgtcccaggcgtccgccgcaactcggaattctctttacgatatggctaggtatgagagggagcagtacgtcgaccgcgccaggtattcagcattctag

SEQ ID NO: 20484 - DNA, 2448 bp, Artificial Sequence
  Description of Artificial Sequence: Synthetic coding sequence
atgggcagcgacaagcgggtgagccggaccgagcggagcggccggtacggaagtattattgatagagacgacagagacgaacgcgaatcgaggtctagacgacgtgatagtgattataagaggtcttctgacgaccgtagaggagatcggtacgacgactaccgcgactacgatagtcccgaacgtgaaagggaaagaagaaattctgacagatctgaggatggatatcactctgacggggactacggagaacacgactacagacatgatatatccgacgagagagaatctaaaactattatgctgcgtggcctacctataacaatcaccgagagtgacattagggagatgatggagagtttcgaaggaccacaaccagccgacgtgcgcttgatgaagcggaagacgggagtttcgcgcgggttcgcgtttgttgaattctaccaccttcaagacgcaacaagctggatggaggctaaccagaaaaaactggtgatccaaggaaagcatattgccatgcactattcaaatccaagacccaagtttgaggactggttatgtaataagtgttgtctgaataacttccggaaaaggctgaagtgttttaggtgcggtgcagacaagtttgatagcgagcaggaggttcccccaggtacaacggagtccgtccagagcgttgactattattgtgacacaattattctgagaaacatcgcacctcacacggtggttgattcaatcatgactgctctttctccctatgcctccctggccgtcaacaacatccgcctgatcaaggataaacaaacacagcaaaaccgcggttttgcatttgtgcagctgagctccgcgatggatgcctctcagctcttgcagatcctccagtctctccatcctcccctcaaaatcgacggcaagaccatcggggtcgatttcgcaaaatcagctcggaaagatctcgtcctgtcagatggtaaccgcgtgtctgccttttctgtcgcatccaccgcaatcgccgctgcacagtggagttccacccagtcccagtcaggcgaaggcggctctgtcgattattcatacttgcaacctggacaagatggatacgctcaatacgcccagtactcacaggattatcaacagttctaccagcagcaggcaggtggcctggagagcgacgccagctccgcttctggaaccgctgttacaacgaccagtgcggctgttgtgtcgcagtcgcctcagctgtacaatcagacctcaaacccccctggcagccccactgaggaagcccagcccagcacaagcacaagtacccaggcacctgctgcctcccctacaggagtcgtgcctggcactaaatatgccgtcccggacaccagtacttatcaatacgacgagtcgtcaggctattactacgaccctaccactggactatattatgatccaaactcccagtattactacaactccctgacacaacagtacctgtactgggatggggaaaaagaaacctacgttcccgcagcagagtcatcctcccaccagcaatcggggttgccccctgccaaggaaggcaaagaaaaaaaggaaaagcccaagtctaagaccgctcaacaaattgccaaggacatggaaaggtgggccaagtcgctcaacaaacaaaaggagaatttcaagaacagtttccagccagtaaattctctccgcgaggaggaaagaagggagagtgcagcggccgacgccggcttcgcactgttcgaaaaaaagggcgcgttggcggagaggcagcaactcatccccgagctcgtgcgtaacggagacgaggaaaatcccctcaaacgcgggctagttgcggcttatagcggcgactcagataacgaagaagagcttgtcgaaaggctcgaaagcgaggaggagaaactcgccgattggaagaaaatggcatgcctgttgtgtaggcgccagtttccgaacaaagacgccctggttaggcatcaacagctgtcagatctgcacaagcagaatatggatatataccgccgaagtcgcctgtcagagcaggagttagaagctctggaactgagggagcgggagatgaaatatagggacagagcggcggagcgccgcgagaagtatggcataccagagccgcctgaaccaaaaagaaagaagcagttcgacgccgggacggtgaattacgagcagcctaccaaagatggcatcgaccattctaatattgggaacaagatgctgcaagcaatggggtggagagaaggatccggattggggaggaagtgccagggaattacggcccctatcgaggcacaggtgcggcttaagggtgccggactgggagccaagggaagtgcatatggcttgtccggcgcagatagctacaaagacgccgttcgaaaagcaatgttcgcgaggttcaccgaaatggagtag

SEQ ID NO: 20485 - DNA, 363 bp, Artificial Sequence
  Description of Artificial Sequence: Synthetic coding sequence
atgggcagcgacaagcgggtgagccggaccgagcggagcggccggtacggatctataatcgaccgagatgatcgagacgagcgagaatctcgctcacgacggcgagactccgattacaagaggtcctctgacgataggcggggagatcgatatgatgattatcgggattacgattctcctgagcgggaacgtgaacggaggaattccgatagatcagaagacgggtatcatagcgatggagactatggcgagcatgattacaggcacgatattagtgacgagagggagtctaagaccatcatgctgcgcgggctacccatcacaataacggaaagcgatattcgggagatgatggagtcatag

SEQ ID NO: 20486 - DNA, 318 bp, Artificial Sequence
  Description of Artificial Sequence: Synthetic coding sequence
atgggcagcgacaagcgggtgagccggaccgagcggagcggccggtatggtagcatcattgatcgcgacgatcgggatgagagggagtcacgttcccgaagaagggacagcgactataagcgatcctcagacgatcgaaggggcgacaggtatgacgactatagagattacgattcccctgaacgtgaaagagagcggaggaattctgatagatccgaggacgggtaccatagcgatggcgactatggagagcacgattacagacatgacattagcgacgaacgcgaatctaagaccatcatgctgcgtggtctgtag

SEQ ID NO: 20487 - DNA, 414 bp, Artificial Sequence
  Description of Artificial Sequence: Synthetic coding sequence
atgggcagcgacaagcgggtgagccggaccgagcggagcggccggtacggtagcataatcgacagggacgatcgcgacgagagggagtctcgatccagacgccgagattctgactataaaaggtcaagcgatgaccgccggggagacaggtacgatgattacagggactatgactcccctgaacgggagcgagagagacggaactccgaccgcagcgaggatggctaccactctgatggtgactatggggagcacgactacagacacgacatctccgatgaaagggagtctaaaaccattatgctgaggggtctccccattacgatcacagaatccgacattagggaaatgatggagtctttcgaggggcctcagccagccgacgtccgtctgatgaagagaaagacaggatag

SEQ ID NO: 20488 - DNA, 432 bp, Artificial Sequence
  Description of Artificial Sequence: Synthetic coding sequence
atgggcagcgacaagcgggtgagccggaccgagcggagcggccggtacggctcaatcatcgatcgagatgaccgagacgagagagagtccagatcgagacggcgagacagcgactataagaggtcaagtgatgatagacgaggggaccgctacgatgactatagagattacgacagcccagaacgggagagagaaaggcggaactccgatagaagtgaagacggctaccattctgacggcgactacggggaacatgattacaggcatgacatttctgatgagcgcgagtccaaaaccataatgctgagagggttgcccatcacaattaccgagtccgatattagagagatgatggaatctttcgagggaccacaacccgccgacgttagactcatgaaacgcaagacgggggagagcctgttaagctcctag

SEQ ID NO: 20489 - DNA, 381 bp, Artificial Sequence
  Description of Artificial Sequence: Synthetic coding sequence
atgggcagcgacaagcgggtgagccggaccgagcggagcggccggtatggttctataatcgatcgtgatgatagggatgaaagggaatcgcgctcccgcagacgcgattctgattataagagatctagcgacgacagaaggggcgaccgctacgatgattatcgggattatgatagtcctgaaaatgacaaatactcaaggaatgacggagttcttcgtagaccctccgcatgtggctgtgaagccgacgaggaagaaaatcgatgcaaaccctggtttcgccttcggggagtgctgtccctggcgagatgttaccaactggatggctcacagtccgagaaggtgggtgattcgcgtaaggctcactgtaacgctttatag

SEQ ID NO: 20490 - DNA, 450 bp, Artificial Sequence
  Description of Artificial Sequence: Synthetic coding sequence
ggcaccaagtgccgggtgagccggaccgagcggagcggccggtacgggtctattatcgaccgtgatgaccgcgatgaacgcgaatccaggtcccgtaggagggatagtgactacaagaggtcaagtgacgatagacgtggtgacagatacgatgattacagggactatgatagtccagagcgcgaacgcgaacgacgcaatagtgatcgcagtgaggacggttatcacagtgatggggactacggtgagcatgattataggcacgatatcagcgacgaaagagaatcgaaaactattatgcttaggggattgcctattacaataactgagtccgatattagggagatgatggagtcctttgagggcccacagcctgccgacgtcagactcatgaaaaggaagactgaaaaagtaggcgattccagaaaggctcattgtaatgctctgtag

SEQ ID NO: 20491 - DNA, 2445 bp, Artificial Sequence
  Description of Artificial Sequence: Synthetic coding sequence
ggcaccaagtgccgggtgagccggaccgagcggagcggccggtacggcagtattatcgacagagatgaccgggatgaacgggaaagcagaagtcgcagacgcgactctgactacaaaagaagttcagatgatcgccgcggagaccgctatgatgactaccgcgattacgattcccctgagcgggagcgggagcggcgaaactcggatcgaagcgaggatggttatcactccgatggggactacggggagcacgattataggcatgacatttctgacgagcgagaaagcaagaccataatgctgaggggtttgcctattacgattacagaaagtgacattcgcgaaatgatggagtcattcgagggtccacaaccggccgacgtccggcttatgaaaaggaagacaggagtttcccgcggcttcgcctttgtcgaattctaccacctgcaggatgcgacctcgtggatggaggccaaccaaaaaaagctggttattcagggcaaacacatagcaatgcactattcaaaccctagacctaaattcgaggattggctgtgtaataagtgctgtctgaataacttccgcaagaggctaaaatgctttagatgtggagcagacaagttcgatagcgaacaagaagtgcctcctggcaccaccgagtctgtgcagtccgtagactactactgcgataccattatcctgcgaaacatcgcaccccacacagtcgtcgacagcatcatgaccgccctgtctccctacgcatctctggctgtgaacaacatccgccttataaaggacaagcaaactcaacagaatcgaggattcgctttcgtgcagctctcatcagccatggacgcaagccagcttctacagatactgcaatctctccacccccccctcaagatcgatgggaaaactattggcgttgacttcgctaagagtgcacggaaagatcttgtgctcagcgatggtaatcgcgtgagtgcgtttagcgtggcttctaccgctatcgcagccgcccagtggagtagtacccagtcgcaatctggggagggcggctcagtcgactacagttacctgcagcctggacaggatgggtacgctcagtatgctcagtattcccaagactaccagcagttctatcagcagcaggcaggcggcctggagtctgatgcctcttccgcttctggaaccgctgttactacgactagcgctgcagtggtgagccaatccccacagctgtacaaccaaacctctaatcctcctgggtctccaacagaggaagcccagccttctacttctaccagcacccaggcccccgccgcctctccaactggcgtagtgcccggcacaaaatatgccgttcctgatacttccacatatcaatacgacgagagcagcggctattattacgacccaaccacagggctgtattatgacccgaattcacagtattattacaattcgcttacccagcagtacctctactgggacggtgaaaaagaaacctacgtgcctgccgcggagtcttcaagccaccagcagagcggccttcctcccgccaaggaaggaaaagagaaaaaagaaaagcccaagtcgaaaacagcgcagcaaatcgccaaggatatggaacgctgggctaagagccttaacaagcagaaggagaattttaagaattcatttcaaccagtcaattcattgagggaagaggagagaagagaatctgctgcggcagatgccggcttcgcccttttcgagaaaaaaggggcgctggctgagagacagcagctgattccagagttagtcaggaacggggatgaagaaaatcccttaaagaggggtctggtggctgcctactccggggactcagataacgaggaagaacttgttgagagactggagtctgaagaagagaagcttgcagattggaagaaaatggcctgtttgctgtgcaggcggcagtttccaaacaaggatgctctggtacgccaccagcagctgagcgacctgcacaagcagaacatggatatataccgcagatcgcgtctgagcgaacaggaattggaagcactggaactgagggaacgtgagatgaagtatagggatcgtgcagcagaaaggagagagaaatatggcataccagagccccccgaacccaagcggaagaaacaattcgacgccggcactgtgaattatgaacagccaactaaggatggtattgatcatagtaatatcggtaataaaatgctgcaggccatggggtggcgggaggggagtgggctgggcaggaagtgtcagggcatcacagcaccaattgaagcacaggtgaggctgaagggtgccggcttaggcgctaaagggtccgcctatggactttctggggccgatagctacaaagatgccgtgcggaaagcaatgtttgcaaggttcacggaaatggaatag

SEQ ID NO: 20492 - DNA, 1518 bp, Artificial Sequence
  Description of Artificial Sequence: Synthetic coding sequence
aacggcttccggagcggcgagcgggacctggtgctgagcgacggcaacagagtgagcgctttctcagtggctagtaccgctatcgcagcagcccaatggagtagcacacaatcgcagagtggcgaaggtggctccgtcgactattcttatctgcaacctggtcaggatggatacgcacagtacgcacagtattctcaagattatcagcagttctaccagcagcaggccggtggactggagtcggacgcttcttctgctagtggcaccgcagtcactacaacttctgcagcagtcgtgagccagagccctcagttatataatcagacatccaaccctccgggcagcccaacagaggaggcccagcctagtacatcaaccagcactcaggccccagccgcctctccaacaggtgtggtgcctggaactaaatacgccgtccccgatacttctacatatcagtacgatgaatcttctggctactattacgatccaaccaccggcctgtattacgatcctaattcccagtactattacaattccctgactcagcaatacctgtattgggacggcgagaaagagacttatgtaccagctgctgagtcatcctcgcaccagcagtcaggcctcccgcctgcaaaggaagggaaggaaaaaaaagaaaaacctaagagcaaaactgcccagcagatcgcaaaggacatggaaagatgggccaagagcctgaataaacagaaggaaaactttaagaattcttttcaacccgtgaattctcttcgtgaggaggaaaggcgcgaaagcgccgcagccgacgccggctttgccttgtttgaaaaaaaaggtgctctggctgagcgtcaacaattgattcccgagctggttaggaatggcgatgaggagaacccactgaagcggggcctggtcgcagcatactccggcgatagtgacaatgaggaagagctggtggaacggttggagtctgaggaggagaaactggcagactggaagaaaatggcatgcctcctgtgtcgtcgccagttccctaacaaagacgccctggtgcgccatcaacagttgagcgaccttcataagcagaacatggacatttatcgcagaagtaggttaagcgagcaggaactcgaagccctcgaactgagggagagggagatgaagtatagggatagagccgcagagagacgggagaagtatggtatccccgagccccctgagcctaagcgcaagaagcagttcgatgccggaacagtcaactatgagcaaccgaccaaggacgggatcgatcacagtaatatcggtaacaagatgcttcaggctatgggctggcgcgagggtagtggcctggggaggaaatgtcaagggatcacggcccccatcgaagcccaggtgcgcctcaaaggcgccggtctcggcgctaaaggctctgcctatggcctttccggcgctgatagctacaaggatgcagtgcggaaggctatgttcgcaagatttactgagatggagtag

SEQ ID NO: 20493 - DNA, 3372 bp, Artificial Sequence
  Description of Artificial Sequence: Synthetic coding sequence
atgtggggcgacagccggcccgccaaccggaccggccccttccgggggtcccaagaggaacggtttgcgccgggctggaaccgcgactaccccccccctcccctgaagtctcatgctcaggaaaggcatagcggtaattttccagggagggattcgctgccattcgatttccagggccatagtggcccacctttcgcaaacgtcgaggagcattccttttcctatggtgctcgtgacgggccacatggggattataggggcggggagggacctggacatgacttccggggcggtgatttttctagtagtgattttcagtcaagagacagcagtcaattggactttagggggagggacatccattcaggtgatttcagggatcgtgaaggacccccgatggactatagaggaggggacggcaccagcatggactaccgcgggcgggaagccccccacatgaattatcgggatcgggacgcacatgccgtggactttcgcgggagggatgctcccccttctgactttaggggtaggggcacctatgatctggattttaggggccgcgatggaagccacgccgatttccgggggcgagatctttcagatttagacttccgtgctagggaacagagccggtcggatttcaggaatcgagatgtcagtgatttagattttcgtgataaggacgggactcaggtcgatttccggggaaggggaagtggaaccactgacctggatttccgggatcgggacactccacattcagactttcgcggcagacacaggtcacgcactgaccaggatttccgcgggcgcgagatggggtcctgtatggagtttaaagatagagaaatgccacccgtagaccctaacattctggactacattcagcccagcactcaggaccgcgagcacagcggaatgaacgtaaatcgaagagaagagagcacacatgatcataccattgaaaggccagcatttggcatccagaaaggtgagtttgagcactccgagacacgagagggcgagacccagggggtggcgtttgagcatgagtcccccgctgactttcagaactctcagtcccctgtgcaagaccaggataaatcccagctgtctgggagagaagagcagtccagtgatgccggattatttaaggaagagggcggactagacttcctgggaaggcaagataccgattacaggtcgatggagtatcgggatgttgaccaccgcctccctggtagccaaatgttcgggtatggacagtctaaatctttccctgaagggaaaaccgccagagacgcccaaagggacctccaagaccaagattacaggacaggcccgtcggaagagaagccgtcacgtctgatccgtctttctggcgtccccgaggacgccaccaaagaagaaatcctgaacgcattccggacacccgacgggatgcccgtgaaaaatctgcaactgaaggagtataacacgggctacgactacggctacgtgtgcgtggagttctccctgctcgaggacgctattggttgcatggaggccaatcagggaactctaatgattcaggataaggaggtgacgctggaatacgtgtcttctctggatttctggtactgtaagcggtgcaaagccaatatcgggggacatagatcctcatgttcattctgcaaaaaccctcgcgaggtgacagaggcaaaacaggaattgatcacctatcctcagcctcagaaaacgagtattccagcccctctcgaaaaacagccaaaccagcccttgcgtccggctgataaagaacctgagccccgcaagcgagaggagggacaggagtctagactcggccaccaaaagcgcgaagcggagaggtacctgcccccctctcgccgtgaggggccgactttccggcgtgacagagagcgggaatcctggtccggtgagactagacaagatggcgaaagtaagaccataatgttgaagaggatctataggtcaaccccacctgaggtgatagtggaggtgcttgagccttacgtccggcttaccactgccaatgtcagaatcatcaagaatcgaaccggacctatggggcatacatatggcttcatcgacctggactcccacgccgaagccctcagggttgtgaagatcttacagaatctggaccccccattcagcattgatggtaaaatggttgccgtgaacctggcaaccgggaagcgcaggaacgattcaggggaccactcagatcacatgcactactaccaaggcaaaaaatatttcagggatagacgcgggggtggaaggaacagcgattggtccagcgatactaataggcaaggccagcagagctcttccgattgctatatctacgatagcgctacgggctactactatgaccccctagccggtacttactacgaccctaatacccagcaagaagtgtatgtaccccaggaccctgggttaccagaggaagaagaaatcaaggaaaagaagcctacatcacaaggcaaatcttcttctaaaaaagagatgtcaaagcgcgacggcaaagagaagaaagacaggggcgtgaccagattccaagagaacgcttcagaaggtaaagccccggctgaagatgtgtttaagaaacccctgccccccactgtaaaaaaagaggagtcccctcctcctcccaaagttgtcaacccccttatcgggttgctcggggaatacgggggggattccgattatgaggaggaggaggaagaagaacagacccctcccccccagccgaggaccgcccaaccccagaaacgggaagagcaaactaagaaagaaaatgaggaggataaactcacagactggaacaagctggcttgtttactgtgtcggagacagtttccgaacaaggaggtgctgatcaagcaccaacaactcagcgacctgcataagcagaacctcgagattcacagaaagataaaacagtctgagcaagagctggcctatctggaacggagggagcgcgagggaaagtttaagggaaggggcaatgatcgacgggaaaaactgcagtcgttcgacagccccgaaaggaagcgaattaaatattcaagagagactgattcagaccgcaaacttgtcgataaggaggatatcgatacgtcctcaaaaggaggatgtgttcagcaggccacaggctggcgcaaggggacaggtcttggatatggccaccctggactggcaagctccgaggaagccgagggcagaatgagggggcctagtgttggcgcttccggtaggacgtctaaaaggcagtcaaacgaaacctaccgtgacgcggttaggcgagttatgttcgcccgatacaaggagctcgattag

SEQ ID NO: 20494 - DNA, 429 bp, Artificial Sequence
  Description of Artificial Sequence: Synthetic coding sequence
atgtggggcgacagccggcccgccaaccggaccggccccttccggggcagccaagaggagcgttttgcccccggctggaatcgcgattaccccccacccccactcaaatcacacgcccaggagaggcactcgggaaactttcccgggcgcgactccctgccgtttgattttcagggccactcaggacctccattcgcgaatgtggaagaacatagcttttcttatggtgctagggatggaccccacggcgattaccgtggaggtgagggcccagggcatgacttcagaggcggcgacttcagttcatctgattttcagagtagggacagctcacagcttgattttcggggccgagacatccatagcggggatttcagagaccgtgagggacctccaatggattacagggggggcgacggaacatcctag

SEQ ID NO: 20495 - DNA, 1806 bp, Artificial Sequence
  Description of Artificial Sequence: Synthetic coding sequence
atgatccaggacaaggaggtgaccctggagtacgtgagcagcctggatttttggtactgcaagcgctgcaaggcaaatatcggaggtcataggtcatcatgttctttctgcaagaatcctagagaggtgaccgaggctaagcaggagttgatcacataccctcagccccaaaaaacttccatccccgctccgcttgaaaaacagcctaatcagccgctccgccctgccgacaaggaaccagaaccacggaaacgagaggaagggcaagagtccaggcttggtcaccagaagagggaggccgagcggtatctaccaccttcacgacgcgaggggcccactttccggagggatagagagcgcgaatcttggtccggggagaccaggcaagacggcgagagtaagactattatgctcaagaggatatacaggagcacaccacccgaagttatcgtcgaggtgctggagccctacgtcaggctcactacagctaatgtgagaatcatcaagaaccgtactggacccatggggcatacctacggattcattgacttggactcccatgcagaggcgctgcgggtggtgaagattttacagaacctggatcctccgttcagcatcgatggaaagatggtagcggttaacctggccactggaaaacggagaaacgatagcggtgaccacagcgatcacatgcactactatcagggtaaaaagtatttcagagatcggcggggcggcgggaggaactccgattggagctctgacaccaaccggcagggtcaacaatctagttcggactgctacatctacgacagcgctacaggttactactatgacccactcgccggtacttattatgatcccaacactcagcaggaggtgtatgttccgcaggaccctggactgcctgaagaggaggaaatcaaggaaaaaaagcccacctcacagggcaaaagtagttcaaaaaaggagatgtccaaacgcgatggaaaggagaaaaaggatcgcggggtcacccggtttcaggaaaacgccagtgaaggcaaagctcccgccgaggatgtgtttaagaaacccctcccaccgactgtgaaaaaggaggaatctccccccccaccaaaggtagtcaatccgctgatcggcctcctaggagaatacggcggcgactccgattacgaggaggaagaagaagaggaacagactcctcctccacagccaaggactgcgcagccccagaaaagagaagaacagaccaagaaagagaacgaagaggataagctcaccgactggaataaactggcctgtttgctgtgtcggaggcagtttccaaataaagaggtgctgattaagcatcagcagctgtccgacctgcacaaacagaacctggaaatccataggaaaataaagcagtctgagcaagagctggcctacttggaacgacgtgaacgcgagggcaaatttaagggcagaggaaacgaccgccgcgaaaagctgcagtctttcgattctccagagagaaagcgaattaaatattctcgcgagaccgacagtgatcggaagctggtcgacaaggaagatatcgatacatcttctaaaggcgggtgcgtacagcaggcaaccggctggaggaagggaaccggtcttggatatgggcatcccgggctggcatcaagcgaggaagctgagggacgtatgagagggccatccgtgggcgcatcgggaaggacaagcaagcgtcagagtaacgagacatacagagacgccgtgcgacgcgtcatgtttgctaggtataaggagttggactag

SEQ ID NO: 20496 - DNA, 1563 bp, Artificial Sequence
  Description of Artificial Sequence: Synthetic coding sequence
atgtggggcgacagccggcccgccaaccggaccggccccttccgggggagtcaggaagaaaggttcgcccctggatggaatcgtgattacccccccccaccactcaagagccatgcccaagaaagacattcggggaattttcctggccgggatagcctgcccttcgattttcagggtcatagcggccctccgttcgcaaacgtagaggagcacagtttcagttacggggccagggatggaccccacggggactatcggggtggtgagggtccaggccacgacttcaggggcggagacttctctagttcagatttccagtcacgtgacagtagccaattggatttcagggggcgggatatacactccggggattttcgggacagagagggcccacctatggattaccggggaggggacggcacttctatggattaccgggggcgagaagcaccccatatgaattaccgagacagagacgctcacgccgtggactttagaggcagagacgcaccgcctagtgactttcgagggcggggcacatatgacctggatttccgcggacgggatggatcccacgctgatttccgcggccgggacctgtctgatctggatttcagagcacgagaacagtcccggtccgattttcggaacagggatgtgagcgatctcgatttcagggacaaggatggtactcaggtggattttcgcggccgcggctctgggacaaccgacttggattttcgtgaccgggacactcctcactcagactttcgcggccgccacaggtcaaggactgatcaggacttccggggtagggagatggggtcctgtatggagtttaaagatcgggaaatgccccctgtggaccctaacatcttagattacatccagccttctacccaggatcgggaacatagcgggatgaatgtaaatagacgggaagagtcgacccatgaccatacgatcgaaaggcccgcattcggcatccagaaaggagagtttgagcattcggagactcgggaaggcgagacacagggagtggcgtttgaacatgagtcaccggccgattttcaaaatagccaatcgcccgtacaggatcaggacaagtcccagctgtcagggagagaggagcagagctcggacgctgggctgtttaaagaagaaggcggactggatttcctcggccggcaggataccgattataggtcgatggaatatcgtgacgtggaccatcggttaccagggagccaaatgttcggttatggccaaagcaagagcttccctgagggtaagacagcaagagacgcccagagggacctgcaggaccaggattataggaccgggccatcagaggagaagccaagcaggctgatcaggctcagcggtgttcccgaagatgcgacaaaagaggagatcttaaacgccttcaggacacctgatggtatgcctgtgaaaaatttgcaactgaaagaatacaacacagggaattccaacgatcctggccagagatcatacccgggggtgtgcatcaagcctggtttcctggtgttgcaaaccatgtag

SEQ ID NO: 20497 - DNA, 231 bp, Artificial Sequence
  Description of Artificial Sequence: Synthetic coding sequence
atgtggggcgacagccggcccgccaaccggaccggccccttccggggctcgcaagaagaacgcttcgcacccggctggaatagagactacccccccccccctctgaagagccacgcacaggaacgccactctggcaacttccctggccgggacagcctgccctttgatttccaagggcactcaggccctccgtttgcaaatgtcgaagagcattcgttcagttacgggtag

SEQ ID NO: 20498 - DNA, 1806 bp, Artificial Sequence
  Description of Artificial Sequence: Synthetic coding sequence
atgatccaggacaaggaggtgaccctggagtacgtgagcagcctggatttttggtactgcaaacggtgcaaggccaatattggcggacataggagttcatgttccttctgtaaaaacccgagggaggtaacagaggcaaagcaggagctgatcacctatcctcagcctcagaagacttcgatcccggcaccgcttgaaaagcagcccaaccagccattgagacccgctgataaggagcccgaaccacgcaagcgggaagagggacaggaaagccgactgggacatcagaagcgggaggctgagcgttatcttcccccaagccgccgcgagggaccaactttccgacgcgaccgtgaacgggagagttggtctggcgaaacaaggcaggacggagagtctaaaaccatcatgttgaaacgcatttataggagcacgccgccagaagttatagtggaagtcctggagccatacgtgaggcttaccaccgctaatgtgagaataattaagaataggactggtcctatgggacacacctacggctttattgacctggattcccatgcagaagcactgcgggtggtaaagatactgcagaatctagacccccctttctcaattgacgggaagatggttgccgtcaacctagccactgggaaaagaaggaacgatagcggcgaccattctgatcacatgcactactaccagggcaagaagtatttccgcgacagacgcggcggtgggcgtaactctgattggtcttctgatacgaatcgtcaaggacagcaatcttcatccgattgttacatctatgactctgctaccggctactactacgatcccctggccgggacctattacgaccctaatacccagcaggaggtttacgtacctcaggatcccggtctgcctgaagaagaagagatcaaggagaaaaaaccaacttcccagggcaagagctcctcaaagaaagaaatgtctaaacgcgacgggaaagaaaaaaaggatagaggcgtaacccgcttccaagagaacgcctctgagggtaaggctccagccgaggatgtattcaaaaagcccctaccacccaccgtgaaaaaggaggaaagcccccccccaccaaaggtggttaatccgctgattggcctgctgggagagtacggaggagactccgattacgaagaggaagaggaggaggagcagacaccaccccctcaacccagaactgctcagccgcaaaaaagggaggaacaaacaaagaaggagaacgaagaggacaaattaactgactggaataagttggcctgtctactttgcaggaggcagttcccaaacaaggaggtgttgatcaagcaccaacaactcagcgacttgcacaagcagaacctagaaatccataggaagatcaagcagtccgaacaggagctggcctatttggaacggagggagagggaaggcaagttcaagggccgcgggaatgatcggcgggaaaagctccagagctttgactcacccgagagaaagcggattaaatattcacgggagactgacagtgaccggaagttggtcgacaaagaggatatagacacatccagcaaagggggctgcgttcagcaggctactggatggcgcaagggtactggacttggctacggccaccccggactggcttcttcagaggaggcggaggggagaatgagaggcccttctgtgggagccagtggccgaacaagcaagagacagagcaacgagacataccgggatgccgtcaggagagtaatgttcgcaagatacaaggaactggattag

SEQ ID NO: 20499 - DNA, 2976 bp, Artificial Sequence
  Description of Artificial Sequence: Synthetic coding sequence
atggactaccggggcggcgacggcaccagcatggactaccggggccgtgaagcccctcatatgaactatcgggaccgcgatgctcatgctgtggattttcgggggcgggacgctcctccgtcagattttagaggaagggggacctatgacctagacttccgtggccgcgacgggtcccacgctgatttccgaggtcgcgacctatccgacctcgacttccgcgcccgcgaacaaagcaggagcgacttcagaaaccgggacgtttcagacttagattttagagacaaggacgggacccaggtggactttagaggtcggggttcgggtacgaccgatctcgacttccgcgacagggacacaccacattctgatttccggggcagacatcgaagcagaaccgatcaggacttcagaggccgcgaaatgggatcttgcatggaatttaaggaccgcgagatgcccccagtggacccgaatatcctggactatatacaacccagtacccaggatcgtgaacactcaggaatgaatgtgaataggcgggaggagagcactcacgaccataccatcgagcgcccggccttcggtatccagaaaggagagtttgagcactctgagacgagggaaggagagacacagggagtggcgttcgaacacgagtctccggctgatttccagaatagccagtccccggtgcaggaccaggacaaaagccaactaagcgggagagaggaacagtcttcagacgcagggctctttaaagaggagggaggcctggactttctaggcaggcaggacactgactaccgctctatggagtatcgcgatgtagaccatagactgccagggtctcagatgtttggatacggtcaatcaaaatcatttcctgagggcaagacagctcgggacgctcagagggatcttcaggatcaggattatagaacaggcccatctgaggagaagccaagtcggctgatcagattgtcaggggtacccgaagacgcaaccaaggaggagatcctgaatgcattccgcacaccagacgggatgccggtaaagaacctacagctgaaagagtataatacggggtatgactatggctacgtctgcgtggagttcagcctgctcgaagatgccatcggatgcatggaagccaaccagggtaccctcatgatccaggacaaagaggtcaccttggaatacgtttcctcattagatttctggtactgtaagcgatgtaaagctaacatcggaggccataggtcgtcatgcagcttctgcaagaacccccgggaggtgaccgaggcaaaacaagaactcatcacgtatccccagccgcagaagacatcaatacccgcccctctggaaaagcagcccaatcagccattgagaccggccgacaaagagcccgagccaaggaagcgggaagaagggcaagagagccgcctgggccaccagaaacgagaggccgagaggtatttgcccccatcaaggagggaagggccaaccttcaggcgtgatcgagagcgcgaatcttggagcggggagactagacaggacggagaatccaagaccatcatgcttaagcgcatttacagatctacacctcctgaagtcatcgtggaggtgttggaaccttacgtcagactgacaactgcaaacgtgagaattataaagaataggaccgggcccatgggccacacctatggcttcattgaccttgacagccatgcggaggcactgagagtggtcaaaattttacagaacctggaccctcctttctccatagatggaaaaatggtcgctgtgaacctggctactgggaaaaggcgcaatgattcaggggaccacagtgatcacatgcactactaccaggggaagaaatacttccgcgacagaagaggcggaggcaggaattccgattggtctagtgacaccaaccgccaaggtcagcagagctcctccgattgttatatctatgacagcgccactggttattactatgacccccttgccggcacctattacgaccccaatacgcagcaggaggtgtatgtcccacaggaccctggcctgcctgaggaagaagaaatcaaggagaaaaagccgacctctcagggcaaatcctcatctaaaaaggagatgagcaagcgggacgggaaggaaaaaaaggaccgcggagtcacccgatttcaggagaacgcatcagagggcaaggctccggctgaggacgtttttaagaaaccactgcccccaaccgtcaagaaggaggagagtccacccccaccaaaggtggtaaacccgctcataggactgcttggagaatacggaggagactctgattacgaagaggaggaggaggaagaacagaccccaccgcctcaacctcggacagcacaacctcaaaagagagaagagcagacgaagaaagaaaacgaagaggataagcttacagactggaataagctggcatgtttgctttgtcggcgccagtttccgaataaggaagtcctgatcaaacatcagcagctcagtgatttgcacaagcaaaatctagagattcatcgaaagatcaaacaaagcgaacaagagctagcttatctggaacgtcgggaaagggagggcaaattcaagggccgagggaacgaccgccgggaaaagctgcagagtttcgattctcctgagagaaaacgaataaagtactcaagagagactgactcagatcgaaaactggttgacaaggaggacattgatacttcgagtaaggggggctgtgtccaacaagctactgggtggcgcaagggcaccggactcggttatggccatcccggcctcgctagctccgaagaggccgaaggcaggatgcggggtccatctgtgggcgcctccggacgcacgagtaaaaggcaatccaatgaaacatacagagacgccgttcggagagtcatgttcgccagatacaaagagctagactag

SEQ ID NO: 20500 - DNA, 1398 bp, Artificial Sequence
  Description of Artificial Sequence: Synthetic coding sequence
atgctgaagcggatctaccggagcaccccccccgaggtgatcgtggaagttctggaaccatacgtacgcctcaccacggctaatgtgcgcatcatcaaaaatcgaacaggaccgatgggacatacatacggattcattgacctggattctcatgccgaagccctccgtgtggtgaaaattttgcaaaatctagatccaccctttagtatagatggcaagatggtggctgtaaatctggcaaccggtaagcgccggaatgatagcggagatcattctgaccacatgcactactaccagggtaaaaagtactttcgggatcgccgagggggaggccgaaattctgactggagtagcgatacaaatcgtcaggggcagcaatcctcgtccgattgctacatctacgacagtgcaacgggttattattatgaccccctcgctggaacatattacgatcccaatacccagcaggaagtgtatgtgccgcaggacccgggacttcccgaggaagaggagatcaaggagaaaaaaccaacctctcaggggaagtcctcctccaaaaaggagatgagcaagagagatggaaaagagaagaaagaccgcggagtgactcggtttcaggagaacgcctcagagggcaaggcccctgcagaggacgtcttcaaaaagcccttgccaccaactgtcaagaaggaggagagccccccacccccgaaggtggtgaaccccctgatcggcctccttggggaatacggaggcgatagcgattacgaggaggaggaggaagaggaacagacgccccctcctcagcctcgtaccgctcagccgcaaaagcgagaagagcagactaagaaagagaatgaggaagacaagctgacagattggaacaaacttgcttgtttgctctgtcggagacagttccccaataaggaagttttgatcaagcatcagcaactgagtgatctgcataagcagaatctggagatccaccggaaaatcaagcagagtgagcaagagctcgcctacctggaacggcgggaaagggagggaaagtttaagggaagaggcaatgaccgcagggagaagttgcagtcttttgactcaccagaacgcaaacgcattaaatacagcagggaaaccgattctgacagaaaattggtagataaggaagacattgatacctcaagtaaaggcggttgcgtgcagcaggcaacgggctggcggaagggcaccgggttggggtatggtcatcctggcttggcctcaagcgaagaggccgaggggagaatgagaggacccagtgtcggggcctctgggcggactagtaaacggcagagcaatgaaacctatcgagatgctgtgagacgcgttatgtttgctaggtacaaagagctggactag

SEQ ID NO: 20501 - DNA, 1173 bp, Artificial Sequence
  Description of Artificial Sequence: Synthetic coding sequence
atggtggaggccgaccggcccggcaagctgttcatcggcggcctgaacactgagacaaatgagaaggcgttggagaccgttttcgggaagtacgggaggatcgtcgaagtgctgttgatcaaggaccgcgaaaccaacaaatcgcgcggatttgcttttgtgacttttgagagcccggccgacgccaaagatgccgcccgggacatgaatggcaagtctcttgatggaaaagccatcaaggtagaacaggctacaaagcctagttttgaaaggggcaggcatggcccgccccctccaccgaggagccgcggccccccccgcggcttcggtgccggacggggaggctctggaggcacccgtgggccccccagcaggggtggccatatggatgacggcgggtatagcatgaattttaacatgagctcctctagggggcccctgcccgtgaagcgtggacctcctccccggtccggcggccccagtccaaaaagatctgccccctccgggctggtgagatcatctagcggaatgggcggacgggccccactgtcccgagggcgggattcctatggagggcctcctcgtcgggagcctctgccttctagacgagacgtgtatctctccccacgggatgacggctattcaacgaaagactcatatagcagcagagactacccgtcctcacgcgatacacgagactacgcaccgcctccgagagactatacatatcgagattacggccactctagcagccgggacgactaccccagccgcggctatggtgatcgggacggttatgggcgcgatcgtgactattcagatcacccaagcggggggagctacagagattcatacgaatcatatggaaactctcgctcagcccccctgactcgcggcccccctcccagttatgggggaagcagccggtacgatgattattcatcttcccgggatgggtacgggggcagccgggattcgtattcttcgtccaggtcagacctctactcaagttgcgatcgggttggacgacaggagcgcggcctaccaccaagcgtcgaaagggggtatccctcaagccgggattcgtacagcagcagcagtcggggtgcgccacgtggtgcaggcccaggcggatctcggtcagatcggggcggtgggaggtcaaggtattag

SEQ ID NO: 20502 - DNA, 1173 bp, Artificial Sequence
  Description of Artificial Sequence: Synthetic coding sequence
atggtggaggccgaccggcccggcaagctgttcatcggcggcctgaacacggaaacaaacgaaaaagctctggaaactgtgttcggcaagtacggccgcattgttgaagtcttgctgattaaagatagagagacaaacaagagtcgaggattcgcattcgtgacttttgagtcccctgccgatgctaaagatgcagcccgcgacatgaacgggaaatccctagatggaaaggctatcaaggtggaacaggcaacaaaaccttctttcgaaaggggtcgccacggtcctcccccacccccgcggagtcgcggcccaccccgagggtttggcgcagggcggggtggatcgggcgggaccagaggacccccgtcacgcgggggacacatggatgacggcggctactctatgaactttaacatgagcagctccagaggccccctgcctgtgaagcgtggcccacctccaaggtcaggtggcccctctcccaagcggagcgcaccgagtggactcgtgcggtcgagcagtggtatgggtggtcgcgccccactctccagagggcgtgactcgtacgggggccctccccgaagggagccactgccttcccgaagagatgtgtatctgagccctcgcgacgatggatattcgacaaaggacagttattccagccgcgactaccccagcagtcgggacacccgggactacgccccccctcctcgggattacacataccgcgattatggacattccagcagcagggatgactatccctctcgtggctacggagatagggatggttacgggagggatagagattactctgaccacccatcaggcggatcctaccgtgactcgtacgaatcttacggaaactccagatccgcaccactgaccaggggtcctccacccagctatggtggttcctcacgatacgatgattattccagcagccgggatggttacgggggctctagagactcctattcatccagccgatctgacctctattcaagctgtgacagggtggggagacaggaacgcgggctgccacccagcgtggaacgtgggtacccgtcttcacgtgactcatacagctcttcatcaagaggggctccacggggagccgggcctggaggcagcaggagtgatcgcggggggggtcggtcgcgctattag

SEQ ID NO: 20503 - DNA, 1491 bp, Artificial Sequence
  Description of Artificial Sequence: Synthetic coding sequence
atggtggaggccgaccaccccggcaagctgttcatcggcggcctgaatcgcgaaacaaatgaaaagatgctgaaagctgtcttcggcaaacatggacccatctcagaagtacttctaattaaggaccgaacctcgaagtcccgaggctttgcttttattacgttcgagaatcctgctgacgccaaaaatgccgctaaggatatgaacgggacttctctgcacgggaaagcgatcaaggtggaacaggccaaaaagccctcctttcaaagcggcgggcggaggcgcccacccgcatcctctaggaacagaagtccatccggatcattgcgctcagcccgcggctccagcggtggaactcgtggttggctgcccagccatgagggacacctggatgacggtggatatacccccgacctcaaaatgtcttactcccgtggactgatccccgtaaagcgagggccctccagtcgctcaggggggcccccccccaagaagtccgccccttccgcagtggcacgatcaaactcttggatgggatcacaaggcccgatgagtcaacgccgggaaaattatggggtgcctcctcggcgagcaaccataagctcatggcgcaacgaccgtatgagtacacgtcacgacggctatgccaccaacgacggcaatcacccctcctgtcaagagacccgtgactacgccccaccatcacgtggctatgcttaccgcgacaatggccactccaaccgcgatgagcactctagccggggctacagaaatcataggtcctctagggaaactcgagattacgcaccaccctcaagggggcacgcgtaccgagattacggtcattcacgtagagacgagtcctactcaagaggctatcgaaaccatagaagttcacgggaaacaagggagtacgcaccaccgtcacgaggacacggatatcgcgattatggccactcccgacgtcacgagtcttatagtcgcggctaccggaaccacccatcttccagagaaaccagggattatgctccacctcaccgcgactacgcttacagagactatggacactccagctgggacgagcactcaagcaggggctacagttatcatgatgggtacggcgaggctctgggacgggatcactccgagcatttatcagggtcatcctaccgtgacgccctgcagcgctacgggacgtcccacggagccccgcctgcacgtggaccacggatgagctatggtgggtccacatgtcatgcgtatagtaacactagggacagatacggacgaagttgggagagttatagttcctgtggtgactttcattactgcgacagagagcacgtttgccgtaaagaccaaaggaacccgccctctctcgggcgggtactgccagatccccgagaggcatacgggtcatcctcttatgttgcctcaatcgtcgatggaggggagtcacgctcagaaaagggcgactcatcacgttactag

SEQ ID NO: 20504 - DNA, 1380 bp, Artificial Sequence
  Description of Artificial Sequence: Synthetic coding sequence
atggtggaggccgaccaccccggcaagctgttcatcggcggcctgaacagagagaccaatgaaaaaatgctcaaggcagtttttggtaaacatgggccaatttctgaggtgctgctcataaaggaccgcaccagcaaaagccgagggttcgcctttattacctttgaaaatcccgcagacgccaagaatgctgctaaggacatgaatggcacgagcctccacgggaaagccattaaagtagagcaggcgaaaaagccgtcattccaaagcggagggcgaagaagaccccccgcctcatccagaaatagatccccaagcggcagcctccgatcagctagggggagcagcggtggcacgcgcggatggctaccatcacatgaggggcacctcgatgacggaggctatacacctgacctgaagatgtcttactctcgcggtctgataccggttaaaaggggcccttccagccgctcagggggtccccctcctaaaaagtctgctcctagcgctgtagctagatcaaactcgtggatggggagccagggcccaatgagccagagacgcgagaactacggcgtgcccccccggagagctaccatatctagctggcggaacgataggatgtcaacccgccacgacggctacgcgacaaacgatggcaaccacccctcttgccaagaaacgagggattacgcccctccctcaagggggtatgcataccgcgacaatggccattctaaccgcgacgagcacagttctcgcggttacagaaaccacagatcaagtcgagagacaagagattatgctcctccttcacggggacatgcgtaccgggattatggccactctcggcgcgacgaatcttattctcggggatataggaatcaccgctcttccagagagactcgcgagtacgccccaccgtctcgaggacatgggtatcgcgactacgggcatagcaggagacacgagagctattctcgaggctattcctaccatgacggctacggagaggctctgggtcgggaccactctgagcatctgtctgggtcgtcctaccgggacgccctccagagatatggtacttctcacggtgcgccccctgcgcgaggacctagaatgtcatacgggggaagtacctgccacgcttacagcaacacgagggacagatacggaaggagctgggaatcgtacagcagctgcggggatttccactattgtgacagggaacatgtgtgtaggaaggaccagcgtaacccaccaagcctgggacgcgtcctgccagaccctagggaggcctacggatcttcctcttatgtggccagcattgttgatggaggagaatcccgaagcgagaagggcgattcttcccgatattag

SEQ ID NO: 20505 - DNA, 1491 bp, Artificial Sequence
  Description of Artificial Sequence: Synthetic coding sequence
atggtggaggccgaccaccccggcaagctgttcatcggcggcctgaacagagagaccaatgaaaagatgctgaaggccgtgtttgggaagcatggcccaatttctgaagtccttcttatcaaagacaggactagcaagagtcgtggctttgccttcatcacttttgagaacccagctgacgccaagaacgcggctaaggatatgaatggtactagcctgcatggtaaggcaatcaaggtcgagcaagcaaagaagcccagtttccagtctgggggccgaaggagacctcctgctagctcaagaaacagatctccttctgggtcccttagatcagccagaggttcgtcgggaggcacacgggggtggctgcctagccacgaagggcatctggacgacggtggctacacgccggatctgaagatgtcatactcaagaggcctgatacccgtcaagcggggaccatcttctagatcagggggcccccccccgaagaagtcggcgccctcagcagttgctaggtccaatagctggatgggaagccagggacctatgtcccaaagacgggagaattacggagtgccaccgcgccgagcgacgatctcctcatggcgcaatgacaggatgagtactcggcacgacggatatgccactaacgacggcaatcacccatcctgccaagagacccgcgattacgcgcctccctccaggggatacgcgtacagggacaacggacacagcaatcgcgacgagcattcttctcggggatatcggaatcataggagctccagagaaacacgcgattatgctcccccatcgagagggcacgcctacagggactatggacacagtcggagggacgaaagctactcacgcgggtatcgcaatcacagatcaagccgagagacccgcgagtatgcacccccatctcggggacatgggtacagggattacggtcattctcgcagacacgagtcctacagcagggggtacaggaaccatccaagtagtcgggagactagagactacgccccaccccatcgcgattacgcctaccgcgactacgggcactcctcttgggatgagcattcaagccgaggctattcttatcacgacggctatggagaagcacttgggagagatcacagtgagcatctctctggctcctcttacagagatgcgctgcagcggtacggaacaagtcatggagctcccccagctcgtggaccacgaatgtcttacggaggaagtacatgtcacgcttatagcaacacaagggatagatacggccggtcttgggagtcgtatagttcctgtggagacttccactactgcgaccgcgagcacgtttgtagaaaagaccagcgcaaccctcctagcctcggaagggtgcttccagacccgcgtgaggcctatggatcatctagctatgtggcctctattgtggacggcggcgagtcccgatctgaaaagggagatagctcgcgctactag

SEQ ID NO: 20506 - DNA, 1491 bp, Artificial Sequence
  Description of Artificial Sequence: Synthetic coding sequence
atggtggaggccgaccaccccggcaagctgttcatcggcggcctgaatagggagacaaatgagaaaatgctgaaagcagtctttggcaagcacgggcccatttctgaggtgctgctcattaaagatagaacctccaagagccgagggttcgctttcatcacctttgagaatccagctgatgccaaaaatgcagccaaggatatgaatggcacctctctacacgggaaggcgattaaggtggagcaggcaaaaaaaccctctttccaatcggggggcagacggagacctcccgcctcctcacgaaacaggtcccccagtgggtctctgaggagcgccaggggatctagtggcggtacaaggggctggttgccatcacacgaggggcatctagacgacggtggttatacacccgatctgaaaatgagttatagccgcggactgattccagtgaagaggggcccgtcttcccggagcgggggcccaccgccaaagaagagcgcccctagtgcagttgccaggtcaaacagttggatgggatctcagggaccaatgtctcaaagacgagagaattatggcgtgcccccaaggcgcgctacaatttccagttggcgcaatgatcggatgagcaccagacacgatggttatgccactaatgacggcaaccatcccagctgccaggaaaccagagattacgctcctcctagcaggggttacgcgtaccgcgataatggacacagcaaccgggatgaacactcatcacggggatatcgcaaccaccgctctagcagggaaacacgggactacgccccacccagccgtgggcatgcctaccgcgattacgggcactccagacgggatgaatcatactcaaggggatacagaaaccataggtctagtagggagacacgggagtacgcaccccccagcaggggccatgggtaccgggactacggacacagtcgacgacacgaatcatactctcggggctaccgcaaccacccaagttcccgagaaacaagagactatgcccccccacaccgtgactatgcctatcgcgactacggccactccagttgggatgaacatagctccaggggatacagctaccacgacgggtacggcgaagctttggggcgggaccactcagagcacctgtctggaagttcatacagggacgcactgcaacgctacgggacttctcacggtgcccctcccgcccgtggcccccgcatgtcttatggcggaagtacctgtcacgcgtattctaacaccagagatcgctatggaaggagctgggagagctactctagttgtggcgactttcattactgcgacagggagcacgtgtgcagaaaggatcaacggaaccctccctcgctgggccgggtgctgccagatcctagagaggcatacgggtccagcagctatgtggcttccatcgtcgatggcggagagtctcgctcagagaaaggtgattcatcaagatactag

SEQ ID NO: 20507 - DNA, 1380 bp, Artificial Sequence
  Description of Artificial Sequence: Synthetic coding sequence
atggtggaggccgaccaccccggcaagctgttcatcggcggcctgaaccgagagacaaatgagaagatgctgaaggccgtcttcggtaagcacggacctatctcagaagtgctgctcatcaaagatcggactagtaaatcgcggggcttcgcattcatcacattcgagaatcccgcagacgcaaagaatgccgccaaggatatgaatggtacttctctgcatggaaaagccatcaaggtggagcaggccaaaaaaccctcatttcaatccggcggcagacgcagaccgcctgccagcagccggaaccgctccccctcggggtctctgagatcagcaagaggaagctccgggggaacccgaggctggctcccttctcacgagggccatctggacgacggtgggtacactcccgaccttaagatgagctattcacggggcctgattcctgttaagcgtggcccaagtagccgctcgggcgggccaccccccaagaaatcagccccaagcgccgtggccaggtcaaattcctggatgggcagccaggggcccatgtcacagagacgagagaactacggtgtacctcctaggcgcgctaccatatcctcttggcggaatgatcggatgtctactaggcatgatggttatgccacaaatgacggcaaccatccctcatgtcaggaaacacgagactatgctcccccaagccggggctatgcttatcgcgacaatggtcacagtaatagagatgaacatagctccagagggtacagaaaccaccgctcctctcgcgagactcgggactacgctccacccagccggggccatgcgtaccgagattacggtcactcaaggcgggacgagagttattctagggggtaccggaatcaccgttctagtcgagaaactcgagagtacgctcctccttcaaggggccacgggtaccgtgactatggtcattcacgacggcacgaatcctattcccgcggatactcctaccacgacgggtacggagaagccttggggagagaccactcagaacacctgagcgggagtagctaccgggatgcccttcagagatatggaacttcccacggggctcccccagccaggggtccgcggatgtcttacgggggctcaacgtgccacgcttacagcaatacaagggacagatacggacggtcctgggagtcttacagcagctgtggcgacttccattactgtgacagggagcacgtgtgtcgcaaggaccagcgcaacccaccaagcttgggacgtgtcctccccgatccacgtgaagcctacggttcttcctcctacgtggcctctatcgtggacggaggtgagtcacgcagtgagaagggagactcaagtcggtactag

SEQ ID NO: 20508 - DNA, 1221 bp, Artificial Sequence
  Description of Artificial Sequence: Synthetic coding sequence
atgggcaaggtgtggaagcagcagatgtacccccagtacgccacctattactaccctcagtacctgcaagcaaagcaaagtctcgtgcccgctcatccaatggcacccccctcaccttctacaacgtccagcaacaataattcttcctcatcctctaatagcggttgggatcagctgtcaaaaacaaatctctacatacgcggactgcctcctcacaccaccgaccaggacctggtaaagctctgccagccttatgggaagattgtctccacgaaggccattctggacaagaccactaataaatgcaagggttatggcttcgttgatttcgatagtcctgccgcagcccagaaagctgttagcgccctgaaggcctccggcgtgcaggcccagatggccaagcagcaggaacaagatccaactaatctatatataagcaatttgccactgagtatggacgagcaggaattagagaatatgctaaaaccctttggccaggtcatcagcacgaggatactgagagacagttctggcacatcaagaggggtgggtttcgcccgaatggaaagcacagagaagtgcgaagccgtgatcgggcacttcaatggcaaattcataaagaccccccccggggtaagcgcaccaacagagccactcctctgcaaattcgctgatggaggccaaaaaaaacgccagaatccaaacaaatatatcccaaatggtagaccctggcacagagaaggagaggtcagactagctgggatgaccttgacgtacgaccccaccaccgctgctatacaaaacggcttttatccttccccctactcaatcgcaacaaacaggatgattacccagacttccatcaccccatacatagctagcccagtatccgcataccaagtgcagtctccatcttggatgcagccgcagccctatatcctacagcaccctggggcagtgttgacccctagtatggagcacactatgtccctacaacctgcgtccatgatatcaccccttgcacaacaaatgtctcaccttagcctagggtcaacaggtacgtatatgcctgccacaagcgctatgcaaggggcatatttgccgcagtatgcccatatgcagacgaccgccgtcccagttgaagaggcttcagggcagcagcaggtggccgtagaaacgtcaaacgatcacagtccttacacttttcaacctaacaagtag

SEQ ID NO: 20509 - DNA, 1260 bp, Artificial Sequence
  Description of Artificial Sequence: Synthetic coding sequence
atgggcaaggtgtggaagcagcagatgtacccccagtacgccacctattattatccccaatacctccaggcaaaacagtctctggttccagcacaccctatggctcctccgtctcctagcactacctcttctaataacaactccagctcgtcttccaattcaggatgggatcagttatcaaagaccaacctctacattcgagggctgcctccccacaccacagaccaggatctggtcaagctgtgccagccatacggcaagattgtgtctaccaaagcaatattggacaaaactaccaataaatgcaagggatatggttttgtggatttcgacagccctgctgccgctcagaaagccgtatcagctctcaaggcctccggtgttcaagctcagatggccaaacagcaggagcaggaccccacaaacctgtacatatccaacctacccttgtcgatggatgagcaagaactggaaaacatgctcaaaccctttggccaggtcatctctaccaggatcctcagggacagctccgggacatctaggggcgtgggatttgcccgcatggagagcactgagaaatgcgaagcagtgatcggccatttcaacggcaagttcatcaaaactccgccaggggtgagtgccccaacagagccattgttgtgtaaatttgccgacggcgggcagaaaaaacggcaaaaccctaataaatatatcccaaacggccgcccttggcacagggagggggaggccggcatgacattaacatatgaccctactacagccgcaatccagaatggcttctacccttcaccgtactctatcgcaaccaacaggatgattacacagacctctattaccccttacatcgcaagccccgtgagtgcgtaccaagtggccaaagaaacccgggagaataagtacaggggctcagccattaaggtccagagtccgagctggatgcagccccaaccgtacatcctgcagcatcccggagctgtcttaactccatccatggaacatactatgagcttacagcctgcctccatgatctcaccccttgcccagcagatgtcccacctgtccctgggctctaccgggacctacatgccagccacttcggctatgcagggtgcctacctgccacaatacgcccacatgcagactaccgctgtgccagtggaggaagcttccgggcaacagcaggtggctgtggagacctctaacgaccacagcccctacacattccaacctaataaatag

SEQ ID NO: 20510 - DNA, 1113 bp, Artificial Sequence
  Description of Artificial Sequence: Synthetic coding sequence
atggccccccccagccccagcaccaccagcagcaacaacaacagcagttccagctccaacagtggctgggatcaactatccaagaccaacctgtacatcagaggtcttccaccacacactaccgatcaggacttggtgaagctttgtcagccttatggcaaaatcgtgagtactaaggccatcctagacaagaccactaacaaatgcaagggatatggattcgtcgatttcgacagccccgcagcagcacagaaggctgtgagcgccctaaaagcgagcggtgtccaggcccagatggcaaagcagcaagagcaggatcccacaaatctttatattagcaacttgcctttgtctatggacgagcaggagctggaaaacatgctcaaacccttcgggcaggtcattagtacaaggatcctacgcgattcgtccggcacgagtcgcggtgttgggtttgcccggatggagtccaccgaaaagtgcgaggctgtgatcggccattttaatgggaaattcatcaagacacccccaggcgtgtctgcacctactgagccactgctgtgcaaatttgctgacggcggacagaagaagcgccagaatcccaataaatacatcccgaatggccggccctggcatagagagggcgaagcgggtatgactttaacttacgatcctacaacagccgcaattcagaatggcttctatccgagtccgtactccatcgccaccaaccgaatgatcactcaaacatccattaccccctacatcgcctcacctgtcagcgcctaccaggtacagagtccctcctggatgcaaccacagccatatattctgcagcacccaggagccgtcttgactccatcaatggagcacaccatgtctttgcagcctgcctctatgatcagccctttagcacagcagatgagccatctgtcattaggctcaacagggacatatatgccagccacgtctgcgatgcagggagcctacctcccacaatacgcacacatgcagaccactgccgtccctgtggaagaggcctcaggccagcagcaggtcgcggttgaaactagcaatgaccactctccgtatacattccagccaaataagtag

SEQ ID NO: 20511 - DNA, 1113 bp, Artificial Sequence
  Description of Artificial Sequence: Synthetic coding sequence
atggccccccccagccccagcaccaccagcagcaacaacaacagctcctcctcttccaattctggctgggaccagctgtctaagacaaatctttatattcgtgggctgccaccacacaccactgaccaggatttagtgaagctctgtcagccatacgggaagatcgtgtccactaaggcgatccttgacaagacaaccaataaatgcaaagggtatggcttcgttgacttcgatagcccagctgcagcacaaaaagcagtctcagctttgaaagcctctggggtgcaggcacagatggcgaaacagcaggaacaggaccccacaaatctctatattagtaacctgcccttgtctatggatgagcaggaattagagaacatgctgaaaccctttggacaagtcatcagcacccggatcctcagagacagctctggcactagtaggggcgtgggattcgcaagaatggagagtaccgagaagtgcgaagcagtgattggccacttcaatggtaaattcattaagacacctcctggggtttccgccccgactgagcctctgctgtgtaagtttgcagatgggggccagaagaaacgccaaaaccccaacaagtacattcctaacgggcgcccatggcaccgtgagggggaggccggtatgacactaacttacgatccaactaccgccgcgatacaaaacggattttacccctcaccttacagcatagccacaaataggatgataactcagacgagtattaccccctacattgcatctccagtttccgcataccaggtgcaatctccatcttggatgcagcctcagccatacatactgcagcaccccggcgccgtacttacgccttctatggaacacacgatgtccttgcagcctgcttcaatgatatcccctctcgcacaacagatgtctcatctgtcacttggctcaacgggtacctatatgccagcaaccagcgcgatgcagggagcctacctgccacagtacgctcatatgcagacaacagcggtcccagtggaagaggcatccggccagcagcaggtcgccgttgagacttctaacgaccactcaccttatactttccagcccaataaatag

SEQ ID NO: 20512 - DNA, 1113 bp, Artificial Sequence
  Description of Artificial Sequence: Synthetic coding sequence
atggccccccccagccccagcaccaccagcagcaacaacaacagctcatcctcctctaattccggatgggatcagttgagcaaaaccaatttgtacattcgcggcttgcccccccacaccacagaccaggatctggtaaagctctgccagccttatgggaagatcgtctccaccaaggccatccttgataagactactaacaagtgtaaagggtacggattcgtcgactttgatagcccagccgcagcccagaaggccgtgtctgcgttaaaggccagcggggtgcaggcccagatggccaagcaacaggagcaggatccaacaaacctctacattagtaaccttccattatccatggacgaacaggaactagaaaatatgctgaaacctttcgggcaggttattagcacacgaatactcagagacagtagcggcacaagcaggggagtgggttttgctagaatggagtctaccgagaagtgcgaagccgtaattggacacttcaatggcaagttcattaagactcccccgggcgtttctgcccccacggagccattgctttgcaagttcgccgatgggggacagaaaaagcgacaaaacccaaataagtacatacccaacggccgaccttggcacagagagggtgaagctggcatgactttgacatacgaccctaccactgctgcaatccagaatggattttatccctctccatactctatcgcgactaaccgcatgattactcagacaagcatcactccatatatagcatccccggtgtcagcttaccaagtgcagtctccttcctggatgcagccacaaccatatatccttcaacaccccggcgccgttcttacaccgtctatggaacacacaatgtccctgcagcccgcatccatgatctctcctttggcgcaacagatgtctcacctctcccttgggtccacaggcacctatatgccagcaaccagcgccatgcagggggcgtatctgccccagtacgcccatatgcaaactaccgccgtacctgtggaggaggcatccggccagcagcaagttgctgttgagacatccaacgaccattctccctatactttccagcccaacaaatag

SEQ ID NO: 20513 - DNA, 387 bp, Artificial Sequence
  Description of Artificial Sequence: Synthetic coding sequence
atggccccccccagccccagcaccaccagcagcaacaacaacagcagtagcagctctaacagcggctgggaccaactgagtaagaccaacctctacattaggggcctgccgccccataccaccgatcaggacttggtgaagctttgccaaccctacggaaagattgtgtctacaaaggccatcttagataagactacaaacaagtgcaaagggtacggtttcgtggacttcgactcccccgccgcggcacagaaggcagtcagcgccttgaaggcctcaggcgtgcaagcccagatggccaagcagcaggaacaggaccccactaatctgtacatttctaaccttccgctgtcaatggacgaacaggaactcgaaaatatgctctag

SEQ ID NO: 20514 - DNA, 1224 bp, Artificial Sequence
  Description of Artificial Sequence: Synthetic coding sequence
atgctgctgagcgtgaccagccggcccggcatcagcaccttcggctacaatcgaaataacaaaaaaccatacgtaagcttagcccagcagatggcccctcctagcccatcaaacagcacaccaaattccagcagtgggtccaacggcaatgatcagcttagcaaaacaaatttatacatcagagggctgcagccgggtaccaccgaccaggatctagttaaactgtgtcagccatacggcaagatagtgagtaccaaggccatactagacaaaactacgaataagtgcaaaggatatggctttgtggacttcgattctccctctgcggcccagaaagccgtgacggccctaaaagcttccggtgtgcaagcccagatggctaagcaacaagagcaggaccctaccaatctatacatctcaaaccttccgttgtctatggacgagcaggaactggaagggatgttaaagcccttcggtcaggttatatcaacacgcatcttgagagatacaagcggtaccagtagaggggtgggattcgctaggatggagtcgacagaaaaatgtgaggctatcattacacacttcaacggaaaatatatcaagactccaccgggggtcccagctccctctgatcccctcctgtgcaaatttgcagacgggggcccaaagaaacgccaaaaccaggggaaattcgtgcagaatgggagggcatggccaaggaacgccgatatgggagtaatggcattgacttatgatcctaccaccgctctacagaacggcttctaccccgcgccatacaacattactcctaatcggatgttagcccaaagcgccctatccccctatttatctagcccggtttcctcatatcagcgtgttacgcagacctcccccctgcaggtgccaaacccaagttggatgcaccatcattcctatctcatgcaaccatctgggagcgttctgacaccaggcatggaccaccccatctccctgcagcctgcatcgatgatgggaccacttacccaacagctgggacacctatcactgagtagcactggcacttatatgcccaccgcggcagcaatgcaaggggcctatatctcacaatacactccggttccttccagctctgtatcggtcgaagagtcctccggacaacagaatcaggttgcagtggatgccccctccgaacacggtgtctattcttttcaattcaacaagtag

SEQ ID NO: 20515 - DNA, 921 bp, Artificial Sequence
  Description of Artificial Sequence: Synthetic coding sequence
atgagcctgaagctgcaggccagcaacgtgaccaacaagaacgaccctaaatcaatcaacagccgggtgttcataggaaacctgaacactgcactggtgaaaaaaagtgacgtggagacaatcttctctaaatatggacgggtcgctggctgctccgtccataaaggctacgcctttgtgcagtatagcaacgagagacatgctagagctgccgtcctgggcgaaaacggccgggttctggctggccagaccttggatatcaatatggccggggagcccaagccagataggccgaaaggactcaagagagccgcctccgccatttattccggttacatcttcgactacgactactatagagacgatttctatgacagattgttcgattacagaggacgactgagtcccgtgccggtccctagggctgttccagtgaagaggccgcgagtgacagtgcctctggtgaggagagtgaagacaaatgtgcccgtgaagttgtttgccaggtcgaccgccgtgactacaagttccgctaagatcaaactgaagtcctccgaactgcaagcaatcaagactgaattaacccagatcaagagtaatatcgacgctctgctaagcaggttagaacagatcgccgcagagcaaaaggcaaatcctgatggcaagaagaagggagatggaggcggcgctggggggggcgggggcgggggggggtccggcggaggtggttcagggggcgggggtggaggtggcagcagtagaccccctgcgcctcaggagaacaccacatcggaagccgggctaccccagggcgaagccagaactcgcgatgatggcgatgaagagggtctgctcacacactcagaggaggagttggagcacagccaggacaccgatgccgatgacggagccttacaatag

SEQ ID NO: 20516 - DNA, 873 bp, Artificial Sequence
  Description of Artificial Sequence: Synthetic coding sequence
atgagcctgaagctgcaggccagcaacgtgaccaacaagaacgacccgaagtcaatcaattctcgggtgtttataggaaacctcaatacagccctcgttaagaagtcggatgttgagaccatcttttctaagtatggacgcgtagccggttgttctgtccacaaagggtacgcatttgtgcagtatagtaatgagcgccacgcccgcgccgccgtgctgggggagaatggccgggtgctggctggccagacgttggacatcaatatggcaggtgaacctaagccagacaggcccaaaggcctcaagcgagccgccagcgcgatctaccgtttattcgattatcggggacgcctgagccctgtcccagtcccccgagcagtgccggtcaaaaggccacgagtcacagtccccctggtgagaagggtcaagacgaatgtaccagtaaagctgttcgcacggtctacagccgtgacaacatcttcagctaaaattaagctgaagtcctcagagcttcaggcaatcaaaactgaattgacccagattaagtccaacatcgacgctctcttatcgcggctcgagcagatcgccgcagagcaaaaagcaaatcctgacggaaaaaagaaaggtgacggaggcggggccggaggaggcggcggcggcggaggctctggcggcggaggatcaggcggcggcggcggaggtgggagctctcgcccgccggcccctcaggaaaataccacaagcgaagcaggcctgcctcagggcgaagcgcgcacgcgagacgatggcgacgaggaaggacttctgactcatagtgaggaggagctcgagcatagccaggacaccgacgccgacgacggcgcattgcaatag

SEQ ID NO: 20517 - DNA, 270 bp, Artificial Sequence
  Description of Artificial Sequence: Synthetic coding sequence
atgagcctgaagctgcaggccagcaacgtgaccaacaagaacgacccgaaaagcataaattcgcgagtgtttatcgggaacttaaacaccgctctcgtgaagaagagcgacgtggaaactattttttctaaatacggtagggtggcagggtgctctgtgcataaaggctatgctttcgtccagtattccaatgagaggcacgcacgtgctgcggtcctaggagagaacggccgagttttggccggccaaacactcgacatcaacatgtag

SEQ ID NO: 20518 - DNA, 714 bp, Artificial Sequence
  Description of Artificial Sequence: Synthetic coding sequence
atgagcctgaagctgcaggccagcaacgtgaccaacaagaacgacccaaagtccataaattcacgcgtgtttataggtaatctgaatactgcattggtcaagaaatcagatgtggagactatcttctcgaagtacggcagagtggcaggctgctctgtccacaaggggtatgcattcgtgcagtactctaatgagagacatgcacgggccgcagttctgggggaaaacgggcgtgtgttggccgggcagacgctggacattaatatggctggcgagcctaagccagaccggcccaagggattaaagagagccgcttctgcaatttaccgtctttttgattatagaggaaggttaagccctgtgccagtccctcgggcggtgcccgtgaagcgtcctcgggtgacggttcctctggtgagacgagtgaaaacaaatgtccccgttaagctgttcgcgcggtcaaccgccgtgactacatcgtcagctaaaatcaaattaaagagttccgagctgcaagccatcaagacggaactgactcagattaagtcaaacatcgacgcattactgagccgtctggagcagatagcagctgaacagaaagccaatcccgacggcaagaagaagggagacgggggcggagctggcggcggaggcggaggtgggggctctggtggcggaggatctggggggggtggagggggcggatctagctag

SEQ ID NO: 20519 - DNA, 546 bp, Artificial Sequence
  Description of Artificial Sequence: Synthetic coding sequence
atgagcctgaagctgcaggccagcaacgtgaccaacaagaacgaccccaagtcaatcaactcgcgtgttttcatcgggaaccttaatactgcgctggtaaagaagagcgacgtggagacaattttctcaaaatatggccgtgtcgcgggctgctccgtccacaaggggtatgcctttgtgcaatatagtaacgaacgacacgctcgagcggccgtgctaggagagaacggacgagtacttgcaggccagacgcttgatatcaacatggctggtgaaccgaagccagataggccaaaaggcttgaaacgtgcggcttccgccatttattcgggttacatctttgactacgactactatcgggacgatttctatgaccgtctctttgactacagggggcggttatctccagtgccagtgcctcgagccgtgcctgttaagcggccaagagttactgtgccactcgtccgaagggtgaaaacgaatgtaccggtgaagctattcgcccggtccacggccgtcactacgagcagtgcaaaaataaaatag

SEQ ID NO: 20520 - DNA, 564 bp, Artificial Sequence
  Description of Artificial Sequence: Synthetic coding sequence
atgaccagcctgacccccggctgccggtacagcgtgcgggtgagcccacagatggcaaatcggatcgtcgacagcgctcgatcaatcttgaataaatttatcccagatatttacatctataccgaccacatgaagggggttaacagcggcaagagcccaggcttcggcttaagcttagtagcggagacgacaagtggaaccttcttaagcgcggagctggccagcaacccacagggtcagggagccgctgtcctgccagaagacctggggcgaaactgtgcccgcttgttgctggaagagatttataggggcggttgcgtggattctacaaaccagtcactggcccttttactcatgactctggggcagcaagatgtcagcaaagtgctgctgggtcctctcagtccctacactatcgaatttttgcggcatctgaaatcctttttccagatcatgtttaaaatagaaaccaaaccatgtggtgaagagctgaaagggggggataaagtcctgatgacctgcgtcgggatcggcttctctaatctgtctaagactttgaagtag

SEQ ID NO: 20521 - DNA, 564 bp, Artificial Sequence
  Description of Artificial Sequence: Synthetic coding sequence
atgaccagcctgacccccggctgccggtacagcgtgcgggtgagccctcaaatggctaacaggatcgtggactcagccagaagtatcctgaataagttcatcccagatatctatatctatactgatcatatgaaaggcgtgaatagcggcaagagccctggattcggcctgagtctcgtggccgagaccacttctgggacatttttgtcagccgagctggcctcgaaccctcagggtcaaggcgctgcagttttgcctgaggatctgggacgcaattgcgccaggctactacttgaggagatctaccggggtggatgcgtggattctactaaccagtccctggcacttctgctgatgaccctcggccagcaagatgtgtcgaaagtcctactcggacctttatcgccatacaccatagagttcctgaggcacctaaaatcatttttccagataatgtttaaaatcgaaacgaaaccatgcggcgaggagttgaaaggaggggacaaagtgttaatgacttgtgtagggattggctttagcaatctttctaaaacactgaagtag

SEQ ID NO: 20522 - DNA, 528 bp, Artificial Sequence
  Description of Artificial Sequence: Synthetic coding sequence
atggccacccaggcccacagcctgagctacgccggctgcaacttcttaaggcagaggctggtcttgagcacactctcagggaggcctgtcaaaattcgtaagattcgggccagggacgacaaccctggcctacgggacttcgaggcctcgtttatacgcttgctcgacaagattaccaatggctctcgcatcgaaattaaccagaccggtactaccctgtattaccagcctggtctgctatacggggggagtgtagagcatgattgtagtgtgctgagaggaatcggttattatcttgagagcctcttgtgtctcgccccattcatgaagcatccgcttaagatcgtactgcgcggcgtgactaacgatcaggtggaccctagtgtttcaatcgaaaataaaccctggtgcggattctgtttcgtcagctgtcacaaccccacctgcgagaagaaggtgccctacaaagcacagttctactataagtgcatcctcctgttgctgttcactctgagatttcggggctag

SEQ ID NO: 20523 - DNA, 1122 bp, Artificial Sequence
  Description of Artificial Sequence: Synthetic coding sequence
atggccacccaggcccacagcctgagctacgccggctgcaacttcctaagacagaggctagtactctctactctgagtgggaggcctgtaaagatcaggaaaatccgggcccgcgacgataatccagggctgcgagattttgaggcaagttttataaggctgctggataagataaccaatggcagtcgcattgagattaaccagaccggcaccaccctgtactatcaacccggcttgctgtacgggggcagtgtcgagcatgattgctccgtgttgagggggataggatattacctcgaatctctgctatgcctggccccattcatgaagcaccctcttaagatcgtcctgcgcggcgttaccaatgaccaggtcgacccctcagtcgacgtgctgaaggcaactgcgctgcccttactaaagcaatttggaatcgacggcgagtcctttgagttgaagattgtgaggcgcgggatgccccccgggggtggaggggaggtggtgttttcctgtcccgtgcggaaggtgctgaagcccattcagcttacagaccccgggaaaatcaaacgtattcggggaatggcttacagcgtcagggtatctccccaaatggcgaatagaatcgtggacagtgcacggtcaattcttaacaagtttatcccagatatctatatttatacagaccacatgaagggggtgaatagcgggaaatctccaggttttggtttgtctctggtcgcggagaccacctccggcacgttcctgtcagcagaactcgcttctaatccacagggacagggagccgccgtgctgcctgaggacttaggtaggaactgcgccagattgctgctagaggagatttacaggggagggtgcgtggactccaccaatcagtccctcgcccttctgttgatgactctaggccagcaggacgtctctaaggtgttgcttggcccgctgagcccctatacaatcgagtttctgcggcacttgaagtctttctttcagatcatgttcaaaatcgaaaccaagccctgcggcgaggaactgaaaggaggagacaaggtgctcatgacatgtgtaggtatcggcttctcaaacctgagcaaaacgctcaagtag

SEQ ID NO: 20524 - DNA, 417 bp, Artificial Sequence
  Description of Artificial Sequence: Synthetic coding sequence
atgaccagcctgacccccggctgccggtacagcgtgcgggtgagccctcagatggcgaatcgaatagttgacagcgcacgaagtattctgaacaagtttattccggacatctacatttacaccgatcacatgaaaggcgtcaattccgggaagagcccagggtttgggctgtctctcgtagcagagacaactagcggcactttcctgagcgcagagctcgcctctaaccctcagggccagggcgccgccgtgctgccggaggatttaggacggaactgcgcccgcctgctcctcgaggaaatttaccggggtggttgtgtcgactctacaaatcaatcacttgccctcctgctcatgacgttgggacagcaggatgtgtctaaagtgctgctcggccccctttcaccatacacctag

SEQ ID NO: 20525 - DNA, 549 bp, Artificial Sequence
  Description of Artificial Sequence: Synthetic coding sequence
atgccccccggcggcggcggcgaggtggtgttcagctgccccgtgagaaaggtgttgaaacccattcaacttacagatcccggcaagataaaacgaattagaggtatggcttactcagtcagggtcagcccacagatggcgaatcgcatcgtcgacagcgcacggagcatcctgaataaatttatccccgacatctacatttacaccgatcatatgaagggggtcaactccggtaagtctcccggctttggcttatcactggttgccgagactacatccggcacattcctcagtgctgagttggctagcaacccacagggccagggcgccgccgtccttcctgaagatctcgggaggaactgtgcccgcctgttattggaggaaatttacaggggcggctgcgtggattcaaccaaccagtccttggcactcctgctcatgactttgggccagcaggatgtgtccaaagtgctgttaggcccattgtcaccctacacaattgagtttctgcgccatctgaagagcttcttccagataatgttcaaatag

SEQ ID NO: 20526 - DNA, 564 bp, Artificial Sequence
  Description of Artificial Sequence: Synthetic coding sequence
atgaccagcctgacccccggctgccggtacagcgtgcgggtgagcccccagatggccaacagaatagtcgactccgcccggtccatcctgaacaaattcatacccgatatttacatatacacagaccacatgaagggggtcaatagcggtaagtctccgggatttgggctaagcctcgtagccgaaaccaccagtggcacattcctctcagcggaattggcatccaatccacaggggcagggggccgccgttctaccagaggacctagggcggaactgtgctcggctactcctagaagagatctatcgaggagggtgtgtggacagcaccaatcagagcctagcattactcctgatgacactgggtcagcaggacgtgtctaaagtcttactgggcccgctttcaccttacacaattgaattcctgcggcacctcaagagctttttccagattatgttcaagattgagaccaaaccatgtggggaggagctgaagggcggggataaagtactgatgacctgcgtaggaattggctttagcaatctttcaaagactctaaaatag

SEQ ID NO: 20527 - DNA, 1554 bp, Artificial Sequence
  Description of Artificial Sequence: Synthetic coding sequence
atggccgcccccgagcagcccctggccatcagccggggctgcacctcctcgtccagcttgagtcccccccgcggagacagaacactccttgtccgccatctgccagccgagctcacagccgaggagaaggaggacctgctgaagtatttcggcgctcagtctgtcagggttcttagtgacaagggacgtcttaaacataccgcctttgctacctttcccaacgagaaggctgcaatcaaggcactcacacggttgcatcagctgaagctgctggggcacacactcgtggtggaatttgctaaagagcaagatagagtgcacagcccgtgtcctacttcgggaagcgagaaaaaaaagaggtctgacgaccctgtggaagacgacaaggaaaagaaggagctcggatatctgaccgtggaaaacggaattgcccccaaccatgggctcaccttccctctgaactcttgtctgaaatacatgtatccacctcccagtagtacaatcttggctaacattgtcaacgctctggcttctgtgccaaaattttacgtccaggtgctgcacctcatgaataagatgaatctacctacgccgttcggtcctatcacagcccggcctcccatgtatgaagattatatgcccttgcacgctccactccctcctacatccccgcagccaccagaagaacccccccttcccgatgaggacgaagaactgagctccgaggagtctgagtatgagagcactgatgacgaggatcggcagcgaatgaacaaactgatggagctggccaacttacaaccgaagcgaccaaaaacgatcaaacagaggcatgtgaggaagaaaagaaaaatcaaggacatgttgaacacccctctttgtccatcgcattcatctttgcatcctgtgctgctgccttctgatgtcttcgaccaaccccagcccgtcggtaacaaacgcatcgagtttcatatctcaacagatatgccggctgcctttaaaaaggatttggaaaaagaacaaaactgtgaggaaaagaatcacgacctcccagcaacggaagtcgatgcttcaaacataggcttcggaaaaatctttccgaaacccaatttggacatcaccgaagaaatcaaggaggactcagatgagatgcccagtgaatgtatttcacgcagggagttagaaaaaggtaggatctcaagagaagagatggagactttgagtgtcttcagatcatacgaaccaggggaacccaactgccggatctatgttaagaatcttgccaagcacgtccaggagaaagatctgaaatatatctttggaagatatgttgacttttcctcggagacgcaaagaattatgtttgacattcgcctgatgaaagaggggcgcatgaagggtcaagccttcattggcctaccaaatgagaaagctgcagctaaggccttgaaagaggccaacggttacgtgttattcgggaagcccatggtcgtacaatttgcacggtcagctcggccgaaacaggaccctaaagaaggcaaacgaaaatgctag

SEQ ID NO: 20528 - DNA, 387 bp, Artificial Sequence
  Description of Artificial Sequence: Synthetic coding sequence
tgacggcgggagctggagaagggccggatcagccgggaggagatggagacattgagcgtgttccgtagttacgagcctggggaacctaattgccgcatatacgtcaagaatttagccaagcatgtgcaggagaaggacctgaaatatatattcggcagatacgtcgatttctcaagcgagactcagaggattatgttcgacatcagactcatgaaggagggccgcatgaaaggacaggcctttatcgggttgcccaatgagaaagccgccgccaaagcccttaaggaagccaatgggtatgtcctctttggaaaaccaatggtggtccagtttgctagaagcgcgagacccaagcaggacccaaaggaggggaagagaaaatgttag

SEQ ID NO: 20529 - DNA, 558 bp, Artificial Sequence
  Description of Artificial Sequence: Synthetic coding sequence
atggccgcccccgagcagcccctggccatcagccggggctgcacctcttcctcaagtctttcaccccctcgaggagaccgcacgcttctggtaagacatttgccagccgagcttacagccgaggaaaaggaggacctgctgaagtatttcggagctcagagcgtgcgggttctcagcgataaaggaagactgaagcacaccgcgtttgctacctttccaaatgaaaaagcagcaatcaaggccctgactcgcctgcaccaactgaaactcttgggacataccctcgttgtggaatttgcaaaggaacaggatagagtgcatagcccatgtcccacttccggctcagaaaaaaagaagcgctcggacgaccccgtggaggatgataaggagaagaaagaactggggtacctaactgtggagaacggcatagcccccaatcatggtctaacctttccgctaaactcctgtcttaagtacatgtaccctcctcccagcagtaccattctggctaacattgtgaatgctctggcttctgtgccaaaattctatgtccaatag

SEQ ID NO: 20530 - DNA, 1554 bp, Artificial Sequence
  Description of Artificial Sequence: Synthetic coding sequence
atggccgcccccgagcagcccctggccatcagccggggctgcaccagctcttcttccctttcaccgccccggggtgacagaacactcctcgtcaggcacctgccagcagaactgaccgctgaggagaaggaggaccttttaaagtacttcggggcacaatccgtgagggtcctgtccgacaaggggagacttaagcatacagcctttgccaccttccctaatgagaaagcagctataaaggcgctgactcggttgcaccaattaaagttactcggacacactctcgtggtggagtttgccaaggaacaggacagagttcactccccgtgccccacctccggttctgagaagaagaagcgttccgatgatccggttgaggatgacaaagaaaagaaggagctggggtacctcacagttgaaaacggtatcgctcccaatcacggcctgaccttcccactgaatagctgtctgaagtacatgtatccccctccgtcaagcaccatactggccaacattgtcaacgccctggcttcagtccccaagttctacgtccaggtgctccatttaatgaacaaaatgaatttgcctacaccttttggcccaataacagcccggcctccgatgtatgaagattatatgccactgcatgccccgctgcctcctacaagcccacagcccccagaggagcccccactccccgacgaagatgaggagctgagcagcgaggagagcgagtacgagtctactgacgacgaggacaggcagaggatgaacaaattgatggagctggcgaatttgcaaccaaagaggccaaaaactatcaagcaaaggcacgtccgaaagaaaaggaagataaaagatatgctgaacaccccactttgcccttctcacagctcactgcaccctgtgctattgcctagtgacgtgttcgaccagccacagccagtgggtaataaacgaattgagtttcatatctcaacagacatgccagccgcctttaaaaaagatcttgaaaaggagcagaattgtgaggagaaaaaccatgacctgcccgcaacagaagtagatgcgtcaaatattggtttcggcaaaatctttccaaaaccaaatctcgatattaccgaggaaattaaggaggactcagacgagatgccatccgagtgcataagtcggcgcgagctggagaaaggccggatttcccgagaggaaatggaaacattgagtgtattccgatcctatgagcccggggagcccaattgtaggatctacgtaaagaacctggccaaacatgttcaggaaaaggacctgaaatacatttttggacggtacgtagacttttccagtgagacacagaggattatgttcgatatccgccttatgaaagaaggcagaatgaaaggtcaggcctttataggccttccgaacgaaaaggcagcggctaaggccctgaaagaagcaaacggatacgtgctattcggtaagcccatggtagtccagttcgcacgcagcgccaggccgaaacaggaccccaaggaaggcaagcgtaagtgctag

SEQ ID NO: 20531 - DNA, 2409 bp, Artificial Sequence
  Description of Artificial Sequence: Synthetic coding sequence
atgttcatcagcggccggcggaccgccgacaagtggcgggccgaggaaagactgcagtgccccgctggaagtgcaagggcagctctggccagatgcgcagacggcggggctgtgggccctttcaagtgcgtattcgtgggggagatggcagcacaggttggcgccgtcagggtcgtgcgggctgtggcggcccaggaggagcctgacaaagagggcaaggaaaagccacacgccggtgtttctccaagaggcgtcaaaagacagcgaagaagctcgtccggcggctctcaggaaaagaggggacggccatctcaagagccgccactggcaccgcctcaccgcaggaggcgttctagacaacatcccggcccactgccaccgaccaacgcggcacctacagtgcctggcccggtagagcctctgctcctcccaccaccaccaccacccagcttagcacccgcgggtcccgctgtcgctgctcccctcccggcacccagcacctctgccctgtttacattttcaccactaacagtgtctgccgccggcccaaagcataagggccataaggaacgccacaagcatcaccaccataggggacctgatggcgaccccagctcttgcggcaccgacctgaagcacaaggataagcaagagaacggcgaacgcactggcggggtgcccctaatcaaagctccgaagcgcgaaacgcccgacgaaaacggcaaaacccagcgagccgacgactttgtcctgaagaaaattaagaagaagaaaaagaagaagcaccgcgaggatatgagaggtagaaggcttaagatgtataataaagaggtgcagaccgtttgtgctggtctaacccgtatttctaaagaaatcctgacacaaggacagattaatagtacttccgggttgaacaaagagtcattccgatatctcaaagacgagcaactttgccgtctgaatctcggcatgcaggaatatcgggtgcctcagggagtgcagacaccctttatgacacatcaagaacacagtataaggcgcaacttcctgaagaccggcaccaagttctccaatttcattcacgaggagcatcagtctaatggaggcgctctggtgctgcatgcatacatggatgaactgtcatttctctccccaatggaaatggaaagattctcagaggaattcctggcgctgacctttagtgaaaacgaaaagaatgccgcctattatgcactagccattgtgcacggggccgctgcttacctccctgactttctggactactttgcatttaactttcctaatactcccgttaaaatggagattctcggcaagaaagacatcgagactaccacgatctcaaactttcatactcaggtcaaccgcacatattgctgtggaacatatcgagctggccctatgagacagatcagtctagtgggtgccgttgacgaagaagtaggcgactatttcccggaattcctcgacatgctggaagagtctccattcctgaaaatgacactaccttggggaactctatcctctcttagactccagtgtagaagtcagagtgacgacggacccataatgtgggtgcggccaggggaacaaatgattcccactgcagacatgccaaagtctccgttcaagcgccggagatctatgaatgaaatcaagaacctccagtacctgcctaggacatcagaaccgcgagaagtgcttttcgaagatcgaactagggcccacgcagaccatgtcggtcaggggttcgattggcagagcacggctgccgtgggagtgttgaaagccgttcaattcggcgaatggtccgaccagccgcggatcactaaggatgtgatatgctttcatgcggaagactttacagacgtggtgcagcgtctgcagttagatttacatgagccaccagtcagccagtgcgttcagtgggttgacgaggctaagcttaatcaaatgagaagggagggtataagatacgcgcgaatccagttgtgcgataacgacatctacttcattccacggaacgtgattcatcagtttaagacagtgtctgcagtgtgttctctggcctggcacatacggcttaagcagtaccacccagtcgttgaagcgactcagaacaccgagtctaattcaaacatggactgcggtctcaccggaaagcgcgaactcgaagtggacagccaatgtgtgcgcattaaaaccgaatcagaggaagcctgcactgagatccagttattaaccacagcgtcgtcttcctttccccctgctagcgagctcaacttgcaacaggatcagaagacacagcctatcccagtcctgaaagtagaatcgcggttggattccgaccagcaacacaacttgcaagagcacagcaccacatccgtgtag

SEQ ID NO: 20532 - DNA, 2541 bp, Artificial Sequence
  Description of Artificial Sequence: Synthetic coding sequence
atggccgagccccccagccccgtgcactgcgtggccgccgccgcccccaccgcaactgtgagcgagaaggagccctttggaaaactccaattgagctcgcgagacccgcccggctccctatccgcaaagaaagttcggaccgaggaaaaaaaggcccccagacgggtaaacggcgagggcggatccggaggcaacagccgccagttgcagccccccgccgctccgtcccctcagtcctatggctctcccgcgagctggtccttcgctccactgtccgccgccccatctcccagctcttcaaggagcagcttctcgttctctgccggaactgccgtgccaagttcagccagcgcaagtctttctcagcctgtgcctcggaagttgcttgtaccgcccacactgctgcatgcccagccccaccacctgctgctacccgcagccgccgccgccgcctccgccaatgcgaagagccggcggccaaaagagaaacgagagaaggaaaggaggcggcatggactgggtggtgcccgcgaagctggcggggcatccagggaagagaatggtgaagtaaagcccctgcctagagacaaaatcaaggataagattaaggagcgagacaaggaaaaggagagggaaaagaagaagcataaagtgatgaatgagattaagaaggaaaacggagaggtgaaaatccttctgaagagcgggaaggaaaagcctaagaccaacatcgaggatctacaaatcaaaaaggtgaagaagaagaaaaagaagaaacataaggagaacgaaaagaggaagagacccaagatgtactccaagagtatccagaccatctgcagcggactgctaaccgatgtggaagaccaagcggctaagggtatcctcaacgataacattaaggactacgtgggtaaaaacctcgataccaaaaattatgacagcaagatccccgaaaatagtgagttcccatttgtgagcctcaaagaaccgagggtgcagaacaatctgaaaaggttggatacactagaattcaagcagctaattcatattgagcaccagcccaatggcggggcctcagtgattcacgcctatagcaacgagttatctcatttgtctcctatggaaatggagaggttcgcggaggaatttgttggtctggtctttagcgagaacgagaatagtgctgccttctatgttatgggcatcgtgcatggcgcagccacctatttaccggattttctggattacttctcattcaactttccaaattcgccagtgaaaatggagatcctgggcaaaaaagacattgaaaccaccaccatgagcaattttcacgcgcaagtaaaaagaacatattcccacggcacttaccgtgctgggccaatgcgccagatttctctggtgggtgcagttgatgaagaagtcggcgattatttccccgagttcctagatatgttagaagaatctccgtttttgaagtgtactctaccttggggcactctgtcttctctgaagttgcagagcaggaaggatagcgacgatggaccgattatgtgggtgcgccctggagaacagatgattcccgtggctgatatgcccaaatctcctttcaagcgaaagcgaactaccaatgagatcaaaaatctccagtatctcccacgtactagcgagcctcgggagatgctcttcgaagatcgcactcgcgcacacgccgaccacataggtcaggggttcgaaagacagacaaccgccgctgtgggcgtgttgaaggctgtgcactgcggcgagtggccggaccaaccccggatcaccaaggatgttatctgctttcatgcagaggactttctggaggtggtgcaacgcatgcaactggacctgcacgaacctcccctgagccagtgcgtgcagtgggtcgatgacgctaagctgaaccagcttagacgggagggtattcgctacgcacgtattcagctgtacgataatgacatttattttattcctcggaatgtggtgcaccagttcaagactgtgtccgcagtgtgcagtctggcctggcacatcaggctgaaactgtatcactcagaggaggacacgtcacagaacacggcgacccacgagactggcacatcctctgactctactagttccgtattaggcccacacacagacaatatgatctgcgctgttagtaaagctagccttgacagcgtgttctctgataaactccacagcaagtacgagcttcagcagattaaacacgagccaatcgcctctgtgcggattaaggaagagcccgtcaacgtcaatattcccgagaaaacgaccgcccttaataacatggatgggaagaatgtgaaggccaagctcgatcatgtgcagttcgccgagtttaaaatcgatatggactcgaaatttgagaactccaacaaggaccttaaagaggagctatgccccggtaacctgtctctggtcgacactcgacaacattctagcgcccactccaatcaagataaaaaggacgacgacatcctttgctag

SEQ ID NO: 20533 - DNA, 1731 bp, Artificial Sequence
  Description of Artificial Sequence: Synthetic coding sequence
atgtacagcaagagcatccagaccatctgcagcggcctgctgaccgacgtggaggatcaagctgctaaaggaatccttaacgacaatattaaggattacgtgggcaaaaacttagacaccaaaaactatgattcaaagattccagagaactcagaatttccgtttgtgagtctgaaagagcctcgggtccagaacaatttgaaacgcctcgacaccctggagtttaaacaactgattcacatagaacaccagcccaatggaggagcttccgtgattcatgcttactcaaacgaacttagtcacctgtctccaatggaaatggagcgattcgctgaggagtttgtgggcctggtcttttctgaaaacgagaactccgccgctttctacgtgatgggcatcgtgcacggagctgctacatacctgcctgatttcctggattatttctcattcaatttcccgaattccccagttaaaatggagattctggggaagaaggatatcgagacaactactatgtctaacttccacgcccaggtaaagaggacctactctcatggcacctacagagccggccctatgagacaaataagtctggtcggagcggtggatgaggaggttggtgattacttcccggagtttctcgatatgctggaagagtccccctttctcaaatgtacgttaccttggggcacccttagttccctgaaattacagtctagaaaggattcagacgatggcccgatcatgtgggtgcggccgggcgaacagatgatccccgtggccgatatgcctaaaagccccttcaaaagaaagaggacaacgaacgaaattaaaaatctgcagtatctgcccagaacttcggagccccgagagatgttattcgaggaccgaacacgggcacacgccgaccatatcggccaaggtttcgagagacagaccacagccgcagtgggggtcttgaaagcagtgcattgtggcgagtggcccgatcagcctagaatcacaaaagacgttatttgctttcacgcggaagattttctggaggtagttcagaggatgcagctggatctccatgagcctccgctgtctcagtgtgtgcagtgggttgacgacgctaaactcaatcagctcaggcgcgagggaattcgctacgccagaattcagctctacgataatgatatatattttataccaagaaatgttgtacaccagttcaagacggttagcgctgtttgctcactggcatggcacatcaggctgaaactataccacagcgaggaagatacgtcacaaaacactgcaacacacgaaacaggcacttccagtgattctaccagctcagtgcttggaccccacactgataatatgatatgtgccgtatccaaagcgagcctggattcagtcttctcggacaaactccattctaagtacgagctgcagcagatcaaacacgaaccaattgctagtgttcgtatcaaagaggagcccgtgaatgtgaacatccctgagaaaacaacggctctcaacaacatggatggaaagaacgtcaaagcaaagctggatcacgttcagtttgctgagtttaagattgatatggacagcaagttcgagaactcaaacaaagacctgaaggaagaactgtgtccaggcaatctctcacttgttgatacacggcaacatagctcagcccacagcaatcaggataagaaggacgacgacattctctgttag

SEQ ID NO: 20534 - DNA, 1815 bp, Artificial Sequence
  Description of Artificial Sequence: Synthetic coding sequence
atgatcagcgtgaagcggaacacctggcgggccctgagcctggtgatcggagattgtaggaagaagggtaatttcgaatactgccaggatcgcacggagaaacatagcacaatgcctgatagccccgtggatgtcaagacccaatcccggctgacccccccaactatgccccccccccctactacacagggcgcaccccggacctccagcttcacccccaccaccttaactaacgggacaagccactcccccacagctttaaatggggccccgagcccaccgaacggtttctccaacggaccatcatcctccagcagttcctccctggctaaccagcaactccccccagcctgcggcgctcgccaactatccaagttgaaacggttcctgacaacccttcagcagttcgggaatgacatttctcctgaaattggagagagagtgcgcactcttgtcttgggcctggtgaacagcacactgaccattgaggaattccactccaaactacaggaagctactaattttcctctgcgcccctttgtgattcccttcctgaaagccaatttgcctttgcttcagagagagcttctccactgtgcaaggctcgcaaagcagaatcctgcccaatatttggcccagcacgagcagctcctcttggatgcatccactacatctcccgtcgattcatctgaactgctgctggacgtcaatgaaaatggaaagcgccgcactccggatagaactaaagagaacggcttcgaccgtgagcccttacactctgagcatccttccaaaagaccttgcactatctcccccggccagcgctactcccccaacaatggacttagctaccaaccaaacgggctgccccacccgaccccaccccccccacagcattatcgtctggacgacatggccattgctcatcactaccgcgactcctacagacacccctctcatcgcgacctaagagatcgaaaccgtcccatgggacttcacgggacacgccaggaagagatgattgaccacaggctgactgatagagagtgggctgaagagtggaagcaccttgaccacctgctgaattgtatcatggacatggtagaaaaaaccagacgtagcctgaccgtgctgagacgctgtcaggaagctgatcgggaggaactgaactactggatcaggagatacagcgacgccgaggacctcaaaaagggagggggctcctcgagcagccactccagacagcagagcccggtgaacccagatcccgtggccctggacgcccaccgcgaattcctgcatcgcccggcctctgggtacgtccccgaggagatctggaaaaaggccgaagaagcggtgaatgaggtcaagcgtcaggcaatgacggaactgcagaaagcagtgtcggaggctgaacgaaaggctcatgacatgattaccacagagagggcaaaaatggaaaggaccgtcgctgaagccaaaagacaggcagccgaggatgcactcgctgtgatcaatcaacaggaagattctagcgagtcctgttggaactgcggcagaaaagcttctgagacgtgctctgggtgtaatacagcaagatactgcgggtcattctgtcaacataaggattgggagaagcaccatcacatatgcgggcaaacattgcaggctcaacagcaaggagacactcccgccgtatcctcctccgttactccaaattcaggtgcagggtctcctatggatacccccccagccgccacacctagatccacgacccccggtaccccgtcaacgatcgaaacaaccccccgctag

SEQ ID NO: 20535 - DNA, 1704 bp, Artificial Sequence
  Description of Artificial Sequence: Synthetic coding sequence
atgcccgacagccccgtggacgtgaagacccagagccggctgacccctcccacaatgcctccaccacctaccacccagggggctcctagaacatccagcttcacaccaaccaccctgacgaatggaacctctcatagtccgacggcactgaatggcgccccctctccacctaatggtttttccaatggtcctagctcatccagctcctcttccttggcgaatcagcagttgccgcctgcgtgtggggctcgccagctttctaaactgaagcggtttttgaccaccctgcagcaatttggaaatgatatatcgccagaaatcggggagcgggtgcgcacattagtcctaggtcttgtgaattccaccctgactatcgaggagttccattctaaattgcaagaggccacaaatttccctctgagacctttcgtgattccttttctgaaggctaacctgccacttcttcaacgggagctgctacactgcgcccgtctcgcaaagcaaaacccggctcagtatctggcccagcatgaacagctcctactcgatgcctccaccactagcccagtagattcatccgaactgctgctagatgtgaacgaaaacggcaagagacgcactcctgaccgaacgaaagaaaatggatttgaccgcgagccgctacacagcgaacacccatctaagcggccttgtaccatcagcccaggccagcgatattcacctaacaacggtctgagctaccagcctaacggtctcccacaccccactcctccacccccccaacactaccggctggacgatatggctatcgctcaccattaccgagattcctatagacacccttcccacagggatctgcgagacagaaaccgtccaatgggtctgcacgggaccagacaggaagaaatgatcgatcaccggctcactgacagagagtgggctgaggaatggaagcacttggaccatcttctcaattgcattatggacatggtagaaaagaccaggcggagtttgacagtccttcggcgatgtcaggaagctgaccgcgaagagctaaattattggatcagacggtatagcgacgctgaggacctcaagaagggcggcgggtcttcttcaagtcactcaagacagcagtcacccgtcaacccagatccagttgcccttgatgcacatcgagaatttttgcataggccagccagcggatatgtccctgaggaaatttggaagaaagccgaagaagctgttaacgaagtgaagagacaggccatgactgagttgcagaaagctgtgtctgaagctgagcgcaaagcccacgatatgatcaccaccgaaagggctaagatggagcggactgtggctgaagccaaaaggcaggctgcagaggacgctcttgccgtgattaaccagcaggaggactcgagcgaatcgtgttggaactgtggacgaaaagccagtgaaacttgttctggatgcaacaccgctcgctattgcgggagcttttgccagcataaggactgggagaagcaccaccacatttgtggccagacgctgcaggcacagcaacagggagatacacctgctgtgtcatcttccgtaactcccaactccggagccgggtctcccatggacactcccccagccgcaaccccacggtccacaaccccaggcactccgtctaccatcgaaactacgccacggtag

SEQ ID NO: 20536 - DNA, 1734 bp, Artificial Sequence
  Description of Artificial Sequence: Synthetic coding sequence
atgcccgaccggaccgagaagcacagcaccatgcccgacagccccgttgatgtgaaaactcagtcacggttgactccaccaacaatgcctcctcctcctacaacacagggcgcgcctaggacaagttcattcacccctacaacgctcactaacggcacctctcactcccctaccgccctgaatggggcaccatccccccccaacggtttctccaatgggccgtcctctagttcttcgtccagcttagccaaccagcaactcccgcctgcatgcggcgccagacagctctcaaaactcaaacgttttctgactacgctgcagcaattcgggaatgatatcagtcccgaaattggagaacgggtacgcaccctggtcctgggcctagttaattctactctcactattgaggagttccactcgaagctgcaggaagccactaactttccgctgcgccccttcgtaattccattcctaaaggccaatttacccctgctccaaagagagctcctacactgcgccaggctcgctaaacaaaacccagcgcagtatctggcccagcatgaacagcttttacttgacgcttctacaacatcaccggtggactcaagcgagttgctgcttgacgtgaacgagaatggaaagcgccgcacaccggatagaaccaaggaaaacggatttgacagagagcctctgcacagcgaacatccatccaaacggccatgtaccatctcaccgggccagagatacagcccaaataatggattatcctatcagcccaatggcttgccgcatcccacccctcctccgccacagcactatcgcttggacgacatggctatcgctcatcattaccgggattcctatcggcacccctctcacagggacttacgtgaccgaaatcgacccatgggtctgcacggaaccaggcaggaagaaatgatcgatcatcgccttacggatagagaatgggcagaagagtggaagcatctcgaccaccttctgaactgcataatggatatggttgaaaagaccagacgctctctgacagtgcttcgaaggtgccaagaggccgatcgtgaagaattgaactactggatcagacgatatagcgacgccgaggacttgaagaagggcggaggaagctctagtagtcattccaggcaacagtcgccggtaaatccggaccccgtggcactggatgcccatcgggaatttctgcatcggccagccagcgggtatgtgcctgaagaaatttggaagaaggcagaggaagcagttaacgaggtgaagcgccaggcaatgactgagttgcagaaggccgtgtcagaggctgagaggaaggcacacgatatgattaccaccgagcgagccaaaatggagcggacagtggccgaagccaaacgccaggcagccgaagacgcgcttgctgtgatcaaccagcaagaagacagttccgaatcatgttggaattgcggtcgaaaggcctcggagacctgttcgggatgcaataccgctaggtattgtggatctttttgccagcacaaagattgggaaaagcatcatcacatctgtggccaaaccttacaagctcaacagcaaggagacacaccagccgtgagctcttctgtgacacccaacagtggggctggttcccctatggatacacctcccgctgccacacctagatctaccaccccggggaccccctcaacaatcgagaccacaccgcggtag

SEQ ID NO: 20537 - DNA, 1704 bp, Artificial Sequence
  Description of Artificial Sequence: Synthetic coding sequence
atgcccgacagccccgtggacgtgaagacccagagccggctgaccccgcccacaatgcccccgcctcctacgacccagggagcaccacgaacctctagttttactcccacaacactcaccaatggtaccagtcactcacctaccgcacttaacggtgcaccgtcgccacccaatggtttctccaatgggccttcatcctctagcagcagcagcttagcaaatcaacagctaccgccagcttgcggggctagacagctgtctaagcttaagagatttctaaccaccctgcagcaatttggcaatgatattagtccagagataggagagcgggtccggacactggtgctcgggcttgtgaactcgacactgacaatcgaggagtttcatagcaaattacaggaggccaccaatttcccgttacggccattcgtcataccatttctcaaggccaacctcccattgctgcagagggaactattacattgcgcccgactggccaaacagaatcccgcccagtacttagcacaacacgaacaactgctcctagatgctagcacgacaagtcctgtggattcttcagaactgctcctggatgttaatgagaatggaaagcgccggaccccagatcgaacgaaggagaatggcttcgatcgagagccccttcatagtgaacatccttccaagaggccttgtacaatctcacccgggcagcgttacagtccgaacaacgggttgagttaccagccaaacggcctcccacatccaacacctcctccaccacagcattatcgcctcgacgatatggcgatcgctcaccactacagggattcttatagacacccttctcaccgagatttacgagaccgtaatcgcccaatggggcttcatgggacccggcaggaggagatgattgaccacagactcactgatagggagtgggcggaagaatggaagcacttggaccatctcctgaactgtatcatggacatggtggaaaaaacccgaagatcgttgactgttctccgtaggtgccaggaggcagaccgcgaggagctgaactactggattcgacgatacagcgacgcggaagatttaaagaaaggaggcggatcatcatcaagccacagtagacagcagtccccagttaaccccgaccccgtcgcgctcgacgctcaccgcgagttcttgcatcgcccggcctctggatatgtgccggaagaaatatggaaaaaggctgaagaggcggttaacgaggtgaaacgccaggctatgacggaactgcaaaaagctgtgtccgaagccgaacgaaaagctcatgatatgatcactactgaacgagctaaaatggagcgcacggtagccgaggcaaagcggcaggcagcagaggatgcgttagccgtgatcaatcagcaggaggattcttcggaaagttgttggaactgtgggcgcaaagcctcagaaacttgtagcggatgtaatacagcaaggtactgtggctccttttgccagcataaggactgggagaagcaccatcacatatgcggacaaaccctgcaggcacagcagcagggggataccccggccgtgtcttccagtgtcacccctaatagcggggccggtagtcccatggacacgccccctgccgccacaccaaggtcaaccaccccaggcaccccctctactattgagacaacaccaaggtag

SEQ ID NO: 20538 - DNA, 1848 bp, Artificial Sequence
  Description of Artificial Sequence: Synthetic coding sequence
atgtgccaccccgacaaggccttcaccagcgacaagctgcagtgcgtgtttaatgagtataaagcagccgtgtgggtgcctcctaggccacggccactatctagggctccgctgcccgaagatcgaacagagaaacattccacaatgccagactcccccgttgatgtgaagactcagtcccgcctgaccccacccacaatgcctcctccacccactacccagggagccccaagaacctccagtttcacaccaaccactcttacaaatggaaccagtcatagcccgacagccctcaacggagccccctctccccctaatggattcagcaatggtccgtcctcatcatcctcaagttccctggctaaccagcagttacctccagcttgtggagctcggcaactgtccaaacttaaaaggttccttaccacactccaacagttcggcaatgacatctcaccagagattggggaaagggtgcgtacgctggtccttggactggtcaacagcacattgactatcgaggagttccactctaaattgcaggaggccacaaactttcctttgcggccctttgtaatcccctttctgaaagctaatctgcccctcctgcaacgcgaattactgcactgcgcccggttagccaaacaaaatccagcccagtacctggcgcagcacgaacaactgctgcttgacgcttcaacaacttcgccagtagattccagcgagctgctcctagacgtcaatgaaaacggaaagcgcagaaccccggaccgcacgaaggaaaacgggtttgacagggaacccctccactctgaacatccaagcaagcgtccatgtactatctcgcccggccagaggtactcccctaacaacggcttaagctaccagcccaatggtctgcctcatcctacacctcctcccccccagcattatcggctggacgatatggccattgcgcatcactaccgagacagttatcgacatccctctcacagggatctgagggataggaatagacctatggggctgcacgggacaagacaagaggagatgattgatcacaggcttactgatagggaatgggctgaggaatggaagcatttggatcatcttctcaactgcatcatggacatggtcgagaagactaggagatccttgaccgttcttcgacggtgccaggaggctgatagagaggagctgaattattggatccgccggtattcggatgccgaggacctgaagaagggcggagggtcatcatcttctcacagccggcaacagagtcccgtgaaccctgacccagtggccctggacgcccacagggaattcctgcataggcccgcatctggctatgttccggaggaaatctggaagaaagcagaagaggcggtgaatgaagtcaagcgccaagctatgacagagctccagaaggctgtgagtgaagcagaacgcaaggctcatgacatgataactaccgagcgggcgaagatggaaagaaccgtagccgaggccaaacggcaggcggcagaagacgccctggccgtcattaaccagcaagaggacagttctgagagttgttggaactgcggccggaaagcttcagaaacatgttctggctgtaacacagcccgctactgcggaagcttttgtcagcacaaagattgggaaaagcaccaccacatctgtggtcaaactctccaggcacagcagcagggggacacacctgctgtttctagctctgtgaccccgaacagtggcgccgggagccccatggatacgcctcccgcggctacaccccgctctaccacccctgggacaccctccaccatcgagaccacacctcgatag

SEQ ID NO: 20539 - DNA, 363 bp, Artificial Sequence
  Description of Artificial Sequence: Synthetic coding sequence
atgcccgacagccccgtggacgtgaagacccagagccggctgaccccacctaccatgccaccacctccaacgactcaaggcgccccgaggacaagctcgttcacacccactaccctgactaatggtacaagccattcccctacggcactgaacggcgcaccaagtccccctaacggcttctcaaacggtcctagcagttccagctcttcctccctggccaatcaacagctgcctcctgcatgcggagcgaggcagctcagcaaacttaagaggttcctgacaaccctccaacaattcggaaatgacattagccccgaaattggtgaacgcgttcgcactctggtcttggggcttgtcaattag

SEQ ID NO: 20540 - DNA, 408 bp, Artificial Sequence
  Description of Artificial Sequence: Synthetic coding sequence
atgatcagcgtgaagcggaacacctggcgggccctgagcctggtgatcggtgattgtcgtaaaaaaggcaactttgaatattgccaggacaggacagagaagcattctaccatgcctgatagccccgtggatgtgaaaacccaatctcggcttacgcctccgacaatgcccccacctcctacaactcagggtgcccccaggactagctcttttacccctacaactcttactaatggcacttcccactcgccgactgcccttaacggtgccccttcgccaccgaacggtttttcaaacggcccctcatcttcaagttcttcctctctggcaaatcagcaactgcctcctgcttgtggtgcccgccagctgtcaaagctcaagaggttccttacgacactgcagcagtag

SEQ ID NO: 20541 - DNA, 210 bp, Artificial Sequence
  Description of Artificial Sequence: Synthetic coding sequence
atgcccgaccggaccgagaagcacagcaccatgcccgacagccccgtcgatgtgaagactcaaagcagactgacaccgcccacgatgccgccccctcccaccacccagggcgctcctcgtacatcttcatttactccaacaactctgactaacgggacatcccacagccccacagctctgaatggggccccctcaccacctaatggctag

SEQ ID NO: 20542 - DNA, 177 bp, Artificial Sequence
  Description of Artificial Sequence: Synthetic coding sequence
atgatcagcgtgaagcggaacacctggcgggccctgagcctggtgatcggtgattgcaggaagaagggcaatttcgagtactgccagggtgcgcgagcccaacaccccgcgtccggcgatgcagcaccagctcccttgatggcactgcttagcgctgctacacacagccggacttag

SEQ ID NO: 20543 - DNA, 240 bp, Artificial Sequence
  Description of Artificial Sequence: Synthetic coding sequence
atgcccgaccggaccgagaagcacagcaccatgcccgacagccccgtggacgtcaagactcagtctaggttaacaccacccactatgccccctcccccaaccactcagggggcgcctcgaacatctagcttcacaccaaccacgcttactaacggcacctcgcacagccccaccgctctgaacggtgcaccatcacccccgaatggattctccaatggcccatctagctcctccagttag

SEQ ID NO: 20544 - DNA, 141 bp, Artificial Sequence
  Description of Artificial Sequence: Synthetic coding sequence
atgcccgacagccccgtggacgtgaagacccagagccggctgacccctcctaccatgccaccacccccaactacccaaggagccccacgtaccagttccttcactcccacgacccttactaatgggaccagccattcctag

SEQ ID NO: 20545 - DNA, 1734 bp, Artificial Sequence
  Description of Artificial Sequence: Synthetic coding sequence
atgcccgaccggaccgagaagcacagcaccatgcccgacagccccgtggacgtaaaaacgcagagtcgccttactcccccaaccatgccaccccctcccactacccagggtgctccccgcacgtctagttttacccctactaccctaactaatggtacctcacactccccaacagcactcaacggtgctcccagtccacccaatggttttagcaacggaccttcttcttcttcaagcagttccctcgcaaatcagcagttgcccccagcatgtggtgcacggcagttgagtaaattgaagcgattcttgacgactttacaacagttcggtaatgatatcagcccggaaattggggagagagtgcgaacattggtgctgggcttagttaattcgacactgacaatcgaggagttccattcaaagttacaggaagctactaatttccctctgcggccgttcgtcattcctttcctgaaagctaacttgccactgttgcagagagagctcctgcattgtgcacgcctggccaaacagaatcctgctcaatacctggcccagcacgagcagctgctactggacgcatccaccaccagtcctgttgatagctctgagctcctgcttgacgtcaatgagaatggtaagaggaggacccccgaccgaacaaaggagaacggctttgatcgcgagccacttcattccgagcatccctccaaacgcccctgcaccatctcccccggtcagagatacagtcctaacaacggactgtcctatcagcccaatggtctcccccatcccacacccccgcccccgcagcactatcgcctcgatgatatggctatcgcccaccattaccgagactcctacagacatccctctcatagagatctccgggacaggaataggcctatgggattgcacggaaccaggcaagaagagatgattgaccatcggctcaccgatagagagtgggctgaggagtggaaacacctggatcacttgctgaactgcattatggatatggtggagaagacgaggcggagcctgaccgtgctgaggcgctgccaggaagcggaccgagaggagctcaactattggatcaggcgctactctgacgctgaggaccttaagaagggagggggctcaagctctagtcatagccgacagcagagcccagtgaatcccgaccccgttgctctcgacgcccaccgggagtttctccaccggcctgctagcggttatgttccagaggagatctggaagaaggcagaggaagccgtgaacgaagtgaaaaggcaggcgatgacagaacttcagaaggccgtgtcagaagccgagcgtaaagctcacgacatgatcaccaccgagagagcgaagatggagcgtactgtggccgaagcaaaacggcaggcagccgaggatgctctggccgtaattaatcagcaagaagactctagcgagtcgtgctggaactgtggacgcaaagcatcggagacctgttccggctgtaacactgcccggtactgtggaagtttctgtcagcacaaggattgggagaagcaccaccatatttgcggccaaacactacaggcacagcagcagggagatacccccgccgtttcctcatctgtgacacctaattcaggcgcaggatcaccaatggacactcctcccgcagccaccccacggagtacaaccccaggaaccccgtccaccatagaaaccacccctaggtag

SEQ ID NO: 20546 - DNA, 165 bp, Artificial Sequence
  Description of Artificial Sequence: Synthetic coding sequence
atgatcagcgtgaagcggaacacctggcgggccctgagcctggtgattggcgactgccggaaaaaaggcaacttcgagtattgccaggatagaacggagaagcacagtacaatgcccgacagtccagtcgatgtgaaaacccagagccgcctaacacctccctag

SEQ ID NO: 20547 - DNA, 690 bp, Artificial Sequence
  Description of Artificial Sequence: Synthetic coding sequence
atgatcagcgtgaagcggaacacctggcgggccctgagcctggtgatcggcgattgtcgaaaaaagggtaattttgagtactgtcaagacaggaccgagaagcatagcacaatgccagatagcccagttgatgttaaaacccagtctcggctgaccccccccaccatgccacctccgcctaccacccagggggctccacgcacatctagcttcacccccacaactctgacgaacgggacctcacacagccccacagctcttaatggagccccatcccctcctaatggctttagtaacggaccatcaagcagtagcagtagttccctcgccaaccagcaactgcctcctgcttgcggggccagacagctgagcaaattaaagcggtttctgacgaccctgcagcagttcggcaatgatatttcaccggagatcggtgagcgcgtgagaactcttgttctgggattagtgaattcgactcttaccatcgaagagttccactctaaactgcaagaagctacaaacttccccctgcgcccgtttgtaattccttttctgaaagccaacttgccacttcttcagcgagaactgctgcattgcgcaagactggcgaagcagaacccagcccagtatctggcccaacacgagcaactactactggacgcatccaccacctcccccgttgatagttag

SEQ ID NO: 20548 - DNA, 81 bp, Artificial Sequence
  Description of Artificial Sequence: Synthetic coding sequence
atgcccgaccggaccgagaagcacagcaccatgcccgacagccccgtggatgtgaaaacccaaagcaggttaaccccttag

SEQ ID NO: 20549 - DNA, 510 bp, Artificial Sequence
  Description of Artificial Sequence: Synthetic coding sequence
atgatcagcgtgaagcggaacacctggcgggccctgagcctggtgatcggcgattgcagaaagaagggaaattttgagtactgtcaagatagaaccgagaagcactctaccatgccagatagcccagttgacgtgaaaacacagtctaggctcacgcccccaacaatgcccccaccaccgacgacccagggagccccacggactagctccttcaccccaactacccttaccaacggtactagccatagcccgacagcactgaacggcgctccatcacccccgaacggatttagcaacgggcctagcagttcatctagttcctcccttgccaaccagcagttgccgccggcgtgcggggccaggcagctgtccaagctgaaaagattccttaccacgctgcagcaattcggcaatgacatctccccggaaatcggtgaacgagtgcgcactctcgttcttggtctggtgaattccaccctgacgattgaggagtttcatagcaagctttag

SEQ ID NO: 20550 - DNA, 147 bp, Artificial Sequence
  Description of Artificial Sequence: Synthetic coding sequence
atgatcagcgtgaagcggaacacctggcgggccctgagcctggtgattggggattgcagaaaaaagggtaactttgaatattgccaggatcgcactgaaaagcattctaccatgcccgatagcccagtcgacgtgaagacccagtag

SEQ ID NO: 20551 - DNA, 276 bp, Artificial Sequence
  Description of Artificial Sequence: Synthetic coding sequence
atgcccgacagccccgtggacgtgaagacccagagccggctgacccccccaactatgccaccaccccctacgactcagggagcgccccggacgtccagctttacaccaaccaccctcaccaacggaactagccactcaccaaccgccctgaacggtgccccttccccaccgaatgggttttccaatgggccatcttcctcaagctcctctagtctcgcaaaccaacagcttcccccggcttgcggggcccgccaactcagtaaactgaagcgatag

SEQ ID NO: 20552 - DNA, 363 bp, Artificial Sequence
  Description of Artificial Sequence: Synthetic coding sequence
atgatcagcgtgaagcggaacacctggcgggccctgagcctggtgattggcgattgtcggaagaagggaaatttcgagtattgtcaggatagaaccgaaaagcacagtaccatgccagatagtccggtagatgtcaagacccaatcccggctcacacccccaactatgccacctccaccgaccactcagggagcccctcgcacaagtagttttacgcctactacgctaactaatggtacatcacacagcccaactgcactgaatggggcgcctagtccaccaaatggattcagtaacggcccatcgtcatctagctcctccagtctggctaatcaacagctgccccctgcgtgtggggcctag

SEQ ID NO: 20553 - DNA, 1704 bp, Artificial Sequence
  Description of Artificial Sequence: Synthetic coding sequence
atgcccgacagccccgtggacgtgaagacccagagccggctgaccccacctaccatgccccccccgcctacaacacagggcgcacctcgcactagctcttttacaccaactactctgaccaacggcacatcccactctccaactgcactgaatggagctcctagtccccccaacggtttctctaatggtccttccagctcgtctagctcttcattggcgaatcagcagctgccaccggcttgcggagcccgacagttgtcaaagctgaagcgtttcctgacgactctgcagcagttcggcaatgatatctccccagaaataggcgagcgcgtccgtaccttggtgctggggttagtcaactcaacgttgactatcgaggaatttcactcaaagctgcaggaggccacaaattttccccttcgcccattcgtcataccattcttgaaggcgaacctgccgcttctgcaacgggagctgctgcactgtgcccgattggcgaaacaaaacccggcccaatacctcgcccagcatgaacagttactgttggatgcgtcaaccactagccccgtggattctagcgaactgcttctggacgtcaacgagaacggaaagagaaggacacccgacagaactaaagagaatggttttgatagagaaccccttcattctgagcacccttctaagaggccttgtactattagccccggtcaacggtatagtcctaacaatgggctgagttatcaacccaatgggctgccccacccaacacctccgcctccccagcattaccggctggatgatatggccatcgcacatcactatagggacagctacaggcacccctcgcatagagacctcagggatagaaaccgtcctatgggcctccacggtactaggcaggaggagatgatcgatcatcggctgacagacagggagtgggcggaggaatggaaacacctggaccacctattgaattgtatcatggatatggtggaaaagacgcgccgaagcctaacggtcctgcggagatgtcaagaggctgaccgggaggaactaaactactggatccggagatatagcgatgctgaagacctgaagaaagggggtggatcttcttcctcacactcccgccaacagagcccagtgaacccagatcctgtagcattagacgctcatcgggagttcctgcataggccggcatctggctatgtgcccgaggaaatatggaaaaaagctgaagaggctgtcaacgaagtgaaaaggcaggccatgaccgagctgcagaaggcagtgtctgaagctgagaggaaggcacatgacatgatcactaccgagcgtgccaaaatggagaggaccgtggctgaagccaagcgccaggctgccgaggatgccctggcagtgatcaaccaacaggaggacagctcggaaagctgttggaactgtgggcgaaaggcaagcgagacttgctccggctgcaatacagctaggtattgtggctccttttgccaacacaaagattgggagaaacatcatcatatttgtggccaaactctccaggcccagcagcagggtgacacccctgcagtgagttccagcgtgacccccaactccggcgccggctcaccaatggacacccctcccgccgccacaccaagatcaaccacaccgggaacaccctctaccatcgagacaaccccccgctag

SEQ ID NO: 20554 - DNA, 258 bp, Artificial Sequence
  Description of Artificial Sequence: Synthetic coding sequence
atgatcagcgtgaagcggaacacctggcgggccctgagcctggtgatcggcgattgccgtaaaaaggggaactttgaatattgtcaggatcgcacggagaaacactccacaatgccagacagtcccgtcgacgttaagactcaaagccggttgacaccccctacaatgccccccccacctaccacccagggcgctcctcgcacgagcagctttactccgacaacgttaactaacggcacatctcattctccaacatag

SEQ ID NO: 20555 - DNA, 516 bp, Artificial Sequence
  Description of Artificial Sequence: Synthetic coding sequence
atgcccgacagccccgtggacgtgaagacccagagccggctgaccccccccaccatgccaccgcctcccacgacccagggcgccccccgtaccagctccttcacacccaccaccctgaccaatggcacatctcactcacccacagccctgaatggggccccctctcccccgaacgggttcagcaatggacctagttcctcatcctcaagtagtcttgcaaaccagcagcttccacctgcatgcggggcccgccagctgtcaaagctcaaacgattccttaccactttgcaacaattcgggaatgacatctctcccgaaatcggggaaagagtgagaactctggtcctaggactcgtgaacagtacgctgacaatcgaggaattccactcgaagctccaagaggctaccaattttcctctccgacctttcgtgatcccatttctgaaagcaaaccttcctctgctgcaacgggaattgctacactgtgctagactggcaaaacagaatccagcctag

SEQ ID NO: 20556 - DNA, 270 bp, Artificial Sequence
  Description of Artificial Sequence: Synthetic coding sequence
atgcccgacagccccgtggacgtgaagacccagagccggctgacccctcctacaatgcctccgcctcccaccacacagggtgcaccacgcacctcttccttcacacccaccacattgacaaacggaactagccacagccctaccgccctcaacggcgcacctagtccaccaaacggtttttcaaacggcccctcttctagtagctcgtctagcctggcaaatcagcagctcccgcctgcctgcggagcaagacagctgagcaaactgtag

SEQ ID NO: 20557 - DNA, 285 bp, Artificial Sequence
  Description of Artificial Sequence: Synthetic coding sequence
atgatcagcgtgaagcggaacacctggcgggccctgagcctggtgattggagactgtcggaaaaaagggaacttcgaatactgccaggaccggactgaaaaacactcaacaatgccggacagccccgttgatgtcaagacacagagcagactaacaccacccacgatgcctccccctccaactacccagggagcacctcggacgagcagttttactccaaccactctgacgaatggcacttcacactcaccaacagctctgaacggtgcaccttcgccaccctag

SEQ ID NO: 20558 - DNA, 306 bp, Artificial Sequence
  Description of Artificial Sequence: Synthetic coding sequence
atgcccgaccggaccgagaagcacagcaccatgcccgacagccccgttgacgttaagacacagtctaggctgacccccccaactatgcccccaccgccaaccacacagggcgcaccacgcacgagttccttcacgcccactactcttactaacggcacaagtcacagtccaacggcactgaatggcgccccgtccccaccaaatgggttctcaaacggaccaagctcgtcttcttctagcagtctggctaatcagcagctgcctcccgcatgcggtgctcggcagttgtccaaactgaaacgctag

SEQ ID NO: 20559 - DNA, 471 bp, Artificial Sequence
  Description of Artificial Sequence: Synthetic coding sequence
atgatcagcgtgaagcggaacacctggcgggccctgagcctggtgataggagactgcagaaaaaagggtaacttcgagtattgccaggaccgcaccgaaaagcacagcaccatgcccgacagccctgtcgatgtcaagacccagagtcggcttacccccccgaccatgcctcccccaccaaccacccagggagcacctaggacctcatctttcacccccaccacactcactaacggcacttcccatagcccgacggcgctcaatggagcccccagcccccccaacggctttagcaatggcccctccagcagctcttcctcttcgctggcaaaccagcagttacctcctgcctgcggagccagacagctgtccaagttgaagagatttctgacaactcttcagcagtttggcaatgatatcagccctgagattggtgaacgggtgcgcacattagtgttgggccttgtctag

SEQ ID NO: 20560 - DNA, 363 bp, Artificial Sequence
  Description of Artificial Sequence: Synthetic coding sequence
atgatcagcgtgaagcggaacacctggcgggccctgagcctggtgattggtgattgtcgcaaaaagggaaactttgagtattgccaagatcgaacagagaagcattccacaatgccggattctccagttgacgtgaagacacagagtagacttactccaccaactatgccgcctcccccaactactcaaggagcaccacgaacctcatcgttcacccctaccactcttaccaacggcacctcccattccccgacagctctgaacggtgccccctcgccacctaacgggttcagcaatggccctagtagcagttcgtcgtcctctctggctaaccagcagctgcccccggcttgtggagcctag

SEQ ID NO: 20561 - DNA, 1815 bp, Artificial Sequence
  Description of Artificial Sequence: Synthetic coding sequence
atgatcagcgtgaagcggaacacctggcgggccctgagcctggtgatcggtgactgcagaaaaaaaggcaacttcgaatattgtcaagacaggacggaaaaacactccacaatgccagactcccccgtagacgtaaagacccagtctcgcctgactccgccgacaatgccaccccctcctacgacacagggggcacccagaactagtagcttcacgcccacaactcttaccaacggcacctcacactcccctactgctttaaatggggcccctagcccgcccaacggcttcagcaatggcccttcatctagctccagctcctcactggccaaccaacaactgcctcccgcctgtggtgcccgccaactttctaaattaaagcgattcctgaccacactgcaacagttcggaaatgatatcagcccagaaattggcgagcgtgtgagaactctggttctgggcctggtgaacagcaccttgactattgaggagttccatagcaagctgcaggaggccactaacttcccactccgccccttcgtaatcccttttctgaaagcaaacctcccactgttgcagagggagctcctccactgtgcccggctcgccaaacagaaccccgcgcagtacctggcccagcatgagcagctactgttagatgccagtactacaagtcccgtggactcgtccgagcttctgcttgatgtgaacgagaacggcaaacgccggactccagacaggaccaaggagaacggatttgaccgcgagcctctccattccgagcacccttcgaaacgcccttgcaccatcagtcccgggcaaagatacagtccgaacaatggcctgtcataccagccaaatggcctgccccatccaactcccccaccaccccaacactaccgtctcgatgacatggcaatcgcccaccattaccgagattcctataggcatccttcacacagggatctgagagatagaaatagacccatggggttacacggcaccagacaagaggagatgatcgatcataggctcactgatcgggaatgggcggaagagtggaagcatctggaccatttactgaattgcattatggatatggtggagaagaccaggagaagtcttaccgtgctgcggcgctgccaggaagccgaccgggaagagttgaattattggatccgccgatactctgatgcagaggatttgaaaaagggaggaggctcgagctcttcccattctcggcagcagagccccgtcaacccggatccagtggcattagacgcccatagggagtttttgcacaggcccgcctcaggttatgttcctgaggaaatctggaaaaaagctgaggaggccgtaaacgaagtaaagaggcaggccatgacggagctgcaaaaggccgtgagtgaggcagagcgcaaagcccacgacatgattacaaccgaacgggctaagatggaaaggaccgtggcagaggccaaacgccaggctgcagaggacgccctggcggtcattaatcagcaggaggactccagcgaaagctgttggaactgcgggcgaaaagccagtgagacatgctcgggttgtaacacagccaggtattgcgggagtttttgccaacacaaggactgggaaaaacatcatcatatctgtggccagacacttcaggctcaacagcaaggggacacacccgctgtttcctccagtgtgaccccaaactcaggggcggggagtccaatggacaccccccctgcagccacgcccaggtccaccaccccaggcacaccttcgactatcgaaaccacccctaggtag

SEQ ID NO: 20562 - DNA, 3105 bp, Artificial Sequence
  Description of Artificial Sequence: Synthetic coding sequence
atggccgccgccaccggcgccgtggccgccagcgccgccagcggccaggccgagggaaaaaagattactgaccttcgggtgatcgatctgaagtccgagctgaaaagacggaacttagatataacaggcgttaagacagtcctaattagccgccttaagcaggcaattgaagaagaggggggagaccctgataacatcgagttaactgtaagcaccgatacacccaataagaagccgactaagggcaaaggcaaaaaacatgaggcagatgagctcagcggtgacgcaagtgttgaggatgacgcatttattaaagattgcgaactggaaaaccaggaggcacatgagcaagatggcaacgacgagctgaaagattcagaagagtttggcgagaacgaggaagagaacgtgcactctaaagaactcttgtcagccgaggagaacaagcgggcgcacgaattgatagaggccgagggcattgaagacatcgagaaagaggacatcgagtctcaggagatcgaagctcaagaaggtgaagatgatacattccttactgctcaggatggtgaggaagaagagaacgaaaaggatatcgctgggtccggggatgggacccaggaagtctcgaaacctttacccagcgaagggagcctcgccgaggctgatcacacggctcacgaggagatggaggctcatacaaccgtaaaagaagcagaggatgataacattagcgttaccattcaggcagaagatgccatcaccctagattttgacggggatgatctcctggagaccggtaagaatgtgaaaattacagatagtgaggccagtaagcccaaggatggacaagacgcaatagcccagagtccagaaaaggaatcaaaagactacgaaatgaatgccaatcacaaggacggtaaaaaagaggactgtgttaaaggggatcccgtcgagaaagaggcacgggagagtagcaagaaagccgaaagcggtgataaggagaaagatacactcaaaaagggtccgtcatctactggcgctagtggacaggccaaatctagtagtaaagagagcaaggattccaagacctctagcaaggacgataaaggaagtacctccagcacctctgggtcttccgggtcctcgactaaaaatatttgggtctctgggctgagttctaacacaaaagccgcagatctgaagaacctgtttggcaagtacggcaaagtattgagtgcaaaggtggtcaccaatgcaaggtcccccggggccaagtgctatggaatcgttacaatgtcctcctctacggaggtgagcagatgcatcgcccatctgcaccggactgaactacacggacaactgattagtgtcgagaaggtaaaaggagaccctagtaaaaaggaaatgaaaaaagagaatgatgagaaaagctctagtcggtcgagcggcgataagaagaatacatctgatcgctcttctaagacacaagcctccgtgaagaaggaggagaagcggtcttcggagaaatccgagaagaaggagagcaaggatactaagaaaattgagggcaaggatgaaaagaatgataacggcgcgtctggacaaaccagcgagagtatcaagaagtctgaggagaagaaacggatcagcagcaagagccctggtcatatggtcattttggaccagaccaagggtgatcactgccgaccttcccgtagggggagatatgagaaaatccatggaaggtccaaagagaaagaacgtgcgagcctggacaaaaagagggataaggactaccgccgaaaagagattctcccctttgagaaaatgaaggagcagaggctccgggaacacctcgtgcgctttgagagattacggagggcaatggaactgcggagaaggagggaaatcgctgagcgagaacggcgcgagcgcgagagaatcaggataatccgcgaacgggaggagcgcgaacggcttcaacgcgaaagggaaaggctcgaaatcgaacgacagaaattagaaagagaacgcatggaacgtgagaggctggagcgggaacggataaggattgagcaggaacgtagaaaagaggcagagaggatcgcgcgggaacgggaagagctgaggaggcagcagcagcagcttcgttacgagcaagaaaagaggaactctctcaagaggcctcgcgatgttgaccaccgccgcgacgacccatattggagtgagaacaaaaagctctctctggataccgatgcccgatttggccatggctctgattatagcaggcagcagaataggttcaacgacttcgaccaccgcgaaagaggaagattccctgagtcaagcgccgtccaatctagctccttcgagagacgggaccgatttgtgggccaatcggaaggaaaaaaggcccgaccgacggcccgtagggaggatcccagcttcgagcggtacccgaagaacttcagcgacagtagacgaaatgaaccgccaccccctagaaatgaactgcgggagtctgatcgccgggaggtccgcggggaacgcgatgagaggaggactgttatcattcacgatagacctgacattacccacccacgacaccctcgcgaggcggggcctaacccctccagacccacgtcttggaagtcagagggttctatgagcacagataagcgggagactagagttgaacgtccagaacgaagcggacgcgaagtctccggccactccgtacgcggcgccccacccggcaaccgcagttcagcgtctgggtacggatccagggaaggggacagaggagtgattactgaccgtggtggcgggtcgcagcactatccagaggagagacatgtcgtggaacgacacggccgagacacctcgggtcctcgaaaggaatggcacgggcctccatctcagggtcctagctaccacgacactcggcgaatgggtgatggacgcgcaggggcaggaatgataacccagcatagtagcaatgcgtcccccatcaatcggattgtgcagatctctggaaactccatgccgcggggatcaggttccggatttaaacccttcaaaggcggacctccaaggcggttctag

SEQ ID NO: 20563 - DNA, 1812 bp, Artificial Sequence
  Description of Artificial Sequence: Synthetic coding sequence
atgagcagcagcaccgaggtgagccggtgcatcgcccacctgcaccggaccgagctccatggtcagctcattagtgtggaaaaagtcaagggtgatccttccaaaaaagaaatgaaaaaggagaacgatgagaaatcaagcagtcgatctagcggggataagaaaaatacttccgaccgcagtagcaagactcaggccagcgttaaaaaggaagagaaacgaagctctgaaaaaagcgaaaaaaaagaatccaaggatacgaaaaaaattgaaggcaaagatgagaaaaacgacaatggggcatctggccagacaagcgaaagcattaaaaagtccgaggagaagaagcgcatcagttccaaatctcccggtcacatggtcatactcgatcagaccaaaggagatcattgtcgaccttctagacgagggcggtatgaaaaaatccacgggaggagcaaagagaaagagcgggccagtcttgacaaaaagcgggataaggactaccgtaggaaagaaatcctgccttttgaaaaaatgaaggagcaacggctgcgggagcatcttgtgagatttgagaggctgcgtcgggccatggagcttcgcaggcggcgtgaaattgcagagcgtgaaaggcgcgagcgagagagaataagaattattcgggaaagggaggaaagagagcggctacagcgcgagcgagagcggctggagatcgaacgccaaaagttagagcgggagcgaatggagcgcgagagactggaacgtgaacggatacggattgaacaggaacgtcggaaggaagctgaacgaattgcccgagagagggaagaactgcgtcgtcagcagcaacagctcagatatgagcaagaaaagcgcaactcccttaagagacccagggatgtggaccaccgaagggacgacccttactggtctgaaaataaaaaactgtctctcgatacagacgccaggttcggtcacggaagcgactatagccggcagcaaaacaggttcaacgatttcgaccaccgcgagaggggcaggtttccagagtcttccgccgtacagagttcatcatttgagcggcgagaccgttttgtgggccagtctgaagggaagaaggcacgccctaccgcaaggcgcgaagatccatctttcgagagatatcctaagaacttcagcgattctaggcgaaacgagccgcctcctccaaggaatgaactcagggagtcagatagacgagaggttaggggcgagcgcgacgagaggcggactgtgatcattcacgatcgtccggatattacacatccacggcatcccagagaggcgggaccaaatcctagtcgaccgactagctggaagtccgaagggtcaatgtccactgataagcgagagacccgcgttgaaagaccagaaaggtctggacgggaggtgagtggacactctgtgagaggcgcaccccctggcaatcgcagctctgccagcggctatggctcccgagaaggagacagaggagttatcaccgatcgcggaggcgggtcccaacactaccccgaagagaggcacgtcgtggagcgccacggcagagacacgagcggaccccgcaaggaatggcacggacccccatcacagggcccatcatatcacgatacaaggagaatgggcgacggccgcgctggggctggcatgatcactcaacattctagcaacgcctcccctatcaaccgaatcgtacagatctctggaaattctatgcctcgagggtcggggagcgggttcaaaccatttaagggcggacctcccagaagattttag

SEQ ID NO: 20564 - DNA, 303 bp, Artificial Sequence
  Description of Artificial Sequence: Synthetic coding sequence
ggcgtgatcaccgaccggggcggcggcagccagcactaccccgaggagcgacacgttgtagaaaggcacggccgagatactagtggcccacgcaaagaatggcatggacctcccagccaaggcccctcataccacgacaccaggcgtatgggggatggaagagccggtgcaggcatgataacccagcactcatcaaacgctagccctattaacaggattgttcagattagcggaaattctatgccacgcggctctgggtccggatttaagccatttaagggcggaccaccacgacgcttctag

SEQ ID NO: 20565 - DNA, 552 bp, Artificial Sequence
  Description of Artificial Sequence: Synthetic coding sequence
atgaacggcttcagcaccgaggaggacagccgggagggcccccccgccgcacccgccgcagcggccccgggatacggtcagtcatgttgtctgattgaagatggtgagcgctgtgttcggcctgctggtaatgcttccttttccaagcgtgtgcagaaaagcatttcccagaagaagttgaaactggacatcgataaaagcgtgcgtcatctttatatctgcgacttccataagaatttcatccagtctgtgcgcaacaagagaaaacgaaaaacttcagacgacggaggtgacagcccggagcatgataccgacattcctgaagttgatctgtttcagttgcaggtgaacacactccgcaggtacaaaaggcattataagctacagacgagaccagggttcaataaggcccaactcgctgaaactgtgtctcgccatttcaggaatatcccggtgaatgagaaggagaccttggcttactttatatacatggtgaagtcaaacaagtcgaggctcgaccagaagtctgagggcgggaagcagctcgaatag

SEQ ID NO: 20566 - DNA, 414 bp, Artificial Sequence
  Description of Artificial Sequence: Synthetic coding sequence
atgaacggcttcagcaccgaggaggacagccgggagggcccccccgcagccccagctgccgccgcccccggctacggacagtcatgttgcctgattgaggacggggaaagatgtgttcgcccagccgggaatgcttcattttccaagagggtgcagaaatctatctcacagaagaagctaaagctcgacatcgacaagtctcttcaggtcaatactctgcggaggtacaaacggcattacaagttacagaccagaccgggcttcaacaaggcccagctggccgagacagtttcccggcactttagaaatatccccgtgaacgaaaaagaaacgctggcatatttcatttacatggtcaagagtaacaaaagccgcctagaccaaaagtccgaaggaggcaaacaactggagtag

SEQ ID NO: 20567 - DNA, 429 bp, Artificial Sequence
  Description of Artificial Sequence: Synthetic coding sequence
atgaacggcttcagcaccgaggaggacagccgggagggcccccccgctgccccagcggcagcagcacccggttatgggcagtcctgttgcttaatagaagacggagagcgctgcgtgcgccctgcaggcaacgcatccttcagcaagagggttcagaaatccatttctcagaaaaagctgaagcttgacatcgataaaagcgtggacctgtttcagctccaggtgaatacccttagacgctacaagcggcactacaagctgcaaacccggcctggatttaataaagcccagcttgctgagaccgtctcacgccatttcaggaatattcccgtgaacgaaaaagagactctcgcatactttatttatatggtgaagagcaataagagccgattagaccagaagtcggaaggagggaaacagttagagtag

SEQ ID NO: 20568 - DNA, 540 bp, Artificial Sequence
  Description of Artificial Sequence: Synthetic coding sequence
atggccgccaccgagcccatcctggccgccaccggcagccccgccgccgtgcctcctgagaaactcgagggtgctggtagtagcagtgcacccgagcggaactgtgtgggaagctcgctgccggaggcaagccctcccgcgccagaaccttcatccccaaatgcggccgtacctgaggccatcccgacacctcgtgccgcagcctctgctgcgctcgagctccctctgggacctgcccctgtgagtgtggctccgcaagccgaggccgaggcaaggagcactcccggccctgcaggaagcagactcggaccagagacgtttcggcagcgatttcggcaatttcgttaccaggatgccgccggtccccgagaagcatttcgacagctgcgggagctgtctcgccaatggcttaggcccgacattcgcaccaaggaacagattgtagagatgctggttcaagagcagctgttggccattttacccgaggctgccagggcccgccggattaggcgtagaaccgatgtgagaatcaccggttag

SEQ ID NO: 20569 - DNA, 540 bp, Artificial Sequence
  Description of Artificial Sequence: Synthetic coding sequence
atggccgccaccgagcccatcctggccgccaccggcagccccgccgctgtgccgccggaaaagctggaaggggccggtagtagttcagcgcccgagcgaaattgtgtggggtcaagcctgccggaagccagcccacctgccccagaaccaagctctccaaatgccgcggtccccgaggccattccaactccccgcgccgccgctagcgccgcgctcgagctgcccctcggacctgcccccgtgagtgtcgcaccgcaggccgaagccgaggcccgcagcacgccaggtcccgctggatcacggctgggacccgagacattccgacaacgcttccgacaatttaggtaccaggatgccgccgggcccagagaagctttccggcagcttagagaactgtccagacaatggttacggcctgacataaggactaaggagcagattgttgagatgcttgttcaagaacaactcctggccattttacctgaggcggccagagcccgtcgcattcgccgccgtaccgacgtgaggattaccggatag

SEQ ID NO: 20570 - DNA, 3978 bp, Artificial Sequence
  Description of Artificial Sequence: Synthetic coding sequence
atggaggccgtgagccgggtgttccccgccctggccggccaggccccagaagaacagggggaaattattaaggtcaaagtcaaggaagaggatcatacgtgggatcaggagtcagccctcaggagaaacctgtcatatacacgtgaactctccagacagcgctttcggcagttctgttatcaagaaactccgggaccccgggaagcactgtctcagctgagagaactgtgtcggcagtggctgaacccggagatccacactaaggagcagatactggagctgttggttctagagcagttcctgaccatccttccggaggaactgcagtcgtgggtgcgagaacacaatcctgagtccggagaggaagtggtgaccctgctggaagaccttgagcgagagctggacgagccaaggcaacaagtgagtcagggcacctacgggcaggaggtctccatggaggagatgataccactggattcagccaaggaatcactgggcacacagcttcaaagcatggaagaccgcatggagtgcgaatcgcccgaaccacaccccctgcaggacaatgggagctttttgtggttctctatgatgagtcagtctatggggggcgataacctgagctctctggatacaaacgaagccgaaatcgaacccgaaaatatgcgagagaagttcttccggagcctcgccaggctccttgagaataagtctaataatacgaagatattttccaaggccaagtactgtcaacttattaaggaggtgaaggaggccaaagctaaggctaaaaaggaatccgtggattaccggcggctggcgaggttcgatgtcattctggtgcagggcaacgagaaactgattgaagccgtgaatggagaaacagacaagatccgttattatctccattcagaggatctctttgacatcctgcataatactcatctcagtattggtcatggtggaaggactaggatggagaaagagcttcaggctaagtacaagaacattaccaaggaggttataatgttgtacctaactctgtgtaagccatgccagcagaagaactcgaaactcaaaaaagtgctaacgtcaaaaagcatcaaggaagtgtcgagccggtgccaggttgacctcattgatatgcagctgaatccggacggcgagtataggttcatcttgcactatcaggatctctgtacgaagctgacctttctccgatccttgaaaagtaaacgcccgacagaggtggcccacgccttgctggacatctttaccattatcggcgctccatccgtgctgcagtcagacaatggccgcgagtttagcagccaagtggttagcgaactgtctaatatttggcccgagttgaaaatcgtgcacggcaagagccagacatgtcagtctcagtcatcagccgagcagaccgaagacattaggaaaaggatcttttcatggatgcagaccaacaatagttctcattggaccgaatttctttggtttattcagatgagccagaatcaaccttatcacaggtccatgcagcagactccatgtgaatcggccttttccagcgaggcgaagctgggactgagtcatagccagctgacggaggaacttgtcgcctcactgcataccgagaatgagctggaccaggcagacaaagagctggagaatacactgcgggcacagtatgaggagaatatagaaacaggaacagattctagtgatattgaggagaacctatcagtgaccccaaaagttgctgagaaaagtccccccgagtcccggctgcgcttcctctcttgtgtcgtctgcgaaaaagaatgtactggggtgaattcgtgtatctcttgtgacggaaatatccacgctatttgtggcgtgccctcacagcatggcactgagggctgtggtagacagatcacatgtagcctgtgctacgagaccagtacaatgaagaggaagcacgacgaaatccagcgctccttgccagtcaaaccatccaaaatgttgaaaccgagcggaacaccgttcagccctgacaaggtgggtgactggatggctaagcaggcaagtttggacttcttcgttaaaaaacgtcatgcatttagtgagcattcgtccagtaataaaaggaacgtgaacaacagatcctaccccgaggaaggcaagaccaaacgagtgcatgcttccttcacacgcaagtatgatcccagttacatcgagtttggctttgtggccgtgatcgatggcgaagtgctcaagccacagtgtattatatgtggggatgtccttgccaacgaggccatgaaaccaagtaaactcaaacggcacttgtacagcaagcacaaagagattagttcccaacctaaagagttcttcgaaagaaagtcttccgaactgaagtcccaacctaaacaggtcttcaacgtgagccatattaatatttccgccctccgcgccagctacaaggttgcacttcctgtagctaagagcaaaacaccctacactatagccgagacgcttgtgaaggattgtatcaaggaggtgtgcctggaaatgctgggagagtcggcagctaagaaagtggcccaggtgcccctcagcaacgatactattgccagaagaatccaggaactcgccaacgacatggaagaccaactgattgagcagatcaagctcgcgaagtacttctctctccagctagacgagtgccgggatatcgccaacatgattatactgctggtatacgtgaggtttgagcacgatgatgacatcaaggaggagttctttttttctgcatcactcccaactaacaccacttcctcagagttgtatgaggctgtcaagaactatatcgtgaacaagtgcggcttggaatttaaattttgcgtgggagtttgctccgacggagccgcgtccatgacagggaaacactccgaggtcgtgacccagatcaaagagttagcaccagagtgcaagacaacgcactgttttatccaccgggaaagcctggctatgaaaaagatttccgctgaactcaatagcgttctcaacgatatcgttaaaatcgtgaattacattaaatctaacagcctgaattcaagattattcagtttgttgtgtgacaacatggaggctgaccataagcaattactgcttcacgccgagatcaggtggctgagtagaggtaaggtgctgtcgcggatgtttgagatccggaatgaactcttagtgttcctccagggaaagaagcctatgtggtcacagcttttcaaggacgtgaactggacagcgaggctggcctatttgtcagacatcttcagcattttcaacgaccttaatgcgagtatgcagggaaagaacgccacctatttctccatggccgataaggtggaaggacagaaacaaaaacttgaagcatggaaaaaccggatttcaactgattgctatgatatgttccacaacctcaccactataatcaacgaggtcggcaacgacctcgatattgcccatcttcgtaaggtgatttctgagcatctgaccaatctgctcgaatgcttcgaattctattttccaagcaaagaagatcctcgcatcggtaatctctggattcagaacccatttctaagtagtaaagataacctgaatttaacagtaacacttcaagacaagctcctgaaactggccacagacgagggactgaagatttcgtttgagaacaccgctagcctcccaagcttctggatcaaagccaaaaatgactacccagagctggccgagatcgccctgaagctgctactcctcttcccgtctacttatctctgtgaaaccggtttctccactctcagtgtcatcaaaactaaacacaggaactcccttaatattcactacccattgagagtggccctgagctcgatacagccaaggttggataaactcacaagtaagaaacaagctcacctatctcactag

SEQ ID NO: 20571 - DNA, 2706 bp, Artificial Sequence
  Description of Artificial Sequence: Synthetic coding sequence
atggaggccaaccagtgccccctggtggtggagcccagctaccccgatctcgtgataaatgtgggagaggtgaccttgggcgaggaaaacagaaagaagctgcagaaaatccaaagagaccaagagaaggagcgggtaatgagagcggcatgcgctctcctaaatagtgggggcggcgtgattagaatggccaagaaagtagaacatcccgtggaaatgggtctggatcttgagcaatccctgagagagttgatccagtcttcagatctgcaggccttttttgagaccaagcagcagggtcggtgtttctatatcttcgtgaaaagttggagctccgggcccttccccgaagaccggagtgtaaaacccaggctgtgttctctgtcgtcctccttatatcggcgctcggaaacctctgtcaggagcatggactctcgagaggccttttgcttcctgaaaacgaaaaggaagcctaagatcctggaggagggaccttttcataaaatccacaagggagtgtaccaggaactgccaaacagtgatcctgcagatcctaattctgatcctgctgacttgatttttcaaaaggattatcttgaatacggcgagattctgcccttcccagagagccagcttgtggagttcaagcaatttagtaccaagcacttccaggagtacgtgaagcgtacaattcctgagtatgtccccgcattcgctaatacaggcggtggttatctgttcatcggcgtggatgataagagtagggaagtgctcggctgtgcaaaggagaacgtagaccctgatagcctgcgcagaaaaatcgagcaagcgatctacaagctgccgtgcgtgcacttttgccagccacagcgtcctatcaccttcactttaaagatcgtgaacgtgctcaagcggggcgagttgtacggatacgcctgcatgatccgcgtcaatcctttctgttgcgctgtgttcagtgaagcccccaatagttggatagtggaagacaagtacgtgtgttccttgaccaccgaaaaatgggtaggcatgatgactgataccgatccagatctactgcagctcagtgaagacttcgaatgccagctgtcgctgagctccgggccgcccttgtctaggcctgtctattctaagaaaggtttagaacataaaaaggagcttcaacagctcctgttcagtgtcccccctgggtatctcaggtacacgcctgaatccctgtggagggatctgatatctgagcacagaggattggaggagctgattaataaacaaatgcagcccttttttcgtggtattcttatcttctctcggagctgggcagtcgatctcaatctccaggaaaaacctggggtgatatgtgacgcattgctgattgcccagaactcaacaccaatcctttacaccattctcagagagcaagacgccgaggggcaggattattgtacccgcacagcttttaccctgaaacaaaagctggttaacatgggcggatacactggcaaagtgtgcgtacgcgccaaggtcttgtgcctcagcccagaaagctccgccgaagccttggaggctgcagtttcgccgatggattacccggccagttattcactggcaggtacgcagcacatggaagcgcttctccagtccttggtgatcgtgctactgggctttcgatccctgttatcagatcaactgggttgtgaagtgctgaaccttctaaccgctcagcagtacgaaatattctccagatccctgcgcaaaaatcgcgagctcttcgttcacggcttgccagggtcagggaagactattatggctatgaaaattatggagaagatccgaaatgtgttccattgcgaagcgcaccgcattctgtacgtctgtgagaatcagcccttgcggaattttatatccgatcgtaacatctgtagagcagagactaggaagaccttccttcgggagaactttgagcacatccaacatatagtaattgacgaggcccagaattttcgaactgaggatggcgactggtatgggaaggccaaatcaatcacccggagggcgaagggaggccctggcatcctgtggatttttttagattatttccagacctcacacctggattgcagcggcctgccccctttgagcgatcaatatccccgagaagagctgacgcggattgtccgtaacgcagacccaattgctaagtacctgcagaaagagatgcaggtgattcgcagtaacccttcattcaacattcctaccggctgtttagaagtgtttccggaagctgagtggtcacagggagtccagggcaccttgcggatcaagaagtatttaacagtcgaacagataatgacctgcgtggctgatacgtgtagacgctttttcgaccgaggctacagcccaaaggacgtcgccgtcctggtgtctaccgccaaagaggtagaacattacaagtacgaactgctcaaggcaatgagaaagaagagagtggtccagctgagtgatgcttgcgatatgctgggggaccacatcgtgctggactccgtgcgccgcttcagtggtttagagcgtagcatcgtgttcggaattcaccctaggactgccgatcccgccatcctgcctaatgtgctaatctgtctggctagtagagcaaaacagcacttgtacattttcccatggggcggccactag

SEQ ID NO: 20572 - DNA, 2706 bp, Artificial Sequence
  Description of Artificial Sequence: Synthetic coding sequence
atggaggccaaccagtgccccctggtggtggagcccagctaccccgatttggtgatcaacgtaggcgaagtgacgttgggggaagagaataggaaaaagctgcagaaaatccagcgggatcaggagaaggagcgcgtcatgcgtgccgcctgtgccctcctgaacagcgggggtggcgtcattcgaatggccaaaaaggtggagcaccctgtggagatgggattagatctggaacagtctttacgcgaactgatacagagctccgatttacaggccttcttcgaaactaagcagcaggggagatgtttttatatattcgttaagagttggtcaagcggacctttcccagaggaccggagtgttaagcctcgactatgtagtctgagctcatccttgtatcgccgaagcgaaacctctgtcaggtccatggacagtagggaagccttctgctttttgaagaccaaacgaaagccaaagattcttgaagaaggcccttttcacaagatccacaaaggcgtgtatcaggaactgccaaactcagaccctgcggatcccaacagtgaccccgccgacctcatattccagaaggattacttggaatacggcgagatccttcccttccccgagtcgcaacttgtggaatttaaacagttttctaccaagcattttcaggagtatgttaagcgcacaattccagagtacgtgcccgcctttgccaacacgggcgggggctacctgttcattggagtcgacgataagtcccgggaagtcctgggctgtgccaaggagaatgttgacccggatagtctgcgcagaaagatagagcaagcaatctataagctaccttgcgtgcacttctgccagccccaacgacccatcaccttcaccctgaaaatagtgaatgtcctgaagcggggggagctgtatggatatgcatgtatgataagagtcaatccattttgctgcgctgtgttttctgaggccccgaatagttggatcgtggaagacaaatacgtgtgctccctgactaccgagaagtgggtgggcatgatgaccgacaccgatccggatttgctccagttatccgaggacttcgaatgtcaactgagcctgtcttccggcccccctctctcaaggcctgtgtacagtaaaaaaggacttgaacacaaaaaggagctgcaacagctcttgttttccgtgcctccagggtacctgcgctacacccctgaaagcttgtggagggatctgatcagcgagcatcgaggactggaggagcttattaataaacaaatgcaaccattcttccgggggatcctgattttctcacgctcttgggcagtagacctaaatctgcaggaaaagcccggggttatctgcgatgcactgcttattgcacaaaactcaacacccatcctttataccattctgcgcgagcaagacgccgagggccaggattactgcacccgcaccgcctttacgctgaagcaaaagcttgttaacatgggaggatatactggtaaggtgtgtgtgagagccaaagttctatgtttgagcccagagagcagtgcagaggcgttagaagccgcagtgagccctatggattaccccgccagctacagcctggccggcacccaacacatggaagcacttttgcagtcactggtaatcgtacttctgggctttcggagcttattgagcgaccaactgggatgcgaggtcctcaacctgctgaccgctcaacagtacgagattttctctcgctcgctgcgcaagaatcgagagctcttcgtgcatgggttgcccggctccgggaagacaattatggccatgaaaattatggagaagataaggaacgtatttcattgtgaagctcaccgaatcttgtacgtttgcgagaaccaacccctgcgcaatttcatttccgatcgcaacatttgccgcgccgaaacacggaagacatttttgcgggaaaacttcgagcatatacaacacatcgttatcgatgaagcccagaacttccggaccgaagatggagactggtatggcaaggccaagagcatcaccaggcgggccaagggcggacccggtatcctctggatctttctcgactattttcagacatctcatcttgattgctccggcctcccaccactgtccgatcagtacccgagagaagagctcacacgaattgttaggaatgcggatccaattgctaaatatctgcagaaggagatgcaggtgatccgttctaatccatcatttaacatcccaactggctgcctggaggtattccccgaggctgagtggagccaaggggtccagggaactctacgcatcaaaaagtatcttaccgtggagcaaataatgacttgtgtggcagacacctgccggcgcttcttcgaccggggttattctcccaaagatgtagctgtcttagtcagtaccgctaaggaggttgaacattataaatatgagctgctcaaggccatgcggaagaagcgcgtcgtgcaactgagcgatgcctgcgatatgctgggtgatcacatcgtcctggatagcgttcgccgcttcagtgggctcgagcgctcaatcgtctttggtattcacccccggacggccgaccctgctattctgcccaacgtcctgatttgtctcgcgtctagagcaaaacaacacctgtacatatttccatggggcggacattag

SEQ ID NO: 20573 - DNA, 273 bp, Artificial Sequence
  Description of Artificial Sequence: Synthetic coding sequence
atggaggccaaccagtgccccctggtggtggagcccagctaccccgatttggttataaacgtaggggaggtgacactcggtgaggagaatagaaagaagctacagaaaattcaacgagaccaggagaaagaacgagttatgcgcgcagcttgcgcattgctgaacagcggcggcggcgttatacggatggccaagaaggtggagcacccggtggagatgggcctggacctggaacaatccttaagggagctgattcaaagcagtgatctgtag

SEQ ID NO: 20574 - DNA, 273 bp, Artificial Sequence
  Description of Artificial Sequence: Synthetic coding sequence
atggaggccaaccagtgccccctggtggtggagcccagctaccccgacctcgtcattaatgttggagaggtgacattgggtgaggagaacagaaagaaacttcagaagattcagcgggatcaagaaaaggagagagtcatgagggcagcttgtgctctgttgaactccggaggaggagtaattcgaatggctaagaaagtcgagcacccagttgaaatggggctggacctggaacagtctctgagagagctgattcagtcttccgacctatag

SEQ ID NO: 20575 - DNA, 273 bp, Artificial Sequence
  Description of Artificial Sequence: Synthetic coding sequence
atggaggccaaccagtgccccctggtggtggagcccagctaccccgatttagtgataaacgtcggagaggtcaccctgggcgaggaaaacagaaagaagcttcagaaaattcagagggatcaggaaaaggaacgcgtcatgagagccgcgtgcgccttactcaatagtggcggcggcgtgattaggatggctaagaaggtcgagcatccggtagagatgggcctcgacctcgaacaatccctaagagaactgatccaaagctctgacctgtag

SEQ ID NO: 20576 - DNA, 606 bp, Artificial Sequence
  Description of Artificial Sequence: Synthetic coding sequence
atgagcttcgccaccctgcggcccgccccccccggccggtacctgtaccccgaggtgagcccactttcagaggatgaggacagagggtcggacagttctggttcggacgagaagccgtgtcgtgtccacgctgcaaggtgtggtttgcagggggctaggaggagggctggagggaggcgcgcgggcggaggaggtcccggcggccgtcccggacgggaaccccggcagcgccacacagctaatgcaagagagagagatagaacaaattctgtcaataccgccttcacggcgctccggactctgatccccactgaacccgctgacagaaagctgtcaaagatcgagacattacggcttgctagctcatatattagccacctaggaaacgttctacttgcgggtgaggcttgtggtgatgggcagccctgtcactctgggccagctttctttcatgcagctcgtgctggcagcccacctccgccacctcctcccccacctgcccgggacggtgaaaacactcagcccaaacaaatctgcaccttttgcctatccaatcagaggaagctttccaaagatcgagacaggaagacagctattcggtcatag

SEQ ID NO: 20577 - DNA, 2472 bp, Artificial Sequence
  Description of Artificial Sequence: Synthetic coding sequence
atgaacggcgagcagcagctggacgccgacgccggcagcggcatggaggaagtggaactatcttgggaagactacctagaggaaaccggctccactgccgtaccgtacggatcttttaagcacgtggacacgcgtctccagaatggctttgctcctggcatgaaacttgaggtggcagtcagaaccgacccggaaacatactgggtcgccaccgtgattaccacatgtgaacaactgttactgctgaggtacgacggttatggagaggaccgaagagctgatttctggtgcgacattagaaaagccgatctgtaccccattggctggtgtgagcagaataagaagactctggaagccccagaaggtatcagggataaagtgagtgactgggatgagttcttaagacagacgctgatcggcgcttgtagtcctccagtgcccctgctggagggccttcgcaacggtaggaaccctctggacctgatcgcgcctggctcgcggctggaatgccaggcgtttcaggactcgctgtctacttggatagtgaccgtggtggaaaatattggaggtagacttaagttgcggtacgaaggtctggaatcctcagataattacgagcattggctctattatctggaccctttcctgcaccatgtgggctgggcagctcagcagggctatgaactgcagcccccatctgctattcgccacctaaaaaatgaggctgagtggcaagagattctcgcaaaggtgaaggaggaagaggaggaaccactgccaagttatttgtttaaggataagcaggtgatcggaattcacaccttctccgtaaacatgaaactggaagccgtggacccttggtcaccatttggaatttcacccgcaacagtggtgaaggtgttcgatgaaaaatacttcctggttgaaatggatgaccttcgccctgagaatcacgctaggagatccttcgtctgccatgccgacagccccggcatttttccggtacagtggtcactaaaaaatggcctgcacatcagtccacctcctgggtacccctcacaggacttcgattgggccgactaccttaaacagtgtggcgcagaggcggctccacagagatgtttcccccctctaatttcagaacatgagttcaaggagaacatgaaactcgaggcggtcaacccaatccttcctgaagaagtgtgcgttgcaactatcaccgcagttcgcggaagctatctttggctgcaactcgagggatctaaaaaacccattccggaatgtatcgtgagcgtcgagtcgatggacatcttccccttgggctggtgtgaaaccaacgggcacccactatctaccccacggcgtgcccgagtctacaagcagcgaaagatagccgtcgttcagcccgagaaacaagtgccttccagcaggacagtacacgaaggtctgcgcaaccaggagctgaacagtacagagtccgttatgattaacgggaaatactgttgtcctaaaatctacttcaatcacagatgcttttcaggaccatatctcaacaaaggcagaatcgccgaacttcctcagtgcgtcggccctggtaactgtgtgctcgtcttacgggaagttctaaccctgctcattaacgcagcttataagccgagccgtgtgttgcgcgaactccagctggataaggattccgtctggcatggatgcggagaagttctaaaagccaagtacaagggcaaatcttatcgagccaccgttgagattgtaaagactgctgaccgggtgacagaattctgtcgccaaacctgtataaaactggagtgctgccccaacctctttgggcctaggatggtgctggataagtgttcagagaattgctccgtgctgaccaagactaaatatactcattattatgggaaaaagaaaaataaacgtatcgggaggcccccaggcggacactctaatctcgcatgcgcacttaagaaggcctcaaagaggcgcaagaggcgtaagaacgtcttcgtgcacaagaagaagcgctcctcagcgagtgtcgacaatactccagccggctcacctcaggggtctggtggcgaagacgaagacgatcccgacgagggcgatgatgatagtctctcagaaggctctacaagtgagcaacaagatgagttgcaggaagagtctgagatgtcggagaagaaaagttgctcttcttctccgactcagtccgagatcagtacgagccttccacctgatcgacagcgtcggaaacgtgagctgaggaccttttcgttctccgacgacgagaacaagccgccatcacctaaggagatcgatggtcaggcgctgctgttactgaccctccccactgtgcaggagtgtatggacctgaagttgggccctgctatcaagctgtgtcaccacattgaacgaataaagttcgccttctatgaacaattcgcgaactag

SEQ ID NO: 20578 - DNA, 2601 bp, Artificial Sequence
  Description of Artificial Sequence: Synthetic coding sequence
atgaacggcgagcagcagctggacgccgacgccggcagcggcatggaggaagtggaattatcctgggaggattatctcgaggaaacaggatccacagcagtaccttatggatccttcaagcacgtggacacaaggctccaaaacggcttcgctccaggtatgaaactagaggtggccgttaggaccgacccagaaacttattgggtcgccactgtgattacgacatgcgaacagctcctcctgttgagatatgatgggtatggcgaagacaggcgggcagacttttggtgtgatatcaggaaggcagatctctaccccatcggctggtgtgagcaaaacaaaaaaacactcgaggctcccgaggggatcagagacaaggtcagtgattgggacgaatttctccggcaaaccttaataggggcgtgcagcccccctgtgccccttcttgaagggttgcgtaacggaagaaatcccttggacctgattgctcccgggagtagactagagtgccaggccttccaagattctctgagtacctggatcgtgacggtggttgagaacatcggaggccgcctgaagctaagatatgagggactcgagtcctccgataattatgaacattggttatactacttggacccttttctacaccatgtgggctgggccgctcagcaggggtatgaattgcaaccacctagtgctatccgccatctgaaaaacgaagccgagtggcaggagatcctagctaaggtgaaagaagaggaggaggagcctctaccatcctaccttttcaaggataagcaagtgatcggcatccatacctttagtgttaatatgaagctggaggccgtagacccctggtctcccttcggaattagccccgccactgtggtcaaagtcttcgacgagaaatatttcctcgtcgagatggacgacctgcggcccgaaaaccacgctcgccgaagttttgtgtgccacgccgattcgcccggcatcttccctgtacagtggtcactgaagaatggcctgcacatttcacctccgccaggctacccttcacaggactttgactgggctgattacttaaagcagtgcggcgccgaggccgctccgcagaggtgctttcccccgttgatctcggagcacgagttcaaggagaatatgaaactggaggctgtaaatcctatcttacccgaagaggtatgtgtcgctaccatcacagccgtcaggggaagttacctgtggctccagctcgaaggcagtaaaaagcctattcctgaatgcatcgtgtcagtggaaagcatggacattttccctttagggtggtgtgaaaccaacggtcatcccctgtccacaccacgccgagctcgggtgtataaacagcgaaaaattgcagtagttcagcccgaaaaacaggtgccatctagtagaactgtgcacgaagggcttaggaaccaggagttaaattctacagagtctgtgatgataaacggcaagtattgttgccccaagatttattttaatcatcgctgctttagcggcccctacctcaataaaggtagaattgctgagcttcctcagtgcgtggggccaggaaactgtgtactagttctgcgtgaggtcctcaccttgttaatcaacgccgcctataaaccttcaagggtcctgcgcgagctccagctcgacaaggattctgtgtggcatggctgtggggaagtgctcaaggctaagtataaaggcaaaagctatagagccaccgttgaaattgtgaagacggcagatcgggttactgaattctgccggcagacctgcatcaagctggagtgttgccctaatctttttggaccgcggatggtgttggacaagtgttctgaaaattgttccgtcctgacaaagaccaaatacacccactactatggcaagaagaagaacaagcggatcggcaggccacccgggggccactcgaatttggcttgcgcactgaagaaggcctccaagaggaggaagcgccgaaagaacgttttcgtacacaagaagaagagatcctccgcctctgtcgacaacacacccgctgggtccccccaaggatccgggggtgaagacgaggatgatcccgatgagggggatgatgattcactgagtgaagggtcgactagtgaacagcaagacgagctgcaggaggaaagtgagatgtcagagaagaaaagctgttcctctagccctacccagagcgagatcagcacgagcctgcctcctgacagacaacgtcgcaagagagaattgaggacctttagctttagtgacgacgagaataaaccaccttctcctaaggagattagaatcgaggtcgcagagcgactacacctggacagcaacccgctcaagtggtccgtcgcggatgtggtgaggtttatcagaagcactgactgtgcacccctcgccagaattttcttggatcaggagatagatggccaggcactgcttctcctgaccctccccaccgttcaggaatgtatggacctaaaactcggccctgccatcaagctgtgtcatcatattgagagaatcaaattcgccttctacgaacagttcgcaaactag

SEQ ID NO: 20579 - DNA, 2601 bp, Artificial Sequence
  Description of Artificial Sequence: Synthetic coding sequence
atgaacggcgagcagcagctggacgccgacgccggcagcggcatggaagaggtcgagctgagttgggaggattaccttgaggagactgggagcaccgctgtcccctacgggtcctttaagcacgtggacaccagactgcagaatggcttcgcgcccggaatgaagttggaggtggctgtccgaactgatccagagacttactgggtggctactgtgataacgacctgtgaacagttactgcttctgcgatacgacggctatggggaagataggcgggctgatttctggtgcgacatccgaaaggcggatttataccctattggctggtgcgaacagaataagaaaacactcgaggcccccgagggcatcagggataaggtgtccgactgggatgagtttctacggcagaccctcattggcgcttgttctccacctgtgccactgctggaaggcctgagaaatggaaggaatccactggatctgatcgccccaggcagccggctagaatgccaagcctttcaagactctttgagcacttggatcgttaccgttgtggagaacatagggggacggctgaagctgagatacgaggggcttgagtctagtgataactacgaacattggttgtactacctggacccgtttctacaccacgtaggttgggctgctcagcaaggatacgagctccaacctcctagcgctatccgccatcttaagaacgaggcagaatggcaggagatattggcgaaagtaaaggaggaggaggaagagcccttgccatcctacttgtttaaggacaaacaggtaatcggcatccacaccttctccgtgaacatgaagctggaagccgtggatccatggagcccattcgggatctcacccgctacggtggtgaaagtattcgacgagaagtacttcctcgtcgaaatggatgatctgcggcccgagaaccacgccaggaggagtttcgtctgtcacgccgacagccctgggattttccctgttcagtggagcctaaagaacgggctgcacataagccccccccctggatatcccagtcaagatttcgattgggctgactatcttaagcagtgcggggcagaggccgccccccagaggtgctttccccccctaatatcagaacacgaattcaaggaaaatatgaagctcgaggctgtaaaccccatcctgcccgaagaggtttgtgtggcgaccatcacagccgtccggggcagttacctctggcttcagctggaagggtccaaaaagcccattccagaatgtatcgtctctgttgaatctatggacattttccccctgggttggtgtgagacgaatgggcacccactgtcaacccctcgaagagccagagtgtataagcagcggaaaattgccgtggtgcagcctgagaagcaggtgccgagcagtcggactgttcacgaaggcctgcgaaatcaagaactgaacagcactgaatcagtaatgatcaacggcaagtactgctgtcctaaaatctactttaatcaccggtgcttcagtggtccatacctgaataaagggagaattgctgagcttccacagtgtgtgggcccaggtaattgtgtactggtccttcgcgaagtgctaactcttctcatcaacgccgcttataagccctcacgggtgctccgcgagttgcagctggataaagattccgtgtggcacgggtgcggcgaggttctcaaagcaaaatataagggtaagtcctacagggctaccgtcgaaattgtaaagactgctgatcgcgttacagagttctgcaggcagacatgtatcaaattggaatgctgccctaacttgtttggtcctcgtatggtgctggacaaatgttcagaaaattgttctgtactgacaaagacgaagtatactcactactacgggaagaaaaagaacaagagaatagggcgaccgcccggcggccattccaatctcgcttgtgccctcaagaaagccagtaagcggagaaagagacgcaagaatgtgtttgtgcataagaagaagagaagttccgccagtgtggacaacaccccagccgggagcccacaggggtccggaggagaggacgaggatgaccccgacgagggggatgacgacagtctgagcgaaggttcaaccagtgaacagcaggacgagttacaggaagagtctgaaatgagcgaaaagaagagctgtagcagtagccccacccagagcgaaatcagcacgtctttgccaccagatagacagcgccgtaagcgggagctaagaaccttttcattttcagatgacgagaataagcccccatcaccaaaggaaatccgcattgaggtggccgaacggctccatctggattcaaatcccctgaagtggtcagtcgccgatgttgttcggtttatccggtctaccgactgtgccccactggctcgcattttcttagatcaagaaatcgacgggcaggctcttctccttctgacactgccaactgtgcaggagtgtatggatctgaagctggggccggcgatcaagctgtgccatcatatcgagagaattaagttcgcgttttacgagcagtttgccaactag

SEQ ID NO: 20580 - DNA, 2601 bp, Artificial Sequence
  Description of Artificial Sequence: Synthetic coding sequence
atgaacggcgagcagcagctggacgccgacgccggcagcggcatggaggaagtggaactatcctgggaggactatctggaagagacagggtcgaccgccgtaccctacggatcattcaagcacgttgataccagactccaaaacggctttgccccagggatgaaactggaagtggctgtcagaactgacccggagacatactgggtggcgactgttataactacttgtgaacagctgctgcttttgagatatgacggatacggcgaggacaggagggcagacttttggtgtgacattcgcaaagccgacttgtaccccattggctggtgcgaacagaataaaaaaactttagaggctcctgaaggtattcgcgataaggtttcggactgggatgagttcctgcggcagaccctgatcggtgcatgctcacctccggtgccacttctggaaggcttgcgtaatggacgtaaccccctcgatctgattgccccaggttcccgcctggaatgtcaggcattccaggactctcttagtacgtggatagttaccgttgtcgaaaacatcggcggccgcctcaagttaaggtacgaggggttagaatcttccgataactacgaacactggctatactacctggatccttttctgcaccacgtcggatgggccgcccagcaagggtatgagttgcagcccccatccgcaatccggcatcttaaaaacgaagccgagtggcaggaaatccttgccaaggtgaaagaggaagaggaggaaccgctgccaagttatctctttaaagacaagcaagtgataggaatacacactttctccgttaacatgaagctggaggctgtagacccctggtcgcctttcggcatcagtcctgctaccgtagtcaaagtctttgatgaaaaatatttcctcgtagagatggatgatctgaggcccgaaaatcatgctcgccggagctttgtctgtcacgcagattccccaggtatcttcccagtccagtggagtctgaaaaacggtctgcacatttctccgccccccggttacccatcacaggacttcgattgggccgattatctcaagcagtgtggggcggaggccgccccccagcgctgtttccccccactcatttccgagcatgaattcaaagaaaacatgaaactggaggcagtgaacccaattttaccggaggaggtatgtgtagccactatcacagccgtgcggggatcttacctgtggctacagttagaggggtctaaaaaaccgatcccagagtgtattgtttccgttgagtccatggacatctttccgttgggctggtgtgagactaacggccaccctttatccactccacgtcgggccagagtgtacaaacagcgcaagattgccgtcgttcagccagaaaaacaggtgcctagttccaggactgtgcacgaaggtcttcggaatcaggaactaaactccactgaaagcgtgatgattaacggtaagtactgctgtcccaaaatatacttcaatcataggtgcttttccggtccttacttgaataagggacgcatcgccgaactcccacagtgcgtgggcccagggaattgtgtcctggtgctcagggaagttctgacactgctaatcaatgccgcatataagccttcccgcgtgctcagagaattacagcttgataaagacagcgtctggcacggatgcggcgaggtcctaaaggccaaatataaaggcaagagttaccgcgcaactgtcgagatcgtgaagaccgctgacagagtaacagagttttgtaggcagacatgtatcaaacttgaatgctgtcctaacctgttcgggcctcggatggtgctggataagtgtagtgagaattgcagcgtgttgaccaaaacaaaatatactcactattatggcaagaaaaagaataagaggatcggccgtcctcccggggggcactccaatctagcctgcgcgctgaagaaggcgagcaaacgtaggaaacggcgcaagaacgtgttcgtgcataagaagaagagaagttccgccagcgtcgacaacacgcccgccgggagccctcagggcagcggcggggaagatgaggatgaccccgatgagggagatgacgactccttgtcggagggctctactagtgaacagcaagacgaactgcaggaggagagtgagatgagcgagaaaaagtcatgttcatccagtcccacgcagagtgagatctctacaagtcttccccctgatagacagcgccgtaaaagagaactcagaactttcagcttttcagatgacgagaataaaccaccgtctcccaaagagatacggattgaagtggccgagcgcctgcatctggacagcaatccactgaaatggagtgtggccgacgtcgtacgatttattcgtagtacagattgcgcccctttggcacgtattttcctggaccaggagatcgacggccaggcactcctgctcctgactctccctaccgtgcaggagtgtatggacctaaagctgggccccgcaatcaaactgtgtcatcatatcgagcggatcaaattcgctttctacgagcagttcgccaactag

SEQ ID NO: 20581 - DNA, 366 bp, Artificial Sequence
  Description of Artificial Sequence: Synthetic coding sequence
atgaacggcgagcagcagctggacgccgacgccggcagcggcatggaggaggtggagctctcatgggaagactacttagaagaaaccggcagtaccgcagtgccgtacggctcctttaagcatgtggatacacggttacagaacggtttcgctcctggaatgaaattagaggtagcagtgaggaccgatcccgagacctactgggtcgccaccgtcatcacaacatgcgagcagctgctattgctcagatacgatgggtacggagaagaccgtcgtgctgacttctggtgtgacatcagaaaagccgacctctaccctataggctggtgtgagcagaacaagaagacacttgaagcaccagagtag

SEQ ID NO: 20582 - DNA, 285 bp, Artificial Sequence
  Description of Artificial Sequence: Synthetic coding sequence
atgaacggcgagcagcagctggacgccgacgccggcagcggcatggaggaggtagagctgagttgggaggattacctggaagagacaggctcaacggccgtgccttatggcagtttcaagcatgtcgataccagacttcagaatgggtttgctcccgggatgaagctggaagtcgccgtgcgcacagatcctgagacatactgggtggctactgtcataaccacatgcgagcaactcctgttgctgcggtacgacggatatggtgaggatcgaagggctgactag

SEQ ID NO: 20583 - DNA, 153 bp, Artificial Sequence
  Description of Artificial Sequence: Synthetic coding sequence
atgaacggcgagcagcagctggacgccgacgccggcagcggcatggaagaggtagaactgtcttgggaggactacctggaggagacgggctccaccgctgtcccttacggctcttttaaacacgttgacactcggttgcagaatggcttttag

SEQ ID NO: 20584 - DNA, 2685 bp, Artificial Sequence
  Description of Artificial Sequence: Synthetic coding sequence
atggagagcaccctgagcgccagcaacatgcaggaccccagcagctcgcccctggagaaatgtttgggcagcgcaaatggcaacggcgacctagattctgaggagggatcatccctggaggagaccgggtttaattggggagagtatttggaagagaccggggcctctgcagccccccacacaagctttaagcatgtggagatatccatacagtccaattttcagcccggaatgaagctggaagtcgccaataagaacaacccggatacttattgggtagctacaatcattactacgtgcggacagctcttactccttaggtattgcggctacggtgaggatcggagggccgatttttggtgcgatgtggtgatcgcagatctgcatcctgtcgggtggtgcacccagaacaataaggtcctaatgcctccagatgccatcaaggagaaatatacggactggaccgagttcctgattcgagacttgacgggctccaggacggcacccgcaaacctcctggagggtccactcagaggaaagggccccatcgatctaattacggtggggagcctgatcgaacttcaagattcgcagaacccttttcagtattggatcgtatccgtgatagagaacgtgggcggcaggttgcgcttgcgttacgtcggactggaagacaccgagtcatacgaccaatggctcttttacctggattaccgcctgagacctgttggttggtgccaggagaataagtaccgcatggacccccccagcgaaatttatccactgaaaatggcctctgaatggaagtgcactctcgagaagtcactcatcgatgctgccaagttccccctccccatggaggtttttaaggaccatgccgacctgagatctcatttttttactgtgggcatgaagctcgagactgtgaacatgtgcgaacctttctatatctctcctgcgtctgtcactaaagtattcaacaatcacttttttcaggttaccatcgatgacttacgacctgagccctccaagttatccatgttatgtcacgccgacagccttggaatactgccggtccagtggtgtttaaaaaacggtgtttcactgacgcctcccaaaggctattcgggccaagattttgattgggcagattatcacaagcagcatggcgcgcaggaagctccaccattttgcttccggaatacgtctttctctagggggtttacaaagaatatgaagctagaagcagtaaacccgcgcaatcccggagagctttgtgtagccagtgtggtttctgtgaaaggccgcctcatgtggctgcaccttgaggggctgcagacccccgtgccagaggttatagtggacgtggaaagtatggatatatttcccgtgggatggtgtgaagcaaacagctaccccctaacggcaccccacaagaccgtatctcagaaaaagcgaaagatagctgtggtgcagcctgaaaaacagctgccgcccacagtgccagtaaaaaagattcctcacgacttgtgcctgtttcctcacctggacactactggcaccgttaacgggaagtactgttgtccacagctgttcatcaatcacaggtgtttttccggaccttatctgaacaaaggtcgcatcgccgaactgcctcagagcgtgggacctgggaagtgcgtcctcgtcctgaaagaggtactcagcatgatcataaacgccgcttacaaacctggcagggtgctgcgcgagctccagctagtggaagacccacattggaactttcaagaggaaacccttaaggcgaaataccgcgggaagacttacagagccgtggtgaagattgtgaggacttctgaccaggtggcaaacttttgtcggcgagtgtgtgcgaagctggaatgctgtcctaacctgttctcccctgtgctgataagcgagaactgccccgaaaactgctcaatccacaccaagacaaagtacacatattactatgggaaaaggaagaaaattagtaaaccacccataggggaatctaatccagactccggccaccccaagcctgcccggagacggaagagacgaaagtctatatttgttcagaagaaaagacgctcatcagcagtggattttacggccgggtcaggagaagagagcgaggaagaggatgccgacgccatggatgatgacaccgctagtgaggagacaggcagtgagttacgggatgaccagactgataccagctcagccgaagtcccttccgcacgcccaagacgggctgtcaccttacgctctggtagcgagcctgtaaggcgtccgcctcccgagagaacccggcgaggccgaggcgcccctgctgccagttctgcagaggaaggggaaaagtgcccacccacaaagcctgagggtacagaggacacgaaacaggaggaagaggagcgcctggtactagagtcaaaccctctggagtggactgtgacagacgtggtgcgctttataaaactcacagactgcgcacccctggccaagatctttcaagaacaggatatcgacggccaggctctacttcttctcactctcccaactgtccaggagtgtatggagctcaaacttgggccagcaattaaactgtgccaccagatcgagagagtcaaggtcgccttctacgcccagtatgccaactag

SEQ ID NO: 20585 - DNA, 483 bp, Artificial Sequence
  Description of Artificial Sequence: Synthetic coding sequence
atggagagcaccctgagcgccagcaacatgcaggaccccagcagcagtccacttgaaaaatgcctgggaagcgctaatggcaacggagaccttgactccgaggaggggagttctctcgaagagacaggatttaactggggggaatacctggaggagacaggggcctctgcggcccctcacaccagttttaagcacgtggagattagtatccagagcaacttccaacccgggatgaagcttgaggtcgccaacaagaacaaccccgacacctactgggttgcaaccatcattaccacctgtgggcagctgctgctgttgaggtactgcgggtacggtgaggaccggcgagcagatttctggtgtgacgtggtgatcgccgatctacatcccgtgggctggtgcacacagaacaacaaagttctgatgccccccgacgtcgaaagcgacgtgaagccgtctgcctccgtgcagcatatctcgtag

SEQ ID NO: 20586 - DNA, 561 bp, Artificial Sequence
  Description of Artificial Sequence: Synthetic coding sequence
atggagagcaccctgagcgccagcaacatgcaggaccccagcagcagccccctggagaagtgccttggatccgctaacggcaacggtgaccttgacagcgaggagggcagttcgctggaggagacaggattcaattggggtgaatatctggaagaaaccggcgcgagcgcggctccgcacactagcttcaaacacgtggagatatccattcagtcaaactttcagccgggaatgaagctcgaagttgcgaacaaaaacaatcccgacacttactgggttgcaactatcataacaacgtgtgggcagctgctacttttaaggtactgtggctatggggaggaccgaagggccgacttctggtgtgatgttgtgattgccgatctgcaccccgttgggtggtgcacccaaaataacaaagtactcatgccccctgatgcgatcaaagagaagtacacggactggacagagtttctaattcgcgacctcaccggcagccgaacagcgcccgccaatctgctcgaaggggtatgtatcgtggtgatccatctgatgtatctgtag

SEQ ID NO: 20587 - DNA, 483 bp, Artificial Sequence
  Description of Artificial Sequence: Synthetic coding sequence
atggagagcaccctgagcgccagcaacatgcaggaccccagcagctctccactggagaagtgtctaggaagtgctaatggcaatggcgacctggacagcgaagagggctcatccctggaagagaccgggtttaactggggcgagtatcttgaggagacaggcgcctcggccgccccgcatacctccttcaaacacgtcgaaatcagtatccagagtaactttcagcctgggatgaaattggaagtggccaataagaacaatcctgacacatactgggttgccacaattatcacaacctgcggtcagttgctattattaaggtactgtgggtacggagaggatcggcgggccgacttttggtgcgatgtagttattgcagaccttcatcccgtgggctggtgtacacagaacaataaggttctgatgccccccgatgttgagtctgacgtgaaaccatcagcctcggttcagcacatatcctag

SEQ ID NO: 20588 - DNA, 2685 bp, Artificial Sequence
  Description of Artificial Sequence: Synthetic coding sequence
atggagagcaccctgagcgccagcaacatgcaggaccccagcagctcaccactcgaaaaatgtctgggctccgcaaacggtaatggggacctggactccgaagaaggctcttcccttgaggagactgggttcaattggggtgaatatctggaagaaacgggggcctccgcagctccacacacctcatttaagcacgtggagatctccatccagtcaaattttcagcccggcatgaaactggaggtggcgaacaagaataaccccgacacatactgggtggcgaccattattacaacctgtggccagctgctgcttctaagatattgcgggtatggtgaggatagacgtgccgatttttggtgcgacgttgtgattgcagacttgcacccggttggatggtgcacccagaataataaggtactgatgccacctgatgccatcaaagagaaatacaccgactggacggaattcctgattcgggatctgaccggctcccggactgcccctgcaaatttactggaaggccctttacgtggaaagggccctatagatttaattacggttggttctttgatcgagctccaggacagccagaaccctttccagtattggattgtgtcggtgattgagaatgtgggagggagactccggctccggtatgtgggattggaggataccgaatcctatgatcaatggctgttttatctggactaccgcctgcgccccgtagggtggtgccaggaaaataaataccgaatggatccaccctccgagatttaccctttaaaaatggcgtccgaatggaaatgcacactcgagaaatcactcatcgacgcagctaaattcccactccctatggaggtattcaaagaccatgcagatctgcggtctcactttttcactgttggtatgaaactcgaaaccgtgaatatgtgtgagcccttctacatcagtcctgcttcagttacaaaggtgttcaacaaccactttttccaggtgaccatcgacgatcttaggcctgaaccatctaagctgtctatgctgtgccacgcagattccctcgggattctgcccgtgcagtggtgtctcaagaatggtgtgagcctcacccctcccaagggttacagcgggcaggactttgactgggctgattaccacaagcagcacggtgcacaagaagccccccctttttgcttccgcaatacttcttttagtcggggattcaccaagaacatgaagctagaggcagtgaacccccgcaatcccggggagttgtgtgtcgcttccgtagtaagtgtaaaggggagacttatgtggctgcatttggagggcctgcagactccagtgcctgaagtcatcgtggacgtggaatcaatggatattttccccgtggggtggtgtgaagccaacagctaccccctgaccgctccacacaagactgtgagtcagaagaaacggaaaatcgctgtcgttcagcccgagaaacagctcccccctactgtgccagttaagaagattccgcacgacctctgtttattccctcatctggatacaacaggaacagtcaacgggaaatattgttgccctcagttgttcatcaaccacaggtgcttcagtggcccgtatctaaataagggtcggatcgccgaactgccccagagcgtgggtcctggcaaatgtgtattagtgctcaaagaggtgctgtccatgatcataaacgcagcttataaacctgggcgcgtgctcagagagctccagttggtcgaggatcctcactggaacttccaagaggaaacactaaaggctaaatatagggggaagacataccgcgccgtggtcaagattgttcgtaccagtgaccaggtcgcaaacttctgtcgcagagtatgcgcaaagctggagtgctgtccaaatcttttttcacccgtgctcatcagtgagaactgcccagagaattgtagcatccacaccaagacaaagtacacatattactacgggaagcgtaagaagatctctaaaccgcctatcggtgaatccaaccctgattcaggacaccctaagccggcccgacggagaaaaagaagaaaaagtatcttcgtgcagaagaagcgcaggagctctgctgtggatttcaccgcaggttctggagaggagagtgaagaggaggatgctgacgcgatggatgacgataccgcgtcagaagaaaccggtagcgagctccgggacgaccaaaccgatacctcaagcgccgaggtgccaagcgctagaccaagaagagctgtgacactgaggtccggatcagaacctgtgcggagacctcctccggaaagaacccgcagaggtaggggcgcacctgctgcttccagtgcagaagagggcgaaaagtgccctccaaccaagcctgagggaaccgaggacacaaagcaggaggaggaagaaagactcgtgctggaaagcaatcccctggagtggaccgtgaccgatgtagtgcgatttatcaagctaaccgattgcgcccccttggccaaaatctttcaggagcaagacatcgacggccaggctctgctcctcctgaccttgccgacagtgcaagagtgtatggagctgaagcttgggccagctattaaactgtgtcaccagatcgaacgtgtaaaggtggccttctacgcacaatacgccaattag

SEQ ID NO: 20589 - DNA, 924 bp, Artificial Sequence
  Description of Artificial Sequence: Synthetic coding sequence
atgccccggagcttcctggtgaagaagatcaagggcgacggcttccagtgctcaggggtgccagccccaacataccatccacttgagacggcgtatgtactgcctggcgcgcgtggcccccctggagataatggatacgctccgcacagactccctcctagctcttacgatgctgatcaaaagccagggctcgaactggccccggcagaacctgcctacccccccgcggccccagaggagtacagcgacccagagtcaccccagagcagtttgtcagctagatacttccggggagaggcagctgttacagactcctactccatggatgcctttttcatcagtgacggaaggtctcgcaggaggagaggcggaggtggaggggatgccggcggttccggtgacgctgggggcgccgggggaagagccggacgcgccggggctcaagctggcggggggcaccgtcatgcctgcgccgagtgcggcaaaacgtacgctaccagtagcaacttgagccgccacaagcagacccacagatcacttgactctcaactggcgcgaaagtgtcctacatgcggaaaagcctacgttagcatgccagcccttgccatgcatctcctcacccacaacctgagacacaagtgcggagtttgcggaaaagctttttctcgcccctggctgttacaaggccatatgagatcccatacaggtgagaagcctttcggctgcgcccactgcggcaaggctttcgctgacagatcaaacctgagggcgcatatgcagacacattccgcgttcaagcactatcgctgccggcaatgcgacaagtctttcgcgctcaaatcttacctacacaagcattgcgaggccgcctgtgccaaggcagcagagcctccgccacctacgccagccggtccagcttcttag

SEQ ID NO: 20590 - DNA, 2064 bp, Artificial Sequence
  Description of Artificial Sequence: Synthetic coding sequence
atgagcaaccggaacaacaacaagctgcccagcaacctgccccagcttcagaatctgatcaaaagagacccaccggcctacatcgaggaattccttcagcagtacaatcactataagagcaacgtcgagatcttcaaactgcagcctaataagccgagcaaagaacttgcagagcttgtcatgtttatggcccagatttcccactgttatccagaatacttatccaatttcccccaggaggtcaaggatcttctctcctgcaaccatactgtcctagaccccgatcttcgcatgactttttgtaaggctcttattctgttgaggaataagaatctaataaacccttcttccttattagaattgttcttcgaactctttcgatgtcacgataagctcctccgtaaaacactgtacactcacatcgtgacagatatcaaaaacatcaacgccaagcataagaacaacaaagtcaatgttgtcttacagaattttatgtatacaatgttgcgagatagtaatgccacagctgctaagatgagcttggatgttatgatcgagctatacagaagaaacatttggaacgatgctaaaaccgttaacgttataacaacagcgtgcttttctaaagtgacaaagatcctcgtggccgcacttactttttttctgggcaaagacgaagatgaaaaacaggattccgactccgagtctgaagacgatggacccactgcacgcgacctcctggttcaatatgcaactggcaagaagagctccaaaaataagaaaaagctcgagaaagctatgaaggtcctgaaaaaacagaagaagaagaagaaaccagaggtatttaatttttcagccattcatcttatacatgaccctcaagacttcgccgaaaagcttctgaagcagctggagtgctgcaaagaacgattcgaggtaaagatgatgcttatgaatctcatatcacgattggtcggtattcatgagctgtttctgtttaatttttatccctttctgcagcgatttctccaaccgcaccagagagaggttacaaagattctgctttttgctgctcaagcaagtcaccacctggtccccccggaaattatccagtccctactcatgactgtagctaataactttgtaaccgacaaaaactccggggaagtgatgaccgttggaattaatgccatcaaagaaataacagccagatgccccttggccatgaccgaggagctgcttcaggacctcgcgcagtacaagactcacaaggacaaaaacgtgatgatgagtgctcgtactttaatccatcttttccggaccctcaatcctcaaatgttacagaagaaattccgaggtaaaccaacggaggctagtatcgaggccagagtgcaagaatatggtgaactcgacgccaaagactacatccctggagctgaggtgctagaagtggaaaaagaggaaaacgctgagaacgatgaggacgggtgggaatctacctctctttcagaagaggaagatgcagacggcgagtggatcgatgtacagcactcaagcgacgaggagcagcaggaaatctccaaaaagctgaattctatgccaatggaagaacggaaggctaaggccgcagctatatctacttcacgagtcctgactcaggaggacttccagaagatccgtatggcccagatgcggaaagagctggatgcagctccaggcaagtctcaaaaacggaaatacattgaaattgactcagatgaagagcctaggggtgagctgctgagcctgcgcgacatcgaaaggctgcataagaagccgaaatcagacaaagaaacgcgccttgcaacagccatggcgggcaagactgacagaaaggagttcgtacgaaagaagactaaaactaatccattctcctccagcacaaacaaggagaagaagaaacaaaaaaactttatgatgatgcgatactcacagaacgtgcgcagcaagaacaagcggtctttcagagaaaagcagctcgccctccgggacgcactactgaaaaagaggaagaggatgaagtag

SEQ ID NO: 20591 - DNA, 786 bp, Artificial Sequence
  Description of Artificial Sequence: Synthetic coding sequence
atgagccggtacacccggccccccaacaccagcctgttcatccggaacgtcgctgatgctacaaggccggaggatcttcgacgagagttcggacgatatggaccaattgtggacgtgtatatcccattagacttctatacgaggcgcccccggggtttcgcatacgtgcagtttgaggacgtgagagatgcagaagacgctctgtataatctcaatcgcaagtgggtgtgtgggcgacaaatcgagatccagtttgctcaaggagaccgtaaaacacccggtcagatgaagtcaaaggagaggcacccctgcagtccatccgatcaccgcagatcacgttcaccatcgcagagaagaactcgcagccggagcagcagctggggtcgtaaccggcgtaggagcgactcactgaaggagtcaaggcatagacgtttctcctattcccaaagcaagtcccgcagcaagtctcttcctcggcgtagtacctctgcccggcagtctaggactccgcggcgaaactttggatcccggggaagaagtaggtcaaaaagcctgcagaagcggtccaaaagtattgggaagtctcaaagttcgagccctcagaagcagacaagttccggaaccaagtcccgaagccatggaaggcatagcgacagtattgcccggagtccatgcaaatcacctaagggatacaccaactctgagacaaaggttcagacagccaaacactcccacttccgttcacacagccgcagccgatcttatcgccacaagaatagttggtag

SEQ ID NO: 20592 - DNA, 1245 bp, Artificial Sequence
  Description of Artificial Sequence: Synthetic coding sequence
atgatccccctggagaagcccggcagcggcggcagcagccccggcgccacatcaggctctggacgcgctggacggggtctgtccggtccgtgtcgaccccccccaccaccccaagcccgtggactcttgaccgaaattcgtgctgtggtcaggaccgaaccattccaagatggatacagtttatgtcctggaagagagctaggaaggggaaaatttgcagtggtgcgcaagtgtataaaaaaggacagtggtaaagaatttgctgcaaaattcatgagaaagcgacgcaagggacaagattgtcgaatggaaatcattcacgaaatcgctgtgctggagctggcccaggacaacccctgggtgatcaaccttcacgaggtttacgaaacagcctctgagatgatccttgtcctcgagtacgcagcagggggcgagatctttgatcaatgcgtggccgaccgagaagaggccttcaaggaaaaagacgttcagagacttatgcggcagatcctggagggcgtccattttctgcatacccgtgacgttgttcaccttgatctgaagccccaaaatatcttgctgacctccgaaagcccattgggagatataaaaattgtagatttcggcctgagccggatcctaaagaatagtgaggagctgagagagatcatgggaacccctgagtatgtcgcacctgagatcctgtcctatgatccaatctccatggcgacagacatgtggtccataggagtcctcacttatgtgatgctaacagggatcagccctttcctcgggaacgacaaacaggagaccttcttgaacattagtcaaatgaatttgagctattccgaggaggagtttgacgtcctcagtgaatctgccgtcgacttcataagaaccttgcttgtgaagaaacccgaagatagggctactgcagaggaatgtctcaagcacccatggttgacgcaatcttcgattcaagaacccagtttccgcatggaaaaggctctcgaggaggctaacgccttgcaggaagggcacagtgtaccagaaatcaactcagataccgacaaatccgaaaccaaagagtccatcgtaacagaagagttgatcgttgtgacaagttacacgctgggccagtgcaggcagtcggagaaggagaagatggaacaaaaagctatcagcaaacgattcaaatttgaagagcccctgctccaggaaattcctggcgaattcatctattag

SEQ ID NO: 20593 - DNA, 1062 bp, Artificial Sequence
  Description of Artificial Sequence: Synthetic coding sequence
atgagcctgcacacccagtacctggagagcttcctgcggagccagttctacatgctgcgcatggatggacccctccccctgccataccggcactacatagctatcatgaagctggtgaagacaggcgaaaataactggagtctgccagaattggtccatgcagtggttctgctggcccactaccatgccctggcctcattcgtttttggatcaggaattaaccccgaaagagaccccgagatttccaacggctttcggctaattagcgttaacaacttttgtgtctgtgacctggccaacgacaataatattgagaatgcctcactctcaggttctaactttgggatcgtagattccctgagcgagttggaggcactgatggaaagaatgaagagactgcaggaagaacgcgaagatgaggaggcaagccaggaggaaatgtcgacccggtttgagaaagagaagaaggagtctctgttcgtggtgtctggagacacattccactctttccctcatagtgatttcgaagacgacatgatcatcacctccgacgtttctcgctatatcgaagatcccggctttggttacgaggattttgctagacgaggagaagaacacttgccgacttttcgtgctcaggactatacatgggaaaatcatggtttttctctcgtgaaccgattgtattcggatatagggcacttgctggatgagaagttccggatggtctacaacctcacatataacaccatggcaactcacgaagacgtggataccactatgctgaggcgagcactttttaattacgtgcactgtatgttcgggatccgatacgacgactacgactatggagaagtgaaccaattgctagaacggtctctgaaagtgtacatcaagacagtaacctgttacccagagcgcactaccaaacggatgtatgactcatactggagacagttcaagcatagcgaaaaggtccacgtgaatctgttgctgatggaggcaagaatgcaagctgaattactctacgcgctgagggctatcaccaggcacttaacttag

SEQ ID NO: 20594 - DNA, 954 bp, Artificial Sequence
  Description of Artificial Sequence: Synthetic coding sequence
atgaaccggggcggcggcagccccagcgccgccgccaactacctgctgtgtacaaattgccgaaaagtacttaggaaggataaacggatcagggtgagccaaccacttaccagaggaccctctgccttcattcccgagaaggaagtcgtccaggccaacacagtcgacgagaggaccaatttccttgtggaggaatatagtactagcgggcggctggataacatcactcaagtgatgagtctgcacactcagtacttagagagttttcttaggtcgcagttctacatgctgagaatggacggccccctgcccttaccctataggcactacatcgctataatggcggctgccaggcaccagtgctcgtacttaataaatatgcatgtggatgagttcctgaagaccggcggcatcgccgagtggctgaatggactggaatatgtgccacagcgactgaagaacctgaacgagatcaacaagctgttagcacacagaccatggttaatcaccaaggagcacattcaaaagttggtgaagacaggcgaaaataactggtctctccccgagcttgtccacgcagtcgttttgctagcccactaccatgcattggcctcatttgtgtttggttcaggtatcaaccctgagcgggacccggagatctcaaacggattcagattgatcagtgtcaacaacttttgtgtctgtgacctggccaatgacaacaatatagagaacgcctcccttagcggatccaattttggaatcgtggattccctgtcagagctggaagctcttatggagagaatgaagaggcttcaggaggagagggaggatgaggaggcatctcaagaagagatgtccacccgatttgaaaaggaaaagaaggagtctctgttcgtcgtcagcggcgatacttttcattccttcccgcactctggactgctgaagtattag

SEQ ID NO: 20595 - DNA, 966 bp, Artificial Sequence
  Description of Artificial Sequence: Synthetic coding sequence
atgaaccggggcggcggcagccccagcgccgccgccaactacctgctgtgcacaaattgtcgtaaagtgctccggaaagataaacggatcagggtgagtcagcccctcacacggggcccatccgccttcattccagagaaagaagtcgtacaggcaaataccgtggatgaaaggacaaacttcttggtggaggagtactcaacctctggtcggctagataatattacccaggttatgagtctacatacccagtacctcgagtcgtttctgcgttcacagttctacatgctgcgaatggatggtccactgccgcttccctaccgtcattatatcgctattatggcggccgctaggcatcagtgctcttacctgatcaatatgcatgtcgatgagttcctgaagacaggaggaatcgcagaatggttgaacggcctcgagtacgtgcctcagaggctgaagaatttgaatgagatcaacaaactgttggcccaccgcccttggttgattacaaaggagcacattcagaagctggtcaagaccggagaaaacaactggagcctcccggagcttgtgcacgctgtcgtcttgctggcgcactatcatgccttggcatcatttgttttcgggtccggtataaatcctgagagagatcctgaaatatcaaacggctttaggctaatttctgttaataatttctgcgtctgcgatcttgccaacgataacaatatagagaacgcctcactcagcgggagtaatttcgggattgtggacagcttgtcagagcttgaggctctgatggagcgtatgaagaggctgcaggaggagagggaagatgaggaagcatcccaagaggagatgtccacacgcttcgaaaaggagaagaaggaaagtttgttcgttgtgagcggcgacacattccactcgtttccccattccggggcgtttctccacttctttgccttctag

SEQ ID NO: 20596 - DNA, 1479 bp, Artificial Sequence
  Description of Artificial Sequence: Synthetic coding sequence
atgaaccggggcggcggcagccccagcgccgccgccaactacctgctgtgcaccaactgtcggaaagttctgcggaaggacaagagaatccgagtgagccagccgctaacccgggggcctagcgcgttcattcccgaaaaagaggtcgtgcaggctaacactgtagacgaacggactaactttctggttgaagagtactctacaagtggcaggctggataatatcacacaggtcatgagcctccacacgcaatacttggaatcatttctgcgaagccagttttacatgcttagaatggatggcccactgcccttaccctaccgccactacattgcaatcatggccgcggcacgtcatcagtgtagctacctgattaacatgcatgtggatgagttcttgaagactgggggtattgctgaatggctcaatggcctcgaatacgtcccccaaagacttaagaatctaaatgaaattaacaaactcctggcgcatcgaccctggttaatcaccaaagagcacatacagaaattggtaaagaccggggaaaataactggagtctgcctgagctggtgcacgccgttgttctcctggcccattatcacgccctggcctcattcgtcttcggatcaggcatcaatcccgagagagaccccgagatttccaacggtttccgtctgatctccgtgaacaacttctgtgtgtgcgacttggcaaatgacaataacatagagaatgcatctttaagtggtagcaacttcggaatcgtagactccttgtccgagctcgaggcgcttatggaaaggatgaagcggcttcaggaagaaagggaagatgaggaggccagccaggaggagatgtccaccagatttgagaaggagaagaaagagtcgctgttcgtggtcagcggtgatacttttcactcttttcctcatagtgactttgaagatgacatgattatcacaagcgacgtgtctagatacattgaggaccccggctttggctacgaagacttcgccagaagaggtgaggaacatctgccaacctttagggctcaggactacacttgggaaaatcacggcttttccctggtgaataggctgtattcggacatcggccatttgttggatgaaaaattccggatggtatacaatctcacctacaacacgatggccacacatgaagacgtggataccacaatgcttcggagagctctcttcaactatgtgcactgtatgttcggaatccgatacgacgattacgactatggggaagtcaaccagctcctcgagcggtccttaaaagtctacatcaaaacggtgacctgttatcctgagcggacgacgaaacggatgtatgattcttactggcggcaattcaagcatagcgagaaagtgcacgtgaacctgctgctgatggaggcaagaatgcaagcagaactcctgtacgcgttgcgggcaattacccgccacctgacttag

SEQ ID NO: 20597 - DNA, 891 bp, Artificial Sequence
  Description of Artificial Sequence: Synthetic coding sequence
atgggcaagaagagccgggtgaagacccagaagagcggcaccggcgcaactgccacagtgagccctaaggagattctcaatctcacttctgaactgttacagaagtgttcgtctcctgctcctggtccaggcaaggagtgggaggagtacgtgcagattcgcactttagttgaaaaaatacggaagaaacagaagggcttaagtgtgacgttcgacggaaagagggaagattatttccccgatcttatgaagtgggctagtgagaatggggcctctgtggagggtttcgaaatggttaacttcaaagaagaagggtttggactgagagccacacgcgacatcaaggccgaagaacttttcctttgggtgcctcggaagcttcttatgacagtggagtctgccaagaactccgtattgggcccgctgtattcacaggaccgcatcctgcaggccatggggaacatcgctttagcattccacttgctctgtgaaagggcatcccccaattcgttctggcaaccatatatccagaccctgccatccgagtatgatacaccactgtattttgaggaggacgaggttcgctatctgcagtccacacaggctatccatgatgtgttttctcagtacaagaacactgccaggcaatacgcatacttctacaaggtcatccaaacacacccccacgctaacaagttaccgcttaaggatagtttcacctatgaagattacagatgggccgttagttcagtgatgactagacagaaccaaatacccacggaggacggctctcgcgtgaccctcgcattgataccgttgtgggacatgtgcaaccatacaaatggtctgacccccgaggatagtttcgccttggctgtcgcttccgcatag

SEQ ID NO: 20598 - DNA, 1785 bp, Artificial Sequence
  Description of Artificial Sequence: Synthetic coding sequence
atgggcaagaagagccgggtgaagacccagaagagcggcaccggcgctacagccacagtgagccctaaagagattctgaacctgacatccgagctgcttcagaagtgttctagtcccgcaccaggacctggaaaagagtgggaggaatacgtccagatccgcacacttgtcgagaagattcggaagaagcagaaaggactgagcgtgacttttgacggtaaacgtgaagattatttccctgatctgatgaagtgggcctcggagaacggagcctcggtggagggctttgagatggtcaattttaaagaagagggatttggtctaagggccacgagagatatcaaagcagaggagctcttcctttgggtgcccagaaaactgctgatgaccgtcgagtctgcaaagaacagcgtcttaggccccctctattctcaggaccgcatcctgcaggccatgggcaacattgctctggcctttcatcttctttgcgaaagagcgagtccaaacagtttctggcagccctacattcagacgctcccaagcgaatatgatacacccttgtactttgaggaggatgaggtgagatatctgcagagtactcaggccatccatgacgtatttagccagtataagaacacggctaggcaatacgcttacttctataaagtgatccagacccaccctcatgctaacaagctacccctgaaggattcttttacttatgaagattacaggtgggccgtgagcagcgtgatgactcgacaaaaccagattcccacagaggacggttctagagtgactctggcactgatccccctatgggacatgtgtaatcatactaatggcctcataacgacaggatacaacctcgaagatgaccggtgcgagtgtgtcgctctccaggatttccgagcaggagaacagatttacatcttctatggcaccaggtcaaatgccgagttcgtgattcatagcggtttcttctttgataataactctcatgaccgcgtcaagattaagctgggtgtgtccaagagcgataggctgtatgcaatgaaggctgaagtactggcccgagctgggatacccacaagctccgtgtttgcactacatttcaccgaacctcctatatctgctcaactgcttgcatttctccgtgtgttctgtatgaccgaggaggagctgaaagagcacctccttggcgattctgctatcgacagaatcttcactcttggcaactccgagtttcccgtgtcttgggataatgaggtgaaactgtggacatttctggaagatagggccagcctgctcttaaaaacctataagaccactattgaagaagataagagtgtccttaagaaccacgatctgtctgtacgggccaagatggcaattaagttgaggttaggagagaaggaaatcctggagaaggcagtgaagagcgccgccgtcaatagggagtattatcgccagcagatggaggagaaagcccccctaccaaaatacgaggagagcaatctcggacttctcgaatcaagcgtgggtgacagccgcctacccctggtcttaagaaatctcgaggaagaggccggggtgcaggatgccttgaatatccgggaggctatcagcaaggccaaggcaactgagaacgggctggtgaacggtgagaattctattcccaacggtacaagaagcgaaaatgagtccctgaaccaggagtctaagagagctgtggaagacgctaaaggcagcagctccgactccaccgcaggcgtaaaagagtag

SEQ ID NO: 20599 - DNA, 975 bp, Artificial Sequence
  Description of Artificial Sequence: Synthetic coding sequence
atgcccgagctggccgtgcagaaggtggtggtgcaccccctggtgttgctgtccgtggttgaccacttcaaccgcatcggcaaagttgggaaccaaaaacgagtcgtgggggtccttctcggatcttggcaaaagaaggttcttgacgtgagcaactcattcgcagttcccttcgatgaagatgataaagatgacagtgtctggtttctggaccacgactatctcgagaacatgtacggcatgtttaaaaaggtgaatgccagagaacgcatcgtggggtggtatcatactggccccaaactccacaaaaacgacatcgcgataaacgaactgatgaagcggtattgtcctaatagcgttctcgtgattattgatgttaagcccaaggaccttggccttccaacagaggcctatatctcggtggaggaggtgcatgacgatggcactcccacatccaagactttcgagcacgtaaccagcgagatcggcgccgaggaggccgaggaggtgggggtagaacaccttctcagagatattaaagatacgacggttgggactctgtcccagagaatcacaaaccaggtgcatggccttaaggggctcaactccaaactcctagacatacgttcttatctggaaaaagtagccactggcaaacttcccatcaatcatcagatcatataccaactacaggacgtgttcaacttactgcctgatgtgtcattacaggagttcgtgaaagccttttatctcaaaaccaacgatcagatggtagtagtctaccttgcatcgctgatcagatcagttgttgccctgcacaatcttatcaacaacaaaatcgcaaatagggatgccgagaagaaagagggacaagagaaggaagagtctaagaaagaccgcaaggaggacaaagagaaagataaagacaaagaaaaatcagatgtgaaaaaagaagagaaaaaggagaagaaatag

SEQ ID NO: 20600 - DNA, 1350 bp, Artificial Sequence
  Description of Artificial Sequence: Synthetic coding sequence
atggccacccaggccaagcggccccgggtggccggccccgtggacggcggggacttggatcccgtggcgtgcttcctctcgtggtgtagacgagtagggctggagcttagccccaaagttgctgtgtctcgacaggggaccgtagccggctatggaatggtggcgcgggaatcagtgcaggccggtgaactgctcttcgtggtgcccagagccgctctgctgtcgcagcatacctgtagcattggaggtctgctggaaagagaaagagttgccctgcagtcacaatcaggatgggtgccccttctgctcgcactacttcatgaattacaggcccccgcctctcgatggagaccgtactttgctctatggcccgaactcgggcggctggaacacccaatgttttggcccgaagaggagagacgttgcctgcttcaagggaccggcgtaccggaagctgtcgagaaggatctggctaacataaggtcagagtaccagagtatcgtgttgccattcatggaggcacatcccgacctgttctcccttcgtgtccgtagtctcgaactgtatcatcagctggtggctctcgtgatggcgtatagcttccaagagccgctggaagaggaagaggacgaaaaggagccaaattcccctgttatggttccagcggccgacattctaaaccatctggctaatcacaatgcaaacctggagtattccgcaaattgtctgcgcatggtggcaacccagcctattcccaagggccatgagatctttaatacttacggccagatggctaactggcagttgattcacatgtacggcttcgtcgaaccttaccctgataacaccgacgacactgcggacatccaaatggtcactgtgagagaagcagccctacagggcactaagactgaggcagagaggcatttagtgtatgagcggtgggattttctgtgtaagctggagatggtcggcgaggagggagcttttgtcattggccgcgaggaggtcctcactgaagaggagctgaccaccactctgaaggtgctgtgtatgcccgccgaagaatttcgcgagctgaaggaccaggacggggggggcgatgataagcgcgaagagggttccctgacaataaccaacattcccaaattgaaggcctcctggcgccagcttctccagaattcagtgttgctgaccttgcagacatatgcgacagatcttaagaccgatcaggggctgctgagtaataaggaggtgtatgcgaagctttcatggagggagcagcaggcccttcaggtacgttacggccaaaagatgattttgcaccagctcctggagctgactagttag

SEQ ID NO: 20601 - DNA, 372 bp, Artificial Sequence
  Description of Artificial Sequence: Synthetic coding sequence
atggccacccaggccaagcggccccgggtggccggccccgtggacggcggggatctggaccccgtggcttgtttcctgtcatggtgccgaagagtgggactggaactttcccctaaagtgtccgaaagggcggcgggtagagccccagtggccgctcacctgctgcaccggcgccctgcaggcgccagagcatcttgcgcagccgaacctgtggggctgggtgccaccgctgctggtgctgctccacgtgcagcagggcctgggttgacactggaggccctcctttgcgcattagctcgggccggaccactgggagcacccgacgtactcgtgagagctctaggaggtgtgggggaacggctgcataggtag

SEQ ID NO: 20602 - DNA, 810 bp, Artificial Sequence
  Description of Artificial Sequence: Synthetic coding sequence
atgctgttcttcacccagtgcttcggcgccgtgctggacctgatccatctacgatttcaacactataaagctaaacgggtgttctcagccgcgggacaactagtctgcgtggtcaatcctacccataacttgaaatatgtaagttctcggagagcagtgactcaatctgctccggaacagggttcctttcacccccaccacttatcccatcatcactgccatcatagacaccaccaccatctgcgccaccacgcccatccccaccatctgcatcaccaagaagcaggccttcacgctaaccccgtgaccccctgcctgtgcatgtgtccactgttttcctgccagtgggaagggaggttggaagtggtggtcccacacttgcgacagatacaccgcgtggatatccttcaaggagctgaaattgtgttcctcgccacggatatgcaccttcctgcgcccgcagattggattattatgcatagctgcttgggtcaccactttcttctggtgctgagaaagcaggaaaggcatgagggtcatcctcagttcttcgccacaatgatgctgatcggcactccgacccaagcggactgcttcacatacaggttagagctgaatcgaaaccaccgtcggcttaagtgggaggcaactcctaggtccgtgctggaatgcgtagattccgtcattacagacggggactgtctggtactgaatacatctttagcccagctgtttagcgataacgggagcctggccattggtatcgctataacagctaccgaggtgctgccctcagaggcagaaatgtag

SEQ ID NO: 20603 - DNA, 1983 bp, Artificial Sequence
  Description of Artificial Sequence: Synthetic coding sequence
atgctggtgtgctacagcgtgctggcctgcgagatcctgtgggacttaccatgttcaataatgggcagtccacttggccatttcacctgggacaaatacttgaaagagacctgcagcgtgcccgctcccgtacattgttttaagcagtcttacaccccacctagcaacgagtttaaaatctcgatgaaattggaggcccaggatccccgcaacaccacatccacatgtatcgcgacagtggttgggctcactggtgccagactacggttacgcctggatgggtctgataacaagaacgacttctggagactagtggacagtgccgaaatacagcccatcggaaactgcgaaaaaaatggcggcatgctgcagcccccacttggctttaggcttaatgctagctcttggcctatgttcttgctgaaaacgctgaatggtgctgagatggcacccattcggattttccataaagagcctccaagcccctcacataatttctttaagatgggtatgaagctggaggccgttgacagaaagaatccacacttcatctgtcctgcaaccattggcgaggtccggggttccgaagttctggtgacctttgacggttggaggggcgcgttcgactactggtgccgattcgacagccgggatatttttccagtgggctggtgttctctgaccggggacaacctgcagccccccggcactaaagtcgtgattcccaaaaacccttacccagctagcgacgtcaacactgagaaacctagtatacactcctcaaccaagaccgttctcgaacaccagcccggacagagggggcggaagcccggcaagaagagggggcgtacacccaagactctgatcagtcatcccatctccgccccttcaaagactgcagaaccattaaaatttcctaagaagagaggcccaaagcccgggagtaagcgcaagcctcgcaccctgctgaaccctcctcccgcctcccctacgactagcacccctgagccggatacaagcaccgtcccacaggatgctgctacaattcccagctcggcaatgcaggcacctacggtgtgcatttatctaaataaaaatggcagcaccggacctcacttggacaagaagaaggttcagcagcttcctgatcactttggccctgcacgcgcctcagtcgtgctccagcaggccgtgcaggcctgcatcgattgtgcctatcaccagaagaccgtgttcagctttttaaaacagggccacgggggggaggtcatttcagctgtgttcgatcgcgagcagcatactctcaacttgcccgccgtcaattcaatcacttacgtcttgcgatttctggaaaagctgtgtcataatctgcgttccgataacctgtttggtaatcagcctttcacacagacgcatctgagtctcactgccatagagtattcccattcacacgacaggtatctgccaggagaaacttttgttctgggaaactccctcgctcgatcattggagccccacagtgattccatggactctgctagtaaccctaccaatttagtgtctacgagccaacgtcacagacccttgctgtccagttgcggtctgcctccctcgaccgcctccgcagtgcgacgcctgtgttctcgaggggtcctgaaagggagcaacgagagaagagatatggagagcttctggaaacttaacaggtctccaggatccgatagatatctggagtccagggatgccagccgattgagcggacgggatccaagttcatggaccgttgaggacgtgatgcagttcgtgcgcgaggctgacccccagctcgggccccacgcggacttgttccggaaacatgaaatcgatgggaaggctctgcttttactgcgaagcgacatgatgatgaagtatatggggctgaaactgggcccagcacttaaattaagctatcacattgacaggctcaaacagggtaagttttag

SEQ ID NO: 20604 - DNA, 1947 bp, Artificial Sequence
  Description of Artificial Sequence: Synthetic coding sequence
atgcagcccaacgtgatcgactggagcgacgtgcggaagcacaagtatgggcatctgtcagagagtgccagccagtaccaggaggccgccgacatcctggatctcggccacttcacatgggacaagtatcttaaagaaacttgcagcgtacccgcacctgtacactgttttaagcagtcttacacacctccctcaaatgaattcaagatctccatgaaattagaggcgcaggacccacggaatacgacctccacttgtattgctaccgttgttggactcaccggagcaaggcttcgattacgcttggacggaagtgataacaagaacgacttttggcgccttgtcgatagcgccgagatccaaccgattggcaattgcgagaaaaatggtggtatgctgcaaccgcccctcgggtttagactgaacgcatcttcatggccaatgttcttgctaaagacactgaacggcgcggagatggctccaattaggattttccataaggagcccccgtcaccctctcataattttttcaaaatgggcatgaaactggaggccgttgataggaaaaatccacacttcatctgtccggctacaatcggtgaagtaagagggagcgaagtattagtgaccttcgacggttggagaggcgcctttgattattggtgtaggtttgactccagagacatcttccctgtgggctggtgtagtctgacaggcgataatctccagcctccgggcactaaggtggtcatacccaaaaacccctatcctgcctccgatgttaacactgaaaaaccttctatccacagcagcaccaagaccgtactcgagcatcaacccgggcagagaggccgcaagccaggcaagaagaggggccgcacacccaaaactctgatatctcacccaattagcgctccatcaaagactgccgagcccctgaaatttcctaaaaagaggggcccaaagcctggcagtaaaagaaagcccaggacattactcaaccctcccccagcgagccccaccactagcacccctgagccagatactagtactgtgccacaggacgcggccaccatccctagttctgcgatgcaggctcccaccgtgtgtatctacctgaacaaaaacgggtccactggtccacacctcgacaagaaaaaggtacaacaactcccagaccattttggacccgcccgcgctagtgtggtattgcagcaggcagtgcaggcctgcattgattgtgcttaccaccagaagaccgttttctcattcctgaagcaggggcatgggggagaagtaatcagcgctgtcttcgatcgggagcaacatactctgaacctcccagctgtaaactccatcacctacgtcctcagatttctggagaaactgtgccataatctgcggtccgacaacttatttggcaaccagcctttcacccagacacaccttagcctcaccgcaatcgaatactcgcactctcacgatcgttacctgcctggggagacctttgtactgggcaattccttggccagatcgttagagccacacagcgattctatggattcggccagtaaccctactaatctagtctcaactagccagcgccaccgccccctgttgtcttcgtgcgggctgcccccatcaaccgcctcagctgtgcgtcggctttgtagtaggggcagtgacagataccttgagtcaagggacgctagccggctgtcagggagggacccatccagttggaccgttgaagacgtcatgcaatttgtgagggaggccgacccacagctcgggccccacgctgacctcttccgcaagcatgaaattgacgggaaggcgttgctgctcctgagaagcgacatgatgatgaagtacatgggcctcaaattaggtcccgcgctgaagctctcctaccacatcgaccgattgaaacagggcaaattctag

SEQ ID NO: 20605 - DNA, 1734 bp, Artificial Sequence
  Description of Artificial Sequence: Synthetic coding sequence
atgaagctggaggcccaggacccccggaacaccaccagcacctgcattgcgactgtggtgggcctgacaggagcacgactccgcctccgtttagatggatctgataacaagaacgacttctggcgcctggtggactccgcggaaatccagcccattggaaactgcgaaaagaatggcggaatgctgcagcctcccttgggattccgactgaacgcaagtagttggccaatgttcctgctgaaaactctcaacggtgccgaaatggccccaatcagaatcttccacaaggaacctccgtccccatcacacaactttttcaagatgggcatgaagttggaggcggtggaccggaaaaaccctcacttcatatgtcctgctaccataggagaagttcggggatcagaggtactggtcactttcgatggctggcgtggagcttttgattactggtgccggttcgattcccgtgatatatttccggtcggatggtgtagcctgacaggagataaccttcagcctcccggcacaaaggttgtgataccgaagaatccctacccagcttccgatgtgaacaccgagaagccatccattcactcatcaacgaagacagtgctggagcaccagcccggacagcgggggcgtaagcctggcaaaaaaagaggaagaaccccaaagacactgatctcccacccgatctctgcaccttctaaaacagccgagccacttaaattccccaagaagcggggcccaaagccaggctccaaacgcaagccccggacactcctgaatcctccacctgcgagtcctacaaccagcaccccggagccggatacttcaacagttccacaggacgcagccaccatcccatcaagtgccatgcaggccccaaccgtctgtatatacctcaataagaacggatccaccgggccacacctggacaagaagaaggtccagcagctcccggatcattttggacccgccagagcgtctgtggtactccaacaggcagtgcaggcatgcatcgattgcgcatatcatcagaagactgtgttcagtttcttgaagcaggggcacggtggggaggttatctccgctgtctttgacagggagcagcataccctgaacctgcccgcagttaattccataacttacgtactaaggttcctggaaaaactctgtcataatttgagatctgacaatctgttcgggaatcagccctttactcagacacatctaagtcttactgccatagaatattcccattcacatgacaggtaccttcctggcgaaacctttgtcctgggcaatagtctggcccggtctctcgaaccccactccgattctatggacagtgcgtccaaccccaccaatctggtgtcaacttctcaacgccacaggcctctgttgagcagctgcgggctgccgccatcaacggctagtgcggtgagaaggttgtgtagccggggatccgatcggtacctggaaagtcgggatgctagccggcttagcggacgggacccctctagctggacagttgaagatgtgatgcagtttgtgagagaggctgaccctcaacttggacctcacgccgatctttttagaaagcacgagatcgatggtaaggcccttttgctgctgcggagcgatatgatgatgaagtacatggggcttaagctggggcccgcgcttaaattgagttaccacatcgaccgtctgaagcagggcaaattttag

SEQ ID NO: 20606 - DNA, 1776 bp, Artificial Sequence
  Description of Artificial Sequence: Synthetic coding sequence
atgcagagctacaccccccccagcaacgagttcaagatcagcatgaaattggaagctcaggatcctcgcaatactacttctacatgtatcgctaccgtcgttggcctgacaggcgctcgcctccgcctccgtttggatggaagtgacaacaagaatgacttttggcgcttagtggacagtgccgagatccaacctatcggcaattgcgagaaaaatggtggcatgctgcagccccctttaggtttccgcctaaacgcctcttcatggcctatgttcctcctgaagaccctgaacggagctgaaatggcccctatcaggatattccacaaagagcctccttcacctagtcataattttttcaaaatggggatgaagctagaggcagtggacagaaagaatcctcactttatctgtccagccacaattggcgaggtccgcggaagtgaggttctcgtcacatttgacgggtggcggggcgcctttgattattggtgcagattcgactcccgcgatatcttccccgtagggtggtgctcactgactggggacaacctgcagccacccgggaccaaggtagtcatccctaagaatccttatccagctagcgacgtgaacaccgaaaagccaagcatccatagctctaccaagaccgtcctagaacaccagccagggcagcggggtaggaagcctggaaaaaaacgaggtcgcaccccaaaaacactcatctctcatcctatctcagctccttcaaagaccgctgagcctctgaaattccctaagaaaagaggccctaaacctggatccaaacggaaaccgagaaccctcctgaaccccccaccagcatcacctactactagtacaccggagccggatacttcaacagtgccacaggatgctgcaactattccctcaagcgcaatgcaggcacccacggtgtgtatctatctcaacaagaacggatccacaggaccccatctcgataaaaagaaggtgcagcaactcccagaccactttgggccagcccgagcgtccgttgtgttgcagcaggccgtccaggcatgtatagattgcgcctaccaccagaaaacggtgttcagctttctcaaacaagggcacggtggcgaagtgattagtgctgtgtttgaccgcgagcaacacactctaaatctccccgctgtgaacagcatcacttacgtgctgcgctttctcgaaaagctctgccataatctcaggtctgataatctctttggtaatcagccctttacccagacccacctgtcccttactgctattgagtactctcactcacacgacaggtatcttcctggcgagacatttgtccttggaaactctcttgcccgaagcctggagcctcatagtgattccatggattctgcgtctaacccgaccaacctagtgtcaaccagccagcgtcataggccattactctcatcctgcggcttaccgccttctactgcttcagctgtccggagactctgctcacgcggaagcgataggtacctcgaatcaagggacgcatcccgtttgagtggacgagatccttcaagctggaccgtcgaggacgtcatgcagtttgttcgggaagccgacccccagctgggcccacacgctgacctgttccgaaagcacgagatcgacggcaaagccctcctcctgttacggagcgatatgatgatgaagtacatgggcctgaagctgggccctgcccttaaactcagttatcacatcgaccgccttaaacaggggaagttctag

SEQ ID NO: 20607 - DNA, 1800 bp, Artificial Sequence
  Description of Artificial Sequence: Synthetic coding sequence
atgaagctggaggcccaggacccccggaacaccaccagcacctgcatagccactgtggtgggattgaccggagccagattacgcttgcggctcgacggaagtgacaacaaaaatgacttctggagactggtggactctgcagagattcagccaatcggcaattgcgagaagaacggtgggatgctgcaaccccctttaggtttccgcctcaatgcatcatcctggccaatgttcctgctgaagacattaaacggagctgaaatggcccctatcaggattttccacaaagaaccaccgagcccttctcataacttcttcaagatggggatgaaacttgaggccgtggaccggaaaaacccacactttatttgccctgccaccatcggcgaggtcagaggatcagaagtcctggtgacttttgacggctggcgaggcgcctttgattattggtgccggttcgactcgagagacattttccctgtgggttggtgtagtcttacgggagacaacctgcaaccgcctgggacaaaggtcgtcattccaaagaacccctaccccgcatccgacgtgaacactgaaaagcccagtattcactcctccactaaaactgtgctagagcaccaacctggccaaagaggccggaaacctgggaagaagaggggccggactccgaaaactctaatcagtcaccctataagcgctccatccaagacagctgaaccacttaagttccccaaaaagcggggacctaagcccggctcaaagcgtaagccaaggacccttctgaatcctcccccggctagtcctactacctcgacacccgagcctgacacgagtactgtgccccaggacgctgcaacaatcccgtcatcagccatgcaggcccctaccgtgtgcatttatctaaacaaaaacggttctaccggacctcatcttgacaagaaaaaagtccagcaactgccagatcactttggaccggcccgggctagcgtggtattacagcaggccgtgcaggcatgtatagattgcgcgtatcatcagaagacagtcttctcctttcttaagcaggggcacggaggcgaagtgataagcgcagtgtttgacagggaacagcacactctgaacctgcccgcagtcaattccataacatacgttctgagattcttggagaaactgtgccataacttacggtcagacaacttgttcggaaaccagccatttacccagactcatctgtctctcacggccatcgagtactcacactcccacgatcggtatcttcctggagaaacctttgtgctgggaaattcattagcccgcagcctcgaacctcattccgactcaatggattctgctagtaatcctacaaatctggtgagtacttctcagcggcatagaccactgctgtcttcttgtggactccccccatcgacagcttccgccgtgaggagactgtgcagtcggggagtattgaaaggaagtaacgagaggcgcgacatggagtcattttggaagttaaatagatcacctggttcagaccggtacctggagagccgggacgcctcaagactcagtggcagagatccgtcaagctggacagtcgaggacgttatgcaattcgtgcgagaggccgacccgcagctcggacctcacgcagacctgttccgcaaacacgagattgatggcaaggcactgttgttgctgcggtcagatatgatgatgaagtatatggggctgaagctgggtcctgctctgaagcttagctatcacattgatcgcctgaaacagggaaagttctag

SEQ ID NO: 20608 - DNA, 1734 bp, Artificial Sequence
  Description of Artificial Sequence: Synthetic coding sequence
atgaagctggaggcccaggacccccggaacaccaccagcacctgcattgccaccgtagtgggactgactggtgccaggttgaggcttcggctggacggttcagacaataagaacgacttttggcgcctggtggatagtgccgaaatacaaccaattgggaattgtgagaagaacggggggatgttgcagcctcccctgggattccgacttaacgcttcgtcttggcccatgtttctattgaagacattaaacggcgccgaaatggctccaatccggatcttccacaaagagccgccttccccttcccacaattttttcaaaatgggcatgaaattggaggctgtcgaccgaaaaaatccacactttatttgccccgcaactataggcgaggtacgcggatccgaggttttggtcacttttgacgggtggcgcggggcatttgactactggtgtcgatttgacagccgggacatattccccgttggctggtgtagcctgacaggcgataacctccagccgccaggcaccaaggttgtgatccccaagaacccctatccggcctccgacgtcaacacagaaaaaccatccattcactcgtccactaaaacagtcctggagcatcaaccagggcaaaggggacggaagcccggaaaaaaaaggggaagaacacccaaaacgctgatctcacaccccatcagcgcaccatccaaaaccgcggaacctctgaaatttccgaaaaaaagaggccctaagccgggaagcaaaagaaaacctaggacactgctcaaccctccacccgctagtcctactacttctacaccagaacctgacacctctaccgtcccccaggacgctgctaccatcccaagttccgctatgcaagccccgaccgtgtgcatatacctgaacaaaaacggctctaccggacctcatctcgacaaaaaaaaggtgcagcagttacctgaccatttcggacccgcccgcgccagcgttgtgctccagcaggctgttcaggcttgtatagattgtgcctaccaccagaagacagtcttctccttcctcaagcaaggacacggtggcgaggtgattagtgccgtctttgatcgcgagcaacacaccctgaaccttccggcggttaactccattacttacgtcttacgctttctggagaagttatgccacaacctgcgcagtgataacctgtttgggaatcaaccgtttactcaaacccatttgtcattgacggctatcgaatacagccactctcacgaccgatatctaccaggagagactttcgtcctggggaactcgctggcacggagcttagagccacacagcgactctatggactccgctagcaaccctacgaatctggtatccacttcgcagcggcatagacccttgctctccagttgcggtttacccccctctactgcctccgccgtgcgacgcctctgctccagggggtccgaccgctatctagaaagccgcgatgcctctcggctatctggacgagacccatcttcctggaccgtagaggatgtaatgcagtttgttagggaggcagacccgcagctcggccctcatgccgatctcttcaggaaacatgagatcgacgggaaagctctcctcctgctgagaagcgacatgatgatgaaatacatgggcctcaagttagggcctgcactcaaattgagctaccacattgacaggttgaagcaggggaaattttag

SEQ ID NO: 20609 - DNA, 1776 bp, Artificial Sequence
  Description of Artificial Sequence: Synthetic coding sequence
atgcagagctacaccccccccagcaacgagttcaagatcagcatgaagctggaagcacaggacccacgtaataccacttccacttgtatcgccaccgtcgtcggcctgacaggagcccgcctgcggctccgcctcgatggttcagacaacaagaatgacttttggcgcttggtggattcggctgagattcagcccatcggcaactgcgagaaaaacggaggtatgttgcagccccctttgggattccgcttaaacgccagcagctggcctatgttcctgcttaaaacactgaacggcgccgagatggcacctatccgtatttttcataaggaacccccgtccccctcccacaacttcttcaaaatgggcatgaagcttgaagcggtagataggaagaacccccattttatttgtcccgccacaattggtgaggtcaggggttccgaggtgttggtcacttttgacggatggagaggcgccttcgattactggtgcaggtttgacagtagagatatcttcccagttgggtggtgctccctaacaggcgacaacctgcaacctccgggtacaaaggtagtcatccctaaaaatccatatcccgctagtgacgtgaacacggagaagccttcaatccactcctccaccaaaaccgttctggagcaccagccgggacagagaggacgcaagcccggaaaaaagagagggcggacccccaaaaccctgatctcccacccaatcagtgcccccagcaagactgcggaacctctgaagtttcctaagaaacgaggaccaaagcctggctccaagagaaaaccccgcacattactcaacccacccccagctagccccacaaccagtacccctgagcctgacacgtctacagtgccccaagatgccgcgactatcccctccagcgctatgcaggccccaactgtgtgtatctacctgaacaagaatggttccactggtcctcaccttgacaagaagaaagtgcaacagctgcccgaccattttggccctgcaagagcctcagttgtgctgcagcaagccgtccaagcctgcattgattgtgcatatcatcaaaagaccgtatttagctttttgaagcagggccatggtggtgaggtcatttctgccgtgtttgatagggaacaacacactttaaacctccccgccgtcaattccatcacctatgtgctgagattcctggagaagctgtgccacaacctgagatctgataatttatttgggaatcaacccttcacccagacacacctcagccttaccgctatcgaatacagtcactctcacgaccgttacctgccaggagagacatttgtgctgggtaatagtctggccaggagtctcgaacctcacagcgactcgatggactctgcctcaaaccctaccaacttagtctctacctcacaacgacaccggcctctcctcagttcctgtggtttgcctccctccactgcgtccgccgtgaggcggttatgctccagagggtccgatcgttacttagagagcagggacgcatccaggctcagtggacgggatccaagctcctggaccgtggaagacgttatgcaattcgtccgtgaggcagacccgcaactggggccacacgctgacctttttcgaaagcacgagatcgacgggaaagctctactgttgctgcgatcagacatgatgatgaagtacatgggcttgaaactgggacccgcactgaagctctcatatcacatcgatcgacttaaacaaggcaaattttag

SEQ ID NO: 20610 - DNA, 1734 bp, Artificial Sequence
  Description of Artificial Sequence: Synthetic coding sequence
atgaagctggaggcccaggacccccggaacaccaccagcacctgcatcgccacggtcgtgggtctgacaggggccagactccgcttaagactggacggctccgataacaaaaacgacttctggaggttggttgacagtgccgagatacagccaatcggaaactgcgagaagaatgggggcatgctgcagccccctcttggatttaggctcaatgcctcctcttggccgatgttcctgctcaaaactctgaacggggccgagatggctcccatcagaatctttcacaaagagcccccttctccttcccacaacttcttcaagatgggcatgaagttggaagcagtggataggaaaaatccacatttcatttgcccagctacaatcggtgaagtaaggggcagcgaggtcttggtgacatttgatggttggagaggggcctttgactactggtgtagattcgactcgagggatatttttccagtgggttggtgtagcctgaccggggacaatctccagccccctggaactaaggtcgtcattccgaaaaatccatatcctgcctctgacgtgaacaccgaaaagccctctattcactcatctacaaagacagtattagaacatcaacccggccagagaggacgtaagcccggcaagaaacgtggccgcactcccaaaacattgatctctcatcctattagcgcaccctccaagactgctgaacctctcaaatttcctaaaaagcgtggtcccaaaccaggctcaaaacgtaagccacgtacactgctaaaccctccccccgcgagccctaccacgagcaccccagagccggatacttctactgtgccacaggacgcagccactattccaagcagcgctatgcaggcacccaccgtatgcatatacttgaacaagaatggaagtaccggaccccacctggataagaaaaaagtgcagcaactgcctgaccattttggccctgctcgggcctctgtggtcctccagcaggctgtgcaagcttgtattgactgcgcgtatcatcagaaaaccgtgttctcatttttaaaacaggggcacggtggagaagtaatttccgctgtattcgaccgggagcaacatacactgaatctgccagccgtgaacagcattacctacgttcttcgatttctcgagaagctgtgtcacaatctgcggtccgataacttgttcggcaaccagccatttacgcagacacacctctcgctgacagctattgaatatagtcattcacatgatagatacctgcccggggagaccttcgtcttaggaaattccctcgcaaggtcccttgagccgcattccgattctatggattcggccagtaatccgaccaacttggtcagcacatcacagcgacatcggcccctcttaagttcatgcggcctcccgccaagcactgcctccgccgtccgtcgtctctgctctaggggctctgatcgctacctagaatctcgtgacgcctcaagactgagtggaagagacccaagcagctggacagtggaggacgtgatgcagtttgttcgcgaggctgatccacaacttggtccccacgctgatctttttcggaaacatgagatcgacggaaaagctctgttgttgctacgaagcgacatgatgatgaagtacatgggcctcaagctcgggccagctttaaagctcagctaccacatcgacagactgaaacagggtaaattttag

SEQ ID NO: 20611 - DNA, 1857 bp, Artificial Sequence
  Description of Artificial Sequence: Synthetic coding sequence
atgggcagccccctgggccacttcacctgggacaagtacctgaaggaaacatgcagcgtgcctgcacctgtgcactgttttaagcagtcctacacaccacctagcaacgaattcaagatcagtatgaaactggaggcacaggacccccgaaatacaacatctacatgcatagcaacagtggtaggattaaccggcgccaggctccgactccggctggacgggagcgataacaagaacgacttctggcgattagtggacagtgcggaaatccaacctatcgggaattgcgaaaagaatggtgggatgttgcagccgcctctggggttcaggcttaacgcgtcatcctggcctatgtttctgcttaaaaccttgaacggggccgagatggcgcccatacgaatattccataaggagccccctagtccgagccacaacttctttaagatggggatgaagctggaggccgtagatagaaaaaaccctcacttcatttgcccggctacaatcggagaggtcaggggatctgaggtgctggtaaccttcgacggctggcggggggcctttgactactggtgccgctttgactccagggacatttttccagtgggatggtgtagtttaaccggtgataatctacagcctcctggtaccaaggtggtgatccctaagaacccctaccccgcaagcgacgtgaatactgagaagccctctattcactctagcaccaagactgtgttggagcaccagccaggccagcggggccgaaagccaggtaagaagagagggagaactcccaaaacgctaatttctcatccaatatccgcaccttcgaagactgctgaacctctgaagttccccaaaaaacggggtcccaaacccggctccaagagaaagccccgaaccctacttaatcctcctcccgcatctcccacaacaagtaccccggagcccgacactagtacagtaccccaagatgcagccactattccgagcagtgcaatgcaggcgcccaccgtctgcatatacctgaataaaaatggctctaccggcccccacctggataaaaaaaaagtgcaacagctgccggaccatttcggccctgcccgcgcctccgtcgttctccagcaggcggtgcaggcatgcattgattgtgcttatcaccaaaaaacggttttcagcttcctgaaacagggccacggaggagaggtaatttcggccgtgtttgacagggaacagcacaccctcaatctcccagctgttaattctattacatacgtgcttcggtttctggagaaattgtgtcataatctgcggtcagataacctctttggtaatcagcccttcacacagacgcacttgtcacttaccgcaattgaatattcccatagccacgatcgatacttgcccggcgaaaccttcgttctggggaacagtctggccagaagcttagagcctcattcagacagtatggactccgcttctaatcccacaaacctcgtgtccacctcacaaagacaccggccactgctgtccagctgtggtctgcccccctcgaccgcctcagccgtacggaggctttgctcgagaggcagtgataggtacctggagtcccgggacgcatcccgactttccgggcgggatccaagtagctggacggtggaagacgtcatgcaatttgttcgagaggcagatccccaactgggaccgcatgctgatctgttcagaaaacatgaaattgacgggaaagctctgctcctgctgaggagtgacatgatgatgaaatatatgggactgaagctgggtcctgccctgaagctcagctatcatatcgacagactgaaacagggaaagttttag

SEQ ID NO: 20612 - DNA, 1983 bp, Artificial Sequence
  Description of Artificial Sequence: Synthetic coding sequence
atgctggtgtgctacagcgtgctggcctgcgagatcctgtgggacctgccatgcagtatcatgggtagtcccttaggacatttcacctgggacaaatatctcaaagaaacttgttccgtgccggctcctgtgcactgcttcaagcagtcttacacaccaccctctaacgagtttaagattagcatgaagttagaggctcaagacccccggaataccacttccacgtgcatcgcaacagtcgtagggctaaccggcgcgagactgagactcaggttggatggaagcgataacaagaacgatttctggcgcctggttgattctgccgagatccaacccattggcaattgtgaaaaaaacgggggaatgcttcagccccctttgggcttcaggcttaatgcctcttcatggcctatgttcctcctgaaaaccctgaacggcgcagaaatggctccaattagaatcttccacaaagaacctccaagtccctcgcacaacttcttcaaaatgggaatgaaactagaagccgtggatcgcaagaacccacattttatctgtccagccacaataggggaggtacgggggtcagaagtccttgtgacattcgacggctggaggggtgcgttcgactactggtgccgcttcgactctcgcgacattttcccagtgggttggtgctccttaacgggggacaacctgcagccacccggcacgaaggtcgttatccctaagaacccctaccctgcgagcgatgttaacacagagaaacccagtattcatagcagtacaaagactgtccttgaacaccagcccggtcagcgcggccgcaaaccagggaaaaagcgcggaaggacgccgaagaccctaataagtcacccaatatcggctccttcgaagactgcagagcccctgaaatttcctaaaaagcgcggccctaagcctggtagcaaaagaaaaccccgcaccctgctgaacccacccccggccagtccaacaacctccacgcccgaacctgatacatccacagtccctcaagacgctgccacaattccaagttccgccatgcaggctccaaccgtctgcatttatttgaacaagaacggatcaaccggtccccatctggacaagaaaaaagtccagcagttgccagatcacttcggcccggcccgggcatcagtggtacttcaacaggccgtgcaggcttgcatcgattgcgcctatcatcagaagaccgtattctccttcttgaagcagggccacggtggagaggtcatctctgcggttttcgacagggagcagcacacgctgaacctgcctgccgtgaactccattacatacgtgctgcgcttcttggaaaaactgtgccacaacttgagatctgacaacctctttggaaaccagccatttacccaaactcacctgagcttgacagccatcgaatacagccacagccacgatcggtatctccccggggagacgtttgtgttgggtaattcacttgcacggtctctggagccccatagtgattctatggacagcgcgtccaaccccactaatctggtgagtactagtcagagacatagacctttgttgtcctcatgcggcctgccaccgagcaccgcgagcgccgtacggcggctatgcagccgtggtgtgttgaaaggctctaatgaacggcgtgacatggaatccttttggaaactgaatagatctcctgggtcagacaggtacctggaaagcagagatgcgtccagactaagcggtcgggatccctcttcatggactgtcgaggatgtgatgcagtttgttcgagaagctgacccccagctcggtcctcatgcagacctgtttagaaagcatgaaatcgacggcaaagcgctgctgttgctgaggtccgacatgatgatgaagtacatgggcttaaagctggggccagccctgaaactcagctatcacatcgacagactgaagcaaggaaaattctag

SEQ ID NO: 20613 - DNA, 1443 bp, Artificial Sequence
  Description of Artificial Sequence: Synthetic coding sequence
atgcagagctacaccccccccagcaacgagttcaagatcagcatgaaactcgaagcgcaagatccacgaaacactacttcaacctgcatcgccacagttgttggcttaaccggagcacgcctgagactgcgcctggatgggagtgataacaagaatgacttctggagactggttgacagcgccgagatccagcctattgggaactgtgagaagaacggaggaatgctacagccccccctcgtcgtgatacccaagaacccctaccccgcctctgacgtgaacaccgagaagccatcaatccacagttctaccaagacggttctggaacaccaaccggggcagagaggcagaaagcctggaaaaaagcggggtaggaccccgaaaactctgatctctcatccaatctctgcaccctcgaagactgctgagcccctcaagtttccaaagaagagagggccaaagcccggcagcaaacggaagccacgcaccctcctgaatccaccccctgcatccccaaccacaagtacacctgaacccgatacaagtacggtgccccaggatgcagcgactatcccatcaagcgccatgcaagcccccacggtctgcatttacttgaacaagaatggatcgacggggccccacctggataagaaaaaggtgcaacagctgccagaccacttcggtccagctagggcgagtgttgttcttcagcaggcagttcaagcctgcattgactgcgcgtaccaccaaaagaccgtcttcagtttccttaagcaaggccatgggggtgaggtaattagcgcggttttcgaccgggagcaacataccctaaacctgcccgccgtgaactctatcacatacgtgttgaggttcctagaaaagctctgccacaatctgagatccgataatttgttcggcaaccaaccgttcactcagacccacctcagtcttaccgccattgaatattcccattcacacgatcgctaccttccaggagaaacctttgtgttgggcaactctctggcaaggtcactggaaccccacagtgactcaatggacagcgcctccaaccccaccaatctggtaagcactagtcaaaggcacagaccactattgagctcctgtgggctgccacctagtaccgctagcgccgtgcgtaggctgtgctctagaggctcggatcgttacctggagtcgcgcgatgctagcaggctgagcggcagggatcctagcagctggacggtggaagatgtgatgcagtttgtaagggaagctgacccacaacttggaccgcacgcggatctcttcaggaagcatgaaattgacggtaaggccctgctgctcctcaggtctgacatgatgatgaaatatatgggattgaagttgggcccagccctaaagttatcttatcacatagaccgcttgaaacagggtaaattttag

SEQ ID NO: 20614 - DNA, 1245 bp, Artificial Sequence
  Description of Artificial Sequence: Synthetic coding sequence
atgcagagccagcggatccccggccggaagcggggccggcccagccttcacagcactccaatgaaaatggccgttcataatctctattccgcctccgcgggtagtctgccagccgtcaaaatccccaaaaagaggggccgcaagcctggatataaaattaagtctcgcgtactcatgacaccactcgctctgtctccacccagaagcactccggagccagacctgtcctctatcccacaagatgctgctaccgtcccctcattggcagccccccaggctctgacagtgtgtctctacataaataagcaagctaatgccggcccatacctggaaagaaagaaagttcagcaacttccagaacacttcggaccggaaaggccgtctgccgtgctgcagcaggccgttcaggcttgtatcgactgtgcacaccagcagaaattggtgttttcgctggtgaaacaggggtatggcggcgagatggtgagcgtgagcgcatcttttgacggaaagcagcaccttaggagcctgcccgtggtgaattcgatcgggtacgtattaaggttcctggccaagctgtgcagatcgttactgtgtgacgacctgttttcgcaccaaccattccctagaggctgttctgctagcgagaaggtgcaggagaaggaagaggggcgtatggaatccgtgaagaccgtgaccactgaggagtacctggtgaatccggttggcatgaatcgttactccgttgataccagcgcttcaacattcaatcaccggggaagcttgcatccatcaagctcactgtactgtaaacgccagaattctggggacagccacctcggcggcggcccagctgctaccgccggaggtcctcgcacgtccccaatgagcagcggcggcccaagcgctccggggctccggcctcctgcgtcatctccgaagcggaacacaacaagtctcgaaggcaatcgctgcgcttcaagtccgagccaggatgctcaagatgctagaagaccacgcagccgcaatccatccgcgtggacggtagaagacgtggtgtggtttgtgaaggacgccgatccacaggcactagggccgcacgttgaattattccggaagcatgaaatagatggtaatgccttacttttgttgaagtcagacatggtgatgaaatatcttggactcaaactgggcccggccctcaagctatgctatcatattgacaaactgaagcaagccaaattctag

SEQ ID NO: 20615 - DNA, 918 bp, Artificial Sequence
  Description of Artificial Sequence: Synthetic coding sequence
atgccctgccagcggaccgcctggatcggctgcgaccggcagcggacaccacctttccactggcgggagattaaatcaagggttctcatgacaccattggctctgtccccaccgcgcagcacccctgagcccgatttgagttctatcccacaggatgccgccaccgtcccatctctcgcggctccgcaagcgctgactgtttgcctttatatcaataagcaagctaatgctgggccctacctggagcggaagaaagtccaacagctgcccgagcacttcggcccagagcgcccaagcgcagtccttcagcaggccgttcaggcctgtattgattgtgcacaccaacagaagctggttttctcactggtaaagcagggttatggtggggagatggtgagcgtgtctgcaagcttcgacggtaagcagcatttgcggagcctgcctgtggtcaacagcataggctatgttctacgcttcctggctaaactgtgccgcagcctcttgtgcgacgacctattctctcaccagcctttccccaggggatgttcagcctccgagaaggtgcaagaaaaggaggagggaaggatggagagtgtaaagaccgtgacgactgaagagtacctcgtgaaccctgtgggtatgaaccgctactcagtggacacaagtgcctctacctttaaccatcgaggttctttacacccttccagctctttgtattgtaaacgccagaattccggtgactcgcatcttgggggaggcccagctgccaccgcgggcggacccaggaccagcccgatgagtagcgggggcccctcagcaccgggactgaggccccccgcctcttcccctaagagaaacacaacgtcactggaggggaatcgttgtggaaacgtcatgcatgcttctgcaagtcactag

SEQ ID NO: 20616 - DNA, 324 bp, Artificial Sequence
  Description of Artificial Sequence: Synthetic coding sequence
atggtgatccgggtgttcatcgccagcagcagcggcttcgtggccattaagaagaaacagcaggatgtcgtgagatttctcgaggccaataagatagagtttgaggaggttgacatcacaatgagtgaggaacagcgtcagtggatgtacaagaacgtcccacctgagaaaaaacccacacaggggaaccccctaccgccacaaatttttaacggcgaccgctattgcggtgattacgactctttttttgagtctaaagaaagtaatactgtttttagtttcctgggcctgaaaccgcgcttggctagtaaggccgaaccctag

SEQ ID NO: 20617 - DNA, 960 bp, Artificial Sequence
  Description of Artificial Sequence: Synthetic coding sequence
atggaggagctgaccgccttcgtgagcaagagcttcgaccagaaggtgaaggagaagaaggaggccataacctatagagaagtacttgagtcaggccccctgcggggggccaaagagcccaccgggtgcactgaggcgggacgagatgatagaagttcacctgccgtgcgcgctgcgggcggaggaggtggtggagggggagggggcggcggcggaggtggaggcggtggagtcggtggggggggcgctggcggcggggcgggcggcgggcggagcccagttagggaactggatatgggtgcagccgagagatcacgggagccaggctctccacgccttaccgaggtctcccccgaactgaaggataggaaggaggatgcaaagggcatggaggacgaaggccagaccaagatcaaacaaagacggtcacgaacgaatttcactcttgaacagctgaatgaacttgagcggctattcgatgagactcactaccccgacgctttcatgcgggaggagttaagtcagcggctggggcttagtgaagcgcgtgtgcaggtctggtttcagaatagaagagctaagtgcaggaagcaggaaaatcagctgcacaaaggcgtgttaattggggccgcttcacagtttgaagcatgccgcgtggccccgtacgtcaacgtgggagcattacggatgccattccagcaggtccaggctcagctccagctggactcggcggtggctcacgcccatcaccacttgcatccacatcttgccgcccatgctccatatatgatgtttcctgccccgccgttcgggttacccctggccactctggctgctgacagtgcaagtgccgcttcagtggtggctgcggctgccgctgcaaagactacctctaagaattcctctattgccgatctacggcttaaggcgaagaagcatgcagctgcacttggtctatag

SEQ ID NO: 20618 - DNA, 663 bp, Artificial Sequence
  Description of Artificial Sequence: Synthetic coding sequence
atgaacggcttcacccccgacgagatgagccggggcggcgacgccgccgccgccgtcgcagccgtcgtggctgctgcggccgcggccgcaagcgctgggaacggaactggagctgggaccggggcagaagtgcctggggcaggagcagttagcgccgctgggcctcccggcgctgccggccctggacctgggcagctgtgttgtttacgagaggatggcgagagatgcggtcgagctgcaggtaacgcttctttttcaaagaggattcaaaaaagcatctcccaaaagaaagtaaagatagagctcgataagtctgcaaggcacctgtacatatgtgactaccacaaaaatttgattcagtccgttcggaaccggaggaaaagaaaggggagcgatgatgacggtggcgactctcctgtccaggatatcgatacccctgaggtggacctgtatcaactgcaggtcaacaccctcagacgttataagcgacactttaagctccctaccagacccgggctcaacaaggcccagttagtcgagatcgtagggtgccactttcgtagtatccccgtcaatgaaaaggataccctgacgtactttatatatagtgtgaagaacgataagaataaaagcgatctaaaggttgactcaggagtgcactag

SEQ ID NO: 20619 - DNA, 828 bp, Artificial Sequence
  Description of Artificial Sequence: Synthetic coding sequence
atgggccccgccggcgtggccgcccggcccggccggttcttcggcgtctatctcctgtactgccttaatcccagataccgcggcagggtatacgttggctttacggttaacaccgcccggagggtccagcaacacaacggcggaagaaagaagggaggagcatggagaaccagcggaagaggcccctgggaaatggttcttgtggtgcacggtttcccttccagtgtggcggctctgcgatttgagtgggcttggcaacacccccacgcctctaggcgtctcgcccatgtgggacctagactgcgcggggaaaccgcctttgccttccatctccgcgtattggcccacatgctgagggcacctccttgggcccgcctgcctctaactcttaggtgggtgcggccagaccttaggcaggatctttgccttccaccaccccctcatgtacccctggcattcgggcctccccctcctcaagctcctgcccctagacgacgcgccggaccattcgacgacgcagaaccggagcccgaccagggagatcctggggcttgttgctccttatgcgcccagacaattcaggacgaagaagggccactctgctgccctcaccccggatgcctgctgcgcgctcacgttatttgcctggcagaagagtttcttcaggaggaacccggtcaactcctccctctggagggtcaatgcccctgctgcgagaagagcctgctctggggggaccttatctggttgtgccagatggatactgagaaggaggtggaagactccgagttggaagaggcacattggactgaccttcttgagacttag

SEQ ID NO: 20620 - DNA, 486 bp, Artificial Sequence
  Description of Artificial Sequence: Synthetic coding sequence
atgggccccgccggcgtggccgcccggcccggccggttcttcggcgtctatctgctgtactgtctcaacccacggtatcggggtcgtgtgtatgtgggatttactgtcaacaccgcccgcagggtgcagcagcacaacggcggtcgtaagaagggaggagcctggcggacctcgggccggggcccgtgggagatggtcttagtagtgcatggatttccatcatctgttgcagctctacgcgatgaggaagggcccctgtgctgtccacaccccgggtgtctgctacgggcccatgtaatttgtctggctgaagaattcttgcaggaagagcccgggcagctcctccccctggaaggtcaatgtccctgctgcgagaagagcctgctctggggtgatctcatctggctgtgtcaaatggatactgaaaaagaggttgaagacagcgaactggaggaggcccactggacagacttgctggaaacctag

SEQ ID NO: 20621 - DNA, 765 bp, Artificial Sequence
  Description of Artificial Sequence: Synthetic coding sequence
atgggccccgccggcgtggccgcccggcccggccggttcttcggcgtttatctgctatactgtttgaaccccagatatcgggggcgagtgtatgtcggctttaccgtgaacacagctcgcagggtccaacaacataatggggggcgcaaaaaagggggagcctggcgtaccagcggacggggcccttgggaaatggtactggtcgtgcatggattcccttcatcagtggccgcgctgcggttcgagtgggcttggcaacatcctcacgcaagccgaaggctggcacacgtcgggccccggctcagaggcgagacggcatttgctttccacctcagagtgttggctcacatgctcagagccccaccctgggcaagattgcctctcacactgcgctgggtgcgccctgatctgaggcaagacctgtgtctgcctccacctcctcacgtaccccttgcttttggccccccaccaccacaagctcccgccccccggcggcgcgcaggacccttcgatgatgcagagcccgagcctgatcagggagaccccggcgcgtgttgcagtctctgcgcccaaaccatccaggatgaagaggggccgctgtgctgtccccaccccggttgtcttcttagagcccatgtgatatgcctcgctgaggagttcctccaggaggaaccaggccagctcctgccactggagggccagtgcccttgctgcgaaaagagcgctctgggccgaccagacttagccgtacccgatggtcattag

SEQ ID NO: 20622 - DNA, 828 bp, Artificial Sequence
  Description of Artificial Sequence: Synthetic coding sequence
atgggccccgccggcgtggccgcccggcccggccggttcttcggcgtgtatcttctttactgtctcaacccccggtataggggacgggtctacgtgggctttactgtgaataccgctaggagagttcagcaacacaacgggggccggaagaaaggtggtgcttggcgaacgagcggccgggggccatgggagatggttttggtcgtgcacgggttccccagctcagtcgcagcccttagattcgagtgggcgtggcagcacccgcacgcaagccgcagactcgcccatgttggcccaaggctgcgcggcgagactgccttcgcttttcatttgcgggttttagctcacatgctgagagcacctccctgggcccgcttacctctgaccctaaggtgggtgcggccggatctgcggcaggacctgtgcctgcctccacctccccatgtacctctggcattcgggcctccccccccacaggcgccagcccctagaagacgggcaggccccttcgatgatgctgagcccgaaccagaccagggggacccaggcgcatgttgctccctttgcgcacagacaatacaggacgaagagggcccattgtgctgcccccaccctggctgtctgctccgcgctcacgtaatttgcctggccgaggagttcctacaggaggaaccagggcagttgctgccactggagggacagtgcccctgttgcgaaaagagcctgctatggggtgacttaatctggctatgtcagatggatactgagaaggaagttgaggattcagagctcgaagaggcccactggacagatttactcgagacctag

SEQ ID NO: 20623 - DNA, 486 bp, Artificial Sequence
  Description of Artificial Sequence: Synthetic coding sequence
atgggccccgccggcgtggccgcccggcccggccggttcttcggcgtctatctgctgtattgtctgaacccaaggtaccgggggcgggtttacgtagggtttacggtgaacaccgcacgacgagtgcagcagcataatggtggccgaaagaagggaggtgcttggcgaacatccggacgcggaccctgggaaatggtcctggtggtccacgggtttccatctagcgtggctgcattacgagacgaagaagggccattgtgctgtccacatccaggatgcctgttgagggctcacgtcatctgtctggccgaggagtttttacaagaggagcctggacagctgctgcctctggagggacagtgtccatgctgtgagaaatcccttctctggggcgacctgatctggctgtgccagatggacaccgaaaaggaggtcgaagacagtgagttggaggaggcccactggacagacctgctggagacctag

SEQ ID NO: 20624 - DNA, 765 bp, Artificial Sequence
  Description of Artificial Sequence: Synthetic coding sequence
atgggccccgccggcgtggccgcccggcccggccggttcttcggcgtgtacctactgtattgcctgaatccccggtaccggggaagggtctatgttggtttcaccgttaatactgcccgtagggttcagcaacacaatgggggtaggaaaaaagggggggcttggcggacgagcggcaggggaccgtgggagatggtcctggtagttcatgggttcccaagcagtgtcgccgcccttaggttcgagtgggcttggcaacacccacacgcgtccaggaggctggctcacgtgggacccagacttcgcggagaaactgccttcgcattccatctgcgagtgctcgcccatatgctgcgcgcacctccttgggcccggttacccctgactcttagatgggtgcggcccgatcttcgccaagacctgtgccttcccccacccccgcacgttccactagcattcggtcctcctcccccacaggctccagcccctaggcggagagcgggacccttcgatgacgccgaaccggaacccgaccagggcgacccgggtgcatgttgttccctgtgcgctcaaacaattcaggacgaagaaggcccgctatgttgccctcatcccggatgcctgctgcgggcccacgtgatttgtttagccgaggaatttctgcaggaagagccaggtcagctcctcccactcgagggtcagtgcccttgttgcgaaaaatcagccttaggaaggcctgatttggccgtgcctgacggccactag

SEQ ID NO: 20625 - DNA, 372 bp, Artificial Sequence
  Description of Artificial Sequence: Synthetic coding sequence
atggtggtgcaggaccccctgctgtgcgacctgcccatccaggtgacccttgaagaagtcaactcacagatcgcccttgaatatggccaggctatgacagttagggtttgcaagatggacggtgaagtgatgcctgtggtcgtcgttcagtccgctacagtcttagacctaaaaaaggccatccagaggtatgtccagctgaagcaagaacgagaaggtggtatccagcacattagctggtcttacgtctggcggacataccatttgacatccgcaggggagaagctgactgaggataggaagaaattgagagattatggtatcaggaaccgggatgaggtcagcttcattaaaaagctgaggcagaaatag

SEQ ID NO: 20626 - DNA, 399 bp, Artificial Sequence
  Description of Artificial Sequence: Synthetic coding sequence
atggacgtgttccaggagggcctggccatggtggtgcaggaccccctcctttgcgacctgccaattcaggtgaccttagaagaggtcaacagtcagattgctctggaatacggtcaagctatgaccgtccgcgtctgcaaaatggacggtgaagtcatgccagttgtagtggtccagtcggccacagttctagacctgaagaaggccatacagcggtacgtgcaactcaagcaggagagggaggggggtattcaacatattagctggtcttacgtctggcgaacttaccatctgacctctgccggcgagaagttaacggaagataggaagaaactgagagattacgggatcaggaaccgggacgaagtgagctttattaagaaattgagacagaagtag

SEQ ID NO: 20627 - DNA, 468 bp, Artificial Sequence
  Description of Artificial Sequence: Synthetic coding sequence
atgggccggagccggagccggagcccccggcgggagcggcggcggagcagatcaacttcccgggaacgagaacgtagacgccgggagaggtcccgcagccgcgaacgcgataggaggagaagcaggagccgttcgccccaccgcaggagatcgagaagccctcggcgccacagaagtaccagcccgtcaccatccaggttgaaggagagaagagatgaagaaaaaaaagaaacgaaggagactaaaagtaaagaacggcagatcaccgaggaggatctggaaggaaagacagaggaagaaattgagatgatgaagctgatgggcttcgcatcatttgacagcaccaagggaaaaaaagtcgatggatcagtgaatgcctacgccattaacgtaagtcagaaaaggaaatataggcaatatatgaacagaaagggagggtttaacaggccccttgattttatcgcatag

SEQ ID NO: 20628 - DNA, 468 bp, Artificial Sequence
  Description of Artificial Sequence: Synthetic coding sequence
atgggccggagccggagccggagcccccggcgggagcggcggcggagtcgctccactagcagagagcgcgagcgcaggaggcgggagcgcagtcggtcacgtgaaagggaccgtcgcagatctagatcccgtagcccacacagacggaggtcaagatcaccgcggcgccaccggtcaacgagtccttcaccctctcgcctgaaggaaagacgggacgaagagaaaaaagagacaaaagaaacgaaatcaaaagaaagacagataaccgaagaagacctggagggtaaaacagaggaagagatcgaaatgatgaaacttatgggcttcgcaagcttcgacagcacaaaaggcaaaaaggtggacgggtctgtgaatgcatacgccatcaatgtgtcacagaagcggaagtatcgacagtacatgaacaggaaaggcggatttaatagaccgctagatttcatcgcttag

SEQ ID NO: 20629 - DNA, 741 bp, Artificial Sequence
  Description of Artificial Sequence: Synthetic coding sequence
atgaacgactggatgcccatcgccaaggagtacgaccccctgaaggcaggcagcatcgacggtacagatgaggatcctcacgacagagccgtgtggagagctatgctggccagatacgtgccgaacaagggcgtcatcggggatccattgctgaccttgtttgttgcacggttaaatctgcagactaaggaggataagttgaaggaggtgttctctagatacggcgatatcagacggcttagactcgtgcgcgacctagtaacaggtttttccaagggctatgcttttatcgaatacaaggaagaaagggcagtgatcaaggcttacagagatgcagatgggctggttatcgaccagcacgagatatttgtggactatgaactggagcgcacactgaaagggtggattcctaggcgcctcggcggcgggttgggcggtaagaaagaatctgggcaactgcggttcggcggtagggacagacccttccgcaagccgatcaatttaccagttgtgaaaaatgacctctaccgagaaggaaaacgggaacgccgggaaagatcacgctccagggaaagacactgggactcaaggacgcgcgaccgcgaccacgacagaggccgcgagaagcgatggcaagaacgggaacccacacgggtgtggcccgacaatgattgggaacgcgaaagagattttagggatgatagaattaagggacgggagaagaaagagaggggaaaatag

SEQ ID NO: 20630 - DNA, 756 bp, Artificial Sequence
  Description of Artificial Sequence: Synthetic coding sequence
atgaagcccgccaacatgaacgactggatgcccatcgccaaggagtatgatcctctgaaagcagggagcatcgatggaactgatgaggacccacatgacagagccgtgtggagggccatgttggcgaggtatgtgccgaacaaaggtgtaatcggggaccctctgttgactctgtttgtggcaagactgaacttgcaaaccaaggaagataagctcaaggaggtcttttctcggtatggcgatatcagacgactgcgccttgtgcgggacttggtaacaggattttcgaagggctatgctttcattgagtataaggaagagcgggctgtgatcaaagcataccgcgatgccgacggccttgtcatcgatcaacacgaaatttttgttgattacgagctcgagaggacgttaaaaggatggatacctagaaggttgggcggtggattaggcggaaagaaggagtcaggacaactgagattcggtggtcgggataggccttttcggaaaccaataaatctgccagtggtcaagaacgatctctatagagaaggcaagagagaaaggagggagagatcccgtagccgcgagagacactgggactctcggacccgggatagagatcacgatcgtggtcgagagaagcggtggcaggaaagggagcccactcgggtgtggcccgacaatgactgggaacgggagcgggactttcgggatgatcggattaaaggacgcgaaaagaaagagcgcggtaagtag

SEQ ID NO: 20631 - DNA, 741 bp, Artificial Sequence
  Description of Artificial Sequence: Synthetic coding sequence
atgaacgactggatgcccatcgccaaggagtacgaccccctgaaggccggctctatcgacgggaccgatgaggatccacatgatagagctgtgtggcgagccatgcttgcacgttatgtcccgaacaagggagtgattggcgacccccttttgaccctgtttgttgcacgtcttaatctgcagacgaaggaagataaacttaaggaagtgttctcaagatacggagacattcggcggctgcgcctggttcgtgatctggtcaccggcttcagtaaagggtatgcattcatcgaatacaaagaggaacgcgccgtaatcaaggcctaccgcgacgccgatggcctggtcattgatcaacatgagatttttgtcgactacgagctggagcgaacgctcaaagggtggatcccccgaagattgggcggcggcctgggaggaaagaaagagtccggacagttgcggttcgggggccgtgatcgccctttccgcaaaccgattaaccttccggtggtcaagaacgatctgtatagggaaggcaagagagaaaggcgagagaggagtcgttcgcgcgagcgtcattgggactcacgcacccgggacagggaccacgaccgaggccgcgaaaaacgctggcaagagcgggagccaactcgcgtctggcccgacaatgactgggaacgggagcgggatttccgcgacgatcggatcaagggacgggagaagaaggagcggggcaaatag

SEQ ID NO: 20632 - DNA, 1371 bp, Artificial Sequence
  Description of Artificial Sequence: Synthetic coding sequence
atggagccccggtgcccccccccctgcggctgctgcgagcggctggttctaaatgtggcgggactgcgcttcgagacccgggccagaactcttggacgattccctgacaccctcctgggcgatccagcacggcgtggccggttttatgatgacgccagacgcgagtacttcttcgatcggcaccggccttcctttgacgctgtcctgtattactaccagtctgggggccggctccgccgacccgcgcatgtgcccctcgacgtattccttgaagaagtggcattttatgggctgggagctgccgccctggcccgactccgggaggatgagggatgtcccgtgccaccggaacggcctctgcctcggcgagcattcgctcgccagctttggctgctattcgaattccctgagtcctcgcaggccgctcgtgtgctcgctgtggtcagcgtgctcgttatcttggtttccatcgttgtgttctgcctagagaccttgcccgactttcgagacgacagagacggcacaggactcgccgccgccgcagctgccggaccttttccggctcccctcaacggctcctcccagatgcccggaaaccccccgcggctgccatttaatgatccctttttcgtcgtggaaacattatgcatatgttggttttcatttgaattgttagtgaggctgctcgtgtgcccatctaaagccatcttcttcaagaacgttatgaacttgatcgacttcgttgctatcctgccatattttgtcgccctggggaccgagcttgcgaggcagaggggcgtgggccagcaggcaatgagtctcgcaatactccgcgtgatcaggctggtgcgcgtgttcagaatcttcaagctcagccgccactccaaaggactgcagattctgggacagacactacgcgcctctatgagagagcttggattattgatcttttttctctttataggcgtcgtgttgtttagcagtgccgtctattttgccgaagtcgacagggtggacagtcactttacctcaatacccgagagcttctggtgggcagtggtcactatgaccacagtgggctacggggacatggccccagtgaccgtgggagggaaaattgtcggcagcctgtgcgctatagctggtgtcctgactatcagcctgccagtgcctgtaattgtgtccaattttagttacttctatcaccgagaaacagagggtgaggaagctggaatgtttagccacgttgacatgcagccctgtggccctctcgaaggcaaagctaatggagggctggttgacggtgaagtgccggaactcccgcctccactgtgggcaccacccggcaaacatcttgtgacagaggtatag

SEQ ID NO: 20633 - DNA, 501 bp, Artificial Sequence
  Description of Artificial Sequence: Synthetic coding sequence
atgacccagttcctgccccccaacctgctggccctgttcgcccccagagacccaatcccatatcttccgccgctcgaaaaactgcctcacgagaagcaccacaatcaaccgtactgtgggatcgcaccctatattagggagtttgaggacccgcgcgacgcaccacctcctacccgagccgagacacgggaggagcgcatggagcggaaacgccgggagaagatcgagcgccgccagcaggaagtggaaactgaactcaaaatgtgggacccccacaacgacccaaatgcccaaggggatgccttcaagacgctctttgtggccagagtgaactacgatactaccgaatctaaacttagacgggagtttgaagtgtacgggcctatcaaacgcattcacatggtctattctaaacgttcgggaaaaccacgcggctacgcctttatcgaatacgagcatgagagagacatgcactcaacgacccagctggcgtgcagctag

SEQ ID NO: 20634 - DNA, 114 bp, Artificial Sequence
  Description of Artificial Sequence: Synthetic coding sequence
gccgccgccgccgccgccagcctgcggaccgacgcccgggcccggcgctacgcaacctggcaggacgatcccgtgcctgcagcacaacctagtggccccctctgccctccgtag

SEQ ID NO: 20635 - DNA, 1026 bp, Artificial Sequence
  Description of Artificial Sequence: Synthetic coding sequence
atggagcaggccctgcaccggttcggccggggcctggtgtggctgagcgtggcctggctctctgtgggcagggtcagagtccgtgacgatggcgacactgggcgcggcttctgtagagctggccccgtgctcacacgagggccctctggggactctagtcctctccccctccctacatctgtgacggctgcctacaagcacgccgacggcaagaaaatagatggcagaagagtgctggtcgatgtggagagaggtcgtactgtgaagggatggcggccgcggcgactcggcggagggctcggggggacccgaagggggggcgcggatgttaatatccggcacagcggccgcgatgatacatccagatacgacgaacggccaggaccaagccccctgccacacagagaccgggatcgggacagagagcgcgaaagaagggagcggagccgcgagcgcgataaggagcgagaacgcaggcggtctcgctcccgtgacaggagacgtcgttcacggagccgggacaaggaggagagacgacggagccgcgagaggtctaaagataaggaccgcgatcgcaaaagacgctcatcccgaagtcgggagcgtgctaggcgagaaagggaacggaaagaggagctgaggggaggcggtggcgacatggcagaaccttctgaggccggtgatgcgccacccgatgacgggccacccggcgagctgggccccgatggtcccgatggacctgaggaaaaaggacgcgaccgcgatcgggagagaaggcgaagtcaccggagcgagcgagagcgtcgtcgggaccgagaccgcgaccgcgaccgcgaccgggagcacaagcggggtgaacgtggatctgaaaggggacgtgacgaagcacggggcggcggcggcgggcaagacaatggtcttgaaggcctggggaacgattctcgcgatatgtacatggaatcagagggtggggacgggtatttagcaccagagaatggatatctaatggaagcagcccccgagtag

SEQ ID NO: 20636 - DNA, 1314 bp, Artificial Sequence
  Description of Artificial Sequence: Synthetic coding sequence
atgacccagttcctgccccccaacctgctggccctgttcgccccccgggatcccataccatacctgcctcccctggagaaactcccgcacgaaaaacaccacaatcagccttactgtggaatcgctccctacatccgggaattcgaagacccgcgggacgctcctccccctacaagagccgagaccagggaagagcggatggaacggaaaagaagagagaaaatcgaacgtaggcagcaggaggtggagaccgaactcaaaatgtgggatcctcacaacgatcccaacgctcagggagatgcctttaagaccctgtttgtggccagagtgaattatgatacaactgagagcaagctccggcgcgaatttgaggtctacggccccataaaacgcatccacatggtctactccaagcggtccggtaaaccacgcgggtacgcttttatcgaatatgagcacgagcgggatatgcattccgcctataagcacgcagatggaaaaaagatcgacgggagacgagtgctcgtggacgttgagcggggccggaccgtgaagggatggagacctcgtcggttagggggcgggcttggcggcacgagacgcggaggagcggacgtcaatataagacacagcgggagggacgatacttctcggtacgatgaaaggcccggaccctccccgttgccccatagggatcgggacagagatcgcgagcgagaaagacgagagcggtctagggagagagataaagagcgtgagcggcgccgcagccgttccagggatagacgacgtcggtcacggtctcgggacaaggaagaaagacgccgaagcagagagcgctccaaagacaaagacagagaccgaaagaggcgatcctcacgaagccgggagcgcgcacgaagagaaagagagcggaaggaggaactgcgggggggcggaggggacatggcagagccatctgaggccggcgacgcccccccagatgacgggccacctggagagctggggcctgacggcccagacggtccagaagagaaaggacgtgatagagatcgcgaacggcggcggtcccaccgatccgagcgtgagaggcgccgcgatagagacagagatagagaccgggacagagaacataagagaggggaaagaggatcggaacggggcagagatgaagccaggggcggaggcgggggccaagacaatggtttggaaggattgggcaatgactcccgggatatgtatatggaatcggagggaggcgacgggtatctcgctcctgaaaacggatacctgatggaggccgctcctgagtag

SEQ ID NO: 20637 - DNA, 678 bp, Artificial Sequence
  Description of Artificial Sequence: Synthetic coding sequence
atggacatccggcccaaccacaccatctacatcaacaacatgaacgataagattaaaaaagaagagctgaaacggtctctgtacgccctgtttagtcagttcggccacgtggtggacattgtagccctgaagacaatgaagatgagggggcaagccttcgttatattcaaggagctgggatccagcactaacgccctgagacaattgcagggcttccccttctatgggaagcctatgaggatacagtatgccaagaccgattccgacattattagcaagatgcgaggaacgtttgcagacaaggagaagaagaaggagaagaagaaggctaagacggtggagcagacagccacaaccacaaataaaaagcccgggcagggtactccaaacagtgctaatacacagggaaactctacaccaaatcctcaggtgccagactacccccctaattacatactgtttttgaataatctgcccgaggagacaaatgaaatgatgttgtccatgctctttaaccagtttccgggttttaaggaggtccggctagtccctggcaggcatgatatcgctttcgtggagttcgagaacgatgggcaagccggagcagcaagagacgcacttcaaggctttaaaattacacccagccacgctatgaagattacgtatgccaagaaatag

SEQ ID NO: 20638 - DNA, 678 bp, Artificial Sequence
  Description of Artificial Sequence: Synthetic coding sequence
atggacatccggcccaaccacaccatctacatcaacaacatgaacgataagattaaaaaggaggagcttaaaaggtccttgtacgctttattcagccagttcgggcacgtggtagatattgtggctctcaagaccatgaaaatgaggggtcaggccttcgtcattttcaaagaacttgggtcttctacaaatgctttgagacagctgcagggatttcccttttacggaaagcccatgagaatccaatacgctaagactgattccgatatcatctcgaagatgaggggcacctttgcagacaaggagaaaaaaaaagagaaaaaaaaggcgaagacggtggaacagacagctactaccaccaacaaaaagcctggccagggcaccccaaactctgctaatactcagggcaattctactcccaatccacaggtacctgattacccccctaattacattctgttcctgaacaacctgcccgaagagaccaacgaaatgatgctctcgatgcttttcaaccagtttccgggattcaaggaggtccgactggtcccagggagacacgacattgctttcgtcgaattcgaaaacgatggacaggcaggcgctgcaagggacgcgctgcagggctttaaaataaccccttcccatgccatgaagattacctatgctaagaaatag

SEQ ID NO: 20639 - DNA, 2142 bp, Artificial Sequence
  Description of Artificial Sequence: Synthetic coding sequence
atgagcacccggacccccctgcccaccgtgaacgagcgggacaccgagaaccacacctctcacggtgacgggcggcaggaagtgacctcccgtacatccagatccggagcaaggtgcaggaacagtatcgcgtcctgtgctgacgaacaaccccatatcggcaattaccgactcctgaaaacaattggcaagggaaattttgctaaagtgaaactggcccgccacatccttacaggaagggaagttgctattaaaataatcgataaaacacagcttaaccctacctctctgcagaagctgttccgggaggtccggatcatgaagatactgaatcaccccaatattgtgaagctctttgaggtgatcgagaccgaaaagaccctttatctgattatggagtacgcctccggaggagaggtgtttgactatctggtggcacacggccgtatgaaggagaaggaggcgcggagcaagtttagacagattgtgtccgccgtgcaatactgtcaccaaaaacgtatagttcaccgggacttgaaagccgaaaacctccttctggacgctgatatgaacatcaaaattgcagacttcggcttcagtaatgagtttactgtaggtggcaagttggataccttttgtgggtctcccccctacgcagcccccgaactcttccagggcaaaaaatatgacgggcctgaagttgatgtgtggagtctgggagtgatcctttacacgttggtgtccgggtcactgcctttcgatggacagaatctcaaggagttaagggaaagggtgctgagggggaagtatcgaattccattctacatgtccacggactgtgaaaatctactgaagaggttcctggtgcttaacccaattaagcgtggaacactcgagcagatcatgaaagatcggtggattaatgcgggccatgaggaagatgaactgaaaccattcgtggagcctgaattggacatcagcgaccagaagcgaattgacatcatggtgggcatgggttatagccaggaggaaattcaagagagtctctcaaagatgaagtatgacgaaatcacagccacttatcttcttctgggcagaaagagctctgaggtccgacctagcagcgatctgaataactcgaccggacaaagcccgcatcataaggtccaaagatccgtgttctcctctcagaagcagcgacggtatagcgatcatgccgggcccgccatcccctcagtggtcgcataccctaagcgatctcagacatcaactgccgactctgacctgaaagaagatggaatcagctccaggaaaagttccggctctgccgttgggggcaagggaatagctcccgcaagtcccatgctggggaacgcttctaatccaaataaagcagatatcccagagcggaagaagtcaagcacagtcccatccagtaatactgctagcggaggcatgacacggcgcaatacctacgtctgttctgaacgcaccacagccgatcgacactccgtaatacaaaacgggaaggaaaactcaactatccccgaccagcgaacccctgtggcctctactcattctatctcttccgccgctacccccgatcgcattcggtttccccggggcacggcttcccgaagtacctttcacggccagccacgagagaggcggacggcaacctataacggcccaccggcctcacccagtttaagtcacgaagccacacctctttcacagacgagaagcagaggaagtactaatctgtttagtaaattaacatccaagctgacgagaagtcgaaatgttagtgctgagcagaaggatgagaacaaagaagcaaaaccacggagcctgagattcacatggtccatgaaaaccacctcatcaatggaccccggggatatgatgcgcgagatcagaaaggtgttggacgccaataactgtgactatgagcagcgcgagcgatttctccttttttgtgtgcatggggacgggcacgccgaaaacctggtgcagtgggaaatggaggtgtgcaagctgccccgtctttccctgaacggggtgcgctttaagaggatctccgggacttccatagcgtttaagaatatcgcctcaaagatagccaatgaactcaagctgtag

SEQ ID NO: 20640 - DNA, 1059 bp, Artificial Sequence
  Description of Artificial Sequence: Synthetic coding sequence
atggcccccaagctgatcaccgtgctgtgcctgggcttctgcctgaatcagaaaatttgcccacacgcaggcgctcaggataaatttagcctttccgcctggcccagccctgtggtacctctcggcggacgcgtgactctgtcctgtcacagtcacttgaggttcgtgatctggacaatcttccaaacgaccggaactcgatcacacgagctccacaccggcctgagtaacaacattacaattagtccagttactcccgagcacgcaggtacctaccgctgtgttgggatttacaagcacgccagtaagtggtctgccgagtctaattccttaaagattatagtgacagggttgttcactaagccgtcgatctcggcacatccaagctctctcgttcatgctggggctagggtgtcattgcggtgtcatagcgagctggcctttgatgagtttattttgtataaggaggggcatatccaacattcccagcaactggaccagggtatggaggcggggatccactatgtggaggccgtgttttccatgggaccagtgacccccgcgcatgccggcgcctaccgatgctgtgggtgtttctcccacagcagatacgaatggtccgccccctccgaccccttggacattgtcattactggtaaatataagaaacccagtttgtctacacaagtcgacccaatgatgagactaggggagaaactgactctattttgttccagcgagatttcctttgaccagtaccacctgtttagacacggggttgctcacggtcaatggctgtccggcggccaacggcaccgcgaggcttttcaagcaaacttctccgtggggagagcaacccccgttccaggcggcacgtatagatgctatggaagttttaatgacagtccttataaacctccagtaactaggtgcaatttcactccacaggaaacactgcgggtgctcctgtgccacagtcaaaacccaccattaaacttgacccatctggctttgaaagactcccctgccacatgtatctgttctctggactctcagtag

SEQ ID NO: 20641 - DNA, 75 bp, Artificial Sequence
  Description of Artificial Sequence: Synthetic coding sequence
ctggccagcagctgggacctgagccccgagcccgtgcccgagagccttggcccacccgtaggcccgggcctatag

SEQ ID NO: 20642 - DNA, 375 bp, Artificial Sequence
  Description of Artificial Sequence: Synthetic coding sequence
atgctggtgctgggcagccagaagctgacccagctgcgggacagcattcggtgtgtctcggacctccaaatcgggggggaattcagcaatacgcctgatcaggcacctgagcacatctccaaggacctgtataaatctgccttcttttattttgaagggacgttttacaatgacaaacggtacccggaatgcagggatctatccagaacaatcattgagtggagcgagtcacacgaccgaggatacggaaagttccagacagcgaggatggaagacttcacgttcaatgatctctgcatcaagctaggtttcccctacctgtactgtcaccagggagactgcgaacacgttatagtgatcactgacatcaggtag

SEQ ID NO: 20643 - DNA, 732 bp, Artificial Sequence
  Description of Artificial Sequence: Synthetic coding sequence
atggccgagggcagccggggcggccccacctgcagcggcgtgggcggacgacaagaccccgtcagcggctccggagggtgtaactttccagaatacgagttaccagaactgaacacaagagctttccacgtaggggcctttggggagctatggcgtggcagattgcgcggcgctggcgatctgtcccttagggaaccacctgcaagtgcactgcccgggtcccaagccgccgattccgatcgcgaggacgctgcagtggcaagagacctggactgctcgttggaagccgcagccgagctgcgcgccgtgtgtgggttggataagttgaaatgtctcgaggatggcgaggacccagaggtcattcccgagaacacagacttggtcacacttggcgtgaggaaaaggtttctggaacaccgagaggaaaccatcactattgatcgcgcgtgtcggcaagaaacctttgtttatgagatggagagtcatgccattggaaaaaaacctgaaaactccgcagacatgatcgaggaaggggagcttattctgtctgttaatatcctttatcctgttatattccacaaagacctctacaagtccgcgttcttctattttgaaggcacgttctataacgacaaaagatacccagaatgtcgggatctgtctcgaacaataatcgagtggtccgagtcgcacgatcgggggtatgggaagttccagacagctaggatgtag

SEQ ID NO: 20644 - DNA, 1236 bp, Artificial Sequence
  Description of Artificial Sequence: Synthetic coding sequence
atggccgagggcagccggggcggccccacctgcagcggcgtgggcgggcggcaggacccagttagtggcagtgggggttgtaactttccggagtacgagctcccagaactaaacacaagagcttttcacgtgggcgcctttggggaactttggcgaggtcgattgagaggagctggtgacctgtctctgcgggaacctcctgccagtgcactgccgggaagtcaggctgcggactccgatagggaagatgctgcagtcgccagagacctggactgctccctggaagccgccgctgaattgcgcgcagtgtgcggattggacaagctgaagtgcctggaggatggtgaggaccctgaggtaatccccgagaacaccgatttagtgaccttgggcgtcagaaagcggtttctcgagcatcgagaggagaccattactattgatcgcgcctgtcggcaagaaacttttgtgtacgaaatggagtcccacgccatcgggaagaaacccgagaattccgccgatatgatcgaggagggcgagttgatcctgtcggttaacattttgtaccccgtgattttccacaaacataaagagcataagccctatcagaccatgcttgtactgggatcccagaagcttacccagctgcgggattcaatccggtgcgtgtctgatttgcagatcggtggagagttcagtaatacccccgatcaggctccggagcatatatcaaaggatctctacaagtcagcttttttttactttgaaggcacattctataacgataagaggtaccccgagtgtagggatctatctcggacgattattgagtggagtgaaagccacgataggggatacggaaagtttcagacagcacgaatggaggactttacttttaacgatctgtgcataaagctgggattcccctacctctactgtcaccagggggactgtgagcacgtcatcgttattactgacatcagactcgtgcatcacgacgactgtcttgatcgaacactttaccctctgctgattaagaagcattggctgtggacacgaaagtgcttcgtgtgcaagatgtatacagctaggtgggtaaccaataacgactcttttgccccagaggatccctgttttttctgcgacgtttgctttaggatgctacattacgactccgaaggaaacaagttaggcgagtttctggcatatccgtacgtggacccaggcacatttaattag

SEQ ID NO: 20645 - DNA, 732 bp, Artificial Sequence
  Description of Artificial Sequence: Synthetic coding sequence
atggccgagggcagccggggcggccccacctgcagcggcgtgggcgggcggcaggatcccgtcagcgggtcaggaggttgtaacttccccgagtatgaactacctgaacttaacacacgcgcattccacgtgggagccttcggtgaactgtggagaggtcggctcagaggagctggcgatctgtccttgcgggagccaccagctagcgccctgcctgggtcccaggcggctgatagtgacagagaagatgccgctgtcgctcgcgaccttgattgtagtctagaggctgccgccgaactcagagcggtgtgtgggctcgataaactgaagtgcctggaggatggcgaggacccagaggtgatccccgaaaatactgatctcgtgactctaggcgtaagaaaaaggttccttgagcaccgcgaggagaccattacaatagatcgcgcctgtcgtcaggaaacttttgtttatgaaatggagagccacgcgatcggaaagaaacctgagaactcagcggacatgattgaggagggcgagctcatcctgtcggtgaacattctttacccagtgatctttcataaggacctctacaagtctgcctttttttactttgaaggcaccttctacaacgacaaacgatatcctgagtgccgggacctgtccagaacaattatcgaatggtccgagtctcacgatcgtggatacggcaagttccaaactgctcgaatgtag

SEQ ID NO: 20646 - DNA, 657 bp, Artificial Sequence
  Description of Artificial Sequence: Synthetic coding sequence
atggccgagggcagccggggcggccccacctgcagcggcgtgggcggccggcaagatccggtgtcgggctccggaggctgcaatttcccagaatatgagctccctgagctcaatacacgtgcttttcacgttggggcctttggcgaactctggcggggccggctccgaggcgctagggatctggactgcagcctggaagcggccgccgagttgcgcgccgtttgcgggctggacaaactgaagtgcctagaggatggcgaggatccagaggtgatcccggagaacacagatctggtcacactcggagtccggaagaggtttctcgagcacagggaggagacaatcacaatcgatagagcttgtcgacaggagacctttgtctatgagatggaaagccacgcaatagggaagaagcctgaaaattctgctgacatgattgaagaaggagagttaatcctgagcgtgaatatcctgtaccctgttatttttcataagcacaaagaacataaaccctaccaaactatgcttgttcttgggtcacagaagctgacccagctgagggactcaatccggtgcgtgtcagacctccaaataggcggggagtttagtaacacccccgaccaagctcccgagcacatctctaaaaattatcactag

SEQ ID NO: 20647 - DNA, 1236 bp, Artificial Sequence
  Description of Artificial Sequence: Synthetic coding sequence
atggccgagggcagccggggcggccccacctgcagcggcgtgggcggtaggcaggatcccgtgtccggtagcgggggatgtaacttccccgaatatgagctacccgagctgaataccagagcgttccatgtaggcgcttttggagagctgtggcgcggcagactcaggggggccggtgatttaagcctgcgggagccacctgcgagtgctctgcctgggagccaggccgccgatagcgatcgcgaggacgctgcagtcgccagagatcttgattgttctttggaggccgccgccgagttgagagctgtgtgtggcttagataaacttaaatgcttggaagacggcgaagaccctgaggttattcccgaaaacactgatcttgttacactgggtgtgcgcaaaaggttcctcgagcacagagaagaaactatcaccattgatagagcgtgcaggcaagagacgtttgtgtacgagatggagagccacgctatagggaaaaaaccagaaaatagcgctgacatgatagaagagggcgaacttatcctgtccgtgaacatcctgtacccagtgattttccacaagcacaaagagcacaagccataccagaccatgctggtattgggatcacagaaactcacacagcttcgcgactccatcaggtgcgtaagtgaccttcagattggaggagaattctctaatacccccgaccaggctcctgaacacatcagcaaggatctgtacaagagtgcctttttctattttgagggtactttctacaatgacaagcggtaccccgagtgtagagacttgtcccgaaccattatcgagtggagtgagtctcatgacagggggtacgggaaattccaaaccgccagaatggaggactttactttcaacgacctttgtattaagctaggctttccctatttgtactgccatcaaggtgactgtgaacacgtgatcgttatcaccgatatcaggctggtgcatcacgatgattgtctggataggacgctataccctctgctcatcaaaaagcactggctgtggacaaggaagtgctttgtctgtaagatgtacacagctagatgggtgaccaataacgattcctttgcccccgaggatccctgctttttctgtgatgtgtgtttcaggatgctccactacgacagcgaaggaaataaattaggggagttcctagcctatccttatgtggatccaggaacctttaactag

SEQ ID NO: 20648 - DNA, 1236 bp, Artificial Sequence
  Description of Artificial Sequence: Synthetic coding sequence
atggccgagggcagccggggcggccccacctgcagcggcgtgggcggcaggcaagaccccgtgtctggatccggcgggtgcaacttccctgagtatgaactacctgagcttaacactcgggcattccacgttggcgccttcggggaactatggagaggacgcctacggggagctggcgacctatctctgagagagcctcctgcatctgcattacccggcagccaggccgccgattctgatagagaagacgctgccgttgctagggacctcgactgcagtctggaggccgccgccgaactgcgagcagtgtgcggtctggacaaactcaagtgccttgaagacggtgaagaccccgaggtgattccagagaacacagatttggtgaccttaggcgtaagaaagcgattcctggagcatcgtgaagaaacaattaccatagacagggcctgtagacaggagacattcgtgtacgaaatggaatctcacgctattgggaagaaaccagaaaactctgctgacatgatcgaggagggtgaactgattttgtcagtcaacatcctttacccagtgattttccacaaacacaaagaacacaagccttaccagacaatgctggtcttggggtcacagaagcttacccagctccgcgactctatccggtgtgtgtctgatttacaaataggaggcgagttctcaaatacgcctgatcaggctccggagcatatttcaaaggatctgtacaagagtgccttcttctatttcgaaggtaccttctataacgacaagcgatatcccgagtgcagagacctttcccgaactatcatcgagtggtcagaatcacatgacaggggttacggaaagttccagactgctaggatggaagacttcactttcaacgacctgtgtatcaaacttggcttcccatacctctactgtcaccagggcgattgcgagcacgtgatcgtaattacagatattcggctcgttcatcacgatgattgcttagatagaaccttgtacccgctgctgatcaagaagcactggctatggacgaggaagtgctttgtctgtaagatgtatacagcccgctgggtgacgaataatgacagctttgcccccgaagatccctgctttttttgcgacgtctgctttcgaatgctgcactatgacagtgaagggaacaaattgggagaattcttggcatacccttacgtggatcccggaacttttaattag

SEQ ID NO: 20649 - DNA, 4410 bp, Artificial Sequence
  Description of Artificial Sequence: Synthetic coding sequence
atggacgtggacgccgagcgggagaagatcacccaggagatcaaggaattagaacggattctggaccccgggtctagcggcagtcatgtggaaatcagtgagagctcactcgagtccgactccgaggccgactcattaccttctgaggatctggaccccgccgacccaccaatcagcgaagaggaacggtggggcgaagctagtaacgatgaggacgacccaaaggataagaccctgccggaggatcccgaaacatgcctgcagttaaacatggtctatcaggaagtgatccaggagaagctggccgaggccaatcttcttttagctcagaatcgggagcagcaggaagagctgatgcgagacctcgccggctcaaagggtacaaaggtcaaggacggcaagtcattgccccctagcacttacatgggccactttatgaagccctactttaaggataaagtgactggcgtaggcccaccagctaacgaggatactagagagaaggctgctcagggaatcaaagctttcgaggaactgctagtgacaaagtggaaaaactgggaaaaggccctcctgaggaaaagtgttgtcagcgaccggctacagcgtctgctgcagcccaagctactgaaactggaatacctgcaccagaaacagtccaaagtttcctccgagctggaaaggcaggccctcgaaaagcagggcagagaggctgagaaggagatccaagacatcaatcagctgccggaggaggcgctgctgggaaataggctggactcccatgactgggaaaaaatttcaaatattaatttcgagggatccaggtcagccgaggaaatcagaaagttttggcagaattcagaacacccatctatcaacaagcaggagtggtctcgggaagaggaagagagacttcaagcaatcgccgccgcccatgggcatctcgagtggcagaaaatagctgaggaattggggacatctcggagtgcatttcagtgtcttcaaaagttccagcaacacaacaaggctctaaagcgcaaagagtggactgaagaagaggatagaatgcttacccagttggtccaggaaatgcgggtcggaagccacatcccctatcggcggattgtttactatatggaggggcgcgactcaatgcaattgatctaccgctggaccaaaagcctggaccctggtctgaagaaaggttattgggcgcctgaagaggatgcgaagttgctacaggctgtggctaagtatggcgagcaggattggttcaagatacgagaggaagtccccggtagaagtgatgcccaatgccgcgatcgttatctcaggaggttgcacttctctctaaagaaggggaggtggaaccttaaggaggaggagcaactgatcgagctgattgagaaatatggtgtgggtcactgggccaaaatcgcaagcgaactcccccatcgctcggggagccagtgtctgtcgaagtggaagattatgatggggaaaaaacagggtctcagacggagaagacggcgcgcacgccactccgtccgatggtcatctaccagctcctccggctcctctagcggtagctcaggtggcagttcttctagttcctctagcagctcagaagaagacgagcccgaacaggcgcaggctggtgagggtgatagagcgctgctttccccacagtacatggttcccgacatggacctgtgggtgcccgccaggcagagcactagccagccctggcgtgggggtgctggcgcttggctcggcggtcctgctgcttccctgtcccctccaaagggatcatctgccagccaggggggctccaaagaagcctcaacaacagcagccgctcctggagaagaaacatctccagtgcaggtcccagctagggctcatggccctgtgccccggagcgcccaagccagccattcagctgatactcggccagccggcgcggagaaacaggctctggagggcggacgccgtctgctgacggtccctgtagagacagtgctccgagttctgcgggctaacacagcagcacgcagttgtactcaaaaggagcagctgagacagccccctctgccaactagctcacccggggtcagcagcggagatagcgtggctaggagccatgttcagtggctcaggcaccgggccactcagtcgggacaacgcagatggcgccacgctctccatagaaggctgctgaacagaagattgctactcgcagttacaccatgggtgggcgatgtggtggtgccatgtacgcaagcatcacagaggcctgctgtggtacaaacccaggccgacggactacgcgaacagttgcagcaagccagactggcatctacacccgttttcactctctttacgcagctgttccacatcgacaccgcgggatgccttgaggttgtgcgagagaggaaggcactgccaccccgcctgccgcaggcaggtgcaagagaccctcctgtgcacttgctccaggcctcttcaagtgcccagtctactccagggcacctatttccaaatgtgcctgcacaggaggcttctaagtccgcttctcataagggatcccgtcgactcgcatccagccgcgtcgaacgcaccctgccccaagcgtcactgctggcgtctaccgggccccgccccaaacctaagaccgtctcagaattacttcaggagaaacgtcttcaggaagcacgggcccgcgaggctacaagaggacccgtggtcctgccgtcccagcttctagttagcagcagcgtgatcctgcagcctcctttaccgcacacaccccacggtagaccagcccccggaccgaccgtcttaaatgtgcctttgagcggcccaggagcacccgccgctgctaaaccaggtacaagtggctcatggcaggaggcgggaacgagcgcaaaagacaagcgattgtctactatgcaggccctcccactagccccagtgttctcagaggcagagggcacggcacctgcagccagccaagcaccagcattggggcccggtcaaatcagcgtgtcatgccctgagtctggattgggccagtcacaagctcccgccgcttcccggaaacaagggctcccagaagcaccgccgttcttacccgcagcaccctcgcctacccccctcccagtccagcccctgtccttaactcatatcggaggccctcacgttgccacaagcgtgcccctgcccgtgacctgggtgctgacagcgcagggcctactgcctgtgcccgtgcctgccgttgtttcccttcctaggcccgctgggacaccagggccagccggcctgctcgccacgctgctgcctcccctgacagagaccagggccgcacaggggcctagggcccccgcgctatctagcagctggcagccccctgcaaacatgaatcgggagccagagccctcgtgccggaccgacacacctgcaccccccactcacgccctgtcccagtcacctgctgaggccgacggatccgtcgcctttgtcccaggagaagcgcaggttgctagggaaatccctgaaccacgcacaagcagtcacgccgaccctcccgaggcagagcctccgtggtcggggcgcctgcccgcttttggaggagtgatccccgccacagaaccccggggaacacccggttctcctagcggcacacaagagccccggggtcccctgggcttagagaagttacctttaagacagcccggaccagagaaaggtgccctggacctggagaaaccgcctctgccccaaccaggccccgaaaaaggagcccttgacctgggtctgctctcccaggagggagaagccgctacacaacagtggcttgggggccagaggggggtgcgggtcccccttctcgggagcaggctgccatatcaacctcccgctctgtgttccctacgagcactaagcggattactgctccacaaaaaggccttggagcacaaagctacttccctggtagtgggtggtgaggcggaaaggcccgccggggccctgcaggcaagcttagggttggtacgggggcaattacaggataacccggcttatctgctcctaagggcacgcttcctcgccgccttcacactgccagctctgttagccacgctcgccccacaaggagtcagaactacactatcagtcccaagtagggttgggtctgagagcgaagacgaggatctgctctcggagcttgaactcgcagatagagatggtcagcctggctgcacaactgctacttgtcccatccaaggtgcaccagactccggaaagtgtagcgcaagcagttgcctcgacacaagtaatgaccctgacgacctcgatgtcttgaggacacgccacgccaggcacactcgtaaacggcgccgattagtgtag

SEQ ID NO: 20650 - DNA, 207 bp, Artificial Sequence
  Description of Artificial Sequence: Synthetic coding sequence
atgctgagccggctgcaggagctgcggaaggaggaggagaccctgctaaggctgaaggccgccttgcatgaccagctgaataggttgaagatgcttgtccatgtagataatgaggcatccatcaaccagaccacgcttgaactaagtactaaatcgcacgtcactgaggaagaggaggaggaggaagaggaagaaagtgactcctag

SEQ ID NO: 20651 - DNA, 297 bp, Artificial Sequence
  Description of Artificial Sequence: Synthetic coding sequence
atgctgagccggctgcaggagctgcggaaggaggaggagaccctgctgcggcttaaggccgctttgcatgaccagctcaatcggctgaaagtggaagagctggcactgcagtctatgatttcctcgcggcgcggggacgaaatgctaagctcacacacagtgcccgaacagagtcatgacatgctggtgcacgtcgataacgaggccagcattaatcagaccaccctcgagttgtcaaccaagtcacacgtcactgaagaagaagaggaagaagaggaggaggaatccgactcatag

SEQ ID NO: 20652 - DNA, 297 bp, Artificial Sequence
  Description of Artificial Sequence: Synthetic coding sequence
atgctgagccggctgcaggagctgcggaaggaggaggagaccctgctgagactcaaggctgccctgcacgatcagctgaatcggctcaaggtggaagaactcgcccttcagagcatgatcagttcccggcgaggggatgagatgctgtccagtcacaccgtgccagaacagtcccatgacatgttggtccacgtagataatgaggcatcgattaatcagacaacattagagctatcgactaaaagccacgtaaccgaagaggaagaggaggaagaagaggaagagtccgacagttag

SEQ ID NO: 20653 - DNA, 5052 bp, Artificial Sequence
  Description of Artificial Sequence: Synthetic coding sequence
atgagcagccggcggaagcgggccccccccgtgcgggtggacgaggaaaaacgacaacagttacactggaacatgcatgaggatcgccggaacgaaccgatcatcatttctgatgacgatgagcaaccatgtcctggatccgacacatcaagtgctcactatattatcctttcagattccctgaaggaggaggtggctcaccgcgacaaaaagaggtgttccaaggtggtcagcttctccaaaccgatagagaaggaggaaacagtgggcatattctcacccctgtctgttaaacttaatatagtgatctctccataccacttcgataacagctggaaagccttccttggcgaactgactctccagctattaccggcacagtccttaattgagaactttagcgagagatcaattactctgatgtcctccgagtcctccaatcaattccttatctacgttcactcaaaaggagaggatgtggagaagcagaagaaggagcctatgtcgatctgcgacaagggtattcttgtggaaagctccttctctggtgagatgctagaagacctcggttggctccaaaaaaagagaagaatcaagctgtatcagaagcccgaaggcaaccatatcattaaagtaggaatctatttgttggaggctgggctggctaaacttgactttctatccgatgctaattctagaatgaagaagttcaaccaacttatgaagaaagtaatggagaagctgcacaatagcatcatcccagatgtgttggaagaggacgaggatgacccagagtcggagcccgagggccaggatatcgacgagctataccatttcgtaaaacagacacatcagcaggagacacagtccatccaggtcgacgtgcagcacccagcattgattccagttctgcgcccctaccagcgagaagcggtcaactggatgctgcagcaggaatgcttcaggtcttcccccgctacagaaagtgctctccacttcctgtggcgcgagatcgtgaccagcgagggattaaagttatattacaacccctatacaggctgcattattcgagagtatcctaattctggccctcagctgctcggggggatactcgccgacgaaatggggctgggaaaaacggtagaagtattagccctaatcctaacccacacccgccaggatgtgaagcaggacgcattgacactcccagagggtaaggtcgtgaactactttatccccagtcactatttcggcggtaagttgaagaagacagagatccagaacatagagttcgaacccaaagaaaaagtacaatgtcccccaacccgcgtaatgatcctgaccgccgtcaaagagatgaacggtaaaaaaggcgtctccatactatccatttacaagtatgtgtcatccatctatcgatacgacgtccagcgcaatcggagcttgttaaagcgaatgctgaagtgcctaatattcgaagggctggtgaagcagatcaaagggcatgggttctctggaactttcaccttggggaagaattataaggaggaggatatttgcgataaaaccaaaaagcaggctgtgggctccccccgcaagatacagaaagaaacccggaaaagtggtaataaggacacggactctgagtacctgccctcggacacttctgatgacgacgatgatccgtactattactactacaaatcccgcaggaatagatctaagctcaggaagaagcttgtccctagcacgaaaaaggggaagagccagccctttattaaccctgatagtcagggccactgtccggccaccagcgattctggaataactgacgtggctatgtcaaagtccacctgtatttctgaatttaaccaggagcatgaaactgaagactgtgcagaatctctgaatcatgcggattcagacgtaccgccttctaacaccatgtctccttttaatacaagcgattatcggttcgagtgtatctgcggggaactagatcagattgacaggaaaccacgcgttcaatgcctgaagtgtcacttgtggcagcacgccaaatgtgtaaactacgacgagaagaacctgaaaattaagcccttctactgcccacactgccttgtggctatggagcccgttagcacacgagccaccctgatcatctctcccagttccatatgtcatcaatgggtggatgagataaatcgtcacgtccgttcctcctctctgcgggttcttgtgtatcaaggtgtgaaaaaggatggatttctgcaaccacacttcctcgctgagcaggatatcgtgatcattacttatgacgttttaagatcggaactgaactatgtggatatacctcactctaactccgaagatgggcgccgtctgagaaaccagaaaaggtacatggccatcccctctccactggtggccgtggaatggtggcgtatctgtctggatgaggcacagatggttgagtgtcccaccgtaaaagccgcagaaatggcacagcgcttatcaggaatcaataggtggtgtatatccgggacacccgtgcagcggggcctggaggacctgttcggtctagttgttttcctaggtattgagccgtattgtgtgaagcactggtgggtccggctactttatcgcccatactgtaagaaaaatcctcagcacctgtatagctttatcgctaagatcctatggcgctcagccaagaaggatgtgatcgatcaaattcaaattcccccgcagactgaagagatccattggctccatttctcccccgtggagcggcacttctatcatcgccagcatgaggtctgctgtcaggacgtggtggtcaagctgaggaagatttccgactgggcccttaagctgagcagtctcgatagaaggaccgttacgtctatcttataccctttgctgcggctgagacaggcctgctgtcacccacaggcagttagaggggagtttcttcctcttcaaaagagcacaatgacgatggaggagctgctcacgtcactccagaagaaatgcggcactgaatgcgaggaagctcaccggcagctcgtttgtgccttgaacgggctggcaggcattcacataataaagggtgaatacgccctcgcagcggaattgtaccgagaggtgctacgcagttccgaggagcataagggaaaactgaaaacagacagcctccagcgcctacatgcaactcacaatctgatggagctattgattgcccggcaccccggcataccacctaccttgcgcgacggccggctggaggaagaggctaagcagctgagagagcactatatgagcaaatgcaacactgaagtggcggaggcccagcaggctctttatcccgtgcaacagactatccacgaattgcaacgaaagattcactcaaatagcccgtggtggctgaacgtgattcacagagctatcgagttcaccatagatgaggaacttgttcagagagtacggaacgagattaccagcaattacaaacagcagaccggaaagctgagtatgtctgagaaattccgggactgtagaggactgcaatttcttctcaccactcagatggaggagttgaacaagtgccagaagttagtgcgcgaggccgtgaaaaacttagaaggtcccccttcaagaaatgtcatcgaaagcgccactgtctgccatttgaggcccgccaggttaccgcttaattgctgcgtcttctgtaaagcagatgaactcttcacggagtatgaaagcaagcttttctctaacacagttaaaggccagactgctatctttgaagaaatgattgaggacgaagagggcctcgtagatgacagagctcctaccacaacaagggggctgtgggctatctctgaaacagagcggagcatgaaggcaatcctctccttcgccaagagccacagattcgacgtggagtttgtagatgaaggatccacatctatggatcttttcgaagcctggaagaaagaatataagctgctgcatgagtactggatggcgctcaggaaccgcgtctcagctgtcgatgaacttgccatggctactgagagactcagggtgagagatccacgggaacccaagcccaacccacccgtactgcacatcatcgagcctcatgaggtggaacagaatcgaataaagcttcttaatgataaagccgttgcaacttcccaactccagaagaaactgggccagctcctgtacctgacaaatctggaaaaaagccaggacaagacctcagggggagttaaccccgaaccctgtccgatatgcgctaggcagcttggtaagcagtgggccgtgctcacctgcgggcattgcttctgtaatgagtgcattagtattatcattgaacagtattccgtgggctctcaccggagctccattaaatgtgccatctgccggcagactacatcacataaagagatatcttatgtgttcacctcggaaaaggccaatcaagaggaggatatccctgtgaagggatctcacagcacaaaggtggaggctgtggtgcgcactctcatgaagatccagctaagagatcctggggccaaagccctcgtgttttcgacttggcaagatgtcctggacatcatcagcaaggcactcaccgacaacaacatggaattcgcccaaatcagcagagttaagacctttcaggaaaatctcagtgcgttcaaacgagaccctcagatcaacatcctgttgcttcctctccacaccgggtcaaacggactaaccatcatcgaggctacacatgtgctcctggtggagccaatcctgaacccggctcatgaattacaagccattggccgcgttcatcggatcggacagactaaacccactatcgtccaccgcttcttgataaaggccactatagaggagaggatgcaggccatgcttaagaccgctgagcgttcccataccaattctagtgccaagcactcagaggcctccgtgttgactgtggccgatctcgccgacctattcacaaaagagacagaggaactcgagtag

SEQ ID NO: 20654 - DNA, 5064 bp, Artificial Sequence
  Description of Artificial Sequence: Synthetic coding sequence
atgagcagccggcggaagcgggccccccccgtgcgggtggacgaggagaaaagacagcagctgcattggaatatgcacgaggaccggcggaatgaaccaataattatatcggatgacgatgaacagccttgcccagggagcgacacgagctccgctcattacatcatcctgagcgacagtttgaaagaggaggtggcccaccgtgacaagaaacgctgcagcaaggtggtcagttttagtaaacctatcgagaaggaagaaactgtgggcatatttagtcctctaagtgtgaagctgaacattgtgatatcaccatatcactttgacaattcctggaaagcatttctaggggaacttacactccagttactgcccgctcagagcctcattgagaactttagtgaacgatcaatcacactgatgtcctccgaatcctcaaatcagtttttaatctatgtgcacagcaagggagaagacgttgaaaaacaaaagaaagaacctatgagcatttgcgataaggggattctcgtggaatcctccttttccggcgaaatgctcgaggaccttggatggctccaaaagaaacgcagaataaaattgtatcagaagcctgagggaaaccatatcatcaaggtcggtatctacctactggaggccgggctggcaaagctggactttttatcagacgccaacagtcgcatgaagaagttcaatcagctgatgaagaaagtgatggagaaactccacaactcgatcatacccgatgtcttggaagaagacgaagacgacccagagtctgaaccagagggacaggacatagatgaactgtaccactttgtgaagcaaacccatcagcaggaaacacagagtatccaggttgacgtccagcacccagcacttatacccgtattacggccctatcagagagaggcagttaactggatgttacaacaggaatgcttccgcagcagtcctgctactgaaagcgctctccactttctttggcgagaaatcgttacatcagaggggctcaaactgtattacaatccttacaccggctgcattatccgcgagtacccgaactcgggcccacagctactggggggcatcctggctgatgagatgggcctggggaagacagtcgaggtcctcgccctgatattaacgcatactcggcaggatgtcaaacaggatgctcttaccctaccggaagggaaggtggttaactatttcataccatcccattatttcggggggaaactgaagaagacagagattcagaatatcgaattcgaacccaaagagaaggtgcaatgccctcccacgagagtgatgatcctgacagctgtgaaggagatgaatggtaagaaaggagtgtccattttgagcatatataaatatgtgagcagtatctatcgctatgatgtgcagcggaaccgctcgttgctgaagcggatgctcaaatgcctgattttcgagggtcttgttaaacaaattaaagggcatggtttcagtggaacgttcactcttggtaagaattataaagaagaagacatatgcgataaaaccaaaaaacaggccgtcggctccccacgaaagattcaaaaggaaaccaggaagagcggcaacaaggacactgattcggaatatctgccgtccgacacaagtgatgacgatgacgacccgtattattactattacaagtctcgccgtaatcgctccaagctgaggaaaaagctggtcccttctacaaaaaaggggaagagccaacccttcatcaaccctgactcccagggacactgccccgcgaccagtgacagcgggattaccgacgtggctatgagcaaatccacttgtatcagcgaatttaaccaggagcatgagactgaagattgtgccgaaagcttgaaccatgccgatagcgatgtgcccccctccaacacaatgtcccccttcaatacttctgactacagattcgagtgcatttgcggagagctggatcaaattgatcggaagcctagagtgcagtgtctcaagtgtcacctgtggcagcacgccaagtgcgtgaattacgacgaaaaaaatctgaaaattaaacccttctattgtccacactgtctggtcgcgatggagccggtgagcacccgcgcaaccctgattatttcaccctcatctatttgccaccagtgggtggatgagatcaatcgacatgtgagatcttcttccctccgggtgctggtttaccagggcgtcaaaaaggatgggttcttgcagccacattttctggcagaacaggacattgtcatcataacttacgatgtccttcggagcgaactcaattacgttgatatcccccatagtaactcagaggatggaaggcggctgaggaaccagaagagatacatggctatcccatcccccttagtcgctgtggaatggtggcggatatgcttagacgaagcccaaatggtggagtgtcccacagtgaaggccgccgaaatggcccagcgcttgagcggtattaatcgatggtgcatctcaggaacacctgttcagcggggactggaggacctgttcggtctcgtcgtcttccttggcatcgaaccatattgcgtgaagcactggtgggtgcggctgctatatcgcccctattgtaaaaaaaatccccagcatctgtatagtttcatcgcaaaaatattatggcgttccgcaaagaaagacgtcattgatcagatacaaattcctccgcagaccgaagagattcactggctgcacttcagtccagttgaacggcacttttatcaccgccagcatgaggtctgttgtcaagatgttgtggtcaagctcagaaaaattagcgattgggcacttaaactctctagcctcgataggagaacagtaacgtcaatcctctacccattacttcgactgaggcaagcttgctgccacccacaggccgtgaggggggagtttcttccactacaaaagagttttgaacagtctacattttccttctcaacaatgaccatggaagaactcctcacctcgctgcaaaagaagtgtgggactgagtgcgaggaggcccacaggcagttggtgtgtgcactcaatgggctagccgggatccatataatcaaaggggaatatgctctggccgcggaactgtacagggaagtgctgagatcgtccgaggaacacaagggcaagctcaagaccgattctctgcagcgactacacgcaacacacaacctgatggaacttcttatcgccaggcatcccggaatcccgcccacactcagggatgggagactagaggaggaggcgaagcaacttcgtgagcattatatgtctaaatgcaatacagaggtcgcggaggctcagcaggcgctgtaccccgttcagcagactatccacgagttgcaacgtaagatacacagcaattcaccctggtggctgaacgtaatacaccgcgcgattgaattcacaattgacgaagaactcgtccagcgcgtcagaaatgagattaccagtaattacaaacagcaaacaggcaagctctccatgagtgagaaagggctccaatttctgctgaccacccagatggaagagctaaacaaatgtcagaaactggtgcgggaggccgtaaagaatctcgagggcccaccgtccagaaatgtgatcgaatccgccaccgtctgccacctgaggccggccagattgccgctgaactgctgtgttttttgcaaagccgatgaactgttcacagaatacgaaagcaaactgttttcaaacaccgtaaagggacagactgcgatttttgaggagatgattgaggacgaagagggcttggtggatgaccgggcgccaactaccactagaggcctttgggctatctccgaaactgagcgcagtatgaaggccatcctgtccttcgccaaatcccaccgtttcgacgtcgaatttgtcgatgaagggtccacctccatggatctatttgaggcctggaaaaaagaatacaaattacttcacgaatattggatggctttgcgaaaccgcgtctctgccgtagatgagctggcaatggcgaccgagcgtcttagggtacgcgatccccgtgaacctaagccgaaccctcctgtgctacatataatcgaacctcacgaagtggagcagaatcgtattaaactgctcaacgataaggctgtcgccacatctcagttgcagaagaagctgggtcagcttctctatctgacgaatctggagaaatcccaggataagacgtccgggggtgtgaatccagaaccttgcccaatttgcgcaaggcaattgggaaagcagtgggcagtcctaacatgtggccattgtttctgcaacgagtgcatttccataatcattgaacagtatagtgtaggatcccaccggagcagcattaagtgtgcaatctgcaggcaaacaaccagtcacaaggaaatttcctacgtgttcacaagcgagaaggccaaccaggaagaggacatccccgtgaaagggtcccacagtacaaaagtggaggctgtcgtgcgcaccttaatgaaaatccagctccgggaccctggagcgaaagcccttgttttcagtacatggcaggacgttctggacatcatctccaaggccctgacagataacaacatggagtttgcccagatatcccgcgtcaaaacgtttcaagagaacctaagcgctttcaaacgggacccccagattaatatcctgctgctgccactacacacaggatctaatgggctgaccattatcgaggccacacacgtccttctagtggagcccatcctcaacccagcacacgaactccaagctattgggcgcgtgcacaggatcggacagacaaaacccacgatcgtgcatagattcctcatcaaggctactattgaagagcgcatgcaggccatgctaaagacagctgaacggtcccacaccaacagcagcgctaaacactccgaagcctcagtcctaaccgttgcagacctcgcagatctcttcacgaaggagaccgaagagctcgaatag

SEQ ID NO: 20655 - DNA, 5052 bp, Artificial Sequence
  Description of Artificial Sequence: Synthetic coding sequence
atgagcagccggcggaagcgggccccccccgtgcgggtggacgaggaaaaaagacagcaactgcattggaatatgcatgaggacagacgtaacgagcccattataatttctgacgatgatgagcagccctgccccggctctgacacatcttccgcacactacatcattctgtcggatagcctcaaagaagaggtggcacaccgggataagaagagatgcagtaaggttgtgagctttagcaaacccatagaaaaggaggaaacagtgggcatatttagcccgctgagcgtgaagctgaatattgtgatatctccttaccattttgacaatagttggaaggcattcctcggagaattaaccctccagctactccccgctcaatccctgatagaaaacttctcggagcgatcaatcactctgatgagcagcgagagttcaaaccagtttctaatttatgtgcatagcaagggcgaggatgtcgagaagcagaagaaggagccaatgtccatctgtgataaaggcattctcgtagaatcatcattctccggcgagatgctcgaagacctgggatggctgcaaaagaagcggagaattaagctgtaccagaaacccgagggaaaccatatcatcaaggtaggaatatatctcttggaagcggggctggctaaactagattttctgtcagacgccaattctcggatgaaaaaatttaaccagcttatgaaaaaagtcatggagaagcttcacaattctatcatccctgatgtgctagaggaagacgaggacgatccagaatctgaacctgagggccaagacatcgacgagctgtaccatttcgtgaaacagacacatcagcaggagacacaatcgattcaggtggatgtccagcacccagcccttatcccagtcctgcggccttatcaaagagaagccgtgaattggatgctccagcaggagtgtttccggtcatccccagccaccgagtctgctctccatttcctttggcgcgagatagtgacctctgagggcttaaagctgtactataatccttacacaggctgtatcatccgagagtaccccaactccggaccccaactcctcggcgggatcttagccgatgaaatgggcctgggcaagacagtcgaggtgttagcactgatcttgacccatacacggcaggatgttaaacaggacgccttaaccttgcctgagggcaaagtggtgaactactttatcccctcacactactttggcggaaaactcaagaagacagagattcaaaatattgaattcgaaccgaaggagaaagtgcaatgccccccaacccgggtgatgatcctgactgcagtgaaggagatgaacggtaaaaagggtgtctccatcctctccatatacaaatacgtttccagtatttataggtatgacgtccaaagaaatcggagtctcttaaagagaatgctgaagtgcttgattttcgagggactggtgaaacagattaagggtcatggtttttcaggaacctttacgctggggaaaaactataaggaagaggatatatgtgacaaaaccaagaagcaagccgtagggagcccgcgcaagatacagaaggagacgagaaagtctggtaataaggatacagattccgagtacctgccctccgacacgagcgatgatgacgacgatccctattactactactataagtcacggcggaacagaagcaaattgcgtaagaagctcgtaccctctacaaaaaaaggcaagtcccagccatttattaatccagattctcagggacactgccccgccacgagcgattccggaattactgatgtggcaatgtccaaaagcacgtgtatttcggagttcaaccaggaacacgagaccgaggactgcgccgaatcattgaatcacgccgattcagatgtgccaccctccaacaccatgtctccttttaacacttctgactatcgattcgaatgcatctgcggggagctcgatcagatagaccgaaaaccacgggtgcagtgtctgaaatgtcatctgtggcagcacgctaaatgcgtgaattacgatgaaaagaacctgaaaattaaacctttctactgcccacattgcctggtggcaatggagcctgtgtccacccgcgccacactgatcatatctcctagttccatttgtcatcagtgggtggatgagatcaacagacacgtgaggagctcatcactccgggtgttagtatatcagggtgtgaagaaggatggtttcctgcagccacacttcctggctgagcaagacatcgtgataattacctatgatgtgctcagaagtgaactgaattacgtggacatcccccattctaacagcgaggatggcagacgcctcaggaaccagaaacgatacatggcaatcccttcaccactggtagcagtggaatggtggcggatatgtctcgacgaagcgcaaatggtggagtgtcccacagtaaaggctgcggagatggctcagcgcctgagtggaataaatcgttggtgtatctccggaacaccagtacagcggggactggaagatctcttcggattagtggtcttcctgggcattgagccatactgcgtgaaacactggtgggtgcgcttgctgtataggccctattgtaagaaaaatccacaacatctatatagctttattgctaagatcctgtggcggagcgcaaaaaaggacgtgatagaccagatacagattccacctcagactgaggagatacattggctgcacttttcccctgtagagcgacatttctaccatcgacaacacgaagtttgttgtcaggatgtggtggtcaagttacgcaagatctcagactgggccctgaaactgtctagcctcgacagacggacggtgactagcattctgtatccgctgttgcgtctgcggcaagcttgttgtcacccccaagccgtacgcggtgaatttctgcctctgcaaaaatcgactatgacgatggaggagctgttgacttctctgcagaaaaagtgtggtaccgagtgtgaggaagcccatcgtcagctcgtgtgcgcactgaatggattagcggggatccatattatcaagggagagtatgccctggccgccgagctgtacagagaggtcctacggagctctgaggaacacaagggcaagctaaagactgattctctacagagactgcatgcaacccacaatctcatggaactgctaattgctcggcatcccgggatccctcccacgctgcgcgacgggcggctggaggaggaggccaaacagctccgtgaacactacatgagcaagtgcaataccgaagtcgcagaagcccaacaggccctgtaccccgttcaacagacaatacatgaactgcaacgcaaaatccattcaaactcaccatggtggctcaacgtgatccaccgggctatcgagtttacaatcgacgaggaactcgttcagcgtgtgcgaaacgaaattacctccaattataaacaacagactggcaagctgtcaatgtcagaaaaattccgcgactgccgcggcctgcagtttctgctgacaactcaaatggaggaacttaataagtgccagaaactggtcagggaggcggttaagaacctggaggggccaccgagcaggaacgttattgagtcagcgacagtgtgtcatctccggcccgcccgactgcccttaaattgttgcgtgttctgcaaagctgacgagttgttcaccgagtatgagtcgaagcttttttcgaatacagtgaagggacaaacggccatctttgaagagatgatcgaggacgaggagggcctcgtggacgacagagctcccaccacaacccgtggcctttgggccatcagcgagaccgaacgctcaatgaaggctattctctctttcgcaaagagccacagattcgatgtggagttcgttgatgaaggcagtactagcatggatttatttgaggcttggaagaaggaatacaaacttctacacgagtactggatggcccttcgcaatcgcgtttccgctgtcgacgagttagccatggccaccgagcggctgcgagtcagagacccccgagaacctaagccaaacccgccagttcttcatatcattgaaccacacgaggtagagcagaaccgcataaaattgctcaatgacaaagcagtggccacctcccagttgcagaaaaaactcggccagcttctgtacttaacaaacctggagaagagtcaggataaaaccagcggaggggttaacccagagccgtgtccgatctgtgcaaggcagctcgggaagcagtgggccgtgctaacctgcggtcattgtttctgtaacgagtgtatatcaattattatcgaacagtactctgtcggtagccatcgcagttccataaaatgtgccatttgccggcagacaaccagtcataaagaaattagttatgtgtttacatctgagaaggctaatcaggaggaggacattcccgttaaaggatcacacagcaccaaggtggaagcagttgtgcgcaccttaatgaagattcagctccgggacccaggagctaaagccctggtattcagcacttggcaggacgtgctggatatcatatctaaagctctgaccgataacaacatggagtttgcacagatctcaagggtgaagacattccaggagaacttgtcagcatttaagcgggacccacaaatcaatatcctcctgctccccctgcacactggcagcaacggtcttactatcatcgaggctacccacgttctgttagttgagccaatcctgaaccccgcccacgagttgcaggcaatcggacgcgtccacagaattggacaaaccaaacccacaatcgtacatcgctttctgatcaaagccaccatcgaggagcggatgcaggccatgcttaaaacagcagagagatcccacactaactctagcgcgaagcactctgaagcgtccgtcctgacagtggccgacttggccgatttattcaccaaagagacagaagaattagaatag

SEQ ID NO: 20656 - DNA, 468 bp, Artificial Sequence
  Description of Artificial Sequence: Synthetic coding sequence
atggagttcgcccagatcagccgggtgaagaccttccaggagaaccttagtgcgtttaagcgggaccctcagatcaacatcctgctgctgcctctccacaccggcagcaacggcctgaccataatcgaggccacacatgtcctactcgtggaaccaatcctaaacccagcccatgagctgcaagccattgggagagtccataggattggtcagacaaaacccactattgtgcaccgcttcctgatcaaggcaacaatagaggagcgaatgcaggctatgttaaagacagccgagaggcgctttttcgaggaacaggccttgttttgctttcatgacatcacacccttctcacacccttggtcactgactactgcgatacttcagcttcgagacttagtgatttgcgagctgttctttatctactttaagaactttctgatctgtttcctcagctcattttccatctag

SEQ ID NO: 20657 - DNA, 4980 bp, Artificial Sequence
  Description of Artificial Sequence: Synthetic coding sequence
atgagcagccggcggaagcgggccccccccgtgcgggtggacgaggaaaaaaggcagcagctccactggaatatgcacgaggaccgtcgcaacgaacccattatcattagcgatgacgatgagcagccatgtccaggctctgacacaagctctgcccactatattatcctgtcagatagcctaaaggaggaggtggctcatagggacaaaaagcgctgtagcaaggttgtcagcttctccaagcccatagaaaaggaagaaacagtaggaatcttcagtcctctgtccgtcaagcttaatattgtgatcagcccgtaccattttgacaattcatggaaagccttcttgggcgagctcacgctgcagctgctgcccgctcagtccctgattgaaaacttttccgaacgatctatcactcttatgtcaagtgaatcttccaaccagttcctcatttacgtgcactctaaaggcgaggacgtggagaaacagaagaaggagcccatgagcatctgcgacaagggcattttggtggagtcctctttctcaggagagatgctcgaagacctcggatggctgcaaaagaaacggcggatcaagctctatcagaagcctgagggcaaccatataattaaggtggggatctacttactggaagcagggctcgctaaactagattttctgagtgacgcaaacagtcggatgaagaaattcaaccagctgatgaaaaaagtcatggagaaattacacaatagtattatcccggacgttttggaagaggatgaagatgatcccgaaagcgagcctgagggccaggatatcgacgagttatatcactttgtcaaacaaacccaccaacaggagacacagagcattcaggtagatgtgcagcacccagccttgataccagttctacggccttaccaacgcgaagccgtcaactggatgctccagcaagaatgctttaggagctcacccgctaccgagtcagcgctgcatttcctctggcgtgagattgtcacatccgaagggttgaaactttattacaatccttataccggttgtatcattcgcgaataccccaacagcgggccgcagctgctcggaggcattctggccgatgagatggggctcgggaaaaccgtggaggttcttgccctgatactgacccatactcgccaggacgtgaaacaggacgcactgacattgcctgaaggcaaagtcgttaattattttataccatcgcattatttcggcggcaagctgaagaaaactgaaatccagaatatcgagtttgagcctaaagagaaggtgcagtgcccacctactcgggtgatgatcctgacggccgtcaaagagatgaatggcaaaaagggcgtgtccatcctctctatctataagtacgttagttccatttataggtatgatgtccagcgcaaccgttccctgctgaagcggatgctcaagtgtcttatcttcgagggcctcgttaagcaaattaaaggccacggtttcagcggaactttcactctggggaaaaattacaaagaagaggatatttgcgacaaaactaagaagcaggcagtgggatcacctcggaagatccagaaagaaactcggaagtcaggtaacaaggatacggatagtgaatatctgccatcagatacatctgatgacgacgacgacccgtactattattactacaaaagcagaagaaaccgtagcaaactccgcaagaaattagttccaagcacgaaaaaaggcaaaagccagccttttatcaaccccgacagccagggacactgtcccgcaacttcagacagcggtattactgacgttgctatgtctaaatccacctgcatctctgagtttaatcaggaacatgaaactgaggactgtgctgagtcacttaatcatgcagatagtgacgtgccccctagtaatacaatgtccccattcaatacctctgactatcggttcgaatgcatctgtggagaactcgatcagatcgatcgcaaaccacgggtgcagtgccttaagtgtcacctctggcaacatgcaaaatgcgtgaactatgacgaaaagaacttgaaaatcaaacctttctattgcccacactgcctcgtggccatggagcccgtgtccacccgtgctacacttatcatttcccctagttccatctgccaccaatgggtggatgagatcaacagacatgtcagatcctcatctctaagagtgttggtgtatcagggagtgaagaaggacggtttcctacaaccacactttctcgctgagcaagacatcgtcatcattacttatgatgttttacggtccgagctcaattatgttgacattccccatagcaattctgaagacgggaggcggctgcgaaatcagaaaagatacatggccattcctagcccactggtcgctgttgaatggtggcgaatttgcctagatgaagcccagatggtggagtgtccgactgttaaagctgccgaaatggcccagcgcctgtctgggattaaccgctggtgcatcagcggaactccagtccagagaggcctcgaggacctttttggactagtggtattcttgggcattgaaccctactgcgtgaaacactggtgggtgaggctcctttacaggccatactgcaaaaaaaatccccagcatttatactccttcatcgcgaagattctgtggcggtccgccaagaaggacgttatagaccagatccagataccaccacagaccgaggagatccactggctccatttctccccagtcgaaagacatttttaccatcgccagcacgaagtgtgctgtcaggatgtagtggtcaagctgaggaaaatctccgactgggccctcaagctttcttccctggacagacgtaccgtcactagcattctgtatcctctcctccgcctgaggcaggcctgctgccaccctcaggcagtgcgaggcgagtttttacccctgcagaaatctttcgaacagtccactttctctttctcaaccatgaccatggaggagttgctgacctccctgcagaaaaagtgtggaaccgaatgcgaggaagcacacagacagctcgtctgcgctttgaatggactcgcggggatccatattatcaagggtgagtacgcgcttgccgcagaattatatagggaggtgctacgcagcagcgaagagcacaagggaaagttgaagaccgactcacttcagcgtcttcacgcaacacacaatctgatggagctgcttatcgctaggcatccgggcatacccccgacactgagagatggcagacttgaggaagaggccaaacaactgagggagcactatatgtccaagtgtaacactgaggtcgccgaggctcaacaggctttgtaccccgtgcagcagaccattcacgaactacaacggaagattcattctaacagcccgtggtggctcaacgtcatccatcgagctattgagttcacaatcgacgaagagctcgtgcagcgggtacgaaatgaaattacctccaattacaagcagcagactgggaaactcagcatgtctgaaaagggacttcagttcttgttaaccactcagatggaggaactcaataagtgccagaagctcgtcagagaggccgtcaagaacctggagggacctcctagccggaacgttatcgaatctgcaaccgtatgccatctgagaccagctcgcctgcctctgaactgttgcgtgttttgcaaggccgatgagttgtttactgagtatgagtctaagttattttcgaatactgtcaaaggccagaccgccatttttgaggaaatgatcgaggacgaagagggacttgtagacgacagggccccaacaacaacacgcggactttgggctatcagcgagaccgagaggtccatgaaggcgatcctctccttcgccaaaagccacagattcgacgtagagtttgtggacgagggcagcactagcatggacctctttgaggcttggaaaaaggaatacaagttgctgcatgagtactggatggcactgcgaaaccgcgtttcagcggtggacgaactagccatggccactgagcgcctgagggtccgggaccctcgggaacctaagcccaacccacccgtactgcatattatcgaacctcacgaggtcgaacagaatcgtattaagttactcaatgacaaggcagtggccaccagtcagctgcagaaaaaactcggtcagcttctctatctgactaatctagaaaagtcacaggataagacctccggcggagttaacccagaaccatgccctatttgcgcccgccagcttggcaagcagtgggctgttcttacctgtggccattgcttttgtaacgagtgcatctctattattatcgagcaatactcagtaggttcgcacagatcttctatcaagtgcgctatttgtaggcaaacaactagtcacaaggagatatcgtacgtgtttacttccgaaaaagccaaccaggaggaggacatccctgtcaaaggttcgcatagcacaaaggtggaggcggtggtgcggacattgatgaagatccagctgagagatcctggagcaaaagcccttgtcttcagtacatggcaagatgtcttggatatcattagcaaagcattaactgataataacatggaattcgctcagattagccgggttaagacttttcaggagaacttatcagccttcaaacgtgatcctcagatcaacatcctgctgcttccgcttcatactggttcgaatgggttgacaatcattgaagccactcacgtactgttagtggagcctattctgaaccctgcccacgagttacaagcaattggcagggtgcataggatcggacagaccaagccaaccatcgtacatcgttttttaattaaggccaccatagaggagcgcatgcaggcaatgcttaagacggccgaaaggtctatttatatctag

SEQ ID NO: 20658 - DNA, 1983 bp, Artificial Sequence
  Description of Artificial Sequence: Synthetic coding sequence
atgagcagccggcggaagcgggccccccccgtgcgggtggacgaggagaaaaggcagcagctgcactggaacatgcacgaagatagaaggaacgaacctataatcatatctgacgacgacgagcagccatgcccaggtgaagacgttgagaagcaaaaaaaggagcccatgagcatttgcgacaaaggtattctcgtcgagtccagtttcagcggcgaaatgcttgaggacctgggctggttgcagaagaaacgccgtataaaactgtatcagaagccagaagggaaccacattatcaaagtggggatttacctacttgaagccgggctcgcgaagctggattttctgtccgacgccaatagccgaatgaagaaattcaatcagctaatgaagaaagtcatggagaaactgcacaatagtatcatccccgatgtgcttgaggaggacgaagacgatccagagtctgaacccgaaggtcaggacattgatgagctgtaccactttgtaaagcaaactcaccagcaagagactcaaagcattcaagtggacgttcagcaccctgcactcatccccgtgctgcgcccctaccaaagagaagccgttaattggatgctccagcaggagtgctttcgctccagccctgccactgagtctgcattacactttttgtggagggagatcgttaccagcgagggcctgaagctctactacaatccatacactggctgcatcattcgggaataccctaactctggtcctcaactgctgggcggcatcctggccgacgagatggggctgggtaagaccgtggaggtcctggcactgattctaactcacacacgtcaggacgtgaaacaggatgccctcacactgcccgagggtaaggtcgtgaactacttcataccttcccactattttggaggtaagcttaaaaaaaccgagatacagaacattgaatttgaacctaaggaaaaagtgcagtgcccccctactagggtcatgatcttgacggcagtgaaggagatgaatggaaaaaagggagtctcaatactgtctatatacaaatatgttagctcaatatacaggtacgacgttcaacgaaatcgtagcttactcaagcggatgctaaagtgcctgatctttgagggtctcgtaaagcagattaaaggccatgggttcagtggaaccttcactctgggcaagaattataaggaagaggatatttgcgacaagacaaagaaacaggccgtaggctccccacgtaagatccagaaagaaacacgcaagtccgggaataaggataccgatagcgaatatctaccaagcgatacttcagatgatgatgatgacccgtactactactactacaaatcccggcgcaacagatccaaactgagaaagaagctagtgcccagcaccaaaaagggaaaatctcaacctttcattaacccagacagtcaaggccattgccccgccaccagcgactctggcattacggatgtggcaatgtcgaagagcacctgtatctctgagtttaatcaggaacatgaaacagaggactgcgccgaaagcctaaatcatgcagactccgatgttccaccatcaaacaccatgtctcccttcaatacctctgactaccgctttgaatgcatctgcggcgagctggaccagattgaccgtaaaccgagagtgcagtgcttaaaatgccacctgtggcagcatgccaaatgtgtgaactatgacgaaaagaacctgaagattaagccgttctactgccctcactgtctggtcgctatggaaccagtgagtactcgagctacactgataatttcaccctccagcatatgtcatcagtgggtggacgaaattaataggcacgtaaggagctccagcctaagagtcctcgtgtaccagggggtcaagaaggatggcttcctgcagccccattttggcaggactggttatagttaccactacctgtag

SEQ ID NO: 20659 - DNA, 216 bp, Artificial Sequence
  Description of Artificial Sequence: Synthetic coding sequence
atggagcgggcccgggaccggctgcacctgcggcggaccaccgagcagcacgtaccggaggtggaggttcaagtgaagcgcagacgtacggcatccttaagtaaccaagagtgccagttgtacccgcgccgcagccaacaacagcaggtacctgttgtagattttcaagcagaactgcgacaggcatttttggctgaaactccgcggggcggatag

SEQ ID NO: 20660 - DNA, 216 bp, Artificial Sequence
  Description of Artificial Sequence: Synthetic coding sequence
atggagcgggcccgggaccggctgcacctgcggcggaccaccgagcagcatgtgcccgaagtcgaagtgcaggtcaagcggaggcgcacagctagtcttagcaatcaagaatgccaactgtatcctaggagatctcagcagcagcaggtgcccgtggtagacttccaggcggagcttcgtcaagcatttctagccgagacgcccaggggcgggtag

SEQ ID NO: 20661 - DNA, 375 bp, Artificial Sequence
  Description of Artificial Sequence: Synthetic coding sequence
atgaccccccagggccggggcaccgtggccgccgccgccgtggccgcgacggctagtattgcaggcgcacccacccaatacccccctggtcggggtacccctcccccgccagtcgggcgcgcgacccctccaccagggatcatggcaccccctccagggatgcgcccaccaatgggcccgcctattggcctgccccccgcgcgcggcacacccataggaatgcctcctccagggatgcgccctccaccacccggaattcggggcgaggcctttctgcttgcattggtttgctggtacgggtggcctctggacttcggaatgagtgactatgccgcgtatctcaagaaaacttgcttccaggacctattcaactag

SEQ ID NO: 20662 - DNA, 216 bp, Artificial Sequence
  Description of Artificial Sequence: Synthetic coding sequence
atggagcgggcccgggaccggctgcacctgcggcggaccaccgagcagcacgtgccggaggtggaggttcaggtaaagagaaggcggaccgccagtctgtcaaaccaggaatgtcagctatatccccgtcggagtcaacaacaacaggtacccgtggtggacttccaagccgaactgaggcaggcctttctggctgaaactccgcggggaggctag

SEQ ID NO: 20663 - DNA, 1611 bp, Artificial Sequence
  Description of Artificial Sequence: Synthetic coding sequence
atggccctgaccagcttcctgcccgcccccacccagctgagccaggaccagctggaggcagaagagaaggcgcgatcgcagagatctaggcagaccagtctagtgtcgtcacgccgtgagcctccaccatatggatacagaaagggttggattccgcggttactcgaggactttggtgacgggggagcctttccagagattcacgtcgctcaataccctctcgacatggggcgtaagaagaagatgagcaatgctctagcaattcaagttgactctgagggaaagataaagtatgacgccattgcccgccagggacaaagtaaggataaggtgatttacagcaaatataccgatttggttcccaaagaagtgatgaacgctgacgaccccgatctgcagcgccctgacgaggaggccatcaaggagattacggagaaaacaagggtagccctggagaaaagcgtgtcccagaaagtggctgccgctatgccagtcagagccgccgataagctcgcaccagcccagtacatacgctacactcctagccagcagggggtcgcatttaacagtggggccaaacaaagggtgattcgcatggtggaaatgcaaaaggaccctatggaacctccaagattcaagattaataagaagatccctcgggggccaccttcacctccggctccagtaatgcactctccctctcgtaaaatgaccgtaaaagagcaacaggaatggaagatccccccttgtatctccaactggaagaacgccaagggttataccatcccgcttgataagaggctggccgctgacggccggggccttcagaccgtgcacattaatgagaatttcgctaagctggcagaagctctgtatatcgcagaccgcaaagctcgtgaggctgtggaaatgcgggcacaggtggaaagaaaaatggcccaaaaggagaaggaaaaacatgaggaaaagctacgtgagatggctcagaaggctagagagcgcagggccggaatcaagactcatgtggagaaagaagatggagaagcccgtgagcgagacgagatacgacatgaccgcaggaaagagcgtcagcatgatcgcaatctgtcgcgcgccgctccagacaaaagatcaaaactgcagcgcaatgaaaaccgggacatcagtgaagtcattgcactcggcgtaccgaaccctcgcaccagcaacgaggtacagtacgatcaacgccttttcaatcagtctaagggcatggactcaggcttcgccggaggggaggacgagatctacaacgtttatgatcaggcatggcggggaggcaaggatatggcacagtctatctaccgaccctcaaagaatctggataaggacatgtacggcgatgacttggaagcgaggattaagaccaaccggttcgttcccgataaggagttctcagggtcagaccgacgacagagagggagggaaggtccagttcagttcgaagaggatccttttgggttagacaaatttctggaagaggccaaacagcatggtggctcaaagcgtccgtctgattcatctaggcccaaggaacacgagcatgaaggcaagaagcgacgtaaagaatag

SEQ ID NO: 20664 - DNA, 867 bp, Artificial Sequence
  Description of Artificial Sequence: Synthetic coding sequence
atggccctgaccagcttcctgcccgcccccacccagctgagccaggaccagctggaggcggaggagaaagcccgcagccagaggagccgtcagacctccctcgtatcctctcggagagagcctccgccctacggttaccgaaagggctggattccaagactgttagaagacttcggcgatgggggtgccttcccggaaatccatgttgcacaataccctctcgacatgggtcgtaagaagaaaatgtctaatgctctggccatccaggtagactctgaagggaagattaaatacgatgcaatcgccagacagggtcagtcaaaggacaaggtgatctactccaaatatactgacttagtgccgaaggaagtgatgaatgccgacgatccagatctgcaaagaccagacgaggaagcgattaaggagatcacagagaagacccgtgtcgctttggaaaaaagtgttagtcagaaggttgccgccgccatgccagtacgcgctgctgacaagctcgccccggcccaatacataaggtatacaccctctcagcagggagtcgccttcaattcaggggctaaacagcgagtcattagaatggtggagatgcaaaaggacccaatggagccccccagatttaagattaacaaaaagatacctagaggccctccctcgccccccgcacctgttatgcattccccgtcacgaaagatgactgtgaaggagcagcaggaatggaagatacctccctgtatatccaactggaaaaacgctaaaggctatactattcccctggacaaacgtttggctgcagatgggagaggcttgcagactgtgcacaagaagaagaagaagaagaagagaaagtag

SEQ ID NO: 20665 - DNA, 558 bp, Artificial Sequence
  Description of Artificial Sequence: Synthetic coding sequence
atggccctgaccagcttcctgcccgcccccacccagctgagccaggaccagctggaggccgaggagaaagctcgatcccagcggtctcgccagacatcactggtaagctccaggcgcgagccccctccctatggctatagaaaaggatggatcccccggctgttagaagattttggggatggtggtgcattcccagaaatccatgtggcccaatatcccctggatatgggacgcaagaaaaagatgagcaatgcacttgccatccaggtagattctgagggtaaaataaaatacgacgcaatcgcccgtcagggacagtccaaggacaaagtgatctatagtaagtatacggacctcgtgcctaaggaagtgatgaatgctgatgatcccgatttgcagcggccagatgaggaggccatcaaagagatgaccgtcaaggagcagcaggaatggaaaattccgccctgcatttctaactggaaaaatgccaagggatacacaatacccttggacaagcgcctcgccgccgacggacggggactacagacagttcactag

SEQ ID NO: 20666 - DNA, 2211 bp, Artificial Sequence
  Description of Artificial Sequence: Synthetic coding sequence
atggtggccgagatccagaacgtggagggccagaacctgcaggagcaggtctgtccagaacccatctttaggttttttcgggagaataaggtagagatcgcatcagcaatcactaggccatttcctttcttaatgggcctcagggaccggtcattcatttcagaacagatgtacgaacacttccaggaggcttttaggaacctggttcccgttacaagagttatgtactgtgttttatccgagttagagaagactttcgggtggtcccaccttgaggccctcttttcaagaattaatcttatggcttatccagatctgaacgaaatataccgaagtttccaaaatgtatgttatgaacacagtcctctgcagatgaacaacgtaaacgacctggaggaccgacctcgcctgctcccctacgggaaacaggaaaactccaacgcctgtcacgaaatggacgatattgctgtcccccaggaagccctgagcagctccccaagatgtgagcctggcttcagctcggaatcttgcgaacaacttgccctgcccaaagccggggggggcgatgccgaagacgccccatcattactgccgggcggaggcgtttcttgcaagctagccattcagatcgacgagggtgagtctgaggaaatgccaaagcttctgccctacgacactgaagagacctttgaccttaaaacaccccaggtgacaaatgaaggagagcctgagaaaggattgtgtctgctgccgggagaaggagaagaggggtctgacgactgctctgagatgtgtgacggcgaagaaagacaggaagcctccagtagcttagcccgtcggggctccgtaagctccgaacttgagaatcaccccatgaatgaagagggggagtctgaggagctggctagctcactgctatacgacaatgtgccaggagctgagcagagcgcttacgagaacgaaaaatgcagctgcgtaatgtgcttttctgaggaggttccaggctcaccagaagcccgcaccgagtccgaccaggcctgcggaaccatggataccgtcgacatcgcaaataatagtacgctaggcaaaccaaagcgcaagcgtcggaaaaagaggggccacggatggtctaggatgaggatgagacgacaggagaattcccaacagaacgacaacagcaaggccgacggccaggtggtgagctccgagaaaaaggctaatgtgaacttgaaagatcttagtaaaattcggggtcgcaaacgtggcaagcccggaactaggtttactcagtctgatagagccgcccagaagcgtgtgagatctcgggcatctaggaagcacaaagatgagactgtggacttcaaggccccgctattacccgtgacatgcggaggggttaaaggaatcctgcacaagaaaaagcttcaacagggtatattggttaagtgtattcagacagaagatgggaaatggtttactcctaccgaatttgagatcaaaggaggccacgccagaagtaaaaattggcggctgtctgtgcggtgtgggggatggccacttaggtggttgatggaaaatggttttctgcctgatcccccaaggattcggtaccggaaaaagaaacggatcttgaaatcgcagaacaattccagcgtggacccttgcatgaggaacctggatgagtgcgaggtttgtcgagatggcggggaacttttctgttgtgatacgtgttcaagggtgttccacgaggattgccatataccacctgtggaagctgagaggacaccttggaactgtattttctgccgcatgaaggagtcacctggaagccaacaatgctgtcaagagtctgaagtcttggagcgccagatgtgccctgaggagcagcttaagtgcgaatttctgctgctgaaggtgtactgctgctctgaaagcagctttttcgcaaagatcccttattactattacatccgggaggcttgccagggactcaaagaaccaatgtggctggataaaattaaaaagcgactgaatgaacacggctatcctcaggtggagggcttcgtgcaggacatgcgccttatcttccaaaaccatcgcgctagttataaatataaggattttggccagatgggttttcgattggaggccgaattcgaaaaaaacttcaaagaggtgttcgctatccaggaaacaaatggcaacaattag

SEQ ID NO: 20667 - DNA, 519 bp, Artificial Sequence
  Description of Artificial Sequence: Synthetic coding sequence
atggcccagcagggccagcagggccagatggccagcggcgacagcaaccttaatttccgtatggtcgccgagatccagaatgtggaaggccagaacctacaagagcaagtgtgccctgagccaatctttaggtttttccgggagaacaaggtcgagatagcctcggctataacccgcccattcccctttttgatgggtctgagggaccggtcctttatttccgagcaaatgtacgaacacttccaggaagcgtttcgcaatctggtgcctgtgacacgggtcatgtattgcgtcctgagtgaacttgagaaaacctttggctggtcacaccttgaagcactgttcagcagaattaacctgatggcctacccagacctgaacgagatttatcgatcatttcaaaacgagaacttaagttctagcgctgttctctgccagcttgttagccctaacaaagattggcgaagccatgaggagagtctggcccatacagggacgttgaggcggagctgtatgtag

SEQ ID NO: 20668 - DNA, 1218 bp, Artificial Sequence
  Description of Artificial Sequence: Synthetic coding sequence
atggcccagcagggccagcagggccagatggccagcggcgacagcaatttaaactttaggatggtggccgagatccaaaacgtggaagggcagaatctgcaagagcaggtatgccctgaaccaatcttcaggtttttccgcgaaaataaggtggagatcgcaagcgctattaccaggccctttccgttcctgatggggctacgcgatagatcttttatttctgagcaaatgtatgagcactttcaggaagcctttaggaatctggtgccagtgactagagtgatgtattgcgtgttatcagaactagaaaaaaccttcggatggtcacatttggaggccttgttctccaggataaacttgatggcctatcccgatctgaatgaaatctacagatcattccaaaacgtgtgttatgaacacagtcccctccaaatgaacaacgtaaatgatctggaagatagaccacgtctgctgccgtacggaaagcaggagaatagcaatgcctgccacgagatggatgacattgcggttccccaggaggctctgtcttcctccccccgttgcgagcccggcttctctagcgaatcctgcgaacaattggccttgccgaaggctggaggtggtgatgcagaggacgccccgtcactgctgcccggcggaggtgtgtcctgtaaacttgccatccagatcgatgagggtgaaagtgaagaaatgcccaagttgctcccatatgatactgaggtattggaatcgaacggcatgatcgatgccgcgaggacatattctacggcccctggggaaaaacagggggaggaggaggggagaaactcaccgcgcaagaggaatcaggacaaggaaaaatatcaggaatcgcctgaaggtagagacaaggagacgttcgatctgaagacaccccaggtgacaaacgagggggaacctgaaaagggactgtgcttattgcccggagagggagaagaggggagcgatgactgttcagaaatgtgtgacggggaagagccccaggaagcttcctcaagtttagcccgctgcgggagcgagggctccgatgactgttctgagatgtgcgatggcgaggaaagacaggaggcccagaagcagggtcgtaaggtaattaaaagggtcgcacagtggattctctggattctgcaaactactccgctgtgggaaaatccaagggggaaagaagataagcgctag

SEQ ID NO: 20669 - DNA, 2604 bp, Artificial Sequence
  Description of Artificial Sequence: Synthetic coding sequence
atggcccagcagggccagcagggccagatggccagcggcgacagcaatcttaatttcagaatggttgctgagatccagaatgtcgaaggccagaacttgcaggaacaggtctgtcctgaaccgatttttagattctttcgggagaataaggtagagatcgcatccgcaattacccgccccttcccattcctgatgggtttacgggataggtccttcatctcagagcagatgtacgagcactttcaagaggcttttcgaaacctggtgcctgtgacccgggtgatgtactgcgtgctttcagaactggagaagacgttcgggtggagccaccttgaggccctttttagtagaattaatctgatggcttatcccgatctgaatgagatataccgctccttccagaacgtatgttacgagcacagccccctccaaatgaacaacgtgaatgatctggaagaccgtcccagactgttgccttacggcaagcaggaaaattccaacgcttgccacgaaatggatgacattgcagtccctcaagaggccttgtcctcctccccccgctgcgaaccggggttcagttcagagtcctgtgaacagttagcgctaccaaaggctggcggaggcgacgcagaagacgcaccaagtcttctcccaggcgggggcgtatcctgcaagctggccatccaaatcgatgagggcgagtctgaggaaatgcccaagctgctcccctatgacactgaagtcctcgagtctaacggcatgattgatgccgctcgaacctatagcacggctccgggagagaaacagggggaggaagaagggaggaattctccaagaaagcgcaatcaagataaggaaaagtatcaagaatcccccgagggacgcgataaagaaaccttcgatctcaagacacctcaagtaacaaatgaaggggaaccggagaagggcctatgtctcctgcctggagagggcgaggaaggaagtgacgactgttcagaaatgtgtgacggagaagagccgcaggaggccagttcttctcttgccagatgtggttccgtttcttgcttgagcgctgaaacttttgatctcaaaaccccacaggtgactaatgaaggggaaccagaaaaagagctaagtctgctacccggcgagggggaagaaggaagtgatgactgcagcgagatgtgtgacggggaggaacgacaggaggcttcatccagccttgctaggcgtggcagcgtgtcctccgagctcgaaaaccaccctatgaatgaggagggagaatcagaagagctcgcctctagcctgctctatgacaacgttccgggggccgaacagtccgcctatgaaaacgaaaagtgcagctgcgtcatgtgtttctcagaagaggtccctgggtcccccgaggctcgtactgaatcagaccaggcctgtgggaccatggatactgtagacatcgcaaacaatagcactctcgggaaacctaagcgtaagaggcgcaagaagagaggccacggttggtccaggatgcgcatgcgcaggcaggaaaatagccagcagaatgataacagcaaggccgatggccaggttgtgagtagtgagaagaaggctaacgtgaatctgaaggacctcagtaagatcaggggtcggaagagaggcaaacctggaacgaggttcacccaaagcgacagagcagcccagaaacgggtgagatctcgggcgtcaagaaagcataaggatgaaacagtagactttaaagctccccttcttccagttacatgtgggggtgtgaaagggattctgcacaagaagaagttacagcagggtatccttgttaagtgtatccagaccgaagacgggaaatggttcacccctacagaattcgagataaaggggggccatgctcggtccaagaattggagactgagcgtgcgatgcggaggttggccactcaggtggcttatggagaatgggttcctcccagacccacctcgcattagataccggaagaagaaaagaatactaaagagccagaacaactccagcgttgatccttgcatgcgtaacctagacgaatgtgaggtgtgccgggacgggggagaattgttctgttgtgacacctgttccagggttttccatgaggattgtcatatccctccagtggaggccgagagaacaccttggaactgcatcttctgtagaatgaaggagtccccagggtctcagcaatgttgtcaggagtctgaggtcttggagcggcagatgtgccccgaggaacagcttaagtgtgaatttctgttactgaaggtgtattgctgttctgagtcctcatttttcgccaagatcccttattactactacatcagggaggcatgtcagggactgaaagagcccatgtggttggataaaatcaaaaagagacttaatgagcacggataccctcaggttgaagggttcgttcaagatatgagactgatattccagaaccatagggctagctataagtacaaagattttggccagatgggcttccgcttagaagctgaatttgagaagaattttaaggaggtgttcgctatccaggaaacgaatgggaataattag

SEQ ID NO: 20670 - DNA, 2523 bp, Artificial Sequence
  Description of Artificial Sequence: Synthetic coding sequence
atggcccagcagggccagcagggccagatggccagcggcgacagcaaccttaacttccgtatggtcgcagaaatccagaacgttgaaggacagaacctgcaggaacaggtgtgtccagagcctattttcagattctttcgagagaataaagtcgagattgcttccgcgattacacgtcctttcccctttctaatgggactgagagataggtcctttatcagcgaacagatgtatgaacacttccaggaagcttttagaaatctcgtcccagtgacacgcgtcatgtactgcgtcctgtccgaacttgagaagacgtttgggtggagccatctcgaagccctgtttagccgtatcaacctcatggcatacccagacctcaacgagatttatcgttccttccagaacgtgtgctacgaacacagccccttgcaaatgaataatgtgaatgatctcgaggacagacctcgactgcttccctatggcaaacaagaaaactccaacgcttgccatgaaatggacgacatcgctgttccccaggaagcattgtcttctagcccgcggtgtgaacctggattcagctcagagtcctgtgagcagctagcactgcccaaagcaggcggaggagatgccgaagatgccccatcactgctgcctggcgggggcgtgagctgcaagctggcaatacaaatcgatgaaggcgaatcagaggagatgcccaaattgctgccctacgacactgaagttttggaatctaatgggatgattgacgccgccagaacctactcaactgcaccgggcgagaaacaaggtgaagaggaaggccgcaattctccgcgtaagcggaaccaggacaaggagaaataccaggagagccccgagggccgcgacaaggagaccttcgacctgaaaacgccccaggtcacgaatgaaggcgagcccgagaaaggtctctgcctgcttcccggcgagggcgaggaagggagtgatgattgttcagaaatgtgcgatggagaggagccgcaagaagcctcctcaagtctggcacggtgcggatcagtgagttgtctatccgccgaaacattcgatttgaaaactccccaggtgacaaatgagggggaaccagagaaggagctttcactccttcccggggagggtgaggtgtccagcgaactggaaaaccatcctatgaatgaagagggggagagcgaggagttagcatcaagccttctgtacgacaacgtaccaggggccgaacaatctgcctacgagaatgagaaatgctcttgtgttatgtgtttttctgaggaagtccctgggagcccagaagccaggactgagagcgaccaggcttgcgggactatggacaccgtcgatatcgcaaacaattctaccctaggcaaacccaagaggaagcgaagaaagaagagaggacacggttggtcaagaatgcggatgaggagacaagaaaactctcagcagaacgataattctaaagctgacggccaggtcgtgtcttccgagaagaaggcaaacgtgaaccttaaggacctaagtaagattcgcggtaggaaacgggggaagccagggacccgattcacccagagcgaccgcgccgctcagaaaagagttcgctctagggcaagtagaaaacataaggatgagacagtagatttcaaggcccccctcctccccgtcacctgtggcggcgtcaagggtattcttcacaagaagaagctccaacagggcattctcgtgaaatgcattcagaccgaggatggtaagtggttcacaccaacagagttcgaaattaaaggcgggcatgcacggtcaaaaaattggcgattgtctgtgcgatgcggcggttggcccctgcgctggcttatggaaaacgggttcttgcctgatcccccaagaattaggtataggaagaaaaaaaggatcctcaagagtcagaataattccagtgtcgacccctgcatgaggaacctagacgagtgcgaggtgtgtcgcgatggcggggaacttttttgttgcgacacatgtagtagagtgttccatgaagactgccatattccacccgttgaggctgagcggacgccttggaactgtatcttctgccgaatgaaggagtcacctggttcccaacagtgttgccaggagagtgaggtcctcgagcgacagatgtgccctgaggagcagctgaagtgtgagttcctgctgctaaaagtgtactgttgctctgaaagtagcttcttcgcaaagattccatactactattacatacgagaagcctgccagggattaaaggaacccatgtggctcgacaaaattaaaaagagattaaatgagcatgggtatccccaggttgaaggatttgtgcaggatatgcgactgatttttcagaatcaccgtgcctcctataagtacaaggacttcgggcagatgggattccgcctcgaagcggaatttgaaaaaaattttaaagaagtgttcgccattcaggaaacaaatggaaacaattag

SEQ ID NO: 20671 - DNA, 2307 bp, Artificial Sequence
  Description of Artificial Sequence: Synthetic coding sequence
atggcccagcagggccagcagggccagatggccagcggcgacagcaacttaaattttcggatggtggcagagatccagaacgtcgaaggtcagaatctgcaggagcaggtgtgcccggaacccatcttcagattttttcgggaaaacaaggtggagatcgcctcagccataacaagaccatttccattcctgatgggactacgagatagaagtttcatttccgagcagatgtatgagcattttcaggaggcgtttaggaacttggtcccagttacacgggtgatgtattgtgtgctatccgagctggaaaagaccttcggatggtcccacctggaagcgctgttcagccggatcaatttaatggcttaccctgatttgaatgaaatttatcggagtttccagaacgtgtgctacgagcactctcccctacagatgaataacgtcaatgacctcgaggaccggccgcgactcctgccttacggtaagcaggaaaacagcaatgcatgtcacgagatggacgatatagctgttccccaggaggcactgagcagctccccgaggtgcgaaccaggatttagctcagagtcctgcgaacagctggcattaccaaaagctggcgggggcgacgccgaagatgcaccatctcttctccctgggggtggcgagaccttcgatctcaaaactccacaggtgacaaacgaaggcgaaccagaaaagggtctctgcctgctgcccggggagggagaggaaggatccgacgattgttcagagatgtgcgacggggaagaaccacaggaagcctctagctcactggccaggtgtggcagtgtctcatgtctaagcgcagagacatttgacttgaagacacctcaagtcactaacgagggggaacctgaaaaagaactgagcctgctgcctggagaaggggaagaaggatccgacgactgctccgagatgtgtgatggagaggaaaggcaagaggcctcatcctccctggcgcggaggggttctgtgagttccgaactcgagaatcacccgatgaacgaggaaggcgaatctgaagagctggccagttcactcttatacgataatgtaccaggggccgaacagtcagcctacgaaaacgaaaagtgctcctgtgtgatgtgcttcagcgaggaagtaccaggtagccctgaagctcgcacagaatctgatcaggcctgcgggaccatggacactgttgacatcgccaacaatagcactctgggaaaacctaaacgaaagaggcgcaaaaagaggggtcatggatggtcacgcatgcgaatgcgaaggcaggagaattctcagcagaacgacaattctaaggccgatggtcaagttgtgtcctcagaaaagaaggcaaacgtgaatttgaaagatctgtccaaaatccgcggtagaaaacggggtaagcccgggaccaggttcacacagagtgaccgggccgctcagaagcgagtgcggtcacgggcctcccgcaaacacaaggacgaaaccgtggatttcaaggctccactactcccagttacctgcggaggagtcaagggaatactgcataagaagaaactccagcaggggatcttggtgaaatgcatccagacggaggacggcaaatggtttactcctactgaatttgagatcaaaggcggacacgcgcggtctaaaaactggcggctatctgtgagatgtgggggttggcccctccggtggctgatggagaacggatttctgcctgacccccctcgtattagataccgtaaaaaaaagagaatcctcaagagccaaaacaactctagcgtggacccatgtatgcggaacctggacgagtgcgaagtatgcagagatggcggggaactgttctgctgcgatacttgttccagggtcttccatgaagactgccacattccccccgtggaggctgaaagaacaccctggaattgcattttttgtaggatgaaagaatccccaggctcccagcagtgttgccaggaaagcgaggtgctggagagacagatgtgccccgaggaacagctgaaatgcgagttcctcctgctcaaagtgtactgctgctccgaaagttcattctttgctaagattccctattattattatattagggaagcatgccaaggactcaaggagcctatgtggctcgacaaaattaagaaacgcttaaacgaacatggttacccgcaagttgagggtttcgtccaggacatgagactaatcttccagaatcaccgcgcctcatacaaagcagtgcacggacgtcctggttgccgctag

SEQ ID NO: 20672 - DNA, 570 bp, Artificial Sequence
  Description of Artificial Sequence: Synthetic coding sequence
atggcccagcagggccagcagggccagatggccagcggcgacagcaacttgaacttcaggatggtggccgaaatccagaatgtggaggggcagaatctgcaggagcaggtgtgccctgagcctatcttcagatttttccgagagaataaggtggagatcgccagtgcaatcactcggccattcccttttctaatggggcttcgggacaggtcatttattagcgagcagatgtacgagcactttcaggaggctttcagaaacctggtgccagtaactcgggtgatgtactgtgtgctctcagagttggagaaaacattcggttggagtcatctggaggccctctttagcaggattaacctgatggcctaccccgacctaaatgaaatctatcgctctttccagaacgtttgctatgagcatagtccactgcaaatgaataatgtgaacgatctggaggatcggccacggctgctgccttatgggaaacaggaaaactctaatgcttgtcacgagatggatttttgtttaatactgcaagagtacgtgactggcaagaaacgcgagtattag

SEQ ID NO: 20673 - DNA, 1317 bp, Artificial Sequence
  Description of Artificial Sequence: Synthetic coding sequence
atggccggcggcggcagcgacctgagcacccggggcctgaacggcggggtctctcaagtggctaacgaaatgaatcacttgcctgcgcactcccaatcactccagaggctctttactgaagatcaggacgtggacgaaggtcttgtctacgacaccgtgtttaagcatttcaagcgacacaaactcgaaatctctaacgcaattaagaagacatttcccttcctcgaggggctcagagatcgggaattaataacaaataaaatgtttgaagatagtgaggacagctgtcgaaatttggtgcctgttcaaagagtggtgtataacgtactgagcgagctggaaaagacctttaatctttccgtgctcgaggctctgttcagtgaggttaacatgcaggagtacccggatcttatccatatctacaagagctttaaaaacgctatccaggacaagctttcgttccaggagagtgatcgcaaggagagggaggaacggcctgacatcaagttaagcttaaagcaaggtgaagtgcctgagagtccggaagccagaaaggaaagcgatcaggcctgcgggaaaatggacactgtggatatcgccaacaatagtaccctcggaaaacctaagagaaagcggcggaaaaaaaagggtcacggatggtcacggatgggcacgaggactcagaagaacaaccagcagaatgataacagcaaggctgacgggcagctcgtgtcatccgagaagaaggccaacatgaacctaaaggatctgtctaagataagaggccggaaaaggggaaaacccggcacacattttactcagagtgatagagccccgcagaagagagttagatcacgagcctcacgaaaacacaaagacgaaaccgtggatttccaggcaccactgctgcctgtgacgtgcggcggagtgaagggcatcctccacaaagagaagcttgaacaagggacccttgctaagtgcattcaaacagaagacggtaagtggtttacccctatggagtttgaaatcaaaggcgggtacgcaagatccaagaattggcgcctgtccgtcagatgtggcggatggcctctgcgaaggctgatggaggagggtagtctgcccaacccgccacggatttattaccgcaacaaaaagcgcatcttgaagagccagaataactcctctgtcgacccatgcatgagaaatttggatgagtgcgaggtgtgtagagacgggggagaactgttttgttgcgacacctgttctcgtgtgtttcacgaagattgtcatatcccccctgtcgagtccgagaaatag

SEQ ID NO: 20674 - DNA, 1212 bp, Artificial Sequence
  Description of Artificial Sequence: Synthetic coding sequence
atggccggcggcggcagcgacctgagcacccggggcctgaacggcggcgtgtctcaagtggcgaacgagatgaatcatctgcctgcacactcccaaagtctgcagcggctgttcaccgaagatcaggacgtggacgagggcctagtgtacgataccgtattcaaacacttcaagcgccataaactggagatctcgaatgcgatcaagaagacgttcccattcctagagggcctccgagaccgcgagctgattactaacaaaatgttcgaagattctgaagactcatgtaggaacctcgttcccgtccagagagtcgtatacaatgtcctgagcgagttagagaaaaccttcaatctcagtgtattagaggctctttttagcgaggtgaatatgcaggagtatcctgacttgatccatatttacaagagtttcaagaacgccatacaggacaagttatcttttcaggagagcgacaggaaggagcgcgaggagagaccagatatcaagctgtcactcaagcagggtgaagttccagagagccccgaagcgagaaaagagagcgaccaggcctgtggtaaaatggacaccgtggatatcgccaacaactctaccctcgggaagcccaagaggaaacggcgaaagaaaaagggtcatgggtggagtcggatgggaactaggacccagaagaacaatcagcagaatgacaatagcaaagcagacggacagctagtgtcttcagagaagaaggcgaatatgaatctgaaggacttatctaaaatcaggggccgtaagagaggaaagcccggcacacacttcactcaaagtgaccgggcccctcagaagagggtccgatcgaggggaactctggctaagtgtatccagactgaagatggaaaatggttcactcccatggagtttgagatcaaaggtggctatgcccgatctaaaaattggaggctgtcagtcaggtgtggtggctggcccctgcggcgactgatggaggaaggctcactcccaaacccgcctagaatctactataggaataaaaaacgaatcctgaaaagccaaaacaatagttcggtcgacccatgtatgagaaatctggatgaatgcgaggtgtgtagagatgggggtgaattgttctgttgcgatacatgctcacgtgtgtttcacgaagactgccacatccctcccgtggaaagcgaaaagtag

SEQ ID NO: 20675 - DNA, 1743 bp, Artificial Sequence
  Description of Artificial Sequence: Synthetic coding sequence
atggccggcggcggcagcgacctgagcacccggggcctgaacggcggagtgtctcaagtcgccaatgagatgaaccacctccctgctcacagtcagtctctccaaaggctttttaccgaggatcaggacgttgacgaaggcctggtgtacgataccgtgttcaagcactttaaaagacataagctggagatcagtaacgcgatcaagaaaacgttcccttttctggaaggtctccgggatcgggagctaatcaccaacaagatgtttgaagatagtgaagactcttgtcgcaacttggtacctgtgcaaagggtggtgtataacgtgctatcggagctcgagaaaacattcaacctcagcgtccttgaagctctgttttctgaagtgaacatgcaggaatacccagacttgatccatatctataagtcgttcaagaatgctattcaagataagctttcgtttcaagagtcagatcggaaagagcgggaagagcgcccagatattaaactgtctctaaaacaaggcgaagttcccgagtccccggaggccagaaaagaatcagatcaagcctgcggtaaaatggacacagtggacattgcaaacaattccactctgggaaaaccgaagaggaaacgacgaaagaaaaagggacatggttggtctaggatggggacccggacccagaaaaataaccagcagaatgacaacagtaaggctgacgggcaattggtgagctcggaaaaaaaggctaacatgaatctgaaggatcttagcaagatccggggcaggaaacgaggaaaaccgggaacccattttactcagtcggatagggctccacagaaacgagtccggagcagggcaagcaggaagcacaaggacgaaactgttgatttccaggcgcccctcctcccggtcacctgcggcggggtgaagggaatcttacataaggaaaagctggaacaaggaaccctcgctaaatgcatacaaactgaagacggtaagtggttcacgccgatggaattcgagatcaaaggtggctacgccagaagcaagaattggagactgtctgtgagatgtggaggatggccattgcgtcggctgatggaagaggggagcctccccaaccctcctcgaatatattataggaacaaaaaacgcatacttaaatcccaaaataatagctccgtggacccttgcatgcggaatctggatgaatgcgaggtgtgccgagacggtggagaattgttttgttgtgacacatgtagcagagtgtttcacgaagattgccacattccaccagtggagtcggaaaagacaccgtggaattgtattttttgcaggatgaaagaaagtcctggatctcagcagtgctgccaggaatccgaagtcctggagaggcagatgtgccctgaggagcaattgaaatgtgaattcttgctgctgaaggtgtattgctgttcagaatcctctttctttgcgaaaatcccttattattattatatccgcgaagcctgccagggactcaaagagcccatgtggctggacaagattaagaagcggctcaacgaacatggctatccgcaggttgaggggttcgtccaggatatgagactcatcttccaaaaccacagagcctcgtataaatacaaggacttcgggcaaatgggcctgagactggaagctgagttcgagaaagatttcaaggaagtgtttgccatccaagaaacaaacggaaactcctag

SEQ ID NO: 20676 - DNA, 1317 bp, Artificial Sequence
  Description of Artificial Sequence: Synthetic coding sequence
atggccggcggcggcagcgacctgagcacccggggcctgaacggcggggtgagtcaggtcgccaatgaaatgaatcacctcccagcccattctcagtctctgcagcgactctttactgaggatcaagacgtggatgaggggctggtctatgacactgtgtttaaacacttcaagcggcataaacttgaaatttcgaacgcgatcaaaaaaacgttcccctttcttgaaggactgcgcgacagagaactgatcaccaataagatgtttgaagattccgaagattcttgccgcaatctcgttcctgtgcaacgcgtggtgtacaatgtgcttagcgaattagaaaaaactttcaacctgtcggttctcgaggccttgttttctgaggtgaatatgcaggagtaccccgacttgatccacatctataagagctttaaaaacgccatacaggacaaactgagttttcaggagtccgatagaaaggagcgggaggagcgcccagatattaagctcagccttaagcagggagaagttccggagtcacccgaagctcgcaaagagtccgatcaggcctgtggaaagatggacacagtcgatatcgccaataattctacactgggtaaaccaaaacgaaagcggaggaagaaaaagggtcatggttggtcacgcatggggacgcgcacacagaaaaataaccaacagaacgacaattcaaaggctgacgggcagctggtgtcctcagagaaaaaagcaaatatgaacctgaaagatcttagtaagatcagagggcgtaagcgagggaaaccgggcacccattttacgcaatccgacagggcaccacagaagcgggtccggtctagagcatcaaggaagcacaaggatgaaacagttgacttccaggccccgctgctgcctgtgacctgtggaggagtgaagggaattttacacaaggaaaagctcgaacaggggaccctcgccaaatgcatacaaaccgaagatgggaagtggtttacccccatggagtttgaaattaaaggcggttacgctcgcagcaagaattggcgtctgtctgtgcggtgcggaggatggccgctccgcagactcatggaggagggctcattgccaaatcctccacggatctattataggaataaaaagcgcattctaaagtcccagaacaatagctcagtcgacccctgtatgaggaacttagatgagtgcgaagtatgtagagatggcggcgaactgttttgttgtgacacctgcagtcgagtcttccatgaggattgtcacatccccccagttgaatcagagaagtag

SEQ ID NO: 20677 - DNA, 390 bp, Artificial Sequence
  Description of Artificial Sequence: Synthetic coding sequence
atgttcgaggacagcgaggacagctgccggaacctggtgcccgtgcagagggtggtctataacgttttaagtgagcttgagaagacatttaatttatccgtgctagaggcactcttttcagaagtgaatatgcaggagtaccccgatctgattcatatctataagtccttcaaaaacgctatacaggataaactctctttccaggagtcggatcgaaaagaacgggaggagcgtccagatattaagctgagtctgaaacagggggaggttccggagtcacctgaagcccgtaaagaatcggatcaagcctgtgggaagatggatacagtggacattgctaacaactccactctggggaagcctaagaggaagaggagtaagaataaatag

SEQ ID NO: 20678 - DNA, 750 bp, Artificial Sequence
  Description of Artificial Sequence: Synthetic coding sequence
atggccgccaccgccgccgtgagccccagcgactacctgcagcccgcagcaagcactacacaagacagtcagccgtcacctctggctctgctggctgccacctgcagcaagatcggtcccccagcagtcgaagctgccgtgacccccccagctccgccccaaccaacaccgcgaaagttagtgcctatcaagccggcacctcttccgctgagccctggaaagaatagcttcgggatcctttcatccaaggggaatattctccagatacagggctcccaactcagcgcctcatacccaggtggccagctggtgtttgctattcagaaccctaccatgatcaataaggggacacgcagcaatgccaacattcagtaccaggccgtgcctcagatccaggctagcaactctcagacaattcaggtgcagcctaatctgaccaatcagatccagatcatccctggaaccaaccaggctatcatcacacccagcccctcgagtcataagccggtgcccattaagcccgctcctatccagaaaagtagcacaacaactacccctgttcagtcaggggcaaatgtggtaaagctaacaggcggcggagggaacgtgacactgaccctccctgtcaataacttggtgaacgcctcagacacaggcgcccccacacagctcctgaccgcatcctgccaaaccggaatgcttaacagcacaaggatgttccttttcctcgcatttattaatgtcctgtag

SEQ ID NO: 20679 - DNA, 1842 bp, Artificial Sequence
  Description of Artificial Sequence: Synthetic coding sequence
atgagcgacccccagaccagcatggccgccaccgccgccgtgagcccctctgattatttacagcctgccgcctccaccacacaggatagtcagccctctcccctggctcttctggctgccacatgctcaaaaatcgggccgccagctgtggaagccgccgtcacccccccagcaccaccgcagcctacacctcggaagctggtaccaataaaacccgcacctctgcccctgtcacctggcaaaaatagcttcggaattctgtcctccaagggaaacattctgcagatccaaggctctcagctcagtgccagctatcccggaggtcagctggtgtttgccatccaaaacccgaccatgatcaacaagggaacacgctctaatgctaacatacagtaccaggccgtgccacaaattcaggccagtaattcccagactatccaggtgcaaccaaatctgaccaaccagatacagattatacccggaacgaaccaggcaattatcacgcctagccctagcagtcacaaacccgttccgatcaaacccgcccccatccagaagtcaagcacgacaacgactccagtgcagtctggggcaaacgtggtgaaattaacaggaggagggggcaacgttaccctgactctgcctgtgaataatctcgtgaacgcttctgacaccggcgcccctactcaactgctgacagaatcaccccctaccccactgagcaagaccaacaagaaggcccgcaagaagtcccttcctgccagccagccgcctgtggccgtggcagagcaggtcgagactgttctgatagagacaacggcagacaatatcatccaggctggtaacaacctgctgatagtgcaaagtcccgggggcggccagccagctgttgtgcagcaagtgcaggtggtgccccctaaggctgagcagcaacaggtggtccagattccccagcaggcactgagagtggtgcaggccgcttcagctacgcttcccactgtaccacagaagccatcccagaactttcaaatccaggccgccgagcccactcccactcaggtttatatccgaaccccatccggtgaagtgcagacagtactggtccaggacagccctccagccaccgccgcagcaacaagcaatactacatgtagctctccggcctctcgcgccccccacttatctggaacctcaaagaaacattcagctgcaatcctgaggaaagagagacctttgccaaagatagctcccgccgggagcatcatctcactcaacgctgcacagttagcagctgctgctcaggcaatgcaaacgataaatataaatggcgtgcaagtgcagggtgtaccagtaacaatcacaaatactggcggacaacaacaattgaccgttcagaacgtgagcggaaacaacctcactatcagtgggcttagccccacccagatccagttgcagatggaacaggctttggctggggagactcagccaggagaaaagcgtaggcgaatggcttgcacatgccctaactgcaaagacggagagaaacgcagcggcgagcaggggaaaaagaagcatgtgtgccacattccagactgtggtaagaccttcagaaagacatcgttactgcgtgcgcatgtgagactgcacacaggcgaaaggccgtttgtctgtaattggttcttctgcggaaagcgctttacccggtcagacgagctccagcggcacgcccgtacccacacaggggataagcggttcgagtgtgcgcagtgccagaagcgcttcatgagatccgatcacctgactaagcattacaagacacatctagtgaccaagaacctgtag

SEQ ID NO: 20680 - DNA, 1197 bp, Artificial Sequence
  Description of Artificial Sequence: Synthetic coding sequence
atggccgccgtggccgtgctgcggaacgacagcctgcaggccttcctccaggaccgcacacccagcgcgagccccgatctgggcaagcactcacccttggccctgctcgccgccacctgcagcagaattggtcagccaggggctgctgctcctccggatttcctacaggtgccctacgaccctgcccttggtagtccctccagactattccatccatggaccgctgacatgcccgcccatagtcccggcgccctgcccccccctcatccatcccttgggcttactccccagaaaacccacctccaaccatcctttggagcagcacacgaactccctcttacaccccccgccgacccttcttacccgtacgagttcagtccagtgaaaatgcttcccagctcaatggccgcgctgcctgccagttgtgcaccagcttatgtcccctacgcagcccaggccgctctgcctcctggttactcaaatttgttgccccctccacccccacctcctccacctcctacctgcaggcagttatccccaaacccagctccagatgacttaccatggtggtctattccgcaggcaggagccggacccggtgcctccggagtccctgggagcgggctgtcaggcgcgtgtgcgggggcaccacatgccccacgcttcccagcatccgctgctgcggcagcagcagcagcagcagcactgcagcgcggccttgtccttgggccatctgacttcgcacagtatcaaagtcagattgcggctctgctccagaccaaagcccctcttgccgctacggccagacgatgccgaaggtgcagatgccccaactgtcaggcagcagggggcgcccccgaagccgagcccggtaagaagaaacagcacgtgtgccacgttcctgggtgcggaaaagtttacggaaagacttcacacctgaaagcccacctaaggtggcataccggcgagcgacctttcgtctgcaactggctgttctgtgggaaatcatttactagaagtgatgagctccagcggcatctccggactcataccggcgagaaacgatttgcctgtccagaatgcggcaaacgatttatgagaagtgaccatctagcgaagcacgtcaaaacccatcaaaacaagaaactcaaagttgccgaagccggggtcaagcgggaggatgccagggatctgtag

SEQ ID NO: 20681 - DNA, 1131 bp, Artificial Sequence
  Description of Artificial Sequence: Synthetic coding sequence
atgctgaccgccgtgtgcggcagcctgggcagccagcacaccgaggccccacacgccagcccaccaaggcttgatctgcagcccctgcagacctatcagggacatacttccccagaagctggcgattacccttctcccttgcaacctggcgagttgcagtctttgcctctgggccctgaagtcgacttttcccaggggtacgaactgcctggagcttcatcgcgtgtgacctgcgaggacctggagagtgacagtccattagcgcctggccctttctctaaactgctgcagccggacatgagccaccattatgagtcatggtttcgtcctactcaccctggcgccgaggatgggtcttggtgggatcttcacccagggacttcttggatggatctgccgcacacccagggagctctgactagtcccggtcatcctggcgcgcttcaagctggcctcggcggctacgtcggagatcatcagctttgtgctccccctccgcacccacacgcacatcacttgctcccagccgccggaggacagcacctcttgggccctccggatggtgctaaggcccttgaggtggcggcacctgagagccaagggttggactcttcgctcgacggtgcggcccgtcctaagggcagtaggcgaagtgttccgaggtcctcgggccagactgtgtgccgctgtccaaattgcctggaagccgagcggctgggggcgccgtgtggccccgacgggggaaagaagaaacatcttcataactgccacatacctgggtgcggcaaagcatacgcaaaaacgagtcatttgaaagcccacttgcgatggcattctggagacaggccatttgtctgcaattggctgttctgcggtaagcgcttcactcgttcagatgaattacaaagacatctgcaaacgcacaccggaacgaaaaagttcccttgtgccgtgtgttcccgagtgtttatgcgatcagaccacttagccaaacatatgaagactcatgagggcgctaaagaggaggccgctggtgctgccagcggcgagggtaaagcgggcggggctgtggagcctccaggaggcaaagggaagagggaagcggagggcagcgttgctccttccaattag

SEQ ID NO: 20682 - DNA, 1131 bp, Artificial Sequence
  Description of Artificial Sequence: Synthetic coding sequence
atgctgaccgccgtgtgcggcagcctgggcagccagcacaccgaggcccctcatgcttctcctccgagactggatctgcagccgctgcagacgtaccagggccacacctcacctgaggctggcgattatccatctccactgcaaccaggggagctccagtctttacctctggggcccgaggtggacttctctcagggctatgagctgccaggagcgtcaagccgagtgacatgcgaagatttggagagtgattcacctttggcccccgggccttttagtaaactactgcagccagacatgagccatcactatgagagttggtttcgccccactcatcctggagccgaagacggcagttggtgggatctccatccgggaacaagctggatggacctgccacacacccaaggagccctgacatccccggggcacccaggtgccttacaggccggcctgggagggtacgtcggtgaccatcaactctgtgctccccctccacacccacacgcacaccacttgctcccagctgccggaggacagcatcttctgggcccccctgatggagctaaggctctcgaggtcgctgcaccagaaagccaagggctcgacagcagccttgatggagccgctcggcccaaaggaagtagaaggtcagttcctaggtcttctggacagaccgtgtgccgctgccccaattgtctggaagcagagaggctgggggccccttgcggacctgacggcggcaagaagaagcacttgcataactgccacatcccaggctgtggcaaggcctatgccaagacttcccatctgaaggcccatctgcggtggcattccggagatcgcccattcgtctgtaactggctgttttgtggcaagcgcttcacccgctcagacgagctgcagagacatcttcagacacatactgggactaaaaagttcccctgcgcggtttgctctcgggtgtttatgcggagcgaccacctagcaaaacacatgaagacacatgagggggccaaagaggaggcggccggtgccgcctctggcgaaggaaaagccggaggggcggtcgaaccacccggggggaagggaaagagagaagccgagggaagtgtcgcaccttcaaattag

SEQ ID NO: 20683 - DNA, 1455 bp, Artificial Sequence
  Description of Artificial Sequence: Synthetic coding sequence
atggccaccagcatcctgggcgaggagccccggttcggcaccaccccactcgctatgttggccgccacgtgtaacaaaatcggcaatacctcccctttgacaactttacctgagtcctcagctttcgctaaaggtggtttccatccgtggaagcgatcaagtagttcttgcaatcttggatcttccctgtcaggcttcgcagtagccacgggcggccgcggaagcgggggccttgctgggggaagtggggcagctaattccgcgttctgcctcgcaagtactagcccaaccagcagtgccttttccagcgactatgggggcctgttttctaactcagccgctgccgcagctgctgcggccggtgtcagtccgcaagaagcgggtggacaatcagcttttatttccaaagtccacactacggccgctgacgggctgtatcctcgggtgggtatggcacacccatatgagagctggtataaaagtgggttccactccacactggccgccggggaggtgactaatggagccgcttcttcatggtgggacgtccatagctcccctggttcctggctcgaggtacagaatccagctggaggactccagagttcactccactccggcgccccacaggcttccctgcactctcaattgggcacatataatcccgatttttccagtttaacacacagtgccttttcgagcacagggttggggtcctcagccgcggcggcttcacacttgctgtccacaagccaacacctcctggctcaggacgggttcaagcccgtgttgccaagctatagcgacagtagcgcggcagtagcagccgccgcagcaagcgctatgatctccggcgcagccgccgctgccgcaggaggcagcagcgccagatctgctagaaggtattccggtcgagcaacctgtgattgccctaattgtcaggaagcggaacgcctcgggcctgccggcgcttctctgaggcggaagggattacacagttgccacatccccggctgcggcaaggtatatggtaaaactagccatctaaaagcacacctgcgctggcacaccggagaacgacccttcgtttgcaactggttgttctgtggcaaacggtttacaagaagtgacgagctgcaacgccacctccgaactcacacgggagaaaagcggttcgcttgtcctgtatgcaacaaaagatttatgaggtccgatcacctgagtaaacatattaagactcataacggaggtggaggcggaaaaaaaggatctgatagtgatacggacgcctcaaacctagaaactcctcgcagcgaaagccccgacctaattttgcatgattctggggtgagcgctgcccgggcagctgccgcagctgccgccgcagcggccgcggccgcggccgctgcttctgccggtggcaaagaggcggcaagcggacccaatgactcttag

SEQ ID NO: 20684 - DNA, 1125 bp, Artificial Sequence
  Description of Artificial Sequence: Synthetic coding sequence
atgagccgggtgcccagcccccccccccccgccgagatgagcagcggaccggtggctgaatcctggtgttacacccagattaaggtggtgaagttctcttacatgtggactattaataactttagcttctgcagggaagagatgggtgaagtcatcaaatcttcaaccttttcctctggagcgaatgacaaactgaagtggtgcctccgggtgaaccctaagggcctcgacgaagagagtaaggattatcttagtctctacctgctcttggtgagctgtcccaagtctgaagttagagcaaagttcaagttttccattctaaacgccaagggagaagaaaccaaggcgatggaatctcagcgggcgtaccgctttgtccagggaaaagactggggcttcaagaaattcattagacgggacttcctgctggacgaagctaatgggctgctgccagacgataagctgacacttttttgcgaagtttccgtcgtgcaggacagcgtgaacatttctggccagaacacgatgaatatggtgaaagtgcccgaatgtagactagcagacgagctgggcggcctttgggagaattcacgcttcaccgactgctgtctttgcgtcgcagggcaggagtttcaggcccacaaagcaatcctggccgccagaagcccagttttctctgccatgttcgagcacgaaatggaggagtcaaaaaaaaatagagtcgagattaatgacgtcgagcccgaggttttcaaagaaatgatgtgtttcatctatacagggaaggctcctaacctggacaaaatggctgatgatcttctagctgccgcggacaaatacgcccttgagcgtttaaaagttatgtgtgaggacgccctgtgctcaaatctgtctgtggaaaatgctgcagaaatcctcatcttggccgatctgcactccgccgatcagctgaagactcaggccgtggacttcatcaattaccacgcttcagatgtgcttgagaccagcggctggaagtccatggtggtgtcccaccctcatttagtagctgaagcataccgctcccttgcctctgcccagtgcccctttcttgggccacccaggaagaggctgaagcaatcctag

SEQ ID NO: 20685 - DNA, 1125 bp, Artificial Sequence
  Description of Artificial Sequence: Synthetic coding sequence
atgagccgggtgcccagcccccccccccccgccgagatgagcagcggacctgtggcagaaagttggtgctacactcaaataaaagtggtgaagttcagctacatgtggaccattaacaattttagcttttgcagagaagaaatgggagaggtgatcaaatccagcacattcagttcaggggctaatgacaaactcaagtggtgcctcagagtgaatcctaagggtctggatgaagaatccaaagactatctatccctgtacctacttttggtcagctgcccgaaaagtgaggtgcgggccaagtttaagtttagcatcctaaacgcaaagggagaggagaccaaggcgatggaatctcagcgcgcataccgatttgtgcaggggaaagactggggattcaagaagttcattagacgggattttctactggacgaggctaacggtctgctgcccgatgacaagttgacccttttctgcgaggtgagtgtggtgcaagactcagtgaatattagtggccagaataccatgaatatggttaaagttcctgaatgccgactggctgatgaacttggggggctgtgggagaattcccgttttactgattgttgcctctgtgtggcaggtcaggagttccaagcacataaggccattttggccgctcgctcccccgtcttttcagccatgttcgagcacgagatggaggaatccaagaagaaccgggtggagatcaatgatgtagaacctgaagtgttcaaggagatgatgtgtttcatctacacagggaaagcccctaacctcgataagatggccgacgacctgctcgccgccgccgataagtatgccctggaaagactgaaggtgatgtgcgaagatgctctgtgtagcaatttgtccgtggagaatgcagccgagatcttaattctcgctgatttacactctgccgaccaactgaaaacacaggctgttgattttattaattatcacgcatccgatgtgctggagacgtcagggtggaagtctatggtggtgagccaccctcacctggtcgctgaagcttatcggagtcttgccagtgcacagtgcccatttttgggcccgccccgcaagcggctgaagcagtcatag

SEQ ID NO: 20686 - DNA, 1125 bp, Artificial Sequence
  Description of Artificial Sequence: Synthetic coding sequence
atgagccgggtgcccagcccccccccccccgccgagatgagcagcgggccagtggcggagagctggtgttacacccagattaaggttgtcaaattttcttatatgtggactatcaataacttcagcttttgtagagaagaaatgggtgaagtgattaagtcgtccaccttctcaagtggagctaacgataagcttaagtggtgcctccgagtaaaccctaagggacttgatgaggaatctaaggactacctgtctctctatctcctgctggtttcctgtcccaagtctgaagtgcgcgcaaagttcaagttcagtatcttgaatgctaaaggcgaggagacaaaagcgatggaatcacagagagcctaccgattcgtgcagggaaaggattgggggtttaaaaaattcattcgacgagatttcctgctagacgaggccaacgggttactacctgacgataagctgaccctgttttgcgaagtttcagtcgtacaggatagcgttaacatatctgggcagaatactatgaatatggtcaaggtaccggaatgtcggttagcggacgagttggggggtctctgggagaacagtaggttcacggattgttgcttgtgcgttgcaggacaagaattccaggcccacaaggcaatcctcgcagctcggtcccccgtgttcagtgcaatgtttgaacacgaaatggaggagtccaaaaaaaatcgcgtggagattaatgatgtggagccggaagtgtttaaagagatgatgtgctttatctatactggcaaagcaccgaatttagataaaatggccgacgatttgctggccgccgccgacaaatacgccctggagaggctgaaagttatgtgcgaggacgctctctgctccaacctaagtgtcgaaaatgctgccgagattctcatcctcgcggatttgcacagcgctgatcagttaaaaactcaggcagtcgacttcatcaattaccacgcctccgatgtactggagacctcaggttggaaaagtatggttgtgagccatccgcacctagtggccgaggcttatcgcagtttagcttccgcacaatgtccgttcctcgggccccctaggaagagactgaagcagtcatag

SEQ ID NO: 20687 - DNA, 99 bp, Artificial Sequence
  Description of Artificial Sequence: Synthetic coding sequence
atgagccgggtgcccagcccccccccccccgccgagatgagcagcggacctgtggccgagtcttggtgctatactcagatcaaggtcgtcaaattttag

SEQ ID NO: 20688 - DNA, 777 bp, Artificial Sequence
  Description of Artificial Sequence: Synthetic coding sequence
atggagagccagcgggcctaccggttcgtgcagggcaaggactggggcttcaagaaattcatacggcgggatttcttattggatgaagcaaacggtttgttacccgacgataagctcactcttttctgcgaagtcagcgtagttcaggattccgtcaacatttccggacaaaacaccatgaacatggtgaaggtgcctgagtgccgcctggcagatgagcttggaggcctgtgggagaattctagattcacagattgctgtctgtgcgttgccggccaggaattccaggcacacaaagcaatcttggccgcgaggagcccggtgttctccgcgatgtttgaacatgagatggaggagtctaaaaagaatcgggtcgagatcaacgacgtagagcccgaagtctttaaggagatgatgtgcttcatctacaccggtaaagccccgaatctggataaaatggcagacgacttactcgctgcagctgataagtacgctctcgagaggctgaaggtgatgtgtgaagatgctttatgttccaatctgagtgtcgagaatgctgccgagatcctgatcctagcggacctccattccgcagatcagctaaaaacacaggcagtggactttattaactaccacgctagtgatgtcttggagacctctgggtggaagtcgatggtcgtgagccaccctcatctggtggctgaggcttatagaagtctggctagcgcccagtgcccttttctaggtccacctagaaaacgcctgaagcagagctag

SEQ ID NO: 20689 - DNA, 1125 bp, Artificial Sequence
  Description of Artificial Sequence: Synthetic coding sequence
atgagccgggtgcccagcccccccccccccgccgagatgagcagcggcccggtggctgaatcttggtgctacacccagatcaaggttgtgaaattcagttatatgtggaccataaacaatttctcattttgcagagaggaaatgggggaagttatcaagtcatctaccttttcctctggcgctaatgataaacttaagtggtgtctgcgagtgaaccctaaggggctcgacgaggagtccaaggactacctctctctatatctactgctggtgtcatgccccaagagcgaggtaagagccaagtttaaattcagtattctgaatgccaaaggggaagagaccaaggctatggaatcccagcgagcctaccggtttgtacaagggaaagactggggtttcaaaaagtttattcggcgggatttcctgctggatgaagcgaatgggctgctgcccgacgacaagttaaccttgttctgtgaggtgtcggtggtgcaggattcggtcaacatctctggtcaaaatactatgaacatggtgaaagtgcccgaatgcagacttgcagacgaactgggtggcctatgggagaacagccgcttcacagattgctgtttgtgtgtagctggacaggaattccaggcccacaaggccatactggctgccaggagcccagtgttctcagcaatgttcgaacacgagatggaagaaagcaagaagaatagggtggagataaacgatgtcgagccagaagtgtttaaggaaatgatgtgttttatctacaccgggaaagcccccaacctggacaagatggccgatgacttgttggctgctgccgataagtatgccttggaacgccttaaggtgatgtgtgaggatgccctctgcagtaacctctctgttgagaatgccgccgagattttgatcctggcagacttgcattctgctgaccagctgaagacgcaggccgtggacttcatcaattaccacgcctctgacgtgctggagacgtccgggtggaagtccatggtcgtatcccacccacacctggtcgcagaggcttatcggtctttagcgtctgcacagtgccccttcctcgggccacctcgtaaaaggcttaagcaaagttag

SEQ ID NO: 20690 - DNA, 1125 bp, Artificial Sequence
  Description of Artificial Sequence: Synthetic coding sequence
atgagccgggtgcccagcccccccccccccgccgagatgagcagcggcccagtcgcagaatcatggtgctatacacagatcaaggtggtcaaattcagctacatgtggacgattaataactttagcttttgtcgcgaagaaatgggggaggtgattaaatcatcgactttctctagcggtgccaatgacaagttgaagtggtgcctccgggttaaccctaagggacttgacgaggagagtaaggattatctgtccttatacctgcttttggtctcttgccctaagtctgaggtacgggctaagtttaagttcagcatcctcaatgcaaaaggcgaggaaacaaaagctatggaatcccagagagcgtatcggttcgtgcaaggcaaggactggggttttaagaaattcatcagaagggactttctgctggatgaagccaatgggctcttacccgatgataagctgactctcttctgtgaagttagcgtggtgcaagattctgtgaatatctcaggccagaacacgatgaacatggtcaaagtcccagaatgccgactagccgatgaacttggcggcctatgggaaaactcaagatttacagattgctgtctctgtgttgccgggcaggagttccaagcccacaaggcgatcctcgcagctcgctcccctgttttctctgccatgttcgagcatgaaatggaagaatccaagaagaaccgagttgaaattaatgatgtggaacctgaggtttttaaagagatgatgtgtttcatatatacaggcaaggcccctaatttggacaaaatggccgacgatctcctcgccgcagcagacaagtacgccctcgaacgcctgaaggtgatgtgtgaggatgctctgtgttcaaatctgtctgttgaaaacgcagctgaaatcttgattctcgccgatctacattccgcagaccagctcaagactcaggccgttgactttatcaactatcatgcgagcgacgtcttggagacttccgggtggaaatctatggttgtcagccaccctcacctcgtcgcagaggcttatagatctctcgccagcgcccaatgcccattcctgggaccccctaggaagcgtctcaaacagagttag

SEQ ID NO: 20691 - DNA, 717 bp, Artificial Sequence
  Description of Artificial Sequence: Synthetic coding sequence
atgagccgggtgcccagcccccccccccccgccgagatgagcagcgggcccgtagccgagtcctggtgttatacacaaattaaggtcgtgaagtttagctatatgtggacaatcaacaacttctccttctgtcgcgaggagatgggcgaggttatcaaaagttccaccttcagctctggcgcgaatgacaagttgaagtggtgcctccgtgtcaatcccaagggcctagacgaggaatctaaggactacctgagtctgtatctcttactcgtcagctgcccgaagtccgaagtacgcgctaaatttaagttcagcatcctaaatgccaaaggagaggagaccaaggcaatggaaagtcaaagagcctacaggtttgtccagggtaaagactgggggttcaaaaaattcatacggcgcgacttccttctcgatgaagccaacggccttctgcccgatgacaaactcaccttattttgtgaagtctccgttgttcaggacagtgtgaacatttcaggacagaacactatgaacatggtgaaggtccccgagtgcagactcgctgatgaactgggtgggctttgggaaaactctcggttcacagattgctgtctttgcgtggccggccaggagtttcaggcgcataaagccattctggccgccagatctcctgtcttcagcgcaatgttcgaacacgagatggaagagtccaagaagtag

SEQ ID NO: 20692 - DNA, 561 bp, Artificial Sequence
  Description of Artificial Sequence: Synthetic coding sequence
atgagccgggtgcccagcccccccccccccgccgagatgagcagcggacctgtcgctgagtcctggtgttacacccagatcaaagtggttaaattttcttatatgtggaccatcaataattttagcttttgccgagaggaaatgggggaagtcattaagtcttcaacgttcagtagcggcgccaatgataaactgaagtggtgtctccgtgtcaaccccaaaggcctcgatgaagaatcaaaggattacctcagcctctatctgttgttggttagctgtcccaaaagcgaggtgcgggctaaattcaagtttagcatcctgaatgccaagggtgaagagactaaggctatggagtctcagcgggcgtacaggtttgtgcagggtaaagattggggatttaagaagtttattcgacgcgacttccttctggacgaggccaacggcctgctgcccgacgacaagcttaccctgttctgtgaggtgtctgtcgtgcaggacagcgtcaacatctctggccagaataccatgaacatggtgaaagtgccagaatgccgcctgtag

SEQ ID NO: 20693 - DNA, 123 bp, Artificial Sequence
  Description of Artificial Sequence: Synthetic coding sequence
atgagccgggtgcccagcccccccccccccgccgagatgagcagcggaccagtcgctgagtcctggtgttatacccagattaaagtggttaaattcagctacatgtggaccattaacaactag

SEQ ID NO: 20694 - DNA, 789 bp, Artificial Sequence
  Description of Artificial Sequence: Synthetic coding sequence
atgagccgggtgcccagcccccccccccccgccgagatgagcagcggacccgtggcagagagctggtgctatacccagattaaagtagtaaagtttagttatatgtggaccatcaataactttagcttctgtagagaggagatgggagaggttattaagtcttccacgttttcgagtggggctaacgataagttaaagtggtgcctgagggtgaatcctaagggcttagacgaagaatccaaggattatctgtctctgtatctgctgctggtgagctgcccaaagtccgaagtgagagccaagttcaaattttccattctcaatgcgaagggcgaggaaaccaaggccatggagtcccagcgagcctatagattcgtgcagggtaaggactgggggttcaaaaaatttatacgccgagactttctgttggacgaagcaaatggtctgctgccagacgacaagctaacactgttctgcgaggtaagcgtagtgcaggatagtgtgaatatttccggccagaacactatgaacatggtaaaggtgcccgaatgcaggttggcagatgagctgggtgggttgtgggagaacagccgcttcaccgattgctgtttgtgcgtcgctggccaggagttccaggctcacaaggcaattctggctgcaagatcaccagtgttcagtgctatgttcgagcacgagatggaagagtccaaaaaaaatagggttgagatcaacgatgtggagcccgaagtctttaaggagatgatgtgtttcatttatactggaaagtag

SEQ ID NO: 20695 - DNA, 201 bp, Artificial Sequence
  Description of Artificial Sequence: Synthetic coding sequence
atgagccgggtgcccagcccccccccccccgccgagatgagcagcgggccggtggccgagtcatggtgttatactcagattaaagtggtgaagttcagctacatgtggaccattaataattttagtttctgcagggaggaaatgggggaagtaattaagtcatcaactttttccagcggggccaatgacaaactaaaatag

SEQ ID NO: 20696 - DNA, 984 bp, Artificial Sequence
  Description of Artificial Sequence: Synthetic coding sequence
atgggcgaggtgatcaagagcagcaccttcagcagcggcgccaacgacaagctaaaatggtgtctgagagttaaccccaaagggctggacgaggaatccaaggactacctatctttgtacctgctgttagtgagctgcccaaagagcgaagttagggctaagtttaagttttcaatccttaacgctaaaggtgaggaaacgaaagctatggagagtcagagggcctatcggtttgtgcaggggaaggattgggggttcaaaaaattcatccgcagggattttttactggacgaagcaaacgggttgctgcctgacgataaactcacactcttctgtgaagtgagtgttgtccaggactccgttaacattagtggccagaacacaatgaacatggtcaaggtgcctgaatgtcggctcgccgatgaactcggtggcttgtgggagaatagtcggttcactgactgttgtttgtgtgttgcagggcaggagttccaggcacacaaagcaattctcgcagccaggtctcccgtcttcagtgccatgtttgagcacgagatggaagaaagcaagaaaaatagggtggagattaacgacgtggaacctgaggtgtttaaggaaatgatgtgtttcatatacaccggcaaagcccctaaccttgataagatggctgacgaccttctagccgccgccgacaagtacgctctggaacgtcttaaggtgatgtgcgaggacgccctgtgttctaatctttctgtggagaatgccgctgagatcctgatcctggccgaccttcattccgcagatcagctgaagacacaggccgtggacttcataaattatcacgcatctgatgtgttggagacttctgggtggaagagcatggttgtatctcacccacatttagttgccgaggcgtacaggtcactggctagtgcacagtgtccctttcttggaccaccccgaaagcgcctcaagcaatcatag

SEQ ID NO: 20697 - DNA, 417 bp, Artificial Sequence
  Description of Artificial Sequence: Synthetic coding sequence
atgagccgggtgcccagcccccccccccccgccgagatgagcagcggtcctgtggccgagtcatggtgctatacccagatcaaggtggtgaaattttcctatatgtggacaatcaacaatttcagcttctgccgcgaggaaatgggagaagtgatcaaaagttcaacttttagtagcggcgcaaatgataaactcaaatggtgcctcagggttaatcctaagggtcttgatgaagaatcaaaagactacctgagcctgtacctcttgctggtgtcctgtcccaaatccgaggtgagggctaaattcaagttttccattctgaacgccaagggggaggagacaaaagcaatggagagccagagggcatacagattcgttcaagggaaggactggggattcaagaaatttatcaggtag

SEQ ID NO: 20698 - DNA, 354 bp, Artificial Sequence
  Description of Artificial Sequence: Synthetic coding sequence
atgagccgggtgcccagcccccccccccccgccgagatgagcagcgggccagtggcggaaagctggtgctatacacagattaaggttgtcaagttctcatatatgtggaccataaacaacttctccttctgcagggaagagatgggtgaggtgattaagagcagcaccttcagttctggcgccaatgacaagctcaagtggtgtctgcgagtcaatcctaagggccttgacgaggagtccaaagattacctgtctctgtacctcttgctagtgagttgtccaaagtccgaggtacgcgccaagttcaaattttccattcttaacgcaaaaggcgaggaaactaaggccatgtag

SEQ ID NO: 20699 - DNA, 1179 bp, Artificial Sequence
  Description of Artificial Sequence: Synthetic coding sequence
atgagccgggagcccaccccccccctgcccggcgacatgagcaccggccctatcgccgaatcctggtgttatacacaggtaaaggtggtcaaatttagctatatgtggaccattaacaacttttccttttgtagagaagagatgggtgaggtgctcaagagttctacattttcaagcgggccttctgacaagatgaaatggtgcctacgggtgaaccccaagggcctggatgacgaaagtaaggattaccttagtttgtatctcctgctcgtatcttgtcctaaatctgaggtcagagccaagtttaagttttcactcttgaacgcgaaacgggaggagacgaaagccatggagagccaaagagcatatagattcgtgcagggcaaggattggggatttaagaaatttattaggcgcgacttcctactagacgaagccaacgggttgttacctgacgataagttgacgctgttctgcgaggtctccgtcgtgcaggattcggtgaacataagcgggcatacaaacacaaataccctcaaggtgcctgaatgtagactggctgaggatctgggtaatctgtgggagaacaccagattcaccgattgcagctttttcgtgcggggacaagaattcaaagcccataaatccgtgcttgctgctaggtctcctgtcttcaacgcgatgttcgagcatgaaatggaagagtctaagaaaaaccgcgtagagatcaacgacctggatccagaagtgttcaaggaaatgatgagattcatctataccggccgagcccctaacctcgacaagatggcagataacctgctcgctgctgccgacaaatatgcactggagaggcttaaggtgatgtgcgaagaggctctctgcagcaatctgtcagtcgagaacgtggccgacaccctggtcttggctgatttgcattccgccgaacaactgaaggcacaggctatcgattttatcaatagatgttctgttctgcgtcagttgggctgcaaagacgggaaaaactggaattccaatcaggctacagatataatggagacatcaggctggaagagtatgattcaatcacatccccacttggtcgctgaagcgttccgggctctagctagcgctcaatgtcctcagtttggtatcccaagaaaaaggctcaagcagagttag

SEQ ID NO: 20700 - DNA, 9675 bp, Artificial Sequence
  Description of Artificial Sequence: Synthetic coding sequence
atgcagaaggcccggggcacccggggcgaggacgccggcacccgggccccgccgtctcccggcgtgccccctaaaagggcgaaagtcggagctggcggcggagcccccgtggcggtagcaggggcgcccgtcttcttaagaccactcaagaacgccgccgtctgtgccggaagtgacgtgcgtctgagagtggtggtctccggcacaccacagccatcactgagatggttcagagacgggcagctcctgccagcacccgcgcctgagccgtcgtgcctgtggttgcgaaggtgcggcgcacaggacgccggagtttactcatgcatggcccagaatgaacggggacgcgcctcatgtgaagctgtcttgacagtactcgaagtgggggactcagaaactgcagaagacgacatttcagatgtccaaggaactcagaggctggagctcagggacgatggcgcattttccactcctacagggggcagtgataccctggtgggcaccagcttagatactccgcctacctctgtaactggtacatcagaggaacaggtgtcttggtgggggagtggccagactgttctcgagcaggaagccgggagcggcggcggaactcggcgcctgccagggtcacctagacaagcccaggctaccggcgcaggtccacgtcatctgggggtggagcccctggtgcgcgccagcagggctaatttagtaggcgcctcgtggggcagtgaagacagcttgtccgtggcttccgacctatatggcagtgcttttagtctgtataggggaagggctcttagcattcacgtatcagtgccacaatccggattgcgacgagaggagcccgacctccaaccacagctggctagtgaagcaccaaggcgccctgcgcaacctcctccaagcaagtctgccttgctcccacccccgtctcccagggttggaaaaagatcaccccctggaccacccgcccaacccgctgccacccctactagtccgcatcgccggacgcaggagccagttctgcctgaggacacgactactgaagagaagagggggaagaagagcaagtctagcggcccctccttggcaggcacggccgagagtaggccccaaacgccgctgagtgaggctagcggacgtctgagcgcactcgggagatctccccggctagtgcgggccggaagccgcattctagacaaattgcagtttttcgaggagcgccgccgaagcctagaacgctctgatagtcctcccgcaccgttaagaccatgggtccctttaagaaaagctcgctcgctggaacagcctaagtctgagcggggagccccatggggaacgccaggggcctctcaggaggagttaagggcccccgggagcgtcgccgaaaggcggcgtctgttccaacagaaggccgctagtttagacgagcggactaggcagcgttcgccagcctcagatcttgagcttcggtttgcacaggagttgggaaggatacggcgtagcacttctagggaggagctcgttcgcagccacgaatctctgcgagccacactgcaaagggccccatcccctcgggaacctggtgagcctcccctcttttcccggccaagtacaccaaaaacctctagggccgtgagtccagcagccgcccagccaccttcccccagcagcgctgaaaagcctggggatgaacctggaaggcctagatctaggggcccagccgggaggaccgaacccggggaaggtccacagcaagaagtacgcaggcgtgatcaattccctcttacaagatctcgggctatccaagagtgtcggagccccgtgccaccccctgcggccgacccgccagaggccaggacaaaagctccgccgggccgcaaacgagaaccaccagctcaggccgtcagattcctcccttgggctactccgggccttgagggcgcggccgtgccccaaaccctggaaaaaaatcgtgcgggacccgaggccgaaaaacggctccgaaggggtcccgaagaagacggaccgtggggaccctgggatagacgcggcgctcgatcccagggaaagggaaggagagcccggccaacaagtcctgagctggaaagttccgacgatagttatgtcagtgccggcgaggagcccctcgaagcccctgtgttcgagattcctctgcagaatgttgtggttgctcctggagccgacgtgctcctaaagtgcatcattacagcgaatccccctccccaggtgagttggcacaaagatggaagtgccttgaggtcagaagggcgactcctcctgcgtgccgagggtgagcggcacaccctgctgttgcgcgaggctcgtgcagcagacgccggcagctacatggcaacagcaacaaacgagctcggacaagcgacctgcgctgccagcctcacagtgcgaccaggcgggagtacctcgccattttcctcccctatcacctctgatgaggaatatctctctcctccagaagagtttccagagccaggcgagacatggcctcggaccccaaccatgaagcccagccccagccaaaatcgtcgtagctcagacaccggttccaaagcccctcccaccttcaaggtgtcactcatggatcagtccgtcagagagggccaagatgtgatcatgtcaattagagtccagggtgaacccaaacctgtggtttcatggctacggaacagacagccagtgaggcctgaccagcggaggtttgccgaagaagcggaggggggactgtgccggctccgaatcctagcagccgagcgcggcgatgcaggtttctatacctgcaaggcagtgaatgagtacggcgctcgacagtgcgaggcgaggttggaggtgagggctcacccagagtctcgatcgctggctgtgctcgcccctttacaggacgtcgacgtcggggccggagaaatggcactgtttgagtgcctggtggccggaccaaccgatgtggaagtggattggctgtgcagggggcgcttacttcaacctgccctgctgaagtgtaaaatgcacttcgacgggaggaaatgcaaactgttgcttacctctgtccatgaagacgattccggcgtgtatacatgcaaattaagcactgctaaggatgagcttacctgcagcgcccgactgaccgtgcggccctctttagcaccactgtttacccgcctcctcgaggatgttgaggtgctcgaaggtcgcgctgccagattcgactgtaagatctccggtaccccgcctccagtggtgacgtggactcatttcggttgcccgatggaagaatctgagaatctaagactgcggcaagatggtgggctacactcattacacatcgcccacgtcggcagcgaagatgaaggactctatgcagttagtgcagtcaacacgcacgggcaggcccactgtagcgcccaactgtacgttgaggagccgcgcacggccgcatcaggcccctcctctaaactggagaagatgccctctatccccgaagagccggagcagggggagcttgaaagactatcaatcccggattttctgagacccctgcaagacctggaggtgggcctggccaaggaggccatgttggagtgccaagttaccggcctgccttatcccaccatctcatggtttcacaacgggcacagaatccagtcgagtgatgatcggcggatgacccaatacagagatgtacatcgcctggtgttccctgctgtcggcccacaacatgccggggtgtataagtcggtgatcgccaacaaactgggaaaggctgcgtgctatgcacacctctatgttacagatgtcgtgcccggcccccctgatggtgctccccaggttgtggccgtgaccggcagaatggtgacactcacatggaaccctcctaggtccttggatatggcgattgaccctgacagcctcacctacaccgtacagcatcaggtgctgggaagcgaccaatggactgccttagttacagggctacgcgagcctggatgggccgccactgggttgagaaagggggtgcagcatatctttagggttttgagtacgacagtcaaatcctccagcaagccctcgcccccaagtgagccggtgcagctgctggaacacggtccaacgctggaggaagctccagccatgttggataagcccgacattgtgtacgtggtcgaagggcagccagcatctgtgacagtgaccttcaaccacgtggaagcacaggtcgtttggcgctcttgcagaggagcgctgttggaggctcgggcgggcgtgtatgaattgagtcagccagatgacgaccagtattgtctgcggatttgcagagtgagtaggcgtgatatgggcgccctgacatgcaccgcccgaaataggcacggcactcagacttgttccgttactctagagctagcagaggctccaaggtttgaatccatcatggaagatgtagaggtaggtgctggcgagactgctagatttgcagtagttgtcgagggcaagccattgcccgatatcatgtggtacaaagatgaggtgctgctgactgagagctcccacgtatctttcgtctacgaagaaaacgagtgtagcctcgtagttctcagtaccggagctcaggacggtggcgtgtacacatgcactgcgcagaacctggcgggagaggtgtcttgcaaggccgaactcgccgtgcattctgctcagaccgcaatggaggtggaaggtgtgggtgaagacgaggaccatcggggtaggcggctctcagatttctacgacatccaccaggagataggccggggcgcattctcctatctcagaagaatcgtggaaaggtcttcaggcctcgagttcgcggccaaatttatcccaagccaagccaaacccaaagcctccgcgagacgggaggcccgactgctcgcccggttgcagcatgattgtgttctgtattttcacgaggccttcgagaggcggagaggcttggtgattgtgaccgagctctgtacagaagaactcctagagcggattgcccgaaagcccactgtatgtgaatctgaaatcagggcatatatgcgccaagtgctcgaggggatacactacctccaccagtcccatgtactccaccttgacgttaagcccgaaaatctactcgtttgggacggcgccgctggagaacaacaggtgcgcatctgtgattttgggaatgctcaggaactgacgccaggtgagcctcagtattgccaatacgggacccccgagtttgtggcacccgaaatcgtgaaccagagccctgtgtcaggggtcaccgacatctggcctgtcggcgtggtggccttcctctgcttaacaggtataagtccatttgtcggcgaaaacgaccggacgacattaatgaacataaggaactataatgtcgcgtttgaggaaaccaccttcctgtctctttctcgcgaggccaggggattcttaatcaaggtgcttgtgcaggatcgtctgaggccgaccgcagaggaaactctggaacacccctggttcaagacccaggctaaaggcgccgaagtctccaccgaccaccttaagttattcttgtcccggcgccggtggcaacgatctcagatttcttacaagtgtcatcttgttctgaggcccattcccgagttgctgcgagcacctcctgagcgcgtgtgggtcaccatgccccgccgcccgccccccagcgggggcctgagtagtagctcagactccgaagaggaggagttggaagaattgccatcagtcccacggcccttacagcccgaattctccggcagtcgggttagtcttactgatatcccgaccgaggatgaggcactgggaactccagaaacaggcgccgccactcccatggattggcaagaacaaggccgcgccccctcacaggaccaagaggcaccgtctccagaagcattacctagccccggccaggagccggctgctggggcctcaccccggcggggagaactaaggcggggttctagcgccgaatcagcactaccgagagctggccctcgcgagctcggtcgaggcttacataaggctgcctctgtggaactgcctcagcgcagaagtccaagcccgggagctaccagattggcccgcggcggcctgggagagggagagtatgcgcagaggctgcaggccctgcgacagcgattactgcgaggaggccctgaggatggaaaggtctctggcctgcgcggcccactcttggagtctcttggagggcgggctagggatcctaggatggctcgcgccgccagctccgaggctgccccccatcaccagccccctctggagaatcgtggcctccagaaatctagcagcttttcacagggcgaggctgaacctcgcgggcgacaccgcagggccggagctcccctcgagattcccgtggcacgactgggtgccaggcggttacaagaatccccgtcactgagtgctctttctgaggcccagccgtctagtcctgccaggccctctgcaccgaaaccctcaacccccaagtccgcagagccgtctgccaccacaccatctgatgccccccagcctcccgcaccacaacccgcccaggacaaagcacctgaacctagacctgagccggtgcgggcgtcaaagcccgctccacctcctcaggctttgcaaactctggctctaccgctgaccccctacgcccagataatacagagccttcagctgtcgggtcatgcccagggcccatctcaggggcccgcagctcctccctccgagccaaagcctcatgctgctgtttttgccagagttgcatcccccccacctggtgctcctgaaaaacgggtcccatcagcgggggggccgcctgtgctcgctgaaaaggcgcgggtgccaacagtgcccccacgacccggatcttctttgtcaagtagtatcgaaaatctcgagtccgaggctgtcttcgaagctaaattcaaacgctcgcgcgagagtcctctgagtctgggcctccgcctcctctctcgctcacggtccgaggaacggggaccttttagaggcgcggaagaggaggatggaatataccgccctagccccgccggaactcccctcgagctggtgcgccgaccggagcggagcagaagcgttcaggatttaagagccgtgggggagccaggcctggttcggcggctgagcctctctctttctcagagacttagacggacccctccagcccagcggcaccctgcctgggaggctcgaggtggtgatggggaatctagtgaaggaggctcctccgctaggggatccccagtgctggctatgcgtagacgccttagctttactttagaacgattgagctccaggctgcagcggtcaggcagctcggaggactccgggggcgccagcggaagaagtacccccctctttgggcgcctgcgacgcgcgactagcgagggagaatctctgagaaggttggggctcccacataaccagctggccgctcaggcaggtgccacgaccccaagtgcagaaagccttggatctgaggcatccgccacgagcgggtccagcgcccctggtgagtcccgatcaagattgaggtggggtttctcaagaccccggaaggataagggactctcccctcccaatctctctgccagcgtccaggaggaacttggccatcagtatgttcggtccgagagtgattttccccctgtttttcatatcaaactcaaggaccaggtgttacttgagggtgaagctgctaccctgctctgtctgccagcagcatgcccagccccgcatattagctggatgaaagacaagaagtctttgcggtcggaacccagtgtgataatcgtcagctgtaaggacggccggcagctgctgtctatcccccgggcaggaaagcggcacgcaggtctttacgagtgctctgcaacaaacgtacttggatcaattacttcaagctgtacagttgccgtagcgcgcgtgccgggcaaactggctcctccagaagtgccacaaacatatcaggatacagccttagtgctgtggaagcccggcgactcaagagcaccttgtacatacacactggagaggcgtgtggatggagaatctgtctggcatcccgtgtccagcggaatccccgattgctactacaatgtgacccaccttccagtgggggtgaccgtgaggtttcgggtggcctgcgccaaccgggcaggccaggggcctttcagcaacagctccgagaaggtgtttgtgcgaggcacacaggactcatccgccgtgcccagtgccgctcaccaggaggctcctgtgacgtcccgacccgctagagcacggcccccggactccccaacatccctagcaccaccactggcccctgccgccccgactccaccttccgtaaccgttagccctagttctccacccaccccaccctcccaggcactgtcttctttgaaggccgtcggccctcctccacagacacccccccgtaggcataggggactccaggccgcaagaccagcagaacccaccctcccgtctacccacgtgactccttctgagccaaagccattcgtcctggatacaggtactccgatacccgcaagcactcctcagggcgtgaaaccagtgtcgtccagtacccccgtgtatgtggtcacatcctttgtttctgctcccccggctcccgaacccccagcacccgagccccccccagagcctaccaaggtgaccgttcagtccctcagccctgctaaggaagtcgtgagctctcccggctcgtcaccacgcagctcaccacggcccgagggtactaccctccgccagggcccaccccaaaagccttacacctttctggaggagaaagccagaggaagattcggggtggtgcgggcttgtcgggaaaacgcaaccggaaggacgttcgtcgcaaaaatcgtcccctatgctgctgagggaaaacggcgtgtcctccaggagtacgaggtgctgcggacccttcaccacgagaggattatgagcttgcacgaggcatacattaccccccgatatctggttcttatcgcagaatcttgcggaaatagggaactcctttgcggactgtctgaccgcttccgttacagcgaggacgacgtagctacatacatggtccagcttctgcagggacttgactatctccacggtcaccacgtgttgcacctcgatatcaagcccgataatttactcttggcaccagataacgcgctgaaaatcgtggattttgggtccgcacagccttataacccgcaggctttacgtccgctgggccaccgcacaggtacgctggaattcatggcaccggagatggtgaaaggagagccaatcggctctgccacagacatctggggcgctggcgtgctcacctacattatgctttccgggcgtagccctttctacgagcctgacccgcaggaaaccgaagctagaatcgtcggtggtcggtttgacgccttccagctgtacccaaatacttctcagagcgctaccctgttcctgaggaaggtgctctctgtgcatccatggctgagtcggccatcttcctgtctcagtgtgtgccataaagagatcaagatggcttcttcctag

SEQ ID NO: 20701 - DNA, 9804 bp, Artificial Sequence
  Description of Artificial Sequence: Synthetic coding sequence
atgcagaaggcccggggcacccggggcgaggacgccggcacccgggcgcccccatcaccgggggtgccacccaagagggcaaaagtgggagcaggtggtggtgcacccgttgcagtcgcaggcgcccccgtctttctgagacccctgaaaaatgcggctgtttgtgcagggtccgacgtgagactgcgggtggtggtgtctggaaccccacagccaagcttgcgctggtttcgagatggccaacttctgcctgctcccgctccagagccaagctgtctgtggttgcgccggtgtggtgcccaagatgctggagtgtactcctgcatggcccagaacgagcgcgggagggccagctgtgaagctgtcctcacagtgctagaagttggcgactcagaaacagcagaggatgacatcagtgacgtgcaggggacccagaggctggagcttagggacgacggcgcattttctacacctacaggcggctcagacacgcttgtggggacatccctggacaccccgcctacctccgtgaccgggacatctgaagagcaggtgagctggtggggctcaggccagaccgtcctggagcaggaagcaggctccggcggcgggacacgcaggctgcctggctcccccagacaggcccaggcaaccggggccggacctcgccacctgggggtggaacctctcgttagagcgtctagggcaaaccttgtcggagcttcatggggctccgaagacagtttatccgtagcgtctgatctgtacggcagcgccttttcactgtatagagggagggcactgagtatccacgtctcagttcctcagtctgggctcaggagggaggagcctgacctccagcctcaattagctagcgaagcgccccggcgccctgcccagccaccacccagtaaatctgccctgttgcctccgccgtctccccgggttggaaagaggtcgccccctggaccacccgcgcaaccagcagctaccccaactagtcctcaccggaggacccaggaacccgttttgccagaggatactacaactgaagagaaacggggtaaaaagagcaaaagttccggcccctcgctcgccggcacagcagagtctagaccacagacgccgctgtccgaggccagtgggcggctgtctgctctcgggagaagcccacgcctggtgcgggccggcagcagaatcttagataagctgcaatttttcgaagagaggcggagatccctggaaagaagcgatagccccccagcgcccttacgaccatgggtccccctgcggaaggctcgctcactggagcagcccaagtcagagcgcggagcaccttggggaactcccggcgcctctcaggaggagctcagggcaccaggcagcgtggccgagcggagaaggctgtttcagcagaaggcagcctcccttgatgagcgcacgcggcagcgctcgcctgcgtccgatcttgagctaagatttgctcaggaacttgggaggattagacgttcaacaagtcgagaagagttggtccgcagccatgagagtttacgggcaaccctgcagagagctccgagtcctcgcgagccaggggagcccccacttttttccagaccctcaacaccaaagacgagcagggcagtctcacctgccgcagcccagcccccctcaccatcttcagccgagaaaccaggtgacgagccgggccgccctagatccagagggccagccggtcggacagaacctggcgaaggaccccagcaggaagtccgcagacgcgaccagttcccattgacacggtctcgagccatacaggaatgtcgaagcccagtgccacccccagccgccgatccccctgaagcccggacaaaagccccccccggcagaaaaagggagccgcccgcccaagcggtcaggttcctcccatgggccacacctggtctcgagggcgccgcggtgccacaaacattagaaaagaaccgggccggacccgaggccgaaaagcgcctccggcgtggacctgaggaggatggaccatggggaccgtgggaccggaggggggctaggtcccagggaaaaggacgcagagccagacctaccagccccgagctggaatcctctgacgacagctacgtttcagcaggcgaggagccccttgaggctcccgtattcgaaattccgctgcaaaacgtcgtagtcgccccaggcgccgatgtccttctgaagtgtattattaccgctaacccccccccccaggtctcttggcacaaggacggatccgccctacgcagtgagggacgactgttgctccgggcagagggagaaagacataccctcttgttgagagaggcccgggctgcagatgcaggttcttacatggcaactgctaccaacgagctcggccaggcgacatgtgccgccagcttaaccgtgcgtccaggaggctcgacttcgcccttctcttcacccattacgtcagacgaggaatatctgtctcctccggaggagtttcctgaacctggggaaacttggcctcgcactcccaccatgaagccttcgccatcacagaaccggcgctcttcagatacaggtagtaaggcccctcccacgtttaaggtctccctcatggatcaaagcgtgcgggagggacaagatgtgatcatgagtatcagggtgcagggtgaaccaaagcccgtggtctcatggctgcggaaccggcagccggtgagacccgaccagcggcgcttcgcggaggaagccgagggcggtttgtgcaggctgcgcattttggccgctgagaggggggatgcgggattctacacctgcaaggccgtgaacgagtacggagcaaggcagtgcgaagcgaggctcgaggtgagagcccatccggaatctaggagcctggctgtgctcgcccccttacaggatgtagatgtcggagccggcgagatggctctctttgaatgtctggtggcaggccctaccgacgttgaagtggactggctgtgtagggggaggctcttacagcctgccctcttaaaatgtaaaatgcatttcgacggcaggaaatgtaaactgttgttgacctcagtacacgaggacgacagtggggtttacacctgcaagctgtcaaccgctaaagatgagctgacctgctcagcccgcctgactgttcgcccgtcgttagcaccgttattcacccggctgcttgaggatgtggaggtgctggagggaagagcagctagattcgactgcaagatcagtggaacaccaccaccagtggtcacgtggactcattttggctgccccatggaagaaagtgagaatctgaggttaagacaggacgggggcttgcacagtctgcatatagcacacgttggcagcgaagacgaagggctttatgccgtctcagccgtaaacacccacggccaggctcattgttccgcccagttatacgtggaggagccacggaccgccgctagcgggcctagtagtaaactcgagaagatgccttccattccagaggaacctgaacagggcgagctggaacgtctcagcattccagatttcctgcgaccgctgcaggacttggaagtaggcctcgccaaagaggctatgctagagtgccaggtcacgggcctcccatatccaaccatttcatggtttcataatggccaccgcatacagagctccgatgaccgccgcatgacccagtatagggacgtgcacaggttggttttccctgcagtgggaccacagcatgcaggagtttacaagtcggttatcgccaacaagctcgggaaggcggcatgttatgcccatctctacgtcacagatgtggttccagggcctccagatggcgcccctcaggtcgtggcagttacgggacgcatggtcaccctaacatggaaccccccgcggagcctggatatggctattgaccctgactctctgacatacactgtacaacatcaagttctcggctcagaccagtggacagccctggttaccggcctgcgggagcctggttgggccgctactggtcttaggaagggtgtccaacatatttttcgagtattatctaccacggttaagtcctcttctaaacccagcccaccgtctgagcctgtgcagttgttggagcacgggcctactctggaggaggcacccgcaatgctggacaagcctgatatcgtatacgtggtggagggacagccggcctccgtgaccgtcaccttcaatcatgtggaagcacaggtggtttggcgctcatgtcggggcgccctgcttgaggcaagagcaggagtttacgagctgtcgcaaccagacgacgatcaatactgcctccggatctgtcgggtttcacggagggacatgggcgccctgacatgcacggctcgaaatcgccatggaacccagacttgcagtgttactcttgagttggccgaagcccctcgttttgagtccataatggaggatgtggaggttggggctggcgagacagccaggtttgccgtggtggtggagggcaaaccgctgcctgatattatgtggtataaagacgaggtgctcctcactgaatccagtcacgtgtcatttgtgtatgaggaaaatgagtgctcccttgtggtactcagcaccggagcccaggacggcggagtgtatacctgcacagcccaaaacttagccggcgaggtgtcatgtaaggccgagttggctgtgcattctgcacagaccgccatggaagtcgaaggcgtcggagaagacgaggatcatagaggcaggcgtctgtccgacttttatgatatacatcaggagataggtaggggcgcttttagctatttgcggaggattgtcgaaagaagctctggattggagttcgccgccaagtttatccccagccaggcaaagccaaaggcgtccgcccggcgagaggccaggttgctggctagactccagcacgattgtgtgttgtactttcatgaggcgtttgaacgcaggcgagggctggtgatagtcactgagttgtgcactgaggagctgcttgagcgcatagcacggaagcccaccgtctgtgagtcagagatccgcgcctacatgcgccaggtgttagagggtattcactacctccaccagagtcatgtgctgcacctagatgtaaagcctgaaaatctactggtatgggatggcgcggcaggggagcaacaggtgagaatatgtgatttcggaaatgcccaggaactgacaccaggagagcctcagtactgtcagtacggtacacccgagttcgtggcacccgagatcgtcaaccagtcgcccgtgtccggcgtgaccgacatctggcctgtgggcgtcgtagccttcttgtgcttaaccggtatatctccgttcgtaggcgagaatgatcggactacactcatgaatatccgcaactacaacgtcgccttcgaagaaaccacttttctgagtctgagcagagaggcaagaggatttctgatcaaagtgctggtccaggacagactgagaccaaccgcagaagaaactcttgagcacccatggttcaagacccaggcaaaaggggctgaggtctctacggaccatctgaaactttttcttagccgtcgcagatggcagagaagtcaaatcagctataagtgccacctggtgcttcggcccatccctgagctgctgagggccccacctgagcgcgtttgggtgacgatgccgcgacgaccaccgcctagcggaggactgagctcttccagtgacagcgaggaggaagaacttgaggagttgccaagcgtgcctagacccttgcagcctgaattttcgggatcccgggtctcgttgacagatataccgactgaggatgaggcgttaggaactccagagaccggagccgcaacccctatggattggcaagaacagggaagagccccttcacaagatcaagaagcgccgtctcccgaagccttaccaagcccagggcaggaacccgccgctggcgcatcaccacgacgtggagaactccgcagggggtcgtctgcagagagtgccctgcctcgggctggaccacgggagctcggtcgcgggctgcacaaggctgcgagtgtggagcttccccagcgtcggtcaccctcaccaggggccacacggttggcccgcggaggcctcggagaaggcgagtatgcccaacgactgcaggctctgaggcagcggctgctgcgcgggggtccggaggacggcaaggtgagtgggctgcgggggccattactggagagtctcggcggcagagcacgggatcctcgcatggcacgtgccgcgagcagcgaagcagcacctcaccatcagcctcccttggaaaatcgtggtcttcagaaatcttcctcgttttctcagggggaggccgagcctagaggccgtcatcgacgtgcaggagcccccctggaaatcccggtcgcccggttgggagccaggagacttcaagaaagtccatccctgagtgccttatccgaggcccagccgtccagccctgccagaccctctgctcccaagccctctactcccaagagtgccgagccttcagcaacaactccttccgacgcgccacagcctcctgcaccccaaccagctcaggacaaggcaccagaacccaggcccgaacctgtgcgggcctcaaaacccgccccacctccacaggctctgcagacactcgcactgcccttgaccccctatgcccaaattattcaaagcctccaacttagcggtcatgctcaggggccttcccagggtcctgcggcacctccaagtgagccaaagccacacgccgccgtgtttgccagggttgcttcaccccctccaggcgcacccgagaagagagtgccctcagccggcggacctcctgtgctggcagaaaaagcgcgggttccaaccgtgccccccagaccaggaagtagtctttctagtagtatagagaatctcgagagtgaggccgtatttgaggccaagttcaaacgctctcgcgaatcacccctcagtctggggcttcggctactgtccagaagccggtctgaggagaggggcccttttaggggagctgaggaagaggatggaatctaccgaccatctcctgctggcacacctctcgagcttgttaggcggcccgagaggtcacggtctgttcaggacctgcgagccgtgggcgagccagggctcgtcaggcgtttatccctcagtctaagtcagcgcttgaggcgaacccccccagctcagagacacccagcctgggaggcgagagggggtgacggtgaaagctcagagggtggttcgtccgcacgaggcagtcctgttctggcaatgagaagacggctatctttcacactagaacgcctcagcagtcgtctacagcgctctggctcatccgaggacagcgggggcgcttctggccgatcaacgcctcttttcggccgattaaggcgcgccactagtgaaggcgagagccttagacgactcggtttgcctcacaatcagctggccgcccaagccggtgccacaaccccttcagctgagtcccttggctccgaggcttccgctacatccggctcctcagctcccggggagtcacggagtcgcctccgatggggcttcagcaggccgcgaaaagacaagggactgtccccccctaatctaagcgcctccgtgcaggaagagctgggtcaccagtacgtaaggtctgagtccgacttcccacccgtgttccatataaaacttaaggaccaggtactgctcgagggagaggctgctactctgctgtgcctgccagcagcctgtcccgctccgcacataagttggatgaaggacaaaaaatccctgaggtcggaaccctccgtaatcatcgttagctgcaaggacggtcgacaattactgagcattccgagagctgggaaacgccacgccggactgtacgagtgcagtgcgactaacgtcttggggtctatcaccagcagctgcaccgtggcggtagcaagggtgcctggtaaattagcccctccagaggttcctcagacatatcaggacaccgctctggtactatggaaacctggagatagcagggcgccatgcacctatacacttgaacgccgcgttgatggcgagagcgtatggcaccccgtttcaagcgggattcctgattgctattacaatgtgacccacctgcctgtaggcgtcaccgttagatttcgcgtcgcttgcgccaaccgggcaggccaaggcccattttccaactcctcggaaaaggtcttcgtaaggggcacccaggacagctctgctgtgccatcagcagcccatcaagaagctccagtcacgagtcgccctgctcgagctagaccacccgattcccccacgtccctggcgcctcctctcgccccagcggctccaacccccccatcagtcaccgttagtcccagtagccctccaacccctcccagccaggcactaagttctcttaaagcggtcggacctccgccccagacccctcctaggcgtcaccggggcttgcaggcggcccgtcccgcagagcccacactgccttctacacacgtcacgccgtcggaacccaagccttttgtcttggacaccggcactcccattcccgccagcactccgcaaggcgtgaaacctgtgagtagtagcactcctgtgtatgtggttacttcattcgtgtcggcaccacccgctccagaacctcctgcacctgagccacctcctgagcccaccaaggtgacagtccaaagccttagtcccgccaaagaagtcgtgagctcacctgggagctcaccgagatcctctcctaggcccgaaggaaccacccttagacaagggccaccgcagaagccgtataccttcttggaggagaaagcccgggggaggttcggagtggtgagagcatgccgcgagaacgcaacaggtcgcactttcgtggccaagattgttccgtatgccgcagaaggcaaacggcgggtccttcaagagtacgaggtgctccgcacactccaccatgagaggattatgtccctgcatgaggcttacattacccctcggtatcttgtccttattgctgagtcctgcggcaatagagagctcttgtgcgggctgtccgatcgcttccgctattctgaagacgatgttgctacctacatggtgcagctcctgcaaggcctggactatctgcacggacaccacgtgctgcatctggatattaaacccgacaatctactgctggccccagataatgctttaaagattgtcgactttggaagcgcccaaccttacaacccacaggctttgcgcccactgggccatcgcactggcaccctcgagtttatggcaccagagatggtgaaaggggaacctattggctctgccactgatatctggggggccggagtcttaacctacattatgttatcgggacggtcacccttctatgagcccgaccctcaggaaacagaagcgcggattgtcggcgggcgcttcgacgcttttcagctgtatcccaacacttcccaaagtgcaacattgttcctgcgcaaggtactttcggttcatccatggagcagaccatccctgcaggactgcctagcgcacccctggcttcaagacgcttatctcatgaaactgagaaggcagactctcacatttacaacaaacaggctcaaggaatttttgggggaacagcgccggcgacgcgcagaggcggctacacgccacaaggtacttctgcggtcttaccccggagggccctag

SEQ ID NO: 20702 - DNA, 342 bp, Artificial Sequence
  Description of Artificial Sequence: Synthetic coding sequence
atgaagcccagccccagccagaaccggcggagcagcgacaccggcagcaaggctccgccaacattcaaagtttctctaatggatcagtcagtccgggagggtcaggatgtgataatgtccattagggtgcaaggcgaaccgaaacccgttgtgagctggctccggaacaggcagcctgtccgtccagatcagcgtcggttcgccgaagaagctgagggcgggctttgccgactgagaattcttgccgcggagcgaggcgatgctggattttatacatgcaaagccgtgaacgaatacggggcccgccagtgcgaggcccgcctggaagtccggggtgaatag

SEQ ID NO: 20703 - DNA, 342 bp, Artificial Sequence
  Description of Artificial Sequence: Synthetic coding sequence
atgaagcccagccccagccagaaccggcggagcagcgacaccggcagtaaggcgccccccacgttcaaggtctcgttgatggatcagtctgtgcgagagggccaggacgttataatgagcatcagagttcaaggcgaacctaaaccagtggtcagctggctcaggaatcgccagcctgtgaggccagaccagcgcagatttgcagaggaggcggaggggggcttgtgcaggctgagaatcctggccgctgagcgaggcgatgcagggttttacacatgtaaagccgttaacgagtatggtgcccggcagtgtgaggcccggctggaggtgcgcggcgaatag

SEQ ID NO: 20704 - DNA, 342 bp, Artificial Sequence
  Description of Artificial Sequence: Synthetic coding sequence
atgaagcccagccccagccagaaccggcggagcagcgacaccggcagtaaagctccccccacatttaaagtgagcttgatggaccagtctgtcagagaaggccaggatgtcatcatgtcaatcagagtccagggcgaaccgaagccagtcgtgtcatggctacgaaatcgccagcccgtcaggcccgaccagcgcaggttcgccgaagaggctgaaggaggtctatgtcggttgagaatcctggctgcagagcgaggggacgcaggcttctacacctgtaaggctgtgaatgagtacggagccagacagtgcgaagctagactggaagtccgaggtgagtag

SEQ ID NO: 20705 - DNA, 513 bp, Artificial Sequence
  Description of Artificial Sequence: Synthetic coding sequence
atggccaccgccaccaacgagctgggccaggccacctgcgccgcctccctgaccgttagacccgggggtagtacgagcccattctcctcccccattacctccgacgaagagtatctgagccccccagaggagtttcctgagccaggcgagacttggccgcggactccaacaatgaaaccaagcccctcccagaaccgtagatcttccgacaccgggtctaaggccccgcctacgttcaaggtttccctgatggaccagagcgtgagagagggccaggacgtgattatgtctatacgggtccagggtgagcccaagcccgtagtcagctggctgcgcaaccgtcagcccgtgcgaccagatcaacggagattcgctgaggaagcggagggagggctgtgcaggcttcggatactggcagccgaacgaggtgacgctggtttctacacttgtaaggcagttaatgagtacggagctaggcaatgcgaggccaggcttgaggtaaggggtgagtag

SEQ ID NO: 20706 - DNA, 1038 bp, Artificial Sequence
  Description of Artificial Sequence: Synthetic coding sequence
atgatcagccccgtgctgatcctgttcagcagcttcctgtgccacgtggctatcgcaggtagaacgtgccctaagcctgacgatctgcctttcagcaccgtcgtgccgttgaaaacattctatgaacctggagaggaaattacttatagttgtaaaccaggctatgtgagccgtggcgggatgcgtaagttcatctgtcctctgacaggcctgtggccaattaataccctgaagtgcactcccagggtctgtccttttgccggtatcctagaaaacggtgcagtgcggtataccacatttgagtatcccaataccatcagcttttcctgcaatactggcttttatctcaacggggcggactccgcaaagtgcacagaggaggggaaatggtccccggaactcccagtctgcgctccgatcatttgcccacccccatccatacctacatttgccacacttagagtttacaagccctctgccggcaacaacagtctgtacagagatactgcagttttcgagtgcttaccacagcatgctatgtttgggaacgataccatcacctgcacgacccatggcaactggactaaactgcctgagtgtcgggaagtaaaatgtccttttccgtcaagaccagacaacggtttcgtgaattacccggccaagccaacactgtactataaggacaaagccactttcggctgccacgacggttacagtctggacgggcctgaagagattgaatgtactaagctggggaattggtcggccatgccaagctgtaaggccagttgcaaagttccagtgaagaaagccacagtcgtttaccagggagaacgcgtcaagatccaggaaaaattcaagaacggcatgctccacggagataaagtgtctttcttctgcaaaaataaagagaagaagtgctcctacactgaggacgcccaatgcattgatggtaccattgaggttcccaagtgcttcaaagaacattcgtcattggccttctggaaaaccgacgcgtccgatgtaaagccctgctag

SEQ ID NO: 20707 - DNA, 1278 bp, Artificial Sequence
  Description of Artificial Sequence: Synthetic coding sequence
atggccagcagcatcatctgccaggagcactgccagatcagcggccaggccaaaatcgatatcctgctcgtgggcgacgtgacagtgggctacctggccgacaccgtgcagaagctattcgcaaacatcgctgaggtaacaattaccatttccgacaccaaagaggctgcagctctgctggacgactgcatattcaacatggtgctgttgaaggtgccaagtagcctatcggcggaggagctggaagctattaagcttattcgatttgggaagaaaaaaaacacccactccctcttcgtctttataatccccgagaattttaaaggctgcatttctggacatggcatggacattgccctgaccgaaccgttgactatggaaaagatgtccaatgtagtgaaatattggacaacttgccccagcaatacagtgaagactgaaaacgcgaccgggccggaggagctgggtctcccactgcagaggtcctatagtgagcatttagggtatttccctaccgatcttttcgcctgctccgagtctctgcgcaatggcaatgggctagaactcaacgcctccttgagcgaatttgaaaagaacaaaaagatctctttactgcatagctccaaggagaagctccggcgcgagaggatcaagtactgttgtgagcagctgaggacccttctgccctatgtgaaaggtcgaaagaacgatgcagccagcgtgctggaggccactgttgactacgtgaaatatataagggaaaaaattagccccgctgtgatggctcaaatcacggaagccttgcagagcaatatgaggttttgcaagaaacagcagacaccaattgaactctctctccctgggacggtgatggcacagcgagagaattcagtcatgtccacatactccccagaacgcggtttgcagttcctcaccaacacttgctggaatgggtgctccaccccagacgctgagagtagtctggatgaggccgtacgagtgcctagctcttcagcttcagagaatgccattggcgatccatacaaaactcatattagcagtgcagccctcagcctgaacagtttgcatacagtgaggtattactctaaggtgacaccgagctatgacgctacggccgtgactaaccagaatatcagtatacacctgcccagcgcaatgcccccagtgtcaaagctgctccctcggcactgtacctcaggacttgggcagacttgcaccacccatcccaactgtttgcaacagttttgggcatattag

SEQ ID NO: 20708 - DNA, 1509 bp, Artificial Sequence
  Description of Artificial Sequence: Synthetic coding sequence
atggagaccctgcaggagagcctgaacaccctgctgaagcagctggaggaggaaaaaaagaccctagagagccaggttaaatattatgctctaaaattagagcaggagtccaaggcgtaccaaaagattaacaacgagcggaggacatatctcgcagagatgagccagggcagcggactccaccaggtaagtaaaaggcagcaggtcgatcagctccctagaatgcaagagaatctggtgaaaactctcctgctgaaggaggagcttgacccattgaaagctaagatagatatattgttggtgggcgatgttaccgtgggctatctggcagatacggtccagaaacttttcgctaacatcgcagaggtcaccattaccatttctgacactaaggaagccgccgccttactggatgactgtatctttaacatggtactccttaaggtgccttcgagccttagcgcggaggaactggaggccataaagctgatcaggttcggaaaaaaaaaaaatacacatagcctctttgtgttcattatacccgagaactttaaaggttgtatctccgggcacggcatggacatcgccttaacggaacctttgactatggagaagatgtcaaatgttgtgaaatactggaccacctgtccaagcaataccgttaagacagaaaacgccactggccccgaagagttaggactgcctcttcagcgatcatattcagagcatctgggctattttccgactgacctgttcgcatgttccgagtctctccgcaatgggaacggattggaattaaacgctagcttatccgaattcgagaaaaacaagaaaatcagtctcctgcatagctcgaaagagaaattacggcgtgagcgtatcaagtattgctgcgaacaactcaggacactgctgccatacgttaagggccggaaaaacgatgctgcctcagtactggaagcaaccgtggactacgtcaagtacatacgagaaaagatctcaccggctgttatggcccaaatcaccgaggccttacagtccaatatgcgcttctgcaagaagcagcaaactcctatcgagttgtccctgcctggaacagtgatggcccagagggagaattcagtaatgagcacctatagcccagagagaggactgcaattcctcaccaatacctgttggaacgggtgctccacaccagatgcagagagctcactggacgaggccgtaagggttcccagtagttccgccagtgagaatgctattggcgacccctacaagactcacatctccagcgctgccctatcccttaacagtctccacacagttcggtactattccaaggtgaccccttcttacgatgctacagcagtcacaaaccaaaacatatcaatccacctgccatctgctatgccccctgtgtctaaattactcccacgccattgtaccagcgggctcggacaaacttgtactacacatcccaattgcttgcagcagttctgggcatactag

SEQ ID NO: 20709 - DNA, 777 bp, Artificial Sequence
  Description of Artificial Sequence: Synthetic coding sequence
atgaagacccccaacgcccaggaggccgagggccagcagacccgggctgcagccgggcgtgccaccgggagtgccaacatgaccaaaaaaaaggtgtcccaaaaaaagcagcgcgggaggccttcttctcaaccacgccggaatattgtgggttgtaggatctcccacggttggaaggaaggtgacgaaccaattacacagtggaaaggaacggttctcgaccaggtacccataaatccttctctgtacttagtgaagtatgacgggatagattgcgtatacgggctggagctgcacagggatgagcgcgttttatccctgaaaattttgtccgatcgtgtcgcttcatcgcatatcagtgacgccaatctggccaacactattatcggcaaagcggtggagcacatgttcgagggggaacatggttcgaaagacgagtggagggggatggttttagcccaagccccaatcatgaaggcatggttctacattacttatgaaaaggatcccgtgctgtacatgtatcagttgttagatgactacaaagaaggtgatctccgtatcatgcccgagtcatccgaatctccaccaaccgaaagagagcctggaggcgtcgtcgacggcctcatcggtaaacacgtagagtacaccaaagaggatggcagcaagagaattggaatggtgattcaccaggtcgaggctaaaccctcagtgtactttattaagttcgatgatgactttcacatctacgtatatgatctggtgaaaaagtcttag

SEQ ID NO: 20710 - DNA, 777 bp, Artificial Sequence
  Description of Artificial Sequence: Synthetic coding sequence
atgaagacccccaacgcccaggaggccgagggccagcagacccgggccgccgccggacgcgctacaggatctgcaaacatgaccaaaaagaaagtgagccagaaaaaacagagagggcgccccagttctcagcctaggcgcaatatcgttggctgtagaatctcccatggttggaaggaaggagatgagccaattacccaatggaaaggcaccgtgctggatcaggtacccataaacccatctctgtatcttgttaaatacgacggaattgattgcgtgtatggcctggaactgcatcgggatgagagagttctctcactgaagatcctgtctgacagggtggccagctctcacataagcgatgccaacctggccaacaccatcatcggcaaggccgtggaacatatgttcgagggcgagcatggatccaaagatgagtggcgaggcatggtcctggcacaggcacccatcatgaaagcttggttctacatcacatacgagaaggaccccgtcctgtacatgtaccagctcctggatgattataaagagggggacctgcgaattatgcctgaaagctcagaaagccctcctacagagagggagcccggaggtgtcgtcgatggcctcatcggaaagcacgtggagtacactaaggaggacggctcaaagcgtattggcatggtgatacatcaggtggaagcaaagccttctgtgtacttcattaagttcgacgacgactttcacatctacgtctatgacctggttaagaaaagctag

SEQ ID NO: 20711 - DNA, 474 bp, Artificial Sequence
  Description of Artificial Sequence: Synthetic coding sequence
atgaagacccccaacgcccaggaggccgagggccagcagacccgggcggctgcagggcgggcaaccggcagcgctaatatgaccaaaaagaaggtaagccaaaaaaagcaaagaggcagaccaagtagccaacctcgaaggaacatcgtggggtgcagaatatcccacggctggaaggaaggcgatgaacctataacacagtggaagggaactgtgctagatcaattactagatgattacaaagaaggtgacctcagaattatgcctgaaagctccgaaagtccacctacagagagagaacccggaggcgtggtcgatgggctcatcggaaagcatgtcgagtataccaaggaagatggcagcaagagaatcggcatggttatccatcaagtggaggctaaaccgagcgtctattttatcaagttcgacgatgacttccacatttatgtgtacgacctagtgaaaaagtcatag

SEQ ID NO: 20712 - DNA, 777 bp, Artificial Sequence
  Description of Artificial Sequence: Synthetic coding sequence
atgaagacccccaacgcccaggaggccgagggccagcagacccgggcggctgctggccgggccacagggagcgccaacatgactaagaaaaaggtgagccagaagaaacagagaggccgacccagctcccaaccgcgcagaaacatagttgggtgccgtatctcccatgggtggaaggagggggacgagcccatcactcaatggaaaggcactgtccttgatcaagtgcctatcaacccctccttgtatcttgtcaaatatgatggcatcgattgcgtgtacggactagaattacatagggacgaaagagtgctcagtctcaaaattttgtcagatcgcgtggcgtctagtcacatttctgacgctaatctcgctaatactatcattggaaaagccgtggagcatatgttcgagggagagcacggctctaaagacgaatggcggggcatggtcctggcccaggcaccgattatgaaggcctggttttatattacttacgagaaggatccagtgctttacatgtaccagttattagacgactacaaggagggtgatctgagaataatgcccgagtcttctgagtcaccacccactgagagagagccaggaggggtggtggacggccttatcggtaagcacgtggagtacacgaaagaggatgggtctaaacgaattgggatggttatccatcaagttgaagctaagcccagcgtatatttcatcaaattcgatgacgacttccatatctatgtgtacgatctggtgaagaagagctag

SEQ ID NO: 20713 - DNA, 744 bp, Artificial Sequence
  Description of Artificial Sequence: Synthetic coding sequence
atgaagacccccaacgcccaggaggccgagggccagcagacccgggccgccgcagggagagctaccggaagcgctaacatgacaaagaagaaggtgtctcagaagaaacagagaggacgtccttcctcgcagcctcgcagaaatattgtgggatgccgcatttctcacggctggaaggaaggagacgaacccatcacgcagtggaaaggaacagtgctcgatcaggtccctatcaatcctagcctgtacctggttaagtacgatggcattgattgcgtgtacggtctagaactccacagggatgagcgggttctatctcttaagatactatcagaccgggtggcgtcatcacacattagcgatgcgaatctggcgaatactataattgggaaagccgtagagcatatgtttgagggtgaacacggttctaaggacgaatggcgcggcatggtcctcgcccaggcacctataatgaaggcgtggttttacattacttatgaaaaagacccagtgctttatatgtatcagctgctcgacgactacaaggagggagacttaagaatcatgccagagagctcggagagtcccccaacagaacgcgaacccggtggggtggtggacggtctgattggtaagcacgtcgaatacaccaaggaggacggctcaaagcgcattggtatggtgattcaccaggttgaggccaagccatctgtgtatttcattaaattcgatgatgatttttag

SEQ ID NO: 20714 - DNA, 1506 bp, Artificial Sequence
  Description of Artificial Sequence: Synthetic coding sequence
atggagaccatcctggagcagcagcggcggtaccacgaggagaaggaaagacttatggacgtaatggcaaaagaaatgctcaccaagaaatcaactctaagagatcagattaatagtgatcaccggaccagggcaatgcaagacagatacatggaagtctccgggaatcttcgagacctgtacgatgataaggacgggctgcgaaaagaagaactcaatgccattagtggcccgaacgaattcgccgaattttataacaggctcaagcagatcaaggaattccatcgaaagcaccccaacgaaatatgtgtgccgatgagtgtggagtttgaggagctgctaaaggctcgagaaaacccatccgaagaagcgcagaatcttgtcgaattcacagacgaggaagggtacggaaggtacctggatttgcacgattgttacctgaagtacatcaacctgaaggctagtgagaaattagattatatcacctatctatcaatctttgatcagctgtttgacattcccaaagaaagaaagaacgctgagtacaagagatacttagaaatgctactcgagtaccttcaggactatacagaccgggtgaaacctcttcaggaccagaatgagctgtttggcaagattcaggctgaattcgaaaaaaaatgggaaaacggcacttttcccggctggccaaaggaaacatcttctgccctgacacacgccggtgcccatctggacctcagtgcctttagcagctgggaggaactggcatccttaggcctggatcgactaaagagcgctctgttggctctcggattgaagtgcggaggaacattggaagagcgggctcagcgactgttcagcaccaaaggcaagtctctcgagagcctggatacctccttgttcgccaaaaacccaaaatcaaaagggacaaaaagagacactgaaagaaacaaggatatagcattcctggaagcacagatctacgaatatgtcgaaatattaggcgaacagcgacatttaacgcacgaaaacgtccaacgtaagcaggcccgaactggagaggagcgggaggaggaggaggaagagcagatttcagaatcagaatctgaggatgaagagaacgagatcatttataatccgaaaaatctcccactcggatgggacggcaagccaataccgtattggctctacaaactccacggactaaacataaattataattgcgaaatctgcggaaattacacataccgcggcccaaaggcgtttcaacggcactttgctgagtggcgccatgcccacggaatgcgatgcttaggaatacccaataccgctcacttcgcgaacgtgacacagattgaggacgccgtcagtctctgggccaagttgaagctgcagaaagcctccgaacgatggcagcctgatactgaggaggaatacgaagactcttctgggaatgtagtaaacaaaaagacatatgaggacctaaaaaggcagggattgctttag

SEQ ID NO: 20715 - DNA, 1347 bp, Artificial Sequence
  Description of Artificial Sequence: Synthetic coding sequence
atggagaccatcctggagcagcagcggcggtaccacgaggagaaggaaagactcatggatgttatggcaaaagaaatgttgacaaaaaaaagcacactgagggaccagatcaactctgaccaccggacgcgcgctatgcaagacatatgtgtcccgatgtccgtcgagttcgaggagcttctgaaggctagggagaacccctctgaggaagcacagaatttagtcgaattcactgacgaagagggctacgggcgatatctggacctacatgactgctatctgaaatatataaatcttaaggcgtccgagaagctggactatattacctacctgagcatcttcgatcaactgttcgatattccaaaggagcggaagaacgctgagtacaagaggtacttagagatgctgctggagtacttacaggattacaccgatcgggtgaaacctctccaagatcagaacgaactgtttggcaagattcaagcagaatttgaaaaaaagtgggaaaacggaacattcccaggctggcctaaagagacttcatccgccctgacacacgctggcgcacatctcgatctgagcgcattcagttcatgggaggagctagcctctcttggactcgatcgacttaagtccgccttgttggccttaggtctcaagtgcggcgggacacttgaggaaagggcccagagattgtttagcaccaagggaaagagcctcgaaagcttagacacgtcgctgttcgccaaaaatcctaagtccaagggcacaaaaagagacactgagcgcaataaggacattgcttttctcgaggcacaaatctacgaatatgtcgagatccttggggagcagcgccacctgactcatgagaacgtgcagaggaaacaggctaggactggtgaagagagggaagaagaagaagaagagcagatctcggaaagcgagagcgaagacgaggagaacgagatcatctataatcccaagaacctgcccttgggctgggatggtaaacctattccctactggctgtacaaactccatggcctgaacataaactataactgtgagatatgcggaaactacacttatcgaggccccaaggccttccagcgtcactttgctgagtggcgccatgcccatggaatgcgctgcttaggtatcccgaatacggcccattttgcgaatgtcactcaaatcgaggatgccgtttctctttgggccaagctcaagctgcagaaggccagtgaaaggtggcagcctgacactgaggaggagtatgaggactctagcgggaacgttgttaataaaaagacatatgaggatctgaagagacagggtctcctctag

SEQ ID NO: 20716 - DNA, 261 bp, Artificial Sequence
  Description of Artificial Sequence: Synthetic coding sequence
atgaccgaccggtacaccatccacagccagctggagcacctgcagtccaaatatatcggaaccgggcacgccgataccacaaaatgggaatggcttgtcaaccagcatcgtgatagttattgctcttatatgggccacttcgatcttttgaattactttgcgatcgctgagaatgagagcaaagcccgagtgaggtttaatctgatggaaaagatgttacagccctgcggaccaccagcagacaagccagaggaaaactag

SEQ ID NO: 20717 - DNA, 3012 bp, Artificial Sequence
  Description of Artificial Sequence: Synthetic coding sequence
atgtacggcgccagcggcggccgggccaagcccgagcggaagagcggggctaaggaggaagctggtccagggggagccggtggcgggggctctcgcgtagagctcctggttttcgggtatgcttgcaagctgttccgggatgacgaacgggcactggcgcaggagcaagggcagcacctcattccatggatgggcgatcacaagatcctgatagatcgctatgatggtaggggtcacctccacgatttatcggaatacgatgctgagtattctacgtggaatcgcgactatcagctgagtgaagaggaagcccgcatcgaggcactgtgcgacgaggagagatatttagccctacacaccgatcttctcgaagaggaggccagacaggaggaagagtacaaaaggctttctgaggcactggccgaagacggtagttacaatgcagtcggctttacctacggatccgactattatgatcccagtgagcctacagaagaagaggagccaagcaagcagcgggagaaaaatgaagcagagaatctggaggagaacgaggaaccattcgtcgctcctctcggcctcagcgtgccaagcgacgtggagctgcctcctactgccaaaatgcacgccattatagaaaggactgcgagcttcgtctgccgccagggggctcagttcgaaatcatgctaaaggccaagcaggcgagaaacagccagtttgattttttacgatttgatcattatttgaacccgtattataaattcattcagaaggcgatgaaagagggacgctacaccgtcctggccgaaaacaagagtgacgaaaaaaaaaagtcaggcgtgagttcagataatgaggacgacgacgatgaggaggatggtaattacctgcatcctagcttgttcgcctctaagaaatgtaacagactggaggagctgatgaagccgctaaaggtggtagatcccgaccacccattggcggccctcgttagaaaggcccaggcagattcctccacgcctaccccacataacgccgacggagccccagttcagcccagtcaggtggagtatactgccgactcgaccgtagcagcgatgtattactcttactatatgctgcccgatgggacttactgtctcgctccccctccaccagggatcgatgtcaccacgtactactcgactttgccagctggagtgaccgtgtctaattccccgggggttactaccacggctccccctcctcccggtacgaccccacttcctccccccacaacggcggagacaagtagcggagccacttcaacgacaaccaccactagcgcactggcacctgtagccgcgatcataccacccccacccgatgttcagcctgtcatcgataagttggctgaatacgtggcacgaaacggcctgaaattcgagacctctgtgcgggccaagaacgatcaacgttttgagtttctccagccatggcatcagtacaacgcatactacgagttcaaaaaacagttttttctgcagaaagaaggcggcgattctatgcaggccgtatccgctccagaagaagcacctaccgattctgccccagagaaaccctcagatgccggggaagatggcgcgccagaggatgctgctgaggtcggtgcaagagccggttcgggaggtaagaaggaggcttcatcctcgaagacagttccggacggcaagctcgtgaaggcctcttttgctcccataagcttcgcaatcaaagcaaaggagaatgacttgctgccattagagaaaaaccgcgtgaagctggacgatgattcggatgatgacgaagagtccaaagagggccaggaatcctctagcagcgcagccaacacaaatcccgctgtcgcacctccctgcgtggtggtagaggaaaagaagccccagttgacacaggaagagctagaggcgaaacaggctaaacagaaactagaggacaggttggctgcagctgcccgagagaagctggctcaggcatccaaggagagcaaagagaagcagctccaggccgagcgcaaacgaaaagctgcactttttcttcagacgctgaaaaaccccctgccagaagcagaggctggcaaaatcgaggaatcgcctttttcagttgaagaaagctcgaccactccttgtccactgcttactggcggacgacctttaccaactcttgaagtgaaacccccggatcgcccatccagtaaatcgaaagaccctccccgggaggaagaaaaggagaaaaaaaagaaaaagcataaaaagcgatctcgcaccaggtctcggagtcccaaatatcacagctccagtaagtctagatctcgaagccattcaaaggccaagcattcactcccatccgcttatagaaccgtcagaagaagcagagtcactgcttctcccggaacgctgagagcagagccgtgtcaatcctccgccagcgtgaccgcggctgctgagcctgggtcctatcaagccgctagcactacaaccaggtttgatagcgcctccagtttcgaggggaagcccgggaaaacatctaggagtaggtcccggtcccctcgtagacgggctcacagccccgagagacggagagaggagcgctccgttcctactgcataccgcgtgagcagatccccgggtgcgtccagaaaaagaacacggagccgttcaccccacgaaaaaaagaaaaaaagaaggtccaggtcaaggactaagtcaaaagcacgatcccagagtgtgtccccctctaaacaggccgcaccaagacccgccgccccagccgcccacagcgcacactccgcaagcgttagcccagtggagtccagaggctcttctcaggagcgatcgaggggtgtgagtcaagaaaaagaggcccagatttcctcagctatagtgagttccgttcaatcaaaaattacacaggatctgatggccaaggtgcgggccatgctggccgccagcaagaacctgcagacaagcgcctcatag

SEQ ID NO: 20718 - DNA, 2856 bp, Artificial Sequence
  Description of Artificial Sequence: Synthetic coding sequence
atgtacggcgccagcggcggccgggccaagcccgagcggaagagcggtgccaaggaagaggccgggcctggtggggccgggggcggcggcagtcgcgtggaactgttggttttcggctacgcctgcaagctgtttcgggatgatgagcgcgcattggctcaggaacaaggtcagcatctgatcccttggatgggcgaccacaagatactgatcgatagatacgatggacgcggccacctccacgatctgtccgaatatgatgctgaatacagcacctggaacagagactaccagctgtctgaagaggaggcaaggatcgaagcactctgcgacgaggaaagatacctggccttacatactgaccttcttgaagaggaggccaggcaagaagaagaatacaaaaggctgtcggaagcactggctgaagatggatcctacaatgctgtcgggtttacatatggcagcgattactacgaccccagcgaaccaacagaagaggaagagccttccaagcagcgggaaaaaaatgaggccgaaaacttggaagaaaacgaggaaccgtttgtggcacctctggggctttccgttcccagcgatgtggagctcccacctactgcgaaaatgcacgccatcatcgagcgaacagcttcattcgtctgtagacaaggggcccagtttgaaatcatgttgaaagccaagcaggcacgaaacagccagtttgatttcctccgcttcgaccactatttaaacccttactacaagtttattcagaaagccatgaaagaggggaggtatactgtgctggctgagaataaaagcgatgagaagaagaaatcaggtgtgtcctcagacaacgaagatgatgatgatgaggaagatggtaattatctgcacccaagcctgttcgcatctaagaaatgtaaccggcttgaagagctgatgaagccattgaaggtggttgaccccgatcatcctctcgctgccttagttcgaaaagcccaggccgattcatctacacccaccccgcacaatgcggatggtgcaccagttcagccctcgcaagttgaatacactgccgacagtaccgtggcagccatgtactactcctactacatgttaccagatgggacttattgcctcgcacccccaccccccgggatcgacgttaccacatattactctacccttcccgcaggcgttaccgtgagtaattcgccaggagtcactaccaccgctccacccccacctgggacgacgcctctccccccccccactacagcagagactagcagcggggcaaccagcactaccaccacaacatccgcccttgcaccagtcgcggcaatcatcccccctcctccagatgtgcaaccggttattgacaaacttgcggagtatgttgccagaaatggtctgaagtttgaaacttctgtgagagccaaaaatgatcagcggtttgagtttttacaaccctggcatcagtacaacgcctattacgaattcaagaagcagtttttcttacagaaagaaggaggggacagtatgcaggccgtctcggcaccagaggaagctcctaccgactccgctcccgagaaaccatcagatgccggtgaagatggagctcccgaggatgcagcggaggttggagcaagggccgggagtggcgggaagaaagaggcatcaagctcaaagaccgtgcccgatggtaaactggtgaaggcttccttcgcccctatatcttttgccattaaggctaaggaaaacgacctccttccattggagaaaaatagagtgaaacttgatgatgacagtgacgatgacgaagaatctaaggaagggcaagaatcgagttcttccgccgccaataccaaccctgccgttgcccccccctgcgtagttgtcgaagaaaagaaaccccaattgactcaggaggagctcgaggctaagcaggctaagcagaaattggaagacaggctggccgctgctgcgcgggaaaaactagcacaagcaagcaaagagtctaaggaaaagcagctccaggccgagagaaaacggaaagccgccctgttcttacagaccttgaagaatccattgccagaagccgaagcgggtaagattgaagagtcacctttttccgtcgaggagtcatctactaccccgtgccctcttttgacaggcggtagaccactccctactctagaagtcaagcctcccgatcgaccttcctctaagtccaaggaccccccccgtgaggaagagaaagagaaaaaaaaaaaaaaacataagaagaggtcaaggactcgttcacgtagtccaaagtatcatagctctagcaaatcacgctctcgttctcactctaaagccaaacattctctgccttccgcatatcgcaccgttcgccgcagcaggtcaagaagcagatcgcctaggaggagagcccactctcccgagcgtaggcgggaggaaagatctgtgcccacggcttatcgcgtttctcggagcccaggagcctcaagaaagcgtacccgttccagatccccacacgagaagaaaaaaaagaggagaagtaggtctcgcacaaagtcaaaagccagatcccagagcgtgagtccaagcaagcaggcagcaccacgacccgctgccccagcggcccacagcgctcattcagcttccgtgagtcccgtggagagccggggctcgtcccaggagaggagccggggcgtgagccaggaaaaggaagcccagatatcatcagctatcgtgtccagtgtccaaagcaagatcacccaggatctgatggcgaaggtgagggcaatgctggctgcatcaaaaaatctgcaaaccagcgccagttag

SEQ ID NO: 20719 - DNA, 1644 bp, Artificial Sequence
  Description of Artificial Sequence: Synthetic coding sequence
atgggcgaccacaagatcctgatcgaccggtacgacggccggggccacctgcatgatttatccgagtatgatgccgagtatagcacctggaatcgcgattatcagttgtctgaggaagaggcacgaatcgaagctttatgcgacgaggagagatacttagccctgcatacagacttactagaggaggaagccagacaagaggaagagtataaaagactcagtgaggcccttgccgaggatggttcttataacgcagtcggctttacatacggcagtgattattatgatccctcagagcccaccgaggaagaggagccctccaaacagagagagaagaatgaggctgagaaccttgaagagaacgaagagccctttgtggccccactgggattgagcgtgccgagcgacgtggaactgcctccgacggccaagatgcacgccattatagagagaacagcatcatttgtgtgtcggcagggggcacaatttgaaatcatgttaaaggctaagcaggcacgcaattcccaatttgatttcctgcgtttcgaccactacctgaatccttattacaagtttatccagaaagctatgaaagaaggccggtataccgtgctggcagaaaacaagtctgacgaaaagaaaaaatccggtgtatcttcagataatgaggatgatgacgatgaagaggacggaaattacttacacccgtccctatttgcctcaaagaagtgtaataggcttgaagagctgatgaaaccgctaaaagtggtcgatcccgaccacccgctggccgcccttgtacgtaaagctcaagcggattctagtaccccaactccccataacgccgatggagcacctgtccagcccagccaggttgaatacactgcggatagcactgtagcggctatgtactatagctattatatgctccccgacggcacatattgcttagctcccccgccccccggaattgacgtgacaacctattacagtaccctgcccgctggggttacagtgagcaactccccgggtgtgacaaccacagcgcccccaccaccgggaacgacaccactgcctcctcccacgacagcagagacatcatcaggtgccacctccactaccacaacaacctctgctcttgcccctgttgccgctatcatcccacccccacccgatgtgcagccagtgatcgacaagctcgccgagtacgttgcaaggaacggactcaagtttgaaaccagcgtgcgagccaaaaatgaccagcgtttcgagtttctgcagccttggcaccagtataatgcctattacgaattcaagaaacagttcttcctgcaaaaggaaggtggggactcgatgcaagctgtcagtgcacctgaggaggctccaaccgacagtgctcctgagaagcctagtgacgccggagaagatggtgcccctgaagatgccgctgaagttggtgctcgggccggctctggggggaagaaggaagcctccagctccaagacagtgccagatggcaaattagtcaaagctagcttcgcgcctatatcttttgcgattaaggccaaggaaaatgacctcctacctctggagaagaaccggaagaagcgtaagaagcggaagcgcaaaagcacaaagaagtag

SEQ ID NO: 20720 - DNA, 2091 bp, Artificial Sequence
  Description of Artificial Sequence: Synthetic coding sequence
atggaggtgagcagccccagccccgcccagcggctgcggcggaagaagaggccgatggtgcagggtccagctggctgtcaggtcttccaaccatcgccaagcggaggcacagccggggatcctggggggctttcagatccattctacccacccaggagcggcagtttggccctgggcgacccatctagtgaccccgcatgtagtcaatccgggcccatggaggcagaagaggacagtctccccgagcagcctgaggacagcgcacagctgcagcaagaaaagccatctctatatatcggcgtccgcgggacagttgtccgcagtatgcaagaggtcctatggaccagactgagggagctgcccgatcctgtgctttcggaagaggttgtggagggcatcgcagccggaatcgaggccgctctctgggacctgacacaggggaccaatggtagatacaagacaaagtacaggtcgctgctgttcaatttacgcgacccgcgaaatctggatttgttcctgaaagtagtccatggcgatgtgacaccttacgatctggtcagaatgtcgtccatgcaactcgcccctcaggagctggctcggtggcgtgaccaggaagaaaaacgggggcttaatataatagagcaacagcaaaaggaaccctgccgccttcctgcgtctaagatgacccataaaggtgaagtagaaattcagcgagacatggaccaaacactcaccctggaagatctggtgggcccacagatgttcatggactgtagcccccaagccctcccgatcgctagtgaggacaccactggacagcacgatcatcacttcttggatccgaattgccacatctgcaaagattgggagccctcaaatgaattgttgggctcatttgaggcagctaagagctgtggtgataacatcttccagaaagcactctcccagacacctatgcctgccccagagatgcctaagacccgcgagctgtctccaacggaacctcaggatcgcgtgcctccttccgggctgcatgttcccgcagctcccacaaaagcccttccttgcctgcccccttgggaaggcgtgttagacatgtttagcataaaacgctttcgagcacgggctcagctggtctctggacattcatgcagattggtacaggccttgcccacggtaatacggtctgctggctgcattccaagtaatatcgtttgggatttgttagcctccatttgtcccgccaaggccaaggatgtctgcgtggtgaggttgtgcccccatggtgcacgcgacacacaaaactgccgcttgctgtacagctatctgaatgatagacagcggcacggtctcgcctccgttgagcatatgggtatggtactgctgcccctgcctgccttccagcccctccccaccaggttacgacccctcggtgggcccggtctcgaggtcacccattctagccttctcctcgcagtgcttctgcccaaagagggcctgcccgacaccgcgggatcatctccatggttggggaaagtacagaaaatggtatcttttaacagcaaagtggagaagagatattaccaacccgacgaccgacggccgaatgtccccctcaagggaacacctccacctggcggcgcttggcagcagtcccagggcagaggctcgattgctcctcgcgggatatccgcctggcagcgaccgccaagaggtcgaggaagattgtggccggagccggaaaactggcagcaccccggtcggggtcagtggccaccggaaccgggtttgaggcagagccaacacccatactcggtggcacctgcgggccacgggtttggcagaggacagcacttccaccgggacagctgccctcaccaggcactgttgcgccacctggagtctctagcaaccatgtcacatcagctccaggcccttctctgcccacagaccaaaagctcaattcctaggccactccagcgcctcagctctgccctggctgcaccagagccccccggccctgctcgagacagttctctgggcccgactgacgaggctggttccgagtgtcccttccctcgaaaagcgtag

SEQ ID NO: 20721 - DNA, 1032 bp, Artificial Sequence
  Description of Artificial Sequence: Synthetic coding sequence
ggcaccaagtgcctggagagcctgctgggcagcgtgccccccccctgtccgggtcttcacagtctgagggaactccctgatccagtcctaagcgaggaagtcgttgaaggcatagccgctggtattgaggctgccctgtgggaccttactcagggaaccaatgggagatacaagaccaagtaccgatcgcttctgtttaacctccgggatcctcgaaacctggatctgtttctcaaagtggtgcatggtgacgtgaccccatacgacctggttcgaatgagcagcatgcagctggcgcctcaggagttggctaggtggcgcgatcaagaagagaagcgtgggcttaacataatagagcagcagcagaaggaaccttgcaggctgccggcgagtaaaatgacacacaagggggaggtggaaatccagagagatatggaccagaccctgacactggaagacttaggcccccaaatgtttatggattgttctcctcaggctctgccgattgcatccgaagatacgacaggtcaacatgaccatcattttctggacccaaactgccatatttgtaaggattgggaaccatccaacgagctgcttggaagctttgaggctgccaagtcctgtggcgataatatatttcaaaaggctctgtcccaaaccccaatgcctccaccatgggagggcgtgctggacatgttctctattaagcgatttcgggccagagcacagcttgtgagtggacacagctgcagactcgttcaggctttgccaacggtcatcaggagcgctggctgtattccttctaacattgtgtgggatctgctcgcaagtatatgtcctgctaaggccaaggtatggcgaagcttgacacaggtgtgttgttggctgtgttgctcacctcggaagggatttcagacgcagcaaggccctgcccccggttggggccggtttaaacggtggagcccttctaccgtgagatggagacgcgataccatcagtcagatgacaggggggcgcatgtgcccctag

SEQ ID NO: 20722 - DNA, 3651 bp, Artificial Sequence
  Description of Artificial Sequence: Synthetic coding sequence
atgagccaggccggcgacgtggagggccccagcaccggcgaccccgtgctcagccctcagcacaattgcgagctgctccagaatatggaaggcgctagttccatgcccggactgagccccgacggtcctggagcaagctcaggtcccggagtaagagcgggcagtcgtcgaaagatcccaaggaaggaggctcttcgtggtggtagttctcgggcggctggagccgccgaggttcgtccaggagtgttggagctgctggccgttgtccagtcccgcggcagcatgctggcccctggcctgcacatgcaactgccatccgtccctacgcagggaagggccctgaccagcaagcgattgcaggtctcgctctgcgacatcttagatgatagttgcccccggaaattatgtagtcgctcggccggcctccccgagcgagcacttgcctgtcgggagcgattggccggcgtcgaggaggtaagctgcctgcggccgcgggaggcgagggacgggggtatgagctcaccaggctgcgacagacgcagtcctaccctctctaaggaagagcctcctggccggcctctgacaagtagcccggacccggtccccgtgagagtaaggaaaaagtggaggaggcagggagcgcatagcgaatgtgaagagggagccggcgactttctgtggttagaccagagtccaagaggtgacaatctgctgtctgtaggggatccgccccaggttgcggacctcgaatctctaggaggaccctgtaggccacctagcccaaaagacaccggatcgggccccggcgaacccggcggctccggagccggctgtgcctcaggtaccgagaagttcggatacctgccggccacgggtgatggaccccaacccgggagtccttgcggcccagtggggtttccagtgcccagtggcggagaaagcctgtcgtccgctgcgcaagccccaccccagtctgctgcgctgtgcctgggcgcgagcgcccaagccagcgctgaacagcaagaagctgtttgtgtggttcgaaccggtagcgatgaaggacaggcaccagcccaggatcaggaggagctagaggccaaggcacagcctgccagccgcgggcggcttgagcagggactggctgctccagcagacacctgcgcatcttcaagagagcccctgggtgggctatccagctcccttgacacagaggcatcccgggcctgttcagggcctttcatggagcagcggaggagcaaaggcaccaagaaccttaaaaaggggccagtcccctgtgcccaggacagagggactgaccgttcatcggacaattcccaccaggaccgccctgaggagccttctcccggggggtgcccaaggttggaagaggtcaagatcccccacggcgtcaagctggtgtgctacctagggagcgggcctgttattcaattgttgggcgccatttcgcatggacaggccggtggtcagctgccccccaaacttgaggttttggaggaccttatggaggtctcttctccttcccccgctcagcgcctgagacgcaagaaaaggcccatggttcaaggcccagccggctgccaagtgtttcaaccgtccccttcagggggcacagcaggcgatcccggcggcctgtccgaccctttttacccccctaggtctgggagcctcgccctcggcgatcccagttccgaccctgcctgttcccagtctggccctatggaggctgaagaggactcattgcccgaacaacccgaggattccgcccagctgcagcaagagaaacctagcctgtacatcggggtgcggggaactgtggtgcgatctatgcaagaagtgctgtggacccgccttcgggaactcccggatccagtcctgtctgaagaggtggtggaaggtatcgcagcaggaatcgaggccgctctatgggatctgactcagggtactaacggccggtacaagacaaagtacagaagcctgctgttcaatttacgcgatccaaggaatctcgatctgttccttaaagtggtccacggtgatgtcaccccatacgatcttgttcgcatgtcctcaatgcagctagccccacaagagttagcacggtggagagaccaagaagagaagagaggcctaaatatcattgagcagcagcagaaggagccttgtaggttgccagcatcgaagatgacacacaaaggagaagtggagatccagagagatatggatcaaactctcactctcgaggacctcgtcggaccgcagatgttcatggattgctcacctcaagccttgcccattgccagcgaagataccacaggccagcacgatcaccactttctggacccgaattgtcatatctgcaaggattgggagcctagcaacgagcttctcgggtcttttgaggccgcaaaatcatgcggcgacaatatttttcagaaggctctatcacaaacaccaatgccagcccccgagatgcccaagacaagagagctgtctccaacagagccccaagacagggtccccccatccggactgcacgtgcccgccgctccaaccaaggccctaccttgcctgcctccttgggagggcgttctcgacatgttcagcattaagcgttttcgcgctagagcacagctggtcagcgggcactcatgccgcctggtgcaggctctgccaacagtgatacgctctgccggatgtatcccctctaacattgtgtgggacctgcttgcctctatctgccctgctaaagccaaagatgtttgtgtggttcgcttgtgtcctcatggcgcccgtgacacacagaattgtaggcttctgtacagttatcttaacgatagacagagacacgggctcgcatctgtggagcatatgggcatggtgttactgcccctgcccgcttttcagcccctccctaccagactcagacctctgggaggcccaggactctgggccctgccggtttcccctcttctcagccccggccttgaagttacgcactcaagcctcttgctcgccgttttgctgcccaaggaggggctgccagatacggcaggaagttccccttggctggggaaagtccagaagatggtgagctttaattcaaaggtggagaaaaggtactaccagcccgatgaccgccgccctaacgtccccctgaaaggcacaccacccccaggaggcgcttggcagcagagtcagggacgcgggtctatcgcaccgagaggcatctccgcctggcagcgcccccctaggggcagaggccgactgtggcccgagccggaaaattggcagcaccccgggcgcggccagtggcccccagaacctggattgaggcagagccagcatccatattccgtggcccccgccggccatggctttggaaggggccagcacttccaccgcgactcatgcccccaccaggctctcctgcgccacctggaatctctggctacaatgagccatcagctgcaggccctgttgtgcccacaaacgaaatcaagcataccgcgcccactgcagaggttgtccagcgcgttggcagcgccagagccgccgggacctgcacgcgactcctcactgggacctacggacgaagccgggtccgagtgtccgttccctcggaaggcctag

SEQ ID NO: 20723 - DNA, 1635 bp, Artificial Sequence
  Description of Artificial Sequence: Synthetic coding sequence
atgagccaggccggcgacgtggagggccccagcaccggcgaccccgtgctgtcacctcagcacaactgtgaactgctccaaaacatggagggagcctcttcaatgcctgggttgagcccagacggccctggagccagcagtgggccaggggtgcgggccggtagtcggaggaaaatcccgcgcaaggaagcacttagaggcgggagctctcgtgcagcaggtgcggccgaagtccgccccggagttctcgagttgttggcagttgtgcagtcccgaggctcgatgcttgcccctgggctccacatgcagctaccgagtgtgcctacacaaggccgtgctttgacctcaaaaaggctccaggtcagcctttgcgacatcctggacgacagctgtcctaggaaactttgctcccgttcagcaggcctccccgaacgggccctcgcgtgccgggagaggctagccggagtagaggaagtgtcgtgtctacggccgagagaggctagggatggcgggatgagctctccaggctgcgatagaagaagcccaactctgtccaaagaagagccacccggaaggcccttgacctctagccctgaccctgttccggtgagagtccggaaaaagtggcgtcggcagggagcacatagcgagtgcgaagaaggagctggggacttcctttggctagaccagtcaccacgcggagacaatcttctgagcgtgggggatcccccccaggttgccgatttggagtcgctcgggggcccatgcaggccccctagccccaaagacactggatccggtcccggggaaccaggaggctcgggggccggctgcgcttcagggaccgagaaatttggctacctgccagccacgggtgacgggcctcagcctggctccccatgcggcccggtagggttccccgttccaagcgggggagagagcctgtcctccgctgcgcaggcaccccctcaatccgctgcgctgtgcctgggagccagtgctcaggcttctgctgaacaacaggaagctgtgtgcgtggtgaggactggctccgatgaggggcaagctcccgcacaagaccaggaggaactggaggcaaaagcacaacccgccagtagaggtcggctcgagcagggtctcgccgcacccgccgacacctgtgcctcatctcgggaaccactgggggggctctcgtcatcgctggacaccgaagccagtagagcctgctctggcccctttatggaacaaaggagatcaaagggcactaagaatctaaagaaaggccccgtcccttgtgcccaagatcggggaacggaccgatctagtgataactcacaccaggaccgccctgaggagccttctcccggcggatgtccgcggctcgaggaagttaaaatcccccacggagttaagttagtctgctacgtgtttcagccttcacctagcggcggtactgcgggggatcctggcgggctttcagacccgttctaccccccacgctctggaagtttagcccttggggaccctagctccgatcccgcgtgctcccagtcaggtcctatggaagccgaagaagactcgcttccggagcagcccgaagactccgcctttgggtcttctcagacccaatgttag

SEQ ID NO: 20724 - DNA, 810 bp, Artificial Sequence
  Description of Artificial Sequence: Synthetic coding sequence
atgcaggaggtgctgtggacccggctgcgggagctgcccgaccccgtcctttccgaggaagtggtggaaggaatagcagctggaatcgaggccgctttgtgggatcttactcaggggaccaatggccggtataaaacaaagtaccgatcactactatttaacctccgagaccctaggaatcttgatttgttcctcaaggtggtacacggcgacgtaaccccgtatgacctggtgaggatgagttccatgcagctcgctccccaggaactagctcggtggcgcgatcaagaagaaaaacgcggaccacagatgtttatggattgctcaccacaggccctgccaattgcttctgaggatacaacagggcagcacgaccaccactttctggaccccaactgtcatatttgtaaggattgggagccatcaaacgaactcttggggagcttcgaggctgccaaaagttgtggagataatatctttcagaaagctctgtctcagacccctatgccggcacctgagatgccaaagacacgagagctcagccctactgagcctcaggatcggtgcggagtgggttctcgcgaggtggataatcccgcaggtcttcgcggtcggccccctccaggagccactgacattgctctggcattccctgtgtggccttgggcctccctgccttctctgggaaacttaacatttccgatatgtgccatggagctcattatcccggccagctggcagcccccagcccagggacaagcttgggcctctgtccctgtgcctacggtgggcactcaggatctgctatag

SEQ ID NO: 20725 - DNA, 63 bp, Artificial Sequence
  Description of Artificial Sequence: Synthetic coding sequence
atggaggtgagcagccccagccccgcccagcggctgcggcggaagaaaagaccgatggtgtag

SEQ ID NO: 20726 - DNA, 264 bp, Artificial Sequence
  Description of Artificial Sequence: Synthetic coding sequence
atggaggtgagcagccccagccccgcccagcggctgcggcggaagaagagaccaatggtccaagggcctgccgggtgccaagtgtttcagccttccccttcgggggggactgcaggcgatccagggggactaagtgatcccttctacccccctcggagcggaagcctggctctgggtgatccctcaagcgacccagcttgttctcagagcggtccaatggaagccgaagaggacagtcttccggagcagccggaggatagttag

SEQ ID NO: 20727 - DNA, 3612 bp, Artificial Sequence
  Description of Artificial Sequence: Synthetic coding sequence
atgagccaggccggcgacgtggagggccccagcaccggcgaccccgtcctctctccacagcacaattgtgagctcctccagaatatggaaggggcatccagcatgcccggcttgagtcccgatggaccaggtgcgtcttctggccccggcgtgcgcgctggatcgaggcggaagatccccagaaaagaagctctgcgcggcgggagctcacgggctgccggcgctgccgaggttcgccctggcgtgctagagttgttggctgttgttcaatcccggggatcaatgctggcgccgggtctgcacatgcagcttccgtctgtgcctacccagggccgagctctaaccagcaaacggttacaggtgagtttgtgcgacatccttgacgactcttgtcctcgaaaactgtgcagtaggagtgccggcctaccggagcgcgcactggcctgcagggaacggctcgccggcgtagaggaggtgtcctgcctgcgacctcgggaggctcgcgacgggggcatgagctcccccggctgtgacagaaggtcgcccacactttctaaggaggagcctcctggtaggccattgaccagttcccccgaccccgtgcccgtgcgtgtgcgcaaaaagtggcggcgccaaggggctcacagcgagtgtgaagagggggccggtgattttctgtggttggaccaatctcccaggggagacaatcttctttcagtgggtgacccacctcaggtcgcggacctagaaagccttggaggaccatgtcggccccccagccccaaagatactggatcagggcctggagagccgggggggtccggcgctggctgtgcctccggcaccgagaagttcggatacttgcctgcaaccggagacgggcctcagcctgggtcaccatgtggacccgtaggcttcccagtcccttcaggaggggaatctctgagttctgctgcccaggcccctccccaatcagccgcactctgtttgggggccagcgctcaagcttccgctgagcagcaggaagccgtgtgtgtggtgcggacaggcagcgacgagggacaagcccctgctcaggaccaagaagagcttgaggcgaaggctcagccggccagcagaggcaggctggagcaggggttggcagcccccgctgacacctgcgcatcgtcgcgcgagcccttaggaggcctgagcagctccttggacacagaagcaagcagagcatgcagcgggccctttatggaacagagacggagtaagggaacaaaaaaccttaagaagggtcctgtaccctgcgcgcaggatcgcgggacagatcgatcatcagataactcacaccaggatagacctgaggaaccctcacctggcggttgccccaggctggaggaggttaagataccacacggcgtcaagttggtatgttaccttggctccggacccgtgatacaactgctcggggctattagccatgggcaggccggaggccaattgccccccaagttggaagtgcttgaggatctcatggaggtgagctcaccttcgcctgctcagcgacttcgccgcaagaaacgtccaatggtccagggccctgctggatgccaggtgtttcagcccagcccatccggcgggaccgctggcgacccaggcgggttgtcggatcccttttatccccccaggtcgggcagtctagccctgggcgatccctcttctgaccctgcatgctcccagtctggccctatggaagctgaagaagactctttgcccgaacaaccagaagactccgcccaacttcagcaggagaaaccatctctctacatcggcgtacgggggacggtagtgaggtctatgcaggaagttctgtggacacggctgagagagctccccgaccccgtactgagtgaagaggtggtggagggaattgctgctgggattgaagcggcactctgggatctgacacagggaaccaacggccggtacaaaactaaatacagatctttgctgttcaacctgcgggatccccggaacctggatttattcttaaaggtcgtccacggggatgtgaccccgtacgatctagttaggatgtcctccatgcagctggcaccacaggaactcgctcggtggcgcgatcaggaggagaagcggggactgaacatcatagagcagcaacagaaggagccttgccgactgcctgctagtaagatgactcacaaaggggaggtagaaatacagcgtgacatggaccagaccctgactcttgaagacctggtcggtccgcagatgttcatggattgttctccacaggctctgcccattgcctccgaggacacaactgggcagcatgaccaccatttcttggaccccaattgccacatttgtaaggattgggaacctagcaatgagctgctgggttccttcgaagccgccaagagctgtggcgataatatttttcagaaggctctgtcacaaacaccaatgcctgctcccgaaatgcccaagacccgcgagctctctccaaccgaaccccaggacagggtacccccatccggcttgcacgtgccagctgcccccactaaagcacttccttgcttacctccctgggagggtgtgctggacatgttctcaattaagagattccgcgccagagctcagctggtttctgggcattcgtgccgtcttgtccaagctctgccgactgtgatccgatccgccggctgcattcctagcaacatcgtctgggacctattagcctcaatttgccccgcgaaagctaaggatgtgtgtgtcgtgaggctttgtccacacggggcacgtgatacacaaaattgtcgcctcttatatagctacctgaacgacagacagagacacggcctcgcatccgtggagcatatgggcatggtgctactgcctcttcccgcatttcagcctctacccacaagactaagaccactgggcgggccgggcctggaagtgacccattccagccttctccttgcagtattactgccgaaggagggccttcctgacaccgccggaagttccccatggctgggcaaggtccaaaagatggtgtcattcaacagtaaagttgaaaaacgttattatcagccagatgatagacgtccaaacgttccattaaaagggactccacccccggggggcgcttggcagcaatctcagggtagaggaagcatcgccccccgggggatctcagcatggcaacggccacccaggggccgtggcagactgtggccagagcccgagaattggcaacaccctggcagagggcaatggcctcccgaaccagggcttaggcagagtcagcacccgtatagcgttgctcctgcgggacacggattcggcagagggcagcactttcaccgcgacagctgtccacatcaagccctgctgcgccacctggagtctcttgctacaatgtcacatcaattgcaagcgctgctgtgtcctcagacaaaatccagtattccacgcccactgcagcgtctttcttccgccctggcggcccctgagccgccaggcccagcccgagacagctccttgggtcctactgacgaagcaggatcagagtgtccttttcccaggaaggcctag

SEQ ID NO: 20728 - DNA, 3939 bp, Artificial Sequence
  Description of Artificial Sequence: Synthetic coding sequence
atggaggaggaggacgagagccggggcaagaccgaggagagcggcgaagatagaggcgatggaccacccgacagagatccaaccctgagtcctagcgcttttattctacgcgctatccagcaggctgtaggatcctcactacagggcgatctgcccaatgataaggacggctcacgttgtcatggtctgcgctggcggcgttgccgatctcctaggtcggagccgcggagccaggagagcggcgggactgacaccgctacagtcttggacatggcaacagacagcttcctagccggcctcgtctcagttctcgatccacccgacacatgggtcccatcacggttggacctgcgcccaggtgaaagcgaggatatgctcgaactggtggccgaggtgcggataggggatcgggaccccattcccctgccagtgccctctctcctgcctcggctgagggcgtggcgcacaggaaaaactgtctctccacagtctaacagcagtcggcccacatgcgcccggcacctaactctgggaacaggagatggcggccctgctcccccccctgctcccagcagcgcctcttcatctcctagtccctctccatcttcctcttcccccagcccaccaccacctcccccccctcccgccccccccgcccctcctgccccaaggttcgacatttacgatcccttccaccctaccgacgaggcctactcaccaccaccagcgcccgagcagaaatatgatccctttgaacccacaggatcaaaccctagttcttccgcaggaacgccttctccagaggaggaggaggaagaggaggaggaagaagaggaagaggaagaggatgaagaggaagaggagggattatctcagagcatctcaagaatatccgagacactggccggaatctatgatgataattctctgtcccaggattttcccggagacgagagccccaggccagacgctcagccgactcaacccacccccgccccgggaactcctccacaggttgattccacccgtgctgacggggccatgaggcggcgggtgttcgtggtaggtacagaagcagaagcttgccgggaggggaaagtgtccgtggaggtggtgactgctgggggcgcagctctgcctccaccactgctgcctccaggtgactctgaaatagaggaaggagaaatagtgcaaccagaggaggagccacggctcgccctgtctctgttccgccccggcggaagagcagccagaccaacacctgcagcatctgcaacacctacagctcaacctctgcctcagcctcctgcaccccgggctcctgaaggcgatgactttctgagcctccatgctgagtctgacggcgagggcgctctgcaagtggatctcggagaacccgccccagcccctcctgctgctgacagcagatggggcgggttggatctccgcagaaagattctaacccagagacgcgagcggtataggcagagatctccttcacctgcgccagccccggcgccagctgcggccgcgggcccccctacccgcaagaaaagccgccgagaacgcaaaagatctggtgaggcaaaagaggccgcaagttcctcctctggtactcaacccgcgccccccgctccagctagtccctgggattccaagaagcaccggtcccgggacaggaagccgggctcgcacgctagcagctctgctagaaggcgcagtaggtccaggtctagatcccgctctacccggaggagaagtagaagcactgatcgtcgccgggggggctcaagaaggtcaaggtcccgcgagaagagacgaaggagacgtcggtccgcttcccccccacccgctaccagttcttcttccagctctcgccgggaaagacaccgcgggaagcatcgggacggaggcggttccaagaagaagaaaaagcggagccggtcacgcggtgagaagcggagcggcgatggcagcgaaaaagccccagcccctgcccctcctccctccgggtcgacctcctgcggagatagagacagcaggcggaggggcgccgttccgccatctatccaagatcttacagatcacgatctgttcgcgatcaaacggacaatcacggtcggcagactggacaagtctgatccacgtggcccttcaccagcgcccgcctcaagcccgaaaagggaagtactgtatgacagcgaagggttgagcggggaagagcggggagggaagtcctctcaaaaagacaggagaaggagcggagctgcgtcctcatcaagcagcagtcgagaaaagggtagccggagaaaagccctggacggaggggatagggacagggacagggatagagaccgcgaccgtgaccggagttcaaagaaagcacgccctcctaaggaatcagcacccagctctggcccccccccaaaaccccctgtatcgagtggatccggctcttctagctcctccagcagctgctccagccgaaaggtaaaactccagtccaaagtcgcagtactcatcagggaaggagtgtcatcaacaacccccgccaaagacgccgcttcagccgggctcgggtcaatcggcgtcaaattctccagagacagggagtctcgaagcccctttctgaagcctgatgagcgcgctcctacagagatggccaaagccgccccaggaagcacaaaaccgaaaaagacaaaggtaaaagcaaaagccggagccaagaaaacaaaagggaccaagggtaaaacaaagccaagcaagacgcgaaagaaggtcaggagtggtggcggaagcgggggaagcggtggccaggtcagtttaaagaagtccaaggccgactcctgtagccaggctgctggcacgaagggtgcagaagagacgtcctggagcggggaggaacgagcggccaaagtaccttccaccccacccccaaaagccgcccctcctccacctgctctgaccccagactcgcaaaccgtcgactcttcctgtaagacaccagaggtcagttttcttcccgaagaagccacggaagaggcaggggtgcggggcggggctgaagaggaggaagaggaggaggaagaagaggaggaggaagaggaagaggaagagcaacagcccgcgacaaccacagccacttcgacggccgctgccgctccttccaccgcaccaagcgcagggagtactgcgggagattcgggcgctgaggatggtcccgcttctagagtatcccagctccctacgctccccccacccatgccctggaacttgcctgcgggggtggattgcaccactagtggcgtgctggcgctgacagccctgttgttcaaaatggaggaagcgaatctggctagcagggccaaggctcaggagctcatccaagctactaatcagatcttgtctcataggaagcctccatctagtctgggcatgaccccagccccagtgccgacatctttggggctgcccccgggcccatcctcctatctcctgcctggatcccttccccttggaggttgcggaagtactcccccaactcctacaggattagcggcaactagcgacaaaagagagggctccagctcctctgagggcagaggtgatacggataagtatcttaagaagctgcatacgcaagaacgggcagtggaggaagtaaagctcgctatcaagccctattatcagaagaaggacataactaaagaggaatacaaagatattcttcgcaaagcagtgcacaagatctgccattcaaagagcggggagatcaaccccgttaaagtgtccaatctggtccgagcctacgtgcagcgctataggtactttcgaaaacacggacgaaaacccggagatccccctggcccaccaaggccaccaaaggaaccaggcccacccgacaagggagggccgggactccccctgcctccgctttag

SEQ ID NO: 20729 - DNA, 660 bp, Artificial Sequence
  Description of Artificial Sequence: Synthetic coding sequence
atggaggaggaggacgagagccggggcaagaccgaggagagcggcgaggatcgcggagacggacccccagacagggaccctaccctaagcccctccgccttcatcttacgagccattcagcaggctgtcggttcttcgttacaaggggatctgcccaacgacaaagatggcagcagatgtcatggcctacgttggcgccggtgccgaagtcccagatctgaaccccgaagccaggaaagtggcgggacagacacagctaccgtgctggatatggcaacggacagtttcctggctggtctggtgtccgtactggatccgcctgacacatgggtaccctcccggttagatcttcggccgggagagtcagaggacatgcttgaactggttgctgaagtgcgcattggcgacagagaccccattcccttgcctgtcccttccctcctcccccgcttgcgcgcatggcggacagggaagactgtctcaccacagagcaactcttcacgccctacatgtgcccgccacctgacactgggaacaggtgacgggccttgcccaacgccatgcccattgttgtgcattttactaccgtttccatttagcttgatctttctcccttttcctagccccacccctacagctccgagtccacagtttcattag

SEQ ID NO: 20730 - DNA, 3444 bp, Artificial Sequence
  Description of Artificial Sequence: Synthetic coding sequence
atggacgccgtgaacgccttcaaccaggagctgttcagcctgatggatatgaaaccacccatttcccgggccaaaatgattttgataactaaggcagcaattaaagccatcaaactatacaaacacgtggtgcaaatcgtggaaaaattcattaaaaaatgcaaacccgaatacaaggtgcccggtctatacgtgattgattccattgtgcgccagagcaggcaccagttcggaacggacaaggatgtattcggtcctcgattttctaagaatatcactgccacctttcagtacttgtacctctgcccctccgaggacaagtctaaaattgtccgggtgctgaacctctggcaaaagaacggcgtattcaagattgagattattcagccgttactggacatggccgcaggcacctcaaatgctgctccagtagccgaaaatgtgaccaataacgaggggtcccccccgccacccgtgaaagtgagcagtgagcccccgacccaagcgactccgaattcagtccctgctgtcccacagctcccctcaagtgatgcttttgctgcagttgctcagttgtttcagaccactcagggtcaacagctgcagcagatcctccagacattccagcaaccccccaagccgcagtcccccgccctggacaacgctgtcatggctcaggtccaagccatcaccgcacaactcaaaactacaccgacacagccctccgaacagaaggcagcctttcccccgccagagcaaaagactgcattcgacaagaagctgttagaccgatttgattatgacgacgagcccgaagccgtggaggagagcaaaaaggaagatactacagctgttactactaccgctcccgctgccgctgtaccccctgcccctaccgccactgtgccggcagccgctgcacctgccgctgcatctcctccacccccacaggctccatttgggttccccggcgatggcatgcagcagccagcctatacccagcaccagaacatggatcagttccaacctagaatgatgggcattcagcaggacccaatgcaccatcaggttcctcttccccctaatggtcagatgccaggattcggactcctcccaacccctcctttccctcctatggcccaacctgtgattcctccaactccccccgtgcaacagcctttccaggcctcttttcaggctcaaaacgaaccgttgactcaaaaaccccatcaacaggaaatggaggtcgagcagccatgcatccaggaggtgaagaggcatatgtctgataatagaaagagccggagccgtagcgcctcaaggagtcctaaacggaggagaagtcgctctgggtcccggtctagaagatctcggcacagaagatctagatcccgttcacgggaccggcggagacactctccgcgatcaagatcgcaagagagacgcgatcgggagaaggaacgggaacgccggcagaaaggcctgccccaggtgaaacccgagaccgcatctgtttgttccactacactatgggtgggccagcttgacaagcgcacaactcagcaggacgtggccagccttttagaggaattcgggcctattgagtcaatcaatatgattcctcctagaggctgtgcatacattgtcatggtgcatcggcaggatgcatatagagctcttcaaaagctctctcgaggcaactacaaggtaaatcagaaatccataaaaatcgcctgggccctaaacaagggaataaaagctgactacaagcagtattgggacgtggagctgggtgtcacctatatcccatgggacaaagtgaagccggaagaactggaaagcttttgtgagggaggcatgctggattctgatactctgaatcctgactggaagggtatccctaagaaaccagagaacgaagtggcacagaacggcggggccgaaactagccacaccgagcccgtaagccccatccccaagcccttgcctgtgcccgtgcctccgatcccagtgcccgcgcctatcaccgtgccacccccccaagtcccccctcaccagccaggccccccagtggtgggcgccttgcagccaccagccttcacaccacctctgggaatccctccccccggcttcggtcccggtgtgccacccccccccccacctcctcccttccttcgcccgggcttcaaccctatgcatttgccaccaggctttctgccacccggccctccacctcctatcacgcccccagtcagtataccgcctccacatacaccaccaatcagcattcccaacagcactatagctggaatcaatgaggacacgactaaggatttaagtattgggaatccaatccctacagtcgttagtggagcacgggggaatgcagaaagcggtgatagcgtgaaaatgtacggcagcgcggtgccaccggccgcgccaaccaacctgcccactccgccggtcacacagcccgtgagtctcctgggtacccagggggtggcccctggacccgtcatcggcctgcaggctccatcgaccggcttgctaggcgcccggccaggccttataccacttcaacggccacctggcatgcccccacctcacctgcagcggtttccactcatgcctcctaggcccatgccgcctcacatgatgcatcgggggccccccccgggccccggagggttcgctatgcctccgccccacggcatgaaggggccgttccccccccacgggcctttcgtgagacccggagggatgcctggactgggcggacctggacctggcccaggtggaccagaggaccgggatgggagacagcagcccccacaacagccacagcaacagcctcagccgcaggcacctcagcagccccagcagcagcagcagcagcagccaccaccttcgcagcagcccccaccaacgcagcagcagcctcaacaatttagaaacgataatcgtcaacaatttaattcaggccgtgaccaggaaagattcgggcgcagatcctttggtaacagggtagagaacgaccgcgagaggtatggaaataggaacgacgatcgcgacaattctaaccgagacaggcgggagtggggacggcgctcaccagatagggacagacatcgggaccttgaagagcgtaatagaaggtctagcgggcatagagatagggaacgcgactcaagggaccgggagtcccgccgggaaaaggaagaggcacgcggaaaggaaaagccagaggtaaccgatagagccggggggaataaaacggtggagccacccattagtcaggtcgggaacgtagatacggctagtgagctcgagaaaggcgtgtctgaagctgcagtcctgaaaccttcggaggagctgcccgcagaggccacatcctctgttgaacctgagaaagatagcggaagcgctgcggaagccccccgctag

SEQ ID NO: 20731 - DNA, 3378 bp, Artificial Sequence
  Description of Artificial Sequence: Synthetic coding sequence
atggacgccgtgaacgccttcaaccaggagctgttcagcctgatggacatgaaaccaccaatctctagggccaaaatgatcctcattaccaaggcagcgattaaggcgataaagctctacaagcacgtcgtgcaaatcgtggagaaatttataaagaaatgcaaacctgaatacaaggtgcccgggctctacgtgatcgattctatcgtcaggcagtcaagacatcagtttggtacggataaagatgtcttcggcccacggttctctaagaacatcactgccacatttcagtatctgtacctttgcccctccgaggataagagcaagattgtgcgagtgctgaacctttggcagaagaacggtgtattcaagatcgagatcatccaaccactgctggatatggcagctggtaccagtaacgcagcccctgtggccgagaacgtaacaaacaatgagggcagtcccccccctcctgtgaaagtttcctcagagccccctactcaagccaccccaaactctgttccggccgtaccccaactccccagctccgacgcttttgccgctgtcgcacagcttttccagaccacccagggacagcagttgcaacaaattctgcagacatttcaacagcccccaaagccacagtccccagcacttgataacgccgtgatggctcaagtgcaggctatcaccgcccagctgaagacaacacccacacagcccagcgaacagaaggccgcctttccaccaccagaacagaaaacagcgttcgataaaaagctgctggatcgatttgattacgatgatgagcccgaggctgtagaggagtctaaaaaagaggatacgaccgccgtcacgacaacagctccagctgccgctgttccacctgcgccgacggccaccgttcccgccgccgcagcacccgctgcagcctctccccccccgccccaggcacccttcggctttcctggggatgggatgcaacaacctgcatacacgcagcaccagaatatggatcaatttcagcctaggatgatgggaatccagcaggatccaatgcaccatcaagtgccacttcctccgaacgggcagatgcccggcttcggccttctccctacacccccgttcccacccatggcccagccagtcatccctcccaccccaccagtacaacagcccttccaggctagcttccaagcgcaaaacgagccccttacccagaaaccccatcagcaggagatggaagtcgaacagccctgcatacaagaggtgaagcggcatatgagcgacaacaggaaaagtcggtcacgctctgcgagtagatctccaaagcgaaggagatcacggtcaggcagccgctcaaggcgtagccgtcatagaaggtccagaagtaggagccgcgatcgcaggaggcactctccaagaagtaggagccaggaacggcgtgacagggaaaaagaacgagaacgacgccagaaaggtttgccccaggtgaaaccagaaacagcctcagtgtgctccacaacgctctgggtaggtcaacttgacaaacgcactacccagcaggacgtggcctcacttctagaggagttcggtccgatcgagtctattaacatgattccaccccgtggctgtgcatacatcgttatggttcaccgccaggatgcttaccgtgccctgcagaagctgagccgcgggaactataaagtgaaccaaaaatcgatcaaaattgcttgggctctgaataaggggatcaaggcagattataaacagtactgggatgtagagctcggtgtgacctatatcccttgggataaagtaaagcctgaagagctcgagagcttctgtgaggggggtatgttagacagtgatactttgaacccagactggaagggcattccgaagaagcccgaaaacgaggttgcacagaatggtggtgccgaaacgtcgcataccgaacccgtctcccctatccctaagcccctgcccgttccagtgcccccaattcccgtcccagctcccatcaccgtaccccctccccaggtcccaccccatcagcctggtccacctgtcgttggagccctgcagcctcctgcatttaccccacctctcgggattccaccacccggcttcggtcccggagttccacctcctcctcctcccccaccttttctccgcccaggttttaatccaatgcacctgccaccggggttcctgccccctgggccacctccaccgattacaccaccagtgagcattcctccccctcacacacctccaatttcaatccctaaccttgtgtccggggcgaggggcaatgctgagtccggcgattccgtaaagatgtacggaagcgctgtcccacctgccgcccctacaaatctgcctactcctccggtgacccaacctgtgtctcttcttgggactcaaggcgttgcaccgggacctgtcattggactgcaggcaccttcgactggcttgttaggcgctcggccaggcttgatcccacttcagcgccccccggggatgcccccaccccacttgcaacgatttccgctgatgcctccccgtcccatgccacctcacatgatgcaccggggaccccctcctgggccggggggctttgccatgccacctccccatggaatgaaggggccctttcccccacacggaccctttgtgaggcctggcggaatgcctgggttaggagggccagggcccggccctggcggacccgaggacagggatggtaggcagcaaccaccacagcagccccagcagcagcctcaaccacaagccccgcagcagccccagcagcagcaacagcagcaacctccgccctctcagcagcctccaccgactcagcaacagccgcagcagtttagaaacgacaatcgacagcaattcaacagcggaagggaccaggagcgctttgggcgtcggtctttcggcaatcgggtggagaatgaccgagaacggtatgggaaccggaacgacgaccgagataactcgaacagagataggcgcgaatgggggaggagaagcccagacagggatcgccatcgagatcttgaggaacgaaaccgccggtcctcagggcaccgggacagggagcgagattcacgtgacagggaaagtaggagagagaaagaggaggccaggggtaaagagaagcctgaagttaccgatagggcaggaggtaacaaaactgtggagcctccaatctcccaggtgggcaacgtggacacggcttcggaacttgagaagggtgtctcggaggccgctgttcttaagccctcagaggaactgccggcagaggcaacttcttcagtggagccagaaaaggactccggctcagccgcagaggcaccacgatag

SEQ ID NO: 20732 - DNA, 3399 bp, Artificial Sequence
  Description of Artificial Sequence: Synthetic coding sequence
atggacgccgtgaacgccttcaaccaggagctgttcagcctgatggacatgaagccgccgatttcacgcgcaaagatgatcctcattacaaaggccgccattaaagccatcaagtgcaagcccgagtataaagtgccaggcttgtacgttatcgacagtatcgtccggcagtccagacaccagttcggcacagacaaggatgtcttcggcccaaggttcagtaaaaatatcacagctacgtttcagtatctgtatctttgtccctcagaggataaaagtaagattgtgcgcgtgttgaatctctggcagaagaacggtgtatttaagattgagataattcagcctctattggacatggctgctgggaccagcaatgctgctccagtggccgagaatgtaactaataatgagggaagcccgccgccacccgtgaaagtgtccagtgagcccccaacccaggccacccccaatagcgtcccagctgtcccgcagcttccctcatcagacgcctttgcagccgtggcccagctgttccagaccacccagggtcagcagctacagcaaatcctgcaaacatttcagcagcctcctaagccccagtctcccgcactggacaacgctgtcatggcacaggtgcaggccatcaccgcccagctgaagaccactcctacccagcccagtgagcagaaggcagcctttccaccgccggagcagaaaactgctttcgacaagaagctgttggatcggtttgattatgatgatgagccagaggccgtggaagaatcgaagaaagaagatactacggccgtgacaactacagctcctgctgcagctgtccctcccgcacctacggccacggtcccggccgcggcagctccagcagccgcatcgccacctcctccgcaggcccctttcggctttcccggcgacggaatgcagcagccagcctatacccagcatcagaacatggaccagttccagccacgcatgatgggcattcagcaggacccaatgcaccaccaggtgccgctccccccgaacgggcaaatgcccggcttcggattgttacccacacctcccttcccacctatggcccagcccgtaatcccacctactccgcccgtccagcagcccttccaggctagctttcaggcgcagaatgaacccttgacacaaaaaccccaccaacaggagatggaagtggaacagccctgtatccaggaagtcaagagacacatgagtgacaatcggaaatcccgcagccgctccgcatcccgctcccctaaaagacgacgctctcgttccggatctcgatcccggaggagtcgacaccggagaagccggtcccgctcgcgggatcgcagaagacacagccctcgatctaggagtcaggagcgccgagatcgagagaaggagagagagcggcgacaaaagggtctcccccaggtgaagccggagacagcgtctgtgtgtagcactaccctgtgggttggccagcttgacaagaggacgacacagcaggacgtcgcaagcctgctggaagaattcggccccattgaaagcattaatatgatcccaccacgcggatgtgcctatattgtgatggttcaccgccaagatgcttatagagccctgcagaagctgtcccggggcaactataaggttaatcagaaatctataaagatcgcttgggcactgaataaggggataaaggcggattataagcagtactgggatgtggagctgggagtcacctatataccttgggacaaagtcaagcccgaagaactggaatcattctgcgaagggggcatgctggatagcgatactctcaacccagattggaaaggcatccccaaaaagccagagaatgaggtcgctcagaatggtggcgctgagacctcccatacagaacccgtctcccccatacctaagccactacctgtgccagttcctcctattccggtcccagcacccatcactgtgccgccacctcaggtgcctccacaccagccgggccccccggtggtaggcgccctccaacccccagcatttacacctccactgggtattccaccccctggcttcggccctggcgtgccgcctccacccccacccccacctttcctgaggccaggatttaatcctatgcacctccctcccggctttctcccacctgggccgcccccccctatcacgccaccagtttcaatccctccgccacatacccccccaatcagcatccctaacagcaccatcgcgggcatcaatgaagacactactaaggaccttagtattggaaacccgatccccactgtggtctccggggcaagggggaatgccgagagcggggactccgtcaaaatgtacggtagcgccgtgccccctgctgcccctacaaatctgccaaccccaccagttacacagccagtaagccttctggggactcagggcgtcgctcccggacccgtgataggacttcaggctcccagtacaggcctcctgggggctcgtcctggactgatcccactgcagcgcccccccggcatgcctcccccccatctccaacgctttccgcttatgccaccacggcccatgcccccccatatgatgcatcggggaccccccccggggcccggagggttcgctatgcccccccctcacggtatgaagggaccattccctcctcacgggcctttcgtgaggccaggaggaatgccggggctgggcgggcctggtcctggaccgggtgggcctgaggacagagacgggagacagcaaccaccccagcagccccagcagcagcctcagccacaagcgccacagcaaccccagcagcagcagcagcagcagccgcccccgagtcaacagccaccaccaactcagcagcagccacaacaattccggaacgacaaccgacagcagtttaacagcggtagagatcaagagcggttcggacgtcgctcattcggcaatcgagtcgagaatgacagggagcggtatggaaatcgtaacgacgacagagacaactccaaccgggacaggcgagagtggggacggcgctcccctgacagggacaggcaccgtgatctcgaggagaggaacaggagatcgtcaggacaccgcgaccgggaacgggactccagagatcgcgagtccaggagggagaaagaagaagcacggggaaaggaaaagcccgaggtaaccgaccgcgcaggggggaataagaccgttgaacccccgattagccaagtgggaaatgttgacaccgcttccgagctcgaaaagggcgtgagcgaagcagccgtgctaaaaccaagcgaggaactacctgcggaggccacctcttccgttgagccagagaaggactctggatcggctgctgaggcaccacgctag

SEQ ID NO: 20733 - DNA, 3816 bp, Artificial Sequence
  Description of Artificial Sequence: Synthetic coding sequence
atggaggccgtgaagaccttcaacagcgagctgtacagcctgaacgattacaaaccccctatctcaaaggctaagatgacacagattacaaaggccgcaatcaaagcaatcaaattctataagcacgtggtgcaaagcgtggagaagttcattcagaagtgcaagcctgagtataaggtccccggcctctacgtcattgactccattgtgaggcagagcaggcaccaatttgggcaggagaaggatgtcttcgcccctaggtttagtaacaacatcatctccacttttcagaacctgtatcgttgtcccggtgacgacaaatccaaaattgtgcgcgtcctaaacctctggcagaagaataatgtgtttaaatctgagatcatccagccgttactagatatggcagcaggtattcctcccccagtggtgacacccgtcctcgccagcacaactaccgccatgtcaaacacgcctggaactcctgtaactcctgtcacccccgctaatgtggtacaagggcttcccgacccatgggtttcacagatcacaaatacagacacattggccgcagtggctcagattctgcagagccctcaaggccaacaacttcagcagcttattcagaccttgcagatccagcagcagaaaccccaacccagtatcctgcaggcactggacgccggactggtggtacagttgcaagccttaactgcccagctcaccgccgccgcagccgcagctaatacccttacacccttggaacagggggttagttttaacaaaaagttaatggaccggtttgacttcggcgaagactccgagcactccgaggagccaaagaaagaaattccagcttcacagctttctcacgtgtctgaatcagtcaacaattccatttttcatcagatagccgagcagctccaacagcaaaatctggaacacctcagacaacagctgctcgagcagcagcagcctcagaaagcgacacctcaggattcgcaagagggaaccttcggcagcgaacacagcgcttctcccagtcagggcagctctcagcaacatttcttagagccagaagtgaacttggacgactccattgacatccagcagcaggacatggatattgacgaaggccaggatggggtggaggaggaggtgttcgaacaggaggccaagaaagttgccgttcgctctagatctcgcacccatagtaggtcacggagccgatcccctaggaagagacgaagcaggtcaaggagcgggtcaaggaagcgaaagcacaggaaacgaagtcgctcccgcagcagagaacgaaagcgaaaaagctcaaggagctacagcagcgagcgccgtgcgcgagaaagagaaaaggaacggcaaaaaaaaggactgccccctatcagaagcaagacgctgtctgtttgctcaaccacgttgtgggtgggccaggtcgataaaaaggctacccaacaagatctgaccaatctcttcgaggagtttggccagatcgagtctataaatatgattccgccccgggggtgcgcttatgtgtgtatggtgcaccgtcaggacgctttcagggctttgcagaagctcagcagtggcagctacaaaatcgggagtaaggttatcaaaatcgcatgggctctgaacaaaggtgtgaagaccgagtataagcaattctgggacgtggacctcggcgtgacctacatcccttgggagaaagtcaaagtggacgacttggagggcttcgctgaaggcggaatgattgatcaggagactgtgaatactgagtgggaaaccgtcaagtcttcagagccagtgaaggagacagtgcagacaacccaatctcctaccccagtcgagaaggagaccgtggtaaccactcaggcagaagtgttccctcctcccgtggccatgttacagataccggtcgcccctgctgtgcccactgtatcactggtccctcccgcttttccggtgtctatgccagtgcctccacctggttttagcccaattcctcctcctccgtttctcagggcctctttcaacccgagccagccaccgcctggatttatgccccccccagtgccaccccctgtggtgcctccacctacaatcccacccgtggttccaacttccttggtgcaaccgagtctctctatgacacctgagacggttaaagatgtcgggtttggcagtcttgtcatcccaggcggcagcgtcgcttcgaaccttgccacatctgctctcccagccggcaatgtgttcaacgcacccacaaaacaggcagagccggaggagaaagtgcctcatttaatcgaccaccagatcagctcaggcgaaaacacccgtagtgtgattcccaacgacatcagctccaatgcagcgattctaggggggcaaccacctaatgttacttcaaacagcggcattctgggagtgcaacgcccaaacgttagctccaacagcgagatcttaggagtgagaccatcaaatgttagttccagctctgggattatcgccgcccagccaccgaacatacttaataactctggaatactaggtatacagcctccatccgtatctaactcatccggcctcctgggagtgctacctcctaatatccccaacaactctgggttggtaggggtccagcctccaaatgttccaaatactccaggactgctgggaacccaaccccccgccggaccacaaaacctgccccccctgtcgattcctaatcagcgtatgccaaccatgcctatgctggacatcaggcctggactgattccccaagccccgggaccccggtttcccctgatccagcctggcattccgccccagcggggtatacctccaccatctgtcctggactctgcccttcacccacccccgagaggacccttccccccgggagacatattttcccagccagagagacctttcttggcgccaggcagacaaagcgtcgataacgtaaccaatcccgagaagagaatcccccttggcaacgataatattcaacaggaaggggaccgggactacaggttcccaccaatcgagacccgggaaagtatctcccggccgccacccgtagatgtgagggacgtggtaggccgcccgattgacccacgcgagggaccaggccggccccccttagatggtcgagaccacttcggccgtccacccgttgacatacgcgagaatctggtgagacccggcattgaccatctcggcagacgagatcattttggatttaacccggaaaagccgtggggtcaccgaggtgacttcgatgaaagggaacaccgcgtcttaccggtgtatgggggaccaaagggactacatgaagaacggggtaggttcagatcgggaaactataggttcgaccccaggtccgggccatggaatcggggtttcgggcaggaggtgcacagagattttgatgaccgccgtcggccctgggaaagacagcgggaccgggacgaccgggacttcgatttctgcagggaaatgaacggaaatcgactggggcgagaccgaattcaaaacacatgggtacccccgcctcacgctcgtgttttcgactatttcgaaggggccactagtcaacgcaagggcgacaatgttccccaggtcaacggcgagaatactgaaaggcacgctcagcctcctcccatcccagttcaaaacgatccagagttatatgagaagctcacatcgagcaatgagatcaataaagaaaagtctgacacggtggctgacatcgagtctgagcctgttgttgagtctaccgaaacagagggaacctag

SEQ ID NO: 20734 - DNA, 4014 bp, Artificial Sequence
  Description of Artificial Sequence: Synthetic coding sequence
atgccccagcccctgctgcccgccctgccccccctgagcagccccagcggtgcgggttcttgcggtccatccggaggggagtgctccggaagaaggctgttcagacggagggcaagaggtctacggagtgacaacatggaggcagtgaaaacgtttaattccgaggactgcgcatcaacacccgcatgtacagactgctttagctcatcaatggacacacgaagcattctctacagcctcaacgactacaagcctccaatcagcaaagccaagatgacacagatcaccaaggcagccattaaggccatcaagttctacaagcatgtggtccagtccgtggagaaattcattcagaaatgcaaacctgaatacaaggtccccgggttatatgtgatcgattcaatcgtgcgccagtctaggcatcagttcggtcaggagaaggacgtctttgccccccgcttcagcaacaatatcatcagcacatttcagaacctgtacaggtgccccggagacgataaatcaaagatcgttcgggttctcaacctctggcaaaagaacaatgtgttcaaatccgagatcatccaaccactgctggatatggctgcaggcatccctcctcctgtcgtcactcccgtcttggcatccactaccaccgcaatgtccaacacacccggcacacctgtgactcctgtgacccctgccaacgtggtccagggcctgccagatccttgggtgtcacagataaccaacactgacaccttggctgcagtggcgcaaatcctgcaatcacctcagggacagcagctccagcagctgatccaaaccctccaaattcagcaacagaaaccacagccctcaatactacaggctctcgatgctggtctagtggtccagctccaggcactcacagcccagttaacagccgccgcggctgcggctaatacactgacaccactcgaacagggggtgtccttcaacaagaagctgatggatcggtttgattttggggaggactccgagcactcagaagaacctaagaaagaaattcccgcctcccaattaagtcatgtttctgaatccgtcaacaatagcatctttcaccagatcgccgagcagctgcagcaacaaaatctcgagcatctccgtcaacagctactggagcagcagcagcctcagaaggcaacaccccaagatagccaggaggggacgttcgggagcgaacactctgcgagccccagccagggcagttctcagcagcattttctcgagcctgaggtgaacctggatgacagcatcgatatccagcagcaggacatggatatcgatgaaggacaggacggagtggaagaggaggtgtttgaacaggaagctaaaaaggtcgcagtccgatctcggtccagaacacatagtaggtctcggtcacgatctccccgcaaacgaaggtcaaggtcacggagtgggtcgcgcaagcggaagcatcgcaaaaggagcaggtcaagaagccgcgagagaaagcgtaaatctagcagatcttacagcagcgaacggagagctcgggaacgggaaaaggaacggcagaagaagggtctgccccccattcggagtaaaacgttatctgtgtgttctactactctctgggtgggtcaggtggataaaaaggcaactcaacaggaccttactaacctcttcgaagagttcgggcaaatcgagtctatcaacatgattcctccgaggggctgtgcttatgtttgcatggtccatcgccaggatgctttccgcgcactgcaaaaactctccagcgggagttacaagattgggtctaaagtgattaagatagcgtgggcactgaacaagggtgtcaagacggagtataagcagttttgggacgtggacttgggggtgacttacattccatgggagaaggtcaaggtggacgatctcgaaggcttcgccgaagggggaatgattgatcaggagaccgtgaataccgaatgggagacggtgaagtcaagcgaaccggttaaggagacagtgcagaccacccagtcccccaccccagtggagaaagaaactgtcgtgaccacccaggcagaggtttttccccctccagttgcaatgctgcagatccctgtcgcaccagccgtgcccaccgtctctcttgtgccccctgccttcccagtctctatgcccgtgccacccccaggattcagtcccatcccccccccccctttcctgagggcctcatttaatccctcccagcccccgccagggtttatgccacccccagtcccgcctccagttgttccacctcccacaataccgcccgtggtgcctactagtctggtacagcccagtctgtcaatgacacccgagacagtgaaagatgtgggcttcggatcattagttattcccgggggcagcgtggcctctaatctggccacgtcagccctgcccgcagggaatgtcttcaatgcgcctactaaacaggccgagccagaggagaaggtgccccacctaatcgaccatcagatctccagcggggagaacacacgctctgttatcccaaatgacatatcctcaaatgcagctattctcggcggacaaccaccaaacgtgacctcaaacagcggaattctcggggttcaaaggcccaatgtaagttccaactctgaaatactcggcgtccgcccatccaacgtttcctctagctcgggaataatcgcagcccagccacccaacatcctaaataactctggtattctgggcattcagccccctagtgtgtccaatagttccggactcctcggcgtactgccccctaatatccccaacaattccgggctggtcggtgtgcagccccccaacgttcctaacacccctgggctcctgggcacccaaccccccgccggaccccagaaccttcccccattgagtattcccaaccaacggatgccaacgatgcctatgcttgacataagacccggcctgatcccgcaggcaccgggcccaagatttcctcttattcaacccggaattcccccccagcgcggcatccctcccccatcggtcctcgattccgctctgcaccctccacccagaggacctttcccacccggtgacattttttcccagccagaaaggccttttcttgcaccgggcaggcagtccgtggataatgtgaccaatcccgagaaacgcatcccactggggaacgataacattcaacaggagggcgaccgggattacagattcccaccaattgaaacccgcgaatcaatttctcgtcctcccccggtcgacgtccgtgatgttgtaggcaggccgatcgaccctcgcgagggccccggccgccctccgcttgatgggcgcgatcattttgggcgcccccccgttgacattcgtgagaacctcgtgcggcctgggattgatcacctcggccgaagggatcactttggatttaatcccgaaaaaccatgggggcatagaggtgactttgacgagcgtgagcacagggtgctcccagtttatggaggaccaaaggggctgcacgaggagcgaggccggttccgaagcggtaactatcggttcgaccctaggtccgggccttggaatcgtggctttggacaggaagtccacagggacttcgacgaccggagaagaccgtgggagagacagagggacagagacgatcgtgattttgacttttgccgggagatgaacgggaaccgcctgggtagagacagaattcaaaacacttgggtcccccctcctcacgctcgggtgttcgattacttcgaaggcgcaacaagccagaggaagggggacaatgtgccacaggtgaacggggaaaatacggagagacacgctcagccccctcccatacctgtgcagaacgacccagagctctacgagaagcttacttcatctaatgagataaacaaagagaagtccgacacggttgctgacatcgagtccgagccagttgtggaatctacggaaaccgagggcacctag

SEQ ID NO: 20735 - DNA, 3816 bp, Artificial Sequence
  Description of Artificial Sequence: Synthetic coding sequence
atggaggccgtgaagaccttcaacagcgagctgtacagcctgaacgattataagcccccaataagtaaggcaaagatgacccagattaccaaagctgccatcaaggccattaagttctataagcacgtcgtgcagagcgtagaaaagttcattcaaaaatgcaaacctgaatataaagtccccgggctgtatgtgattgatagtattgttaggcagtctcgccaccagtttggacaggagaaggacgtgttcgccccccgttttagtaataatatcatcagtactttccaaaacctttaccgctgtcctggagatgacaagtccaagatagtacgcgttttgaacttgtggcagaaaaacaacgtgtttaagagtgagataattcagcctttattggacatggctgcgggaattccacccccagttgttacgccagtgctcgctagcacaaccaccgccatgtccaatacccccggcaccccagtcaccccagttacaccggcgaacgtcgtgcagggcctgcctgacccttgggtgtcccagatcacaaataccgataccctcgcagctgtagcacaaatccttcagtcaccacagggccaacagctgcagcaacttattcagactctacaaatacagcagcagaagccacagcctagtattctgcaggcacttgatgccggcctggtggtccagctccaggccctgacagcgcagcttactgcggctgcagctgccgccaacaccctaactccacttgagcagggggtaagtttcaacaaaaagctcatggataggttcgattttggtgaggactcagagcactcagaggagcccaagaaggaaatccctgcctcacagttaagccacgtgagtgagtccgtgaacaacagcatattccatcagattgccgagcagctgcagcagcagaacctggagcatctgcggcagcagctgctggaacagcagcaacctcagaaggctaccccacaggacagccaagaaggaacctttgggagtgagcattccgcatccccatcccagggctctagtcaacagcactttctggagcccgaggtgaatttagatgactcaatcgacattcagcagcaggatatggacatcgacgaaggacaggatggtgttgaggaggaagtgtttgaacaggaagcaaagaaggtagcagtgcgctcacggagccgtactcatagccgctccaggagcagaagcccacggaaaagacgtagtaggagtagaagcggttctaggaagcggaaacatcgcaaacggagtaggagtaggagccgtgaacgaaagcgtaagtcgtctagatcgtattctagcgaaaggagggcccgtgaacgcgaaaaggaaaggcagaagaaaggtcttcctcccatcaggtccaagactctgagcgtgtgtagcacgaccctctgggtcggacaggttgataaaaaagcgacacaacaggacctcacaaacttgttcgaggagttcgggcaaattgaatctatcaatatgatccccccgcgcggctgtgcatatgtatgcatggttcatcgccaggacgctttccgcgccctacagaagctgtcgagcgggtcttacaagatcggtagcaaggtaattaaaatagcatgggctctcaataaaggtgtgaagacagagtataaacaattctgggatgttgatttgggcgtgacatacattccatgggagaaagtaaaagtggacgacctcgaaggctttgctgaaggcggcatgatcgatcaggagaccgtgaacacagagtgggagaccgtaaagtctagcgagcctgttaaagaaaccgtacagactacgcagagcccgacaccggtcgagaaggaaacagtggtgactacccaggcagaagtattcccacctcctgttgccatgttacaaatccctgtagctcctgccgtgcctaccgtatcccttgtcccccctgccttccctgtctccatgcccgtcccaccaccaggcttttctccaatcccacctccaccattcttgagagcaagttttaatccatcacagccccccccaggttttatgccaccaccggtcccacctccagttgttccccctccaacaatcccgccagtcgtccctaccagtctagtgcaaccttctctgtctatgactccggaaactgtaaaagatgtcggctttggctcactcgtcatccccggcggatcagtcgcttctaacctggcgacatccgctctacccgctgggaacgttttcaatgccccaactaagcaggccgaaccggaggagaaggtgcctcatctgattgatcatcagatttccagcggagagaacactaggtcagtgatcccaaacgatattagttccaatgcagctatactggggggtcagcctcctaacgtaacctcaaactctgggatcctgggcgtacagcgccccaatgtgagcagcaacagtgaaatactaggtgtgaggccctcaaatgtaagttcgtcctccggaatcattgcagcacagccccctaatattctgaataactcaggcatcctaggcatccaaccgcccagcgtgagcaacagctccggactcctgggagtccttcccccaaatatcccaaataattcaggtctggtcggcgtccagccgccaaacgtcccgaacactcctggcctcctgggaacacagcccccggccgggcctcagaatttgcctcccttatcgatccccaaccagagaatgcctacgatgccgatgctggacatcaggcctggcctgattcctcaggctccagggcccaggttcccactcattcagcctgggatccccccacagagaggcattccaccgccctccgtgctggatagcgccctccaccctcctcctcgagggccattccccccgggagacatattctctcagcctgagcgtccatttttggcgccaggaagacagagtgttgacaacgtgacaaatccggaaaagcgcatacctctcggcaacgataatattcagcaggaaggagacagggattatcgattcccacccatcgagacgagggaatcaatctccagaccaccccccgtcgatgtgcgggatgtggtgggaaggcctattgatccacgggagggtccgggacgtccccctctggatgggcgagaccattttgggcgacctcctgtcgatatccgcgagaacttagtgcgaccgggtatcgatcatctgggaagacgggatcacttcggatttaaccctgagaagccttggggccatcggggggattttgatgagcgcgagcatagagtgctgcctgtgtatggcggtccaaaaggtttgcacgaggagcgcggacgctttaggtctggcaattatagattcgatcctagatcagggccttggaacagggggtttgggcaagaggtgcatcgagattttgatgatcgccgtagaccgtgggagcggcaaagagacagagacgacagagatttcgacttttgccgggagatgaatggtaatcgactgggccgggaccgcattcaaaatacgtgggtaccaccccctcacgcacgggtgttcgactattttgagggcgccacaagccagaggaagggagacaatgtccctcaagtgaatggggaaaacaccgagcggcacgcccaacccccacccatccccgtgcagaatgatccggagttgtatgagaagctgacgtcatccaatgagatcaacaaggaaaaatcagacactgtggctgatatcgagagcgaaccagtggtagagagtacagaaacagagggaacctag

SEQ ID NO: 20736 - DNA, 2262 bp, Artificial Sequence
  Description of Artificial Sequence: Synthetic coding sequence
atggagcgggcccggcccgagccccccccccagccccggcccctgagacccgccccgccaccacttcccgtggaaggcactagcttctgggccgctgctatggaaccgcccccttcttcaccaactctttcagcggctgcttccgcgactctggcgtcttcctgtggtgaggcagtcgctagtggactgcagcctgccgtcagacggctgctacaagtgaagccagagcaggtgttgctcctaccgcaacctcaggcccagaacgaggaggccgcggcatcttctgcacaggccagactgctgcaatttcgacccgacctcaggctcctgcagcctcccacagccagcgacggggctacatctaggccagagttacatccagtccaaccactggctcttcacgtgaaagccaaaaaacagaaattgggcccctcactggatcagtccgttggtcctcggggagccgtggagacagggccacgcgctagcagggtcgtcaaacttgaaggtcctggaccggctctcggttatttccggggcgacgagaaaggcaaactcgaggctgaagaagtgatgcgagattcaatgcaggggggtgccgggaagagccctgcagcaatccgcgagggggtgatcaaaactgaagagccggaacgcctcctcgaggactgtcgcctgggcgccgaaccggccagcaacgggcttgtgcatggctcagcggaggtcatcctcgctcctacttccggcgcctttggaccccaccagcaggatctgcgaatacctctcaccctacacacggtaccgccgggggctcgcatccagttccaaggcgcccctcccagcgaactcattcggctgaccaaagtgccattaacccccgtgccaactaaaatgcagagcctgctagagcctagtgtaaagatcgagacgaaagacgtgcctttgaccgtcttaccatctgatgccggaatccctgatactcctttttctaaggaccgcaatgggcacgtgaaacggccgatgaacgcctttatggtgtgggcccgaatccacagacccgcccttgctaaagccaaccctgcagccaacaatgcggagatttccgtgcagctagggctggaatggaacaaattgtcagaggagcagaagaaaccctactacgacgaggctcagaaaataaaggagaagcacagagaggaattccctgggtgggtttatcagccaagacctggcaagcggaaacgctttcccctgtccgtcagtaacgtctttagcggcacaactcaaaatatcatcagcaccaatcctacaacagtgtacccctaccgttcgccaacatattctgtggtgattcctagcctccagaaccccatcacacacccggttggagagacttcgccagctatccagttaccgacacccgcggtacagagtcccagtcctgtaacactatttcagccatctgtaagctccgccgcacaggtcgcagtgcaagacccctcacttccagtatatccagctctgccaccccagagattcactggaccctcgcagacagacacgcaccagttacacagcgaggccactcacactgtcaaacaaccaacacccgtttccttagaatcggccaaccgcatttctagctcagcttcgactgctcatgcccgcttcgctacctctactatccagccccctagggagtactctagtgtgtccccctgcccgcgaagcgcgcccatccctcaggcgtcccccattcctcacccacacgtgtaccaacccccccctctgggccatcccgccactctgtttgggaccccccctcgattcagctttcatcacccttactttctgcctggaccacattattttccttcctcgacctgcccatacagcagacccccgtttggctacggcaacttcccttccagcatgccagagtgcctgtcctattatgaagatagatatcctaagcacgagggcatattcagtactttgaacagggactatagcttcagagattatagtagcgaatgcacacacagcgagaacagcaggagctgtgaaaacatgaacggaacctcttactacaatagccacagtcattctggtgaggagaatctcaatccggtgcctcagctggatatcggcacactggagaatgtgttcaccgcccctacctctactccttcaagtatccagcaggtcaatgtaactgactccgatgaagaggaagaggagaaagtgctcagagatctctag

SEQ ID NO: 20737 - DNA, 1506 bp, Artificial Sequence
  Description of Artificial Sequence: Synthetic coding sequence
atggagcgggcccggcccgagccccccccccagccccggcccctgcgcccggcccccccgcctttaccagtggaggggacaagcttctgggcagccgctatggagccccctcctagcagtccaacccttagtgccgcagcgagcgctactctcgctagttcgtgcggcgaggcagtggcctctggactgcaaccagctgtgaggcggctgctgcaggtgaaacctgagcaagtactgctccttccacaaccgcaggcccagaacgaagaagccgcggctagctctgcgcaagcaaggctcctccagtttcggcccgaccttcgcctcctgcagcctccgacagccagcgatggcgcgaccagtcgtcctgagctgcatccagtgcagcccctggccctgcatgtgaaggccaagaagcaaaagctgggcccttctctcgatcaatcagtggggcctcgtggagccgttgaaactggaccaagagcctcccgggtggtgaaactcgagggccccggccccgccctcggctacttccgcggcgacgagaaaggcaaactcgaggccgaggaagtgatgcgcgactcgatgcaggggggggccgggaaaagtccagccgctataagggagggagtgatcaaaactgaggagcctgaaaggctattggaagactgtaggctgggggcggagcctgcaagcaatggactggtccacggcagcgccgaagtgatacttgcccccacctccggggcattcggccctcaccaacaggatctgcgaattccactgactctccacaccgtgccaccaggagcaagaatccagtttcaaggggcccccccctccgagcttatccgcctgaccaaggtcccactgaccccagtgccaaccaaaatgcagagcctcttggagcccagcgtgaagatcgaaaccaaagatgtgcccttgacagtgcttccctccgacgctggaatccccgatacgccattttctaaggatagaaacggccacgtgaagaggcccatgaatgcctttatggtctgggcacgaattcaccggcccgccctcgccaaggccaaccccgctgcaaataacgcagagatttccgtacagcttggcctggaatggaacaaattgagtgaggaacagaagaagccatattacgacgaggcccagaaaattaaggagaagcaccgtgaagagttcccaggctgggtctatcaaccccggccaggaaagcggaagagattccccctgtctgtcagtaacgtcttttctggtaccacgcaaaatatcatctcaactaaccccacgacagtatatccctataggagcccaacttactccgtcgttatcccttcactgcagaatcccatcacacacccagtggtgcacgctcttactgtggggcttcctctggccatggagatattcagagtgcaatgccagaatgcgctcgtgatcatgaagacgggaactcagaacatgagagtgagttttcaactgtag

SEQ ID NO: 20738 - DNA, 585 bp, Artificial Sequence
  Description of Artificial Sequence: Synthetic coding sequence
atgcccagcagccccctgcgggtggccgtggtgtgcagcagcaaccaaaaccgctctatggaggcgcataacatcctctcaaagcgcggcttttccgtaagatcttttggaacgggcacgcatgtcaaactgcctggaccagccccagataagcctaacgtgtatgacttcaaaaccacttacgatcagatgtataacgacttgctcagaaaagacaaggagctgtatacgcagaatggaatcctccatatgctggaccgcaataaaaggatcaaacctaggcctgaacgctttcagaattgcaaggatctttttgacctcatcctcacctgcgaagagcgcgtgtatgaccaggtggtcgaggatctcaactctagggaacaagagacatgtcagcctgttcatgtagtgaatgtggatatccaggacaaccatgaggaggcaacactcggagcctttctcatttgtgaactatgccaatgtattcaacatactgaggatatggagaacgagattgatgaactgctgcaagagttcgaggaaaaatcaggccgcacatttctacacacagtgtgtttctactag

SEQ ID NO: 20739 - DNA, 462 bp, Artificial Sequence
  Description of Artificial Sequence: Synthetic coding sequence
atgcccagcagccccctgcgggtggccgtggtgtgcagcagcaaccagaaccgatcaatggaggcacacaacattctctcaaaacgagggttctcagtgaggtctttcggcactggcacccacgtcaaactcccaggccctgctccggataagcctaatgtgtacgactttaaaacaacttacgaccagatgtacaatgatctgcttcggaaggataaagaattgtacccaagcggactcccctttaagaaccctccatgcggccccccgtggaaggtattgcgcgtggcaagggctcaggaagcatgccaccccgtacagtgtactcactggttgctgtgcctctgtgagagtctggtctctattcctggggccagacggattgtgcatggccttgtgccggttccgcctatggcagtgggggtggtccgtcggacagacactgtgtgggggagtccatag

SEQ ID NO: 20740 - DNA, 489 bp, Artificial Sequence
  Description of Artificial Sequence: Synthetic coding sequence
atgcccagcagccccctgcgggtggccgtggtgtgcagcagcaaccagaacaggtccatggaggcgcataacattttatccaaacgtgggttctctgtgagatcgtttggaaccggaacacacgttaagctgccagggccagcccctgacaaacctaacgtatacgactttaaaactacatatgatcagatgtacaatgaccttctccggaaggataaggaattgtacacccagaacggcattcttcacatgttagaccgcaacaaacggatcaagcccaggcccgagcggttccagaattgtaaggacttattcgacttgatcttaacgtgcgaagagagagtgtatgatcaggtagtcgagggagaggaagcagccgcttgttgggctggtctccagcagctgtcacaaggactcggaatgcctgccggaccacaccatgatcagtactccccttctagggtcgccggtgctggagaacaaacttag

SEQ ID NO: 20741 - DNA, 336 bp, Artificial Sequence
  Description of Artificial Sequence: Synthetic coding sequence
atgctggaccggaacaagcggatcaagccccggcccgagcggttccagaattgtaaagacttgttcgacttaatcctgacttgcgaggagcgtgtgtacgaccaggtcgtcgaagatctgaattctagagaacaggaaacttgccagccggtacacgtcgttaacgtggacatccaggacaatcacgaggaggccacactgggtgcgtttctgatttgcgagctgtgccaatgtatccaacataccgaagacatggaaaatgagattgacgagctgttacaggagtttgaagaaaaaagtgggagaactttcttgcacactgtgtgcttctactag

SEQ ID NO: 20742 - DNA, 609 bp, Artificial Sequence
  Description of Artificial Sequence: Synthetic coding sequence
atgttcaccgagctgcggagcaagctgagccccccccggggccgggcaggcgccgtgcgggccgggttcggcgaaagacgcgacgtcgacgccacggcgcactttagcttttgtcgcaccttgttggagcatactgtctcagcagaatctatcccctgccacctgcccagaacaccaggcacctccctcacatggcacgacagtcgttctcaacgcgcggcatcctcccgtcccatcaagctcctgcagcagccggggacagacacaccccaaggcagactgtattctgaccattacggtctgtatcatacatcgccctcccttggagggctgaccaggcctgtggttctgtggtctcagcaagacgtgtgcaaatggctcaagaagcactgtccacacaattacctggtctacgtggaagctttttctcagcatgctatcaccggccgtgcactgctcaggctgaatgcggaaaaactgcagcggatgggtctggctcaggaagcgcagaggcaggaggtcttacagcaagtccttaggctccaggtgcgggaagagggtcgctcactgcagctgctctcacaggccagcttcggtaaaatgtcctag

SEQ ID NO: 20743 - DNA, 321 bp, Artificial Sequence
  Description of Artificial Sequence: Synthetic coding sequence
atgttcaccgagctgcggagcaagctgagccccccccggggccgggcaggcgcagtgagggccgggttcggcgaacgccgagatgtggacgggagcgtccacctgcagattccttatagggcgttcatccattcttttatcgacaatgaatgcggagttcccctgtgcaaccagacgtggatcaagaccccagccagtcctgattccgcgacggcccacttttccttttgtcgaactttactggagcacacagtctctgctgaatctattccatgtcacctccccagaactccagggacatccctgacgtggcacgattag

SEQ ID NO: 20744 - DNA, 2046 bp, Artificial Sequence
  Description of Artificial Sequence: Synthetic coding sequence
atgagcaagggcatcctgcaggtgcacccccccatctgcgactgccccggctgtcggatcagttcgccagttaaccgaggccggctcgccgataagcggacagtagccctgccagcagccagaaatctgaaaaaggaacgcacaccaagctttagcgcatccgatggagatagcgacggaagtggccccacttgcggtaggcggccggggctcaaacaggaggacggccctcatatccggatcatgaagcggcgcgtgcacacacattgggatgtgaacatttcctttcgagaagccagctgctcccaagatggaaatctcccaactctaatttcttcagtgcaccgctcccgacaccttgtgatgccagaacatcagtccagatgtgaatttcagagaggttcactcgagattggtctcagaccagccggagatctccttgggaagcgattaggccggtcacctaggatctcctctgattgtttctccgaaaagagagcaagaagcgagtcccctcaggaagctctcctcttaccgagggagctgggcccttctatggcacctgaggatcactatcggcggctggtaagcgcactcagcgaggcaagcacctttgaggatccacagaggttgtaccatctgggattgcccagccatggcgaggatccgccatggcatgaccccccgcaccacctgcccagccatgatctgctgcgagtccgccaggaggtggctgccgccgctctgcggggaccgtccggacttgaggcccacctgccaagttctactgctggccagagaagaaagcagggattagcacaacaccgggaaggcgcagcgcctgctgccgctccgagcttctcagaacgagaacttccgcaacccccaccgctgttgtccccacagaatgcaccacacgtcgctttaggaccccatctgaggccgccattcctgggcgtgccgagcgcgctgtgccagacgcccggctatggattcctgcccccagctcaagccgaaatgttcgcttggcagcaggagctgttaaggaaacagaatttagcccgcctggagcttcctgcagacttacttcggcaaaaagaactcgagagtgcacgtccccaattgctcgcgccagaaacagccctccggcctaacgacggggcagaagagctccaacgaaggggtgccctgctcgtgctgaaccatggcgccgccccattactcgccttgccccctcaaggcccgccgggaagtgggcctcctactccaagtagagactctgcccgccgggctccccggaaagggggcccagggcccgcaagtgccagaccctctgagagcaaagaaatgacaggggcacgtctctgggcacaggacgggtccgaagatgaacctcctaaggactcggacggggaggatcctgagacggccgcagttgggtgccggggacctacacccggccaggctcccgcaggtggcgctggtgccgaggggaagggcctgtttcccggtagcactcttcctctggggtttccgtacgccgtatcaccctattttcacacaggcgctgtcggcggcctctctatggacggcgaagaagcccctgccccggaagacgtgacaaaatggacagtggatgacgtgtgctcctttgttgggggccttagcgggtgcggggaatacactcgagtgttccgggaacagggcatcgatggcgagacattgcccctgcttacagaggaacaccttctgacaaacatgggcctgaaacttgggcccgctcttaagatccgggcacaggttgccaggaggttggggcgtgtgttctatgtagcctcttttcccgttgctcttcccctccagccacctacactgcgggctccagaacgtgaactcgggactggcgaacaacctctgtcccccaccactgctacgtcgccttatggcggcggccatgcattggccggccagaccagccctaagcaagaaaacgggactctcgctctgctgcctggggcccctgacccatcccaacccttgtgctag

SEQ ID NO: 20745 - DNA, 540 bp, Artificial Sequence
  Description of Artificial Sequence: Synthetic coding sequence
atgagcaagggcatcctgcaggtgcacccccccatctgcgactgcccaggttgtcggatttcttctcctgtgaacagaggcagacttgccgataagaggactgttgccctgcctgctgcccgaaatctgaaaaaggaacgtacacccagcttttccgctagcgatggggattcagatggtagcggacctacatgcggcagacgccctgggcttaagcaggaagacggtcctcacattcgcataatgaaaagaagagtgcacacccactgggacgtaaacatctcatttagagaggctagttgcagtcaggacggtaatctgccaaccctcatctcctctgtccacaggtcaaggcacctggttatgcctgagcaccagtcgagatgcgagttccagcgaggtagcttggagatcggcttacggccagcgggagacctgcttggcaaacggctcggacggtcacctagaatatcaagcgattgcttcagcgaaaagcgagctaggtcagagtctccgcaagaggcactgttgcttccctag

SEQ ID NO: 20746 - DNA, 330 bp, Artificial Sequence
  Description of Artificial Sequence: Synthetic coding sequence
atgagcaagggcatcctgcaggtgcacccccccatctgcgactgcccaggatgcagaatcagctcacccgtgaatcggggacgcctcgccgacaaacggactgtggcactgccagctgcccgcaatcttaaaaaggagcggactccttctttcagcgcctctgatggtgactctgatgggtccggcccgacctgcgggcgccgacctgggctgaagcaggaagacggaccgcatatccgcatcatgaagcggagagtgcacacccactgggatgttaatatctcctttagagaggcctcatgctctcaggacggtaacctccccacttag

SEQ ID NO: 20747 - DNA, 606 bp, Artificial Sequence
  Description of Artificial Sequence: Synthetic coding sequence
atggccgtggaggccctgcactgcggcctgaacccccggggcatcgatcatccagctcatgcagagggcatcaaactccagatcgagggcgaaggcgtggaatcccagtcaatcaagaataaaaactttcagaaagtgcctgaccagaaagggaccccaaagcgcctgcaagctgaggccgaaacggcaaaatcagccaccgtcaagttgtctaagccagtggcactgtggacccagcaggacgtttgcaaatggctgaaaaagcattgtcctaatcagtatcaaatttactccgagagcttcaagcaacatgacatcacaggccgcgctctgttgaggctgactgataagaagctggagagaatgggcattgcccaagaaaacctcagacaacacattctgcagcaggtgctccagctgaaagtgagggaagaagtccgtaacctgcagctactgacccagggaactctgcttctgccagatggctggatggacggcgaaatccgccgcaagaccaccttgctcttaggccagacaggggtccgcgaaaatttgttactgttcttacatcgtatttctataattgagaactccatccaaatttag

SEQ ID NO: 20748 - DNA, 486 bp, Artificial Sequence
  Description of Artificial Sequence: Synthetic coding sequence
atggccgtggaggccctgcactgcggcctgaacccccggggcatcgaccatcccgcccatgctgaggggattaagctgcagatagagggagagggcgtggagtcacaaagtatcaaaaacaaaaattttcagaaggttcccgaccagaagggcacccccaaaagattacaggcagaggccgagacggctaagtccgccaccgtgaaactgtcaaaaccagtggcgctgtggacccagcaagacgtctgcaagtggcttaagaagcactgccctaatcagtatcaaatttatagcgagtcattcaagcagcacgatatcaccggcagagccctgcttcgtctgacagacaaaaagctggaacgcatgggcatcgctcaggagaacctccgccagcacattttgcagcaggtgctgcaactgaaggtccgcgaggaggtgcgaaacctgcagctgctgacacaggcatccagcgagggctccccatag

SEQ ID NO: 20749 - DNA, 279 bp, Artificial Sequence
  Description of Artificial Sequence: Synthetic coding sequence
atgcggagctgcctgatgcccggcaacgagatgagcatgaccagccctgaaggcactgaaccgaaagggaagcaaagacgttggcaacggcaaaagacctttggcgggggcactatgcatagtcaggatagccaggagattgatggcaaatccctcttgctgatgacccggaatgacgtgctcaccggcctgcagctcaagttaggacctgcactgaagatctatgagtatcatgtcaaaccacttcagactaaacatttgaagaacaattctagttag

SEQ ID NO: 20750 - DNA, 309 bp, Artificial Sequence
  Description of Artificial Sequence: Synthetic coding sequence
atgctgagcgtggacatggagaacaaggagaacggcagcgtgggcgtgaaaaactctatggaaaacggacggccccccgatcccgctgactgggccgtcatggacgttgtgaattacttccgaactgtcggctttgaggagcaggcttccgcgttccaggagcaggaaatcgatggcaagtcactgctactgatgacccgcaatgacgttctgacaggcctgcaactcaaactgggcccagccctgaaaatctatgagtatcatgttaaaccactgcaaacaaagcacctcaagaacaatagttcctag

SEQ ID NO: 20751 - DNA, 309 bp, Artificial Sequence
  Description of Artificial Sequence: Synthetic coding sequence
atgctgagcgtggacatggagaacaaggagaacggcagcgtgggcgtcaagaactctatggaaaatggcagaccgcccgatcccgccgactgggccgtgatggatgtcgttaattatttccgaaccgttggattcgaagagcaggcttccgctttccaggaacaggagattgacgggaagtcactgctcctgatgacccggaacgacgtgctgaccgggctgcagctgaaattaggccctgcgctgaagatctacgagtatcatgtaaaacctctccagacaaagcatctgaagaataatagttcctag

SEQ ID NO: 20752 - DNA, 309 bp, Artificial Sequence
  Description of Artificial Sequence: Synthetic coding sequence
atgctgagcgtggacatggagaacaaggagaacggcagcgtgggcgtgaagaacagcatggagaacggacgccccccagaccctgccgactgggcagtaatggatgtggtgaactatttcagaaccgtcggttttgaggaacaggcatcagcctttcaggagcaagagatcgatggaaaaagtctgctgctgatgactcgcaacgacgttctgaccggcctccaactgaagctcggtcctgctcttaaaatttatgaatatcacgtgaaacctctgcaaaccaagcaccttaagaataatagctcgtag

SEQ ID NO: 20753 - DNA, 369 bp, Artificial Sequence
  Description of Artificial Sequence: Synthetic coding sequence
atggccaacagcctgctggagggcgtgttcgccgaggtgaaggagccatgctcgctgcccatgctctcagtggacatggagaataaagaaaatggcagtgtgggcgtcaagaatagcatggagaatgggagaccacctgatccagccgactgggctgtgatggatgtggttaactacttcagaacggtgggtttcgaggagcaggcaagtgctttccaagagcaagagattgacggtaagagcctgctgctaatgacccggaacgacgttcttaccggcctgcaactcaaactgggtccagccttaaagatctatgagtaccacgtgaaaccgctgcaaacgaagcatctgaagaataatagctcctag

SEQ ID NO: 20754 - DNA, 351 bp, Artificial Sequence
  Description of Artificial Sequence: Synthetic coding sequence
atgcggggcgtggccgaggtgaaggagccctgcagcctgcccatgctaagtgtggatatggagaataaagagaacggatctgtcggagtaaagaattcaatggagaatggcagaccacccgaccccgcggactgggcagttatggatgttgtgaactacttccggaccgtcggtttcgaagagcaggctagtgcattccaggagcaggaaatcgacggaaagtccttactactaatgacaaggaacgatgtgctgacaggtctgcagcttaaactcggtccggctctgaagatttatgagtaccacgtgaagcctctgcaaacaaagcacctgaagaacaactcgagctag

SEQ ID NO: 20755 - DNA, 309 bp, Artificial Sequence
  Description of Artificial Sequence: Synthetic coding sequence
atgctgagcgtggacatggagaacaaggagaacggcagcgtgggcgtgaagaattccatggaaaatgggaggcccccagatcctgccgactgggccgttatggatgtggtgaactactttcgcactgttggttttgaagaacaagcctctgccttccaggagcaggagattgacgggaaaagcctgctgctgatgacgcgcaacgacgtgttaacagggctacagctgaaactgggacccgccctgaagatctatgagtaccatgtgaaaccactccagactaagcacttgaagaacaacagcagttag

SEQ ID NO: 20756 - DNA, 3666 bp, Artificial Sequence
  Description of Artificial Sequence: Synthetic coding sequence
atgatcaccagcgagctgcccgtgctgcaggacagcaccaacgagaccactgcccatagcgatgccggaagtgagctggaggaaaccgaagtcaagggaaaaaggaaaagaggaagaccaggccgccctcccagcaccaacaaaaagcctaggaagtcacctggagaaaagagcagaatcgaggcaggtatccgaggggcaggccggggccgggccaacggccaccctcagcagaacggagaaggtgaacccgtcacactgtttgaggtggtgaagctcgggaaaagcgcaatgcagtctgttgtagatgactggattgaatcctataaacaggatcgtgacattgctctgctggacctaatcaacttcttcatccaatgctccgggtgtcggggtaccgtccgcatcgaaatgtttcggaacatgcagaacgccgagattattaggaagatgaccgaggaattcgatgaggattccggggactatcccctcacaatgcccggtcctcagtggaagaaatttcgatccaacttctgtgagttcattggggtactaataaggcaatgtcagtattcgataatctatgatgagtatatgatggataccgtgattagcctactcactggcctgagtgactctcaggtgagagcatttcggcatacatctactcttgcagccatgaagttaatgaccgctctggtgaatgttgccctgaatctaagcatccaccaggataatacccagcgccagtacgaggccgaacgcaacaagatgatcggaaagagggccaatgaaagattggagctgttgctccagaaaaggaaagaattgcaggagaaccaggatgaaatcgaaaacatgatgaactctatctttaagggaattttcgttcaccgctatagagatgctatcgcagaaattagggccatctgtatagaagaaatcggagtgtggatgaagatgtacagcgacgcattcctgaatgacagctatctaaagtatgtgggctggactcttcatgatcgccaaggagaagtccgtctgaagtgcctcaaagctctccagtccctctacacaaaccgcgaattattcccaaagttagagctctttacaaataggtttaaggacagaattgtctctatgacgctggacaaggagtatgacgttgctgtggaggctatccggctagttacacttatcctccacggaagtgaagaagccttatccaatgaggactgcgaaaacgtctaccatcttgtgtacagtgcccaccggccagtcgccgtggctgccggtgaatttctgcacaaaaagctcttctcgcgacacgacccccaggcagaggaggcactggccaagagacgtggtcgcaacagcccaaacggcaatttgattcgtatgcttgtgctctttttccttgaatccgaactgcacgagcacgctgcttacctagtggactctctgtgggagagctcccaggaactgctcaaggattgggagtgcatgaccgaattgctgctcgaggaacctgtgcagggggaggaggccatgtccgaccgacaggagtccgcactcatagaactgatggtgtgtactatcagacaggccgccgaggcacacccacccgtgggacggggcactggtaagagggtcctgacagctaaggaaaggaaaacgcagatcgatgacagaaacaaactgacagaacatttcataatcactctgccaatgctgctgtcgaaatattctgcagatgccgagaaagtagcaaacttgttgcagatacctcagtacttcgacttagagatctattctacaggcagaatggagaaacacctggatgcactgctcaagcagatcaagtttgtggtggagaagcacgtagagtccgacgttcttgaggcgtgctctaaaacatactccattctgtgctccgaagagtacacaatccagaatcgcgtcgatatcgcccgatctcaactcattgatgagttcgtcgacagattcaatcatagtgtcgaggatcttctgcaggaaggcgaggaagcagatgacgacgatatctacaacgtgctgtcaacactgaaaagactgactagcttccacaacgcccacgatctgacaaaatgggatctgttcggcaattgctatcggttgctgaaaaccgggattgagcatggagccatgcccgagcagatagtggttcaggccctgcagtgtagtcactacagcatcttatggcaactggttaaaatcactgatggcagcccctccaaagaggatctgctggttctgcggaaaaccgtaaagagctttttggccgtatgtcagcaatgtttaagcaacgtcaacacaccagtgaaggagcaggcttttatgctgctgtgtgatctgctcatgatcttctctcaccagttaatgacagggggccgtgaagggctccagcctctcgttttcaaccccgataccggactgcaatccgagctgctctcgtttgtgatggatcacgtattcatagatcaggacgaggaaaatcagtcaatggagggcgatgaagaggatgaggctaataaaatagaggccctgcacaaacggaggaacctgctggctgcttttagcaagctgatcatctacgacattgtggatatgcacgcagccgctgacatattcaaacattatatgaagtattacaatgattatggagacatcattaaagaaaccctcagcaaaacaagacagatcgacaagatccagtgcgctaagactctaatcctttctctgcagcaattgtttaacgagctggtgcaggagcaggggcctaatttggacaggacctctgctcatgttagcggtattaaagaattggcccgccgattcgccctgacatttggactggaccagattaagacacgggaggcagtggcaactttacacaaggatggaatagaattcgctttcaaatatcagaaccagaagggccaagagtaccctccacccaatttagctttccttgaggtcctgagcgaattcagctccaaattgcttcggcaagacaaaaagaccgtgcactcatacctggagaaatttctcacagagcaaatgatggagcgcagagaggacgtttggctccctctaatttcatatcgaaattcgctggtgactggaggagaagacgacaggatgtctgtgaattctggctcctcatcttctaaaacgtcatccgttaggaataaaaaagggaggcctcctttgcataagaagagagttgaggacgagagcttggacaacacctggctgaacaggacagacacaatgatacaaacaccaggcccgctgcccgcaccacaattaacaagcactgtactgagagagaactctcgccccatgggggatcaaatacaagaacccgagtcggaacacgggtcggagccggatttcttacacaatcgggggctcatggaggaagacgctgagcctatttttgaggatgtgatgatgtccagcaggagtcagctcgaagatatgaacgaagagtttgaagatacaatggtgatcgacctcccaccgagccggaacagaagggagagagccgaactgcgaccagacttcttcgattccgctgccattattgaggatgattcaggtttcggtatgcctatgttttag

SEQ ID NO: 20757 - DNA, 3777 bp, Artificial Sequence
  Description of Artificial Sequence: Synthetic coding sequence
atgatcaccagcgagctgcccgtgctgcaggacagcaccaacgagactactgctcattcagacgctggaagtgaactcgaggagactgaagtgaagggcaagaggaaaagaggcagaccggggagaccgccctccacaaacaagaagcctcgcaaaagccccggagaaaaatcccgtattgaggcaggaataagaggagctggtcggggcagagccaacgggcatccacagcagaacggggagggtgagcctgtgactttgtttgaagtagtcaagctcggaaagagtgcaatgcagagcgtggtcgatgattggatcgagagctacaaacaggatagagatattgcccttctggacttgatcaacttttttatacagtgctccggatgtcggggcaccgtgcggattgaaatgttcaggaatatgcaaaacgccgagattattcgaaaaatgactgaggaatttgatgaagacagcggcgattatcctctgaccatgcccggtccccaatggaaaaagttcagaagcaacttttgcgaatttatcggagtcctaatcaggcagtgccaatattcaataatctatgacgagtacatgatggacacggtgatttcgttactaactgggctctccgactcccaggtacgggcatttaggcacaccagcacgctcgccgccatgaaactgatgacagctcttgtaaacgtggctctcaatctgagcattcatcaggacaacacccagcggcaatacgaggctgaacgtaacaagatgatcggaaagagagctaatgagaggctcgagctactgcttcagaaaaggaaagagttacaggagaaccaggatgaaatcgagaacatgatgaacagtattttcaaggggattttcgtccatcgttaccgggatgctatcgctgagattagagccatttgcatcgaggaaattggcgtatggatgaagatgtactcggacgccttcttaaatgactcatatttaaaatacgtgggctggactcttcatgaccggcagggcgaggtgcgcctgaagtgtctgaaagccctgcaatcactgtacactaacagagaactgttcccaaaactagagttattcacaaaccgcttcaaggatcgaatcgtctctatgactctggataaggagtacgatgtagccgttgaggctatccggctggtgaccctcattctgcatggaagcgaggaggccctgtcgaatgaagattgtgagaatgtgtaccacttggtgtattctgctcaccgccctgtcgcagtggcagccggagaattcctccataagaaactgttttcacgtcatgatcctcaagctgaagaggcactggctaagcgccgggggcgcaactccccgaatggaaaccttatcaggatgctggtgctgttcttcctggaatcagaacttcacgagcatgccgcgtacctcgtggattctctctgggagtcatcccaggagctgctcaaggattgggaatgtatgacggaactgctgctggaggaaccagtgcagggtgaagaagctatgtctgatcgacaggagtccgctctgattgagctcatggtctgcaccatcagacaggccgctgaggcccatcctccggttggtcgtggtaccgggaagcgagttctgaccgcaaaagaacgcaagactcagatcgacgataggaacaaactaaccgagcatttcattattaccctcccaatgctgctgtccaagtacagcgccgacgctgaaaaagtggcaaacctgctgcagattccccagtattttgatttagaaatctattccaccggtcggatggaaaaacatctggacgcattgctcaagcagatcaagtttgtggttgagaaacatgtagagagcgacgtgctcgaggcgtgcagtaaaacatatagtatcctttgctctgaagaatatacaatccagaatcgggttgacattgctagatcacagttgattgatgaatttgtcgaccggttcaatcatagcgtcgaagacctcctccaggagggcgaagaggcagacgacgacgatatctataatgtgctgagcactttaaaacgcctcacctccttccacaacgcgcatgacttgacaaagtgggatctgttcggtaattgctatagattgctcaaaactgggatcgaacacggcgccatgccagaacaaattgtagttcaagcgctgcagtgtagtcattactcaatcttatggcagctcgtgaagataacagatggaagcccatccaaggaagatctcttagtgctccggaaaaccgtgaaaagcttcctcgctgtatgccagcagtgcctgtcaaacgtaaataccccggtgaaggagcaagcatttatgctcctatgcgacctgctgatgatcttctcacaccagctgatgaccggcggccgagaagggttgcagcctctggtgttcaaccccgatacagggctgcaatctgagcttttgtccttcgtcatggaccacgtgttcatcgatcaggatgaggagaaccagtccatggaaggggatgaggaggatgaggccaacaaaattgaagccctgcataagcggcgcaacctcctcgcagccttcagcaaactgatcatttacgacattgtcgacatgcacgccgccgcagatattttcaaacattatatgaagtattataatgattacggcgatatcattaaggagacactctcaaaaacccgtcagattgacaagattcagtgtgctaagaccttaattctttcgcttcagcagctttttaacgaactggtgcaagagcaggggccaaatctggaccgcacatccgcccatgtctctgggattaaggaactggctcgccgcttcgccctcaccttcggactggaccaaatcaagactagggaggccgttgcaaccttgcacaaagacggaatagaattcgcctttaagtaccaaaaccagaaggggcaggagtacccaccaccaaacctagcgtttctcgaggtcctaagtgagttcagttccaagcttctgagacaagataaaaaaactgttcattcctatctggagaaattcttaactgaacaaatgatggagcggcgtgaagacgtctggttgcctctgatatcatacagaaatagcctcgtgaccggcggggaggatgaccgaatgtccgttaacagcggatcttcctcgagcaaaacaagtagtgtccgtaacaagaaaggcaggccccctttacataagaagcgagttgaagacgaatccctcgacaatacatggttgaacagaacagacaccatgatccaaacccccggtccgctccccgcaccacagctcacctctacagtcctgcgggaaaattcacgtcctatgggagaccagattcaggagcctgagagcgagcatggctcagagccagacttcctccataatccccagatgcaaatcagttggctgggccagcccaaactggaagacttaaaccgcaaagataggactggcatgaactatatgaaagtgcgtacaggggtgcgacatgctgttaggggcttgatggaggaagacgccgagcccatctttgaggacgtaatgatgtcctcacggagccagctggaggatatgaacgaggaatttgaggataccatggtcattgatctgcccccgtcccggaaccggcgggagagggctgagctccggccagatttcttcgattcggccgccattatcgaggatgactcagggtttgggatgccaatgttttag

SEQ ID NO: 20758 - DNA, 2997 bp, Artificial Sequence
  Description of Artificial Sequence: Synthetic coding sequence
atgaagctgatgaccgccctggtgaacgtggccctgaacctgagcattcaccaggataacactcaaagacagtatgaggcggaacgcaataagatgattggcaagcgcgctaatgaacggttggagctactgttgcagaagcgtaaagaactgcaagagaaccaggacgagatcgaaaatatgatgaattcgatatttaagggtatcttcgttcaccgctatagagacgctattgccgagataagagcaatatgcatcgaggagatcggcgtttggatgaagatgtatagcgacgctttcctaaacgatagctacctaaagtacgtcggttggaccctgcacgatcgccagggtgaggtgaggctgaagtgtttaaaagcattgcagtccctctatacaaaccgagagttgttcccaaagcttgaactcttcacgaatcgctttaaagatcgtattgtctccatgactctggacaaggagtacgatgtcgcagtggaagccattcgccttgtaacactcattttgcacggctccgaggaggctctgtctaatgaagactgtgaaaatgtgtatcatttggtgtattccgcacacaggccagtcgcggtggccgcaggagaattcctgcataagaagctgtttagtcggcatgacccccaggctgaggaagctctagcaaagcgacgagggagaaacagtcccaatggcaatttgattcggatgctggtgctcttcttcctggaaagtgagctgcatgaacatgcggcgtacctggtggactctctctgggagtcaagccaggaattgctcaaagattgggagtgtatgaccgagctgttgctggaagaaccagttcagggcgaagaggccatgagcgatcgccaagaatctgcactgattgagctaatggtgtgcacaatcaggcaagccgccgaggcccatccacctgtaggccggggcacggggaagagagtgctgaccgcgaaggaaagaaagactcaaattgacgatcgcaacaagttgaccgaacacttcatcattacgctccccatgctactttccaaatactccgcagatgctgaaaaagtggctaacttgctccagatacctcagtactttgatctggagatatacagtacagggagaatggaaaaacacctggacgcgttgcttaagcagatcaagttcgtcgtcgagaaacacgtggagagcgacgttcttgaggcttgctccaagacctacagtattctatgctcggaagaatacacaatccagaatcgggtcgacatcgcccgatctcagcttatagatgagtttgtggacaggtttaatcactcagttgaagacctgctgcaggaaggcgaagaggcggatgatgacgacatctataacgtgttgtccacactgaaaaggctgactagcttccataacgctcatgacctgactaaatgggatctcttcggtaattgttatagactcctgaagacaggaatcgagcacggtgccatgccagagcagattgttgtgcaggctctacagtgttcacattattcgatactgtggcaactcgtgaaaataacagacggcagtccttcgaaggaggatctactggtcttgcgcaaaaccgttaaatcctttctggctgtgtgccagcaatgtctgtctaacgtgaatacccccgtgaaggagcaggcattcatgctgctgtgcgaccttctgatgattttctcccatcaacttatgacgggcggacgagaggggctacagccactcgtcttcaacccagacaccggtctgcagagcgagttactgagctttgtgatggatcacgttttcatcgaccaagacgaagagaaccagtccatggaaggagatgaggaagatgaggcaaacaaaatagaggctctgcacaaaaggagaaatttgctggccgcatttagtaagttgattatttatgatatcgtcgatatgcatgctgctgccgacatcttcaagcattacatgaagttatttaacgaactggttcaagagcagggaccaaacctggatcgaacatcagcgcacgtgtctggtatcaaggagcttgcccgtcgatttgccctgacttttggtctggatcagataaagacccgggaggcggtggccacgctacataaggatggaatagagttcgcgttcaaataccagaaccagaagggccaggagtatccaccgcccaatttggccttcctggaagtcttgagtgaatttagcagcaaactgctcaggcaggacaagaaaacagtacactcatatctggagaagttccttacagagcagatgatggaaaggagagaagacgtgtggctgccattaatctcatataggaatagtttggtcacgggaggggaggacgaccgtatgagcgtaaatagcggctcatcttcttctaagacctcttctgtgagaaacaagaagggtagacccccattgcacaaaaagcgtgttgaagacgaaagtctcgataacacatggctgaatagaaccgacaccatgatccaaacacctgggccgttgcccgcgccccagctcacttctaccgtgctccgtgagaactcacgcccgatgggcgatcagatccaggaaccggagagtgagcatggatctgagcctgatttcttgcacaatcctcagatgcaaatctcttggctaggacagcctaagctcgaagatttaaaccgcaaagacaggacaggcatgaattatatgaaagtgagaacaggggttaggcatgccgtgcgtggattgatggaggaagacgccgagccaatcttcgaggatgtaatgatgtcctccagatcccagcttgaggatatgaacgaagaattcgaagatacgatggtcatcgatctaccccctagtagaaatcgcagagagcgtgcagagctccggccagatttttttgactcagctgcaataatcgaggacgactcaggattcggaatgccaatgttctag

SEQ ID NO: 20759 - DNA, 2529 bp, Artificial Sequence
  Description of Artificial Sequence: Synthetic coding sequence
atgaccctggacaaggagtacgacgtggccgtggaggccatccggctcgttacgctcattctccagctcttcagccgccacgacccccaggccgaggaggcgctggccaagcggcgaggccggaacagccccaacggaaatctgatcagaatgctcgtcctcttttttctggagagcgagttgcacgagcacgccgcatatttggtggacagtctttgggaatccagccaagaacttctgaaagattgggaatgcatgaccgagcttttgctggaagagccggtgcagggagaagaggccatgagtgatcgtcaggagtctgctttaattgaattgatggtatgcacgattcggcaagcggcagaagcccaccctcctgtagggagaggcactggtaagcgcgtgctaaccgctaaggagagaaagacacagatcgacgaccgaaataaactcacagagcactttataatcactctccctatgttgctgtcaaagtactcagccgacgcagagaaggtggctaaccttcttcaaattcctcagtactttgatctggagatttactccacggggcgcatggaaaaacatctcgatgctcttcttaaacagatcaagttcgtcgtggaaaagcacgtagagagcgacgtgttggaagcctgcagcaagacatattcaatcctctgcagcgaagaatatactatacagaatagggttgacatagctcggagtcagctgattgacgaattcgtggatcggttcaaccatagcgtggaggatctgcttcaggaaggagaggaagcagatgatgacgatatatacaacgtgctatctacgctcaagcggctcacatctttccacaacgctcatgacctaactaaatgggacctctttgggaattgctaccgacttctgaaaacaggcatcgagcacggagcaatgcctgagcagatcgtggtgcaggccctgcagtgcagccactatagtatattatggcagctggtgaagatcaccgacgggagtccaagtaaggaggacctgctggtgttgagaaaaactgttaagagctttctggcggtgtgccaacagtgtctcagcaatgtgaatacccccgtaaaggagcaggcctttatgctgctgtgcgatcttctcatgatcttttcacaccagcttatgaccgggggacgtgaggggctgcaacccttggtgttcaatcctgacaccggcctccagagtgagttactttcttttgttatggaccacgtgttcatcgaccaggatgaagagaaccagagtatggagggggacgaagaggatgaggctaacaagattgaggccctgcataagagacgaaatctgctagccgcctttagcaaactgatcatctatgacattgtcgacatgcatgccgcggccgacattttcaaacattatatgaaatattacaatgactatggcgatattattaaggagaccctctccaagactcgccagattgacaagatacaatgcgccaaaacacttattctgagcctgcagcaattgttcaacgagctcgtgcaggagcagggcccaaatctcgatagaacctccgcacatgtttcaggcattaaagagctcgcccgtcgttttgctttgactttcggtctggatcaaattaaaactagagaggccgtggcgaccctgcataaggatggaattgagtttgccttcaagtaccagaaccagaagggtcaagaatacccaccccctaacttagcctttctggaagtgctgtctgaattttcttcaaagctattacggcaggataagaagaccgtccatagttatttggagaagtttttgaccgaacaaatgatggaaaggcgagaggacgtctggctgccactaataagttacagaaatagcttggtgacaggcggcgaggatgacagaatgagcgtcaattctgggtccagtagcagcaaaacctcttccgtgcgaaataaaaaaggccggccccctctgcacaaaaagagagttgaggatgagagcctagataatacctggctaaacagaactgataccatgatccaaacacctggcccattgcccgccccccagcttaccagtactgtgctgcgagagaactctcgccccatgggggaccaaattcaggaacccgagagtgagcacggctcagagcctgatttcttacataaccctcaaatgcagatctcatggctgggacagcctaagctcgaggacctgaataggaaagacaggaccgggatgaactatatgaaggtgcgaacaggggtcagacatgccgtgagaggactcatggaggaggatgccgagcctatttttgaggacgtaatgatgagttcaagatcacagctcgaagacatgaacgaagaattcgaggataccatggtaatagatttaccgccttccagaaatcgacgcgagcgggccgagcttagacctgacttctttgattccgctgctataattgaggatgattccgggtttgggatgcccatgttctag

SEQ ID NO: 20760 - DNA, 405 bp, Artificial Sequence
  Description of Artificial Sequence: Synthetic coding sequence
atgatcttcagcatgctgcggaagctgcccaaggtgacctgccgggatgttctgccagaaataagggctatctgcatcgaggaaattggatgctggatgcagtcttactcaacaagcttcttgactgatagctacctgaaatacatcgggtggacactgcacgacaagcaccgagaagttcgtgtgaaatgtgtcaaggcgctaaaggggctgtacgggaaccgggatcttactgcccggctggaattgttcaccggccggtttaaagactggatggtgtccatgatcgtcgatagagaatacagcgtagctgtagaggctgtgcggctgctcattttgatcctgaagaacatggagggagtgctgatggacgtcgactgcgagtcagtgtaccccatcgtatag

SEQ ID NO: 20761 - DNA, 618 bp, Artificial Sequence
  Description of Artificial Sequence: Synthetic coding sequence
atgatcttcagcatgctgcggaagctgcccaaggtgacctgccgggatgtcctacccgaaattcgcgctatttgtattgaggaaatcggttgttggatgcagagttacagtacatcctttctcaccgacagctaccttaaatatatcggctggacacttcacgataagcacagggaagtgcgggtgaaatgtgtcaaagctcttaaaggcctgtacggcaaccgggatctcacagcacggttagaactctttacaggtcgattcaaagactggatggtctccatgattgtggatcgtgagtattcagtagctgtagaagctgtaaggctcctgattctgatcctgaagctgttttatccggagtgcgagatcagaaccatgggcggcagggaacaaagacagagccccggtgcccagcgcaccttttttcagcttctgttgagtttcttcgtggaatccaaacttcacgatcacgctgcctacctcgtggacaacctgtgggactgcgccggaacccaacttaaggattgggagggcttgacctctctgctgctggagaaggatcagagcacctgccacatggaaccaggccctggcaccttccatctgctcggttag

SEQ ID NO: 20762 - DNA, 456 bp, Artificial Sequence
  Description of Artificial Sequence: Synthetic coding sequence
atgcagcaccgggaggtgcgggtgaagtgcgtgaaggccctgaagggtctgtacggaaatagagatttgacggccagacttgagctctttacgggacggtttaaggattggatggtctcaatgatagtggaccgggaatacagcgtagctgtagaggctgtgcggctcttaatactcattctcaagcttttctacccggaatgtgagattcgtaccatgggcggacgcgagcagcggcagagcccaggagcccagaggactttcttccagctgctcctatcttttttcgtggagtccaagctgcacgatcacgccgcatacctggttgataacctgtgggattgtgcgggaacacagctgaaagactgggagggcctaacatctttgctgctggagaaggatcagtctacttgccatatggaaccaggcccgggcacattccatctgttagggtag

SEQ ID NO: 20763 - DNA, 387 bp, Artificial Sequence
  Description of Artificial Sequence: Synthetic coding sequence
atgatcttcagcatgctgcggaagctgcccaaggtgacctgccgggatgtgctcccagagattagagccatctgtattgaggagatcggatgttggatgcagtcttactcaacatcatttcttacggacagctatctgaagtacatagggtggacgctgcatgacaaacatcgtgaagtgcgggtgaaatgcgttaaggcgttgaagggcctctacggcaatcgcgatctgacagcacggctggagctgttcaccggtaggttcaaagactggatggtgtctatgattgtagacagagagtacagcgtcgccgtcgaggccgtcagactgttaattcttatcctgaagatcggttcacagactccagctacgcgggagtgtatctag

SEQ ID NO: 20764 - DNA, 378 bp, Artificial Sequence
  Description of Artificial Sequence: Synthetic coding sequence
atgcagcaccgggaggtgcgggtgaagtgcgtgaaggccctgaagggcctctacggcaatagagatctgacggctcgactggagctgttcacaggtcggtttaaagattggatggttagcatgatagtcgaccgagagtacagtgtggcggttgaggccgtgcgcctgctgatcctgatccttaaactcttttatccagagtgtgagattagaaccatggggggccgtgagcaaagacagagtcccggtgcccagagaacattcttccagctgctgctgagcttctttgtagaatccaaggtgacttatacagagcggacccttgccgtcgtacaccgcacctataaatgggctggggtgggggggtccaggctttag

SEQ ID NO: 20765 - DNA, 240 bp, Artificial Sequence
  Description of Artificial Sequence: Synthetic coding sequence
atgggcggccgggagcagcggcagagccccggcgcccagcggaccttttttcaactgctcctgagtttcttcgtggaatccaaacttcatgatcatgcagcctatctagttgacaatttgtgggattgcgccgggacccagctcaaagattgggaagggctcacatcgctgctgctggaaaaggaccagagcacatgccatatggagcccggccctggaacattccatctgctcggatag

SEQ ID NO: 20766 - DNA, 405 bp, Artificial Sequence
  Description of Artificial Sequence: Synthetic coding sequence
atgatcttcagcatgctgcggaagctgcccaaggtgacctgccgggatgtgctgccagaaatccgcgctatatgcattgaagaaattggttgctggatgcaaagttactccacaagttttttaacagacagctatcttaagtatattggatggactctgcatgataaacatagagaagtccgagttaaatgcgtcaaggcgttaaaggggctctatggcaatagagatctcacagcccgtctggagctgttcaccggaaggttcaaagattggatggtatcgatgatcgtcgatcgcgaatatagcgtggccgtcgaagcggtacgtctcttgatattaatattgaaaaatatggaaggagtgctgatggatgtcgattgcgaatccgtttacccaatagtgtag

SEQ ID NO: 20767 - DNA, 405 bp, Artificial Sequence
  Description of Artificial Sequence: Synthetic coding sequence
atgatcttcagcatgctgcggaagctgcccaaggtgacctgccgggacgtcttgcccgagatacgggccatatgcatcgaggagattggctgctggatgcagtcttactcaacaagctttctaacggattcctatctgaagtacatcgggtggactctgcacgataaacacagagaggttcgggtgaagtgtgttaaagccctgaagggattgtacggcaatcgggacctcaccgctagacttgaattgttcaccggacgtttcaaagactggatggtctccatgatcgtcgaccgggaatactccgtggccgttgaggcagttcgactcctaatactcatcctcaagaacatggaaggagtcctgatggatgtagattgtgagagcgtatatcccatcgtgtag

SEQ ID NO: 20768 - DNA, 405 bp, Artificial Sequence
  Description of Artificial Sequence: Synthetic coding sequence
atgatcttcagcatgctgcggaagctgcccaaggtgacctgccgggacgtgctgcctgagattcgcgccatctgcatcgaggagatcggctgctggatgcaatcttattcaacgagcttcctgaccgactcgtacctaaaatatattggatggactctccacgacaagcaccgcgaggtgagagtgaaatgtgtaaaggcacttaagggactgtatggaaacagagacctgaccgctcggctcgagctgtttacggggcgcttcaaggattggatggtgagcatgattgtcgatcgagagtacagtgtggccgtcgaggctgtcaggctcttgatccttattctaaaaaatatggagggggtgcttatggatgttgactgcgagtctgtctaccccatcgtgtag

SEQ ID NO: 20769 - DNA, 618 bp, Artificial Sequence
  Description of Artificial Sequence: Synthetic coding sequence
atgatcttcagcatgctgcggaagctgcccaaggtgacctgccgggatgtactgcccgaaatccgtgccatctgtatcgaggaaatcggatgttggatgcagagttacagcacatctttcttgaccgatagctatttgaagtacatcggctggactctccacgacaagcaccgcgaggtacgggtgaagtgtgttaaagcccttaagggactctacgggaatcgtgacctcaccgcccggctagagctctttactggctgcttcaaagattggatggtatctatgattatggatagagaatactccgtggctgtggaggccgtgcgactcctgattctgatcttaaagcttttctaccctgagtgcgaaattaggacgatgggcggtagggagcagagacagagtccaggagctcagcggacatttttccagctcctgctttcgttttttgtcgagtccaagctacacgatcatgcagcctatctggtggacaacttgtgggactgcgccggaacccagttgaaagactgggaggggttgaccagcctgttgttggagaaagaccagtctacttgccacatggagccagggcctggcacgttccacctgctggggtag

SEQ ID NO: 20770 - DNA, 405 bp, Artificial Sequence
  Description of Artificial Sequence: Synthetic coding sequence
atgatcttcagcatgctgcggaagctgcccaaggtgacctgccgggacgtgcttcccgagatccgagctatctgtatcgaggagattgggtgttggatgcagtcctactccaccagtttcctgaccgactcatacttgaaatatattgggtggactctgcacgacaagcacagggaagttcgagtgaaatgtgtcaaagcactgaagggactgtacggcaatcgtgatctgaccgcaaggctagagctatttactgggtgcttcaaagattggatggtgtctatgatcatggatagggagtattcagtggcagtcgaggccgtgcggctcctgatacttatcctcaagaacatggagggtgtgctgatggacgtggattgcgaatctgtgtacccaattgtgtag

SEQ ID NO: 20771 - DNA, 456 bp, Artificial Sequence
  Description of Artificial Sequence: Synthetic coding sequence
atgcagcaccgggaggtgcgggtgaagtgcgtgaaggccctgaagggactctacgggaacagggatctgacagcccggctcgagcttttcaccggatgctttaaggactggatggtgagtatgatcatggatagggaatattcggttgctgttgaagccgtccggctgctcattttaatcctcaagttgttttaccctgaatgtgagataagaactatgggcggccgcgaacaacggcaatctcccggggcacagcgaaccttctttcagctgctgctgtcattctttgtagaatctaagctgcatgatcatgccgcctatctggtggacaacctgtgggattgcgccggaacccagctgaaggattgggagggccttacgagtctactgctggaaaaggaccagtccacatgccacatggagcccggcccaggaacctttcacttgcttgggtag

SEQ ID NO: 20772 - DNA, 351 bp, Artificial Sequence
  Description of Artificial Sequence: Synthetic coding sequence
atgatcttcagcatgctgcggaagctgcccaaggtgacctgccgggatgttctgccagaaatcagggccatttgcatcgaagagatcggatgctggatgcagtcttactcgacatcatttctgactgattcctacctgaaatacatcgggtggactctacatgacaagcaccgagaagtccgagtgaagtgtgtgaaggctctcaagggtctgtacggcaatagggacctgacagcccggttggaactgtttacaggctgttttaaggactggatggtttccatgatcatggacagagagtactctgtagccgtggaggccgtacgactgctgatactgatcttgaaatag

SEQ ID NO: 20773 - DNA, 3708 bp, Artificial Sequence
  Description of Artificial Sequence: Synthetic coding sequence
atggcccacctggagctgctgctggtggagaacttcaagagctggcgtggcagacaagtcataggcccctttagaagatttacatgcatcattggcccaaatgggtcggggaagtctaatgttatggatgctctcagtttcgtgatgggggaaaaaattgccaacctccgagttaagaatatccaggaactgattcacggcgctcatataggaaagccgattagtagctccgctagcgtgaaaattatctacgtggaagaatctggggaagaaaaaaccttcgccagaatcatccgcggcggctgtagcgaatttcgctttaacgacaatctggtgtcacggagcgtttatatcgcggagctggagaaaattggcattattgttaaggcccagaattgtctggtctttcagggcaccgtcgagagcatctctgtcaagaagcccaaggaacggacgcagttcttcgaagagatctctactagcggggagctcattggagagtacgaggagaagaagaggaaactccaaaaggctgaagaagatgcccagtttaacttcaataaaaagaaaaacattgccgccgaacggcgccaggccaagctcgaaaaggaagaggccgagcgctatcaatctctgctggaagagcttaagatgaacaaaattcagctgcagttattccagctctatcacaacgagaagaaaatccatcttctcaacaccaaactagaacacgtaaatagagacctcagtgttaagcgagaatctctctcccatcacgagaacatcgtcaaggcaaggaaaaaggaacacggtatgctgacacggcagctgcagcaaacagagaaggaactgaaaagcgtggagaccttgctcaaccaaaagagaccacaatacatcaaagctaaagagaacacttcgcatcacctaaaaaaattggacgtggccaagaagtcgattaaagacagcgagaaacagtgtagcaagcaggaggatgatataaaagccctggagacagagcttgctgatctggatgctgcatggagaagcttcgaaaagcagatcgaagaggagattctccataagaagagagatattgagttggaagcttctcagctggaccgctacaaggagttaaaggagcaggtgcggaaaaaagtcgccactatgactcagcagcttgagaagttgcagtgggaacaaaaaaccgacgaggaacggctcgccttcgagaagaggagacacggagaggtgcaggggaatctgaagcagattaaggagcaaatagaagaccataaaaagagaattgagaagctggaagaatatactaagacatgcatggactgcctgaaggaaaagaagcagcaggaggaaacgttggtggacgaaattgagaagacaaagtcacgaatgtcagagttcaatgaggaactgaacctcattagatcggaattgcaaaacgctggaatagacacccacgaaggaaagcggcagcagaaacgggccgaggtactggagcatctcaagcgcctgtatcctgattctgttttcggacggctgttcgacttatgccatcccatccataaaaagtaccaactggcagtcacgaaggttttcgggagatttattacagctattgttgtggcttccgagaaagtcgctaaggactgcatccggtttctgaaggaggaacgcgccgaaccagaaacgttcctggctctggattatctggacatcaaacctatcaatgaaaggctgcgggagcttaaggggtgtaagatggtgatagatgtcataaagacacaatttccccagctgaaaaaggtcatccagtttgtctgcggaaatggactggtgtgcgaaacgatggaggaggcgaggcacatcgccctgtccggacctgagcgccagaaaactgtggctctggatggcacccttttcctgaagagcggcgtgatcagcggcggaagctcggatttgaagtacaaagcgaggtgctgggatgagaaggagctgaagaacttgagggatcggcgttcacagaagatccaggagttaaagggcctgatgaaaacactcagaaaggagacagaccttaaacagatccagactctgatccaagggacccagacgagactcaaatactctcagaatgaactcgagatgatcaagaaaaaacacctcgttgccttctaccaggagcaaagtcagttacagagcgaactcttaaatattgagtcccagtgcatcatgctcagtgaagggatcaaagaaaggcagcgcaggattaaagagtttcaggaaaagatagacaaggtggaagacgacatctttcagcacttctgcgaagagatcggcgtggagaatattagggagtttgagaataagcacgtgaagaggcagcaggaaatcgaccagaaaaggcttgagtttgagaagcagaaaaccaggttaaacgttcagctcgagtattcacgctcgcatcttaaaaagaagctcaacaaaatcaacaccctaaaggaaacaatccagaaagggtccgaggatatcgatcaccttaaaaaagctgaagagaattgtctccagacagtcaacgagctcatggcaaagcagcagcagttgaaagacattcgggtgacccagaatagcagtgctgagaaggtgcagactcagattgaagaggaacgaaagaagttcctggccgtcgatcgagaggtcggcaagctgcaaaaggaggtggtgagcattcagacttctctggagcagaagagattagaaaagcacaatcttctacttgattgcaaggtccaagacattgagataatcctgttaagcggctccttagatgatattatcgaggtcgaaatggggacagaagctgagtccacacaggcaacaatcgatatatacgaaaaagaagaagcttttgaaattgactactctagcctaaaggaagacctcaaagcactccaatctgaccaagagattgaggcgcacttacgtctcctgctgcagcaagtcgcatcacaagaggacatcttgctgaagaccgccgcccccaatctgcgggcactagaaaaccttaaaacagttagggacaagtttcaggaatcaactgacgcttttgaagcgtcacgaaaggaagcccgcttgtgtcgacaggagttcgaacaggtaaaaaagagacggtacgatctatttacccagtgtttcgagcatgtttctatctcaattgaccagatttataagaagctgtgtagaaacaacagcgcacaagccttcctaagccctgagaatccagaggagccctatttggagggtatctcttacaattgcgtggctccagggaagagattcatgcctatggacaatctctccggcggtgagaaatgcgtggccgccttagcccttttgttcgccgtacactcattcagaccagcccctttttttgtgctggatgaggtggacgccgctctcgacaacacaaatatcggaaaagtgagctcctatataaaggaacaaactcaagaccagtttcagatgatcgttatcagcctgaaagaggagttctatagcagggccgatgctctcatcggcatctacccagaatatgacgattgtatgttctcacgcgtgctgacactcgatctttcccagtatcccgacacagaaggacaggagtcctccaagcgacacggcgagtctagatag

SEQ ID NO: 20774 - DNA, 3486 bp, Artificial Sequence
  Description of Artificial Sequence: Synthetic coding sequence
atggcccacctggagctgctgctggtggagaacttcaagagctggcgaggacgacaggttattggacctttccgccgcttcacgtgtatcatcggccccaatggcagtggtaaatcaaatgtcatggacgcgcttagcttcgtaatgggggaaaagattgcgaacctaagagtaaaaaacattcaggagttaattcatggggcccacatcggtaaaccgatttcgagcagcgcaagcgtgaaaattatatacgtcgaggaaagtggtgaggagaaaacattcgccagaatcatccgcggaggatgctcagaatttcgctttaatgataatctcgtgagccggtcagtgtatattgctgagctggagaagatcggaatcatcgtcaaggctcagaattgtctggtgttccaaggaactgtggaatcgatatccgtcaaaaagcccaaagagcggacgcagttcttcgaagagatctcaacatccggagagctaattggtgaatacgaggaaaagaaaagaaagttgcaaaaagccgaagaggatgcccagtttaatttcaacaagaaaaaaaacattgcagccgaacgaaggcaagcaaagttagaaaaggaagaggccgaaaggtatcagtcgttgctggaggaactcaaaatgaacaagattcagcttcagctttttcaactgtatcacaatgagaaaaagattcacctcctgaacaccaaattggaacacgttaatagagacttgtctgtgaaaagggagagtctttctcatcatgagaacatcgtgaaagctcgaaaaaaagaacatgggatgttaactaggcagctgcagcagaccgagaaagagttaaagtctgttgagacactattgaatcagaagcgtccccagtatatcaaagcaaaggaaaatacaagtcaccatttgaaaaaacttgacgttgctaagaagtccatcaaagacagcgagaagcagtgttctaaacaggaggatgacataaaggctctggagactgagctggcagatctcgacgccgcatggcggtcattcgaaaagcagatcgaagaagagatcttgcataagaagcgggatatcgagctggaggcatctcagctggaccgttataaggagctgaaagaacaagtaagaaagaaagtcgcaactatgactcagcaactggaaaagctccagtgggagcagaaaaccgacgaagagagactcgcttttgagaaaagacggcatggggaggtccagggaaacctgaagcaaattaaggagcaaatagaggaccacaagaagaggattgaaaagctcgaagagtacaccaaaacttgcatggattgtctcaaggaaaaaaagcaacaggaggagacactggtggacgagatcgagaagaccaagagcagaatgagtgagttcaacgaggagctcaatctgattcggagcgaactgcagaatgcagggatcgatacgcacgaaggaaaacggcagcagaagagggctgaggtgttggagcaccttaagaggctctatcccgacagtgtctttggaaggctgtttgacctatgtcaccccatccataaaaagtatcagctggccgtcactaaggtctttggccgctttattacagccatagtggttgcttccgagaaggtagcaaaagattgcatcaggttcctcaaagaggagagggctgagccagaaaccttcctcgccctggattatctcgacatcaaaccaattaacgagaggctcagagagttaaagggctgtaagatggtgattgacgtcatcaagacacaattcccacagttgaaaaaggtcatacagttcgtgtgcggtaacggcttggtgtgcgagactatggaggaggcccgacatattgccctgtccggccccgaaaggcagaaaactgtggccttagatgggactctcttcctgaaatccggagtaatctccggcgggtcctcagatttgaaatataaagccaggtgttgggatgagaaagaactgaagaatctgcgcgaccggagatctcagaagatccaagaactcaagggacttatgaagacgctgcgaaaggaaaccgatttaaaacagatccagacactcatccagggtacacagactcgcctcaaatactctcagaatgaattagagatgatcaaaaaaaagcatctagtcgctttttatcaggagcagagccagctccaatccgagttgctcaatatcgagtcgcaatgcatcatgctcagtgagggaattaaagagcgacagcgacgaattaaggagtttcaggaaaagattgacaaagtggaagatgacatcttccagcacttttgtgaagagataggcgttgagaatatacgagaatttgagaataaacacgttaagcgtcaacaggagatcgaccagaagcggctcgagttcgagaaacagaaaaccaggcttaacgtccagctagagtattcgcgatctcacctgaagaaaaaactaaataagatcaataccctcaaggagactatccagaaaggtagcgaagatatagatcacctaaagaaggcagaggaaaactgtctgcagacagttaacgaattgatggctaaacagcagcaactgaaggacatccgcgtgacccagaattcatctgctgagaaggtacaaacgcaaatagaggaggagcggaaaaaatttctggccgtggatagggaggtgggtaaattgcagaaagaagtcgtatcaatccagacttcacttgaacaaaaacgcctggagaagcataatctactccttgattgcaaggtccaggatatcgagattatactgctctctggctccttggacgacattatcgaagtggagatgggcactgaagccgagtctacccaggcaaccatcgatatctacgagaaggaggaagctttcgaaatagactattcatcactcaaggaggacctcaaggcgctccaatccgaccaagaaattgaggctcacctgcgcctcctgcttcagcaggtagcttctcaggaggatattctgttgaagacagctgcgcccaacctcagagcactggagaacctgaagacggtcagggacaagtttcaagaatctacagacgcatttgaagccagtaggaaagaggccaggctgtgcaggcaggaatttgagcaggtgaagaagagacgatatgatcttttcacccaatgcttcgaacacgtctcgatctccattgaccaaatctataagaaactctgcaggaataatagtgcccaggtctccagctatatcaaagaacaaacacaggatcaatttcagatgatcgttatctccctgaaggaagagttttattcaagagctgacgccctgatagggatctatcctgagtatgacgattgtatgtttagccgcgttttgaccctggatctctcccagtacccagacacagagggccaggagtcatctaaacggcatggcgagtctcgctag

SEQ ID NO: 20775 - DNA, 5754 bp, Artificial Sequence
  Description of Artificial Sequence: Synthetic coding sequence
atggccgccgccgacggcggcggccccggcggcgccagcgtgggcaccgaggaagatggcggtggagtggggcaccgtacggtgtatctgtttgatcggcgggagaaggaatccgagctgggcgaccggccacttcaggtgggggagcggtcagactatgcaggctttcgggcttgtgtttgtcagaccctcgggatcagtccagaggaaaaattcgtcatcacaactacctctagaaaggaaataacttgtgacaatttcgacgagactgtgaaagatggagtgaccctatatttactgcagagcgtcaaccaactattactgaccgccactaaagagagaatcgatttcttaccccactatgacactctggttaaatccggcatgtatgaatattatgcctctgaggggcaaaatccgctgccctttgcacttgctgaactgatcgacaattccctgtcagcaactagccgcaatatcggcgtgagacgcatccagattaagctgcttttcgacgagacacaggggaagccagcagtggcagtaatagataatggtaggggcatgactagtaagcaactcaacaactgggctgtgtacaggctgtccaagttcaccaggcagggagactttgagtctgatcacagcggttacgtccgtccagtacccgttccaaggtccctaaattcagacatatcctattttggcgtcggaggaaaacaggccgtcttctttgtgggacagtccgcccggatgataagtaaacccgctgattctcaagatgtgcatgaactggtccttagcaaagaagatttcgaaaagaaagaaaaaaataaggaagctatttatagcgggtacatacgtaatcgaaagccctcagacagtgtgcatattacgaacgatgatgagcgctttttgcaccacttgataatagaggagaaggaaaaggattccttcacggccgtagtaattaccggcgtgcagccagagcatatccagtacctcaagaactattttcatctgtggacacgacagctcgcccacatttatcattactacatccacgggcctaagggaaacgagataaggacctctaaggaggtagaaccattcaacaacattgacatcgaaatatctatgttcgagaaaggtaaagtgcccaaaatcgtgaatttgagagaaatccaggacgacatgcagacactgtatgttaacacagccgccgacagttttgaattcaaagcccatgtcgaaggtgatggtgtggtggaggggattattcgatatcatcctttcctgtatgatagggagacttatcccgacgatccttgttttccctcaaagctgaaggatgaggacgacgaagatgattgctttattttggaaaaggctgctcgcggtaagaggcccatattcgaatgcttttggaacggacgactaatcccttacacgagtgtcgaggatttcgactggtgcacaccgccaaaaaaacgcggcctcgcccctatcgagtgctacaataggatctccggcgccttatttaccaacgacaaattccaggtaagtacaaacaagctgaccttcatggatctagagctcaagctgaaggataaaaacactttgtttacgagaattctgaatggtcaggaacagagaatgaagattgacagagagttcgctctgtggctgaaagattgtcacgagaagtatgataaacaaataaaattcacactctttaagggggtgattacacgtcctgatctgccatctaagaaacaagggccctgggctacatacgcagccatcgagtgggacgggaagatctacaaagccggacagctggtcaagacaattaagactttgcccttgttttatggcagcattgtgcgatttttcttgtatggggaccatgatggagaggtgtacgcgaccggaggggaggtgcagatagcaatggagcctcaagccctctacgatgaggttcgtaccgttccgattgccaagctggatcgcacagttgccgaaaaagcggtcaaaaaatatgtggaagacgagatggctaggttgccagacagattgtccgtcacttggccggaaggagacgagctgctgcccaacgaggtaagaccagcagggaccccaattggggctcttcgaattgagatactgaacaagaaaggcgaagccatgcagaaacttccaggtacctcacacggaggcagtaaaaaactgctcgtcgagctgaaggtgattctgcactctagctccgggaataaagaaattattagccacataagtcaacatggcggaaaatggccatattggtttaaaaagatggagaatattcagaagctgggtaattataccctcaaactgcaagtggttcttaatgagtccaacgctgatacttacgctggcaggcctctcccctctaaagctatcaagttctctgtaaaagaaggcaaacccgagaagttttcattcgggctgcttgacctcccattcagggttggggtacctttcaacataccactggagttccaggacgagtttgggcataccagccaactcgtcactgacatccagcccgtcctggaggcatccggcttgtcactacactacgaggaaatcactaagggaccaaactgtgtgataagaggcgtcacggccaagggcccagtcaacagctgccaaggtaaaaattataacctgaaagtgaccctcccagggctgaaggaggacagtcagattttgaagatcaggttgctgcccggccaccctcgaaggctgaaggtgaaacccgactcagagatcctggtcattgagaatggcaccgcgttccccttccaggtcgaggtgttggacgaatcagacaatatcacggcgcagcccaagctgatcgtgcactgcaagttctccggagctccaaatttgcccgtgtacgtggttgattgttcttctagcggaactagtatcctcactgggtccgcaatccaggtacagaatataaagaaagatcagaccttgaaagcacgaattgagatcccatcctgtaaagatgtagcacccgtggagaagacaatcaaattgctcccctctagccatgttgcacggctgcagatattctctgtggaggggcagaaagcaattcaaatcaagcaccaggatgaggtgaactggattgcaggcgacattatgcacaatctgatctttcagatgtacgatgagggtgagagggaaataaacattacttctgccctggcagagaagattaaggtaaactggacccctgaaataaataaggaacacctcctccagggcctattgccagatgtccaggttccaacatctgttaaggatatgcgctattgtcaggtatcctttcaagacgatcatgtttcactcgaatctgctttcaccgtgagaccgctgccggatgaaccaaaacacctgaaatgtgaaatgaaggggggcaagactgtacaaatgggacaagagttgcagggtgaggttgtgatcatcatcaccgaccagtatggcaatcagatccaggccttcagtcctagcagtctctcaagtttgagcattgccggcgttggtcttgactctagcaatttgaaaactacattccaggagaatacccagagtatctctgttaggggaattaaatttatccccggcccacctggaaacaaagatctttgtttcacatggcgggaattttccgactttatccgagttcagttaattagcgggccaccagccaaactgcttctcatagattggcccgagttgaaggagagcatcccggtgatcaacggccgcgatctgcaaaaccctattattgttcagttgtgcgatcagtgggacaaccctgcccccgtccagcacgtgaagatcagtctgactaaagcttcaaacttgaagctgatgcccagtaatcagcaacataagacagacgagaagggcagggcaaatctgggggtgttcagcgtgtttgctcctagaggagagcacaccctccaagtgaaggctatctacaataaatctattatcgaaggacctattatcaagttgatgatcttgccggaccccgaaaagcccgtgcgccttaatgtgaaatatgacaaggatgcctccttcttggccggaggtctgtttaccgacttcatgatcagcgttattagcgaggacgacagcatcatcaaaaacattaatcccgcccgcatctccatgaagatgtggaaactgtctacctccggaaacagacctccggcaaatgcggaaacctttagttgcaataagatcaaagacaatgataaggaggacggttgcttttacttccgcgataaagttatacctaataaagtagggacttattgcatacaattcgggtttatgatggataagaccaacatcctgaactcagagcaggtgatcgtggaggtgctgccaaatcagccggttaaactggttcccaaaatcaaaccacccacacccgcggtgagtaatgtccgttccgtggccagcaggactcttgtgcgggatctgcatctgagtatcacggacgactatgacaatcacacaggcatcgatctcgtcgggacaattattgcaactattaagggctccaacgaggaagacactgatacgcccctctttattggaaaagtgaggacgctggaattccccttcgtcaacggttctgccgagatcatgtcattggtgctcgcagaatcctctccgggacgagactccacggaatacttcattgtattcgaaccccgacttcctctgctgagtagaacattggaaccttacatactgccatttatgttctataacgacgtgaaaaaacaacagcagatggcagcactcaccaaggaaaaggaccagctctctcagtccatcgtaatgtacaagtccctgtttgaggcctcccagcagttgcttaacgagatgaagtgccaagtggaagaggctaggctgaaagaagcgcaacttcgcaatgaattgaagatccacaatattgacatccccaccacccaacaggtgcctcacatcgaagccctcctgaaacgcaagctgagcgagcaggaggagctaaagaagaagcccaggaggtcctgcactctgcccaactacacaaaaggcagcggcgacgttcttggcaaaattgcccatctggctcagattgaagacgatagggcagccatggtcattagttggcatttggcttctgacatggattgcgtggtcacgcttacaactgacgctgcccgtagaatttacgacgagacccaaggccgccaacaggttctccctctcgattcaatctacaaaaagactcttcctgactggaagaggtcactccctcatttccggaacggcaaactgtattttaagcccatcggagatcccgtgttcgccagggacctgctgactttccccgataatgtggagcattgcgaaaccgtcttcggcatgctactgggtgacaccataatccttgacaatctggacgctgccaaccactataggaaagaggtggttaaaataacgcattgccccaccctgctgactcgggatggcgatcgcattcgctccaacggcaagtttggagggttacaaaataaggcccctcccatggataagctgcgggggatggtctttggtgcaccagtaccgaaacaatgcctcatcctcggggaacaaatcgtccacgcatgcgtacctagctattcaggaggctag

SEQ ID NO: 20776 - DNA, 6018 bp, Artificial Sequence
  Description of Artificial Sequence: Synthetic coding sequence
atggccgccgccgacggcggcggccccggcggcgccagcgtgggcaccgaggaagatggcggaggagtgggacatcgcactgtttaccttttcgatcgacgggagaaggagtccgaactcggagacagaccattgcaagtgggtgagcggagcgactatgctggctttagagcctgtgtttgccaaacgcttggtatttctcctgaggagaaattcgtaatcacaacgacttctcgtaaagagatcacgtgcgataatttcgatgaaacagtgaaggatggggtaactctgtacctcctgcaatcggtaaaccagctgctcctgacggccaccaaggaaaggatcgacttcctcccacactacgataccctagtgaagtccggtatgtatgagtattatgcgtccgaaggccagaatcctcttccttttgccctagcagagctcatcgacaatagtttgagcgctacatctcgcaatattggcgttcgccgtatacaaatcaaactgcttttcgatgaaacccagggcaagccggccgttgccgtgatcgacaacgggcgcggaatgacaagtaagcaacttaacaactgggccgtgtataggctcagcaagttcactcgccagggtgactttgagtctgatcacagtggctatgtacggccggtccctgtgccaagatcacttaattccgatatctcgtattttggcgtcgggggaaagcaggctgtcttttttgtgggacagtcagcgaggatgatcagcaagccagccgattcccaggacgtccacgagcttgttctatccaaggaggatttcgagaaaaaagagaagaataaagaagctatttatagcggatacatccgaaatcgcaagccctccgattccgttcatattacaaatgacgatgaaaggttcttacaccatctgatcatcgaagaaaaggaaaaagactcttttacggcagtggtgattactggggtccaacctgaacatatccagtatctcaagaattatttccacttgtggacccggcagctggctcacatttatcattattacatccacggacccaaaggaaacgagatccgaaccagcaaggaagtggaaccgtttaataatatcgatattgagatctctatgtttgagaagggcaaagtacctaaaattgtcaacttgagagagatccaggacgatatgcagacactctacgtcaataccgccgcagattcattcgaattcaaggcgcacgtggagggcgatggtgtagtggagggcattatcagatatcaccctttcctttatgatcgagaaacctatccagacgatccatgttttccctctaagcttaaggacgaggacgacgaagacgattgtttcattcttgaaaaggctgcaaggggcaaacggcctatctttgaatgcttttggaatggcagattaataccttacacatcagtggaagattttgattggtgtactcctcctaaaaagcgtggactggctcctatcgagtgctacaaccggattagcggcgcactgttcacgaacgataaatttcaggtctctacaaacaagttgacatttatggacctggagttaaaactgaaggataagaacacactgttcacgagaatcctcaatgggcaggagcagcgaatgaaaatcgaccgggagttcgccttgtggttaaaggattgtcacgagaaatatgacaagcagattaagttcaccctgttcaagggcgtgatcactagacctgatcttccgtcaaagaagcaggggccctgggctacttacgcggctatcgagtgggatgggaagatatataaagccggccagctggtcaaaacaattaaaacattacctctgttctatggcagcattgtgcggttctttctgtacggcgatcatgacggcgaagtctatgccacagggggagaggttcagattgcaatggaaccgcaggcactctacgatgaggtccggaccgtgcccatcgcaaagctcgataggactgtggccgaaaaggctgtcaagaagtatgtggaagatgaaatggcccgtctacctgatcggttaagcgttacatggcccgaaggcgatgaactcctccccaacgaggtccgtccagcaggaacgccaattggagctctcaggatcgagatactgaacaaaaaaggcgaggctatgcagaagttgcccggcacctcacacgggggcagcaagaaactactcgtggagctgaaagtgatccttcatagcagtagtgggaacaaggagatcatcagtcacatcagccagcacggcggcaagtggccgtattggtttaaaaaaatggagaatattcaaaagctgggtaactacaccctgaagctgcaggtagtattgaacgagtctaacgccgacacctatgcaggtaggcccttacctagtaaggctattaaattttctgtgaaggaaggaaagccagaaaaattttccttcggacttctcgacctaccttttcgagttggcgtgccctttaacataccactggagtttcaggacgaattcggacacacttcccaattggtcactgatatccagcctgtgttggaagccagcgggctttcactgcactatgaagaaatcacaaaaggccccaactgcgtgatcaggggagtcaccgctaaagggccagttaattcatgccaaggcaaaaattataatttgaaggtcacactacctgggttgaaagaggatagtcagatcctgaagattagacttcttcctggacatccccggagactgaaggtcaaaccggactcagaaatcttagtcattgaaaatgggaccgccttccctttccaggttgaggtgctggacgagtctgataatattaccgcacaaccaaagctcatcgtgcattgcaagttcagcggggcaccaaatctgccagtgtacgttgtggactgtagcagcagcgggaccagcatattaacaggctcagctattcaggtacagaatattaagaaggaccagacccttaaggctcggatcgagattcccagctgcaaggacgtcgcccctgtcgagaaaacaataaaactcttgccctccagccacgtggcccggctgcagattttttctgttgaaggccagaaagccatccagattaagcaccaggacgaagtaaattggatagctggagacatcatgcacaatctcattttccagatgtatgacgaaggtgaacgagagataaatatcacttctgccctggcagagaagattaaggtcaattggacccctgaaatcaacaaagagcacctgctccaagggttgttaccagacgtgcaggtgccaacaagcgtcaaagacatgagatattgccaggtgagcttccaggatgatcatgtcagccttgagtctgcctttaccgtgcgccccctgcccgatgagcctaagcacctgaaatgtgagatgaaaggcggaaagacagtccaaatgggccaggagctgcagggggaggtggtgattatcatcaccgatcagtacggcaaccagatccaggctttctctccgtctagtctctcttctctcagtattgccggcgttggcctggacagcagcaacctcaagactacttttcaagaaaacacacagagcatctctgtgagaggcatcaaattcattcccggtccaccggggaacaaagacttgtgtttcacctggagggagttctcagacttcattagggtccaactgatctccggccctcctgctaagctgctactgattgattggccagaattaaaagagagtatccctgtgatcaatgggcgggacttgcagaaccccattatagttcagctctgcgatcagtgggacaatccggcacccgttcagcacgttaaaattagcttgacgaaggcctcaaacctgaaactgatgccatcaaaccagcaacacaagactgacgaaaagggccgagcaaacttaggtgtgttttccgtgtttgccccacgcggcgaacacaccctgcaagtgaaggccatttacaacaagtcaataattgagggacccattattaagctgatgatcctgccagaccccgaaaaacccgtgagactaaacgttaaatatgataaagacgcgtcgttcctcgcaggcggattgttcaccgattttatgataagcgttatcagcgaggacgattctatcatcaagaatatcaatcctgctaggatcagcatgaagatgtggaagctgtccacctctggcaatcgtcccccagcaaacgcagagacttttagctgcaataaaattaaggataacgacaaggaggatggctgtttctacttccgggacaaagtaatacccaacaaggtaggcacatattgtatacagttcggctttatgatggataaaactaatatcctgaacagcgaacaggttatcgtggaggtcctaccaaatcagcccgtaaaactggtacccaagataaagccccccacccccgccgtgtccaacgtgagatccgtggcctcaaggacactggtccgagatctacatttgagcattacggatgattatgataatcataccggtatcgacctcgtgggaaccataatagccacgatcaagggaagtaacgaagaggacaccgatacgcccctctttattggcaaagtacgaaccctggaatttccgttcgtcaatggatccgcagaaatcatgtcacttgtcctcgctgagtcctcgccaggcagagattccacagagtactttattgtgttcgaaccccgactaccgttgctctcgaggacattggaaccctatattttgccatttatgttctacaatgatgtgaaaaaacagcagcagatggcagctctgaccaaagagaaggatcagctgtcccagagcattgtgatgtacaaaagtttgtttgaagcgagccagcaactgcttaatgaaatgaaatgtcaagttgaagaggcgcgcctgaaggaagcgcaactgagaaacgagctgaaaatccataacatcgatatccctactactcagcaagtgccacatattgaagcccttctgaagcgtaaacttagcgaacaggaagaactcaaaaaaaagccacgccgaagctgcactctccctaactacactaagggaagcggggacgtgctcggtaaaatcgcgcaccttgcacagattgaagacgacagagctgctatggtgatatcgtggcaccttgcaagtgacatggactgtgtggtgacattgacaaccgacgctgctcgtagaatctatgacgaaacacagggacgccagcaggtgcttcctttggacagcatatacaaaaagacattgcccgactggaaaagaagtctcccacatttccgaaacggcaagctttatttcaagcctatcggcgacccggtcttcgctagagatctcctgacattcccagataatgttgagcactgcgagacagtctttggaatgctgctgggcgacacgatcattctggataatctggatgcggccaatcactaccgcaaagaggtcgtgaaaataacacactgcccaacgctcttaacacgcgatggcgatcgcatccgatctaacgggaaatttggaggtctccaaaataaggcgcctccgatggacaaattaaggggcatggtgtttggagcgcctgtgcccaagcaatgtctcatccttggcgagcagattgatctcctgcagcagtacagatccgctgtctgcaagttggactctgtgaataaggatctcaacagtcagttggagtacctacggacccccgacatgcggaaaaagaaacaagaattggacgagcatgaaaaaaacctgaagttgattgaggagaagttggggatgactccaattcgcaagtgcaacgattcactgcggcactccccaaaagtcgaaaccaccgactgcccagtgccacccaagaggatgcgccgtgaagcaacaagacagaaccgcatcatcacaaagacggacgtctag

SEQ ID NO: 20777 - DNA, 384 bp, Artificial Sequence
  Description of Artificial Sequence: Synthetic coding sequence
atgcccaagagcaaggagctggtgagcagcagcagcagcggcagcgactccgactctgaagttgataagaaactgaagaggaagaagcaagtggcgccagagaaacctgtgaaaaagcagaaaactggtgaaacttctcgggccctttcttcttccaaacagtcaagcagttcacgtgatgacaacatgttccagatcggaaagatgcgctatgtttccgtgcgtgactttaagggaaaggtcctgatcgacataagagaatattggatggatcccgagggagagatgaagcccggaagaaaggggatatctctgaaccctgaacaatggagccagttgaaggagcaaatatcagacattgacgacgccgtacgcaagctgtag

SEQ ID NO: 20778 - DNA, 384 bp, Artificial Sequence
  Description of Artificial Sequence: Synthetic coding sequence
atgcccaagagcaaggagctggtgagcagcagcagcagcggcagcgactccgattcagaagtggataagaagctaaagcgaaaaaagcaggtggcccccgagaaacccgtcaaaaagcagaagactggcgaaaccagccgggcactgtcatcatcaaagcaatcctctagcagcagagatgacaatatgtttcagattgggaagatgaggtatgtatccgtgcgggacttcaaggggaaagttctaattgatattagggagtactggatggatcctgagggagaaatgaagcctgggcgtaaaggcatctcccttaatcctgaacagtggtctcagcttaaggagcaaatttcagacattgatgacgctgtgcgcaaactgtag

SEQ ID NO: 20779 - DNA, 384 bp, Artificial Sequence
  Description of Artificial Sequence: Synthetic coding sequence
atgcccaagagcaaggagctggtgagcagcagcagcagcggcagcgattcggactctgaagtggacaagaagttgaaacgaaagaagcaggtggccccggaaaagcccgtaaaaaaacagaagaccggcgaaacttccagggcgctgtcatcttctaagcagagtagttcttcaagagacgacaacatgttccaaatcggcaagatgcggtatgtctctgtccgcgacttcaagggtaaggtcttgatcgatataagagaatactggatggaccctgagggagaaatgaagcccggccgcaaagggatttcacttaacccggagcagtggagtcagttaaaagaacagatcagcgacattgacgacgcagtaagaaagctctag

SEQ ID NO: 20780 - DNA, 201 bp, Artificial Sequence
  Description of Artificial Sequence: Synthetic coding sequence
atgcccaagagcaaggagctggtgagcagcagcagcagcggcagcgattccgattccgaggtggacaagaagctcaagcgaaagaaacaggttgcgccagaaaaacctgttaaaaaacagaagactggcgaaacctcccgcgcattatcatctagtaagcagagcagctcttctagagatgacaacatgtttcaggtgtag

SEQ ID NO: 20781 - DNA, 384 bp, Artificial Sequence
  Description of Artificial Sequence: Synthetic coding sequence
atgcccaagagcaaggagctggtgagcagcagcagcagcggcagcgacagcgattctgaggttgataaaaagttgaaaagaaagaaacaggtggcacccgagaaaccagtaaagaagcagaagactggcgaaaccagccgcgctctctcctctagtaaacagtccagctccagcagggacgacaacatgttccagatcggaaagatgcgctatgtaagtgtgagggattttaaagggaaagtgctaattgacattagggaatactggatggatcctgagggtgaaatgaaacctggtaggaagggcatcagcctgaaccccgagcagtggtcccagctcaaagaacaaatttctgatatagacgacgcagtccggaagctctag

SEQ ID NO: 20782 - DNA, 384 bp, Artificial Sequence
  Description of Artificial Sequence: Synthetic coding sequence
atgcccaagagcaaggagctggtgagcagcagcagcagcggcagcgattcggactcggaggtggataagaagctcaagaggaagaagcaggtcgcgcctgaaaaacctgtgaagaagcaaaaaactggggagaccagtagggccttatcctctagcaagcagtctagttcaagtagggacgataacatgttccagattggcaagatgcgttacgtgtctgttcgtgacttcaaaggaaaggtgctgatagacattagagagtactggatggacccggagggcgaaatgaaaccagggcggaagggtatttctctcaaccccgagcagtggtcccagctcaaggagcagatatccgatattgatgacgctgtgagaaaactttag

SEQ ID NO: 20783 - DNA, 372 bp, Artificial Sequence
  Description of Artificial Sequence: Synthetic coding sequence
atgcccaagagcaaggagctggtgagcagcagcagcagcggcagcgacagtgattccgaggtggacaaaaaactgaagcggaagaagcaggtggcccccgagaagccagtgaaaaaacagaaaacaggagaaacttcacgggccctgtcatcctccaaacagtcgtccagcagccgagacgacaacatgttccaaattggaaaaatgaggtacgtgagcgtgagagatttcaaggggaaggtgctgatcgatatcagggaatactggatggatcccgagggggagatgaaacctgggagaaaaggaattagtctgaatcctgaacagtggtcacagcttaaagaacagatccttgttgccctttggcagtag

SEQ ID NO: 20784 - DNA, 2241 bp, Artificial Sequence
  Description of Artificial Sequence: Synthetic coding sequence
atggcctggatccggagcacctgcatcctgttcttcaccctgctgtttgcacacatcgccgcagtacctatcaagtatctgcctgaggaaaacgtccatgatgctgatttcggggaacagaaagatatttccgaaataaacttagctgcagggctcgacttattccagggggacatcctgttgcaaaaatcacggaatggcttaagggacccgaataccaggtggacatttcccatcccgtacatacttgcggataacctggggctgaatgccaagggcgccatcctctacgcctttgaaatgttccggctgaagtcgtgtgtagacttcaaaccttacgagggagaaagttcatatatcatattccagcagtttgatggctgttggagcgaggtgggtgaccagcacgttggacagaatatttccattgggcagggctgcgcatataaagccatcatcgagcacgaaattctgcacgccctaggattttaccatgagcaatccaggactgacagggatgactacgtcaatatttggtgggaccagatcctatctggttatcagcataatttcgatacctacgatgattcactcatcactgatctgaacacaccctacgattacgagtcactgatgcattaccaaccattttcattcaataagaacgcatctgtgcccacaattacagcaaagatccccgagtttaactccataatcggtcaacggctggatttttccgcaattgatctggagcggcttaatagaatgtataattgcacaacaactcacactctgctggaccattgcacatttgaaaaggccaatatctgcggcatgatacaaggcactagagatgataccgactgggcccaccaggattccgcacaggcaggcgaggttgaccacactctgttgggacagtgtacgggggccggttattttatgcagtttagcaccagttcagggagtgccgaggaggcagctcttctggagtcgcggatcctctaccctaaaaggaagcagcagtgcctgcaattcttctacaaaatgaccggctctcctagcgaccgtcttgtggtctgggttagacgcgacgattcaactggcaacgttaggaaactggtcaaggtccagacgttccagggagacgacgaccacaactggaaaatcgcgcacgtggtattgaaagaggaacagaagtttcggtacctgttccagggaacgaagggcgatccgcaaaattccaccggcggtatttacctggacgacattacgctcaccgagaccccttgccctaccggcgtatggactgtgagaaatttctcccaggtgttggaaaatacctcaaaaggcgataagctgcaaagccctagattctacaacagcgaggggtacggttttggcgtgaccctgtaccccaatagccgagaatcatctggatatctcaggctcgcatttcatgtgtgtagcggggaaaatgacgccatcttggagtggccggtagaaaataggcaggtgatcatcactatcctggaccaagaacccgatgtaagaaataggatgtctagttcaatggtgttcaccacctcaaagtctcacacctctcctgctatcaacgatacagtcatctgggacaggccgagcagagtcggcacttaccacaccgattgtaattgttttcgctcaattgacctcggttggagcggctttatttctcatcaaatgctcaagcgccgctccttcctcaagaatgacgatttgataatttttgtagattttgaagatattacacatctctcacagaccgaagtacccactaagggaaagagactgtcaccacagggcctgattctgcagggacaggagcagcaagtttctgaggagggctcagggaaggctatgctggaggaggcccttcctgtctcgctctcacagggccagccttcgcggcagaagcgtagcgtagagaacaccgggcctttggaagatcacaattggccgcaatattttcgagacccatgcgacccaaacccgtgccagaatgacggcatatgcgtgaacgtaaagggcatggcgagctgtaggtgtatctctgggcatgccttcttctatactggagaacgctgccaggccgtgcaggtgcacggatccgtgctgggaatggtgatcggcggaaccgctggagtgatattcctgacgttcagcataattgccatcctatcacagagaccaagaaaatag

SEQ ID NO: 20785 - DNA, 2826 bp, Artificial Sequence
  Description of Artificial Sequence: Synthetic coding sequence
atggagggcgccagccgggtgtgccggcagggccgggtggccctgccggcagaagaggattatttgccactcaaaccgcgcgtgggcaaggctgccaaggagtatcctttcatcctcgatgcctttcaaagggaagcaatccagtgcgtggataacaatcagtcagtgcttgtctcagcgcacacaagtgcgggcaagacagtgtgcgccgaatatgctatagccctggccctccgcgaaaagcagcgtgttatctttactagccccatcaaagcactgtccaaccagaagtaccgcgaaatgtacgaggaattccaggacgtgggtttgatgacgggcgatgtcaccatcaaccccacggccagttgtctggtcatgacaaccgagatattgcgcagtatgctttatcgcggaagtgaggttatgcgggaggtggcatgggtcatctttgacgagattcactacatgcgggactccgaacggggggtggtgtgggaggaaacgatcatccttctgccggacaacgttcattatgtctttctgtcagccaccattcctaacgccaggcaatttgccgagtggatttgtcatctgcacaaacagccttgccacgttatctatacggactatcgcccaacaccacttcaacattacatctttccagctggtggagatggactgcatctcgtggtagacgagaatggtgatttccgggaggacaactttaatacggctatgcaagtccttcgtgacgctggagatcttgcaaaaggtgaccaaaaaggtcggaaagggggcacaaaagggcccagtaacgtttttaaaattgtgaaaatgattatggaacggaactttcagcccgtgataatcttcagcttttcgaagaaggactgtgaagcctatgctctgcaaatgactaagctggatttcaacacagacgaagagaagaaaatggtcgaagaggtcttttctaacgccatagattgcctttcagacgaagacaaaaagctgccccaggtggagcacgtgctgccactcttgaagcggggcattggcatccaccacgggggccttctgccaatactcaaggaaaccatcgaaatcttgttctcagaagggctgatcaaagccctctttgccacagagaccttcgcgatggggattaacatgcccgcccggacagtactctttacaaatgcccggaaattcgacgggaaagattttcgctggatatcttcgggggagtacatccagatgagtggccgagctggcagacgggggatggatgaccggggcatcgttatacttatggtagatgagaagatgtctccaaccatcgggaagcaattgctgaagggatcagcagacccactgaactcggccttccatctgacctacaacatggtgctgaaccttctgcgagttgaggagatcaacccagagtatatgctggagaagtctttctaccagttccagcactaccgagctatccctggcgtggtcgagaaggtcaagaactcggaagagcagtacaataagatcgtgatacccaatgaggaatccgtggtgatttactataagattcggcagcagcttgccaagttgggaaaggaaattgaagaatatatccacaagccaaagtactgtttgccgttccttcaacctggaagactggtcaaggttaaaaacgaaggggatgattttggctggggcgtagtagttaattttagcaagaaaagtaatgttaagcccaactcaggcgaactggatcctctatacgtggtggaagtgcttctgaggtgttccaaagagtctctcaagaactcagctaccgaagccgccaagccggctaaacccgacgagaagggagaaatgcaggtcgtgcccgtgctcgtgcacttgcttagtgctatctcgagcgttcgcctgtatattcccaaggacctgcgccctgtggacaacagacagtcggtgctcaaatcaatccaagaggtccaaaaacgctttccagatggaattcctctccttgatcctattgatgacatgggcatacaggatcagggactcaagaaggttattcaaaaagtagaggcctttgaacatcgcatgtacagtcatccactgcacaatgatcccaatctggaaaccgtctacacactgtgtgaaaaaaaagcccaaatagccattgatattaaatctgcaaaaagagaactaaagaaagcgcgaactgttttgcagatggatgagctcaagtgtagaaaaagggtcttacggcgcctgggattcgcgacaagcagcgatgtcatcgagatgaagggaagagtcgcttgcgagatcagtagtgctgatgagctgcttttgactgaaatgatgtttaacgggctgttcaacgatttgagtgcagaacaggccaccgcccttttgtcgtgcttcgtgttccaggagaacagttccgagatgccaaaattgaccgagcaattggcaggccctctgagacagatgcaggaatgtgcgaaacgaatcgcaaaggtgagcgcagaggccaaactggagattgatgaagagacgtacctgagctctttcaaaccgcacttgatggacgttgtgtacacgtgggccactggcgctacctttgcccatatctgtaaaatgacggatgtttttgagggctcaatcatcaggtgcatgcgaaggctggaagagctacttaggcagatgtgccaggcagcaaaagccataggaaatactgagttggagaataaattcgcggaaggaattaccaaaatcaagcgggatatagtattcgccgcttccttatacttgtag

SEQ ID NO: 20786 - DNA, 3144 bp, Artificial Sequence
  Description of Artificial Sequence: Synthetic coding sequence
atggacgccgaggccgaggacaagaccctgcggacccggagcaagggcacagaagtccccatggacagtcttattcaggagctgtcagtggcctacgattgcagcatggcaaaaaaaagaaccgcagaagaccaagctctgggtgtacccgttaacaaaagaaaaagtctgttaatgaaacctaggcactattcacccaaggcagattgccaggaggacaggtcagaccgcaccgaagacgatggaccacttgaaacacatggccattccactgccgaggaaattatgattaagcctatggatgagagcctgctatcaaccgcacaggagaactccagcaggaaagaagaccggtattcctgttaccaggagcttatggtgaagtcattgatgcacctcggcaagtttgagaagaacgtatcagtccagaccgtgagcgagaatctgaacgatagcggcatccagagtctgaaggcggaatccgatgaggccgatgagtgctttctgatacactcagatgatgggcgcgacaaaatcgatgactctcaacctccgttttgttctagcgacgacaacgagagcaactcagaaagtgctgaaaatgggtgggattctggatcaaattttagcgaggaaacgaagcctcccagagtccctaaatatgtactaactgaccacaagaaggatctgctcgaggtgccagagataaaaaccgagggagacaaatttatcccctgtgagaatcgctgtgactcagaaacagagcggaaggacccgcaaaatgccctggctgagcctttggacggtaatgctcagccatctttccctgatgtggaggaggaggattcagagagcctagccgtgatgaccgaagaggggtccgacctggaaaaggccaagggtaacctaagcctgctggagcaggctatcgctctgcaggccgagcgcggctgtgtatttcataacacgtacaaggaacttgacagattcctcctggagcaccttgccggtgagcgcagacagaccaaggtgattgacatgggcggaaggcagatctttaataacaagcacagccccagaccggagaagcgcgaaaccaaatgtcccatcccgggctgcgacggaacggggcatgtgaccgggctgtatcctcatcacagaagtttgagcgggtgcccccacaaggtccgggtgcccctggaaatcctcgcaatgcatgagaatgttctaaaatgtccgacccccggctgcactgggagaggccacgtaaattctaaccgcaatacccatagaagtctcagcggatgcccaattgctgccgctgaaaaactggcgatgtctcaggataagaaccaactggactcaccccaaaccgggcaatgccctgaccaggctcaccgaacatccctcgttaagcagatcgagttcaatttcccgtctcaagccatcacttcacctagagcaactgtgagcaaggagcaggagaaattcggcaaggtgcctttcgattacgccagtttcgatgctcaggttttcggcaagcgtcccctcatccagaccgttcagggtaggaaaacccccccctttcccgagagtaaacatttccccaacccggtaaagttcccaaatcgactgcctagcgcgggcgctcacactcagagccctgggcgcgcctcttcctacagctacggacaatgctccgaggatactcatattgcagcggcagccgcaatcctcaacttgtctacccgctgccgggaagccacagacattctgagtaacaagccccagtcacttcacgctaaaggggcagaaattgaagtagacgagaatgggactctggatcttagcatgaaaaagaacagaattctggacaaatcggctcccctgacctcaagcaacacatctataccaactccttctagctccccattcaagacgtcttctatactagtaaatgcagccttctatcaagctctctgtgatcaagaagggtgggatacgcctatcaattattcgaaaacacacggaaagacggaggaagaaaaagaaaaggatcccgtcagtagcctggagaatttggaggagaagaagtttcccggagaggcttccattccttcacctaaaccgaagctgcacgcccgggacctgaagaaggagctcatcacttgccctacacctggatgtgacgggtcggggcacgttacaggaaattatgctagccatcggagcgtcagcggttgtcctcttgccgataaaacactgaagagcttgatggccgctaatagccaggagctgaaatgccccaccccaggttgtgacggttccggacatgtgaccggtaactacgcaagtcatcgcagcttaagcgggtgtcctagagctagaaaaggtggcgtgaagatgacacccactaaagaagaaaaagaggaccccgaactgaagtgcccggtgattggatgcgatgggcaggggcatatctctggaaagtatacttcccataggacagcctctgggtgcccccttgccgctaagagacagaaggagaacccactgaacggtgccagccttagctggaaactgaacaagcaggaactaccccattgcccgctgccgggctgcaacggccttggacatgttaataatgtattcgtgacacacagatctctctccggctgccctctgaatgcccaggtgataaagaaggggaaggtcagtgaagaattgatgactattaaactgaaggctaccggcggaattgagtctgatgaagagattcgacatctggacgaagagattaaagagctaaatgaaagcaatctgaagattgaggccgacatgatgaaattgcaaacccagattacctcaatggaatcaaacttgaagacaatcgaggaagagaataagctgattgagcagaataatgaatcacttctgaaggaattggccggcttgagccaagctttgatctcaagtctcgccgacatccagctgccacagatgggtcctatctcagaacagaattttgaagcgtatgtcaatactttgactgacatgtatagcaacctggaaagagactattctccggagtgtaaggcactgttggagagtatcaagcaggccgtgaaaggaatccatgtgtag

SEQ ID NO: 20787 - DNA, 1863 bp, Artificial Sequence
  Description of Artificial Sequence: Synthetic coding sequence
atggacgccgaggccgaggacaagaccctgcggacccggagcaagggcactgaggtgcccatggattctcttatacaggagctttccgtcgcctatgattgtagcatggccaaaaaacggacagctgaggatcaggctcttggagtcccagttaataagcgaaaaagtctactgatgaaaccaaggcactattctccaaaggcagattgtcaggaggatagaagcgaccggactgaagatgacggacctttggagacccacgggcactctacagctgaagagattatgataaagccaatggatgagtccctcttaagcaccgcccaggaaaactcttctaggaaggaagaccggtactcttgctatcaggagctcatggttaagtccctgatgcatttgggcaagtttgagaagaatgtgtctgtgcagactgtgtcagagaacctgaacgatagcggaatccagtcactcaaggccgagtctgacgaagctgacgagtgtttcctaatacacagcgatgatggtcgcgataagatcgacgattcacagcctcccttctgtagtagcgacgataacgaaagcaacagtgaaagtgctgaaaatggatgggattccgggagcaacttttcagaggaaacaaaacccccaagagtcccaaagtacgtcctaaccgatcacaaaaaggatctgctcgaggttccagagatcaagacggaaggtgacaagtttatcccatgcgagaacagatgtgattctgagactgagcggaaggacccacaaaacgctttggctgaaccccttgacgggaacgcccagcccagcttcccagatgttgaggaggaggattccgaaagcctcgcagtgatgacagaggaaggcagcgacctggagaaagccaagggtaaccttagcttactcgagcaagccatagccctgcaggcagagcgcggctgtgtgttccacaatacctataaggagctggacagattccttctggaacacctggctggcgagcgacgccagacaaaggtgattgatatgggtggccgtcagatttttaataataaacactcacctagaccagagaagagggagacgaagtgcccaatcccaggctgtgatggtacagggcacgtcacgggcttgtacccacatcacaggagcttgagcggttgcccacataaagtgagagttccacttgagattctcgcaatgcatgagaacgtgctgaagtgtccgactcctggctgcacagggcggggacacgtgaactccaaccggaacacgcatcggtcgctgagcggatgtcccatagctgccgccgaaaagctcgcaatgagccaggataagaatcagctggacagtccacagaccgggcaatgtccagaccaagcacaccggacctcattggtgaaacagatcgagttcaatttcccctctcaggctattaccagtccgcgagcaacagtgtccaaggagcaggaaaagtttggaaaagtgcctttcgattatgcttcttttgatgcgcaggtctttggcaagcgtcccctgatccaaacagttcagggtcgaaagactcctccattccctgagtcaaaacatttcccgaaccccgtaaaattcccgaatcgactcccctctgcgggtgcccacacccagtcccccgggagggcatcatcatacagctatggtcagtgttccgaagatacgcatattgcagctgcagcagctatacttaacttgagtacccggtgtcgtgaggctactgatattctgtctaataaaccacagtccctgcacgctaagggagcagagattgaagtggatgaaaatgggacactggatctgtcaatgaaaaagtag

SEQ ID NO: 20788 - DNA, 42 bp, Artificial Sequence
  Description of Artificial Sequence: Synthetic coding sequence
atggacgccgaggccgaggacaagaccctgcggacccggtag

SEQ ID NO: 20789 - DNA, 990 bp, Artificial Sequence
  Description of Artificial Sequence: Synthetic coding sequence
atgagcgccgccggcctgctggcccccgcccccgcccaggccggcgcaccaccagccccggaatattaccctgaagaagacgaggaattagaaagtgcagaggatgatgagcgctcctgtcgtggcagagaatcggacgaggacacagaagatgcctccgagaccgacctcgccaagcatgacgaagaagactacgttgagatgaaggaacagatgtatcaagacaaactagcttcactaaaaaggcaattacagcagctgcaggagggcaccttgcaggagtaccaaaagagaatgaaaaagctggatcagcagtataaagaacgcatacggaatgccgataccctcctgctgcaggcccagaccgaacaggtggaacgcaactacattaaggagaagaaggccgcagtcaaagagtttgaggacaaaaaagtggagcttaaggagaaccttatcgccgaactcgaggaaaaaaagaaaatgattgagaacgagaagctcaccatggagctcaccggcgacagcatggaagtgaagcctatcatgacacgcaagctgaggcgccggccaaacgatcctgtgccgatccccgataagcgtcggaagcctgcaccggcgcagttgaactacctgctgaccgatgagcagatcatggaagacctacggaccctcaataaactgaagtctccaaaaagaccggctagtcctagtagcccagaacatttgccggccacgccggcagaaagtccagcgcagagatttgaagccagaatcgaggacggcaagttatattatgataagcgctggtaccataaaagccaggcaatatatcttgagagtaaggataaccaaaagttgagctgcgtgattagtagtgtgggagccaacgagatctgggttcggaaaactagtgattcaaccaaaatgcgtatctacctgggccagctgcagcgcggcttgtttgtgatccggcggcgctcagccgcatag

SEQ ID NO: 20790 - DNA, 987 bp, Artificial Sequence
  Description of Artificial Sequence: Synthetic coding sequence
atgagcgccgccggcctgctggcccccgcccccgcccaggccggcgcacctcccgcccccgagtattatcccgaagaagatgaagagctcgagtcagctgaggacgatgagcggagttgtagaggtagagaatccgatgaagatactgaagatgcaagcgagacagacttagcaaagcacgacgaagaggactatgtggaaatgaaagagcagatgtaccaggataaactggcttctctgaaacgacagctccagcaactgcaggagggcacactccaagagtatcaaaagaggatgaagaagctcgatcagcagtacaaggaaaggattcggaacgccgagttatttttgcagctggagaccgagcaggtcgaaaggaactatattaaggaaaagaaggctgctgtaaaggagttcgaggataagaaagttgaactgaaagagaacctcatagccgaattggaggagaaaaagaagatgattgagaacgagaaattgactatggaactgacaggggactcaatggaagtgaaaccaattatgacacgcaaactcagacgcagacccaatgacccagttcctattcccgataaaaggagaaagcccgcccccgcccagctgaactacctcctgacagatgagcagattatggaggacctgcggacactcaataagctgaaatcccccaaacggccagctagtcctagctcaccggaacatctgccggctactcccgctgaatcacctgcacagcggttcgaggcccgcatcgaggatggcaaactttactacgataaaaggtggtaccacaaatcacaggccatctatttagagagtaaggataaccagaagctcagttgcgtgatatccagcgtcggtgctaatgagatttgggtccggaaaacgtccgactcaacaaaaatgaggatttacctgggacaactgcagagaggactgttcgtgatccgccgcagaagcgcagcttag

SEQ ID NO: 20791 - DNA, 591 bp, Artificial Sequence
  Description of Artificial Sequence: Synthetic coding sequence
atggccagcaacgtgaccaacaagaccgaccccctgttcagcagctccttcgacttagactatgacttccagagagattattatgaccgaatgtatagctatcctgctagggttcctcctccgcccccaatcgcacgtgcagtggttccatcaaagcggcagcgcgtgtcgggaaacacttcccgcagggggaaatcaggcttcaactctaagtcggggcagcggggttcttctaaaagcggcaagctgaagggggatgatctccaggcgataaaaaaggagctcacacagatcaagcagaaggtcgactctcttctcgagaatctggagaagattgaaaaggaacaaagcaagcaggcggttgagatgaagaatgacaagtctgaagaggagcagagcagtagctccgtgaaaaaagacgaaactaatgtaaaaatggagagcgaaggcggcgcagacgattctgctgaggaaggcgacctgctcgatgacgatgataacgaggataggggcgacgaccaggtgaagacaacaggtaaagagcgtaagagatggtggaggggggctcaaggacatatggagtgtctttag

SEQ ID NO: 20792 - DNA, 1197 bp, Artificial Sequence
  Description of Artificial Sequence: Synthetic coding sequence
atggccgtgaccctggacaaggacgcctactaccggcgggtgaagcgcctttactcaaattggagaaaaggggaggacgaatatgctaacgtcgacgcaatcgtagtttcagtcggggtagatgaagagatcgtttacgcaaaatccactgcactgcagacatggctcttcggatacgaactgaccgataccataatggtcttctgcgatgataaaatcatattcatggcctcaaaaaaaaaagttgagttcctgaagcagattgccaatacgaaggggaacgaaaacgccaacggtgcccccgccataactctgctcatcagggaaaagaacgaatcaaataaatctagttttgacaaaatgatagaggctatcaaggaaagcaaaaacgggaagaagattggagtcttcagcaaagacaagtttccaggcgagtttatgaagagctggaacgactgcctgaataaggaaggcttcgataagattgacatttccgcagtggttgcgtataccattgccgtgaaagaggacggtgagctgaatcttatgaagaaagcagcatcgatcactagtgaagtttttaacaaattttttaaggaacgtgtgatggagatcgtggatgctgacgagaaggtccggcattccaaattggccgaatccgtggaaaaggcaatcgaagagaagaagtatctggcaggtgctgatccctcaaccgtagagatgtgctatccgccaatcatccaaagcggcggaaactacaatcttaaattttcagtggtgtcagacaagaaccatatgcactttggggcaatcacctgtgccatgggaatacgttttaagtcttattgctcaaacctagttaggactttgatggtcgacccaagccaagaagttcaagaaaactataattttctgctccaattgcaagaggagctgttaaaggagctccggcacggcgtgaagatctgtgacgtctacaacgcggtaatggatgtggtcaaaaaacaaaaaccggagttgctgaacaagatcacgaagaacctggggttcggcatgggaatcgagtttcgcgagggctctttggtcatcaacagtaaaaatcaatacaagctcaagaaaggcatggttttttcaataaatctcggattcagcgacttaaccaacaagaaaaagaagaagaagaaaaaagccaagtag

SEQ ID NO: 20793 - DNA, 954 bp, Artificial Sequence
  Description of Artificial Sequence: Synthetic coding sequence
atgaacaacaccgccgccagccccatgagcaccgccaccagcagctctggccgttcaacaggcaagagtatctctttcgctaccgaactccagagcatgatgtactcgcttggcgacgctaggagaccgctacacgagactgcagtgttggtggaggatgtggtgcacacacaattgattaaccttctccagcaggccgccgaggtctcgcaactgcgtggagcgcgcgtcatcacaccagaagacctgctgttcttgatgaggaaggataagaagaaactgcgcaggctgctgaagtacatgtttatccgagattacaaaagcaagatagtcaaaggaatcgacgaagatgacctgctcgaggacaaactctctggctcaaataatgccaataagcggcagaaaatcgcgcaggatttcttgaattccattgatcaaacaggggagctcctggccatgtttgaagatgatgagattgacgaagttaaacaggagcgcatggagagggccgagaggcaaactcgcatcatggacagcgcccagtatgctgaattctgtgagagccgccaattatcattctccaaaaaagcttctaagttcagagactggctggactgtagctcaatggaaattaaacccaatgtggtagctatggaaatcttagcttaccttgcctacgagacagtggcccaattagttgaccttgccctgctggtacgccaggacatggttacaaaggccggggatccattctcccatgccatcagcgccacctttattcaatatcataatagtgctgagtcgacagccgcctgtggcgttgaagcacattcagatgctatccagccatgtcacatccgcgaggcaatcaggcggtacagtcacaggataggtcctctcagtccttttaccaatgcctaccgaagaaatgggatggccttcctggcttgttag

SEQ ID NO: 20794 - DNA, 327 bp, Artificial Sequence
  Description of Artificial Sequence: Synthetic coding sequence
atggagatcctggcctacctggcctacgagaccgtggcccagctggtggatttagcactcctagtgcggcaggacatggtgacaaaagcaggcgaccctttttcacacgctatttcagctacctttattcaatatcacaacagcgctgagtccactgccgcatgtggcgtcgaagcccacagcgatgccattcagccatgccatatcagggaggctatccgcaggtacagccatcgcatcgggcccctgtcgcccttcactatctctttcagcctcacagagtgtctgccgcaagagtgggatggcttttcttccctgctgatgtag

SEQ ID NO: 20795 - DNA, 954 bp, Artificial Sequence
  Description of Artificial Sequence: Synthetic coding sequence
atgaacaacaccgccgccagccccatgagcaccgccaccagcagctcaggccgcagcaccggcaaatcaatctcttttgcgacagagcttcagtcgatgatgtacagcttgggcgacgccaggagacctctccacgaaactgcagtcttagttgaagatgtggtccacacccagctgatcaatctgctgcagcaggctgccgaagtgtcccagcttcgcggcgctagggtcatcacacccgaagatctcctcttcctgatgcgcaaagacaagaagaagctcaggaggctgttaaagtacatgtttattagggattacaagagcaaaatcgtgaaaggcattgacgaggatgatctcttggaagacaagctctccggctctaataacgccaacaagagacagaagattgctcaggattttttgaactccatcgatcagactggcgagttgctggccatgttcgaggatgatgagattgatgaagtgaaacaggagcgcatggaaagagcggagagacagacacgcattatggacagcgcccagtacgcggagttttgcgaatcacgtcaattgagcttttctaagaaagcttcaaagtttagggactggcttgactgcagttctatggaaattaagcctaacgttgtcgcaatggaaatcctggcctacctggcatatgagacggtggcccagctagtggacctggcccttctggtgcgacaggatatggttaccaaggctggcgatcctttcagtcatgctatttctgcgaccttcatccagtaccacaacagcgcagagtcaacggctgcctgcggggtggaggctcactctgatgcaatccagccatgccatattcgtgaggccatcagacgatactcacacagaattggacccctgtcaccttttacgaatgcttaccgccgcaacggtatggcttttcttgcctgctag

SEQ ID NO: 20796 - DNA, 987 bp, Artificial Sequence
  Description of Artificial Sequence: Synthetic coding sequence
atggtggtgttcggcaccaccttcttcaacttcgacagcttcatcgggaaaactgactccatcgagatcataggcaagagcgtgttcccctactgttaccacaacatccttccccttctgaacgattcgggccggtacagtctgggcgatgccaggaggcctcttcacgagaccgccgtgctggtggaggacgtcgtccacacccagttgattaaccttcttcaacaggcagccgaggtatctcagctgcgaggtgcacgggtgattaccccagaagacttacttttcctcatgcggaaggataaaaagaagctgcgcaggctactgaagtacatgttcatccgggactataagtctaaaatcgtaaaggggattgatgaggatgatctcttggaggataagctgtccgggagcaacaatgccaacaagagacagaaaatagctcaagatttcctcaactcaatcgaccagactggagaactgcttgcgatgttcgaggatgacgaaattgatgaggtgaagcaggagagaatggaacgggccgagagacagactagaataatggacagtgcccagtatgctgaattctgcgagtccaggcagctgagtttctccaagaaggccagtaagtttcgcgattggctggactgctcatctatggaaatcaaaccgaatgttgtcgcaatggagatcctggcctaccttgcatatgagaccgtggcacagcttgtggatctggccctcttggttcggcaggatatggtcacaaaggccggcgatcctttctctcatgcgatttcagccacttttattcaatatcataattccgccgaatcaacagccgcctgtggggtggaagcacactcggacgccattcaaccctgtcacattagagaggcaattagaagatacagccatagaattggccccctgtcaccctttacaaacgcctataggagaaacggtatggccttcctggcttgctag

SEQ ID NO: 20797 - DNA, 987 bp, Artificial Sequence
  Description of Artificial Sequence: Synthetic coding sequence
atggtggtgttcggcaccaccttcttcaacttcgacagcttcatcggcaagactgattccattgagattatcggcaagtccgtgtttccctactgttatcataacatcctgcccttacttaacgatagcggccgttatagtcttggcgacgccagaaggcctcttcacgaaacggcggtgctcgtagaggacgtggtccatacacaactgatcaacctgttgcagcaggcggcagaggtctcccagcttcggggcgcacgggtgatcaccccggaggacctgttgttccttatgcgaaaggacaagaagaagttgaggcgactgttaaagtacatgttcatcagggattacaagagcaagattgtgaagggcatcgacgaagatgatcttctggaagataagctgtcagggtccaacaatgctaataagcggcagaaaatcgcccaggatttcctgaactctatagatcagacgggcgaattgctggcgatgtttgaggacgacgagattgatgaggtaaagcaggaacgaatggagagggctgagagacagactagaattatggactcagcgcagtacgctgagttttgcgaatcccgacagctgagttttagtaagaaagctagtaaattcagagactggctcgattgctccagcatggaaatcaagcctaatgtggtggccatggaaatcctggcttatcttgcctatgaaacagtggcacaattagtggacctcgccctgctcgttcgccaggacatggtgactaaggcaggcgaccctttctcacatgccatctccgccacttttattcagtaccacaattcagccgagtcaactgcagcctgcggcgtggaggcccactcagatgctatacaaccctgccacatccgtgaggcgatcaggcggtacagtcaccggattggtcctctgagcccttttaccaacgcctataggagaaatggtatggctttcctggcatgctag

SEQ ID NO: 20798 - DNA, 954 bp, Artificial Sequence
  Description of Artificial Sequence: Synthetic coding sequence
atgaacaacaccgccgccagccccatgagcaccgccaccagcagctctggccgctccactggcaagtctatatcctttgccacagagttacagagcatgatgtacagcctgggggatgcaaggcgccccctgcacgaaacggcagtgctggtggaggacgtggtccacacccagctgattaatctcttgcaacaggcagctgaagtctctcaattacggggcgcacgcgtcattacaccagaggatctcttgtttctgatgcgcaaagataagaaaaaacttcggcggctgctgaaatacatgttcattcgggattacaagagcaagatcgtgaagggcatcgatgaggatgatcttcttgaagataaactgagtggctcaaataacgcaaataaacgccagaagatagctcaggacttcttgaattcaatcgatcagaccggcgagctattggcaatgtttgaggatgacgaaatcgacgaagtgaagcaagagcggatggagcgtgcggagcgtcaaaccagaataatggacagcgctcagtatgccgaattctgtgaatcaagacagctcagcttcagcaaaaaggcgagtaaattcagggattggctggattgcagtagcatggagatcaaaccaaacgttgtggccatggagatactggcatacctggcgtacgagactgtagcccaactggttgatttggccctactggttcgccaggatatggtcaccaaggctggtgatccattttcccatgcgatctcagccactttcatccaatatcataacagtgctgagtcgacggctgcctgcggcgtggaggcacacagcgacgctatccagccgtgtcatataagagaagcaatacggaggtactcgcacaggataggacctttaagccctttcaccaatgcgtaccgccgaaatggaatggcttttttagcttgttag

SEQ ID NO: 20799 - DNA, 624 bp, Artificial Sequence
  Description of Artificial Sequence: Synthetic coding sequence
atggccggccccgccacccagagccccatgaagctgatggccctgcagctcttgctctggcattccgccttgtggactgtacaagaggcgacaccgctgggccccgcctctagtctgccccagagttttttgttgaagtgcctggagcaagtcagaaaaatccagggagacggggcggcgctccaggaaaagctggtgtctgagtgtgccacatacaaactgtgtcatcccgaagagttggtcctcctggggcattctctaggtatcccttgggcccccttgagctcatgccccagtcaggcgctccagttggcaggatgcctgtcgcagctccacagcggattgtttctctatcagggactgctgcaggccctggaaggaatttcaccggagttaggcccaacactcgacactctacagttggatgtcgctgacttcgcaacaactatctggcagcagatggaggagctgggcatggccccagctttgcaaccaacccagggggctatgcctgccttcgccagcgcttttcagcgtcgtgccggcggcgttctggttgctagtcacctgcaatctttccttgaagtctcctatagagttctccgacaccttgcgcagccgtag

SEQ ID NO: 20800 - DNA, 2220 bp, Artificial Sequence
  Description of Artificial Sequence: Synthetic coding sequence
atggccccccagaagcacggcggcggcggcggcggcggcagcggccccagtgcgggcagcggcggcggcgggttcgggggctctgcggctgtggctgccgcgacagcaagcggcggaaagagcgggggcgggtcatgcggaggcggcgggagttactctgcctcatcctcttcatcagccgccgcagccgccggggccgccgtcctccccgtcaagaaaccaaaaatggaacacgtccaggccgaccatgaactgttcctgcaggcattcgagaagcctacacagatttataggttcttacgcacacggaatcttatcgcccctatcttcctgcaccggacccttacatatatgagccacagaaattcacgcaccaacataaaacggaaaactttcaaggtagacgacatgctgagcaaggtggagaaaatgaagggagaacaagagtctcactctttgagcgcacacctgcagcttacatttacaggattctttcacaaaaacgacaagccttcccccaactccgaaaatgagcagaactcagtgacattagaagttctcctggtgaaggtgtgccataagaagcgcaaggacgtatcatgtcctatacgccaggtgcccaccgggaagaagcaggttccgctgaaccccgacctcaaccagacgaagcccggtaactttccctcattggccgtgagtagcaatgaatttgagccttctaattcacacatggtcaagtcttattccttactgttcagagtcacgcgaccgggacgtagagagttcaacggaatgattaatggagaaacgaatgagaacattgatgtgaatgaggagttacctgccagaagaaagagaaacagggaagacggagagaaaactttcgtggcgcagatgactgtgtttgataagaaccggcggctgcagcttcttgatggagagtatgaagtcgcaatgcaggaaatggaggaatgccccatttccaagaagcgcgcgacctgggaaaccatactggacggtaaaagactgccaccttttgagacgttttcacaaggccccaccctgcagttcacactgcgctggacaggcgaaaccaacgacaaatcaacagcacccattgccaaacctctagctactcgcaatagtgagtcattacaccaggagaacaagccgggatctgtgaaacctacacaaacgatcgctgtaaaggagagcttgacaactgacttgcagactaggaaggaaaaagacactccaaacgaaaatcggcaaaaactgcgaatattctaccagtttctgtacaataataatacgaggcagcagactgaagcacgcgatgatctgcattgtccgtggtgcacactaaattgccggaagttatatagtctattgaagcacctgaaactgtgccattccaggttcatttttaattacgtatatcaccctaaaggggccagaatagacgtctctatcaatgaatgttatgacggtagctacgccggaaatccacaggacattcatcgacaacccggatttgcctttagtaggaatggccccgtgaaacgcacaccgatcacacacatcttggtgtgccgacccaaacgaacaaaggcttctatgagtgaattcctagaatccgaagacggggaggtagagcaacaaagaacttactcatctggtcataaccgcctatatttccactcagacacatgtttgcccctcaggccccaagaaatggaggtggattccgaggacgaaaaggatccagagtggctcagggagaagacaatcacccagatcgaagaattctctgatgtgaacgaaggtgaaaaagaagtgatgaagttatggaaccttcacgtgatgaagcacggcttcatcgcggacaatcaaatgaaccacgcctgcatgctgttcgtggaaaattacggccagaagatcatcaagaagaacctgtgccgaaacttcatgctccatttggtcagcatgcacgatttcaacctgatctcaattatgagtatagacaaagctgtcacaaagctgagggagatgcagcaaaaactggaaaaaggagagtcagctagcccggccaacgaagaaatcacagaggaacagaatgggacggctaatggcttttccgagatcaattcaaaggagaaggccctggagacagatagcgtctctggtgtttcaaagcagtccaaaaaacagaaactgtag

SEQ ID NO: 20801 - DNA, 1938 bp, Artificial Sequence
  Description of Artificial Sequence: Synthetic coding sequence
atgagcctgaagatggacaaccgggacgtggccggcaaggccaacaggtggttcggtgttgctcctcctaagagcggcaagatgaatatgaacatcctgcatcaggaagaattgattgcacagaaaaagagagagatcgaggcaaaaatggagcaaaaggctaaacaaaaccaggtggcttctccccagccaccccaccccggcgaaatcaccaacgcacacaacagtagttgtattagcaacaagttcgccaacgatggatcatttctccagcagtttctgaagttgcaaaaagcccagacctctactgatgcgcccacttcggccccctcagctcccccgtccacaccaaccccttctgctggcaagaggtctctgctcatctctcgaaggaccggtttaggcctggccagtctccctgggccggtcaaatcttattcccacgcaaagcaactgccagtggcccaccgcccttctgtcttccagtcacctgatgaggatgaggaagaggattatgagcagtggctagagatcaaagtctccccaccagaaggtgccgaaacccgaaaggttatagagaaacttgcgagatttgttgccgaaggagggcctgagttggaaaaggtcgcaatggaggattacaaagataacccagcctttgccttcctgcatgataagaattctagggagttcctgtattatcggaaaaaggtggcagaaattaggaaagaggctcagaagagtcaagccgcctcccaaaaggtatcccctcccgaagacgaggaggtgaagaacttagcagagaaactggcgaggttcatcgctgacggagggcctgaggtggagaccattgcactccagaataacagagagaatcaagcattcagcttcttatacgaacctaactctcagggctataagtactaccgtcaaaagcttgaggaatttcgcaaggccaaagccagttctactggttcatttaccgctccagaccccgggctcaagcgcaagtcacctccggaagcactgagcggatccctgccaccagcaaccacatgccccgccagctctacacctgctccaactattatacccgcacccgctgcccccgggaagccggcaagtgcggcaaccgtaaagaggaagcgcaaatccagatgggggcccgaggaggataaggtcgagttaccgcctgccgaactggtgcagagggacgtggacgcttccccctcacccctatccgtccaggatctgaagggactgggatatgaaaaaggcaagcccgttggcctcgtgggagtcacagaactgtccgatgcgcaaaagaagcagctgaaagagcagcaagaaatgcagcagatgtatgatatgatcatgcagcataagcgggcaatgcaggacatgcagctcctgtgggagaaagcagtccagcaacatcagcatggctacgactctgatgaagaagtggactccgaactcggaacatgggagcatcagctgcgtcgcatggagatggacaagaccagggagtgggctgaacaactgaccaaaatgggacgtggcaagcattttattggtgatttcctgcctcccgacgaactagagaaatttatggagacattcaaggcactcaaagaagggcgggagcctgactacagcgagtataaagagttcaagttgactgtggagaatattggttaccagatgctgatgaagatgggctggaaggaaggcgaagggttgggaagcgagggccaaggtataaaaaaccccgttaacaagggtaccacgacagtagacggagcagggttcggaattgaccggcctgcagagctgtccaaagaggacgatgaatatgaggcctttaggaagaggatgatgctagcataccgttttaggcctaatccgctcaataacccgaggcgcccctattactag

SEQ ID NO: 20802 - DNA, 669 bp, Artificial Sequence
  Description of Artificial Sequence: Synthetic coding sequence
atgagcctgaagatggacaaccgggacgtggccggcaaggccaacagatggttcggcgtggccccccccaagtccggcaaaatgaacatgaatattctccaccaggaagagcttatagcccagaagaaaagagaaatcgaggcaaaaatggaacaaaaagcaaagcagaatcaagttgctagcccacaacctccacacccgggggaaattactaacgcacacaacagctcttgtattagcaataaattcgccaacgacggtagcttcctccaacaattcctcaagctgcagaaagctcaaacctcgaccgatgccccaacttccgcaccgtccgccccgcccagtactccaaccccttcagctgggaagagaagcctgcttatctccagacgtacagggttaggcttggcctccctccctggccccgtgaagtcttactctcacgctaagcagttgccagtggcgcaccggccatccgtgtttcaaagtcctgacgaggacgaggaggaggattacgagcagtggctggaaattaaggtttgtcttaccaaaactgtcagacccacaccacccagttcctggtgctttgttcctgggctcggcacacctgattcccttctccatcttaccctgttctctccacaccctttgtgcagatgcggcccgtag

SEQ ID NO: 20803 - DNA, 558 bp, Artificial Sequence
  Description of Artificial Sequence: Synthetic coding sequence
atgagcctgaagatggacaaccgggacgtggccggcaaggccaacaggtggttcggagtagccccccctaagtccgggaagatgaacatgaatatcctgcaccaggaggaactgatagcccaaaagaaacgagaaattgaggcaaagatggagcagaaggctaagcagaatcaggtggcttccccacaaccgccccatcccggcgaaattaccaatgcgcacaactcaagttgcatctcaaataagttcgctaatgatggaagcttccttcagcaatttctgaagctacagaaggcacaaacttccaccgacgctcccaccagtgcaccttctgcgcctccctctaccccgacccctagtgccgggaagaggagcttgctgatctcccggcgaacgggcctaggcctggcatctctgcctggccctgtaaaatcgtacagccatgctaagcagctcccggtcgcacatcgtccatctgtgtttcagtcacccgatgaggatgaggaagaagactacgaacaatggctggagatcaagggacggaggtggttacgctag

SEQ ID NO: 20804 - DNA, 3093 bp, Artificial Sequence
  Description of Artificial Sequence: Synthetic coding sequence
atggccgcccggcggatcacccaggagaccttcgacgccgtgctgcaggaaaaggccaagaggtaccatatggatgcatcgggtgaggccgtcagtgagaccctgcagttcaaagcccaggatctgctgcgcgcggtgccaagatcccgggccgagatgtacgatgatgtgcattccgacggacggtatagtctaagtggaagcgtggcgcattctcgggatgcaggccgagaggggctgcgcagcgatgtgttccccgggccttcatttcggtcatcgaatccaagcatctccgatgatagctattttcgaaaagaatgcgggcgggacctcgaattttcccactccgattctagggatcaggttatcggccatagaaaactcgggcactttcggtctcaggattggaagttcgcactgcgcggatcatgggagcaggatttcggccatccagtctctcaggagtcctcctggtctcaagagtactctttcggtccatctgccgtcctgggtgactttggcagttccagactaatcgaaaaagaatgtttagaaaaagagagtagggactatgacgtggaccacccaggagaggcagactctgtgctccgaggtgggtcccaggtccaagctagaggacgggcccttaacatagttgaccaggagggaagtctactaggcaagggcgagactcagggtcttctcactgcgaaaggcggcgtcggcaagctcgttactcttcgcaacgtatccaccaaaaagatcccgaccgtcaaccgtattacacccaagacccagggtacaaaccagattcaaaagaacactccgtcacccgacgtgacactgggcactaatcctggtacggaagacattcagttccccatccagaaaatcccactgggtctcgatctcaagaacctgagactccccaggcgtaagatgtccttcgatataatagacaagtccgatgttttcagtcggttcggaattgaaatcattaaatgggcaggtttccacactatcaaggacgacataaagttctctcagctcttccagaccctgttcgagttagaaaccgaaacttgtgcaaaaatgctggcgtcttttaagtgcagtctgaagcctgagcatagagacttctgcttttttacaataaagttcttgaagcactcggccctgaagacaccacgggttgacaatgagtttctcaatatgctgcttgataagggagctgtaaaaaccaaaaactgctttttcgaaattatcaaacccttcgataagtatattatgaggctgcaggacaggttgctcaaaagtgtaacaccactcttgatggcctgcaatgcctatgagctgtctgtgaagatgaagaccctgagcaaccccctggatttggccctggccttggagactacaaatagcttgtgccgcaagtctctcgccctcctgggccagactttttcgctagcctctagcttccgccaggagaagattttggaagcggtcggccttcaggacatcgcaccttccccagccgcatttcctaacttcgaggatagtactctgtttggccgagaatacatagaccaccttaaagcgtggctcgtgagctctggttgccctctccaggtgaaaaaggccgagccggagcctatgcgcgaggaagagaaaatgattcctccaaccaaacctgagatccaggccaaagccccaagcagcctcagcgacgctgtccctcagagggcagatcatcgtgttgtcggcactattgaccaacttgttaaacgagtcattgagggctcactgtctcctaaagagcgaaccctgttaaaggaagatccggcctactggttcttgtccgatgagaacagtcttgagtataaatattacaaactaaaactggcagagatgcagagaatgtccgagaacctccggggggctgatcagaaacccacttccgccgactgtgccgtgcgtgccatgctttatagccgtgccgtgagaaatttaaaaaagaaattactaccctggcagaggcgcggactgctgcgggcacagggcctcaggggctggaaagcacgtagagctaccaccggtactcagacattgttaagctcaggtacccggctgaaacaccacggcagacaggcccccggcctgtcacaagcaaagcccagccttcccgataggaacgacgcagccaaggactgtccaccagatcctgtcggcccatcaccccaggaccctagcctcgaggcaagtggcccgtcccctaagcccgccggtgttgacatctccgaggcccctcagacatcaagcccttgtccatccgcggacattgacatgaaaacgatggaaactgccgaaaagctagcaagattcgtcgcccaggtcgggcccgaaatcgaacagttctccattgagaactccactgacaaccctgacctttggttcctacacgaccagaattcaagtgctttcaaattctaccgcaaaaaagtcttcgagttgtgtccttccatttgctttacttcttccccccataatttacatacaggcggtggcgacactactggctcgcaggaaagcccagtggacctgatggagggcgaggcagaattcgaagatgaaccacctcctcgagaagctgagctggagtctcccgaggcctctagtgggacttgctttcctcgtaagcgcattagtagtaaatctttaaaagttgggatgattcccgcccccaagagagtgtgcctgattcaagagcccaaagtgcacgaacccgtgaggatagcttacgataggcctaggggccgccctatgagcaagaagaaaaaacctaaagacctggactttgcccagcaaaaactaacagacaaaaacctggggttccaaatgctgcagaaaatgggatggaaggaaggtcatggtctggggagcctggggaaggggatccgcgagcccgtcagcgtaggaacgccaagcgaaggagagggactgggcgctgatggacaggaacacaaagaggacacctttgatgtgtttcgacagcgcatgatgcagatgtaccgtcataagcgggctaataaatag

SEQ ID NO: 20805 - DNA, 3249 bp, Artificial Sequence
  Description of Artificial Sequence: Synthetic coding sequence
atggccgcccggcggatcacccaggagaccttcgacgccgtgctgcaggagaaggcgaagcggtatcacatggacgcctctggcgaggccgtttctgagacactgcagttcaaggcccaggatctactcagagccgttcccagatcaagggcagagatgtatgacgacgtccatagtgacggcagatatagcttaagcggaagtgttgcccatagcagagacgcgggcagagaaggcctcagatctgatgtgtttcctggaccttccttcaggagcagcaatccttccatttccgatgatagttacttccgcaaagagtgtgggcgtgatcttgagttctctcatagcgattctagggatcaggtgattggccacagaaaactcgggcatttccgcagtcaggattggaagttcgcactgcggggttcttgggaacaggattttgggcaccctgtcagccaggaaagctcttggtcgcaagagtactctttcggaccgtccgccgtgctgggggactttgggtcctctagacttattgagaaagagtgcttagagaaagaatcccgagattatgacgttgaccatccgggagaggctgattctgtactacgcggcgggtctcaggtccaagcccggggacgcgccttaaacatagtcgatcaggaggggtcactgctgggcaagggcgaaacccagggcctcctgaccgcaaaaggcggcgtggggaagctcgtgaccctccggaacgtctcgactaaaaaaattcccaccgttaatcgcatcacccccaagactcagggtacaaaccagatacagaaaaacacacctagtccagatgttaccctcggtactaatcctggcacagaagacatccagtttcccatccagaaaattccccttgggttggacctgaagaatttgcgcctgccgcgcaggaagatgtccttcgacataatagacaaatccgacgtctttagtcggtttgggatcgagattattaagtgggccggattccataccattaaagatgacatcaagttcagccagttgttccagactctattcgagttagagacagagacatgcgcgaagatgctggcctcttttaagtgcagccttaagccagagcacagagacttttgtttctttaccattaaattccttaagcacagcgcgctgaagactccccgggtcgacaacgagttcctgaacatgcttttggacaaaggtgcggttaagactaaaaactgcttcttcgaaatcattaagccatttgacaaatacataatgcgacttcaggataggttacttaaatcagtgactcctctactgatggcctgcaacgcttacgaactaagcgtgaagatgaaaactctcagcaatcctctagatctggcgttggccttggagaccaccaattccctgtgcaggaagtctctcgcccttctgggccagacattcagccttgcctcctctttccgtcaggagaagattctagaggccgtgggcctccaggatattgctcctagtcctgccgcgtttcccaatttcgaagatagcacactgttcgggagggagtatatagaccatctgaaagcttggctagtgtcttccggctgccccttacaagtgaagaaggcagagcctgaaccgatgagggaagaggagaagatgattccgccaaccaagcccgagatacaggctaaagcaccttcatcactgtctgacgctgtcccccaaagggcagaccatcgggtcgtcggtaccattgatcagcttgtcaaaagggttattgagggatctctctccccgaaggaaaggacattactgaaggaagatccagcatactggtttcttagcgatgagaactcgctggaatacaaatattacaagctgaagttggctgagatgcagcggatgtccgagaacttacggggagcagaccagaaaccaacttccgccgactgcgctgtacgggcgatgctgtacagccgcgccgtccgtaacctcaagaagaagctactgccgtggcaacggcgcggcctattgagggcccagggattgcgtggatggaaagcacggcgggctactaccggaacccaaaccttgctgtcctctggtaccagacttaaacaccatgggagacaggcgccagggcttagccaggccaaaccttccctccctgacagaaatgatgctgcaaaagattgtcctcccgaccctgtgggaccatccccgcaggatcccagcctcgaggcatccggtcccagccctaagcccgcgggagtggacatttccgaagctccacagacgtcttccccatgcccatctgctgacatcgacatgaagacaatggaaaccgcagagaagctggctcggtttgtggctcaagtcggccctgagattgagcagttttctatcgaaaactcaactgataaccccgacctgtggtttcttcacgatcagaactctagcgccttcaaattttatagaaagaaagtgttcgagttgtgcccctccatctgcttcacctccagtcctcacaatcttcacactggagggggggacaccacaggttcgcaggaaagtcccgtggacctcatggagggcgaggccgagtttgaagatgagccaccacctagagaggcagaacttgagagccctgaggtcatgcccgaagaagaggatgaggacgatgaggatggaggagaggaggcgccagcacctggaggtgctgggaaatccgaggggagcacccctgctgacggcctgcctggcgaagctgccgaggatgacttagccggggcacctgcattgtcccaggcatcttctgggacttgcttccctcgcaagcgaatttcgtctaaatctcttaaagttggtatgatcccagcaccaaaaagagtttgcctgattcaggaaccgaaagtacatgaaccagttaggatcgcctacgatcgcccaagaggaaggcccatgtccaagaaaaaaaagcccaaggaccttgacttcgctcagcagaaactgacagacaagaacttaggattccaaatgcttcagaaaatgggttggaaggaaggtcacggacttggaagtctgggaaaggggattcgcgaacctgtgtctgtgggcactccttctgagggtgaggggctcggagcagatggacaggaacataaagaggacactttcgacgtctttcgacagagaatgatgcaaatgtacagacacaaaagagccaataagtag

SEQ ID NO: 20806 - DNA, 3249 bp, Artificial Sequence
  Description of Artificial Sequence: Synthetic coding sequence
atggccgcccggcggatcacccaggagaccttcgacgccgtgctgcaagagaaagctaagagataccatatggacgcctccggggaagccgtgagtgagacacttcaatttaaggcccaggacttgctccgggctgtaccaagatcacgggccgagatgtatgacgatgtgcactccgacggtaggtattctctttccggcagcgtggcacattcaagggatgccgggagagaggggctcaggtccgacgtattccctggtccaagcttcagaagttccaacccgagcatatctgacgattcctactttcgaaaagagtgcggccgcgatttggagttctcacactcagactccagggaccaggtaatcgggcaccgcaaactgggccacttcaggagccaggattggaagtttgcccttcgcgggtcctgggagcaggatttcgggcaccccgtgtctcaagaaagcagttggagccaggaatacagcttcggaccgtccgccgtgctgggagatttcggttcatcaagactcattgagaaggagtgcctcgagaaggaaagcagagactatgacgtagaccatccaggcgaggctgactccgtgctgaggggtgggtcccaggtccaagcccggggaagagctctcaacattgtggatcaggaggggtctctgttggggaaaggggagacacaaggcctcttgacagccaagggtggcgtaggcaagctggttacacttcggaacgtgtctacaaagaaaattcctactgtcaatcgcattacgccaaagacacaaggcacgaatcagatccaaaagaataccccaagtcctgatgtcaccctggggactaaccccggcacagaagacatccaattcccaattcagaaaattcccctgggactggaccttaagaacctaagacttcccagaaggaaaatgagcttcgacataatcgacaaatccgacgtgttctctcggtttggaattgagatcataaagtgggctggatttcataccattaaagacgacatcaaatttagccagctctttcagactcttttcgagctggagaccgaaacttgtgcaaaaatgctggcctccttcaaatgcagtcttaagccagagcatcgggacttttgtttcttcacgataaaatttctgaagcacagcgccctcaagactccccgcgtggacaatgaattcctgaatatgctacttgacaaaggcgctgtgaagaccaagaactgcttcttcgaaatcatcaagcccttcgataaatatatcatgagactgcaggatcgcctgctgaaaagcgtgacccctttgctgatggcttgtaatgcatacgaactgagcgtgaaaatgaagaccctttcaaatcccctagacctagctttagccttggagactaccaatagcctgtgtagaaagtcacttgcactcctcggccagacgttctctctcgcttcctccttccgccaggagaagatactggaagcggtgggtcttcaggatattgctcccagccccgccgccttccctaattttgaggatagtaccttgtttgggcgcgagtacatcgaccaccttaaggcatggctggtgtcttctggatgtcccttgcaggtgaagaaagctgagcccgagccaatgagggaagaggaaaagatgatccctcccactaagcccgaaattcaggctaaggccccaagcagcctgtcagacgccgtgccccagcgagcagatcatagagtcgtgggcaccattgaccagcttgttaaaagggtcatcgaaggatcgttgtcccctaaggaaaggacccttctaaaagaggatcccgcttattggtttcttagtgatgagaacagcttggaatacaagtactataagcttaaacttgctgaaatgcagcgcatgtcggagaatctcaggggcgccgaccaaaaaccaacaagtgcagactgcgctgtgagagccatgctatattccagagccgtcaggaacctcaagaagaagctccttccttggcagcgcaggggcctcctgcgcgctcagggattaagaggctggaaagccagaagagccactacgggtactcagaccctcctttcatccggtactcgactgaagcatcacgggcgccaagctccgggcctgagtcaggctaaacctagcttaccggacagaaacgatgccgctaaggattgccctccagatcctgtgggtccatcccctcaagatccatcactagaggcatcaggcccctcacctaagcctgctggcgtagatatctctgaggctccccagacatcaagcccctgtccgtccgccgacatcgatatgaaaaccatggagaccgcggagaaattagcacgcttcgttgcacaggtgggtccggagatagaacagtttagcattgagaatagcaccgataacccggacctgtggttcttgcatgatcaaaatagttctgccttcaagttttatagaaagaaagtcttcgagctgtgtcccagtatctgctttacatcttctccccacaacctgcacaccggtggcggtgacaccaccggcagtcaagagtccccagtggatcttatggaaggcgaggcagagtttgaagacgagcccccccctcgggaagcagagctcgagagtcctgaggtgatgccagaggaagaagacgaagatgatgaagatggtggggaagaagcccccgcacccggaggggcggggaaatctgaggggtcgacgccagccgatggattacccggtgaggcagcagaagacgacttggccggcgcaccagcgctatctcaggccagttccggcacatgcttccctcgaaaacgaatttccagcaagtcacttaaggtggggatgatacctgcaccgaagagagtgtgtctcatacaagagcccaaggtgcatgaacccgttcgcattgcttacgatcgtcctcgcggccgccccatgagcaaaaagaagaagcccaaggatcttgactttgcccaacagaagctcacagacaagaatttaggcttccagatgctccagaagatgggttggaaagagggtcacggcctcgggtctctgggcaagggaatcagagagcccgtttcggttggaaccccaagtgaaggggaaggcttaggcgccgacggccaggagcacaaagaggacactttcgacgtcttccggcagaggatgatgcagatgtatagacacaagcgcgccaataagtag

SEQ ID NO: 20807 - DNA, 2586 bp, Artificial Sequence
  Description of Artificial Sequence: Synthetic coding sequence
atgaccgccaccttcgccaagaacgtggccggcatctggaacttcctgacactcatcctcggaactaggagcctggctacggggaattggggcatctccgtccttcgtacaggcaatctgcggtctgtagtcctgggcaataagactttggctatacaatttctcaaatctccactgggacacagaagcattgtgttgatcccattaggcctcgatctgaagaatcttcggttgccccgcaggaagatgtcattcgacattatcgacaagagcgatgtgttcagccgcttcgggattgaaatcatcaaatgggccgggtttcatacaatcaaggacgacatcaagttcagtcagcttttccagacattattcgaattagaaactgagacatgcgccaagatgctagcttctttcaagtgcagcttgaagcccgaacacagagacttctgtttttttactattaaatttctgaagcattcagcactgaagactccacgggtagacaatgaatttctcaatatgctgctcgataaaggcgctgtgaagacgaagaactgttttttcgaaataataaagcccttcgataaatacatcatgagattgcaagacagattacttaaaagcgttacgccactgctgatggcctgcaatgcttacgagctgagcgttaaaatgaaaactctttcaaacccactagatctagctctcgctttagagaccactaactcactgtgtagaaaatcccttgcattgctgggccaaactttcagtttagcgtcttctttcaggcaagaaaagatactcgaagccgtgggcctgcaggacatcgcaccatctccggccgctttcccgaactttgaggatagtacactgtttgggcgggagtatatagaccatctaaaggcttggcttgttagcagtggatgtcccctccaggtcaaaaaagctgaacctgagcccatgagagaggaagaaaaaatgattccccccacaaagcccgagattcaagcgaaagcgccgtccagcctctccgacgccgtaccccagcgcgctgaccaccgagtggtgggaacgattgaccagctggtgaaacgagtcatcgagggaagcctgagtcccaaagaacggacccttttgaaagaagaccctgcttactggtttctgagtgatgagaactctcttgagtacaagtattacaaactgaaattggctgagatgcagcgcatgtcagagaacctcagaggagccgatcagaagcctacttctgcagactgtgcagtgagagccatgctgtatagcagagcagtacgcaatctaaaaaaaaaactgctcccttggcagcggaggggcctgttgagagcccagggactacggggctggaaagctaggcgtgctaccactgggacacagacattgctgagcagcgggactcgcctgaagcatcacggcagacaggcccctggtctatctcaggccaaaccaagcctccccgaccgaaatgatgcagccaaggactgtcctccagatcccgttggcccttcacctcaggacccttctctcgaagcttctggaccttcacccaaacccgcgggcgtcgacataagtgaagctccccagacctcctcaccatgcccctcggccgacatcgacatgaagaccatggagaccgccgaaaagctggccagatttgtcgcgcaggtggggcccgagatcgagcagttctcaatcgaaaatagcaccgataaccccgatctatggttcttacatgatcagaatagcagtgcatttaaattttatcgcaaaaaagttttcgaactgtgccctagcatttgttttacatcttcacctcacaatttgcacaccggcggcggcgatacaactggaagccaagagagtccagttgatttaatggagggcgaggccgagtttgaagacgaaccacctccacgggaggccgagttagaatcccccgaggtaatgcccgaagaagaggacgaggacgacgaggacggcggagaggaggcaccagcaccgggtggggcggggaaatctgagggttcaactccagccgatggtctgcccggcgaagccgccgaagacgacctggccggagctcccgcgctgtctcaagcatccagcggcacgtgtttcccgcggaaacgtatatcgagcaaaagtctcaaagtcgggatgattccggcccccaaacgagtctgtttgatccaggagccaaaagtgcatgagcccgtcaggatagcctacgaccgcccgagaggcaggcctatgtcgaagaaaaagaagcctaaggaccttgatttcgcccagcagaagctgaccgataaaaacctgggttttcagatgctgcagaaaatgggatggaaggagggccatggtctggggtccctgggaaaagggatccgggagcccgtctcggtgtacgctgccggcagtctgggctgggagtgggtaggaccccaatctttccacttacagcctgccgcttggctgttacactcccaggatggcctacagctcgctgttgatttctgtttcctaaacaggcggcacttacagatgagatcctag

SEQ ID NO: 20808 - DNA, 534 bp, Artificial Sequence
  Description of Artificial Sequence: Synthetic coding sequence
tgaatgaagcacaccgccaccgcccggttccagcggaaccaccggctgatctcagagatactgagcgaatctgtggtgcctgacgtaagaagtgtggtgacaaccgccagaatgcaggtgcttaagcgtcaggtccaatctctaatggtccaccagcgcaagttggaagccgaattactgcagatcgaagagaggcaccaggagaaaaaaaggaaattcctcgaaagtacggactcgttcaataacgagctaaaacgcctctgcggcctcaaggtagaagtggatatggaaaagattgctgcagagatcgcccaggcagaggagcaggctagaaaacgacaggaggaacgtgagaaggaggccgcagaacaagcagagcgtagccaaagtagtatcgtgcccgaggaagagcaggctgctaacaagggagaggagaaaaaggacgatgagaacattcccatggagacagaaaagaactgtcagctgtgtccccgaaaaacactcacctcccgctacacagactttcctgactag

SEQ ID NO: 20809 - DNA, 1236 bp, Artificial Sequence
  Description of Artificial Sequence: Synthetic coding sequence
atgagcaagcggcccagctacgcccccccccccacccccgcccccgcaacacagatgccctcaacccccgggtttgtgggttataacccttattctcacctggcatacaacaattatcgattgggaggtaaccccggaacaaattctcgcgttacggcctcttccggcattacaatacccaaaccacccaaaccccctgataagcccttgatgccatacatgcgatactccagaaaggtgtgggaccaagtgaaggcctccaaccctgatctgaagttgtgggaaattggtaagatcattggcggcatgtggcgggacctgaccgacgaggaaaaacaggagtacctgaatgagtacgaagcggaaaagattgaatacaacgaatcaatgaaggcttaccataactctcctgcatatctcgcatacatcaatgccaagtcccgcgcggaggctgccctagaggaagagtcccggcagcgccagagccgaatggaaaagggtgaaccctatatgagcatccagccagccgaagacccagacgactatgacgatggattctctatgaaacataccgctacggcccgttttcagagaaatcatagacttatcagcgagatcttgagtgagtccgttgtcccagatgtccgctccgtggtgaccacagctcgcatgcaggtgcttaagagacaggtgcaatccctaatggtgcaccaacggaagctcgaagcagaactgctgcaaatcgaagagcggcatcaggagaaaaaacggaagttcctggaatccacagactcctttaacaacgagctgaagcgcctgtgtgggctgaaagtggaggttgacatggaaaaaatcgcagcagaaattgcccaggccgaggagcaggctaggaaacgccaagaagagcgcgagaaagaagccgctgaacaggcagagaggtcgcagtcttccattgtgccagaggaagaacaggcagcaaataagggagaggaaaagaaggatgacgaaaacatcccaatggaaacagaagagactcatctggaggagactactgaatcacagcagaacggcgaggagggaacatccaccccagaggacaaagagagtggtcaagagggtgtggactccatggcagaggagggaacaagtgactctaacacagggtcagaaagcaacagtgccaccgtggaggagccacctactgaccctatcccggaggatgaaaagaaggaatag

SEQ ID NO: 20810 - DNA, 987 bp, Artificial Sequence
  Description of Artificial Sequence: Synthetic coding sequence
atgagcaagcggcccagctacgcccccccccccacccccgcccccgctaccgcatctagcggcataaccattcccaagcccccgaaacccccagacaaaccactcatgccctatatgaggtattcacggaaagtctgggatcaggtaaaggcttcgaatccagacttaaaattgtgggagattggtaagattattggaggcatgtggcgcgacctgacagacgaggaaaagcaggaatacctgaacgaatatgaggccgaaaagatcgagtataatgagagcatgaaggcataccataatagcccagcatacttagcatacattaatgccaagtcccgagccgaggcggcccttgaggaggagtctagacaaagacaaagcagaatggagaaaggagaaccatacatgtctatacagcccgctgaggatcccgacgattatgacgatggattctcaatgaagcacaccgctaccgctcgcttccaacgaaatcataggttgattagcgaaatactgtcagagtcagttgtcccagatgtcagaagcgtagtgactacagccagaatgcaggtgcttaaacggcaggtacagtctctcatggtccaccagagaaaactcgaagccgagcttttgcagattgaagagcgacaccaggagaagaagcgaaagtttcttgaatccacagacagcttcaacaacgaactgaagcgactgtgcgggctgaaagtcgaagtggacatggagaaaatagccgccgaaatcgcccaggccgaggagcaggcccgcaagcgccaggaagagcgggaaaaagaggccgccgaacaggccgagaggtcacagtcgtcaatcgtccctgaggaagagcaagcagccaataagggcgaagagaagaaagacgatgaaaacatccccatggaaaccgagaagaattgtcagctttgcccgcgaaagacacttacttccagatacacagactttcctgactag

SEQ ID NO: 20811 - DNA, 570 bp, Artificial Sequence
  Description of Artificial Sequence: Synthetic coding sequence
tgagccgaggaccccgacgactacgacgacggcttcagcatgaagcacacagccacggcgaggttccagcgaaatcacaggttgatcagcgaaatcctgagtgaatccgtggttcccgatgtgcggtctgtggtgacaacggccaggatgcaggtgttgaagcgccaggtgcagtctctgatggtccaccagaggaaacttgaagcagagctgttgcaaatcgaggaacgtcaccaagaaaaaaagcgtaagttcttggaaagtacagattcattcaataacgagctgaagcgcctgtgcggtctgaaagtcgaagttgatatggaaaaaattgcagctgaaatcgcgcaagcagaggagcaggctcggaagcgccaggaagagcgcgagaaggaagcagcagagcaggccgagcgctctcagtctagtatcgtcccggaagaggaacaggcagcaaacaaaggagaggaaaagaaggatgacgaaaacatcccaatggaaaccgagaagaattgtcagctttgtccacggaagactctcaccagtcgatatacagatttcccagactag

SEQ ID NO: 20812 - DNA, 1182 bp, Artificial Sequence
  Description of Artificial Sequence: Synthetic coding sequence
atgcccagcacccccggcttcgtgggctacaacccctacagccacttggcatacaataactaccggctgggaggaaaccctggaacaaatagccgggtcaccgcttcgagcggtatcactatccctaaaccaccaaagccacccgataagcccctgatgccctacatgaggtattcccgtaaggtttgggaccaagtgaaagcctctaaccccgatctgaagttatgggaaatcgggaagatcatcggcggcatgtggagagacctgactgatgaggaaaagcaggagtatctcaacgaatacgaagctgaaaaaatcgagtataacgagtccatgaaagcataccacaattcgccagcctacttagcttacattaatgctaagtctcgggccgaagctgccttggaagaggagtctcggcagcggcagagtcggatggagaagggagaaccctatatgagcatacagcccgctgaagatcccgacgattacgatgatggcttttcaatgaagcacactgctacggctagattccagcgtaatcatagactcatctcagagatcctcagcgaatccgtggtgcccgacgttagatcagtcgttaccactgcgcgaatgcaggtgctgaaacgacaagtgcagtcccttatggtccaccagagaaagttggaagcggagcttctgcagatcgaagagcggcaccaggagaagaaacggaagttcctcgagtcaacagactcatttaataacgaattaaaaagactgtgcggcctgaaggttgaagtggacatggagaaaattgccgccgaaatcgcccaggcagaagagcaggctaggaagcgccaggaggaaagggagaaagaggctgcagagcaggctgaaaggtcacaatcttctatcgttccagaggaggagcaggcagccaataaaggggaggaaaagaaggatgatgaaaatatcccaatggagaccgaagagacacatctcgaggaaacaacagaaagccagcagaatggcgaggaaggcacttcaacccctgaggataaagagagcggccaggagggggtcgattccatggcggaagagggaaccagcgatagtaataccggttcagaatcaaattccgctacggtggaagaacccccaaccgaccctattccggaggatgagaagaaggaatag

SEQ ID NO: 20813 - DNA, 474 bp, Artificial Sequence
  Description of Artificial Sequence: Synthetic coding sequence
ctgagcgagagcgtggtgcccgacgtgcggagcgtggtgaccaccgcgcggatgcaagtcttgaaacgccaagtccagagtttgatggtccaccagcgcaagctggaagccgaactcctgcagatcgaggaacggcaccaggagaaaaagaggaaatttcttgagtccactgattcattcaataacgagctgaaacgcctatgtggcctaaaggtagaggtcgacatggagaaaatcgctgcagagatcgcccaagctgaggaacaggcacggaaacgtcaggaggagagagagaaagaggctgctgagcaggcggaacggtcccaatctagtatcgtgcccgaggaggagcaggccgccaataagggagaggagaaaaaagacgacgagaacattccaatggagactgagaagaactgccagttatgtccacggaagacattgacctcgcgctataccgacttccctgactag

SEQ ID NO: 20814 - DNA, 1026 bp, Artificial Sequence
  Description of Artificial Sequence: Synthetic coding sequence
atgccctacatgcggtacagccggaaggtgtgggaccaggtgaaggctagtaatcctgatctgaagctgtgggagattggaaagataatcggtggcatgtggcgcgacctgactgacgaagagaagcaagagtacctcaacgaatacgaggcagagaagatagagtacaatgaaagcatgaaggcataccacaacagtccggcctatctggcttatatcaacgccaagtcccgggccgaggctgctctggaggaggagagtaggcagcgccagagtcgcatggagaaaggagagccgtacatgtcaattcagccggcggaggatcctgatgactatgacgatggattcagcatgaagcacactgccaccgccaggttccaacgtaatcatagactgatcagcgaaattttatctgagagcgtcgtgcccgatgtacggagcgtggtgaccaccgcaagaatgcaggtcttgaaacggcaggtgcagagcctgatggtgcatcagagaaagctcgaggccgaactcctgcaaatcgaagaacgccatcaggaaaaaaagagaaaattccttgagagcacagactccttcaataatgagctcaagcggctgtgcggcctgaaagttgaagtggacatggagaagattgccgctgagatcgctcaggctgaggagcaggcaagaaaacgccaagaggagagggagaaggaggcagccgaacaggctgagcggtcccagtcctcgattgtcccagaggaggagcaggctgctaataagggtgaggaaaagaaagacgacgagaatatacctatggagaccgaagaaacacacttggaagagaccacagagagccagcagaatggagaggagggtacatcaacaccagaggacaaggagtcaggacaggagggcgtggacagcatggccgaggaaggaacatcagacagcaatacagggagtgagagtaattctgcaactgttgaggagccccctacagacccaatccccgaagacgagaaaaaagaatag

SEQ ID NO: 20815 - DNA, 708 bp, Artificial Sequence
  Description of Artificial Sequence: Synthetic coding sequence
atgcagcggcggggccagcgggacctgtggcggcacaacaagagctgcgcaagaaatagatgcccacgaccgcctagagaacggggaggtgcgggcttcccatgggtgcgtgctcagttatctgttcgccaattcaccctgcgtgttagggtgcccggtcctgtgcacctgcgaggaaggagtccgacccccgctcttgacccactggccccgctgaatccactcatcagggggccaagaactcctggacttagaaggtggattcaatctttggcacttctgcttccaaattgtagctccagcagaatccctactgtaccccggccccactcaggactctgggtgcagtctgatttcccgctgggtttcctgtcaagaaccgagccccggttgaccaggagctgtaggggagctttccggagccctcgacccctgccaaagtcgggtcaagccgatggcacatcggaggaatctttgcacctggacatccagaagctaaaggagaaaagggacatgctggacaaggaaatcagccagtttgttagtgaaggatacagcgtggatgaattagaggaccacattacccagctgcatgagtacaacgatataaaagatgtcgggcagatgttgatgggcaaattggcagtcatcaggggagtcaccaccaaagagctgtatcctgagtttgggctggatatgaatgactag

SEQ ID NO: 20816 - DNA, 924 bp, Artificial Sequence
  Description of Artificial Sequence: Synthetic coding sequence
atgaagaacctggtggtgcccatgtgggagggcaagtggaagaccgccaagagggcacggatgaattacaaggttaagctcgaggagatttccggactgttagtggatgcactttataccaacactatctattatctgatcaaggttgattatagagaggtttggctgatccgactcttttacaattttagctttcttgaaaagaaccaggatttcacatttaagatggagagcccttctgacagtgccgtcgttctcccatctactccgcaggccagtgccaacccgagctctccatacacaaattcttcccgtaagcagccaatgagtgccaccctgagggagcggctacgcaagacgcggttcagctttaactcttcatataatgtggtcaaacgtcttaaagtcgagtctgaagaaaacgatcaaaccttctctgagaaacctgccagtagtacagaggagaattgcctggaattccaggagtcattcaagcatattgatagtgagtttgaggaaaacactaacctcaaaaacacacttaaaaacttaaacgtgtgcgaatcccagtctttagattcgggaagttgtagcgcccttcagaacgaatttgtgtcagaaaagctgcctaaacagagacttaacgctgagaaggccaaattggtgaagcaggtgcaggagaaggaagatctgcttcgacggctgaaactggttaaaatgtatagatcaaagaacgacctgtcccaactgcagcttctcatcaaaaagtggcgaagctgttcccaactgctgctctacgaattgcagtcagcggtgtctgaagaaaataagaagttgtctttgacccagttaatcgaccactatgggctcgacgataagttactgcattacaacaggagcgaggaggaatttatcgatgtgtag

SEQ ID NO: 20817 - DNA, 738 bp, Artificial Sequence
  Description of Artificial Sequence: Synthetic coding sequence
atggccgagggcgagaagaaccaggacttcaccttcaagatggagagcccaagcgatagcgccgtcgtccttcccagtacaccccaggcctctgctaatccctcttccccctacactaattcttcgcggaaacagcctatgagcgccacacttagggaacgactcaggaagactagattttccttcaatagctcttataacgtggtcaaaagattaaaagtcgagtcagaggagaatgaccagaccttcagcgagaagcccgcctcatcaaccgaggagaattgcctcgagttccaggagagctttaaacacatcgattccgagttcgaagaaaacacgaacctgaagaacacgttaaaaaacctcaacgtgtgcgagagccaatccctcgactctgggtcttgctccgctttgcagaatgagtttgtgtccgaaaaactaccaaaacagcggctgaacgcagagaaggctaagctggtgaaacaggtccaagagaaagaggatcttctgaggcgcctcaagttagtgaagatgtaccgtagcaaaaacgatttgtcgcagctacagctacttatcaagaaatggagatcgtgcagtcaactgctgctgtatgagttgcaatcggcagtgtcagaggagaacaaaaagttgtcactaactcagctaatcgatcattatggcctcgacgataagctactgcactacaacagatcggaggaagagttcatcgatgtttag

SEQ ID NO: 20818 - DNA, 699 bp, Artificial Sequence
  Description of Artificial Sequence: Synthetic coding sequence
atggagagccccagcgacagcgccgtggtgctgcccagcaccccccaggcgtctgccaacccctcgtcaccgtataccaactcttcacgcaaacagccaatgtctgctaccttgagagagcggttgcgtaaaacaaggtttagcttcaacagctcatataacgtcgtgaagcggttaaaagtggaaagcgaagagaacgaccaaaccttcagcgaaaaaccggctagctctaccgaagagaactgtctggaattccaagagagcttcaaacacatcgacagcgaattcgaggagaataccaatctgaagaacaccctgaaaaatctcaacgtctgcgaaagccagagtctcgatagcggctcatgctctgccctgcagaatgagtttgtaagcgagaagctgcccaagcagcgcctcaacgcggagaaagctaaactcgtgaagcaggtccaggaaaaggaggacctcctcaggcgcctcaagctggtaaagatgtatcggtccaagaatgatttgagtcagttacagctgctgatcaagaagtggaggtcctgtagccagctcctgctctacgaactgcagagtgccgtgtccgaagagaacaaaaagcttagccttacccagttgattgaccattacggccttgatgataagttactccactacaacaggtctgaggaagagttcatagacgtttag

SEQ ID NO: 20819 - DNA, 1059 bp, Artificial Sequence
  Description of Artificial Sequence: Synthetic coding sequence
atgttccggggcctgagcagctggctgggcctgcagcagcccgtggctggcggcggacaaccaaacggggatgctccccctgaacagccctctgaaacagtggccgaatcggccgaggaggaactccagcaggccggagatcaggagttgctgcatcaagcaaaagactttggcaactacctctttaacttcgcctcagccgctactaaaaagattactgagtccgtcgcagaaaccgcgcagacgattaagaagagcgttgaagaaggtaaaattgacggcattattgacaagaccataatcggcgatttccagaaagaacagaagaagttcgttgaggagcagcacacgaagaagagtgaggccgctgtccctccttgggtagacacaaacgacgaagaaacaattcagcagcagatcctggcactctccgccgataaacgcaacttcctgcgcgaccctccagccggcgttcagtttaattttgactttgaccagatgtatcccgtggctctggtgatgttgcaggaagacgaactgcttagtaaaatgaggttcgcccttgtccccaaattggtgaaggaggaagtgttctggcgtaattacttctaccgcgtctccttgatcaagcagtccgcccaacttaccgctctcgcagcacagcagcaggcagcagggaaggaggaaaagtccaacggaagagagcaggacctgcccctcgcggaggccgttaggcccaaaactccaccggttgtgatcaagagccagctgaagacccaggaggacgaggaggagatctctacttcacctggggttagtgagttcgtgtcggatgccttcgacgcctgtaaccttaaccaggaggacctgaggaaggaaatggagcagctggtgctcgataagaaacaggaggagaccgccgtgctggaggaggatagtgcagactgggagaaggagcttcagcaggaattgcaggagtacgaagtcgtgactgaatccgagaaaagggacgagaactgggacaaagagatagaaaagatgctgcaggaagaaaactag

SEQ ID NO: 20820 - DNA, 2439 bp, Artificial Sequence
  Description of Artificial Sequence: Synthetic coding sequence
atgcaggccaagaacaaggacgccctgcagcccatcaaggaggaccgcactggcaaagcccaggacgacgctttttggcttcagtctctgattaccgacgcctttcatgataaaggctttcaaaagattaaggagtattttcagcaaaaggaatcccacttcccacagaagtacaatcggctgctgctgtacaggctcgaccgcagtatcaacaaggagcttgacaaaaatgagtttcagagcgttagtctgctgctcaaatgtatacaacgcttcctggtggatgggctgaaggaagatgagcctcttctaattcgtcagggacttattcccaaactagtcagctggttcgaaaggacgaccggaatattaacatccgaaggactggcctcagacacaagcctaatctgcgtgatcgaggattttttcgacactgctttgatcatcagccggagctcttcagaggggaagatccaaatgttggactcttttctgttgtctctggggtttctcgtgaccgagaagaccgtgaatcacctgctgcagcaggagggtttgaagactttcaactgtatactgcacgctgtcccacgtgaagagagaaagaagtttccgctgtctgaggggatgtgtcacctgatgaaggatttggctcgaacacttttgacagtcggggactacgaccaacaggtagctattagcgaggctctctgcaggcttaccatcaagaaatccagagacgagcttgtgcataagtggttcgatgatgaggtgattgccgaggcatttaaggagataaaggatcgggagttcgagacagattctagacgctttctcaatcatttgaataatagactcggcgatcagcggcgcgtttatagcttcccttgcatagcagcttttgccgacgagcatgagatgagaaaaccagccgacgagaaacttgagaagttttggattgattttaatctgggatcccaaagcgtcaccttctatattgacaatgcagagaacaccctctgggactccgtcaccctcccaaaggaagccgtcatgaacttttctataactgagaccgaaaagattaagattttcatcatttatcttaagaaaccgatgatcatcagttacaaggaggtcatgaagatcgagattcacttcgatcttcaatttaacattagtcaggtgtccattcaggccctgggcgaagataagcagatgctcccagaccagacaaagatttcctctgagctcttctccaaatctgacaaagaggatagggaatctccaagcggtcttgagcgcgaaacagagcaagccgaggagtcaacaaacatggtggagtttatgagtgccgaggatgatcgctgcttaattaccctccacctgaacgatcagtctgagcctcccgtgataggggagccagcctctgactcacatctccagcctgttcctccctttggcgtaccggatttcccacagcagccaaaatcacactacagaaagcacctattctctgagagtaatcaggatagctcaacttctgagttgtcctggacctctaatcaaaagaagaaaagcctcaagagttattcttcaagaaagaagacgcgcacaagaagcaatctccgtatcttacccgtcttccccccaagctccggcagcggccacgagaaggatcaggctaaactgttaagcccatccgagaaagagatcccagaacagaataacaccacatcccccaagacttcagagcagaaatttcaagatagttttgcttttctaaccgccgaagactctgcacagaagacagagttacaggacccacactcacttagcgagctcagttcccttaagcactccgaggatgaagagaaacccaagatcgtgaaccaggagtctctgacagaaagtacctcgttaaagcataaactccgaaacctggaggacaaggatatcccagagggaagttttgccaaatcccagcaatcacgattagaggaggaggtcgcaccggggagccctttctctataacagaggagcgggaactgcccgagggcatctccactagctctctcgaagttgtccccgagaatctgaacggctctgctatcctgccgaccttcgagaacttcacaaagaaacgaaaaaggaagtatgaactgagataccgaaaacgcccatttaatagcgagaatgccaagaaagccccagattgcctgatcaaactgctgaatcagatgcagctctttagattaaataaactggagcggtttcagaacctggtgctgcaggagctatctagcctaaagcaagatatccaggccctggagcacttggagaaagaagtgctcgaattctggggaaagcaatccgccgatctgcagagtttttgtgatctgcaggtgctacgatttaactcgacacagacttcctag

SEQ ID NO: 20821 - DNA, 867 bp, Artificial Sequence
  Description of Artificial Sequence: Synthetic coding sequence
atgctggacagcttcctgctgagcctgggcttcctggtgaccgagaagaccgtgaatcatctcttgcaacaggaggggctgaaaaccttcaattgcattttacacgccgtgcctagagaggagagaaaaaaatttcccctgagcgaaggaatgtgtcacctgatgaaagacctggcaaggaccctactgacggtcggcgattatgatcaacaggtcgcaatctcagaggccttatgtagattaaccataaagaagtcgagagatgaacttgtgcacaaatggttcgatgacgaggtgattgctgaagcttttaaagaaatcaaagatcgcgagttcgagaccgactctagaagatttctcaaccatttaaacaaccgtctgggggaccaacgtcgtgtgtacagcttcccctgcatcgccgcgttcgctgatgagcatgagatgaggaaacccgccgacgaaaagttagagaagttttggatagatttcaatctagggagccagagtgttaccttttacatcgacaacgccgaaaataccctgtgggacagtgttaccctaccgaaagaggctgtgatgaatttttctataacagagaccgagaagatcaagatcttcattatctatctgaaaaagccaatgattatttcctacaaggaagtgatgaaaatcgagatccacttcgacctgcagtttaacatatcccaggtgtccatccaggcccttggggaagataaacaaatgcttccggatcagacgaagatatcatccgaattgttcagtaagagcgacaaggaggatcgggagtcacccagtggcctggaaagagagacagaggtctccctccagaagacaagtctcctgtag

SEQ ID NO: 20822 - DNA, 1845 bp, Artificial Sequence
  Description of Artificial Sequence: Synthetic coding sequence
atgggcgactggatgaccgtgaccgaccccggcctgagcagcgagtctaaaactattagtcagtatacatcagaaacaaagatgtccccttcctctctgtactcacagcaggtgctgtgctcatcgataccgctcagcaagaatgtccactcctttttttctgcattttgcacggaggacaacattgaacagagcataagctacctggaccaggagctcactactttcggattcccatctttgtacgaagaaagtaagggaaaagaaaccaagcgagagctcaacattgtagctgtcctgaactgcatgaacgagttactggtgttacagcgcaagaacctcctggctcaggaaaatgttgaaacacagaatctgaagctgggctctgatatggaccacctgcagagctgttactccaagctgaaagaacagctggagacaagcaggagagagatgatcggcctccaggagagggaccgtcagctgcagtgtaaaaacaggaacctacaccagctactcaaaaatgagaaagacgaggtccaaaagcttcagaacattatagctagccgggcgactcagtacaaccacgatatgaaaagaaaggagagagagtataataaactgaaagaacggcttcaccagctcgtgatgaacaagaaggacaagaaaattgctatggatattctgaactatgtcggaagagcggatggtaagaggggatcctggcggactggaaagacagaagcaaggaatgaggacgaaatgtacaagatactgctcaacgactacgaatacaggcagaagcaaatcctcatggaaaacgccgagctcaagaaagtcttgcagcaaatgaagaaggagatgattagcctcctctcacctcaaaaaaagaaaccacgtgagagagtcgatgattccactgggacagtcatttcggatgtggaagaagacgccggtgaattaagtcgagaaagtatgtgggatctgagctgcgaaactgttagggaacagcttactaattctatacggaaacagtggaggatcctcaaatcccatgtcgagaaattggataaccaagtcagtaaggtgcacctggaaggcttcaacgatgaggatgtgatctctaggcaagatcacgaacaggagacagagaagttggaactggaaatacagcagtgcaaggagatgatcaagactcagcaacagctgctgcaacagcagctcgcgacagcttatgacgacgacaccacctctctcctacgagactgttatctactggaagagaaggaacggctgaaagaggaatggagcctgttcaaagagcagaaaaagaattttgaacgcgagagacgttcgttcacagaagccgccattcgcctaggtctggagcgcaaagccttcgaagaagaaagggccagttggctgaaacagcagttcctcaatatgaccacattcgaccaccagaactctgagaatgtcaaactgttcagcgccttctctgggtcctcagattgggacaacctcattgtgcactcccggcagcctcaaaagaaaccacactcggtaagtaacgggagcccagtgtgcatgagcaaactcaccaagagccttccagccagcccatccacctctgacttctgtcaaacacgtagctgtatcagcgagcactcctctattaacgtccttaacatcactgccgaggagatcaaacccaatcaggtgggcggcgaatgcaccaatcagaagtggtcggtcgcatcccgcccgggatctcaggaaggttgctattcagggtgttccctctcctatacaaatagtcatgtggaaaaggatgatttaccatag

SEQ ID NO: 20823 - DNA, 1683 bp, Artificial Sequence
  Description of Artificial Sequence: Synthetic coding sequence
atgggcgactggatgaccgtgaccgaccccggcctgagcagcgagtccaagactatctcccagtacacgagcgagaccaagatgtcgccatctagcctctatagccagcaagtgctgtgctcgtccatccctctatcaaagaacgtccactccttttttagcgccttctgtaccgaagacaacatagaacagagtatatcttacttggatcaggagctgacaacctttggatttcccagtctgtacgaggaatccaagggaaaggagacgaagcgcgagctgaacattgtcgccgtgctgaactgtatgaatgagttgctcgtgctgcagagaaaaaatctcctagcacaggagaacgtggagacccagaacctgaaattggggtctgatatggaccatctccagtcttgctacagcaaactgaaggagcagctggagacttcccgccgcgagatgatcggccttcaagagcgtgaccgacagctgcagtgcaagaataggaatttgcaccagctcctcaaaaatgagaaagatgaggtccagaaacttcagaacatcattgccagcagagcgacgcagtataatcacgacatgaagaggaaggagcgcgagtacaataaactcaaagagaggctgcatcagctggttatgaataagaaggataagaagatcgccatggatattttgaactacgtaggccgggccgacggaaagagggggagctggcggaccgggaagacggaggcgcgcaacgaggatgagatgtataaaattctcctaaacgactatgaatatcgccagaaacagattcttatggaaaacgctgagcttaaaaaagttctgcaacagatgaagaaagaaatgataagcctactttccccgcagaagaaaaaaccacgcgaacgggttgatgacagtacagggacagttattagtgacgtcgaggaggacgccggggaattaagcagagagagcatgtgggatctgagctgcgagaccgtcagagagcagctgactaattctatccggaagcaatggaggattctcaaatcacacgtcgagaagctcgataaccaggtgtctaaggtgcacctggagggctttaatgatgaagatgtcatttcaagacaggaccacgaacaggaaacagaaaaacttgaattggaaattcaacagtgcaaagaaatgatcaagactcaacagcagttacttcagcaacaattggcaacagcctacgacgacgatacaacctcgctgctgagagactgctatctgttggaggagaaagaacgcctcaaggaggaatggtctctgttcaaggagcagaagaagaattttgaaagggaaagacggagctttaccgaggcagccattcgcttggggctcgaaagaaaagcctttgaggaggaacgcgccagttggctgaagcagcagttcctgaacatgaccacgtttgatcatcaaaactccgagaatgttaagctcttctctgcttttagcggaagctccgactgggataatctgattgtgcatagtcgccagccacagaaaaaaccccactctgtgtcgaatgggtctccagtctgcatgtcaaaactcacgaaatcactgcctgcaagcccctccacttctgacttctgtcagacacgcagttgcatctctgagcaccgagcaaagaattag

SEQ ID NO: 20824 - DNA, 543 bp, Artificial Sequence
  Description of Artificial Sequence: Synthetic coding sequence
atgggcgactggatgaccgtgaccgaccccggcctgagcagcgagtcaaagacaatcagccagtacacatcagaaacaaagatgtccccatcctccctctactcgcaacaggtcctctgctccagcataccactgtcaaaaaacgtacatagtttcttctctgccttctgtacagaggacaatatcgagcaatccataagctatcttgatcaagagctcacgacattcggtttcccaagtctctacgaggaaagcaagggcaaggagaccaagagagagctcaacatcgttgcagtgctgaattgtatgaatgagcttctggttctgcaacgcaaaaatctgctggcccaggaaaatgtggagacccagaacttaaagctcggatctgatatggaccatctgcaatcttgctacagcaaactcaaagaacaacttgaaacctctcggcgggagatgattgggctgcaggaaagggataggcagttgcaatgtaagaatagaaatctccaccaattactcaagaatgaaaaggatgaagtgtag

SEQ ID NO: 20825 - DNA, 1764 bp, Artificial Sequence
  Description of Artificial Sequence: Synthetic coding sequence
atgagccccagcagcctgtacagccagcaggtgctgtgcagcagcatccccctcagcaaaaacgtccactctttcttttcagcgttttgcactgaagataatatagagcagtcaatctcatatctcgatcaggagctaaccaccttcggctttccaagtctatatgaagaatccaaagggaaagaaacgaaacgagaactgaatatagtggcggtcctcaattgtatgaatgagctgctcgtccttcagagaaagaatctcttggctcaggaaaatgtagagacccagaatctgaagctgggcagtgatatggaccatctgcagtcttgctattccaagctgaaagagcagcttgaaacttcccgcagggagatgataggcttgcaggagcgcgatagacaactgcagtgcaaaaacagaaacctccatcagctgctgaaaaacgagaaggatgaggtgcaaaagctccagaatatcatagccagcagagcaacacagtacaaccatgacatgaagaggaaggaacgagagtacaataagctaaaggaacggctgcaccagcttgtcatgaacaagaaagataagaaaatagccatggatatactcaactatgtgggccgcgcggatggaaagaggggaagctggcgtacagggaagaccgaggcaagaaatgaggatgaaatgtataagattctgttgaatgactacgagtatcggcagaagcagattctgatggagaacgcggaactgaagaaggtcctacaacagatgaagaaagaaatgatatcacttctctccccccagaagaagaagccacgggagagagtagatgatagtactggaacagttatcagcgacgtggaggaagatgccggcgagctgtcacgagaaagcatgtgggatcttagttgtgaaacagtacgggaacaactgactaattctattcgcaaacagtggagaattctcaaaagccatgtggaaaagttggacaatcaggtatccaaggtgcatctggagggcttcaatgatgaggatgtcatctccaggcaggaccacgagcaggagacggagaaactggaactcgagatccaacagtgcaaggagatgattaaaacgcaacagcagctgctgcaacaacagttggccaccgcctacgacgacgataccacctctctgctgcgagactgctatctcttggaagagaaggaacgccttaaagaggaatggtctctgttcaaagaacaaaaaaagaactttgaacgggagcgacgctccttcactgaggcggcaattagactcggtttggagcgcaaggccttcgaggaagagcgagcttcctggttgaagcagcaatttctcaacatgacgacattcgaccaccaaaattcagagaatgtgaaattgtttagtgcgttttcaggctctagtgattgggataacctgatagtgcactccaggcaaccccagaaaaaacctcactccgttagtaatggctcccccgtttgcatgtctaagctgaccaagtcactgcccgccagcccaagtacctcagatttctgtcagacacggagctgtatctccgaacatagcagtattaacgtcctgaatatcacagccgaagagattaaacccaaccaggtggggggcgaatgcacaaaccagaaatggtctgtggcaagcaggcccggatcccaggaaggctgttattctggatgtagcctgtcctatacgaatagccatgtggaaaaggatgacttaccatag

SEQ ID NO: 20826 - DNA, 1515 bp, Artificial Sequence
  Description of Artificial Sequence: Synthetic coding sequence
atgggcgactggatgaccgtgaccgaccccgagagcaagaccatctcgcagtatacctctgaaactaagatgtcaccttcttcgctctactcacaacaagtcctgtgttcgagtatcccgctcagcaagaatgtgcattcttttttttccgctttttgtaccgaagacaatatcgagcagagcatttcatatcttgatcaggagttgacaacgttcggttttccaagcctctatgaagagtctaagggaaaagagaccaaacgggaacttaatatcgtcgccgtgcttaactgcatgaacgagctgcttgtcttgcagaggaagaacctgctcgcccaggagaacgtggaaactcaaaaccttaagttgggaagtgacatggaccacttgcagagttgctattcgaagctgaaggaacagcttgagacatccaggcgggagatgatcggcctacaagaacgagaccggcagcttcagtgcaagaatagaaatttacaccagctgctgaaaaacgaaaaggacgaggttcagaagttgcagaatatcatcgcctccagggctacccagtacaatcatgatatgaaacgcaaggagcgcgaatataataaactcaaggagcggctccaccagctcgttatgaacaagaaggataaaaagatcgctatggatatcctcaactacgtaggccgtgcagacgggaagagaggcagttggagaaccggcaagaccgaagcgcggaacgaggatgagatgtataagatcttgctgaatgattacgaatatagacagaaacagattctgatggaaaacgccgaattaaagaaagtgctgcagcagatgaagaaggaaatgatcagtcttcttagcccccagaaaaagaaaccaagggagcgagtggacgactccacaggcactgtgatcagtgatgttgaggaagatgccggggaactcagcagagaaagtatgtgggatctctcttgtgaaactgtaagggagcagctgactaatagcatcaggaagcagtggcggattttgaagtctcatgtagagaaactggacaatcaggttagtaaggtgcacctagagggttttaacgatgaggatgtgatatccaggcaggaccatgaacaagagacagaaaagctggaattagagattcagcagtgcaaggagatgattaaaacccagcagcagctgctgcagcagcagcttgccactgcttatgacgatgatactacgtccctgctccgcgactgttatctgctggaagaaaaagagcgactcaaagaagaatggagcttgttcaaagaacagaagaagaatttcgagcgagagcgccgaagctttacggaggcggcgatcagactgggactcgagataggattccttctcctaagtgtgctgcataagaaatctttgctggggatacaccattcttctactgtcagccgttgcggagtgcggcgccagtgcaaccaagattacatttgctgtctgaagaaaaagggtatctag

SEQ ID NO: 20827 - DNA, 672 bp, Artificial Sequence
  Description of Artificial Sequence: Synthetic coding sequence
atgaacggcgacgacgccttcgcccggcggcccaccgtgggcgcccaaattccagaaaaaatccagaaagcctttgacgatatcgcaaaatactttagcaaggaggagtgggagaaaatgaaggcgagtgaaaaaatcttttacgtttatatgaagagaaaatatgaggctatgaccaaacttggatttaaggccacattgcctccctttatgtgtaacaagcgtgctgaggatttccaggggaatgatcttgacaacgatcccaataggggcaatcaagtggaacggcctcagatgaccttcggaaggcttcagggcattagcccaaagatcatgccgaaaaagccagcagaggaaggcaacgactccgaagaagtcccagaagcttccggtccccagaatgacggcaaggagctttgtcctcctgggaagcccaccacgagcgagaaaattcacgagaggagcggcaaccgtgaagctcaagaaaaggaagaacggcgagggaccgcccacaggtggtctagtcagaatacacataatataggtcgattttccctttctaccagcatgggggctgtgcatggtacaccaaaaaccattacacacaaccgggatcctaaggggggtaacatgcccggtcccacggactgcgtcagagagaactcatggtag

SEQ ID NO: 20828 - DNA, 567 bp, Artificial Sequence
  Description of Artificial Sequence: Synthetic coding sequence
atgaacggcgacgacgccttcgcccggcggcccaccgtgggcgcccagatacctgaaaaaatacaaaaagcgttcgacgatattgccaaatacttctccaaggaggaatgggagaagatgaaagctagcgagaaaatcttctacgtctatatgaaaaggaagtatgaggccatgactaaactaggctttaaggcaaccctgcccccgttcatgtgtaacaagcgagctgaggattttcagggtaatgacctggacaacgatcctaaccgaggcaaccaggtcgaaaggccacagatgacattcggcaggctccagggcattagccccaaaatcatgccgaagaaacccgctgaggaaggtaacgactcagaggaggtacccgaggcttcgggtccccaaaacgatggcaaagagctgtgcccacctgggaagccaactacgagcgagaaaattcacgagagatctgggcccaaaagaggggaacacgcgtggacacacaggcttcgggaaagaaaacaacttgttatctacgaggagatcagcgaccctgaggaggacgatgagtag

SEQ ID NO: 20829 - DNA, 567 bp, Artificial Sequence
  Description of Artificial Sequence: Synthetic coding sequence
atgaacggcgacgacgccttcgcccggcggccccgggacgacgcccagatctctgagaaactgcgaaaggcgtttgatgacatcgcaaagtactttagcaagaaagaatgggaaaagatgaagagctctgagaagatcgtgtatgtatatatgaaactgaactacgaggtgatgactaaactcggatttaaagtcaccctccctccatttatgcgctctaaacgtgcagccgacttccatgggaacgactttgggaatgaccgaaaccatcgtaatcaggtcgagcggccgcagatgacgttcgggtcgttacagcgcatcttcccaaaaattatgcctaagaaaccagccgaagaggagaatgggttaaaggaagtgccggaggccagcggacctcagaacgacgggaaacaactgtgtccccccggaaacccaagcacattggaaaagattaacaaaacctctggccccaagaggggtaagcacgcctggacccacagactccgagaacggaagcagctagtggtgtatgaagaaatcagcgacccggaggaagatgatgagtag

SEQ ID NO: 20830 - DNA, 462 bp, Artificial Sequence
  Description of Artificial Sequence: Synthetic coding sequence
atgaacggcgacgacgccttcgcccggcggccccgggacgacgcccagatctcggaaaaacttcgtaaggctttcgatgacatcgccaaatatttctcaaagaaggagtgggagaagatgaagagttctgagaagatcgtctatgtgtatatgaagctgaactacgaggtgatgaccaaactaggttttaaggtgaccttgccacccttcatgagatccaagagggccgccgactttcacggaaacgactttgggaacgaccgcaaccatagaaatcaggtcgaaagaccccaaatgactttcggtagcctgcagaggatcttccctaaggaccctaaaggagggaatatgcccggacccacagactgtgtccgtgaaagtagttggtggtttatgaaacgctcagcaacactcaggaagatgacctccaattctccccgtgggtatgacacttgtccctag

SEQ ID NO: 20831 - DNA, 690 bp, Artificial Sequence
  Description of Artificial Sequence: Synthetic coding sequence
atgaacggcgacgacgccttcgtgcggcggccccgggtgggcagccagatccccgagaagatgcagaagcacccctggcggcaggtttgcgataggggaattcatctggtcaacctctctcccttttggaaagttggacgggagcccgctagttcaatcaaggccctcctctgtggtcgcggtgaggcaagggcatttgacgacattgcaaagtacttcagtgagaaggagtgggagaaaatgaaagccagtgaaaaaattatctatgtttatatgaagcggaagtatgaagctatgacaaagctcgggtttaaggccacacttccccccttcatgcgcaacaagagagtggcagacttccagggcaacgacttcgacaacgaccctaacaggggaaaccaggtggaacatccccaaatgacttttggacgcctccaaggtattttcccaaagatcacccctgaaaagccagccgaagaaggcaacgattcgaagggagtgcccgaggcgtcagggccacaaaacaacggcaaacaactgcgaccaagcggaaagttgaacacaagcgaaaaagtcaacaaaacaagcggtcctaagagaggaaagcatgcttggacccatcgtgtgagggagcgaaagcaattagttatttatgaagagattagcgatccccaagaggatgatgaatag

SEQ ID NO: 20832 - DNA, 567 bp, Artificial Sequence
  Description of Artificial Sequence: Synthetic coding sequence
atgaacggcgacgacgccttcgtgcggcggccccgggtgggcagccagatcccggaaaaaatgcaaaaagccttcgacgacattgccaaatatttttccgagaaagagtgggagaagatgaaggcctccgagaaaataatctatgtgtacatgaaaaggaagtatgaggccatgacaaagttaggattcaaagctactctgcccccctttatgcggaacaagagggtggctgactttcagggtaacgacttcgacaatgacccgaatagaggaaatcaggtggaacaccctcagatgacttttggccggctccagggtattttccctaaaatcacccccgagaaacccgctgaggaaggcaacgactccaaaggtgtccccgaagcatccggacctcagaacaatggaaagcagcttcgacctagcggaaagcttaatacctccgagaaagtaaataagacttctggaccaaagcgtggaaaacacgcatggactcaccgcgtcagggagcgaaagcagctcgtgatatatgaagaaatcagtgacccgcaggaagatgacgaatag

SEQ ID NO: 20833 - DNA, 567 bp, Artificial Sequence
  Description of Artificial Sequence: Synthetic coding sequence
atgaacggcgacgacgccttcgtgcggcggccccgggtgggcagccaaattccagagaaaatgcagaaagcatttgatgacattgccaaatacttcagcgagaaggaatgggagaagatgaaagcatctgaaaagatcatttacgtatatatgaaaaggaaatacgaggctatgacaaaactcggtttcaaggcaactctccccccttttatgagaaataagagggtggcagattttcaaggtaacgatttcgataacgacccaaaccgtggcaaccaggtggaacatccacagatgactttcggtagactccaggggatttttcctaaaatcacacccgagaagcctgcagaggaagggaacgactccaaaggcgtcccagaggcctccggccctcaaaacaatggaaagcagctgcgtccatccggaaagcttaacacatcagagaaagttaataagacatctggaccaaaacgcggaaaacatgcatggactcaccgggtgcgcgaacggaagcagttggttatttatgaggagatcagtgatcctcaagaagacgacgagtag

SEQ ID NO: 20834 - DNA, 387 bp, Artificial Sequence
  Description of Artificial Sequence: Synthetic coding sequence
ctgatcaccagcgccgccgagtgcccccacgccaccgaggtgagcctggagttcggcaatctttaccagcaacgtaaaatcctgatgtattcgctgagcgtcgagcacccgcagatgacgttcggtcgtctccagggaatcttccccaaaatcactcctgagaaacctgccgaggaggggaacgacagtaagggagttcccgaagcttctggcccccagaataatgggaagcagctgcgtccgtctgggaaactcaacactagcgagaaggtgaacaagaccagcggcccaaaaagaggaaagcatgcctggactcatagggtccgggagaggaagcagctagtaatttatgaggagatcagcgacccgcaggaagacgacgagtag

SEQ ID NO: 20835 - DNA, 273 bp, Artificial Sequence
  Description of Artificial Sequence: Synthetic coding sequence
atgaccttcggccggctgcagcggatcatccccaagatcatgcccgagaaacctgcagaggaaggctccgattccaaaggagtcccagaggccagtgggccacagaacgacggcaaaaaactttgcccgcctggcaaagcatcctccagcgaaaaaattcacgagcggagtgggcccaagcgcggtaaacacgcatggacccacagactacgtgaaagaaagcagcttgtgatttacgaggagatatccgatccagaggaggacgacaagtag

SEQ ID NO: 20836 - DNA, 567 bp, Artificial Sequence
  Description of Artificial Sequence: Synthetic coding sequence
atgaacggcgacgacgccttcgccaagcggccccgggacgacgccaaagcaagcgagaagcggtctaaagcattcgatgacatcgctaaatatttctcaaaggaggaatgggaaaaaatgaagttcagcgaaaaaatcagctgcgttcacatgaaaaggaaatatgaggcaatgacaaagctgggttttaatgtgaccctgagcctattcatgagaaataagcgcgctactgactcccagagaaacgacagtgacaatgaccggaaccgaggcaatgaagtggagcgcccacagatgactttcggccggctgcagagaatcattccaaaaatcatgcccgagaagcccgctgaggaggggtctgactcaaagggcgtacctgaagcatctgggccacagaatgacggaaaaaaactctgcccccccggcaaagcaagctcatcggaaaagatccatgaaagatcgggtccaaaacggggcaagcatgcttggacgcaccggctgagagaaaggaagcagctagtaatatacgaggagatatctgatcccgaagaagacgataagtag

SEQ ID NO: 20837 - DNA, 567 bp, Artificial Sequence
  Description of Artificial Sequence: Synthetic coding sequence
atgaacggcgacgacgccttcgcccggcggccccgggccggcgcccagatccccgagaaaatacaaaaaagctttgatgatattgcaaaatatttttccaagaaagaatgggaaaagatgaagtccctggaaaaaatttcatacgtttatatgaaaagaaagtacgaagcgatgacaaagctcggatttaaagctaccctgccaccattcatgcacaacaccggagccacagatttgcagggcaatgattttgataatgaccgaaatcaggggaatcaggtggagcgcccacagatgaccttctgtcgcctgcaaagaattttccctaagatcatgcctaagaaacctgcggaggagggcaacgactcgaaaggcgtgcctgaggcatctggctctcagaacgatggaaaacacctctgtccccccggcaaaccttctaccagcgagaagataaacaagacctcaggcccaaagcggggcaagcatgcgtggacacaccgcctgagagagcgcaaacagctggtgatctatgaagagatatcagaccccgaggaagatgatgaatag

SEQ ID NO: 20838 - DNA, 567 bp, Artificial Sequence
  Description of Artificial Sequence: Synthetic coding sequence
atgaacggcgacgacgccttcgcccggcggccccgggccggcagccagatccctgagaagatccaaaaggccttcgatgatattgctaagtattttagtaagaaggagtgggaaaaaatgaagtcctcggagaaaatcatttacgtgtacatgaagcggaaatacgaagcgatgactaagttgggtttcaaggccacactccctcctttcatgtgcaacaccggagccacggatctgcaggggaatgattttgataacgatcgtaaccataggaaccaggtggagcggtctcagatgacctttggccgcttacaggggattttccctaagattatgccgaagaaacccgcggaagtgggaaacgacagcaaggaagtcccagaagcctccggccttcaaaacgatgggaagcagctgtgcccgcctggaaaacctacaacgtctgagaaaatcaacaaagcatccggaccaaagcgtggtaaacacgcatggacccaccggctgagggagcgcaagcagcttgtgatatacgaggagatttctgatcctgaggaagacgacgagtag

SEQ ID NO: 20839 - DNA, 567 bp, Artificial Sequence
  Description of Artificial Sequence: Synthetic coding sequence
atgaacggcgacgacgccttcgcccggcggccccgggccggcagccagattcccgaaaagatacagaaagctttcgacgatattgcaaagtacttcagtaaaaaggagtgggaaaaaatgaagtctagcgagaaaatcatttacgtgtatatgaagcgcaaatatgaagccatgaccaagctcggctttaaagccacattgccgccatttatgtgcaacacgggtgctacagacctgcagggaaatgattttgataatgatcggaatcacaggaatcaagtggaacgctctcagatgaccttcggacgactgcaaggaattttccctaagattatgcctaagaaaccagcagaggtcggcaatgatagcaaagaggtcccagaagcctccggcttgcaaaatgatggaaagcaactgtgtcccccaggcaaacctactactagcgagaaaatcaataaagcatcaggccctaagagaggtaaacacgcttggacacaccgcctccgggagcgaaaacagttggtgatctacgaagaaatctctgatcctgaggaggacgacgaatag

SEQ ID NO: 20840 - DNA, 5481 bp, Artificial Sequence
  Description of Artificial Sequence: Synthetic coding sequence
atgcggcccggctgcgacctgctgctgcgggccgccgccaccgtgaccgctgcaataatgtctgacagcgacagtgaggaggacagcagcgggggagggccttttaccctggccgggatcctgttcgggaatatatctggcgctggccagctcgagggagaaagcgtcctggacgatgagtgcaagaaacacctggcagggctcggtgccttgggactgggatccctaataactgaacttacagctaatgaggagttgacagggacgggaggtgcactggttaatgatgagggatggattcgctctacagaggatgccgtggattactcggacattaatgaggttgctgaggacgaaagccaacgacaccaacagactatgggatcattgcagccactgtatcactctgactatgacgaagacgattacgatgctgactgtgaagacatcgattgtaagctcatgccaccccccccccctccccccggccctatgaaaaaagacaaggaccaagatgccatcacatgcgtgagcgagtctggagaggatattatcctcccaagcatcatcgcgccctctttcttagcctcagaaaaagttgactttagctcgtatagtgattcggagagcgagatgggcccgcaggaggccacacaagccgagtcagaggatggcaaactcactttgccgctggccggaatcatgcagcacgacgccacaaagctgcttccctccgtgactgaactgttcccggagtttcggcctggaaaagtcttgcggtttctgcacctattcggccctggcaagaatgtgccaagtgtctggcgttcggccaggagaaagagaaaaaagcacagggaactgattcaggaggaacaaattcaggaggttgaatgttccgtggaatctgaagtcagccagaaatccctgtggaactacgactacgcacctcctccacctccagagcagtgtctcgcggacgatgagataaccatgatggtgccagtggagtcaaaatttagtcagagcaccggcgacgttgataaggtcactgacaccaaacccagggtcgccgaatggcggtacgggccagccaggttgtggtacgacatgctcggcgtgtccgaggacgggagcggtttcgactatgggtttaaactaagaaagacacagcatgaacccgtgattaagtcccggatgatggaagagttccggaaactggaagaaagcaacggcaccgacctgctggccgatgagaattttctcatggtgactcagcttcactgggaagactccattatctgggatggggaggatatcaagcacaaaggaactaagccccagggcgctagcctcgccgggtggctgccctcaataaaaacccggaacgttatggcctacaatgtgcagcaaggatttgctcctactctggacgacgacaaaccctggtatagcattttcccaatcgataatgaggaccttgtgtatgggagatgggaggacaacatcatatgggatgcccaggccatgccccgcttgctcgagccgcccgtcctggcccttgatccaaacgacgagaatctcatcttggagatacccgacgaaaaggaagaggccaccagtaattctccctcaaaggaaagcaagaaagagtcctccctgaaaaaaagcaggatattactggggaaaacaggcgtgataagggaggaacctcaacaaaacatgagccaacctgaagttaaagatccttggaatctgagcaatgacgagtattactttcccaagcaacagggcctgaggggaacctttggcggtaatatcattcagcattccattcctgctatggaactttggcagcctttcttccccacacatatgggtcctatcaagattcgtcagtttcacagacctcctcttaagaagtactctttcggggccctctcacaaccaggccctcacagcgtgcaacccttactcaagcatattaaaaagaaagcaaagatgcgggagcaggagaggcaagctagcggcgggggcgagctcttttttatgcggacacctcaggatctcaccgggaaggacggagatctgatcctcgcagaatactcagaggagaacggacctttaatgatgcaggtcggcatggccactaaaatcaagaattattataaacggaagcctggaaaggatcctggcgccccggactgcaaatatggtgaaactgtgtactgtcacaccagccccttcctgggatcactccaccctgggcagctcttacaagccctcgaaaataatctgtttagggctccggtctatcttcacaaaatgccagaaaccgactttctgatcatccggactcggcaggggtactatatccgggagctcgttgacattttcgtcgtcggtcagcagtgtccactgtttgaggtacccggccccaattctcgtcgagccaatatgcatatccgggactttctgcaagtttttatctacaggctgttttggaagtccaaggataggccccgtcggatacggatggaagatatcaaaaaagctttcccctcccattccgagtcctcaattaggaagcggctgaagctgtgcgctgactttaagcgaaccggaatggacagcaattggtgggtgctgaaaagcgactttaggctgcctaccgaggaggagattagagccaaggtcagtcccgaacagtgttgcgcctactattcaatgattgctgcgaagcaaaggttaaaagatgctggttacggtgaaaaaagtttttttgctcccgaggaggaaaatgaggaggacttccagatgaaaattgatgatgaagtacacgccgcgccgtggaataccacccgagcatttattgcggcaatgaagggaaagtgtttattagaggtgaccggtgttgcagatcctaccggatgtggcgaaggtttcagctacgtaaaaattccaaacaaacctacccagcagaaagacgataaagaaccccaggccgtcaaaaagacagttaccggcactgatgctgatctgaggcgcctgagcctgaaaaatgctaagcaattgttgcgtaagttcggcgtgccagaggaagaaattaagaaactgagtagatgggaagtgatcgacgtggttcgaactatgagtaccgagcaggcccacagcggagaagggccaatgtccaagttcgcaaggggctcccgcttttctgtggctgaacaccaagagaggtacaaagaagagtgtcagcggatctttgaccttcagaataaggtcttgagctccacagaagtgctgagcacagacactgattcaatctccgcggaggatagtgattttgaggagatgggcaagaatattgagaatatgcttcagaacaagaaaacatcttcccagctaagccgagagtgggaggagcaggaacgtaaagagctgcggagaatgctacttgtggccggaagtgcagcctccggtaacaaccaccgcgatgatgtaaccgcaagcatgacatcattgaaatccagcgccacagggcactgtttgaaaatctaccgcacatttcgtgacgaggaaggtaaagaatatgtccgttgcgagactgtaaggaaacccgcagtgatcgacgcctacgtgagaatacggactacgaaagacgaaaaatttattcagaagtttgctttgttcgatgaaaagcacagggaagagatgcgcaaagagcgtagaagaatccaggaacagttaaggcgtttaaagcggaaccaagaaaaggaaaagcttaaagggcctccagaaaagaagcctaagaaaatgaaggaaagacccgatctcaagttgaaatgcggagcatgtggcgccatcgggcacatgcggaccaacaaattttgcccactctattaccagaccaatgtgccccccagcaaacccgtggccatgactgaggagcaggaggaagaactggagaagacggtaatacacaacgacaatgaggaacttattaaagtggaggggaccaagatcgtatttggcaaacagctcattgaaaatgtgcacgaagtgcgtcgtaaaagcctggtcctgaagttcccaaagcagcagctaccaccgaaaaaaaaacgacgcgtcgggaccactgtccattgcgactatctcaatataccacataaatccattcaccgacgcaggactgatcctatggttacgttgagcagcattcttgagagtataataaatgacatgagggatttacctaatacgcatccatttcacacacctgtgaacgctaaggtggtaaaggactactacaaaatcatcacaaggcctatggacctgcagacattaagagagaatgtgcgcaagtgcttgtaccccagcagagaagaatttagggaacatctagaactcatcgtgaagaatagcgccacctacaacgggccgaaacattctctgacgcagatcagccagtcaatgctggacctgtgtgatgaaaagctgaaggagaaagaagataaactggctagactggagaaggcaattaatcctctcttggatgacgatgatcaggtagccttctcctttattctcgataacatcgtgacccagaaaatgatggcagtaccagactcatggccctttcaccatcctgtgaacaaaaagtttgttccagattactataagatgatcgtgaatccagttgacctggaaactatcaggaagaacatatctaaacacaagtatcagtcaagagaaagttttctggacgacgttaacctgatcctggccaattccgtgaagtacaacgggcccgaaagccagtatactaaaaccgcccaggagatcgttaatatttgttatcagaccatcacggaatacgatgagcatctgacacagctggaaaaggatatctgtaccgctaaagaagctgctctcgaggaggccgaattagagtccttggatcccatgactccaggtccgtatacttcacagccccctgatatgtacgataccaatacatccctttccacaagcagggatgcctcagtatttcaagatgagtccaatttatccgtgctggatatatccaccgcaactcccgaaaaacagatgtgtcagggccaggggagattgggggaagaagattccgacgtcgatgtagagggttacgacgacgaagaagaggatggcaagcccaagccgccggcaccggaaggaggggacggggacctcgctgacgaggaagagggtacagtacagcagcccgaggcctccgtgctctatgaggatctgctgatctcagagggcgaggatgacgaggaggacgccggctccgacgaggagggcgacaacccgttctccgccatacagctttcagaatcgggctcagactcagatgttggttatggcggcatacggccgaagcagcctttcatgcttcagcacgcctccggcgagcacaaagatggccatggaaaatag

SEQ ID NO: 20841 - DNA, 375 bp, Artificial Sequence
  Description of Artificial Sequence: Synthetic coding sequence
atggccgacgaggaggaggaccccaccttcgaggaggagaacgaggagatcggtggcggggcagaggggggtcaaggtaagcgtaaacggctgttctctaaagagctgagatgcatgatgtacgggtttggggacgaccagaacccctacacggagtctgtggatatcctcgaggatcttgtgatcgagtttatcacagagatgacacacaaggctatgagtatcggaaggcagggcagggtgcaagtggaggacatcgtgtttctcatccggaaggaccccaggaaatttgcaagggttaaggatctgttaaccatgaacgaagagttaaagcgtgcacggaaggccttcgatgaagccaattatgggtcctag

SEQ ID NO: 20842 - DNA, 375 bp, Artificial Sequence
  Description of Artificial Sequence: Synthetic coding sequence
atggccgacgaggaggaggaccccaccttcgaggaggagaacgaggaaattggcggaggtgccgaggggggccaaggcaaaagaaaacggctgttttcaaaggagctacgctgcatgatgtacggcttcggcgacgatcagaacccctatactgagagcgtagatatcctagaggatttggttattgagttcatcactgagatgactcataaggccatgagcatcggccgtcagggcagggttcaggtcgaagatatcgtctttcttatcagaaaagatcctaggaagttcgcccgggtcaaagacctgctgactatgaacgaggagctcaagagggcccggaaggcttttgacgaggccaactacggctcttag

SEQ ID NO: 20843 - DNA, 3600 bp, Artificial Sequence
  Description of Artificial Sequence: Synthetic coding sequence
atgcccctgaccggcgtggagcccgcccggatgaaccggaagaagggggataaagggtttgaatcaccaaggccttacaagctgacccatcaggtagtttgcattaataacattaacttccagaggaaaagtgtagtgggtttcgttgagctaacaatttttccgacggtggcgaaccttaacaggattaaattgaattctaaacaatgtagaatctaccgagtgaggataaatgacctggaggctgcgtttatctataacgaccccaccctcgaagtatgccactctgaaagcaaacagcgcaacttaaattatttttccaacgcctacgcggccgctgtaagcgccgtggaccctgacgccggaaatggcgagctctgcatcaaggtccctagcgagctgtggaaacacgtggacgagctcaaagttcttaagattcacattaatttttcactcgatcagccaaaaggtgggttacactttgtggtgccatccgtggagggctctatggccgagagaggcgctcacgtgttttcttgtggttaccagaacagtacaaggttctggttcccctgcgtggattcttactcagaactgtgcacatggaagctcgaattcactgtggatgccgctatggtggcagtgagcaatggtgacttggtcgagacagtgtatacacacgatatgagaaagaagacattccattacatgctcactattcccacggctgcaagcaatatcagtctggcaatagggccttttgagatcctcgtggatccatacatgcatgaggtgactcatttctgtctaccccaactgctgccactgctgaagcacaccacttcctacctgcacgaggttttcgagttctatgaggaaatcttgacttgcagatacccttattcttgttttaagaccgtatttatagacgaagcctacgttgaagtggcagcttacgctagtatgagcatcttctctacaaatctcttgcattccgcaatgatcatagacgagacaccgctgacacgcagatgcctggctcagtcgctggcccagcagttcttcgggtgcttcattagtcgaatgtcttggagtgatgaatgggtcttgaaggggatctccggctacatttacgggttgtggatgaagaagacatttggcgtaaacgagtatcggcactggatcaaagaggaacttgataaaattgtggcttatgagctcaagacaggcggagtgttgctccacccgattttcggcggtggcaaagaaaaggataatccggcttcgcatctacactttagcattaagcacccccacaccctgtcatgggagtactactctatgtttcagtgcaaggctcaccttgtgatgcgcctgattgagaaccgcatatctatggaattcatgctgcaggtcttcaacaagctcttatccctggcatccactgcgagtagccagaaattccagtcccatatgtggtcgcagatgttagtgtccaccagcgggttcctgaagagtatctctaacgtaagtggaaaagatatccaacccttaattaaacagtgggtggatcaaagcggcgtagtgaaattctacggctcctttgctttcaatcgtaagaggaacgtgctggaattagagattaaacaggattacacttccccggggactcagaagtatgtaggccccctgaaggttactgtccaagagcttgacggaagtttcaatcacacactccagatcgaggagaactctctgaagcacgacattccctgccacagcaagtctaggcgtaataagaagaagaagatccctcttatgaatggagaagaagttgacatggacctcagcgcgatggatgcagatagtcctctattatggatccggatagatccggacatgtccgtcctgcgaaaggtggaattcgagcaagccgattttatgtggcaatatcagctcagatacgaacgggatgttgttgcccaacaggagagcatattagcgctggagaagttccctaccccagcctctcgcctggctctcacagacattcttgaacaggaacagtgcttctacagagtgcggatgtctgcctgcttttgtctggccaagattgcgaattcgatggtgagcacctggacgggaccgccagccatgaaatccctcttcacacgcatgttttgctgcaagagttgtccgaacattgtgaagacgaataacttcatgtcctttcagagctactttctgcagaagaccatgcccgtggctatggcattactgcgggatgtgcataacctgtgcccgaaggaagttctaaccttcattctcgaccttattaagtacaacgataaccgcaaaaacaagttctctgacaattattatagggctgagatgatcgatgccttggcaaacagtgtaactcccgcggtgtccgtcaacaatgaggttcgaacactggacaatctaaatcccgatgtgcggttgatcctggaggaaataacccgattcttgaacatggaaaaactcctgccctcataccggcacacaatcactgtgtcctgcttgagagcaatccgggtgcttcagaaaaacggtcacgtacctagcgaccccgctttattcaaatcctacgccgagtacggccacttcgtggacatccggattgcggctctggaggctgtagttgactacacaaaggtggaccggtcctatgaagaactgcagtggctgctgaacatgatacaaaatgaccctgtaccatacgtgcgacacaagattctgaatatgttgacaaaaaatcccccctttacaaaaaacatggagtcccccctatgcaacgaggcactggtggatcagctgtggaagctgatgaacagtggtacatcacacgactggcgattgcgatgtggggctgtagacctgtatttcacactatttggtctgtcccggcccagttgtctgccgttaccagaactcggtctggtcctgaatctgaaggaaaaaaaagccgtcttaaacccgacaataattccagagtccgtggcagggaatcaggaagcggcaaacaatccctcttcccatccacagcttgtaggcttccagaaccctttcagttcaagccaagatgaagaggaaatagatatggacactgtccacgatagtcaggccttcatttcccaccaccttaatatgctcgaacgccctagtactcctgggctctctaaataccgtccagcctcgtccaggagcgcgcttatcccgcagcatagtgctggctgcgatagcacaccgaccactaagccccagtggagtctggagcttgccaggaagggcaccggtaaagagcaagcccccctcgagatgtccatgcaccccgcggcatccgcacctctgagcgtatttaccaaggagtccacagctagtaaacacagcgaccatcatcaccaccaccaccacgaacacaagaaaaaaaagaagaaacacaagcacaaacacaagcacaagcataagcacgacagcaaagaaaaagataaggagccctttacatttagtagtcctgcctccggccgctccattaggagcccatccctcagcgactag

SEQ ID NO: 20844 - DNA, 1770 bp, Artificial Sequence
  Description of Artificial Sequence: Synthetic coding sequence
atgaagcgggtgcggaccgagcagatccagatggccgtgagctgctacctcaagcgacgtcaatatgtggattccgatgggcccctgaagcagggtttgagattgtctcagaccgctgaagagatggccgccaatctcactgttcagagcgaaagcggctgtgcaaacatcgtttctgcggcgccttgccaggctgagccccaacagtacgaggttcaatttggccgcctgagaaatttcctgacggatagcgactcgcagcactcccatgaggtaatgcccttgctgtatccattatttgtgtacctccatctgaatctcgtgcagaatagccctaaatcaacagtcgaatctttttattcacgatttcacgggatgttcttacagaatgcgtcccagaaggacgtgatcgagcagcttcaaaccacacaaactattcaagatattttaagcaattttaaattacgagcctttcttgataacaaatacgtggtcagactgcaggaagactcctataactaccttattcggtatttacaaagcgacaacaacactgccctgtgcaaagtgctgacactgcatatccacctggacgtgcagcccgcaaagaggactgactaccagctctatgcatcaggaagcagctccaggtctgaaaataatgggttagagccacccgacatgcccagccctattctgcagaatgaggcggccctggaagtcttacaggagagtataaaaagggtaaaagacggacctccgagtttaactacaatctgtttctacgctttttataacaccgagcagttgctgaatacagccgaaatctctcctgactccaagttgctcgccgcaggattcgataattcctgtattaaactttggtctctgagatcaaaaaaacttaagtcagaaccacaccaggtcgacgtgagccgcatccaccttgcctgtgatatactagaagaggaggacgatgaagacgacaacgccggaacagaaatgaagatactgcgaggccattgcgggcccgtgtattccacaagatttctcgcagactcatctgggctgctgagttgctcagaggacatgagcatccgctactgggatctgggttctttcaccaacactgtgctttatcaggggcatgcctatcctgtttgggacctggacataagtccctatagcctgtactttgcaagtggctctcacgaccggaccgctcgactgtggtcctttgaccggacgtatccactacggatctacgccgggcaccttgcggacgtggactgtgtgaagttccaccctaactctaattacctcgcgaccggctctacggacaaaactgtgcgcttatggagtgctcagcagggcaactcagtgaggctctttaccggccatcggggacccgttcttagtctcgcattctcacccaacgggaagtatctcgcttctgctggtgaagaccaaaggctgaaactgtgggacctggcctctgggactctgtataaggaactgcgaggccacaccgacaatattacatctttaaccttctccccagactccgggcttatcgcttcagcctctatggacaacagtgttagagtgtgggacattagaaacacttactgtagcgccccggccgatggcagtagttccgagctggtcggcgtgtacacaggtcagatgtccaatgtgttgtctgtccagtttatggcctgtaatcttcttctggtgaccggaattacccaggaaaatcaagaacactag

SEQ ID NO: 20845 - DNA, 255 bp, Artificial Sequence
  Description of Artificial Sequence: Synthetic coding sequence
atgaagcgggtgcggaccgagcagatccagatggccgtgagctgctatcttaagagacgacagtacgtggatagcgatgggccattgaagcaggggctgcggctttcgcagacggccgaggagatggctgcgaatctcacaggcaatgggggcggatccagtgggggcgtgtctttggagcaggaaaacagccgccaatacccatgcggaatcacgagtcccctcttgaagacggtgcccgagcgcgccgactag

SEQ ID NO: 20846 - DNA, 978 bp, Artificial Sequence
  Description of Artificial Sequence: Synthetic coding sequence
atgaagcgggtgcggaccgagcagatccagatggccgtgagctgctatctaaaacggcgtcaatacgtcgattctgacggacccttgaagcagggcctcaggctttcccagaccgcagaggagatggcggccaatctgaccgtccaaagcgagagcggatgtgccaacattgtgtctgctgcaccgtgccaggctgagccgcagcaatacgaggtccaatttgggcgactgagaaactttcttactgactcagacagccagcacagccatgaggttatgcctcttctgtatcccctgttcgtctacctgcaccttaatcttgtacaaaattccccgaaaagcacagtggagtcattttattccaggtttcacggaatgttccttcagaatgctagccagaaggacgtgattgaacagctgcagactacacaaaccatccaggatatccttagcaacttcaaactgcgcgcttttctcgacaataaatacgttgtgcgcttgcaggaagactcctataactacttgatccggtatctgcagtcagataacaacacagctctgtgcaaagtgctcaccctccatatccatctcgacgtacagcccgcgaagcggaccgactatcagctgtacgcaagcgggagttcgtctagaagtgagaacaacgggctcgaaccacctgacatgccatcccccatcctgcaaaatgaggccgctctcgaggtcctgcaagaatctatcaagcgcgtcaaggatggcccgccaagtctaaccaccatttgtttttatgctttttacaatacggaacaactgctgaacaccgcggagatctctcctgactctaaactgctggctgccgggttcgacaattcatgcattaagttgtggagcctgaggagcaagaaactcaaatcagaaccccatcaggtcgatgtgagccggatccaccttgcttgcgatatccttgaggaggaggtgtag

SEQ ID NO: 20847 - DNA, 1770 bp, Artificial Sequence
  Description of Artificial Sequence: Synthetic coding sequence
atgaagcgggtgcggaccgagcagatccagatggccgtgagctgctaccttaaacgcagacagtacgtggactctgatggccctttaaagcaggggcttcgactctcacagacagccgaagagatggctgctaacctaaccgttcagagcgagagcggctgcgccaatatcgtcagcgcagctccctgtcaagccgaaccccagcagtacgaagtgcagtttggcagactacgaaacttcctgaccgactcagactctcagcactcccatgaagttatgcccttgttgtatccattattcgtgtatctccatctcaatcttgtgcagaattccccaaagtcaactgtggaaagcttctactcgcggttccatgggatgttcttgcagaacgcctcgcagaaagacgtgatcgagcagctccagactactcaaacaatccaggacatcttaagcaacttcaagctccgcgcttttctggacaacaaatatgttgttcggttgcaggaggacagctacaattatcttatcaggtacttgcaatcagataataatacagccctttgcaaggtcctaactttgcacattcacctggacgtgcaaccagcaaaaagaaccgactaccagctctacgctagcggcagctcttctcggagcgaaaacaatgggctagagcctcccgacatgcccagtccaatcctgcaaaatgaggcagccctagaagtgttgcaggagtcaatcaaaagagttaaggatggtcccccctccctcaccacgatttgcttttatgctttttataacaccgagcagctattgaacacggctgagatttcaccagattccaagctgctcgcagcaggattcgacaattcctgcatcaagctctggtccctgcggagcaagaagctcaagtctgaaccccatcaagtggacgtgagtcggattcatctagcttgcgatattctggaggaggaggatgacgaggacgataacgcgggcacagagatgaagattctgagggggcactgtggtccagtctacagcacaaggttcctcgccgactcatccggcctcctctcatgttcagaggatatgtcaatccgctactgggacctcggatccttcacaaacaccgtgctatatcagggccacgcctaccctgtgtgggacctcgacatctcaccatacagcctgtactttgcgtccggctctcacgaccggacagcacgcctctggtcctttgataggacttacccgttacgcatatatgcggggcatttggccgacgtcgattgcgtgaagttccacccgaatagcaattaccttgctaccggctctacggataagacagtcagactttggtccgcccagcaagggaattctgtgagactgtttaccggccatcggggaccggtattaagtcttgctttctcaccaaatggcaaatacttagccagcgccggagaagatcagcgcctgaagctgtgggatctggcctcaggaactctttacaaggagcttcggggacacactgataatatcaccagtctgaccttctccccggactctggcctaatcgcctccgcgtcgatggataacagcgtccgcgtctgggacattaggaacacttactgttctgcccctgccgacgggtcctccagtgagttggtgggtgtctacaccggccagatgagcaacgtcctgtctgtgcaattcatggcttgtaatttgttgttggtgactggtatcacccaagagaaccaggaacattag

SEQ ID NO: 20848 - DNA, 1869 bp, Artificial Sequence
  Description of Artificial Sequence: Synthetic coding sequence
atgagcgagcgggaggagcggcggttcgtggagatcccccgggagagcgtgaggttgatggcagaaagtacgggactagaactttctgacgaggttgctgccttgctagcggaggacgtttgttacagactgcgggaagcgacccagaacagtagccagtttatgaaacacactaagagaagaaagttgaccgtggaagactttaatcgggccctaagatggtcttcagtggaggcagtgtgtggctacggctcacaggaagcactgcccatgcgacctgctcgggagggggaactctactttccagaggacagagaagtaaatctagttgagctggccctggctacaaacatccccaaagggtgcgcggagaccgctgttagggtgcacgtgagctaccttgacggcaagggcaacctggctccgcagggctctgtaccttctgcagttagcagcttgacagatgatcttctgaaatattaccaccaggtcaccagggccgtactcggagatgacccccagttgatgaaagtggcattgcaggacctgcagactaattcaaagattggcgcgttgttgccttatttcgtgtatgtggtctccggtgtgaaatctgtgagccacgatctagagcagctccatagactcctgcaggtcgcacggagcctatttcggaacccccacctgtgtctcggaccctatgtcagatgcctggttggctccgtgttgtattgtgtattagaaccgttggccgcttctataaatccgttaaatgaccactggacattgagagatggcgctgccctcctgctttctcacatcttttggactcacggtgatctcgtctccggactttaccagcatattctgcttagcctgcagaagattcttgcagatcctgtcagacccctctgctgtcactacggggccgtggttggtctgcatgcgcttgggtggaaagctgtagagcgagttctgtatcctcatctcagtacttactggaccaacctgcaggcagtgctcgacgattattctgtctctaacgcgcaagtgaaagccgatgggcataaggtatatggcgcaattctggttgctgtagaaagactgctgaagatgaaggcacaagccgccgagccaaacaggggaggtcccggtggccgcggctgccgccgcctcgacgatttaccttgggattctttgttgttccaagaatcctccagcgggggcggcgctgaaccttccttcggctctgggttgcctctgccgcctggcggcgctgggccagaggatccttctttgtccgtgacactcgctgacatctatcgggaactatatgctttcttcggtgactccctagccacccggttcgggaccggccagcccgcccccacagccccccgcccccctggcgataagaaagagccagctgcggccccggattcggttcgcaaaatgccacagcttacagcttctgccattgtgagcccgcatggggacgagagccccagggggtccggagggggcggaccagcatcagcgtctggccctgccgcgtctgagagtaggcctctgccaagagtacacagagccaggggggctccgcgccagcaagggccgggcactgggacccgagatgtttttcagaagagcagatttgccccaaggggagcaccacacttccggtttattatagctggaagacaggctgggcgccggtgtcgaggtcggttgtttcaaactgcgtttccagctccatatggaccatctcccgcatcaagatacgtgcagaaattgccaatgatcggaagaacctcacggcccgccagaaggtgggctctctcagactattcactctaccttccgttgtag

SEQ ID NO: 20849 - DNA, 153 bp, Artificial Sequence
  Description of Artificial Sequence: Synthetic coding sequence
atgagcgagcgggaggagcggcggttcgtggagatcccccgggagtccgtcagactgatggctgaaagcacaggcttggaattgtctgatgaggtggccgccctcctggccgaggatgtatgttatcgtctccgggaggctactcagaactag

SEQ ID NO: 20850 - DNA, 438 bp, Artificial Sequence
  Description of Artificial Sequence: Synthetic coding sequence
atgagcgagcgggaggagcggcggttcgtggagatcccccgggagtccgttcggctgatggccgaaagtactggccttgaattgtctgacgaggtggccgcactgctggcagaggacgtctgctatcgcttacgggaggccacacagaacagttcacagttcatgaagcacacaaagagaagaaagttgacggtcgaagattttaacagagcactgagatggtccagcgtggaggccgtgtgcggctacggatcacaggaggctctgccgatgcgacccgcacgcgagggggaattgtatttcccagaagatcgagaagtcaacttggtggaacttgccctggccacaaacattcctaaagggtgcgcagaaacagccgtgagggtccatgtgtcttatctcgacggaaaagggaatttagcacctcagggcagctag

SEQ ID NO: 20851 - DNA, 1473 bp, Artificial Sequence
  Description of Artificial Sequence: Synthetic coding sequence
atggccaccgagttcatcaagagctgctgcggcggctgcttctacggagagacagaaaagcacaattttagtgtggaacgcgatttcaaagccgccgtgcctaactcacagaatgcaaccatttccgtaccccctctgacctcagtctccgtgaagcctcagctggggtgcaccgaggattatctgctgtccaagctccctagcgacggcaaagaggtgcctttcgtggttccaaagttcaaactatcctacatccagccccgcacacaggaaacccctagtcacctagaagaactggaaggttcggctagggcatcctttggcgataggaaggtggagctttcctcatcatcacagcatggccctagctacgatgtgtacaatccattctacatgtaccagcacatcagtccagatttaagtagacgcttccccccaagatcagaagtgaagcgactgtacggtagcgtttgtgatctgaggaccaacaaactgcccggaagcccagggcttagtaaatcaatgttcgatctaacaaattcctcacagcgcttcattcagcgccacgacagtttaagctccgtgcccagtagttcctcttcgagaaagaacagtcagggctcaaaccggagcttggatactatcacactctccggcgatgagcgtgacttcggccggctgaatgtcaagttattctataattcttccgtggaacagatctggataactgtcctccaatgtcgagatctgtcctggccttcttcctacggggatacacccaccgtgagcattaagggaatactaaccctacccaaaccggtccacttcaagtcatctgcaaaggagggctcaaacgctattgaatttatggaaactttcgtatttgccattaaactgcagaatctacagaccgtgaggttagtgtttaaaattcagacccagacaccccgcaagaaaaccattggcgagtgctccatgtccctgcgtacactatccacgcaagagatggactactcactggacatcacaccgccaagcaagataagcgtgtgccatgctgaactcgagttaggcacgtgtttccaagctgtaaacagtagaatccagctgcagatactggaagcccgctaccttcctagttccagcaccccactcacgctgtccttctttgttaaagtcggaatgttttccagcggtgagctcatctacaaaaagaaaacccgcctgctaaaagcctcaaatggccgcgtcaagtggggagagaccatgatatttccactgattcagtcagagaaagaaatcgtctttctcattaaactgtactcccgcagctccgtgagacggaagcattttgtgggccaaatctggatctctgaggattcgaataacatagaagctgtaaaccagtggaaggagactgtaataaacccagagaaagttgtgattaggtggcacaagctcaaccctagctag

SEQ ID NO: 20852 - DNA, 1473 bp, Artificial Sequence
  Description of Artificial Sequence: Synthetic coding sequence
atggccaccgagttcatcaagagctgctgcggcggctgcttctacggcgaaaccgaaaagcataacttttccgtggaacgagatttcaaagccgccgtgccaaacagccagaatgcaaccatttccgttcccccactcacctctgtttctgtgaagccccagctggggtgcaccgaagattacctgctatcaaagttgccatcagatgggaaggaagtgcccttcgtggtgcccaagtttaagctttcctacatacagcctcgcactcaggaaacgccttctcatttggaggagttagaaggttctgctagggccagtttcggagacaggaaggttgaactatcctccagttctcagcacggtcctagctacgatgtttataacccgttctacatgtatcagcacatcagccctgacctaagtcgacggttccccccgcgttcggaggtgaagcgcctgtatggctccgtgtgtgatctgcggaccaacaagttgcccggctccccgggcctctcaaagtccatgttcgacctgactaacagctctcagcggtttatccaaaggcacgacagcctaagcagcgtacccagctcctccagctccaggaagaacagtcagggatcaaacagaagtctggatacgatcacactcagcggcgatgagcgggatttcggtaggctgaacgtgaaactattttataattcttctgtcgaacaaatatggatcaccgttctgcaatgtagggacctcagttggcctagcagttacggcgacactcccaccgtctcgataaaaggcatcttaacccttccgaagccagtccactttaaatccagcgccaaagaaggttccaacgcaatcgagtttatggagacatttgtgttcgcaatcaagctgcagaatctacagaccgtaagattggtgttcaagatccagacccaaacaccacggaaaaagaccatcggggagtgcagcatgagccttcggacgttatctacgcaggagatggattacagcttagacatcacccctcccagtaagatcagcgtctgccatgcggagttagaactggggacttgcttccaggctgtcaactccaggattcaactgcagatacttgaggcgaggtacctgccttcaagctctacccctctgaccctttcttttttcgtgaaagtgggaatgttctcgtccggagagctgatatacaagaagaaaacacgcttgttgaaggcctccaacggcagggtcaagtggggagaaaccatgatctttcccctcatccagagcgagaaagagattgttttcctgataaaactttacagcaggtcctctgtcaggcggaaacactttgtgggacagatctggatctctgaagattcaaataatatcgaggccgtaaatcagtggaaagaaactgttatcaacccagaaaaggtggttattaggtggcataaactgaacccctcttag

SEQ ID NO: 20853 - DNA, 1473 bp, Artificial Sequence
  Description of Artificial Sequence: Synthetic coding sequence
atggccaccgagttcatcaagagctgctgcggcggctgcttctacggcgaaaccgagaaacacaacttctccgtggaacgcgacttcaaagccgcagtgcctaacagccagaatgccactatctccgtgccccctttaacttcagtgtcggtcaagcctcagctgggctgcactgaggattacctgctctccaagttgccctctgatggaaaggaggtcccattcgtggttccaaagtttaagctaagctacattcagcctcgcacccaagaaacaccgtcacatttagaagagctggaggggagcgcccgcgcctcctttggagatcggaaggtggaactcagcagttcttcgcagcacgggccctcctacgacgtgtacaacccattctatatgtatcagcatatttctcccgatctctccaggaggttccctccccgctcagaggtcaagcggctgtatggctctgtctgcgatctgaggaccaacaaactcccggggtcccctggtttatcaaaaagtatgttcgatctgacaaactcgagccagaggttcattcagcggcatgacagcctgtcctccgtcccgagttccagtagctctaggaaaaacagccagggctcaaaccgaagccttgacactatcacactctcaggggatgagagggattttggcaggctgaacgttaagctcttctacaactcctccgtggagcagatttggatcacggtcctacagtgcagggacctaagttggccgagcagctatggggataccccaactgtttccatcaaggggatcctgactctccctaagccagtgcactttaagtccagcgctaaagagggttcgaatgcgatcgaattcatggaaacctttgtgtttgccatcaagctgcagaacctgcagaccgtcaggctcgtattcaaaattcagacccagacccctaggaagaagactattggcgagtgttccatgtctctgaggacactgtccacccaagagatggattattcgttagatattactccccctagcaaaatcagtgtctgccacgctgaacttgaactgggtacctgtttccaggctgtcaactctaggatccaactccagattcttgaggcacggtacctcccttcgtcttcaacccccctaaccctctcttttttcgtcaaggtcgggatgttcagcagtggggagttaatttataagaaaaaaactaggcttcttaaggccagtaatgggagggtcaaatggggggagacgatgatattcccgcttatccagtctgagaaggagattgtgtttctgattaagctgtactcccgatcttccgtcaggcgtaagcacttcgtcggtcagatctggataagtgaagattcaaacaatatcgaggctgtgaatcagtggaaggagaccgtaattaatcccgagaaagtcgtgattaggtggcacaagctcaatccatcgtag

SEQ ID NO: 20854 - DNA, 1281 bp, Artificial Sequence
  Description of Artificial Sequence: Synthetic coding sequence
atggccaccgagttcatcaagagctgctgcggcggctgcttctacggagagacggaaaaacataatttctcggtcgagcgtgattttaaagctgccgttcctaacagccagaacgcaactatttccgtgccacctctcactagcgtctccgtaaagcctcagcttggctgtacagaagattacctgttatccaagctgccatcagacggtaaggaggtgccctttgtcgttcccaagttcaaactttcctatatccagccccgaacccaggagacaccaagccaccttgaagaattagaagggtccgcaagagcttcctttggagatagaaaggtcgagctctctagcagttcacaacatggcccttcctacgatgtgtacaaccctttttatatgtaccagcatatatccccagacctctcccgtcgattccctccacggagcgaggtgaagaggctctacgggagcgtgtgtgatttgcgcaccaacaaattaccaggctcacctggcctcagtaaatcgatgttcgacctgaccaattcctcgcaacggttcatacagcgacacgattctctgtcttccgtcccttcttcaagtagctctcggaagaactctcaggggagcaatcgtagcctcgacaccatcaccctcagcggagacgagcgtgacttcggtaggctcaacgtgaaacttttctataactctagcgtggaacagatttggatcactgtactgcaatgtcgggacctctcctggccgagttcatatggggacacgccgacagtatctatcaaaggcatcctgacactgcccaagccagtgcactttaagagctccgcaaaagaggggagtaacgtgtgccacgccgagcttgaactgggtacatgctttcaggctgtaaactcgaggattcaactccagatcctggaagcccggtaccttccctcctcatcaaccccattgacgctatccttctttgtaaaagtgggcatgttttcatcaggcgaattgatttacaagaaaaagacgcggctgctgaaggctagtaatggacgggtaaaatggggcgagacaatgatttttcctctgatccagtctgagaaagagatcgtcttcttgatcaagctttatagccgctcgtctgtccggaggaaacattttgtggggcaaatatggatctctgaagatagcaataacattgaggcagtgaaccaatggaaggaaacagtaatcaaccctgagaaagtcgtcatcaggtggcacaaacttaatcccagttag

SEQ ID NO: 20855 - DNA, 1767 bp, Artificial Sequence
  Description of Artificial Sequence: Synthetic coding sequence
atggacctggaggaggccgaggagttcaaggagcggtgcacccagtgcgctgctgtgtcttgggggctgacagacgaggggaaatactactgtacttcttgtcacaacgtgacagagaggtaccaggaagtcaccaataccgatctgatccccaatacgcagattaaagcccttaacaggggcctgaaaaaaaagaacaacaccgaaaaggggtgggattggtatgtctgcgagggttttcagtacatactctatcaacaggccgaggccctgaaaaacctgggcgttggacctgagcttaagaacgacgtccttcacaacttctggaagagatatctgcagaagtctaaacaagcctactgcaaaaacccagtgtatactaccggccggaagcctaccgtgcttgaagataaccttagccacagtgattgggcctctgaaccagagttgctcagcgatgtgtcttgccccccgtttctggaaagcggcgccgaatcacaaagtgacatacatactcgtaagccctttcctgtctctaaagcctctcagagtgaaaccagtgtgtgcagcggcagcctcgacggtgttgaatactcacagagaaaagagaagggaatagtcaaaatgaccatgccccagactctggccttttgctatcttagtctgttatggcagcgcgaggctatcacgctcagtgatcttttacgctttgtggaagaggatcacatcccctacattaacgcgtttcagcattttccagagcagatgaaactttatgggcgcgatcgcggaattttcggtatagaaagctggcctgattatgaagatatctacaagaagacagtggaagtgggaacatttcttgacctgcccagatttcctgacattactgaggattgctacctgcacccaaacatcctgtgcatgaagtaccttatggaggtcaacctgcccgatgagatgcacagtcttacctgccacgtcgttaagatgacgggcatgggtgaggttgatttcctcacttttgaccctatcgctaagatggccaagacagtgaaatacgatgtccaggcagtagccatcattgtcgtggttttaaagctgcttttcctgctcgacgactctttcgaatggtcactgagcaatctcgccgaaaagcacaatgagaagaacaaaaaagacaaaccatggttcgacttccgcaagtggtaccagattatgaagaaggcctttgacgagaaaaagcagaagtgggaagaggccagagccaaatacttatggaaaagcgaaaaacctctgtactattctttcgtagacaaaccagtggcctacaaaaagcgcgagatggtggtaaatctgcaaaagcagtttagtacattagttgaatctactgccactgcagggaaaaaatccccctcgtcgtttcaattcaattggaccgaggaggatacagataggacctgcttccacggccactcactgcagggggtcttgaaagaaaagggccagtcactccttacaaaaaactcgctgtactggctgtcgacgcagaagttttgtcgctgttattgcacccacgtgaccacttatgaagaatccaattacagtttatcatatcagtttattctaaaccttttctctttcctcctgcgtattaagactagcctgctgcatgaggaagtgagtttagtcgaaaaaaagttatttgagaaaaagtactccgttaaaagaaaaaagagccgatctaagaaggtccgccgacactag

SEQ ID NO: 20856 - DNA, 1002 bp, Artificial Sequence
  Description of Artificial Sequence: Synthetic coding sequence
atgaagctgtacggccgggaccggggcatcttcggcatcgagagctggcctgactatgaagacatctacaagaagaccgtggaggtgggcacttttttggatttacccagatttcctgacatcacagaggattgctatctacatccaaacatactgtgcatgaagtacctgatggaggtaaatctgcccgatgagatgcattccctgacgtgtcacgtggtgaaaatgaccggcatgggcgaggtcgatttccttaccttcgaccctattgccaagatggcgaaaaccgtaaaatacgacgttcaggctgtggccatcatcgtggtagtgctgaaactgctctttcttcttgatgacagctttgagtggtctttgtcaaatttggccgagaaacataatgagaagaacaagaaggataagccttggtttgatttccggaagtggtaccagatcatgaaaaaagcctttgatgaaaagaaacagaaatgggaggaggcacgcgcaaagtacctttggaaaagcgaaaaacccctctactactcattcgtggataagccggtcgcctataagaaacgggaaatggtggtcaacctgcagaagcagttttcaactctagtggagtccaccgctacagccggtaagaagtctccatcatcattccagttcaactggaccgaagaagacacggacagaacctgtttccatggccacagccttcagggagtcctcaaggagaaaggccagtctctacttacgaagaactcactgtattggctaagtacacagaaattctgcaggtgttattgtacccacgttacgacatacgaggaaagcaactattccctctcttatcagttcattctaaatctcttctctttccttctccgtattaagacttctctgttgcacgaagaagtatcactggtggaaaaaaaactgtttgaaaagaagtactccgtcaagagaaagaaaagcagaagcaagaaggtgcgccgtcattag

SEQ ID NO: 20857 - DNA, 894 bp, Artificial Sequence
  Description of Artificial Sequence: Synthetic coding sequence
atgagccggttcaagttcatcgacatcggcatcaacctgaccgaccctatgtttagaggcatttacagaggcgtccaaaaacatcaggacgacctccaggacgtcatcggtcgggcagtggagatcggagtgaaaaaatttatgattacgggtggcaacctgcaggactccaaagacgccttacatcttgcacaaacaaatggcatgttcttctccacagttggctgccatcccacaaggtgtggcgagtttgaaaaaaataatcccgatctctatttaaaagagcttctgaacctggctgaaaataataaggggaaagtcgtggccatcggagagtgtgggctggattttgaccggctgcagttctgccccaaagacacccagctgaaatatttcgagaaacaattcgagctctcagagcagaccaagctgcccatgtttctccactgcagaaacagtcatgccgagttcctggacattatgaagagaaacagagacagatgcgtgggaggagtcgtgcatagttttgacggtacaaaggaggccgcggccgcactgatcgatttggatctgtacatcggattcaacggttgtagcctgaagactgaagccaacctcgaagtccttaagtccatcccctcagagaagctaatgatcgagaccgatgccccatggtgcggagtaaaatctacgcatgcaggttccaaatatatccgaaccgcatttccaacaaagaagaaatgggaatcaggccactgcctgaaagataggaacgagccgtgtcacatcatacaaattctggagattatgtctgctgttagggacgaggaccccttagagctggctaacactctgtacaataataccatcaaggttttcttccctggcatttag

SEQ ID NO: 20858 - DNA, 753 bp, Artificial Sequence
  Description of Artificial Sequence: Synthetic coding sequence
atgatcaccggcggcaacctgcaggacagcaaggacgccctgcacctagcccaaacaaatgggatgttcttctctaccgtgggatgtcaccccactagatgcggggaatttgaaaagaataacccagatctgtacctgaaagagctgctcaacctggctgaaaataataagggcaaagtagtggcaattggcgaatgtggacttgactttgatagacttcagttttgcccaaaagacacccagctgaaatattttgaaaagcaattcgaattgagcgagcaaaccaagctgcctatgtttttgcactgccgcaacagccatgctgagttcttggatatcatgaagcggaatagggaccgatgtgttgggggggttgtacatagcttcgacggaaccaaggaagctgcagccgcccttattgacctggatctgtatattggtttcaacgggtgctccctaaaaaccgaggcaaatctcgaagttttgaagtcaatccctagcgaaaagctgatgatcgagactgacgccccctggtgcggtgttaaaagcacgcacgccgggtctaagtatataaggacagctttcccgacaaaaaagaagtgggagagcggtcactgtctgaaggatcggaacgaaccttgccacataatccagattcttgagataatgagcgccgtcagagatgaggatccactggagctcgcaaacaccctgtataacaacaccatcaaagtgtttttccctggaatttag

SEQ ID NO: 20859 - DNA, 333 bp, Artificial Sequence
  Description of Artificial Sequence: Synthetic coding sequence
atgatcaccggcggcaacctgcaggacagcaaggacgccctgcacctagcacaaaccaatgggatgttttttagcaccgtgggctgccatccgactcgctgcggtgagttcgagaaaaacaatccagacttgtacctcaaggagctgcttaaccttgcggaaaataataagggcaaggtggtcgcgataggagaatgtggtctagatttcgatcggctgcagttctgtccaaaagacacgcagttgaaatactttgaaaagcagttcgaactgtctgagcagaccaagttgcctatgtttctccactgccgaaactcccatgccgagttctag

SEQ ID NO: 20860 - DNA, 2286 bp, Artificial Sequence
  Description of Artificial Sequence: Synthetic coding sequence
atggccagcgagcggggcaaggtgaagcacaactggagcagcacctccgaaggctgtccaaggaaaaggagctgcctacgcgagccctgtgatgtcgcccccagtagccggccagctcagcgcagtgcgtcaagatctggcgggccttccagcccaaagcgattaaaggctcagaaggaagatgatgtggcctgttctcggagacttagttggggaagcagccgtcgccggaacaactcctctagtagcttttccccccacttcctgggtcccggggtaggaggcgccgcgtccaaaggatgtctgattcgcaatactcgcgggtttctgagcagcggaggaagtcctctgcggcccgcaaacgcatctctcgaagagatggcctccttagaggaggaagcatgttctctaaaggtcgactcgaaagactcatcacacaacagcaccaatagtgagtttgctgccgaagctgaggggcaaaatgataccatcgaagaaccaaacaaagtgcaaaagcgcaaaagagaccgccttcgcgatcaggggtcaaccatgatataccttaaggccatccaaggtatactgggcaagagtatgcccaagcgaaaaggagaggctgccacacgcgccaagccaagcgcggccgagcatccatctcatggcgagggcccagcgaggagtgagggcccggcaaagaccgccgaaggtgccgctcggagcgtgacggtcaccgccgcccaaaaagagaaggacgctactccggaggtgagcatggaagaggacaaaacagtcccggagcggagctctttctatgatcgccgagtagttatagaccctcaagagaaaccaagcgaggaacccctgggagatcgaagaacggtcatcgacaagtgctccccccctcttgagttccttgacgacagtgattcgcacctggagatccagaaacacaaagacagagaagtggtcatggagcatccttcctctgggagtgactggtctgacgttgaggagatatctacagtgcgcttctcgcaagaagagcctgtgtccctgaagccgtccgctgtacctgagccatccagtttcaccaccgactacgtgatgtatccaccccatctgtattctagtccttggtgcgattacgcatcctattggacttccagccccaagccaagttcttatccatcgacaggctctagttccaatgatgcggctcaggtgggtaaatctagcagaagccgcatgtccgattacagcccaaacagcactggctctgttcagaatacctctcgggacatggaggcttccgaggagggatggagccagaattcacgctcttttcgattctctcggtcttctgaagagcgcgaggtgaaagagaagcgcactttccaggaggagatgccacctcgcccctgtgggggccacgccagcagcagtttgcccaagtcccacctggagccgtcccttgaggaaggctttattgatacccattgccatctcgatatgttgtattccaaattgtcttttcaggggacatttacaaagttcaggaagatatactcttcttccttcccaaaagagttccagggttgtatctctgatttttgtgacccgcggacccttaccgattgcctttgggaggaactgctgaaggaggatttggtatggggggccttcgggtgccatccgcacttcgcgcgctattactccgagtctcaggagcgaaacctcctccaggctttgaggcaccccaaggcggttgccttcggcgaaatgggactggactactcttataagtgtaccacaccagtccccgaacaacacaaagtttttgagcgacagcttcaactggctgtttcgctgaaaaaacctctagtgatccactgccgcgaggccgacgaggatctgctggagattatgaagaagttcgtgccccccgactataaaatacaccgtcattgctttacaggatcttatccagtgatcgagcctttattgaaatacttccctaacatgagcgttggatttacagctgttctcacctactcctctgcttgggaggccagagaagcactccgccagatccccctcgagaggatcatcgttgagacagacgctccttatttcctgcctcggcaggtccctaaaagtctatgtcagtatgcccatccaggcctcgccctgcacacagtcagagagatcgccagagtgaaggatcagcctttgtcattaactctcgcagccctgagggaaaacacttctcgactgtactccctgtag

SEQ ID NO: 20861 - DNA, 2286 bp, Artificial Sequence
  Description of Artificial Sequence: Synthetic coding sequence
atggccagcgagcggggcaaggtgaagcacaactggagcagcacctccgaggggtgccctagaaagcgctcatgcctgcgtgaaccatgcgatgtcgcccccagctctcggcccgctcaacgtagcgcatcgcggtcagggggcccgagctctcctaaaagacttaaggctcagaaagaggacgacgtcgcctgctcacgccggctgtcttggggaagttcccgccggaggaataactcctcctcaagcttcagcccacattttctgggacctggtgtgggtggcgcagcatctaaaggctgtctcattaggaacactcgaggcttcctgagttcagggggttctccactgagaccagcaaacgccagcctggaggagatggcaagcctggaagaggaagcttgctcgctcaaggtagattcaaaagactcttcacacaattccacaaactccgaatttgccgctgaggccgaaggacagaacgacaccattgaggaacctaacaaggtgcagaaacgcaagcgagatcggcttcgcgaccagggttcaaccatgatttatttaaaggctattcagggtatcctcggaaagagcatgcccaaacgcaaaggtgaggccgcaacccgggcgaagccttctgctgctgagcacccttctcacggagaggggccagcccgttccgaggggcccgccaaaaccgcagagggagcagcacgatccgtaactgtgactgccgcccagaaggaaaaagacgcaactcctgaggtctccatggaagaagataagacggtgcccgaaagatcttctttttacgaccgcagggtagtgatcgatcctcaagaaaagccatccgaggagcctctgggagatcggcgaaccgtgatagacaagtgctctcccccacttgaatttctggatgactccgactcacacttggagatacagaagcacaaagatagagaagtggtcatggagcatccatcgagtggttcagactggtcggatgtggaagagatatccaccgtcagattcagtcaagaggagcccgtttccctgaaaccaagtgcggtacctgagcctagcagttttaccaccgactacgtgatgtatccaccgcacctttatagttccccttggtgtgactatgcgtcctattggacaagcagccctaagccatctagctacccatctaccggaagttcttcaaatgatgccgcccaggtgggcaaaagttcccgtagcagaatgtctgactactctccaaactcaactgggtccgtgcaaaatacctcgagggacatggaagcctctgaggagggatggtcccagaacagtagatcattccggttctctagaagcagtgaagagcgggaagtgaaggagaagcgcacctttcaagaagagatgccgccgagaccatgtggcggccacgcaagctcctcacttcccaagtctcacctcgagcccagcctggaggagggctttatcgacacgcactgtcatctagatatgctgtacagtaagctctccttccagggtacgtttacgaaatttcgcaaaatttactctagctcattccctaaagagtttcaaggttgcatttctgatttttgcgaccccaggacactcactgactgcctttgggaggagcttctgaaagaagatctggtgtggggagcttttgggtgccatccccacttcgcgcggtactatagcgagagtcaagaaaggaatcttctgcaggccttgaggcacccgaaagctgtagcctttggagagatgggactggactattcctacaagtgcactaccccagtgccggagcagcataaagtatttgaacggcagcttcagctcgccgtcagcctcaagaaacccctggtgattcactgccgtgaggccgatgaggatctgctggagattatgaagaagttcgttccgcctgactacaaaatccatagacactgctttaccggctcatatccagtcattgagccattgcttaagtactttccaaacatgagcgtgggttttaccgctgtgctcacctacagttcagcctgggaggcacgcgaagctctaaggcagatccctctggagcggattatcgtcgagacggatgccccttacttcttgcctcgtcaggtgccaaagtctctgtgccaatacgcccatcctggccttgcattgcacacggtacgggagattgcccgcgtgaaagatcagcctctgagtctgaccctcgccgcactacgggagaacacttctcgcctgtacagcctgtag

SEQ ID NO: 20862 - DNA, 822 bp, Artificial Sequence
  Description of Artificial Sequence: Synthetic coding sequence
atgcgggccgccggcgtgggcctggtggactgccactgccacctgagtgcaccagattttgaccgagacttggatgatgttcttgagaaagccaaaaaggcgaatgtagttgcccttgtagcagttgcggagcactctggagagtttgaaaagattatgcaattaagcgagaggtacaatgggtttgtgcttccctgcctaggggtccatccagtccaagggctgcccccagaggatcagcgatccgtgacattgaaagatctcgacgtcgccctcccgatcattgagaactacaaggatagactcctggccatcggagaggtcgggctggacttttcacccagattcgcaggcaccggcgaacaaaaggaggaacagagacaggttctgattagacagatacagctggccaagcggctcaacctgcctgtgaatgtacactcacgctcagccgggagacccaccataaatttgctgcaagagcagggtgcggaaaaagttcttttgcatgcctttgatgggaggccatcagtggccatggagggagtcagagcaggctattttttcagcattcccccctccattatcagaagcggccagcagaaactcgtgaagcagttgccattaaccagcatttgtcttgagacagattcgcccgcactgggacccgaaaaacaggtccgcaacgaaccttggaatatctccatctctgcagagtatatcgcgcaggttaaaggcattagcgtggaggaagtgattgaggtgacaacccagaacgctctgaaattattccccaagttaaggcacctattacagaaatag

SEQ ID NO: 20863 - DNA, 825 bp, Artificial Sequence
  Description of Artificial Sequence: Synthetic coding sequence
atgcgggccgccggcgtgggcctggtggactgccactgccacctgagcgccccagatttcgatagagaccttgacgacgttctggagaaggccaagaaagcaaatgtggtggcgttggttgcagtggccgagcatagcggtgaatttgaaaaaatcatgcaactgagcgagcgctacaatggctttgtcttaccatgtctgggcgtacatcctgtgcaggggctcccccccgaagatcaaaggtctgtcaccttaaaggatttggacgtggccctacccatcatcgaaaactataaggataggcttttggcgattggagaggttggtctggacttcagccctcggttcgcaggaacaggagagcagaaggaagaacagcgacaggtgctaattaggcagatacagctggccaaacgcttaaaccttcccgtgaacgtccactccaggtcagctggccggccgacaatcaatctcctccaggaacagggagccgaaaaggttctgctgcatgccttcgatggccgtcctagcgtcgctatggagggtgttcgggccgggtattttttctccattccaccctccatcattagaagcggccaaaagcaaaaattggtgaaacaacttccactcacctccatctgtttggagacagacagtcctgccctaggtcctgaaaagcaggtgaggaatgagccatggaatatcagcatcagcgccgaatatattgcgcaggtgaagggtatttccgtggaggaagtgattgaagtcactacccagaatgctctcaaacttttccctaaattgcgtcatctcctccaaaaatag

SEQ ID NO: 20864 - DNA, 762 bp, Artificial Sequence
  Description of Artificial Sequence: Synthetic coding sequence
atgcgggccgccggcgtgggcctggtggactgccactgccacctgagtgcaccagactttgatagggatctggacgacgtgctggaaaaggccaagaaggcaaacgtcgtcgcgctggtcgctgtagcagaacattccggcgagttcgagaagataatgcagctgtccgagagatacaatggatttgttctgccatgtcttggagtgcatccagtgcagggtctgcccccagaggatcaacggagtgtgactctgaaggtgggtctggacttttcaccacggtttgcagggactggggaacaaaaggaggagcaaagacaggtgctgatccgccaaatccagctggctaagcgcttaaatctgcccgtcaacgtccattcgcgcagcgctggacggcctaccattaacttgcttcaggagcaaggcgctgaaaaagtgctgctgcacgcttttgacgggagacccagcgtcgctatggaaggagtccgggcgggttactttttttctattcctccttcaattatccggagtggacagaaacaaaagctggtaaagcagctcccccttactagcatctgtctcgaaactgatagccccgctttgggacccgagaaacaggttcgcaacgaaccctggaatatatccatctccgcagagtacattgcccaggtcaagggaatttctgtggaggaagtcatcgaggttaccacccagaatgctttgaaactgttccccaagcttcgccacctactacaaaaatag

SEQ ID NO: 20865 - DNA, 723 bp, Artificial Sequence
  Description of Artificial Sequence: Synthetic coding sequence
atgcgggccgccggcgtgggcctggtggactgccactgccacctgagcgcaccagactttgatagagatttggacgacgtgcttgagaaggctaagaaagcgaatgtcgtggcattagttgccgtagccgagcattccggggaattcgagaaaatcatgcaactgtctgagagatacaatggcttcgtcctgccatgtttgggagtgcatcctgtgcaaggactaccccccgaggatcagcggtccgtgactttgaaggatttagatgtggcactcccaatcatcgagaactataaagaccgcctgttggcgattggcgaggtggggttggacttcagcccacgatttgcgggaacaggcgagcagaaggaagagcagcgccaggtgctgatccggcagattcagctggcgaagcgcctaaatctacctgtgaatgtgcattccaggtcagccggccgacctaccatcaacctattacaggaacaaggcgctgaaaaggtccttctgcatgccttcgatggaagaccttcagtggctatggaaggagtgcgagcaggctatttctttagtattcccccctctatcatacgttcaggtcagcttctgtcacttttcagtaaaaaacaaaaactggtgaagcaactccccctgacaagcatctgcttggagactgacagccctgctctgggccccgaaaaacagcagaatatactccctcgatag

SEQ ID NO: 20866 - DNA, 846 bp, Artificial Sequence
  Description of Artificial Sequence: Synthetic coding sequence
atgcgggccgccggcgtgggcctggtggactgccactgccacctgagcgcccccgactttgacagagatctggacgacgtgttggagaaagcaaaaaaagccaatgtggtagcactggtagccgtcgcggagcactccggcgaattcgagaaaataatgcaactgtccgagcgctacaatggattcgttcttccatgcctcggtgttcaccccgtacaaggactcccccctgaggatcaacgcagcgtgacactgaaggatctggacgttgctctgccaatcattgaaaattacaaagacaggctgctcgccattggagaggtagggcttgacttcagtccccggtttgcaggaaccggggagcagaaggaagaacaaagacaggtactcattagacagattcagctggccaaacgcctcaacctccctgtgaatgtccactcccggtccgccgggagaccaacaatcaacctactgcaggaacagggggctgagaaggtcctgctccacgcctttgatgggcggcccagtgtggcaatggagggcgtgagggcgggatatttcttctccattccacccagcatcatccgatcaggccagctcttaagtctttttagcaagaagcaaaagctagttaagcagctgccactgacatctatctgtctcgagaccgactctccagccttgggacctgagaagcaggttagaaacgagccttggaacatctccatctctgccgagtacatcgctcaagttaagggaatcagcgttgaggaagtgattgaggttacaacacagaatgcgttaaagctgtttcctaagttgcggcacttacttcaaaagtag

SEQ ID NO: 20867 - DNA, 1824 bp, Artificial Sequence
  Description of Artificial Sequence: Synthetic coding sequence
atggccgagaagcggcggggcagcccctgcagcatgctgagcctgaaagcccatgctttcagcgtggaagccctgattggagcagaaaaacagcagcagctccagaaaaaacgtcgcaagctgggagccgaggaggctgccggcgcagtggatgacggaggctgctctcgtggcggtggcgcaggcgaaaaaggaagctccgaaggcgatgagggcgccgccctgcctcccccagcgggcgccacctccggccccgcccggtccggcgccgacctcgaacggggagccgccggcgggtgtgaggacggctttcagcaaggggcctcaccactcgcctctccagggggctccccaaagggaagccccgcgcgtagcctggctcgaccagggaccccactgccctctccgcaggctccacgcgtcgatttgcagggcgctgagctctggaagcgcttccatgagatcggaaccgagatgataattacaaaggcgggtagacgcatgttcccggcaatgcgcgttaaaatcagtgggctcgacccccatcagcaatattacattgcaatggatatcgtgcctgttgataataagcggtatcgttacgtgtaccattccagcaagtggatggtcgctggcaacgcagactcccctgtgccaccgcgggtgtacatacaccccgactcccctgcctccggggagacctggatgcgacaagtgatctcatttgataaactgaagctcactaacaacgagctggacgatcagggacacatcattctgcacagcatgcacaagtatcagcccagagtccacgtgattcgaaaggactgtggggatgacctttcccctataaaaccggtccccagtggagaaggcgtcaaggcattttcatttcctgaaaccgtgttcacaactgttactgcctatcagaatcaacaaattacccggctgaaaatcgatagaaatccttttgcaaaggggttccgcgattcgggacggaaccgcatggggctggaggcgctggtggagtcttatgccttttggcggccaagcctgagaacactgaccttcgaggacattccaggtattcccaagcaaggcaatgcatcctcttccaccctcctgcagggtacaggcaacggcgtccctgctactcatcctcatttgctaagcggttcttcttgctcatcccccgcttttcacttagggccaaacacatcacagttatgctcattagcccccgcagactactccgcttgcgctcggagcgggctgaccctgaatagatactctaccagcctcgccgaaacgtacaatagactaacaaaccaggctggcgagaccttcgcacctcctagaactccgagctacgtgggagtctccagttcaaccagtgttaacatgagcatgggcggcaccgatggcgacaccttctcatgcccacaaaccagccttagcatgcaaatttccgggatgtctccccagctccagtatatcatgccgtccccttcatccaacgcctttgccaccaaccagacccaccaaggtagttacaacacctttaggctccactctccgtgtgctctttacggctacaacttcagtacgtctcctaagctcgccgcttcgcccgagaagatcgtgtcgtcccagggctcttttctgggatccagtccgtcaggtaccatgacagaccgccagatgctgcccccagtcgaaggggtgcacctgctgagtagtggcggccagcagagcttcttcgattcaaggaccctgggtagtttgaccctgagctcatcgcaggtctctgcccacatggtttag

SEQ ID NO: 20868 - DNA, 918 bp, Artificial Sequence
  Description of Artificial Sequence: Synthetic coding sequence
cggggccggcacatctggaagctgggcttccccaagggcggctgcgaggatggcttccaacagggagctagccccctggccagccccggtggcagccccaagggatccccagccaggtcccttgcccgccccggtactccgctgccttccccccaggcacctagggtcgacctccaaggtgccgaactatggaagagatttcatgaaatcggaaccgagatgatcatcactaaggctggcagacgtatgttccccgctatgagagtaaagatcagcggcttggacccccaccagcagtattacattgcaatggacattgtacccgtggacaataaacgctatcggtatgtgtaccattcatcgaagtggatggtagctggaaacgccgactcccctgtgccgccccgggtgtatatccacccggactctccagcatcaggcgagacctggatgagacaggtaatctcttttgacaaattaaaactcacaaacaacgagctggatgatcagggtcatataatcctgcactccatgcataagtatcaacctcgggtgcatgtgattcgaaaggattgcggagatgacttaagccccattaagcctgttccgtctggagaaggcgtgaaggcctttagcttcccagagaccgtttttaccacagtgaccgcataccagaaccaacaaattactcgtctgaaaatcgacaggaaccctttcgccaaaggttttcgggactctgggcgtaaccgtatgggacttgaggctctggtagagagttatgccttctggagaccctctcttcgtaccttaacattcgaggatattcctggaataccaaaacaagaatatagagatttaaaaaccgattatatattcccggagcgggacaacttagtttcgagagagaccaaactgtag

SEQ ID NO: 20869 - DNA, 2049 bp, Artificial Sequence
  Description of Artificial Sequence: Synthetic coding sequence
atgcagctggagcactgcctgagccccagcatcatgctgagcaagaagtttctgaatgtttcgagctcataccctcattcgggcgggagtgagctcgtcctgcatgaccatcctattatttcaactacagacaatttggagcgtagctctcccctcaagaaaatcacgcggggcatgacgaatcaatccgacacagacaactttccagactctaaagatagccctggggacgtccagcgcagtaaactgagccccgttctggatggggtgtccgagctccgccacagttttgatggttccgcagccgaccgctatcttcttagtcaatcgagccagcctcagtctgctgctactgcaccgtcagccatgttcccataccccggtcagcatggaccagcccacccagcctttagcatcggctctcctagtagatacatggctcaccatcctgtcatcacgaatggggcctacaacagcttgctttctaattcttctccacagggatatccgacagctggttacccttaccctcagcagtatggacactcctatcagggagctcccttctaccaattctcttccacccagcctggcctcgtgcccggaaaggcccaggtttatctgtgtaacaggcctctgtggttgaagtttcacagacaccagaccgaaatgattattacaaagcagggacggagaatgttcccattcctatcatttaacatcagcggtctggaccccacggcacactataacatctttgttgacgtcatactcgcagacccgaaccactggaggtttcaaggcgggaagtgggtgccgtgtgggaaagcggataccaatgtacagggcaatagagtatatatgcaccccgattcccccaacactggagcacattggatgcggcaggaaataagtttcggcaagctgaaactgacaaataacaagggcgcctccaacaacaacggccaaatggttgtcttgcagtccctgcacaagtaccaacctcgcctgcacgtggtcgaggtgaacgaggacggcacagaggacacctctcagccaggaagagtacagacatttacattcccagagactcagtttatcgcggtgactgcctatcagaatacagacatcactcagctgaaaattgaccacaacccgtttgctaagggttttagggacaattatgacactatctacacaggttgtgacatggacaggctcacgccatctcctaatgacagccctcgctcccagattgtaccgggggcccggtacgccatggccgggtcatttctccaagatcaattcgtgtccaattacgccaaggcaagattccatccgggggccggcgccggtcccgggcctggcaccgatcggagcgttccgcacacaaacggactgctctcaccccaacaagcggaggaccctggggcaccatctccccagcgctggttcgtgacgcccgctaataaccggctggattttgccgcctcggcttacgacaccgccaccgactttgcaggaaacgccgcgactctgctgagttacgccgccgcaggggtcaaggctctgcctctgcaggcggccggttgtactgggaggcccctgggatactacgctgacccatccggctggggagctaggagcccacctcagtattgcgggaccaagagcggcagcgtgctcccttgttggccaaactcagctgccgctgccgcccgaatggcgggcgctaatccttacctaggtgaagaggcagaaggtctggcggccgaaaggtcacctctacccccaggcgcggctgaagacgccaaaccaaaagacctatcggattcaagctggatcgaaacccctagcagtattaagtctattgatagctctgactctggcatatatgaacaggcaaagagaagacgcatcagtccagcagacacgccagtgagtgagtcttcatcccctttgaaaagcgaggttttggcacagagggattgtgagaagaattgtgcaaaggacatcagcggatattatggcttttatagtcattcctag

SEQ ID NO: 20870 - DNA, 1188 bp, Artificial Sequence
  Description of Artificial Sequence: Synthetic coding sequence
atgcaccccgacagccccaacaccggcgcccactggatgcggcaggagatctcttttgggaaactaaaactcactaacaataagggggccagcaataataacggtcagatggttgtcctgcagtctttgcacaagtaccagcctagattacatgtagtggaggtaaacgaggatggcaccgaggacacatcacagcccggtcgagtccagacatttacgttccctgaaacccaattcattgcagtaactgcttaccagaacaccgatatcactcagttgaagatcgatcacaacccctttgccaagggattcagggataactacgacacgatttatacaggctgtgacatggaccgtctcacacctagccctaatgacagtcctcggtcccaaattgtccccggcgcccgttacgccatggcgggatcattccttcaggatcagtttgtaagcaactacgcaaaagcaaggtttcaccccggtgcgggggcgggaccaggacccgggacagacaggtcagtgccacataccaatggcctgcttagtccgcagcaggcagaggaccctggagcaccatcaccccagcgctggttcgttacgccagcgaataatcgcctagatttcgcagcaagcgcctacgataccgcgaccgattttgctggaaatgccgccaccttattaagctatgcagcggctggtgtgaaggccctgcctttgcaggccgctggatgcaccggcagaccactgggctattacgccgacccaagtggttggggggctagaagcccgccacagtactgcggcaccaagagcggcagtgttcttccatgttggcccaactccgctgcagctgctgctagaatggccggggccaatccctacctgggtgaagaggcggaagggctcgccgccgagcgcagtcccctgcctcctggagccgcagaggatgctaagccaaaggacctgagtgactcctcgtggattgagacacccagcagcataaaatccattgacagctcggattctggtatttacgaacaagccaaacgccgtcgaattagcccagccgataccccagtctctgagtcaagtagccctctcaagtccgaagttctggcccagcgggactgtgagaaaaactgtgccaaagacatctccggttactacgggttctactcacatagctag

SEQ ID NO: 20871 - DNA, 1056 bp, Artificial Sequence
  Description of Artificial Sequence: Synthetic coding sequence
atgcaccccgacagccccaacaccggcgcccactggatgcggcaggaaatctcattcgggaaactgaaacttaccaacaacaagggagcaagtaataataacggtcaaatggtggtgctgcagagcttgcataaataccagccccgcctgcacgtcgtggaggtgaacgaggacggaacagaagatacatctcaaccaggacgtgttcagaccttcactttcccagaaacccagttcatcgctgtgactgcatatcagaacactgacatcacacaactaaagattgaccacaacccatttgctaaaggctttagagacaattacgatacaatttatactggctgtgacatggatcgagccggccctggacctgggactgaccgctcagtgccccatacaaacgggctcctcagcccacagcaagcagaagaccccggggccccatccccacagaggtggttcgtgacccccgccaataatagactggatttcgccgcctccgcctatgacaccgccaccgacttcgccggcaacgctgccacacttctgagttacgctgccgccggagtgaaagccctgccactccaggccgctggctgcaccggaagacccctgggctattacgcggatccctctggttggggggccagatctcctccacagtactgcggtacaaagtccggcagcgtattaccctgctggcccaatagcgcagctgccgccgcgcgcatggccggagctaacccctatctgggtgaggaggcagagggcctggccgccgaacggtctcctctgccgcccggtgccgccgaggatgcaaaacctaaggacttaagtgattcctcgtggatcgagacacctagttccatcaagtccatagattcttccgactccgggatctacgaacaggccaaacgccgccgtatttcccccgccgacaccccagtgagcgaaagctcatcacctctcaaatctgaggtcctggcacagagggactgtgaaaaaaattgtgccaaagatatatccgggtactacggattctattctcattcatag

SEQ ID NO: 20872 - DNA, 2739 bp, Artificial Sequence
  Description of Artificial Sequence: Synthetic coding sequence
atgagcctgcccatcggcagcgccgaggtggccagcgagcgggtggagctttggaggtcaggcttccggtggtggcaaagatgcttatgtttctgcaggtacaggcgcgtcgctatggctgctgtcgacagtgatgtcgagagtctgccacgcgggggcttccggtgctgtttgtgccacgtcactacagccaatcgtcctagcttggatgcgcatctgggtgggcggaaacataggcatttggtagagctaagggctgcgcgaaaagcacagggactgagatcagtgtttgtcagcggcttccctagagatgtcgactcggcccaactttccgaatacttccttgccttcggcccagtcgcctccgtggtgatggataaagataaaggggtgttcgccatcgtagagatgggagacgtcggagcccgggaagccgttctcagtcaaagccaacactctctgggtggacacagacttagggtaaggccacgcgagcagaaagagttccagtcacccgcttctaaatcacccaaaggcgccgctccggattcacaccagctcgccaaagctttggccgaggctgccgacgtgggcgcccaaatgatcaagctcgtgggactgagggagttatctgaagcagaacgacaattgcgttccctagtggttgcactcatgcaggaggtgttcactgagttcttccctggatgtgtagtacatcctttcgggagttctatcaatagcttcgacgtgcacggttgcgacttagatctcttcctcgatctgggtgacttggaggaaccacaacctgtaccaaaagcaccagaatccccctcactggatagcgcactggcctcaccattggatcctcaggcccttgcttgcacccccgcgagccctccagacagtcagcctcccgcgagccctcaggacagcgaagcgctcgactttgagacgccaagctctagtcttgctccccaaactcctgattccgccctcgcatcagaaaccctggcatctccacagtcactgccgccagcctctccgctgttagaagatagagaagagggagatctaggcaaggcatctgagctggctgagactcccaaagaggagaaggccgagggggccgctatgctggaactggtgggctccatactccgcggctgcgtgcccggcgtgtatcgagtacaaaccgtgccctccgcacgccgcccggtggttaagttctgccatcggccctccgggctacacggagacgtttccctgagcaatcgcctagccttgcacaacagccggttcctctccctttgcagcgaactggacgggagggtgagaccattggtgtacacactcagatgttgggcccagggccgagggttgtccggcagcggtccgttgctaagcaattatgcactgacgctcttagtaatatatttcctccagacacgagacccaccagtgctgcctacagtttctcagctgactcagaaagccggagaaggagaacaagttgaagtggatggctgggactgttcctttcctcgcgatgcctctagactggagccatcaatcaacgtcgaacccctctcctccctactggcgcagttctttagctgtgtctcatgctgggacctgaggggctcgctgctgagcttgcgagaaggccaggcactgccagtcgcaggcgggctgccaagtaatttatgggaagggttaaggctgggtcctctgaacctgcaggacccctttgacctcagccacaatgtggctgcaaatgtaacgagcagagtagcaggccgcctgcagaattgttgcagagctgccgccaattattgcaggtcactgcagtatcagcgcagatcttctcggggcagagactggggcttgctgccccttctccaaccgagttctccctcatctctccttagcgccaccccgatccctctgcctctcgcaccattcactcagttaaccgccgcgctggtgcaggtctttcgggaagctctgggatgccacatagagcaggcgaccaagaggacccgctctgaggggggcggcacaggcgaatcaagtcaggggggaacatcaaagagattaaaggtcgacggccagaagaactgttgtgaggagggtaaggaggagcagcaaggctgcgctggggacggaggggaggacagggtcgaggaaatggtcattgaggtcggggaaatggtgcaggactgggcaatgcagagccccggacagccaggggatttaccactcaccacagggaagcatggcgcgcctggagaggagggccagccatcccatgccgctctggccgagagggggcccaagggacacgaagctgcccaggagtggtcccaaggtgaggccggcaaaggagccagcctgccatctagtgcctcctggcgatgtgccctatggcaccgggtgtggcaggggcgaagacgggcacgaaggaggctgcagcagcagaccaaggaaggtgctgggggaggagctggtacccgagcaggatggctcgcaaccgaagcccaggtcacgcaagaactgaaaggcctctcaggtggagaagagcggcctgagactgagcccctgctttcatttgtggcttcagttagtcccgccgaccgaatgctgactgttactcctctgcaggacccccagggtctttttcctgatctgcaccattttctacaggtctttctgccccaagctattaggcacctgaagtag

SEQ ID NO: 20873 - DNA, 2625 bp, Artificial Sequence
  Description of Artificial Sequence: Synthetic coding sequence
atggccgccgtggacagcgacgtggagagcctgccccggggcggcttccggtgttgtctctgtcacgttacgacagctaaccggcctagccttgacgctcatctgggaggccgaaaacaccgacacctcgtcgaactccgggcagctcggaaggcccagggtttaaggagtgtattcgtgtcaggatttccacgcgacgtagatagcgcccagctgtccgagtacttcttggcgtttggacctgtagcctcagtggtcatggacaaggacaagggggtctttgccatcgttgagatgggcgatgtgggcgcacgtgaggccgtgctgagccagtcccagcactcactgggaggtcatcgtctgcgcgtccgacctagagaacagaaggagttccagtccccggctagtaaatcccccaaaggcgctgccccggactcacatcagctggcgaaggcacttgccgaagccgctgacgtgggcgcgcagatgatcaagctggtgggcctcagggagcttagcgaggctgaacgccaacttcgatcattggtggtcgctttgatgcaggaagtgttcaccgagttcttccctgggtgcgtcgtgcacccatttgggtccagtatcaactcatttgacgttcatggctgcgacttagacctcttcctcgatctcggcgatctggaagaaccccagcccgtgcccaaggctcctgagtctccctcgctggattccgccttggccagccctctggaccctcaggcactggcgtgcacaccggcctcgcccccagactctcagcctccggcgagccctcaggactcggaggcgctagacttcgaaacacctagctcctctctagctccccaaacacccgattcagcactggctagcgaaacattagcaagccctcaatctcttcctcctgccagtccattgctggaagaccgtgaggagggggacttgggcaaggctagcgaactggccgaaactcccaaggaggaaaaggctgagggcgccgctatgctagaactcgtgggctctatattgaggggatgtgtgcctggagtgtatagagtacaaaccgtgccttcagccaggaggcccgttgttaaattctgtcaccggccgagtggattacacggcgacgtgtcgctgtcaaaccgactggctctgcacaattctcggtttctgagcctctgcagcgaactcgacggtcgggtgcggcccctagtttacacattgcgctgttgggctcaaggaagggggttaagcggcagtggcccactgctgtcaaattacgcactcacactgcttgtcatctatttcctgcagactcgggacccaccagtccttccgacggtgtcgcagttgacacagaaggctggcgaaggcgaacaggtcgaggtagacggatgggattgctcgttcccccgcgacgcctcgaggctggaaccgtccatcaatgtggagcccctatcatccctgctcgcacagttcttctcttgtgtgtcctgctgggatctgcggggctcactgttaagccttcgggagggtcaagcattgccggtcgccgggggactgccatctaacctctgggagggtctacggctgggcccactgaacctccaggacccattcgacttatcacacaacgtggctgccaacgtgacatctagagtggctggaagacttcagaactgctgtcgcgccgccgccaattattgccgctcattacagtatcagagaaggtcctcccggggtagagattggggacttctgccattactccagccctcttcccctagcagtctgctgagtgccacgcctatccctttaccattggccccttttacccaactcacggccgcacttgtgcaggtgttcagggaggctcttggctgtcacattgagcaagctaccaaacgcacaaggtccgaggggggaggcaccggggagagctcacaagggggcacaagcaaacgcctaaaagtggatggccagaaaaactgttgtgaagagggaaaagaggagcagcagggatgcgcgggtgatggcggagaggatagagtcgaagagatggtgattgaggtgggcgaaatggtccaggactgggcaatgcagtcaccagggcagccgggggaccttcctctgaccactgggaagcacggcgctcccggagaagaaggccagccaagccacgccgcactagccgaaagggggcctaagggccacgaggccgcccaggaatggtctcaaggagaagcaggcaaaggagcttctctacccagctctgcctcctggcggtgtgcactttggcatagggtgtggcaggggaggaggagggctcgccgtcgtttacaacagcagactaaagaaggcgctggaggtggagcaggcacccgagccgggtggctagccacagaggcacaggttacacaggaactcaagggactgagtggaggcgaggaacgaccagagactgaacccttattaagctttgtcgcatccgtctcaccagcagatcgcatgctaacagtgacaccgttgcaggaccctcagggcctcttccctgacctgcatcactttctgcaggtcttcctcccccaagctatacgccatctcaaatag

SEQ ID NO: 20874 - DNA, 495 bp, Artificial Sequence
  Description of Artificial Sequence: Synthetic coding sequence
atgtgcccccccgtgagcatgcggtacgaggaggagggcatgagctacctttacgcgtcctggatgtaccagctacagcacggggatcagttgagtatttgcttcacatgttttaaagctgcatttctggactttaaggacctgttggaatctgaggactgggaagaagataattgggaccctgagctaatggagcataccgaagccgagagcgaacaggagggaagtagcggaatggagctctcctgggggcaatcccccgggcagcctgtgcagggaggaagcgaagcctggggtccaggcaccctggctgcggctccggaaggcttggaagacgccggtctggatccccatttcgtgccgacagagttgtggccccaggaggccgtgccgcttggtctgggcctggaggatgccgattggacccaggggctcccctggagattcgaagaattattgacatgtagccactggccgtcatttttccctagctag

SEQ ID NO: 20875 - DNA, 1236 bp, Artificial Sequence
  Description of Artificial Sequence: Synthetic coding sequence
atgctgagcctgcgggagcagcagctgcaggtgtggttcaagaaccgcagagcaaaattggcccgcgagcgcagattgcagcagcagcctcagagagttcccgggcagcgcggacgtggagctcgagctgcccccctggtgcctgccgcatcagcatcagctccacagcggggcccttctggcatactgccggcagccgaaccaaccatctgttctcttcaccaggcgtgggggggccccggctgtcgggcacagaaaggaatacccgcggcactgtcacctggaccagggccaattccagcccccataccggggccagcccagatccctggaccgctgccaggctcaatacctgggccgataccaggcccagctcagatcccgagtccaatacctgcacccattccaggcccgatcagcggtccagttcagatacccggaccttttaggggacctatacctggccccatctcagggcccgcccctatccctggacccatatctggccccttctccggcccaaatcccggccccattccaggccccaatccaggtcctatccctggccctatttctgggcctatccccggacccatctccgtccctattcccggccccattcctggacctatctctggaccgatctcggggcctaaccctgggccaatacccggcccgatccccggccctataagtggccccaacccgggcccgattcccggacctattagtggaccaaatcctgggctcatacccgggcctattccagggcctatctccggcccaggaccaattattggacctatccccagtcctgctcagatcccgggccccggccggctgcagggcccgggacccatcctctcgccgggtaggatgcgctcaccaggcagcctgcccgggctcgcgcctattctggggccaggaagcgggcccggtagcgggtccgtccccgcaccaatccctggacccggtagcctccctgctccggccccgttgtggcctcagtcccctgacgcttctgactttctacctgacacccagctcttcccacacttcacagagctgctgctaccgttagatcccttagaaggcagtagcgtgagcacgatgacatcgcagtaccaggagggagacgactcgatgggcaagaagcattccggaagtcagccacaggaagaggggggctccgtcaatgagaatcactcaggcccacgacttctcctcgacttgtag

SEQ ID NO: 20876 - DNA, 1527 bp, Artificial Sequence
  Description of Artificial Sequence: Synthetic coding sequence
atggacgaggccggcaaccaccacagcgagcagaccatcacccggacagagaatcagacgccgcatgccttagcgcaccgccggatggggccctgtctgtcctgctctcagttatactcacagtacctgggactttcacaaacgcatagttcgccaccgctcgctctcgatccacctagacgacagcgacaagagcggaccgtatacaccgagagccaacaaaaggtactagagttctattttcagaaagatcagtaccctaactacgaccagcgtctcaaccttgcagaaatgctaagcctaagagagcaacagctccaggtctggtttaagaatagaagagccaagctcgcccgggaacgccgcctccagcagcagccacagagagtgccaggccagagagggcggggagctcgcgctgctcctctcgtgcctgcagcgtcagcatccgctcctcagcggggccccagtggaatcctgccagcagccgaacccacaatatgtagcctacaccaagcctggggtggccctggatgccgcgcccagaaggggatcccagcagccctcagcccgggacctggacctatacccgcaccaatcccaggacccgctcagattccgggaccactgccaggctcaattcccggccccattccagggccggcacaaatcccgtcccctatcccagccccaatccctggccccatcagtggcccggtgcagatcccaggaccctttcgggggccaatccccgggccgatctcaggacctgccccaatccctggacctatatcgggacccttttcaggacccaatccgggtccaatacccggccctaatccaggtcccatacctggccctataagcggaccaatccccggaccgatctccgtccccatacccgggcccattccgggacccatatccggtcctattagtggcccgaatcccggcccaattcccgggcctataccaggccccatcagtggccccaatcctgggcccattcctggccccataagcggccctaatcccggtcttattcccggacctattcccggcccaatttcgggcccgggccctatcattggacccattccctcaccagcccagatacctggcccaggccgacttcagggtcccgggcccatcctgtcacctgggaggatgagaagccccgggtccctccccggcctagcccctatcctcggccctgggtcgggtccggggagcgggagcgttcctgcccctatccctggacctggcagcctaccggctccagctccactgtggccccagtctcctgacgcgtctgactttctgccagatacgcagctgttcccccacttcactgagctgttactccctctggacccactggagggcagtagtgttagcactatgacaagccaataccaagagggcgacgacagcatgggaaaaaagcatagtggttcccagccccaggaagaagggggatctgtgaacgaaaaccactcagggccgcgcctgctgctggacttgtag

SEQ ID NO: 20877 - DNA, 1206 bp, Artificial Sequence
  Description of Artificial Sequence: Synthetic coding sequence
atgctgagcctgcgggagcagcagctgcaggtgtggttcaagaacaggagagcaaaactggccagggaaagaaggctgcagcagcagcctcaacgggtccctgggcagcgtggacggggcgcacgggctgccccactggtcccagccgcatccgcctcagccccgcagcgtggcccctctggaatcttgcctgctgcagagccaaccatatgtagtttacaccaagcctggggcggacctgggtgtcgcgcccagaaggggattcccgcggctctctcgcctggtcctggcccaatccctgctcctatccccggccctgcacagattcctggtccgctccctggatcaatccccggcccgattcccggtcccgcccagatcccctcccccattcccgcccccataccgggaccaatctctggacctgtacagatccccggcccatttcgggggcctattcccgggcccatatccggcccattttccgggccaaaccctgggccgatccccggcccgaacccaggcccaatacctggtcccattagtgggcccatcccgggccctatctcagtgcctataccgggcccaatccccggacccatatctggccccattagcggacctaatcccgggcctatcccgggccctattcccggacccatttccgggccaaatccaggaccgattccagggccgatttcagggcctaatcccggactcatccccgggcctatacccggcccaatctcggggccagggccaatcattgggcccattccgtcgccagcccagattcctggcccggggagactgcaggggccaggacctattctttcccccgggcggatgcgttccccgggtagcctccccggcctggcgcccatcctggggcctggcagcgggccaggttctggttccgtgcctgctcctattccaggtccaggatctctacccgctccggcccccctctggcctcagtctcctgacgcatctgacttcctgccggacacccaactgtttccacacttcaccgaactactgctgcccctcgacccccttgagggctcgagtgttagcacaatgacctctcaataccaggagggtgacgattccatgggcaagaaacacagcggttctcagccccaggaagaggggggcagcgtgaatgaaaatcatagcggacccaggttgctgctagacctgtag

SEQ ID NO: 20878 - DNA, 1206 bp, Artificial Sequence
  Description of Artificial Sequence: Synthetic coding sequence
atggtgctggcccagagccgggtgagcgccggcgtgggcagcccccactgcagcggaagcggaggaggcggctcagacagtttcccatggccagccagccaccccggtaatccccaatgcagtttcagcacagcattcctggctagccccagactctccaggggtacacttgcctatctgcctcctgcaccttggtccagcctcgcaaccccaagcgccttactcggttctagttgtgcccctccgccccctcccgcgcggtgtccacagccaagagcactctcacctgagctcggcaccaaggcgggcccacgtcgcccgcaccggtgggagctgccgcgctccccatcccagggagcccaaggccccgcacctaggaggcgtctcttagagactatgaaagggattgtcgccgcgagtgggagcgaaacagaggacgaagatagcatggacatcccactggatttgagctcttcggccggaagtgggaagcggcggcggcggggaaacctgcccaaagaatctgtccagattctaagggactggctgtatgagcatcgttataatgcatatccctcggagcaggagaaggccttgctgtctcagcagacccacctgtcaacgctccaagtgtgtaattggttcatcaatgcaaggcgtagattgctacctgatatgttaaggaaagatggaaaggacccgaatcagttcaccataagccgcaggggggcaaaaatttccgaaacaagctccgtagagtcagtgatggggataaagaacttcatgcccgcgctagaagagacaccattccattcttgcaccgccggtccgaatcccacacttgggagaccactcagccccaagccttctagccctggatccgtactagcccgaccatctgtcatctgtcataccaccgtgacagccctgaaagatgtcccattctccctgtgtcagtctgtcggtgtgggccaaaataccgacatccagcagatagcagctaaaaactttaccgatacaagcctgatgtaccctgaggacacttgcaaatcaggcccttccaccaatactcagtctggtctctttaacacaccaccccctactccaccagacttgaatcaggacttttcgggttttcagctgctggtggacgtcgctttgaagcgggccgccgagatggagttgcaggccaagctgacagcctag

SEQ ID NO: 20879 - DNA, 819 bp, Artificial Sequence
  Description of Artificial Sequence: Synthetic coding sequence
atgaagggcaagaagggcatcgtggccgccagcggcagcgagaccgaggatgaagatagtatggacatcccgctggatctatcatcctcagctggatccggaaagcggcgaaggagagggaaccttcctaaggaaagcgttcagatccttagggattggctgtatgaacacaggtataatgcgtatccctccgaacaagagaaggcactcctatcccagcagacccacttgtctaccttgcaggtctgtaattggttcatcaacgccagacgcaggctgctgcccgatatgcttagaaaggatggcaaggacccaaaccaattcaccattagccgacggggtgccaaaatctccgaaaccagctctgtcgaatccgtgatgggaatcaagaatttcatgcccgcccttgaggagacaccctttcatagttgtaccgctggacccaatcccactctggggaggccactgtcccccaaaccgagctcacctggctctgtgttggcccgcccctctgttatttgccacaccacagtcacagcgcttaaagacgttccctttagtctgtgccagagcgtaggtgttggtcaaaacactgatattcagcagatcgctgcaaagaattttactgacacatctctcatgtatcctgaagatacctgcaagtccggacccagcacaaatacgcagtcgggattgtttaataccccacctcctaccccacccgacttgaaccaggattttagtggatttcagttgctcgtagacgtcgcccttaaaagagcagccgagatggaactgcaggcaaaactcacagcatag

SEQ ID NO: 20880 - DNA, 759 bp, Artificial Sequence
  Description of Artificial Sequence: Synthetic coding sequence
atggacatccccctggacctgagcagcagcgccggcagcggcaagcgccggcggcggggaaatctgccaaaggaaagcgttcagatcctgcgcgactggctctatgaacacaggtataacgcttatccctctgagcaggaaaaggccctgctttcccagcagacacatctatcgactctgcaagtctgcaattggttcatcaatgccaggcgtcggctgctgcctgacatgctgagaaaggatggaaaggatccaaatcagttcaccatatctaggaggggggcgaagatttccgaaacgtccagtgtcgagtccgttatgggtataaaaaacttcatgcccgctctggaagagacacccttccattcttgcacagccgggcctaatcctaccctggggcgaccgctgagccccaaaccgtctagccctgggtccgtcctcgcacgaccatctgtgatatgtcatactacggttactgctcttaaggacgtccctttctccctctgccagtcagtcggcgtcggacaaaacactgacattcagcagatagctgccaagaacttcactgatacaagtctaatgtaccccgaagatacatgcaagtcagggcccagcacaaacactcagtcggggctgttcaacacccccccaccaacccctcctgacctcaaccaggacttcagcggcttccagcttttagtcgacgtggctcttaaacgcgcggctgagatggagctgcaggctaagctcacggcatag

SEQ ID NO: 20881 - DNA, 759 bp, Artificial Sequence
  Description of Artificial Sequence: Synthetic coding sequence
atggacatccccctggacctgagcagcagcgccggcagcggcaagagaagacgacgtggcaatcttccgaaggagagcgtacagattttgagggactggctctacgagcaccgttacaatgcttacccttcggagcaggaaaaagcactgcttagtcaacagacccacctgagtaccctccaagtgtgtaactggtttatcaatgcccgaaggcgcctcctgcctgacatgctaaggaaggacgggaaggaccctaaccaatttaccatcagcaggagaggggcgaagatttccgagaccagctctgtagagagcgtgatgggaatcaaaaactttatgccagcacttgaggagaccccttttcactcctgtactgcagggccaaatccaaccttaggccgaccgctgtcacctaaacccagcagcccaggttctgttctggcccgccctagtgttatatgtcataccacagttacagcccttaaagatgtccctttctccctatgccagagtgtgggtgttggccaaaataccgacatccagcagatcgctgccaagaacttcactgacacgtctttaatgtatccagaagatacgtgtaaaagcggcccctccacaaatacacaatcaggcttgtttaatacgccaccgcctactccccctgacttgaaccaggacttctcgggctttcagctgcttgtggatgtcgcacttaagagggccgccgagatggagctccaagccaaacttacagcttag

SEQ ID NO: 20882 - DNA, 759 bp, Artificial Sequence
  Description of Artificial Sequence: Synthetic coding sequence
atggacatccccctggacctgagcagcagcgccggcagcggcaagcgcaggagacgtggcaatctgcctaaagagtccgtgcagattctcagggactggctctacgagcaccggtacaacgcttacccaagtgagcaggagaaggcactgctatcccagcagacccacctgtccaccctccaggtgtgcaattggtttataaatgctcgtcggagactgctgcctgacatgcttcgaaaagacggcaaggatccaaatcaattcactatatctcgacgtggcgctaaaattagtgagaccagctcagtggaatctgtgatgggaattaagaacttcatgcctgctttagaagaaacaccattccatagttgtacagctggacccaacccgaccctgggccggcccctgtcccctaaaccgtcaagcccaggttcagtgctggccagaccgtcagttatatgtcataccactgtgaccgcccttaaagacgttcccttttccctctgtcaaagtgttggcgtggggcagaacaccgatatccagcagattgcagccaagaattttacagatacctcccttatgtatccagaagacacttgcaagagcggcccctcgactaacactcagagcggactctttaacacacctccaccgacacctcctgaccttaatcaggactttagtgggttccagctactggtcgatgtcgcactgaaaagggccgctgagatggagctgcaagcaaaactcacagcctag

SEQ ID NO: 20883 - DNA, 759 bp, Artificial Sequence
  Description of Artificial Sequence: Synthetic coding sequence
atggacatccccctggacctgagcagcagcgccggcagcggcaagcgacgaagacgggggaatctgcctaaagagtccgtccaaatcctgcgggactggctgtacgagcaccgctataacgcgtacccgtccgaacaggagaaggcgctcttgtcccaacaaacgcacctcagcacattgcaggtttgcaattggttcattaacgcccgcagaaggcttttgcccgatatgctaagaaaagacggcaaggatccgaatcagtttaccatttcccgccggggggctaaaatcagtgaaacgagctccgtggagagcgtgatgggtataaagaatttcatgccggccctggaagagaccccttttcattcttgtacagcaggtccaaacccaacgctggggcgacccctctcccctaagccgagctcaccaggctcagtcctggcccgcccctctgtaatctgtcacacgaccgttaccgctctgaaagatgtcccgttctccctctgtcaatcagtgggggtcggccagaatactgacattcagcagattgcggccaagaacttcacagatacctctctaatgtacccggaggatacgtgcaaatccggcccatctacaaatacacagagtggcctgtttaatacaccccctccaacacctcctgacttaaaccaggactttagcggcttccagctgctagtagacgtcgccctgaaaagggctgcggagatggaactgcaggcaaagctgactgcctag

SEQ ID NO: 20884 - DNA, 819 bp, Artificial Sequence
  Description of Artificial Sequence: Synthetic coding sequence
atgaagggcaagaagggcatcgtggccgccagcggcagcgagaccgaggacgaagacagtatggatatcccccttgacctgtctagctctgcaggcagcggcaagcgtcgcagaaggggtaacctgcccaaagaatccgtccagatcctgcgagattggctttatgaacaccgttacaatgcgtacccatccgaacaggaaaaagccctcctaagccaacaaactcacctgagcacactgcaagtctgtaactggtttattaatgcaagacgaagactgctgccagatatgctgaggaaggatgggaaagaccccaatcaattcactatcagcaggcgaggagctaagatcagcgaaacatcgagcgtagagagcgtgatgggcatcaaaaattttatgcccgcccttgaggagaccccctttcatagttgcactgcaggacccaatcctacgttggggagacctctatcacctaaaccttcaagcccaggttctgtcctggcaaggccaagcgtcatctgtcataccacggtgaccgctctcaaagacgtgccattctccttatgtcagtccgtaggggtggggcagaacacagatatacagcagatcgccgcaaaaaatttcaccgatacctcgctcatgtatcctgaagacacatgcaagtcagggccttcaactaatacacagtcagggctgtttaacacacccccacccacgccacctgatctgaaccaagacttcagtggtttccagctcttggtggacgtggcactcaagcgggctgcagaaatggaactgcaagccaaactgacagcatag

SEQ ID NO: 20885 - DNA, 759 bp, Artificial Sequence
  Description of Artificial Sequence: Synthetic coding sequence
atggacatccccctggacctgagcagcagcgccggcagcggcaagcggcgaagacgaggtaatctcccgaaggaaagcgtccagatcctccgggactggctttatgagcatagatacaacgcatacccatctgaacaggagaaggcattattatcccaacagacccatctctcgaccctgcaggtttgtaattggtttatcaatgcgagaagaaggttactccctgatatgttgagaaaagatggcaaagacccaaatcaattcacaatttcgaggcgaggcgctaagatttccgagactagcagtgtagagtccgtgatgggcatcaagaacttcatgcccgcacttgaggagacaccctttcattcctgcaccgcagggcctaatccaactctgggtcggcccctgtcccctaaaccttccagcccgggcagtgtcctcgcaaggccctccgtgatttgccatacaaccgtgactgctctgaaggacgtaccattcagcctgtgtcagtccgtaggggtcggccaaaataccgatatccagcagattgccgccaagaactttactgatacctctctaatgtacccagaggacacttgtaaatcgggaccctcaaccaacacacagtcaggcctcttcaacactccaccacctaccccgccagacctcaaccaggatttttccggctttcagctgctagtggacgtggcattgaagcgggccgccgagatggaacttcaggccaagctcaccgcgtag

SEQ ID NO: 20886 - DNA, 861 bp, Artificial Sequence
  Description of Artificial Sequence: Synthetic coding sequence
atgacctgcagcggcaagagctgcgccctggcccggagcagcctgactagttcccaaggtatcgtggccgctagcggatccgaaactgaagatgaagatagcatggacatcccacttgatttgtctagcagtgctggatccggaaagagaaggcgtagaggaaacctgcccaaggagagcgttcagattctgagagactggctatacgagcataggtataatgcctaccctagcgagcaggagaaggccctgctcagtcagcagacccacctaagtaccttgcaggtgtgcaactggttcattaacgcacgaaggaggctgctgcctgacatgctgagaaaagatggtaaggatcctaaccagttcacaatttcccgtagaggtgcgaaaatttcagagacttcttctgttgagagcgtcatgggcattaagaattttatgcccgctttggaagagaccccatttcactcttgtaccgccggccccaatccaacgctgggtagaccattgagccctaagccctcatctccagggagcgttctcgcccggccttcggtcatctgccacacaaccgtcaccgcactgaaagacgttcccttttccctctgtcagagcgtgggggtcggccagaacactgatatccagcagatagccgcaaagaactttaccgacacaagcttgatgtaccccgaggacacttgtaagtcagggccttcaaccaacactcaatctggcctttttaatacaccacctcccacgccccccgacctaaaccaggacttctccggttttcagctgttggtcgatgtagccctgaaacgcgccgccgaaatggagctgcaggccaaactgacggcctag

SEQ ID NO: 20887 - DNA, 279 bp, Artificial Sequence
  Description of Artificial Sequence: Synthetic coding sequence
atggacatccccctggacctgagcagcagcgccggcagcggcaagcgcagacgacggggaaacttacctaaagagagtgtgcagattcttagggattggttgtacgaacaccgttataatgcttatccatctgagcaggaaaaggccctgctctcccagcagactcacttatccactctacaagtgtgcaattggttcatcaatgctcggaggcgcctgctgccagacatgttacgcaaagacggcaaggatcctaaccagttcactatctcccgctag

SEQ ID NO: 20888 - DNA, 402 bp, Artificial Sequence
  Description of Artificial Sequence: Synthetic coding sequence
atggacatccccctggacctgagcagcagcgccggcagcggcaagagaaggaggagaggcaatctgccaaaggaatctgtacagattctaagagactggttgtacgagcacagatacaatgcctaccctagcgagcaggagaaagcactcttgtcgcaacagacccatctctcaaccctacaggtgtgtaattggttcataaatgccaggagaaggttactgcccgacatgctgcggaaagacgggaaggaccccaatcaatttacaatctccagacgtggggcgaagatctctgagacctccagcgtggagagcgtgatgggtatcaaaaactttatgccagccttagaggagacaccctttcattcatgcacagccggccctaatccgactctgggctag

SEQ ID NO: 20889 - DNA, 741 bp, Artificial Sequence
  Description of Artificial Sequence: Synthetic coding sequence
atggacatccccctggacctgagcagcagcgccggcagcggcaagcgtagacggcgtggcaatctgcctaaggaatcagtacagatccttcgagactggttgtatgagcatcgctacaacgcttacccaagcgaacaggagaaggcgttgctgtcccagcaaactcatcttagtaccttgcaggtatgtaactggtttataaacgccagaaggcgtctgctgcccgatatgctgcgtaaggacggaaaagatccaaaccagttcaccattagccggcgcggcgctaagatatcggaaacgtcttcagtcgagtcagtgatgggtattaaaaatttcatgcctgccctagaagagactccattccattcctgtaccgccggccctaacccaactctaggtcgccccttatccccaaagcctagctcacccggctcagtcctagcaagaccttctgtcatttgccacactacagtcaccgcactgaaagatgttcccttctcactgtgccagtctgtgggcgtgggtcaaaatacagatatccaacagatcgccgcaaagaatttcaccgataccagtctgatgtatcctgaggatacgtgcaagtccggaccttccacaaatacccagtcaggcctgttcaacacacccccacctactccacctgatctgaaccaggatttttccggtttccagctgcttgttgatgtggccctgaaacgcgccgccgagatggagctgtag

SEQ ID NO: 20890 - DNA, 660 bp, Artificial Sequence
  Description of Artificial Sequence: Synthetic coding sequence
atggacatccccctggacctgagcagcagcgccggcagcggcaagcgcaggcgtcgaggtaatttgcccaaggaatcagtacaaatcttacgagattggttatatgagcaccgctataacgcctatccctctgagcaggagaaagccctgctatcccaacaaacgcacttatctacacttcaagtgtgtaattggtttataaatgcccggcgcagactgctgccggacatgttgagaaaagatggcaaggatccaaaccaatttactatctcccgaagaggggccaagatctccgagacttcatctgtcgaatcagtcatgggaatcaagaactttatgccggccctagaggaaacaccattccactcctgcaccgccggaccgaaccccactctcggccgcccacttagcccgaagccttcttctccaggctcagtccttgcacggccatccgtgatatgccacacaaccgtgaccgcccttaaagacgtgccattctcattgtgtcagtccgtgggcgtcgggcagaataccgatattcagcaaattgcggctaagaactttacagacacttccttgatgtatcctgaggatacctgcaagtcaggaccatccaccaatactcagagtggactattcaatacaccccctccgacatag

SEQ ID NO: 20891 - DNA, 396 bp, Artificial Sequence
  Description of Artificial Sequence: Synthetic coding sequence
atggacatccccctggacctgagcagcagcgccggcagcggcaagcgtcgtcgacggggtaatcttccgaaggaaagcgtccagattttgagagactggctgtacgagcaccgctacaatgcctatccatctgagcaggaaaaggccctgttgtcccagcagacccacctctcgaccctccaggtttgtaactggtttataaacgcacgccgccggttgttaccagacatgcttagaaaagacggcaaagatcctaatcagtttacaatttcacggaggggagctaaaattagcgaaacgtcctctgtcgagagcgtgatgggaattaaaaacttcatgcccgccctggaggaaaccccatttcacagctgtaccgccggtcctaatcctacctag

SEQ ID NO: 20892 - DNA, 417 bp, Artificial Sequence
  Description of Artificial Sequence: Synthetic coding sequence
atggacatccccctggacctgagcagcagcgccggcagcggcaagagaagacgccgaggcaatcttcccaaagagtcagttcagatcttacgcgattggctttacgaacaccggtacaacgcctacccctctgagcaggagaaggcactgctgagccagcagacacaccttagtacacttcaggtgtgtaattggttcattaatgcacgccgacgactgctgccagacatgcttcggaaagacggcaaggatcccaaccagttcaccatctctcgccgcggcgcgaagatctccgaaacctcaagtgtggaatccgtgatgggcattaaaaactttatgcctgcactcgaagaaaccccattccacagctgcacagccggtccaaaccctaccctgggcaggcccctgagcccgtag

SEQ ID NO: 20893 - DNA, 759 bp, Artificial Sequence
  Description of Artificial Sequence: Synthetic coding sequence
atggacatccccctggacctgagcagcagcgccggcagcggcaagaggcgcagaagaggcaaccttccgaaggagtcagtgcagatcctaagggactggctctatgaacatagatacaatgcatatcctagtgaacaggaaaaagccctgttgtctcagcagacccatctgtcaacccttcaagtctgtaactggttcattaacgccagaagaagattactaccagacatgctccgcaaagatggcaaggaccccaatcagttcaccatttccagacgtggggccaagataagtgaaacgtcaagtgtggagtccgtgatgggtattaagaattttatgcctgccctggaggagaccccattccattcgtgtaccgccggacccaatccgaccctaggaaggcccctttctccaaaaccctcatcacctggatcggtacttgctaggcccagtgtcatctgccacactaccgtgaccgctttgaaagatgtacccttttcactgtgccagtctgtgggagtcgggcagaacacggacatccaacagatagccgccaaaaattttacggacactagtctcatgtacccggaggatacctgcaagtctgggcctagtacgaatacacagagcggattatttaatacaccgcctcccaccccccctgatttaaatcaggacttcagcggctttcaactgctggtggacgtcgctctgaaaagagccgctgaaatggaacttcaagccaaactgacagcttag

SEQ ID NO: 20894 - DNA, 507 bp, Artificial Sequence
  Description of Artificial Sequence: Synthetic coding sequence
atggacatccccctggacctgagcagcagcgccggcagcggcaagagaaggcgccgaggtaacttgcctaaagaatcagtgcagatcctgcgcgattggctgtacgaacatagatacaatgcctacccgagtgagcaagagaaggcgctcctgtcccaacaaacccacctttctaccctgcaagtttgcaactggttcattaatgctcggcggcggctcctacctgacatgctaaggaaagatggtaaggacccaaaccaattcactatcagcaggagaggggctaagatcagcgaaacgagcagcgtggaaagcgtcatgggcatcaagaattttatgcccgccctcgaagaaacaccattccactcctgcaccgccggacctaacccaacgctgggccgcccattaagccctaaaccctctagtcctgggagcgtgctcgccagaccatccgtgatctgccacactacagtgacagccctcaaagacgtgcctttctcactgtag

SEQ ID NO: 20895 - DNA, 2523 bp, Artificial Sequence
  Description of Artificial Sequence: Synthetic coding sequence
atggccggccccggcagcaccggcggccagatcggcgccgccgccctcgccgggggtgcaagatccaaagtcgctcctagtgtggacttcgaccattcttgcagcgattcggtcgaatacctcactctgaatttcggaccctttgagaccgtgcataggtggcgtcgcctgccaccttgcgatgagttcgtcggggctcggaggagtaagcacacggtggttgcttacaaagacgcgatatatgtgttcggaggagacaacgggaaaaccatgctgaatgacctacttcgcttcgacgtgaaagattgctcctggtgtcgagccttcactacaggaacccctcctgccccacggtaccaccactccgccgtcgtgtatggttcttccatgtttgtgttcggcggttacacaggcgacatctactccaatagcaatctcaagaacaagaacgaccttttcgagtacaaattcgctactggtcaatggacggaatggaagattgagggccgcctgccagtcgcgcggtcggcacacggcgctacagtctactcagacaaactctggattttcgccggctatgacggtaatgcccgactcaatgacatgtggaccataggcttgcaggaccgggagctcacctgctgggaagaggttgctcaatctggtgagatacccccctcttgctgcaacttccctgtcgcggtatgcagggacaaaatgttcgtgttcagcgggcagtccggtgccaaaataacaaataacttgtttcagttcgagttcaaggataagacttggacaaggattcctacggagcacctgcttcgcggttctccccctcccccacagaggcgctacggccacactatggttgcattcgacagacacctgtatgtttttggcggggcggctgataataccctcccaaatgagttgcattgttatgatgttgacttccaaacttgggaagtcgtacaaccaagcagcgactccgaggtagggggggccgaggtgcccgagagagcctgcgcctccgaagaggtgcccacactgacctacgaagaacgtgtgggctttaaaaagagcagagatgtgtttggcctcgactttggaaccacatccgctaaacagcccactcaacccgcgtcagaactgccctccggtcggctctttcatgccgctgcagtgattagcgacgcaatgtacatttttggtggaaccgtcgataacaatatccgaagcggggaaatgtaccggtttcagttcagttgctacccaaagtgtacgctccacgaagattacgggcgactttgggaatcgagacaattttgtgacgtggagttcgtcctcggcgaaaaggaggaatgtgtccagggtcatgtggccatcgtaaccgcacgcagcaggtggctgaggcggaaaattacacaggcacgagaacgcctcgcacagaagttggagcaagaggctgccccagtaccccgcgaggcaccaggagttgccgcaggaggagcacggcccccattactccacgtggccattcgggaggctgaggcacgtccttttgaagtgctgatgcaatttctctataccgataaaattaagtaccctaggaagggccacgtcgaggacgtgttgctgataatggacgtgtacaagctggccctgagctttcaactgtgtcgtctcgaacaactctgtcggcagtatatagaggcttccgttgacttgcagaacgtattggtggtatgcgagagcgctgcacgactccaactgtcccagctgaaggagcactgcctaaacttcgttgtgaaagagagccattttaaccaggtgatcatgatgaaagagttcgagaggctgtccagtcctctcattgtggaaattgtgcgcagaaagcagcagccccccccccgcacccccctagatcagccggtggatatagggacatcattaatccaggatatgaaagcctaccttgaaggagccggagccgaattttgtgacattaccctgctgcttgatgggcacccaagacctgcccacaaagctattcttgcggcgcgaagcagttatttcgaagcgatgtttcggagttttatgcccgaggacggacaggtcaacatttcgatcggagagatggtgccctcccgacaggccttcgaaagcatgctcagatatatctactatggagaagttaatatgccacccgaagatagtctttatttatttgctgctccttattattacggattttataataacagactacaggcatattgtaaacagaatctggagatgaacgtcacagtgcaaaacgttctgcagattctggaagcggccgataagacacaggctctggatatgaaacggcactgcctccacattattgtccaccagttcacaaaggtcagcaagctgccaactttaaggtccctctctcaacaactgctcctggatatcatcgactcactggcatcacacattagcgataagcagtgcgccgaactgggggctgacatctag

SEQ ID NO: 20896 - DNA, 930 bp, Artificial Sequence
  Description of Artificial Sequence: Synthetic coding sequence
atgccccggcactgcagcgccgccggctgctgcacccgggacacccgtgaaactcggaacaggggaatcagcttccaccgtctgcctaaaaaggacaaccctcgtaggggcctctggctggccaactgccaaaggctggacccgtccggacaggggctctgggacccggctagtgagtatatttatttctgcagcaagcacttcgaggaagattgtttcgaactcgtcggtatttctggttatcacaggctcaaggaaggtgctgtgcctactatattcgaatcgttttctaagctgcgaaggaccactaaaacaaagggccattcatatccacccggacctgctgaagtttctcgcctgcggagatgccggaaacggtgttccgaaggacgtggacctactacgccattttccccccctcccccagctgacgtaacttgtttccctgtcgaagaggcgtccgcccccgctaccttgcccgctagccctgccggccggttggaaccaggattatcatcccctttctctgatctgcttggaccgctcggagcccaagctgacgaagcagggtgctctgcccagccgtctcccgagaggcagcctagcccccttgaacctcgccctgttagcccatcagcatatatgctccgcttgccccctccagccggcgcgtacatacagaatgagcattcctaccaagttgggagcgctttgctctggaaaagaagggcagaggccgcgctggacgcgctagataaggcccagcgccaactgcaagcctgtaaaagacgcgagcaaagactccgtctgaggttaacaaaacttcagcaggaacgggctcgcgagaaacgagcccaggccgacgcgagacagaccttgaaggaacacgtgcaagattttgccatgcagctgagttcgagcatggcctag

SEQ ID NO: 20897 - DNA, 1140 bp, Artificial Sequence
  Description of Artificial Sequence: Synthetic coding sequence
atgggcgacagccggcggcggagcctgggcaaccagcccagcagcgaagctgctggtcgctccgaaagggaacaagatggcgaccctcgtgggctgcaatccagtgtttacgaaagcagacgcgtcacagatcctgagcgtcaggatctggataatgcagaacttgggcccgaagatccagaggaagagctgcctcccgaagaggtggcaggtgaggaattccccgagacactggatccgaaagaagccttgtcagagctcgagcgcgtgcttgataaagatctcgaggaagatatccctgaaatctcccggctctcaatcagtcagaagctgccgagtaccactatgacaaaagctagaaagcgccgaagacgccgccgattgatggaactggccgagcccaaaattaactggcaggtgctgaaggacagaaagggtaggtgtggcaaaggttacgcatggatcagcccctgcaagatgtctctgcacttctgtttatgctggcctagcgtttattggaccgaaagatttcttgaagatactactttgacaatcaccgtgcctgcggtctcgagacgagtggaggagctgtctcgcccaaagcgtttctaccttgagtattataataacaaccgcaccacaccagtctggcctatccccagatcatctctggaatatagagccagcagccgccttaaggagctcgccgctcccaaaatccgtgacaatttttggtctatgcctatgtccgaagtgtctcaagtttcacgagccgcccagatggcagtcccatcctcacggatccttcagctcagtaaaccaaaagcgcccgctactctgctggaggaatgggatccggttccaaaacctaagccccacgtgtccgatcacaaccgcctgctgcacttggcgaggccgaaagctcagtcagacaaatgtgtgcccgatcgtgatccgcggtgggaggtcctcgacgtgacgaagaaggttgtagccagcccacgcatcatttccctggctaagccaaaagtgcgcaaggggctgaacgagggatatgatcgccgccccctagccagcatgtctcttccaccccctaaagcgtcaccggaaaaatgcgatcagccacgcccaggcttgtag

SEQ ID NO: 20898 - DNA, 1068 bp, Artificial Sequence
  Description of Artificial Sequence: Synthetic coding sequence
atgggcgacagccggcggcggagcctgggcaaccagcccagcagcgaagctgccgggcgatctgagagagagcaggacggtgaccctagaggattacaatccagcgtgtacgagtctcggagggtcactgatcccgaacgccaggacttggataacgctgaactaggaccagaagaccctgaggaagagttgccaccagaagaagtggcaggcgaagaatttcccgagactctcgatcccaaagaagcactatcggagctggaaagagttttggacaaagacttagaagaggatattccagagatatcccggttatctatctctcagaaactcccgagtaccaccatgacaaaggcacgcaaacgtcggaggaggcgccgcttgatggagctggctgagcccaagattaactggcaggttttaaaggatagaccctctgtctactggacagagaggtttctggaggacaccacgctcaccatcaccgtaccggcagtaagtcggcgggtggaagaactgagtagacctaaacggttctacctggagtactataataataaccggactaccccagtgtggccaattcctcgctctagtctcgagtaccgcgctagtagcagattgaaagagctagccgcaccaaaaatcagggataatttctggtcgatgccaatgagtgaggtgtctcaagtgtcacgagcagcacagatggccgtgccttctagcagaatactgcagctgtctaaacccaaggctcccgctacactcctcgaggagtgggatccagttcccaagcctaaacctcatgtgtccgaccataatcgattgctgcatcttgctaggcccaaagcccagagtgataaatgtgtccccgatcgcgatccaagatgggaagttctcgacgtgaccaagaaagtcgtggcctctcctaggatcatatctctcgcaaagccaaaggttcggaaagggctcaatgaggggtatgacagacggcccctggcctccatgtcactaccgcctcccaaggcctcacccgaaaagtgtgatcagcctagacctgggctctag

SEQ ID NO: 20899 - DNA, 450 bp, Artificial Sequence
  Description of Artificial Sequence: Synthetic coding sequence
atgagcttcctgctgcccaagctgaccagcaagaaggaggtggaccaggctataaagtctacagctgaaaaggttctggtactgagatttggaagagacgaggacccagtgtgcctacaattggacgatatcctgtcaaaaacaagcagtgacctctcaaaaatggccgccatttacttagtggatgtggaccaaaccgccgtgtacacacagtattttgacatttcttatataccttccacagtcttcttcttcaatgggcaacacatgaaggtcgactatggcagccccgatcacactaagttcgtcggctcattcaagaccaaacaagacttcatcgacttgatcgaggtgatctataggggagcgatgaggggaaagctgattgtgcagagccctattgaccccaagaacataccaaagtatgatctgctgtaccaggacatctag

SEQ ID NO: 20900 - DNA, 450 bp, Artificial Sequence
  Description of Artificial Sequence: Synthetic coding sequence
atgagcttcctgctgcccaagctgaccagcaagaaggaggtggaccaggctataaaatctactgcggagaaagtcctggtcctgaggtttggccgagacgaggaccccgtgtgcctccagcttgacgacatactgagtaaaacatcctccgacttgtctaagatggctgccatctacctcgttgacgtagaccagaccgcggtctacacccagtactttgatataagttacatcccaagcacggtcttcttttttaacgggcagcacatgaaagttgactatgggtcccccgaccacaccaaatttgtgggctccttcaaaaccaaacaagatttcatcgatttgatcgaggtcatttaccgaggcgctatgaggggcaagctgattgttcaatccccaatcgaccctaagaacattccgaagtacgacctcctgtatcaggacatttag

SEQ ID NO: 20901 - DNA, 450 bp, Artificial Sequence
  Description of Artificial Sequence: Synthetic coding sequence
atgagcttcctgctgcccaagctgaccagcaagaaggaggtggaccaggcaatcaaatccaccgctgagaaagtgcttgtgctgagatttgggcgggatgaagaccctgtatgtttgcagctggatgatattttatccaagacgagtagcgacctttctaaaatggccgccatttatttagttgatgtcgatcagaccgctgtttacactcagtactttgatatttcttatattcctagtacagtattcttctttaacggacagcatatgaaggtagattacggatctcctgaccacaccaaattcgttgggagttttaaaaccaaacaggattttatagaccttattgaagttatttacagaggcgccatgagaggaaagctgattgtgcagagtccaattgatccaaagaatatccctaaatatgatcttctgtatcaagatatatag

SEQ ID NO: 20902 - DNA, 891 bp, Artificial Sequence
  Description of Artificial Sequence: Synthetic coding sequence
atggagcgggccgtgcccctggccgtgcccctgggccagaccgaggtctttcaggctctgcaacgattacacatgactatattctctcaaagtgtcagcccctgtgggaaattcctcgcggccggtaacaactacgggcagatcgccatcttctcactgtcctccgctctgtcttccgaggccaaggaagagtctaaaaagccggtagttacatttcaagcccatgacggacccgtctactccatggtctccaccgacagacatctcctgagtgcaggcgatggagaagtgaaggcttggctgtgggctgagatgctgaaaaaaggctgtaaggagctgtggcgtagacagccgccgtacaggacctcattggaggtgcccgagattaacgctttactgctagtgccaaaggagaatagcctcatcctcgcgggaggagattgccagcttcataccatggacctggaaacaggtacatttacacgcgtgctacgtggacatactgactatatccattgccttgctctccgagagcgctctcctgaagttctctcaggcggtgaggatggcgcagtacgactgtgggacctgcgcaccgctaaagaggtacagactattgaagtctataagcacgaagagtgtagccgacctcacaatggcaggtggatcggctgcctggcgactgactctgattggatggtttgtggcggtggacctgccctcactctttggcatttgcggtcatctacaccaaccactatctttcctatcagggctccccagaaacatgtgacattctatcaagatctcgtactgaccgcagccggtaattcatgcagggtggacgtgtttacaaatttaggatacagggccttctctctatcattctag

SEQ ID NO: 20903 - DNA, 1026 bp, Artificial Sequence
  Description of Artificial Sequence: Synthetic coding sequence
atggagcgggccgtgcccctggccgtgcccctgggccagaccgaggtctttcaagctttgcaacggttacatatgacaatattcagccagtccgtatcaccttgcggtaaatttcttgcagccgggaataactatggtcagatcgccattttttcattatccagcgcactctcatccgaggccaaggaagaaagcaagaagccggtcgtcactttccaagctcacgacggaccggtatattccatggtgtccaccgaccggcacctgctgtccgccggagacggggaggtgaaggcttggttatgggccgaaatgcttaagaaggggtgcaaagaactctggcgacgccagcctccatatcgaactagccttgaagtacctgagattaatgcacttctgctggtgcccaaagagaatagccttatcctggcaggcggcgattgtcaactccacacgatggatctagagaccggcacatttacgagggtgttaagaggacacacagactatatccattgcttagctctcagagagcgctcgccggaagtgctctccggcggggaagatggcgcagtgagactgtgggacctgaggaccgccaaagaggtccagaccatcgaggtatataagcacgaagagtgtagcagaccccataatggacggtggattgggtgcctcgctacagatagcgattggatggtctgcggagggggtcccgctctgacattatggcatcttaggagttcaacgcctactacaatatttccaattagagcgccccagaagcacgttaccttttaccaggatctaatcctatctgcaggacaaggccggtgcgttaaccagtggcagctaagtggggagctaaaggctcaggtgcctggcagcagccctgggttgctctccctttctttgaaccagcagcccgcagctcccgagtgcaaagttctgactgccgctggcaacagctgtagggtggacgtctttacaaacctggggtatcgggccttctctctctcattttag

SEQ ID NO: 20904 - DNA, 2868 bp, Artificial Sequence
  Description of Artificial Sequence: Synthetic coding sequence
atgagcaagaccaacaagagcaagagcggcagccggagcagccggtcccgctctgcctcccggtcccgcagcaggagttttagcaagtccagatcccgctctcgaagtctctctcgtagcaggaagcggaggttgtcctcccgcagccgctctagaagctactcccccgcccataatcgggagcggaaccaccctagggtgtatcaaaacagggacttccgcgggcacaacagaggctacaggcgtccgtattattttcgaggaagaaaccgcgggttctacccgtggggccagtacaaccgaggggggtacggcaactataggagcaactggcagaattatagacaggcttattctcctcgccgtgggcgctcacggagtcgctcccctaaacggcgctccccctctcccagaagccgctcccattcaaggaactcagacaaaagcagtagcgacaggagtcgcagaagtagctcctctcgcagtagcagtaaccactccagagtagagtcaagcaaaagaaagagcgctaaagaaaagaagtcttccagtaaggacagtcgtccttcacaggcagcaggggataatcagggcgatgaggcaaaagagcagacattctcggggggtacttcacaggacaccaaggcttcggaaagtagcaagccatggccagacgccacctacggcaccggctctgccagcagggccagtgctgtcagcgagctgtcaccaagagaacgatcccccgctctgaaatccccgctccagagcgttgtagtcagacgcagaagtcctagaccgagcccagtcccaaagcccagcccccctctgtcctctacaagtcagatggggtccaccttgccttccggggccggttatcagtctggaacacaccagggccagtttgatcacggcagtggcagcttgagcccctcaaagaagtctccggtgggcaaatcacctcccagcacaggttcaacttacggtagcagccagaaggaggagtccgctgccagtggcggggctgcttacacaaaacgttatctcgaggaacagaagaccgagaacggcaaagataaggagcagaaacagacaaacactgacaaggaaaagatcaaggaaaaagggagcttctctgacacagggctgggcgatgggaagatgaagtcagactccttcgctcccaaaaccgatagtgagaagccgttcagaggcagtcagtctcctaagaggtataagctccgcgacgactttgaaaaaaagatggcagacttccataaggaggaaatggatgaccaggataaagataaagctaaaggccgaaaagagtccgaatttgacgacgagcccaaatttatgagcaaagtgattggcgctaacaaaaaccaagaggaagagaagagtgggaaatgggaaggcttagtctacgctccccccgggaaagagaagcaaaggaagacagaggagctagaggaggagagtttccctgaacgctctaagaaagaggacaggggcaagcgatcagaggggggacataggggctttgtacctgagaagaattttcgggtcacggcgtataaagccgtacaagagaagagcagcagtcctccccctaggaagacaagcgagagcagagataaactcggagccaaaggcgacttccctaccggcaaaagttctttttccatcaccagggaagcccaggtgaatgtaaggatggactcattcgacgaggatctggcccgccccagcgggttgcttgcccaggagagaaagttgtgcagagatctcgtgcatagcaataagaaggagcaggaattccgttctatttttcaacacatccagtccgctcagtctcagaggagtcccagcgaactgttcgctcagcatatcgtgacaatcgtccaccatgtcaaggaacatcattttggtagctcggggatgacattacatgagaggtttacaaaatacctaaaaagaggaaccgagcaagaggctgccaagaacaaaaagtccccagaaattcataggcgcatcgatataagcccatcaactttccggaagcacggactggcacatgatgagatgaagagcccaagggagcccggatacaaagctgaaggcaaatacaaagacgaccccgtggacctaaggcttgacatagaaagacgtaagaaacataaggagcgagacctcaagagggggaaaagccgggaatctgtcgattccagagacagcagccacagcagggaacgatccgcggaaaagactgaaaaaacccacaagggctccaagaagcagaaaaaacatcgaagggcgcgcgaccgatcgcggtcgagttccagcagctcacagtcaagtcattcctacaaggcagaagaatacacagaggagactgaggaaagggaagagtcaaccactggctttgataagagtcgcctgggcaccaaggacttcgttgggccttcagaacgtggcggtggtagggcccgcggcacgttccagttccgggcccggggccggggctggggccgagggaattatagcggaaataataacaacaactcaaataacgacttccagaagagaaaccgtgaagaggagtgggatccagagtatacccccaagtcaaaaaagtattacctgcacgacgatcgagagggggaaggctcagataaatgggtcagccgggggagaggacggggtgcgttcccccgcggccgcggccgcttcatgtttaggaaaagctccacctcccctaagtgggcccatgacaagtttagcggcgaggaaggcgagatcgaggacgacgaatccggcacagagaatagggaagaaaaagacaatatccagcctacgaccgaatag

SEQ ID NO: 20905 - DNA, 2868 bp, Artificial Sequence
  Description of Artificial Sequence: Synthetic coding sequence
atgagcaagaccaacaagagcaagagcggcagccggagcagccggtcgagaagcgctagtaggtctagaagccggtcattctctaaatcgagatcccgctcacggtcactgtctagaagccggaagcgccgattatcctctaggtctcggagccggtcctacagtccagcccacaatagggagcggaaccacccccgggtatatcagaatagagacttccgcgggcataaccggggataccgtcggccatattatttccgtggacgaaaccgaggtttctatccatggggccaatataacaggggcggctatggcaactatcgttcgaactggcagaactatagacaagcttactctccaaggcggggccggagtcgcagtaggagcccaaaacgcagatcaccctcacctcgcagtaggtcccactccagaaattctgacaaatcttcttcagacagatctaggcgcagctcctccagtaggtcaagttccaatcattccagggtggaatcctccaaacggaaaagcgccaaggagaaaaagtcttcgtccaaggactcaaggccttcccaagctgcgggtgataatcaaggcgacgaagctaaggagcaaaccttttcgggagggactagccaggacactaaagctagcgagtcctcaaaaccttggcctgacgcaacatatggaacaggttccgcctcacgagcaagtgctgtttcagaactgagtccccgggagagaagtcctgctttgaaatcccctctgcaaagcgtggtcgttcgacgtcgatctcctcggccttctccagtgcctaagcctagcccccccttgtcttccacctcccagatgggttccacgctgcctagcggagctggataccaaagcggtacccatcagggccagtttgaccacggatctgggagtctcagcccgtccaaaaaaagtcctgtgggcaagagccctccttcaacgggttccacatacggctcgtctcagaaggaggagtctgctgcctcagggggcgctgcctatactaagagatacctggaggagcagaagactgaaaacggaaaggacaaggagcagaagcagacaaataccgacaaagagaaaattaaggagaaagggtcattttccgacactggtttgggggacggcaagatgaaatcagactcatttgccccgaaaactgactctgagaaaccctttcggggcagtcagtccccgaagcggtataagttaagagacgacttcgaaaaaaagatggccgactttcacaaggaggagatggacgatcaggataaagacaaagccaaggggcgcaaggagtctgaatttgacgatgaacctaagttcatgagcaaggtgataggagctaacaagaatcaggaagaagaaaaatctggtaagtgggaggggctggtgtacgcgccacctggaaaagaaaaacaaaggaagactgaagagctcgaagaagagtcattcccagaacgctcaaaaaaagaggaccgggggaagagatctgaaggcggccatcgaggtttcgtgcctgagaagaactttcgcgtgaccgcctacaaggctgtgcaggaaaaaagcagttctcccccgcctaggaaaactagcgagagccgagacaagctgggggccaagggagattttccgacaggcaaatcttccttttccattacgcgggaagcgcaggtgaatgtcaggatggactcctttgacgaagacctcgcccggccttcgggtctgctagcacaagaacggaagctgtgtcgggaccttgtccattccaataaaaaggaacaggagtttagatcaatattccagcatatccagtcggcccagtcccaaaggtccccaagtgagctgttcgcccagcacatcgttacaattgtgcaccacgttaaggaacaccatttcggcagctctggcatgaccctgcatgaacgctttactaagtacctaaaaagggggaccgagcaggaggccgcaaaaaataaaaagagccccgagatacacaggagaatcgatatctcacccagcacttttcgtaagcacggcctggcacacgatgagatgaaatctcccagggagccgggatacaaggccgagggaaaatataaggatgatccagtcgacctgcgcctggatatagagaggcggaaaaagcataaagaacgggacctgaaaagaggcaagtctagagaatccgttgactcacgcgactcatcgcactcccgggagaggtccgccgagaagactgaaaaaacacacaaaggtagtaagaagcaaaagaagcatcgcagggctcgggaccgcagtcggtctagtagctcctcaagtcaaagcagtcactcctacaaggcggaggaatacacagaggaaactgaggaaagggaagaatccaccaccggttttgataaatctcgcctgggaacaaaagactttgtgggtcctagcgagcgtgggggaggacgcgctagggggacctttcagtttcgagccaggggaaggggttggggccgaggcaactactccggcaacaacaataacaactccaacaatgattttcaaaaaaggaatagagaagaggagtgggaccccgaatatacccccaaaagcaagaagtattacctacatgacgatcgggagggcgagggttctgacaagtgggtgtctagggggcgtggtcgaggtgcattccctcggggccggggaagatttatgttcaggaaatccagcacgtctcccaaatgggcacacgataaatttagcggcgaggagggggaaatcgaagatgacgagtcgggaacggagaatagggaagagaaggataatattcagcctactacagagtag

SEQ ID NO: 20906 - DNA, 123 bp, Artificial Sequence
  Description of Artificial Sequence: Synthetic coding sequence
atgagcaagaccaacaagagcaagagcggcagccggagcagccggtcaaggtcagcctcaaggagtcgctctcgaagcttttcaaagagcagaagccgctctagaagtctaagtaggagctag

SEQ ID NO: 20907 - DNA, 1416 bp, Artificial Sequence
  Description of Artificial Sequence: Synthetic coding sequence
atggagctgagcagcaagaagaagctgcacgccctgagcctggccgaaaagatccaggtgctagagcttctcgatgaatctaagatgtcacagtcagaggtcgcccgcaggttccaagttagccagccacagatatcccggatatgtaagaataaggaaaaactgctggccgattggtgcagcggaacagccaacagggagcggaaaagaaagcgcgagtctaaatatagcgggattgacgaggcccttctatgctggtatcatatcgccagagctaaagcctgggatgtgaccggtcccatgctcctgcacaaggccaaggaattggccgatattatgggtcaggattttgtgccttctatcggttggttagttaggtggaaaaggcgaaataacgtgggtttcggcgcacgtcatgtgcttgctccatcattcccccccgagcctccccccccaggcctaacctcccaggcccagctcccccttagtctgaaggactttagtccagaggacgtgtttgggtgcgcagaattgcctctcctgtacagagctgtacccggatcttttggagcctgcgatcaggtccaggttttactttgcgccaacagccgaggcacagaaaagcgaagggtactactcgggggacttcaagcagctccccgatgtttttttgggattaggtcagaggccctccctgcttcttatcaccctgacctgggaattccctggctggagtggctcgctcagttcgatagggatatggggcagcaggggagacaggttgcactgctgttggctgcccgagtggtagaggaactggcgggactgcctggactgtaccacgtcaagctccttcccctggccgcctcttctactacccccccactcccatcttccgttgtgcgtgcctttaaggcgcactaccgtcacagactacttggtaaactggcagctattcaatcagagagggacggcacttctctggctgaggcaggggctggcatcactgtgctagacgctttacacgtcgcgtctgctgcctgggccaaggtgcctccgcagctgatttttagcagctttattcaggaaggcctggcaccaggaaagacccctccttctagtcacaaaacatctgagatgccacccgtgcccggagggctgagtctggaggaattctcaagatttgtcgacctagagggggaagagcctaggagtggtgtgtgcaaagaggagattggcactgaggatgaaaaaggtgatcgggaaggcgcgttcgaaccgctgccaacaaaggccgacgccctgcgcgccctggggacgctgcggcggtggtttgagtgtaacagcacatcaccagagctctttgaaaagttctacgattgcgaagaagaggtggagcgtctctgttgcttgtag

SEQ ID NO: 20908 - DNA, 1539 bp, Artificial Sequence
  Description of Artificial Sequence: Synthetic coding sequence
atggccgaggccagcgtggacgccagcaccctgcccgtgaccgtgaagaaaaaaaagagcctgtctattgaggagaagatcgacataatcaacgctgttgagtccggcaagaagaaggccgagatagcggccgagtatgggatcaagaaaaattctctttcaagtatcatgaaaaacaaggacaaggtcctggaggccttcgagagcctgagatttgatcctaagcggaaacggcttagaaccgctttttacaccgacctcgaggaggcactaatgaggtggtatcgcatcgctcagtgtttgaatgtccctgtgaatggtcctatgctgcggctgaaggctaatgacttcgcccagaagcttggtcataacgatttcaaatgttccaatgggtggctggaccgcttcaagtccaggtatgggctggtttttagggctcagcctgtggaggcaacaggggtgccggtcgatcctagtacggtctggtatcagaacgttctgccctactacctgaacgattaccaccctaaaaacgtgttcaacataaaagagaccggccttctgtacagaatgctccccacgaacacttttgcattcaagggagaaacttgtagcgtgggcaagctgtgcaaggacaggatcacgctcgtggttggcacaaacatggatggtagtgaaaagttgcctctgctggtcattggcaagaagcggaccccacactgctttaaaggcctgaaatctctcccagtttgctatgaggctaatagaatggcctggatgacatctgacgtgtttgagcagtggatgagaaaattagatgaagagttccaggcgcaacagcgaagagtcgtgatcttcgtggagtccttccctgctcatcctgaggtgaaaaatctcaagagtatcgaactggccttctttccatcctgtctgtcaagtaagtgcatcgctatgaaacagggcgtgataaagtccctcaaaataaagtatagacactgtttaataaagaagtttctgagttctgtggaaggaagcaaggagtttaccttttcattgctcgacgcggtcgacacgctccacttgtgctggagagccgtgaccccggagacgattgttaaatcctacgaggaagccggcttcaaatctcagaagggcgagagcgatatcacaaatgcagagaaggacacaggcttggatctggttgcagatgctctgggggcaggcgttgaatttcctgagggcctgagtatcgaggagtatgcggcactggatgatgacttagagacttgcgaagctgctcctaacggcgattccatctgtacgaaggagtctaagtctgacgaaactggattttatacaagcgacgaggaagatgacgatggctcaccaggcaccgagctgccactgccatccaagagtgaggccatcaccgcactggacaccttaaagaaattcctgcgctcacaggacatgaacgatgggttacagaatagtctagcagatctcgaaaacttcatcaactcactaagtcctaagtag

SEQ ID NO: 20909 - DNA, 1782 bp, Artificial Sequence
  Description of Artificial Sequence: Synthetic coding sequence
atggccttccggaaggcctacagcatcaaggacaagctgcaggccattgaacgggttaaaggaggtgaaagacaggcttctgtgtgccgggactttggggtccccgggggcaccttgcgcgggtggctgaaggacgagccgaagttaaggtggtttctggaacagctcggcggtgaagtgggtacccagaggaagaaaatgcgcctcgccaatgaggaggagatcgacagggccgtttacgcttggttcctggcattacgccagcatggcgtcccactttctggccctctcattcaggcccaagcagaggccttcgccagacagatttatggtcccgaatgtacgttcaaggcaagtcatggatggttctggcgctggcaaaagagacacggcattagctctcagcggttctatggcgaggccgggccacctgccccaagcccagcccccggcccccccgtaaaagaggagcctgctctcccctcaggtgctggaccacttcctgatcgcgcccctgcccccccacctccagctgagggcgggtacggtgacgaacagatctacagtgcgtcagtgaccggcctgtattggaaattgttaccagagcaggctgctcccccaggagctggagaccctggggctggtggttgcggcagacgatggcggggcgatcgtgtgaccgtgcttctggctgccaacctgactggcagtcataaactcaagcctcttgtcattgggcgcctaccggatcccccttcactgcgtcatcacaatcaggataagtttcctgcttcatatcggtattccccggatgcctggctgagccggcccctgctcagaggctggttttttgaggagtttgtacctggcgttaagcggtacctgagacgttcatgcctgcagcagaaggcggtgctgcttgtagctcatcctccatgcccgtcaccagctgcgtccatgccagccctcgacagtgaggacgcaccggtgagatgtcgtccggaacctctggggcccccggaggagctgcagacacccgatggagcagtgcgggtgctttttctgtctaagggatcctcgcgcgcacatatcccggcgccgctagagcagggagttgtggcagcattcaagcagctgtacaaacgcgagctgcttcgtctagcggtgtcatgtgcctccggctctccattggacttcatgcggtcgttcatgttgaaggatatgttgtacctggccggattgtcctgggacctggttcaggccgggtctatcgagaggtgctggctactcgggctacgggccgctttcgaaccgcgccctggcgaagactccgccggacagcccgcgcaagcggaggaggccgcagagcatagtagagtgttatcagatcttacccacctagcagccctggcttacaaatgcctggccccggaggaagtggccgaatggttacaccttgacgacgatggaggtccacctgaagggtgccgggaggaggtgggtccagctcttccccccgctgccccacctgctcctgccagcctgccgagcgcaatgggggggggtgaggacgaggaagaagctacagattacggcggtacaagcgtgcccacggcaggagaggccgttagaggtcttgaaaccgcattgaggtggcttgaaaatcaggatcccagggaggtgggaccgttgcgattagttcaactccggtccctcattagcatggcgaggaggctgggtggcatcgggcataccccagccggaccttacgacggagtatag

SEQ ID NO: 20910 - DNA, 1929 bp, Artificial Sequence
  Description of Artificial Sequence: Synthetic coding sequence
atgtaccccgccggcccccccgccggccccgtgccccggcggggcagacggcccctccccggacccccggccccagcccccgccccggtacctgcagctagaccaccccctccggcccctgggccgcgcccgcgtgtggccgtaaaaatggcttttcgcaaagcctattccattaaagacaagttacaggccatcgaaagggtaaaaggcggagaacggcaggcaagtgtgtgtcgcgatttcggtgttcctggaggtaccctgcgtggatggctgaaagatgaacctaagctgaggtggtttttggagcaactgggcggtgaagtcggaactcagagaaagaaaatgcggttggccaacgaggaggagattgatagagccgtgtacgcatggtttcttgcactccgacagcacggcgtgccactgtcaggaccgctgatccaggcccaggccgaagcgttcgctcgtcagatctacgggccggaatgcacctttaaggcctcccacggctggttttggaggtggcagaaacgacatggcatttccagccagcgtttctacggggaggccgggccgccagccccctctccagcccctgggcccccggtaaaggaggaacctgccctgccaagtggagccggtcctttgcccgaccgggccccagccccccctcctcccgccgaggggggctacggtgacgagcagatctacagcgcctcagtaactggactatattggaaactgctcccggaacaggccgctcctccaggggcaggggacccgggtgccggtggctgcggtaggaggtggcgaggcgatcgggtcacggtcctattagctgccaatctcactgggagtcataaattgaaaccactcgttataggtcggctgcctgaccctccaagcttaagacaccacaaccaggataagttcccggcgtcctacaggtattcgcctgatgcctggctgtccaggccactgctcaggggctggttcttcgaggagttcgtcccaggcgtgaagcggtatctgcgccgctcgtgtctgcaacaaaaggctgtgcttttggttgcccaccctccgtgtccctccccggcggcgtcaatgccagcgcttgactctgaggatgcccccgttcgctgtcgccccgagcccctggggccgcccgaggagcttcagaccccggacggcgccgtgcgggttctgtttcttagcaaggggtctagcagagctcatatccctgcacctcttgaacagggagtagttgcggctttcaaacagctctataagagggagctgctccggttagccgtttcgtgcgcctcgggatccccgctggattttatgcgcagtttcatgctgaaggatatgctctacttggccggcctgtcctgggacttagtgcaggctggaagcatcgagcggtgctggctcctgggtctcagggcggccttcgagccccgaccaggcgaggatagcgctgggcagcctgcccaggccgaggaggccgcggaacactctcgtgtgctgtctgaccttactcatctcgctgccctggcctacaaatgcctggccccggaggaggtagccgagtggctccatctcgatgatgacggcgggccaccagagggatgccgagaagaagtgggccccgcactcccccccgctgcgcctcccgcccccgcctcactgccatccgcaatggggggcggcgaagacgaggaagaagccactgattacggaggaacttcagttccaaccgccggcgaggctgtcagaggcctcgagactgctctgaggtggctggagaatcaggatcctcgggaggtcggcccactgaggcttgtgcagctccgttcgcttatcagtatggcaagaaggttgggaggcattggccacacccctgcggggccatatgacggggtgtag

SEQ ID NO: 20911 - DNA, 1566 bp, Artificial Sequence
  Description of Artificial Sequence: Synthetic coding sequence
atggccaacaagggcaacaagaagcggcggcagttcagcctggaggaaaaaatgaaggtggtgggcgccgttgactcaggaaaacgcaagggcgatgtggctaaagagttcgggattaccccaagcaccctgagcacattcctgaaggacaggaccaaatttgaggaaaaggtgcgcgaagcatcggtgggccctcaaaggaagaggatgcgatcagcactgtacgatgacattgacaaagcagtgttcgcttggttccaggaaatacatgctaagaatatactcgtgaccgggtctgtgattagaaaaaaggcgttaaatctggctaatatgctcggctatgacaacttccaggctagtgttgggtggctcaaccggttcagggatcgacatggcatcgccctcaaagcggtttgtagggaagactccgaccgactcatgaacgggctgggtatcgacaagatcaacgagtggcatgctggtgagatcataaaactgattgcagattacagtcctgacgatatctttaatgccgacgagactggtgtcttttttcaacttcttccccagcataccttagcagcgaaaggtgatcactgccggggcgggaaaaaggcaaagcagcggctcacagctttattctgttgcaatgcatctggcacagagaaaatgcgacctttaatcgtgggccgctccgcgagcccgcattgtctaaaaaatatacattctctgccttgcgactatcgggctaatcaatgggcctggatgactcgcgacctgttcaacgaatggctgatgcaggtcgatgctaggatgaaacgtgccgaaagaaggattttactgctgatcgataattgttcagctcataatatgctaccgcatttggaacggatacaggttggatatctaccatcaaactgcactgcggtcctccaacccctgaatctaggtatcatccacactatgaaggtgctttatcaatcgcatcttctgaagcaaatcttgctgaaactgaactcctcggaggatcaggaagaagtggacatcaaacaggccattgacatgatcgctgcagcctggtggtcagtgaaaccttctactgttgtgaagtgttggcaaaaagccggcattgtcccaatggagttcgccgaatgtgataccgagtccgccgcatccgagcctgacattgccatagagaaactctggcacaccgtggcgattgccacttgtgtacctaacgaagtgaatttccaggactttgtaaccgctgacgacgatctgattatatcacaggatacggacataatccaagatatggtggctggggagaatacatccgaagctggatcagaagacgaaggcgaggttagtctgccggagcaacccaaagtgaccattactgaggcaatctcttccgtccaaaagttgcgccaatttctcagcacatgtgtggacatcccggacgctatcttcggtcaacttaacggaatcgacgaatacctgatgaaacgagtgacacagacgctcatcgattctaagatcacagacttcctccagacaaaatag

SEQ ID NO: 20912 - DNA, 1566 bp, Artificial Sequence
  Description of Artificial Sequence: Synthetic coding sequence
atggccaacaagggcaacaagaagcggcggcagttcagcctggaggagaagatgaaggtggtgggcgcggtggatagcggcaagcgcaagggggatgtggccaaggagttcggcatcaccccttccacattgtccacctttctgaaggatcggactaaatttgaggaaaaagtgagagaagccagcgtcggccctcaacggaagagaatgagaagtgctctgtacgatgacatagacaaggccgtgtttgcatggtttcaggagatccacgcaaaaaacattctggtgacgggtagcgtgatacgaaaaaaagcgttgaatcttgctaacatgttgggctacgataacttccaggcgtcagtggggtggctgaatcggttccgcgatagacatgggattgccctcaaagcagtctgtagagaggatagcgacaggctcatgaacggacttggaatcgacaaaatcaatgaatggcatgctggcgagatcattaagttgatagcggattactcgcctgatgatatttttaacgcagatgagacaggagtgtttttccagctgctgccgcaacacactctggctgcaaaaggggatcactgtcggggcggcaagaaagccaaacagcgactgaccgccctgttctgttgtaacgcaagcggtactgaaaaaatgcggccgttaatcgtgggtcgttcagcaagtccgcattgtctgaagaatattcactcactgccatgtgactatagagccaatcagtgggcgtggatgacacgcgatctgttcaacgagtggttaatgcaggtggacgcccgtatgaaacgagcagaacggcgcatcctgttgctgatcgacaactgtagcgcccacaatatgctacctcaccttgagcgcatccaggtgggctacctgcccagtaactgtaccgctgttttacaacccctgaacttgggaatcattcataccatgaaagtgctgtatcagagccacttactcaaacagatcttactaaaactcaattctagcgaagaccaagaagaagtggacattaaacaggccattgacatgatagcagctgcctggtggagcgtgaagccttcaacagtggttaagtgttggcagaaggcggggatcgtaccaatggagttcgcagaatgcgacaccgagtccgcggcctcagagcctgacatagccatcgaaaagctgtggcataccgtcgctattgcgacatgtgtcccaaacgaagtgaacttccaggatttcgtcaccgcagatgacgatctgatcattagccaggacaccgatatcatacaggacatggtggcaggcgaaaatacctcagaagccggcagtgaggatgagggtgaggtgtccctcccagaacaaccaaaagtcactatcacggaagccatttcaagtgtgcagaaactgcgccagtttctgtccacatgtgtggacatacctgacgcaatttttggccagttgaacggaatcgacgagtacctcatgaagagagtaacacagactcttatcgattctaaaattacagactttttgcagacaaaatag

SEQ ID NO: 20913 - DNA, 684 bp, Artificial Sequence
  Description of Artificial Sequence: Synthetic coding sequence
atgcccggctgccggatcagcgcctgcggccccggcgcccaggagggcacagctgaacagcgaagtcctcccccaccctgggatccaatgcctagctcccagccccctcctcctaccccgactctaaccccaaccccgacccccgggcagtctcctcccttgcctgacgctgcaggcgcgtccgctggggcggcagaggaccaggagttgcagagatggcgacagggtgccagcggtattgccggcctggcggggccagggggaggcagcggcgccgccgcaggtgctggcggtcgcgccctcgagttagcagaggctcggaggaggctcctggaagtggaggggaggcggcgcctcgtgtccgagctggaatcgagggttcttcagttacatcgggtgttcctggccgccgaactcaggttggcccatcgagccgagtctctcagtaggcttagcggcggcgttgcacaagctgagttatacctcgctgcccatggttccagactaaagaagggcccccggaggggcaggagaggcaggcctcctgctttgttggcatcagccttggggctcggcggttgcgtaccatggggagctggtcgcctccgacgggggcatgggccggagcccgacagtccattcagacgttcacctcccagaggacctgcctccccccagcgttag

SEQ ID NO: 20914 - DNA, 153 bp, Artificial Sequence
  Description of Artificial Sequence: Synthetic coding sequence
tgaggccggccccccgccctgctggccagcgccctgggcctgggcggttgtgttccatggggcgccggtcgcctgcgtcgtggtcatgggccagagcctgatagtccctttcgacgctcaccaccgcgcgggcctgcctccccacagaggtag

SEQ ID NO: 20915 - DNA, 375 bp, Artificial Sequence
  Description of Artificial Sequence: Synthetic coding sequence
tacctgctgctggagtactgcgagggcaacgacctggacttctacttaaaacagcacaagcttatgagcgaaaaggaggccagatcgatcgtcatgcagattgtgaacgctcttaggtacctgaacgaaataaaacctccgattattcactatgatcttaaaccagggaacatcctgctcgtggacggcaccgcttgtggcgagatcaagatcaccgacttcgggctttcgaaaatcatggacgatgattcatatggagtggacggcatggatctgacctcccagggcgccggaacttattggtaccttccccctgagtgtttcgtggtgggaaaggagccacctaagatctctaacaaagtcgatgtgtggtag

SEQ ID NO: 20916 - DNA, 1242 bp, Artificial Sequence
  Description of Artificial Sequence: Synthetic coding sequence
atgagcgtgcagagcagcagcggcagcctggagggcccccccagctggtcacagttgagtacctcccccacccccggatccgccgctgcagccagaagtctgctgaatcatactccaccttcaggcaggccgagagaaggggcaatggacgagctccattctcttgatcctagacgccaggaactccttgaagctcgattcacaggtgtcgcaagcggaagcactgggagtacaggatcttgctctgtcggtgctaaagcttccactaataacgagtcctcaaaccatagtttcggatcactgggctccctgagcgataaggagtccgagactcccgagaagaaacagtccgagagttcccgaggtcgcaagagaaaagctgagaaccaaaatgaatcctctcaagggaaaagtatcggaggccgcggacataaaatctccgactattttgaatatcagggcgggaacgggagcagccctgtgagggggattccccccgctattagatcaccacagaactcccattcacactccacgccctcttccagcgtgaggcctaactcaccttcccccactgcactggccttcggtgaccaccccatcgtgcagcctaagcaattgagtttcaaaatcatacaaaccgacctaacgatgctgaaactggctgcactggagtcaaacaaaattcaagacctcgagaagaaagagggccggatagacgacctactgcgcgctaattgcgatctcaggagacagatcgatgaacagcaaaaactgctggaaaaatacaaagaaagactcaataaatgtatctccatgagtaagaagctgttaatagagaagtccacacaggaaaaactgagttctcgggaaaagtcaatgcaagaccgcctgcgactcggacacttcacaactgtgcggcatggtgccagcttcaccgaacagtggacagatggcttcgcctttcagaacttagtgaagcaacaagagtgggtgaatcagcagcgcgaggacatcgagaggcagcgcaagctgctcgctaaacgcaagccacctacggcaaataactctcaggctccaagtacaaactctgagcccaagcaacgaaagaacaaggctgtgaatggcgcagagaatgatcctttcgtgcggccgaatttaccccagctcttgaccctcgccgagtatcacgagcaggaggagattttcaagctccgcctggggcacctcaaaaaaagatag

SEQ ID NO: 20917 - DNA, 2301 bp, Artificial Sequence
  Description of Artificial Sequence: Synthetic coding sequence
atgagcgtgcagagcagcagcggcagcctggagggcccccccagctggtctcagctctccacatctccaacacctggaagcgcggcggcagcacgaagcctattgaaccacacccctccttcaggtaggccccgggagggggccatggacgaactgcattcactggatccaaggagacaggagctccttgaggctcgcttcactggcgtagcctccgggtcaacgggttccacaggctcatgcagcgtgggcgcgaaagctagcacaaacaacgagagttcaaaccactctttcggtagcctgggatccttgtccgacaaagagtcggaaactcctgaaaaaaagcagagtgaaagctctagaggtcgtaaacgcaaggccgagaatcagaatgaatcttcccagggcaaaagcattggcggacgcggacacaaaataagcgattactttgagtaccagggagggaacggtagcagccccgtcagggggatcccacctgcgatcaggagccctcagaattctcattcccacagtacgccgtcctcctccgtgaggcccaattcaccctctcccaccgccttggccttcggggaccacccaatcgtgcaacccaaacagctcagttttaagatcatccagacagacctgaccatgttgaaactggccgcccttgaatctaacaaaattcaggacctggagaaaaaagagggtcgcatagacgatttgctaagggctaactgcgaccttcgacgccaaattgatgagcagcagaaactcctagaaaaatataaagagcgtcttaataagtgtatttctatgtccaagaagctgctcattgaaaaaagcacccaggagaagctatcatcgagagaaaagtccatgcaggaccggttgcgactcggacacttcaccactgtgagacatggagccagtttcaccgaacaatggacagacggatttgcattccagaacctcgtgaagcagcaggagtgggttaaccagcaacgggaagatattgagcgacaaagaaaacttctcgccaaaagaaagcctccaacagcaaacaattcacaagcaccaagtactaacagcgaacccaaacagagaaaaaataaggctgtgaatggcgccgagaatgacccctttgtcagacccaatctgccccagctgctgactctggctgagtatcacgagcaggaggaaattttcaagttgcggctaggacatttgaagaaggaagaggctgaaattcaggccgaacttgagaggctggaaagggtgaggaacctacacattcgcgaactcaaaagaattaacaacgaagacaattcccagttcaaagatcaccctactttgaatgagaggtacctgctccttcacctactcggccgtggagggttctccgaggtgtataaggcattcgacctttatgagcagcggtacgccgcagtcaaaatccaccagctcaacaaaagctggagggacgagaagaaggagaattatcataagcatgcatgcagggaatacaggatccacaaggaattggatcacccaagaattgtcaaactgtatgattattttagtctggatacagacacattttgtaccgtgctggagtactgcgagggcaacgaccttgacttttacttaaaacagcacaaactgatgtctgaaaaagaagcccgatctattgtgatgcagatcgttaatgcgctcagatacttgaacgaaataaagccccctatcatccactacgacttgaagccaggcaatatactccttgtcgatggcactgcatgcggcgagattaagattactgacttcggcctgtcgaagataatggacgatgactcttacggcgtggacggcatggacctcaccagccagggcgcaggaacatattggtatctcccccccgaatgttttgtggtggggaaggaaccccccaaaatcagtaacaaggtggacgtttggtcggtcggagtcatctttttccagtgtctctatgggcgaaagccttttggtcacaaccagagccagcaggacatcctccaagaaaacacgattcttaaggccacggaggttcaattccccgtaaaacccgtggtctcctcagaggccaaggcctttattaggcgctgtctggcttacagaaaagaagaccgatttgatgtgcatcagctcgccaacgacccctatttgctgcctcatatgcggcgttctaactcctcaggtaatttacacatggctggcctgaccgcgtcgcctacccctccaagtagcagcattattacatactag

SEQ ID NO: 20918 - DNA, 2013 bp, Artificial Sequence
  Description of Artificial Sequence: Synthetic coding sequence
atggccgtgctgttcctgtacgacctgaagaccaccggcaagaccccagagaagaaacaatctgaatcctccaggggcagaaagcgaaaggctgagaatcagaacgagtcgtcccagggcaaaagtattgggggccggggccataaaatttcggactacttcgaataccaaggtggtaacggatcaagtcccgttcgcggaataccacccgcaattcgtagccctcagaactcgcacagccactctacccctagttccagtgtgcgaccgaattctcctagtcccaccgcactggccttcggcgatcatcccattgtgcagccgaaacaattgagttttaagatcattcagacagatcttactatgcttaagcttgccgccttggagtccaacaagatccaagaccttgaaaaaaaggaaggacgtatcgacgacttgcttagggctaactgcgatctgcgcaggcagatagacgaacaacaaaagctcttggagaagtacaaggaaagactgaataagtgcatctctatgtctaagaagctacttatcgagaagagtacgcaggagaaactctctagccgtgagaagagcatgcaggaccgccttaggctcggccactttaccactgtacgacacggcgcctcttttactgaacagtggaccgacggcttcgccttccagaacctggtgaagcagcaggagtgggtgaatcagcagagggaggatattgagagacagcgaaagctgttggctaagcgaaaaccaccaactgccaataactctcaggctccgagcaccaattctgaaccaaagcagagaaagaataaagccgtgaacggtgccgaaaacgacccatttgtgcggcccaatttgcctcagctgctgactctcgcagagtaccacgagcaagaggaaatctttaagttgaggctagggcacctcaaaaaggaagaggcagagatacaagccgagctcgagcgtctggaacgtgtgcgcaacctgcacattcgtgagttgaaacgcataaacaacgaagataactcccagttcaaggaccatcccaccctcaatgaaaggtacctcctgcttcatctgctcggtcgtgggggcttcagcgaggtgtataaggctttcgacctttacgaacagcggtacgcggccgttaagattcaccagttaaataagagctggagagacgagaaaaaagagaattatcacaagcatgcttgtagggaatatcgcattcataaggaattagaccatcctcggatagtcaaactctatgactacttcagcctggatactgacaccttctgtaccgtactggagtactgcgaagggaatgatcttgacttctatctgaaacaacataagctcatgtctgaaaaagaagcccggtcaatcgtcatgcagatcgtgaatgcgctgcgatatttaaacgagattaaaccacccattatccactatgacctcaagcctggtaacattctgctcgttgacggtacagcttgcggcgaaatcaagataactgattttggactatctaaaatcatggatgacgactcatacggggtggacgggatggaccttacttctcagggagccggtacatactggtatctgcctccagagtgtttcgtggtcggcaaagagccacctaagatttcaaacaaggtggatgtttggtctgtaggagtcatcttcttccagtgcctgtacggccgaaaacccttcggtcacaaccagtcacagcaggatatcctgcaggaaaacacaattctcaaagccacagaagtacagttccccgtgaagcccgtcgtaagcagtgaggcaaaggcctttatccgcaggtgcctcgcttacaggaaggaagacaggttcgatgttcaccagctggcaaacgacccttacctgctgccgcatatgaggcggtctaacagctccggaaatctccacatggccggcctgacagccagtcctacccctcccagtagtagcattataacttattag

SEQ ID NO: 20919 - DNA, 2157 bp, Artificial Sequence
  Description of Artificial Sequence: Synthetic coding sequence
atggacgagctgcacagcctggacccccggcggcaggagctgctggaagcacggttcacaggcgtggcttctggcagcacgggttccaccggctcctgtagcgtgggtgcaaaagcctctactaacaatgaatccagcaaccattcttttggaagcctcggcagcttgtctgacaaggaatctgagactcccgagaagaagcagtctgaaagctcacggggacggaagagaaaagccgaaaaccagaacgaaagcagccagggcaaatctattggaggccgcggacataaaatctcagattacttcgagtatcaaggtggcaatggcagctctccggtccggggaatacctccggccatcaggagccctcagaactcccactcacactccacccccagctcctcggtgagaccaaattccccctctccaacagcattggccttcggtgaccaccctattgtgcagcccaagcagttaagttttaagattatccagacagacctgactatgctgaagctagcagccctcgaatccaacaagattcaggatctcgagaaaaaggaagggcggattgatgatctgcttcgtgccaattgtgacctgcgcaggcaaatagatgaacaacagaagctgctggagaagtataaggagcgactaaataagtgcatttccatgtccaaaaagctactgattgaaaaaagcacccaagagaaactttcctcgagggagaagtcgatgcaggatcgcctccgccttggacacttcaccacggtcagacacggcgcttcctttacggagcaatggactgacgggttcgccttccagaatctggtgaaacagcaagagtgggttaatcagcaaagagaggacattgaacggcagagaaaactgctggctaaaagaaagccaccaacagccaataactcccaggcccctagcacaaatagtgagcccaagcagagaaaaaataaagccgtgaacggggctgaaaatgatccatttgtgcgccccaatctcccccaactcctgacattggcagaataccacgaacaagaagagatctttaagctgcggctgggacacctgaaaaaggaggaggcagagatccaggccgagctggaaaggctggaaagggttcgcaatttgcacattcgcgagctgaagcgcatcaacaacgaggataactcacagttcaaagaccacccaaccctgaacgagcgctacctgctactgcacttacttggcagagggggcttttcggaggtgtacaaggcattcgatctgtacgaacagaggtacgcagccgtgaagatccatcagttaaacaagtcctggcgggatgagaaaaaagagaactaccataaacacgcctgccgagagtaccgcattcacaaggaactcgaccacccacgcattgtcaagctctatgattattttagcctggacaccgatacgttctgcactgtgctggagtattgcgagggtaacgacctggatttttatcttaagcagcataagcttatgtcagagaaggaggctagaagtatcgttatgcaaattgtgaacgcactcagatatttgaatgaaatcaaaccgcccataatccactacgatttgaagccgggaaatatcctactggtcgacgggactgcatgcggcgagatcaaaattacggattttggactgagtaaaatcatggacgatgactcttatggcgtagatggaatggaccttacctcacagggcgccggtacatactggtacctcccgcccgagtgcttcgtggttggaaaggaaccccccaaaattagcaataaggtcgacgtgtggtccgtaggcgttatctttttccagtgtctatacggacggaaacctttcggccacaatcaaagtcagcaagatattctgcaagaaaatacaatcctaaaggctacagaagtgcagttccctgtgaagcccgtggtgtcctctgaggcgaaggcgttcatcaggaggtgcctggcatatcggaaggaggatcggtttgatgttcaccagctggccaatgatccttacttgcttccgcacatgcgccgaagcaactcgtccggtaatttgcatatggctggcttgaccgctagccccacccccccgagttcatctatcataacatactag

SEQ ID NO: 20920 - DNA, 2157 bp, Artificial Sequence
  Description of Artificial Sequence: Synthetic coding sequence
atggacgagctgcacagcctggacccccggcggcaggagctgctggaggcccggtttacgggtgtggcctcggggtccacagggagtactggatcctgctcagtgggtgcaaaagcttccactaacaacgaaagcagtaatcacagcttcggctcactgggtagtctgagcgacaaggagagtgaaactcctgagaagaagcagtccgagtctagccggggaaggaaaaggaaggcggagaaccagaatgagagcagccagggaaagagtattggaggccggggccacaagatttccgactattttgaataccaaggaggcaatggtagtagcccagtaagaggaattccccctgccatccgctcacctcaaaattcacacagccatagtaccccttcatcttccgtgagacctaattctccgtcacccactgctctcgcgttcggggaccatccgatcgttcagcctaagcaattgtcatttaaaataatccagactgacctgaccatgctcaagttggctgccctcgaatcgaacaagatccaggatctagagaaaaaggagggacggatagatgacctactgcgggctaactgcgatctgcgacggcagatagatgaacagcaaaagctgctcgaaaagtacaaggaacgattgaacaagtgtattagtatgtcaaagaaattattgattgaaaagtctacccaggaaaaactcagctctagggaaaaaagcatgcaagaccgtctgagactgggacactttacgacagtccggcacggggcatcctttactgagcagtggacagatggctttgcttttcagaatctggtcaaacagcaagaatgggtaaatcaacaacgtgaagacatcgagcgtcagaggaaactgttagccaagcggaagccaccaactgccaataacagccaggcccctagcactaactctgagccgaagcagcgaaaaaataaggccgtgaatggggcggagaatgacccctttgtaagacccaacctgccgcagcttttgaccctggctgagtaccacgagcaggaagaaattttcaaactgcgcctcggccacctgaagaaggaagaggccgaaatccaggccgaactcgagcgcctcgagagagtgcgaaacctccacattcgagagttgaaacggatcaataatgaagataacagccagtttaaagatcaccctacactgaacgaaagatacctgctgctccacctcctggggaggggcgggtttagcgaagtctacaaggcctttgatttgtacgagcagcgttacgccgccgtgaagattcaccaattgaacaaaagctggcgagatgagaaaaaggagaactaccataaacacgcttgccgcgagtaccgtattcacaaggagctcgaccatcctaggatcgtgaaactctacgactacttttccttggacactgacacattctgtacagtcctggagtactgcgaaggcaatgacctcgatttttacctgaagcagcataagctgatgtctgagaaagaagccagatctatcgttatgcaaatcgtcaacgccctcaggtatctgaacgagatcaagccaccaatcattcactacgatctgaagccaggcaacatcctgctggtggatgggactgcctgtggggagataaagattacagacttcggcctatctaagattatggatgatgattcttacggcgtcgacgggatggatcttacttctcaaggagctggcacctactggtatttacctcctgaatgcttcgttgtcgggaaggagcctcctaagatctctaacaaagtggacgtatggtccgtgggggtgatattctttcagtgcctttatggccgcaaacctttcggacacaaccagtcccagcaggatatcttgcaggagaataccattctcaaggcaaccgaggtccaattcccggtgaagccagtggtgagctctgaggctaaagcattcatcagacggtgccttgcgtaccgcaaggaagatagatttgatgttcaccagctggctaacgacccctatttgttgccccatatgcgccgcagcaatagttctggaaatctccacatggccggcctgaccgccagccctaccccaccctcctcatcaatcatcacctactag

SEQ ID NO: 20921 - DNA, 2319 bp, Artificial Sequence
  Description of Artificial Sequence: Synthetic coding sequence
atgatggaggagctgcacagcctggacccccggcggcaggagctgcttgaggcacgcttcacaggcgttggcgtttccaaaggccctctcaattcagagtctagtaaccaatccttgtgtagtgtgggatccctgtctgacaaagaggtggaaacacccgagaagaagcaaaacgaccagaggaatcgaaagaggaaggccgagccttacgaaacaagccaggggaaaggcaccccacgggggcacaaaatttcagattactttgagttcgcaggaggctcagctccgggaactagccccggtcgtagcgtgccacctgttgctcgaagctctccacagcattctctgtccaatcctttgccaaggagagttgagcagcctctctacggcctggacggcagtgcggctaaggaggcaaccgaggagcagtcagctctgcctacactcatgagtgtgatgctagcaaaaccacggctggacaccgagcagctcgcacagcgcggcgcaggcctatgctttactttcgtctctgctcagcagaactcgccgtcctctactggatctggtaacactgaacactcctgcagcagccaaaagcagatcagtatacagcaccgccaaacccagtcagatttgacgatcgagaagatatctgctcttgagaatagcaaaaactctgacctcgaaaagaaggagggaaggatcgatgatttgttacgtgctaattgcgacctgaggagacagatagatgagcagcagaaaatgttggagaaatacaaggagaggcttaatcgatgcgtgaccatgagcaagaaactcttaattgaaaagagtaagcaggagaagatggcctgcagagataagagcatgcaggacaggttacgcctgggacactttaccactgtgcggcacggcgcttcattcactgagcagtggactgacgggtacgcctttcagaacctcattaagcagcaggaacgcatcaattcccaaagggaggagattgagcgccaacggaaaatgttggctaaaagaaagcctcctgctatgggacaagcaccacctgctaccaacgaacaaaaacagcgaaagagcaagactaacggggctgagaatgagacaccgtccagtggtaatacggagttaaaggacaccgcgcctgccctcggcgcacacagtctcctccggctcacactagcagaataccatgaacaggaggagatctttaaactgcgtctgggacacctgaaaaaggaagaggctgagattcaggccgagctggagagacttgagcgcgtacgtaacttacatatcagagagctgaaacgtattcacaacgaagataactctcagtttaaggatcacccaacactgaacgatcgatatcttcttcttcacttactgggaaggggagggttttccgaggtctataaagcctttgatcttactgaacagaggtacgtagctgtgaagattcaccagctaaacaaaaattggcgggacgagaagaaggaaaactaccacaaacatgcatgtagggagtacaggattcacaaggaactcgaccatccaaggatcgtcaaactgtatgattatttctcactggatacggacagcttttgcaccgtgctggaatattgcgagggcaatgacctcgatttctacctgaagcagcacaagctcatgtcagaaaaggaggcacggtctattatcatgcaaatcgtcaatgcattaaagtatctgaatgaaatcaaacccccaataatccactatgacctaaaaccggggaacattttgctcgtgaacgggacagcgtgcggggagatcaaaattacagactttggactttccaaaattatggacgatgatagttataactcagtggatgggatggagttaacctcgcagggagctggtacttattggtacctgcccccagagtgtttcgtggtgggcaaggagccacctaagatcagcaataaggtggacgtctggtccgtgggtgtgatcttttatcagtgtctctatggccgcaagccttttggacataaccaatcccaacaagacatacttcaagagaacacaattttgaaggctaccgaggttcaatttccgccgaagcctgtagtgacccccgaggctaaggcctttattaggcggtgcctggcttaccggaaagaggacagaatcgatgtgcagcaattagcttgtgacccatacctgctgccgcacattaggaagagcgtgagcacatcatccccagccggagcggctatcgcctcaacatcaggcgcgtccaacaattcaagttctaattag

SEQ ID NO: 20922 - DNA, 2157 bp, Artificial Sequence
  Description of Artificial Sequence: Synthetic coding sequence
atgatggaggagctgcacagcctggacccccggcggcaggagctgcttgaagccagatttaccggggttggggtatcaaagggacctctgaatagcgaaagtagtaaccagagcctgtgttccgtcggaagcctcagtgataaagaggtggagaccccggagaagaagcagaatgaccaacggaaccgaaaacgtaaggccgagccctatgagacctcgcaggggaaggggaccccgcggggtcataaaataagtgattacttcgagcggcgggtggagcagccactatacggactcgacggctccgcagctaaggaagcaacagaagagcaaagcgccctgccaaccttgatgagtgtcatgctggccaagccccgcttggacacagagcagttggctcagcggggtgccggactttgtttcaccttcgtgtccgcacagcagaactcaccctcatcaaccggcagcggtaacaccgagcactcctgttcaagtcagaaacagatcagcatccaacacagacagacacaatctgatttaacgatcgagaagatttccgcccttgagaatagtaaaaatagtgaccttgaaaagaaggaggggagaattgatgacctgctgcgggccaactgtgacttgcggaggcagattgacgaacagcagaagatgctggagaagtataaagaaaggctcaacagatgcgtcacgatgtctaaaaagctcctgattgagaagagcaaacaggagaaaatggcttgtcgtgataagagcatgcaggacagattaaggctgggccattttactactgtacgacacggagcgtcattcaccgaacagtggacggacggatacgcattccaaaacttaattaaacagcaagagcggattaattcacaacgcgaggagatagaacggcagaggaagatgctagccaagcgcaagccccctgccatgggccaggcccccccggctacaaacgagcaaaaacagagaaagtccaaaactaacggggctgaaaacgagactttgacattagctgagtatcacgaacaggaagaaattttcaaattacggttggggcatctgaaaaaagaagaggctgagatccaggcggagcttgaacgcctggaacgcgtcagaaacctgcatatccgcgagttaaaaagaatccataatgaggacaattcccaattcaaggatcaccccaccctgaacgacaggtatctgctgctacatcttttgggccggggggggttctctgaggtttacaaggcctttgatctgaccgagcagagatacgtggccgttaagatccatcagctgaacaaaaactggcgcgacgagaaaaaggaaaattatcataagcatgcctgccgagaatacaggattcacaaagaattggaccaccctcgaatcgtgaaactctatgattacttttcgctggataccgactctttctgtaccgtgctggagtactgcgaaggtaatgaccttgacttttacttaaagcaacataaactcatgtcagagaaagaagcgagaagcattatcatgcaaatagtgaatgcccttaaatacctgaatgagatcaaacctccaatcatacactacgacttgaaaccgggaaacattttgctggttaacggaacagcctgtggagaaatcaagataaccgactttggcctctcaaagataatggacgacgactcttataattctgtggacggcatggagctgactagccagggggcagggacctattggtatcttccacccgaatgcttcgtcgttggaaaggaaccccccaagatctctaacaaggtggacgtttggtctgtcggcgttatcttttaccagtgtctctacggcagaaagccttttggccacaatcagtcacagcaggacatcttgcaagagaatacaatcctgaaagctactgaggttcaatttccccctaagcctgttgtgacacccgaagccaaagcctttattcgccgatgtttggcttatcggaaggaagacaggattgacgtgcaacagctcgcctgtgatccttacctgctaccgcacatccgcaaaagtgtcagcactagctcaccggctggggctgctatcgctagcacctccggtgcgagtaataactcatcatccaactag

SEQ ID NO: 20923 - DNA, 2253 bp, Artificial Sequence
  Description of Artificial Sequence: Synthetic coding sequence
atgatggaggagctgcacagcctggacccccggcggcaggagctgctcgaagctcgctttactggtgtgggagtcagtaaggggcccctgaactccgagtcctcaaatcagtccctgtgctcagtcggctctctgtccgacaaggaggtagaaacccccgagaagaagcagaatgatcaacggaatcgcaaacgaaaagccgagccatacgagactagccaaggaaaaggtactccaagaggccacaaaatttctgactattttgagtttgcaggtggctcagctcctggaacctcaccaggccggtccgtccccccagtggccagaagcagcccacagcacagtctatccaatcctctgccaagaagagtggagcagccactgtatggactggatggcagcgctgctaaggaagccacagaagagcagtccgccttacctaccctgatgagcgtaatgctggctaaaccaagactcgacacagaacaactggcgcagcggggggccggcctttgtttcacatttgtctcagcgcagcagaactccccatcctccactgggtctggaaacaccgaacacagttgcagctctcagaagcagatcagtattcagcacaggcagactcagagcgatctgaccattgagaagatttccgctcttgagaatagtaaaaactccgacttggagaagaaggagggccgcattgacgatttgttgagggcgaattgtgacttacgtagacagattgacgagcagcagaaaatgctggagaaatataaagagaggctgaaccggtgtgtgactatgtccaagaagctccttattgaaaagagtaaacaggagaagatggcctgtagagacaaatctatgcaggatagactcagactcggccacttcacaacagtgaggcacggagcaagttttacggaacagtggacagacggatatgctttccagaacttaattaagcagcaggaacgaatcaacagtcagcgggaagagatagagcgtcaacggaagatgctagccaagcggaagcctcctgctatgggacaggctcctcctgccacgaacgagcagaaacagaggaagtccaagaccaacggagccgaaaatgagactttgacactggccgaataccatgaacaggaagaaatctttaagttacgccttggccacctgaaaaaagaggaagccgagatccaagcagagttagaacggctggaaagagtcagaaatctccacatccgtgagctcaaacggattcacaacgaagataactcccaatttaaggatcacccaacactgaacgatcgctacctactcttgcacctgctgggccggggaggcttcagcgaggtgtataaggcatttgacctgacagagcagagatatgtggctgtgaagatccatcagctcaacaaaaactggagggacgagaagaaagagaattaccacaaacacgcctgtcgggagtaccgcattcacaaagagctggaccaccccagaatagtaaaactctacgactatttttcactggacacggatagcttttgcactgtcctggagtactgcgaaggcaacgacctagatttctacttgaaacaacacaagctgatgtccgagaaagaggcccgctcaattattatgcagattgtgaatgctcttaagtacctgaatgagattaagccaccaattattcactatgatctgaagcccgggaacattttgctcgtgaatggaacggcctgtggagagattaagattacggactttggattgtccaaaataatggatgacgatagctacaatagcgtggatggaatggagcttaccagccagggggccggaacatactggtacctgccaccggagtgctttgttgtgggtaaggagcccccaaaaatatcaaacaaagtggatgtgtggtccgtgggcgtgatcttctaccagtgcctctatgggcgtaagccattcgggcataatcaatcacagcaggacattctccaggaaaataccatcttgaaggctacagaagtccaattcccaccaaagccggtggtaactccagaggccaaagcttttatcaggcgttgccttgcctacaggaaggaggatcggatcgatgtccaacagcttgcgtgcgatccgtacctgctgccacacattcgtaagtctgtatctacttcatccccagcgggggccgccattgctagcacgtcgggtgcttccaacaattcttcttccaattag

SEQ ID NO: 20924 - DNA, 2157 bp, Artificial Sequence
  Description of Artificial Sequence: Synthetic coding sequence
atgatggaggagctgcacagcctggacccccggcggcaggagctgcttgaggctaggttcacaggggtcggcgtctctaaaggacctctgaactcagagtctagcaaccagtccctctgctctgtcggcagccttagtgataaagaggttgagacccctgaaaaaaagcaaaacgaccagcggaatcggaaaaggaaagcggagccatacgagacttcacaggggaaaggtacacccaggggtcataagatctccgactactttgagcgccgggttgagcaaccactgtatggcctggatgggtcagctgcaaaagaggccaccgaagaacaatccgccttgcctaccctgatgtcagtgatgctcgcgaagcctagactcgacaccgaacagcttgctcagagaggggccggcctttgcttcacttttgtgagtgcccaacagaacagtccatcttctaccggcagcggtaataccgagcactcttgctctagccagaagcaaatctctatacagcatagacaaacccagtcagatctcacaatcgagaagatcagcgctctagaaaactccaaaaactccgatcttgaaaaaaaagaaggaaggatagatgatctgctgcgtgccaactgtgatcttcgaagacagattgatgaacagcaaaaaatgcttgagaagtacaaagaacggctcaaccggtgtgttaccatgtctaaaaaactgctgatagaaaaatctaaacaggagaaaatggcttgcagggataaatccatgcaagacagactgagattggggcacttcacgaccgtacggcacggcgcttcattcactgaacagtggaccgacggttacgcatttcaaaatctgattaagcaacaggagcgtatcaactcgcagcgggaggagattgagagacagaggaaaatgctggcgaaacggaaaccgcctgccatgggtcaggcaccaccagcaacaaatgaacagaaacagagaaaaagcaagaccaatggtgccgagaacgagacactgacactggcggagtaccatgaacaggaagagatcttcaaacttcgtctcggacacctcaagaaggaagaggctgagatacaggctgagctggagcgcctcgagagggtccgtaatctgcatattcgagagctcaaaagaatccacaatgaggataactcccagtttaaggatcaccctacactcaacgatcgatacctcctgcttcacttgcttggtaggggtggtttctcagaagtgtacaaggctttcgatctgacagagcagcgctacgtcgctgtgaaaattcatcagctgaataagaactggcgtgacgaaaagaaagagaactaccataaacacgcttgtagagagtaccggattcataaagaactagatcatccacggattgtgaaactgtatgactattttagcctagacactgatagcttttgcacggtgctggaatattgcgagggtaatgacttagacttttacctgaagcagcataaactaatgtctgagaaggaggccaggtcaatcatcatgcagatagtgaatgccctgaagtacctgaacgagataaagccacctatcattcattacgatttgaaacctggtaatattctgttggtgaatgggactgcttgcggagagattaaaataaccgacttcggcctgtcaaaaataatggacgatgattcttataattctgtagacggtatggaactgacatctcagggggccggtacatattggtacctccctcccgaatgctttgtggttggaaaagaaccacctaagattagcaacaaggtagacgtctggtccgtgggtgtgatcttctaccagtgtctatacggaaggaaaccattcggccataaccagtcccagcaggacatcctgcaggagaacacaattcttaaggcgactgaagtgcaattcccaccaaaacctgtggtgacccctgaagcaaaagccttcattaggagatgcttagcataccgaaaagaagacagaatagatgtgcagcagctcgcatgcgacccctatctgcttcctcatatcagaaaatcggtatccacctcatccccagcgggggctgccatagccagtaccagcggtgcttcgaataactcctcctctaattag

SEQ ID NO: 20925 - DNA, 1521 bp, Artificial Sequence
  Description of Artificial Sequence: Synthetic coding sequence
atggacgtgcggctgtaccccagcgcccccgccgtgggcgcccggcccggagcagaaccagcggggctggcacacctagactactaccatgggggaaagtttgacggggactccgcgtacgtgggcatgagtgacggcaacccggagctcttgtcaacttcccagacatataacggtcaatcggagaacaacgaggactatgaaatcccacccatcacaccaccgaatttaccagagccttctctgttgcacttgggagaccacgaggcttcataccacagtttgtgccacggccttacgccaaatgggctgttgcccgcttactcctatcaggccatggacttacccgcaatcatggtcagtaatatgcttgcccaggatagccaccttctgagtggacagttgcctaccattcaggagatggttcactcagaggtggccgcttatgatagcggacgcccggggcccttattgggtagacccgcaatgctcgctagccatatgtcagcactctctcaatctcagttgatcagccagatggggatccggtcttccatcgcacattcatctccgtcccctccaggcagtaaatccgccacaccttctccctccagcagcactcaggaagaagaatcagaggtgcactttaaaatctctggagaaaaaaggcccagtgccgatcccggtaaaaaggctaagaatcctaagaagaagaagaagaaggatccgaatgaaccacagaagcctgtaagtgcatatgcgctgtttttccgcgatacgcaggccgctattaaggggcaaaatccatccgccacttttggtgacgttagcaagatagtagcttccatgtgggacagcttgggtgaggagcaaaaacaggcctataagcggaaaacggaagccgcaaagaaggagtatctgaaggccctagccgcctaccgcgcctccctggtgtccaagtctagccctgatcaaggtgaaacgaaatccacgcaggctaaccccccagctaagatgctgccacccaaacagcctatgtatgctatgcccgggctggcctcttttttgaccccctcagatttgcaggcgtttagatccggcgcgtcaccagcaagcctggcacgaactctcggtagcaaatccctactacccggattatccgcctctccacctccccccccgtccttccccctgagtcctaccctccaccagcagctgtcgcttccgccgcacgcacagggggcgctgttatcacctccagtaagcatgagcccagcaccccagccccccgtgctgcctactcctatggcactccaagtacagcttgccatgtcaccctcaccgccagggccacaggactttccgcatatcagtgagttcccatcctctagcggatcatgctcccccgggcccagtaatcccacatcatcaggtgattgggactcttcttatccctctggggagtgcgggatcagcacttgcagcctcttgcccagggacaaaagcctctacctaacttag

SEQ ID NO: 20926 - DNA, 1467 bp, Artificial Sequence
  Description of Artificial Sequence: Synthetic coding sequence
atgcagcagacccggaccgaggccgtggccggcgccttcagccggtgcttgggattctgtggcatgagactcggcctcctactcctcgctagacactggtgcatcgcaggggtcttccctcagaaattcgacggggactccgcttacgtgggtatgtctgacggcaatccggagctgctgtctacttctcagacctacaatgggcagtccgagaataacgaagattacgagattccacccatcaccccccctaatctgcccgaaccatctctgctgcatttaggcgatcacgaagcttcctatcactccctctgccacgggctgacacctaacgggttactaccggcatattcctaccaggctatggatcttcccgccatcatggtgtctaatatgctagcccaggattcccatcttttaagcggacagctgccaacgatacaggagatggttcactccgaggtagcagcttatgacagtgggcgcccgggtccactcctcggccgtcccgcaatgttagcaagccacatgagcgctctcagccaatctcagcttatttcgcagatgggcatccgctcctctattgctcacagctctcccagtcctcccggctctaagagcgctactccttctccttcctcgagcacacaggaggaagagagtgaagtgcactttaaaatcagcggtgaaaaacgaccttccgcagaccccggcaaaaaggctaaaaatcccaaaaagaagaaaaagaaggatcccaacgagccccagaagcccgtgtccgcctatgcgctgttcttccgagatacccaagccgccattaaaggccaaaatccctccgcaacttttggagatgtgtctaaaatcgtagcgtcaatgtgggactctttgggagaggaacagaaacaaagctcgcccgaccagggagagacaaagagcacgcaggccaatccaccagccaagatgctgccacccaaacagcctatgtatgccatgccgggtcttgcaagctttctcactccaagcgatctgcaggccttccggtctggcgccagtccagccagtttggccagaactctcggttcaaagtcactgttacccggtctcagcgcatcccctccacctcctcctagctttccactgtcacccaccctgcaccaacagctctcccttccacctcatgctcagggagctctgctctctccacccgtgtccatgtcacccgcaccccaaccccccgtgctacctacccccatggccctgcaggtacagctcgccatgagcccgtctccccctggcccccaggacttcccgcacatctccgagtttccttcctcctctggttcatgtagtccagggccatccaatccaacatcttcaggggattgggatagttcttacccttctggagagtgcgggatctctacttgcagtttgttaccaagggacaaatcgctatatttgacgtag

SEQ ID NO: 20927 - DNA, 591 bp, Artificial Sequence
  Description of Artificial Sequence: Synthetic coding sequence
cggcggcggcggaagcggcggacccccatgagccggcggagcctgtgtcgcccaacccattcttcctccgagactttgcggcctccctcacgcgtgaggacccccgtccccctgtctgtgacctgtcccaaatcgtggcctccgtgtggcaccgcttgggaacggaaccgctcaagaacttctcgcacatccttaagcagcccagccgcaagggatcctgcccatcttgctcatcctaccccccccgcagccgggaccggcactgccgctacacctgtgggaagtgtggcctccgcgcctgctgcgtgcagtcctggcacaaaccggtccacttccccaaatcccgctagcctaccatctcttcggctggcggggagacactgttccgagcccgaggggttgaccgccgagaagaggccttggccggaggccggctggcctatcggagagtcaagtgacaccccgatcgcccggggactgtcgctctttctgaacctgcctccggactccgccgaagctgcccactgtccgccccccgcacagagaacatgccgcaaccttcctccagccgatcttctagcacccggttag

SEQ ID NO: 20928 - DNA, 1395 bp, Artificial Sequence
  Description of Artificial Sequence: Synthetic coding sequence
atgagcgacggcaaccccgagctgctgagcaccagccagacctacaacggacagtccgagaacaacgaagattatgaaatccctccaattaccccgcccaatttgccggaaccatcgttgttacacctcggcgatcatgaggcctcttatcactctctctgtcacggacttactccgaacggtctcctgcctgcctattcatatcaggcaatggacctgccagctatcatggtctcgaatatgctggcccaggactcacatctcctgagtggccagttgcctaccatccaggagatggttcatagtgaagtggccgcctatgactcgggccggcccggccccctgctggggcggcctgccatgctcgcttcacatatgtctgccctgtctcagagtcaactgatatcccagatgggaatccgcagcagtattgcccactcctctccgagtcccccaggatccaagagtgccactccttcacctagcagtagcacccaggaggaagagagtgaagtccattttaagatcagcggcgaaaaacgacctagcgcagaccctggcaaaaaggcgaaaaatcctaaaaaaaaaaaaaagaaggaccccaatgagcctcagaagcctgtgtctgcatacgcactgttttttcgagacacacaggccgctatcaagggtcaaaacccatccgcaacgtttggtgacgtttcaaagattgttgcctcgatgtgggactcacttggagaagagcagaagcaggcatataaacgcaagaccgaagccgcgaaaaaggagtatctcaaagccctcgctgcttaccgtgctagcttggtttcgaagagtagccccgatcagggagagactaagtccacacaagccaatccaccggcgaagatgctccccccaaaacagcccatgtacgccatgcccggcttggctagctttctcacaccttccgacctgcaggctttccgcagtggggcctcacctgcatcattggccagaaccctgggcagtaagtcactgctgccagggctatcagcttccccgccaccccccccaagcttcccactttcccccacattgcaccagcagttgagcttgcctcctcatgctcaaggcgccctcttatctcctcctgtttctatgtctcccgcccctcagcccccagtcctacccacccccatggcactgcaggtgcaactggcaatgtctccctccccgcctggacctcaggatttcccgcatatcagcgaattcccgtcctcatctggttcgtgctcacccgggcctagtaaccctacaagttctggagactgggattcttcctacccatccggtgagtgcggaatttcaacctgtagccttctgcctcgcgataagtctctttatctgacctag

SEQ ID NO: 20929 - DNA, 591 bp, Artificial Sequence
  Description of Artificial Sequence: Synthetic coding sequence
cggcggcggcggaagcggcggacccccatgagccggcggagcctgtgtcgacccacccacagctcttctgaaaccttgaggcccccttcccgagtcaggacccctgtccccctcagtgtgacctgccctaagtcttggcctccctgtggaacagcctgggagagaaaccgcagcagaactagtagaacatctctctccagtcctgccgccagggatccagcccacctagcccatcccacacccccagctgccggcaccggcacagcagccacccctgtcgggtcggtggcctccgccccagctgcctgctcccctggcacgaataggagcacatctccaaaccccgcttctttacctagtctgcgcctggcagggcgccactgttctgagcccgagggcttgaccgctgaaaagaggccctggcccgaagcaggctggcccataggggagagcagtgacacacctattgctcgaggtctgtccttatttctgaatttgcctcctgattccgccgaagccgcccattgtccccctccagcacagcggacctgtaggaatctcccccctgcagacttactggcgcccggctag

SEQ ID NO: 20930 - DNA, 1395 bp, Artificial Sequence
  Description of Artificial Sequence: Synthetic coding sequence
atgagcgacggcaaccccgagctgctgagcaccagccagacctacaacgggcagtcagagaacaacgaggactatgagatcccccctattactcctcccaatctcccagagcccagcttgctccatctgggggatcatgaggcaagttatcattctctgtgccatggtctgactcccaacgggctgctgcctgcttatagctatcaggccatggatctacctgctatcatggtgtcaaacatgctggcccaggactcccatctcctgagcggccagttgccaaccatacaggagatggtgcatagtgaagtcgctgcatacgacagtggtcgtccaggtccgctgttgggccggcccgcaatgctcgccagtcatatgagcgctttaagccagtcccagctgatttctcaaatggggatccggagctccatcgcacattcgtcccccagccctccgggaagcaagtccgcgacacccagcccaagcagcagcacacaggaggaggaatcggaggtgcactttaagatctctggcgaaaagcggcccagcgccgatcctgggaaaaaggctaaaaatcccaaaaaaaagaagaaaaaggatcctaatgaaccccaaaagccagtttcagcctacgccctgttctttagagacactcaggctgcaattaaagggcagaacccctccgcaacattcggcgatgtatctaaaatcgtagcttctatgtgggacagcctgggagaagagcagaagcaggcctacaagcggaaaaccgaggcagcgaagaaggagtacctcaaggctctggctgcctatcgcgccagcctcgtgagcaagtcctcccctgatcagggggaaactaagagcacgcaggcgaaccccccagccaagatgttgcccccaaagcagccaatgtacgcgatgccaggtctggcttctttcttgactccctccgacctccaagcgttcaggagcggcgccagccctgccagtttggcccgcactctgggaagcaagagcctgctgccagggctgtccgcttcccctccccctccccctagtttcccactgtcgcctacattgcatcaacagttgtcccttccaccccacgcacaaggcgcactgttgagtccgcctgtctcaatgtctccagcgccgcagcctccagtactgccaaccccgatggcactgcaggttcagctggccatgagcccgtccccaccagggccccaagacttcccccacatatctgaatttccctcctcgtctggttcctgtagccccggtccttccaacccaactagctctggcgactgggactcttcataccctagtggagagtgcggcataagtacctgctcattactgccacgcgacaagagcttgtacctgacctag

SEQ ID NO: 20931 - DNA, 1155 bp, Artificial Sequence
  Description of Artificial Sequence: Synthetic coding sequence
atggagcaggagcgggagggcttcagcgaggaggtgaccttccagatccaggagatggtccacagcgaagtggctgcctacgactccggccggccagggccattgctcgggaggcctgcaatgctggcctcacacatgtccgccctgagtcaatcacagctcatcagccagatgggtatacggtcatccatagcccactcaagtccttccccccccggatctaagtctgcaacaccaagcccgagctccagcacgcaagaagaggagtcagaagtccacttcaagatcagtggggagaaaaggcctagtgccgatcctgggaagaaggcgaaaaaccctaagaagaagaagaagaaggaccctaatgagccacagaaaccagtgagtgcctatgcactcttttttcgagatactcaggcggcgatcaaggggcagaacccctcagctacatttggcgacgtctctaaaatcgtggcgtccatgtgggacagtttgggagaggaacagaagcaggcgtataaaagaaagactgaggcagccaaaaaagagtatctgaaagcactggctgcttaccgagcctcccttgtgagtaaatcctccccagatcagggagagactaagtccactcaagccaatccacccgctaagatgttgccccccaaacagccgatgtatgctatgcccggcttggcctcgtttctgaccccttccgatctgcaggcattcaggagtggcgcaagtcctgcgagcctcgcgaggacgcttggatctaaatctctcctgccgggtttaagtgcaagtccacccccccctccatcctttcctttgagccccacacttcaccagcaactctctctgccgccccatgcgcagggagccctcctctctccaccagtttctatgtcccctgcccctcaaccccccgtgctgcctactcctatggctctccaggttcagttggcaatgtcaccgtccccacccggacctcaggattttccccacatttccgaatttccctctagctctggctcatgttcacccgggccttctaatccaaccagttcaggtgattgggatagctcttatccgtcaggagagtgcggaataagcacttgctcactgctgcctcgtgataaatctctctacctaacttag

SEQ ID NO: 20932 - DNA, 537 bp, Artificial Sequence
  Description of Artificial Sequence: Synthetic coding sequence
atgagcgacggcaaccccgagctgctgagcaccagccagacctacaacggacaatcggaaaacaatgaagactatgaaatcccacccattacgcctcctaaccttcccgaaccatctttactccacctgggggatcacgaagcctcctatcattcactctgccacggcctgacccccaacggcctcctgcccgcttactcatatcaggccatggacttgccagctattatggttagtaatatgctggcccaggacagccacttgttgagcgggcagttaccaactattcaggagatggtacattcagaagtcgcggcatacgactccggtcggccagggcctctcctcgggcgacccgccatgttggctagtcatatgtccgctctgtcacagtcccagctcatttcacaaatgggcatcagaagtagtatcgcccacagctctccaagccctcctggcagcaagagtgcaacaccatcgccctccagttcgactcaggaagaggaaagcgaagtgcactttaaaataagtggctag

SEQ ID NO: 20933 - DNA, 366 bp, Artificial Sequence
  Description of Artificial Sequence: Synthetic coding sequence
atggccgccgcccgggccaccacccccgccgacggcgaggagcccgctccagaggcggaggcccttgctgccgcacgggagcgctctagcagattcctatccggcttggagttagtaaagcagggagccgaagcacgggtgttcaggggtcggtttcaagggagggctgcagtcatcaagcatcgtttcccaaagggctacaggcaccctgcactcgaggcacgactgggcaggcgtcgcaccgtccaggaagccagagctctgcttcggtgtcgccgcgccgggaaagagtatttgccccagctcagttttctgtggaccatgctccctaccgcttatatctggaaaaaactgaaggcccagtag

SEQ ID NO: 20934 - DNA, 762 bp, Artificial Sequence
  Description of Artificial Sequence: Synthetic coding sequence
atggccgccgcccgggccaccacccccgccgacggcgaggagcccgccccagaggccgaagccctggccgcagcaagggagcgttcttcacgatttctgagcggcctggagctggtcaagcagggcgctgaggcgcgagtatttagggggagatttcaggggcgcgcggcggtaatcaagcatcggttccctaaaggctacaggcatcctgctctggaggcgagattgggtaggcggcgcacagtacaagaggccagggccctccttaggtgccgccgcgcgggaatttctgcacctgtagtcttctttgtggactacgcttcaaactgtttgtacatggaggaaattgagggctctgtcacagtacgggactatatccagtcaaccatggaaaccgagaaaacgcctcaggggctgagtaacctggctaagaccattggccaggtgctcgctcgaatgcatgacgaagacttgattcacggggacttgacaacctccaacatgctcctgaaaccacccctggagcagctcaacatagtactcatagacttcggcctgtcctttattagcgctctgcccgaagacaaaggggtggatctatacgtacttgagaaagcgtttttatctacacacccgaataccgagaccgtgtttgaggcgtttctcaaatcatattccacttcatccaaaaaagcaagaccagtgctcaaaaaactggatgaagtgaggcttagaggccgcaaaagatcaatggtgggttag

SEQ ID NO: 20935 - DNA, 1146 bp, Artificial Sequence
  Description of Artificial Sequence: Synthetic coding sequence
atgatcagcgcccaccggaagctgtgcctgcccggcagcagcaactcccccgcatccgccttccgggtagccgggactactgccgtcaaaatgagcgataagaaccagatagccgcacgtgctagtttaattgagcaactcatgtcaaaaaggaattttgaggatctgggaaaccatctgaccgaactggaaacaatctacgtaactaaggaacatctgcaggaaactgacgtggtgagggcggtgtaccgcgtgctgaaaaattgcccaagtgtggcactcaagaagaaggcgaaatgtcttctctccaagtggaaagcagtttataagcagacacattctaaggccagaaatagtcccaaactgttccctgtgcggggaaacaaagaggagaattctggcccaagccatgacccatcccagaacgagacactggggatttgctctagcaatagtttaagttctcaggatgttgccaagctgtccgaaatgatcgtgcccgagaatcgcgccatccaactaaagccaaaggaggagcattttggcgacggcgatccagaatctacaggcaaacgttcaagtgagcttctcgaccctaccacacctatgaggacaaagtgtatagagctgctctatgccgctctcacgagtagctccactgaccaacctaaagccgatctgtggcagaactttgcccgtgaaattgaggaacacgtgtttacattgtactctaagaatattaaaaaatacaagacctgcattaggagtaaggtggcaaatcttaagaacccccgtaatagccatcttcaacagaatctgctgagtggcaccacaagccctcgcgaattcgctgagatgactgtcatggagatggccaataaggaattaaaacagctcagagcgtcctatacggagtcgtgcattcaagaacactatctgcctcaggttatcgacggcacccagactaacaagatcaagtgtaggagatgtgaaaagtacaattgcaaggtgaccgtgatcgatagggggacattatttctgccaagttgggtcaggaattccaatcccgacgaacagatgatgacgtacgttatctgtaatgagtgtggtgagcaatggtaccactcaaaatgggtgtgctggtag

SEQ ID NO: 20936 - DNA, 1056 bp, Artificial Sequence
  Description of Artificial Sequence: Synthetic coding sequence
atgagcgacaagaaccagatcgccgcccgggccagcctgatcgagcagctcatgtcaaagagaaatttcgaagatctgggaaaccacctgactgagctcgaaacaatctacgtgaccaaggaacacttgcaggagactgacgtggtcagagccgtgtacagggtcctgaagaactgtccttccgttgcccttaaaaagaaagccaagtgcctcctgtcaaagtggaaggcagtatacaaacagacacatagcaaggctcggaacagcccaaagctcttcccggtccgcggtaataaggaggaaaacagtgggccctctcacgatccgtcccagaacgagaccctaggtatctgctcctccaattccttgagttcccaggacgtggctaaactgtccgagatgattgttccagagaaccgcgctattcaactgaaaccaaaggaggaacatttcggcgatggggatcccgagagcactggaaaaagaagttcagagcttttagatccgaccacgcctatgagaaccaaatgcatcgaactgctttacgccgcactgaccagctcatccacagaccagccaaaggcagatttatggcagaatttcgcgcgggaaattgaagaacacgtcttcactctatacagtaaaaatatcaaaaaatacaagacttgcattcgtagcaaggtcgctaacctgaaaaatcccagaaattcgcacttgcaacagaatctgctgtctggaacgacaagcccacgggaatttgcggagatgactgtgatggaaatggctaacaaggagctcaagcagttgcgcgctagctacactgagagttgcatccaggagcactacttaccccaagtgattgatggaacgcagacaaacaagatcaaatgtcgccgctgcgagaagtacaactgcaaagtgacagtgattgacagagggactctctttctaccaagctgggtgcggaacagcaacccagacgagcaaatgatgacgtatgtgatttgtaacgagtgcggtgagcagtggtatcatagtaagtgggtgtgctggtag

SEQ ID NO: 20937 - DNA, 1056 bp, Artificial Sequence
  Description of Artificial Sequence: Synthetic coding sequence
atgagcgacaagaaccagatcgccgcccgggccagcctgatcgagcagctgatgtccaaaaggaattttgaggatctcggcaaccatcttactgagttagagactatatacgtgacaaaggagcacttgcaggaaaccgacgtggtgcgcgctgtctatagagtacttaagaattgcccctcagttgcactcaagaaaaaggccaaatgcctcctcagtaagtggaaagctgtgtataaacaaactcactcaaaagcaaggaattcaccaaagttgtttccggtgcggggtaacaaagaggagaacagcgggcccagccatgacccgagccagaacgagacccttgggatctgttcctctaacagcctgagctctcaggatgttgccaagctctccgaaatgatcgttcctgaaaatcgggcaatccaactgaaaccaaaggaagagcattttggagacggggatcctgaaagcactgggaaacgtagctctgaattactggatcccactacgccaatgcggactaagtgcatcgagctgctctatgccgccctgacttcaagttctacagatcagccaaaggcagatctttggcagaactttgctcgggagatcgaggaacatgtgtttaccctgtactccaagaacatcaaaaaatacaaaacatgtatcaggtctaaggtggctaacctaaagaatccccggaattctcatctacagcaaaaccttctgtccggcaccacctctcctcgggagttcgcggaaatgactgtgatggagatggcgaacaaagagctgaagcagctgcgagcgagttataccgagtcatgtattcaggagcactacctccctcaggtcatcgacgggacccaaacaaacaaaatcaaatgcagacggtgtgaaaagtacaactgtaaggtcaccgttatagacagaggcacgctgttcttaccttcctgggtaaggaacagcaacccagacgagcagatgatgacctatgtcatttgcaatgaatgcggcgaacaatggtaccactctaaatgggtctgctggtag

SEQ ID NO: 20938 - DNA, 1056 bp, Artificial Sequence
  Description of Artificial Sequence: Synthetic coding sequence
atgagcgacaagaaccagatcgccgcccgggccagcctgatcgagcagcttatgagcaaacgcaatttcgaggatttaggcaaccacctaacagagttggaaaccatatacgtgaccaaagagcaccttcaggagacggacgttgtccgggcagtgtatcgcgtcctcaaaaattgtcctagcgttgcgctgaagaagaaggcgaagtgccttctgagtaagtggaaggctgtatataagcagacccacagtaaagccagaaactctcctaagctcttccccgttcgtgggaacaaggaggagaacagcgggccctctcatgatcccagccagaatgagaccctggggatatgttcaagcaattccttgtcaagccaagacgttgccaaactgtccgaaatgattgtgcctgagaatcgtgcgatccagctcaagcctaaagaggaacacttcggggatggtgaccctgaaagtacaggaaaacgctcttctgagctgctggatcctaccacaccaatgcgcaccaagtgcatcgagcttctttatgccgccttaacctcatccagtaccgatcagccgaaagccgacctttggcagaattttgctcgagagattgaggagcatgtatttactctgtacagtaagaacattaaaaaatacaagacctgcatccgcagtaaggtggcgaacttgaagaatcctcgaaactctcatcttcaacaaaacctgcttagtgggacaacatcccccagggagtttgccgagatgactgtgatggagatggccaacaaagagctgaagcagctgcgtgcgagctacaccgagtcttgcattcaagagcattacctaccacaggtgattgacggcacgcagaccaataaaatcaaatgtaggcggtgcgagaagtataattgcaaggtgaccgttatcgacagagggacgctgttcctcccttcctgggtacgcaatagcaacccagatgaacagatgatgacatacgtgatatgcaacgagtgtggggaacagtggtaccattccaaatgggtgtgttggtag

SEQ ID NO: 20939 - DNA, 1476 bp, Artificial Sequence
  Description of Artificial Sequence: Synthetic coding sequence
atgaagaccttcacctggaccctgggcgtgctgttcttcctgctggtcgacaccgggcactgccggggcggccagttcaaaatcaaaaagattaatcagagacggtatcctcgggctacagacggtaaggaggaggcaaagaagtgtgcgtacacttttctagtccctgaacagcgaatcacagggcctatctgtgtcaataccaagggccaggatgccagcactattaaggacatgatcacccggatggatctcgagaaccttaaagatgtactgtcccggcagaagcgagaaattgacgtgcttcagctggtagtggacgtagacggaaacatcgttaatgaagtgaagctgctgcgcaaagaaagtcggaacatgaatagtagggtgacgcagctgtacatgcagctactacatgaaatcattcgtaaaagagacaactctctcgagctaagtcagctggagaacaagattcttaatgttaccacagagatgttaaagatggcaactcgttaccgggaactggaagtgaagtatgcatcactgactgacctggtgaataatcagtccgtcatgatcaccctgctcgaagagcagtgcctccgcatcttctcgagacaggacacacatgtttcacccccgctggttcaggtggtcccgcagcacattccaaacagccaacaatacactccgggtctgctggggggaaatgaaatccaaagggaccccggctatccccgcgatcttatgccgccccccgacttggcaacaagtcctacaaaatcaccatttaaaatccctcctgtaaccttcattaatgaagggccgttcaaagactgtcagcaggctaaggaagccggacacagtgtgtctggaatctacatgattaaacctgagaattctaatgggccaatgcagctttggtgtgagaactcacttgaccctggaggttggactgtgattcaaaaaagaacagacggatcggtaaacttctttcggaattgggagaactacaagaagggttttggtaatattgacggtgaatattggctcggcctggaaaatatttacatgctgtctaaccaggataattataagctgttgattgagttggaggattggtctgacaaaaaggtttatgccgagtattccagcttccgactcgagccagaaagcgagttctatagactgcggctagggacctaccagggtaacgccggcgatagtatgatgtggcacaacgggaagcagtttacgactctggatcgcgacaaagatatgtatgccggaaattgtgcccatttccataagggcggctggtggtataatgcctgtgcccattctaacctaaacggagtatggtacagaggtgggcactacaggagcaagcaccaggatggcatcttttgggccgaatacagaggggggtcatacagccttagggcggttcagatgatgatcaagcctatcgactag

SEQ ID NO: 20940 - DNA, 717 bp, Artificial Sequence
  Description of Artificial Sequence: Synthetic coding sequence
atggccgtgttcagcggcgtgctggagagcgccctgttcctggaccaaaatactctgcaggcccggcaggggagtcggtcacctctcactatggataagtttgtcatacgcacccccagaatccagaactcccctcagaagaaggactcagggggaaaggtttacaagcaggccacaatcgagagcctgaaaagggttgtcgtggtagaagacatcaaaagatggaaaacgatgctggagttacccgatcagaccaaggagaatcttgtggaggcgctgcaagaactgaagaagaaaattccgtcgagggaagtgctgaagtcaactcggattggccacactgtcaataaaatgcgcaaacattctgactctgaagtcgcctcactggcacgggaagtgtatacagaatggaagacgttcacggaaaagcattcaaacaggccaagcattgaggtccgcagtgatcctaagacagaatccctgaggaagaatgcgcagaagctcttatccgaagctctggaactaaagatggatcaccttcttgtggaaaatatcgagagggaaacgtttcacctgtgctcccgattgatcaacggtccatataggaggactgtccgcgcacttgtctttacccttaagcatcgcgcggagataagagcgcaggtaaaatcaggcagtctcccggtcgggacctttgttcagactcataagaagtag

SEQ ID NO: 20941 - DNA, 741 bp, Artificial Sequence
  Description of Artificial Sequence: Synthetic coding sequence
atggacctgctgcgggagctgaaggccatgcccatcaccctgcacctgttgcagtccacacgtgtcgggatgagcgtgaatgctttgcgaaaacagtcttctgacgaggaggtgatcgccttagcaaagagtctgatcaagtcctggaagaagctgttagacgcttcggatgctaaagccagggagaggggcagaggcatgcctctccccacgtccagtagagatgcctccgaggctcctgacccatctcgtaagcgtccagagcttccaagagccccaagcacaccacgaataaccacatttcctcccgttccagttacatgcgatgccgtgcgcaacaaatgcagggaaatgttaaccgcagccctccagaccgatcatgatcacgtggctattggcgccgattgtgaacgattgagcgcccagattgaggaatgcatctttagggatgtcggaaataccgacatgaagtacaagaacagggtaagatcacgaatttcaaaccttaaggacgctaagaatccagatttgcggcggaacgtcctctgcggtgcaatcactccacagcagattgcagtgatgactagtgaagaaatggcatccgatgaactgaaagagatcagaaaggccatgactaaagaggcaatccgcgagcatcaaatggcccgcaccggtggcacgcaaaccgatctttttacatgtggcaaatgtcggaaaaagaactgcacttacactcagtag

SEQ ID NO: 20942 - DNA, 900 bp, Artificial Sequence
  Description of Artificial Sequence: Synthetic coding sequence
atgatgggcaaggaggaggagatcgcccggatcgcccggcggctggataagatggttacaaagaagagtgctgagggtgccatggatctgctccgggagttgaaggccatgcctatcaccttacacctgctgcaatctacgcgggtgggaatgtccgtgaacgcgctgcggaagcagagtagtgacgaagaggtcatagcactggcgaaatcactgattaagagttggaaaaagctgttggacgcatcagacgctaaggctagggaaagagggcggggaatgccccttcctacatcaagcagagacgcctccgaggccccagatccttctcggaagagaccggagctaccccgggcgcctagtacacctagaattactacctttccaccagtccccgtcacatgtgacgcggtgcgcaataagtgcagggaaatgctgacagcggcactgcagactgatcatgaccatgtcgctataggagcggattgtgagaggctgtccgcacaaatcgaggaatgcatctttcgagatgtcgggaacaccgacatgaaatacaaaaacagggtccggtcaaggatctccaatctgaaggacgccaagaaccctgatctacggagaaacgtgctgtgcggtgccatcacgccacagcagatcgctgtgatgacaagcgaggaaatggccagcgacgagttaaaggaaataagaaaggctatgacaaaggaagcgatccgcgagcaccagatggcacgcacaggcgggactcagacagatctgtttacctgtggcaagtgcagaaagaagaactgtacctatactcaagttcagacacgatcttccgacgagccaatgaccaccttcgtggtctgtaacgagtgcggcaaccggtggaagttctgctag

SEQ ID NO: 20943 - DNA, 819 bp, Artificial Sequence
  Description of Artificial Sequence: Synthetic coding sequence
atggacctgctgcgggagctgaaggccatgcccatcaccctgcacctgttgcaatccacccgggtggggatgtcggtgaatgccctgcgaaagcaatcgagcgacgaggaggtcatcgccctggcaaagtccctgattaagtcgtggaaaaagctccttgacgcatcggatgccaaagccagagagcgggggagaggtatgcccctcccaacatctagcagggacgcctccgaagcacccgatccttccagaaagaggcccgaacttcctagggctccttctacacccaggatcaccacatttcccccggtgccagtgacctgtgatgccgtcagaaacaagtgcagagagatgctgaccgctgcgcttcagacagatcatgaccatgtggctataggagctgactgtgaacgccttagcgcacagatcgaggaatgcattttcagggacgtgggtaatactgacatgaaatacaaaaacagagttcgctctcggatcagcaatctgaaggatgccaaaaacccagatctgcgacgcaatgtgctgtgtggggccataaccccccaacaaattgccgtcatgacatcggaggagatggcctcagacgagctgaaggaaatacgaaaggcaatgactaaggaagcgattcgggagcatcagatggcacgcaccggaggaacgcagacggacttgttcacatgtgggaagtgtagaaaaaaaaactgcacatatacacaggttcagaccagatctagcgacgaaccgatgacaaccttcgtcgtatgtaacgagtgcggcaatcgatggaagttctgctag

SEQ ID NO: 20944 - DNA, 729 bp, Artificial Sequence
  Description of Artificial Sequence: Synthetic coding sequence
atgatgggcaaggaggaggagatcgcccggatcgcccggcggctggataagatggtaaccaagaaatccgcagaaggggccatggacctgttacgcgagctaaaggctatgccaattacactgcatctgctccaaagcacacgagttggaatgtcagtcaatgctctgcgcaaacagtcatctgacgaagaggtgatcgccttagctaaaagcctgattaaatcttggaagaagctcttagacgcttcagatgccaaggcaagggagagaggacgcggaatgccccttccaacgagctctagggacgctagtgaagcccctgacccaagccgcaagaggcccgaactgcccagggcccctagtaccccccggatcactacgttcccacccgtgccggttacatgtgacgccgtccggaacaaatgcagagaaatgctcactgccgctcttcaaacagaccacgatcacgtggctatcggagccgactgtgagcggctgtccgcgcagatagaggagtatatcctgtgggtgggagcagtcggcctggggttctggtggagccaggaagctgcatggcctggcgccctgtggtggctcctcgatgctactgcacagctgtccagaggacacttgcccggatggtcacctgcatgggtcgtacgcctatcccacctgcgcagagccccgggacccgctgaaggactgatactcagcgcgtgcggcgcatag

SEQ ID NO: 20945 - DNA, 249 bp, Artificial Sequence
  Description of Artificial Sequence: Synthetic coding sequence
atggacctgctgcgggagctgaaggccatgcccatcaccctgcacctcctgcagtctacacgcgtgggtatgagcgttaatgccctgcggaagcagtcaagcgatgaagaggtgatcgcccttgctaaatctttaataaagagttggaaaaaactgcttgacgcctccgacgcaaaggctcgggagaggggcagagggatgcctctgcctacctcctctcgtgacgctagcgaagcaccggacccatag

SEQ ID NO: 20946 - DNA, 741 bp, Artificial Sequence
  Description of Artificial Sequence: Synthetic coding sequence
atggacctgctgcgggagctgaaggccatgcccatcaccctgcacctcctccaatcaacgagagtgggaatgtcagttaatgctttgaggaagcaatccagtgacgaagaagttatagccctggctaagtcacttatcaaatcttggaaaaaattgctcgacgcaagcgatgcaaaagctcgagaaaggggaagggggatgccactccccactagcagtcgcgatgcctccgaggctccagatccgtcccgaaagcggccggagcttcctcgagcgccctcgaccccgcggattacgacttttcctccagtgcctgtgacttgtgacgctgtgcgcaacaagtgcagggagatgctgacggctgcattacagactgaccatgatcatgtggcaattggagccgattgtgaacgcttgtctgcccagatcgaggaatgcatcttccgggatgtaggaaataccgacatgaagtacaaaaatagagttcggtctaggatttccaacctgaaagatgccaagaaccccgacctgagacggaacgtgttgtgtggagctattacaccgcagcaaatcgccgtgatgactagcgaagagatggcctctgacgagctgaaggaaattcggaaagcaatgaccaaggaggctatcagggaacatcagatggccaggaccggaggaacacaaacagacttgttcacctgtggcaagtgtcgcaagaagaactgtacttatacacaatag

SEQ ID NO: 20947 - DNA, 813 bp, Artificial Sequence
  Description of Artificial Sequence: Synthetic coding sequence
atggacctgctgcgggagctgaaggccatgcccatcaccctgcacttgctccagagcactcgagtagggatgtccgttaacgctcttcgcaaacagtccagcgacgaggaagttatcgcactcgcaaagtcccttatcaaatcttggaaaaagctactggacgcctctgatgccaaggcgagggaacgcggtcgcgggatgccattgccaacaagcagccgagacgctagtgaggcaccagaccccagcaggaagagaccggagttgccgcgcgcccctagtacacctcggattacgacctttcccccagtgccggtcacatgcgacgcagtgagaaataaatgtagggagatgctgacagcagccctgcagaccgaccatgatcacgtcgcgattggcgccgactgtgagcggctatcagcccagatcgaggagtgtattttccgggacgtcggcaacactgacatgaagtacaaaaatagagttcgatctaggattagcaacttgaaggacgctaagaatccagaccttcgcaggaatgtcctgtgcggtgccattacgcctcagcagatcgctgtcatgaccagcgaggagatggcgtcggatgagctgaaagaaatccgaaaggcaatgactaaagaagctataagagaacatcaaatggctcggaccggcgggacccagaccgatctattcacgtgcggcaagtgcagaaagaagaattgcacttatacccaagtccagaccagatctagtgacgagcctatgaccactttcgtggtttgcaatgagtgtggcaatcggtggaaatag

SEQ ID NO: 20948 - DNA, 465 bp, Artificial Sequence
  Description of Artificial Sequence: Synthetic coding sequence
atgggccaggaggaggagctgctgcggatcgccaagaagctggagaagatggtggcacgtaagaacacagagggcgcccttgatctgctaaagaagctgcactcatgccaaatgtccatccagttgctccagactacccgcattggtgtcgcagttaatggggtgaggaagcattgctccgacaaggaggtggtgagcctcgccaaagttttgattaagaattggaaaagactattggacagccctggacctcccaaaggggagaagggagaggaacgggagaaggctaaaaagaaggagaagggactcgaatgcagcgactggaaacctgaagccgggctgtccccaccccgcaagaagcgtgaggatccgaaaactagacgcgactccgtggatagcaaaagttccgcctccagcagccctaagcgaccaagcgtcgagcgcgcatgtagcttgatgcaatag

SEQ ID NO: 20949 - DNA, 1047 bp, Artificial Sequence
  Description of Artificial Sequence: Synthetic coding sequence
atgggccaggaggaggagctgctgcggatcgccaagaagctggagaaaatggttgcccgaaagaacactgaaggtgcattagatttgctcaagaaactgcattcctgtcagatgtcaattcagctgttgcagacaaccagaattggggtggcagttaacggagttaggaaacattgtagcgataaggaagtcgtgagcctggctaaggtcctaatcaagaattggaagcggctcctggatagccctggccccccaaaaggtgagaagggtgaggaaagagagaaggctaaaaaaaaagagaagggattggaatgttcagactggaaacctgaagccggactgagtcccccacgtaagaagcgtgaggaccccaaaactagaagggactccgtcgatagcaaatccagcgctagctcctcgccaaagcggccctcggtggaacggagtaattcatctaagagcaaagcggaaagcccaaaaacaccttcatctccgctgactccgacgttcgcctcgtcaatgtgcttgctggcaccttgctatctgacaggcgactccgtgcgtgataagtgcgtagagatgctcagtgcggccctcaaagccgacgatgactacaaagactacggggtgaattgtgacaagatggcttctgaaatcgaggaccacatatatcaggaattgaagtctaccgatatgaagtacaggaacagggtgaggagtcggatatctaatctcaaggaccctaggaaccccggccttcgaagaaatgtactgagcggagctatttctgccggtctcattgcaaagatgaccgccgaagagatggctagtgatgaattgcgcgagttacgcaatgcgatgacgcaggaggccattagagagcaccagatggccaagaccggcggaaccactacagacttgttccaatgctctaagtgcaagaaaaagaactgtacctacaatcaagtccaaacgaggagcgccgacgaacccatgaccacatttgtgttgtgcaatgaatgtggaaataggtggaagttctgctag

SEQ ID NO: 20950 - DNA, 684 bp, Artificial Sequence
  Description of Artificial Sequence: Synthetic coding sequence
atggagaagctgttcaacgagaacgagggcatgcccagcaaccagggcaaaatcgacaacgaggaacagcccccccatgaagggaagccagaagtggcctgcatcctcgaggacaagaagctggaaaacgagggaaataccgaaaatactggaaagagggtggaggaaccactcaaggataaagagaaaccagagtccgccggaaaggccaagggcgaaggcaagagtgagcggaaaggcaagagcgagatgcagggaggaagcaaaacagagggtaagcccgagaggggcggtcgcgccgagggcgaaggtgaacctgattctgaacgggagcctgagtccgagggtgagccagaatctgagacacgcgcagctgggaagaggcctgctgaagacgacataccacggaaggccaagagaaagactaataagggactagcgcagtatttgaaacagtacaaggaagcaatccatgacatgaatttttcaaacgaggacatgatccgcgagtttgataatatggcgcgcgtggaagataaaagaaggaagagtaagcagaaactcggcgccttcttgtggatgcaaagaaaccttcaggatcctttttacccgcgaggaccaagagaatttagaggcggatgtcgcgcaccccgtagagatactgaggacataccatacgtttag

SEQ ID NO: 20951 - DNA, 684 bp, Artificial Sequence
  Description of Artificial Sequence: Synthetic coding sequence
atggagaagctgttcaacgagaacgagggcatgcccagcaaccagggaaagatcgataatgaggagcagcccccgcacgagggaaagcccgaagttgcatgcatactggaggacaagaagctggagaacgagggaaacacagagaacaccggaaagagggtggaggagccattgaaagataaagagaagcctgaaagcgccggcaaagctaagggagaaggcaagtctgaaagaaagggtaagagcgagatgcagggaggaagcaaaaccgaggggaagccagagcgtggcggaagagcagaaggggaaggggagccagattcagaaagggaaccagagtcagagggagagccagagtctgaaactagagcagccgggaagaggcccgctgaagatgacatcccgaggaaagccaagcgaaaaaccaacaaggggctcgcacagtacttaaagcaatacaaagaggcgattcatgacatgaattttagcaacgaagatatgatacgggagttcgataacatggctagagttgaagacaaaagaaggaagtctaaacagaagcttggcgccttcctttggatgcagcgcaatctgcaggacccgttctacccgagaggaccgcgggaattcaggggtggctgtcgagctccacgtagggacactgaggacattccttacgtttag

SEQ ID NO: 20952 - DNA, 603 bp, Artificial Sequence
  Description of Artificial Sequence: Synthetic coding sequence
atggagaagccctacaacaagaacgagggcaacctggagaacgagggcaagcctgaagacgaagtggagcctgacgatgaagggaaaagcgacgaagaagagaagcccgacgtggaggggaaaactgaatgcgagggcaaacgagaggacgagggtgaaccgggcgacgaagggcaactcgaggacgaggggtcccaagagaaacaggggcggagtgagggcgaggggaagcctcagggtgaaggaaagcctgcctcccaggctaaaccagagtcgcagcctagagcagcagagaaaaggccagcggaagactatgtacctcgcaaggccaaacgaaaaacagataggggtacagacgactctccaaaggactctcaggaagacctccaggaacgacacctgtccagtgaggagatgatgcgggagtgcggcgatgtaagtagggctcaggaggagttgagaaaaaaacagaagatgggtggattccattggatgcaaagggacgtgcaggacccatttgctccaagaggacaaaggggggtgaggggggttagaggcgggggaagaggacagcgcggattgcacgacataccttatctgtag

SEQ ID NO: 20953 - DNA, 603 bp, Artificial Sequence
  Description of Artificial Sequence: Synthetic coding sequence
atggagaagccctacaacaagaacgagggcaacctggagaacgagggaaaacccgaagacgaagtggagcctgacgacgaaggtaaatcagacgaggaggaaaagcctgatgtggaggggaaaaccgagtgtgaggggaagagggaagatgaaggggaacccggcgatgaaggccagctggaggatgaaggttcacaggagaaacagggccggtctgagggggaggggaaaccacagggggaggggaagccagcctctcaggccaagccagagtcacagccgagagctgctgagaagcgccccgctgaggattacgtcccccggaaagctaaacgcaagactgatcggggaacagatgactccccaaaagatagccaggaagacctgcaggagcggcacctgtcttcagaagagatgatgcgcgagtgtggcgacgtaagccgggctcaagaagaacttcgaaagaaacagaagatgggcggatttcactggatgcaacgggacgtgcaggaccctttcgcccctagaggccaacgtggtgtccgcggtgtgcggggggggggtcgaggccagcgaggtctgcacgatatcccttatctgtag

SEQ ID NO: 20954 - DNA, 603 bp, Artificial Sequence
  Description of Artificial Sequence: Synthetic coding sequence
atggagaagccctacaacaagaacgagggcaacctggagaacgagggaaaacccgaggacgaagtggagcctgacgatgagggaaagtccgacgaggaggagaagccggatgtggaaggtaaaaccgaatgtgagggtaagcgagaagatgaaggcgagcctggggatgagggccagctggaagatgaaggcagtcaggagaagcaaggtcgctctgaaggcgaagggaagcctcagggcgagggtaaacccgcctctcaggccaaacctgaaagtcagcctcgagctgcagagaaaagacctgcagaggattatgtgcctaggaaagcaaagagaaaaacagatagaggaacagacgactctccaaaggattctcaggaggatctccaggaacggcatctcagcagcgaagagatgatgcgcgagtgcggagacgttagcagagctcaagaagaactgcgcaaaaagcaaaaaatggggggattccactggatgcagagggatgtgcaggacccattcgcaccgcgtggccagcgcggcgtgaggggtgtacggggcgggggtagagggcagcgaggcttacatgatattccatatttatag

SEQ ID NO: 20955 - DNA, 1077 bp, Artificial Sequence
  Description of Artificial Sequence: Synthetic coding sequence
atgcccgccggcggccaggccccccagctgacccccgtgatccccgccttttgggaagctcgcggactccctaacagcaaaggcagagataaagtccatatctgccagtgcgaggagtggaaagggcatatcagttacgtagagagggacattactacgagcgagataaagtctttgccacaggtttccgttagggctttccacgcagccagcgggacccttgaatggcgtaagggtaatgggtacggccggggcaaagggtgggggtggggtcgagtggaaagccgggaagccgggccatccgtcgaccgagatggcggccttcgggtgtgttgtagccagagatcggccaagccggaaaaagaggagcaacccgtacaaaatcctcggcgcagcgttaaagatcgcaagaggaggggtaacctcgatatggaaaagctctacagcgagaacgagggcatggccagcaatcaggggaaaatggagaacgaggagcagccgcaggacgagcggaaacccgaagtgacttgcactctcgaggacaaaaagctcgagaatgaaggtaagactgaaaataagggcaagaccggggatgaagaaatgctgaaagacaagggcaaacccgagagcgagggagaggctaaagaggggaagagcgaacgggagggagagagcgagatggaggggggctctgaacgagagggtaagccagaaatcgagggtaaacctgagagtgaaggagaaccaggaagtgagacccgagcggctggaaagcggcctgccgaagacgatgtgcctcgaaaagctaaaaggaagaccaataaggggttggctcactatctgaaggagtataaagaggctatccacgacatgaatttttcaaacgaggatatgattcgggaattcgacaatatggccaaggttcaggatgaaaaaaggaagtctaaacaaaagcttggggcattcctgtggatgcagcggaacctgcaggacccattttacccccgcgggcctagggaattccgtggcggctgtcgcgcgcctcggagagacatcgaggatattccatacgtctag

SEQ ID NO: 20956 - DNA, 561 bp, Artificial Sequence
  Description of Artificial Sequence: Synthetic coding sequence
atggagaagctgtacagcgagaacgagggcatggccagcaaccaggggaaaatggagaatgaggagcagccccaagacgagagaaagcccgaagttacctgcaccctggaggacaagaagttggagaatgaaggtaaaacggagaataagggcaagacgggcgatgaggaaatgctgaaggacaagggcaaaccggagattgagggaaagcctgagtccgagggcgagcccggaagcgagaccagggcagctgggaagagaccagccgaggatgacgtcccacgaaaagctaaaagaaagacaaacaagggcctggcccattatttaaaggagtataaagaagccatccacgacatgaacttttctaacgaagacatgatccgcgagtttgacaacatggccaaggtgcaggatgagaaacgaaaatctaaacagaagctgggtgcattcctgtggatgcaaagaaatctacaagatccgttttatcccaggggcccacgcgaatttcgtggaggttgccgggcccctcgacgcgacattgaagacattccatacgtttag

SEQ ID NO: 20957 - DNA, 648 bp, Artificial Sequence
  Description of Artificial Sequence: Synthetic coding sequence
atggagaagctgtacagcgagaacgagggcatggccagcaaccagggtaaaatggagaatgaagaacagcctcaagatgaaaggaaacccgaggtaacctgtactcttgaggataaaaaattggagaacgagggaaaaactgagaacaaaggaaaaacaggcgatgaggaaatgttaaaggacaagggaaagcctgagtctgaaggcgaagcgaaggaaggtaagtctgaacgcgaaggcgagagcgaaatggaaggagggagtgaaagagagggcaaacccgaaatcgagggcaagccggagagcgaaggcgagcccggtagtgagaccagagctgctggaaagaggcccgccgaggatgatgtgccaaggaaagcgaaaagaaaaactaacaaaggcctagcccactacctgaaggagtacaaagaagctattcacgatatgaatttcagtaacgaggatatgattcgggaattcgataatatggcaaaggttcaggacgagaagcgcaaatctaaacaaaagctcggagctttcttgtggatgcagaggaatctgcaggaccccttttaccctcgcggaccacgagaattcaggggcggatgtcgtgcaccccgccgtgacattgaggatatcccgtacgtctag

SEQ ID NO: 20958 - DNA, 177 bp, Artificial Sequence
  Description of Artificial Sequence: Synthetic coding sequence
atggagaagctgtacagcgagaacgagggcatggccagcaaccagggtaaaatggagaatgaagaacagccccaggacgagagaaagcccgaggtgacctgcactctagaggacaagaagctcgagaatgaaggtaaaaccgagaataagggcaaaactggagatgaagagatgtag

SEQ ID NO: 20959 - DNA, 153 bp, Artificial Sequence
  Description of Artificial Sequence: Synthetic coding sequence
atggagaagctgtacagcgagaacgagggcatggccagcaaccagggcaagatggaaaacgaggaacagccacaggatgagagaaagccggaagttacatgtacactcgaagacaaaaagcttgaaaacgaaggcaagaccgagaataagtag

SEQ ID NO: 20960 - DNA, 276 bp, Artificial Sequence
  Description of Artificial Sequence: Synthetic coding sequence
atggagaagctgtacagcgagaacgagggcatggccagcaaccagggcaaaatggagaacgaagagcagccccaggacgagagaaagcctgaggtgacatgcactctcgaagacaaaaagctggaaaacgaaggcaaaactgaaaacaaaggcaaaacaggggatgaggaaatgctaaaggacaaagggaaaccagagtctgaaggcgaggcaaaagaaggaaagagcgaaagagagggggagtctgagatggaaggaggatccgaacgcgagtag

SEQ ID NO: 20961 - DNA, 648 bp, Artificial Sequence
  Description of Artificial Sequence: Synthetic coding sequence
atggagaagctgtacagcgagaacgagggcatggccagcaaccagggtaagatggagaatgaggagcagccacaggacgaaaggaaaccagaagtcacttgtacgctcgaggataaaaaattggagaatgagggaaaaaccgagaataagggcaaaaccggggatgaggaaatgctgaaagacaaggggaagccagagagcgagggcgaggctaaggaggggaaatcggaaagagaaggcgaatccgaaatggagggcggctccgaacgggaaggaaaacctgaaatagaaggaaagcctgagagcgaaggagaaccagggagcgagacaagagcagctggtaagcggcccgccgaggatgacgtcccccgcaaagcaaagagaaagactaataagggcctggcccactatctgaaggagtacaaagaagcaatccatgacatgaacttttccaacgaagacatgattcgggaattcgataatatggcgaaggtacaggatgagaaaagaaagagcaagcagaaactcggagcttttctatggatgcagcgtaatcttcaggatccattctacccaagggggcctcgcgaatttcggggcggatgtcgcgccccaaggcgcgatattgaggatataccttacgtgtag

SEQ ID NO: 20962 - DNA, 390 bp, Artificial Sequence
  Description of Artificial Sequence: Synthetic coding sequence
atggagaagctgtacagcgagaacgagggcatggccagcaaccagggaaaaatggagaatgaggagcagccacaggatgagagaaagccagaagtgacttgcaccctcgaagacaagaaactggaaaatgagggaaaaactgagaacaagggaaaaacaggagatgaggaaatgctcaaggacaaggggaaaccggagtctgagggcgaggccaaggagggaaagtccgaaagggaaggggagtcggagatggaagggggatccgagcgcgaggggaagcccgagattgagggcaagccagaatcggagggtgaacccggcagcgagacgcgggctgccggcaaaaggcccgcggaagatgatgtgcctaggaaggccaaaaggaaatag

SEQ ID NO: 20963 - DNA, 648 bp, Artificial Sequence
  Description of Artificial Sequence: Synthetic coding sequence
atggagaagctgtacagcgagaacgagggcatggccagcaaccagggaaagatggagaacgaggagcagccgcaggatgagaggaaaccggaggtgacatgcaccttggaggacaagaagttggaaaatgagggcaaaaccgaaaataaaggcaagactggagacgaggagatgcttaaggataagggaaagcccgaaagtgagggagaggcaaaggaagggaagagcgaaagagagggcgaaagcgaaatggaaggcggaagcgaaagggagggtaagcctgagattgaaggcaagccagaaagcgagggcgaacctggaagcgagactagggctgcgggcaagcgacccgccgaggatgacgtgcctaggaaagccaagaggaaaaccaacaaggggctggcccactatctcaaggagtacaaggaggccattcacgacatgaatttctccaatgaggacatgatccgagaattcgacaacatggcgaaagtccaggacgagaaaagaaagtccaagcagaaattgggggcctttttatggatgcagcgaaacttgcaagacccattctatccaagggggcccagagaatttcgtgggggttgccgagcaccccgccgagatatcgaggatatcccttacgtctag

SEQ ID NO: 20964 - DNA, 648 bp, Artificial Sequence
  Description of Artificial Sequence: Synthetic coding sequence
atggagaagctgtacagcgagaacgagggcatggccagcaaccagggcaagatggagaatgaagagcagccccaggacgagcggaagccagaggtgacatgcacgctggaggataagaaattggaaaatgaagggaaaacagaaaacaagggcaaaacaggagacgaagagatgctgaaagataaagggaagcctgaatccgagggcgaggctaaggagggcaagtctgaaagggaaggcgagagcgagatggaaggtggatccgaacgtgagggaaaaccagagatagaggggaagccggaatctgagggggagcctggatcagaaaccagagccgctggcaaacgacctgcggaagacgacgtgccgcgcaaggccaaaaggaagaccaataaaggtctcgcccactacctcaaggagtacaaggaagctatccacgacatgaattttagtaacgaggatatgatcagagagttcgataacatggcaaaagtccaggacgaaaagcgtaaaagcaagcaaaaattgggggcttttctctggatgcagagaaacctccaggaccctttctacccccggggcccccgagagtttcggggtggatgccgagccccccgcagagatatagaggatattccttatgtgtag

SEQ ID NO: 20965 - DNA, 231 bp, Artificial Sequence
  Description of Artificial Sequence: Synthetic coding sequence
atggagaagctgtacagcgagaacgagggcatggccagcaaccagggaaaaatggagaacgaggaacagccacaggatgagcggaagccagaggtgacctgcaccttggaagacaagaaactggaaaacgagggtaaaaccgagaataaaggtaaaaccggagatgaggaaatgttaaaggacaagggaaaaccagaaagcgaaggtgaggctaaggagggaaaaagctag

SEQ ID NO: 20966 - DNA, 648 bp, Artificial Sequence
  Description of Artificial Sequence: Synthetic coding sequence
atggagaagctgtacagcgagaacgagggcatggccagcaaccagggaaaaatggaaaacgaagagcagccccaagatgaacgaaagccagaggtgacatgtactctggaggacaagaagctagagaatgaaggcaagacagaaaacaaagggaagacaggggacgaagagatgcttaaagataaggggaagccagaatcagagggcgaggcaaaggaggggaagagtgaacgagaaggagaatccgagatggagggaggaagcgaaagagagggcaaaccagagatcgaggggaagcctgagtcggagggtgagccagggtccgaaaccagggcagctggaaagcgacctgctgaggacgacgtacccaggaaagccaagagaaagaccaataaaggtttagcacactacctcaaagaatacaaggaagctattcatgacatgaacttctctaacgaggacatgatcagggaattcgacaatatggcgaaggtacaggacgaaaaaagaaagagcaaacaaaagctgggggccttcttgtggatgcagcgcaacttgcaggaccctttctatcccagaggaccgagagagtttcgcggtgggtgtcgcgcccctcgacgagacattgaggacatcccttacgtgtag

SEQ ID NO: 20967 - DNA, 621 bp, Artificial Sequence
  Description of Artificial Sequence: Synthetic coding sequence
atggagaagctgtacaaggagaacgagggcaagcccgagaacgagcgcaacctcgaatcggaaggaaaacccgaggatgagggatccaccgaggatgagggaaagtccgacgaagaggaaaagcccgatatggagggaaaaactgagtgcgagggcaagcgggaggacgagggtgaaccaggagacgaggggcagctcgaggacgagggaaaccaggagaaacagggcaagtctgaaggtgaggataagccccaatctgagggcaaacccgcctcacaggcgaagcctgaatcccagccacgggccgccgagaaaagacctgcagaagactatgtccctcggaaggccaaacgcaagaccgatcggggcaccgatgactcacccaaggatagccaggaggacctccaggagcgccacctctcatctgaagagatgatgcgcgaatgtggcgatgtgagccgagcccaggaggagctccgaaagaaacagaaaatgggcggttttcattggatgcagcgggatgtccaggaccccttcgcccccagaggtcaacgtggggtcagaggcgtacgggggggaggccgggggcagaaggacttggaagatgttccttatgtgtag

SEQ ID NO: 20968 - DNA, 552 bp, Artificial Sequence
  Description of Artificial Sequence: Synthetic coding sequence
atggagaagccctacaacaagaacgagggcaacctggagaacgaggggaagcctgaggacgaggtcgaaccagatgacgagggtaaaagcgacgaagaagagaagcctgacgctgagggaaaaaccgaatgcgaaggaaagagaaaagccgaaggcgagcccggcgacgaggggcaacttgaagacaaaggcagccaggagaagcagggtaagagcgaaggcgagggtaagcctcagggcgaaggaaaacccgcgtcccaggcaaagcctgaaggccagcccagggctgccgagaagcggcccgctggcgactatgtgccgagaaaagccaaaaggaaaactgatcgggggacggacgattctccaaaggatagtcaagaagacctgcaagagaggcacctttcttcagaggagatgatgagggagtgtggggacgtctcaagagcccaggaagagcttcgaaaaaaacaaaagatggggggattccactggatgcagagagacgttcaggatccatttgctcagggcgataatggagtgagcggggaatag

SEQ ID NO: 20969 - DNA, 552 bp, Artificial Sequence
  Description of Artificial Sequence: Synthetic coding sequence
atggagaagccctacaacaagaacgagggcaacctggagaacgaggggaaacccgaggacgaggtcgaacccgatgacgaagggaaatctgacgaggaagaaaagcccgacgctgagggtaaaacagaatgtgaggggaagcgcaaagctgagggggagcccggcgacgagggccaactcgaggacaaaggcagtcaggaaaagcaaggcaagagcgagggtgagggaaagccccagggtgaagggaagcccgcttctcaggcaaaacccgaaggacagccgagggccgccgaaaagcgccctgctggagattacgtcccaagaaaggcaaaacgtaagaccgacaggggaacagatgattccccgaaagacagccaggaagacttacaagagaggcatctgtcctctgaagagatgatgcgcgagtgcggagacgtctcgcgggcccaggaggaactcaggaagaaacagaagatgggtggtttccattggatgcaacgcgacgtgcaggaccccttcgcccagggagacaatggcgtatccggtgagtag

SEQ ID NO: 20970 - DNA, 600 bp, Artificial Sequence
  Description of Artificial Sequence: Synthetic coding sequence
atggagaagccctacaacaagaacgagggcaacctggagaacgaggggaagcctgaagacgaggtcgagcctgatgatgagggcaaatccgatgaggaggaaaagcccgacgccgaaggtaagactgaatgtgagggcaagcgaaaggccgagggcgaacctggcgatgaggggcagctagaagataaaggttcacaggagaaacaaggcaagagcgagggagaagggaaaccccaaggcgaagggaaacccgccagccaggctaagccggagggccagcccagggcagcagagaagcggccggctggagattatgtgcccaggaaagccaagcgaaaaaccgaccggggcaccgacgatagcccaaaagatagccaggaggatctgcaggagaggcacctgtcctcagaggaaatgatgagggaatgcggtgacgtcagtcgggcacaggaggagctgcgcaagaagcagaaaatgggagggttccattggatgcagcgcgatgtccaggatcctttccccagaggacagagaggagtgcgtggcgtgcgcggaggtggaagggggcagcgcggattacatgacattccatacctctag

SEQ ID NO: 20971 - DNA, 354 bp, Artificial Sequence
  Description of Artificial Sequence: Synthetic coding sequence
atgcagaagagctgcgaggagaacgagggcaagccccagaacatgccgaaagctgaagaagaccgcccactcgaggatgtgccccaagaggccgaaggcaatccccaaccgagcgaggagggggtgagccaggaagctgaaggcaacccgagggggggtccaaaccaacctggccagggattcaaagaagacacccccgtacgccacctcgatccggaggagatgattcgaggagtggacgagcttgagagactcagagaagaaatcagaagagtgcggaacaagttcgtaatgatgcattggaagcagaggcactcccgcagcaggccctacccagtatgctttcgtccctag

SEQ ID NO: 20972 - DNA, 354 bp, Artificial Sequence
  Description of Artificial Sequence: Synthetic coding sequence
atgcagaagagctgcgaggagaacgagggcaagccccagaacatgcccaaagccgaggaagatcggccacttgaggacgtgccacaagaggcagagggcaatccgcagcctagcgaggagggcgtgtcacaggaagccgagggaaaccctcggggcggcccaaatcagcctggtcaagggtttaaggaggatacgccagtccgtcacctggaccctgaggagatgataaggggggtggacgaactcgaacgtttgcgcgaagaaataaggagggtgcgcaataagttcgtaatgatgcattggaagcaacggcactcccggtcccgcccctacccggtgtgtttccggccctag

SEQ ID NO: 20973 - DNA, 225 bp, Artificial Sequence
  Description of Artificial Sequence: Synthetic coding sequence
atgcagaagagctgcgaggagaacgagggcaagccccagaacatgccaaaggccgaagaggacaggccactcgaggacgtgccccaggaggataccccggttcgccacctggatcctgaggaaatgatccggggcgttgacgaactggagaggctgagggaagaaattcgccgggtgcgcaataagttcgtcatgatgcattggaagcagcggcacagtcggtag

SEQ ID NO: 20974 - DNA, 1155 bp, Artificial Sequence
  Description of Artificial Sequence: Synthetic coding sequence
atgccccagctggacagcggcggcggcggcgccggcggcggcgacgatctaggagcgccagacgaacttctggcgtttcaggacgaaggggaggagcaggacgacaaatctcgggactcagccgcgggaccagaacgagatctagccgaactcaaatcctcccttgtcaatgaatccgagggcgctgcaggcggagcggggataccaggcgtcccaggagccggagccggggcacgaggagaagcggaagccctcgggcgggaacacgccgcccagaggttgtttcctgacaagctccctgagcctctggaagacggactgaaagccccagaatgtacctccggtatgtacaaggagaccgtgtatagcgcctttaatctgctaatgcattatccacctccttctggtgcagggcagcatccccagcctcagccacccctgcataaagccaatcagccaccacacggggttccccagctgtccctatacgaacacttcaactcaccccatcccacacctgcaccagccgacatctcacaaaagcaggtgcataggcctctacagaccccagatttgtcaggcttctactcactgacttcgggatccatggggcagctgccccacacagtttcttggtttacacacccttctctgatgctaggcagtggagtccctggccatcctgctgcaatccctcaccccgctattgtgccgcctagtggtaagcaagaactgcagcccttcgatcgcaatctgaagacacaggccgagagcaaagctgaaaaggaggccaagaaacctacaattaaaaaaccacttaatgcattcatgttgtatatgaaggagatgagagcgaaagtgatcgccgagtgtacactaaaggagagcgcagcgatcaaccaaatactcggtcgccggtggcacgccctcagccgcgaagaacaggcaaagtactatgagctggccagaaaagagagacaactccacatgcagctgtacccaggttggagcgctcgtgacaactacgggaagaagaagaggaggtctcgcgagaaacaccaggaatcgactactgaaaccaactggccacgagagctaaaggatggaaacggccaggaaagcttgtccatgtccagttcctcatctcctgcttag

SEQ ID NO: 20975 - DNA, 1098 bp, Artificial Sequence
  Description of Artificial Sequence: Synthetic coding sequence
atgccccagctggacagcggcggcggcggcgccggcggcggcgacgatctaggtgcgccagatgaacttctggcttttcaggatgagggcgaagagcaagacgacaagtctagagacagtgccgctggacctgagcgggacctagccgagctcaagagttcactggtaaatgaatcagagggcgcggccggaggggcggggatccctggcgtgcctggtgctggggccggtgcgcggggagaggcagaggcactgggaagagagcatgcagcccagaggttatttcctgacaaattgcctgagccactggaagacgggctcaaagctccagaatgtacctcagggatgtacaaggaaacagtttactcggccttcaacttgcttatgcactacccccctcctagtggtgccggtcagcacccacagccacagccccctttacacaaggccaatcagccaccacatggtgttcctcagctgtctctgtatgagcacttcaatagcccacatcccacacccgctccagccgatatctcccagaagcaagttcaccgccctcttcagacacctgatctctccggcttttattcactcacttcggggtcaatgggtcagctgccacacactgtgtcatggttcacacacccaagtctgatgttgggctcaggcgtccctgggcacccagcagctatcccacaccccgctatcgtcccaccgtccgggaaacaagaacttcagccattcgatcgcaacctcaagacacaggccgagtccaaagcagagaaggaagctaagaagcccaccataaaaaagccacttaatgccttcatgctgtacatgaaggagatgcgggcaaaagtgatagctgagtgcaccctgaaagagtccgcagccatcaatcagattctggggaggcggtggcacgcattgtcacgcgaggagcaagccaagtactatgaacttgcccgcaaggagcgacagctccacatgcagctgtatccagggtggagcgcgagggacaattatggcaaaaagaagcgaaggagccgtgagaaacaccaggagagtacaaccgacaatagtctccactacagctag

SEQ ID NO: 20976 - DNA, 1155 bp, Artificial Sequence
  Description of Artificial Sequence: Synthetic coding sequence
atgccccagctggacagcggcggcggcggcgccggcggcggcgacgaccttggagcccctgacgagctccttgcctttcaggacgagggtgaagagcaggacgataaaagtagggatagcgccgctggacccgagcgcgatcttgccgaacttaagtcgtccctcgtgaatgagtctgagggggccgccggtggggccggcatcccaggcgtgcctggcgcaggtgcaggcgcccgaggcgaagccgaggcactcggaagagaacatgccgcccagagactcttccccgacaagttgccagaacccttggaagatgggctcaaggcacctgaatgcacctccggaatgtataaggaaacagtgtattctgcctttaatctacttatgcattacccccccccaagtggtgccgggcaacaccctcaaccacagcccccactccacaaggccaatcagccgccacatggagtaccacagctgagcttgtacgaacactttaacagcccccatccaactccagctcccgctgatattagccagaagcaggtccatcgacctctgcaaacccccgatctgtcagggttctatagcttaacatcagggagtatgggtcagctcccccacacggtgtcatggttcactcatccttccctcatgctaggctctggtgtcccaggacaccccgctgctatccctcaccctgctatagtacccccctccgggaagcaggagcttcaaccttttgaccgcaacttgaaaactcaagccgaatcaaaagccgagaaagaagccaagaaaccaaccattaaaaagcccttgaacgcctttatgctgtatatgaaagagatgagggccaaggtgatcgcagagtgtacccttaaggaatccgccgcaataaatcagattctgggccggcggtggcacgcactgagccgtgaggagcaagcaaaatattacgaactcgctagaaaggaaagacaactacacatgcagttataccctgggtggagcgcacgcgataactatggtaagaagaagaggaggtcgcgcgagaagcaccaagagtctacaacgggtggcaaaagaaacgctttcggaacttatcctgagaaggcggccgctcccgcacctttcttaccaatgacagtgctgtag

SEQ ID NO: 20977 - DNA, 1485 bp, Artificial Sequence
  Description of Artificial Sequence: Synthetic coding sequence
atgccccagctggacagcggcggcggcggcgccggcggcggcgacgacctgggcgcccccgacgagctcctggcgttccaggatgagggcgaggagcaggacgacaagtctcgtgattcagccgccgggcccgaacgggatcttgccgaactgaaatcaagcctggtaaatgagtctgagggggccgcagggggtgctggaattcctggggtgccaggcgcgggggcaggggcccgcggagaggctgaggcactaggtcgtgaacatgccgcacagcgcctcttccctgataagctgcccgagccattggaagatggtcttaaggcccctgagtgcacatccggtatgtataaggagactgtgtactcagcatttaacctcctaatgcattacccaccacctagcggtgcaggtcagcacccacagcctcaacctccgctgcacaaggccaaccagccaccacacggggtcccccaactatctctctacgagcatttcaactccccgcaccctacgcccgctcccgccgatatctctcagaaacaagttcacaggccactccagacaccagaccttagcggcttttactccttaacttcgggctctatggggcaactcccgcataccgtctcttggttcacgcacccttcactgatgctgggctctggagtacctggccaccctgccgcaatcccccaccctgccattgtgcccccctcagggaagcaggaattacagcccttcgacagaaatctgaagactcaggccgaaagcaaggccgagaaggaggctaagaagcccacaatcaaaaagcccctgaatgcttttatgctttacatgaaagagatgcgcgcgaaagttatcgccgagtgcaccctgaaagagtccgctgccatcaaccagatattgggtcgtcgctggcacgcattatccagagaggaacaggctaagtactacgaactggccaggaaggaaaggcagcttcatatgcagttatatccagggtggtcggctagggataactatggcaaaaaaaaacggaggtccagagagaaacatcaggaaagcacgacggatccaggcagccccaaaaagtgcagagcgcgcttcgggctgaaccagcagacagactggtgcggaccttgccggaggaaaaaaaaatgtatacgttatctaccaggcgaaggcaggtgcccctcccccgtgcctagcgacgattccgccctgggctgtcctgggtccccagcgccccaggactccccctcctaccacctcttgccacggtttcccacagaactactcacaagtcctgcccgccacctgcacccacaggtcagtccactgctgagtgcctcccagccacagggtccacacagaccgcctgccgcgccctgccgggcccacagatattcgaacaggaacttgagagacagatggccttcgagacaccgcactccaggccgtcttcaggagccaactccgtag

SEQ ID NO: 20978 - DNA, 807 bp, Artificial Sequence
  Description of Artificial Sequence: Synthetic coding sequence
atgtacaaggagaccgtgtacagcgccttcaacctgctgatgcactatcccccaccatccggcgctggccagcaccctcagccccagccccccctccacaaggcaaaccagccccctcatggtgtgccccaactatcactctacgaacatttcaattcgccccatccgacacctgcccctgcagacatctctcaaaagcaggtgcacagaccgctgcagactcccgatctgtcaggattctactctttaacaagcgggtctatggggcagctgccgcacacagtctcttggttcacacacccttcactgatgctggggagcggcgtccctgggcacccggccgcaatacctcacccagcaatcgtgcccccctcaggaaaacaagagctgcagccattcgatcggaacctgaagacccaggccgagtcgaaagcagagaaggaggcaaagaagcccaccatcaaaaagccactgaacgcctttatgctgtatatgaaggagatgagagcaaaggtgatcgccgagtgtactctgaaggagtcagcggccattaatcagattctcggccgccgctggcatgcgctatcaagggaggaacaagccaaatattatgagctggcccggaaagaaaggcagttgcacatgcaactatatcctgggtggagcgcgagagataattatggcaaaaagaagcgacggtcacgggagaagcaccaggaaagtactacagaccctgggtccccaaaaaagtgcagagcacggttcggcctcaaccagcagactgattggtgcggcccttgccgctag

SEQ ID NO: 20979 - DNA, 1110 bp, Artificial Sequence
  Description of Artificial Sequence: Synthetic coding sequence
atgccccagctggacagcggcggcggcggcgccggcggcggcgacgatctgggtgctccggatgaactcctggcttttcaggacgagggtgaggaacaggacgacaaaagtagggactccgccgctggccctgagcgggacctggccgaacttaaatcttcacttgttaacgagtcagagggcgccgcaggtggagccgggattcctggggtgcccggcgccggagccggcgcacgaggcgaggcagaggctctcggacgagagcatgctgcccagcgcctgtttccggacaagttgcctgagcccctggaggacgggctcaaggctcccgaatgtaccagtggtatgtacaaggagacagtatatagtgcgttcaacctgctgatgcactacccccctccttccggagccgggcaacatccacagccgcagccgccgttgcacaaagctaatcagccgccccacggcgttccacagcttagcctgtatgagcatttcaatagtccacaccctacgcctgctccagccgatatttctcagaagcaggttcatagaccacttcagactcccgatctttctggattctatagcctgacctctggctctatgggccaactgccacacacagtgagctggttcacacatccttccctgatgctcggatccggggtgccagggcaccccgccgctataccccaccctgccattgtcccgccatccggcaaacaggagctacagccttttgaccgaaacctaaaaacccaagctgagagtaaggcagaaaaagaagcaaagaagccgacaattaagaagcctctaaatgcctttatgttgtacatgaaggaaatgcgtgccaaggtgatcgccgagtgcactttgaaagaatcggcggctattaaccagatccttggaagacggtggcatgccctcagtagagaggagcaggctaaatattatgaacttgcccgaaaagaacgccagcttcacatgcagctgtacccaggatggtccgccagggacaattacgggaagaaaaaaagacgcagcagggaaaaacatcaggaatcaacaacggacggcatccctgcctgcaccatcttgagcccctag

SEQ ID NO: 20980 - DNA, 810 bp, Artificial Sequence
  Description of Artificial Sequence: Synthetic coding sequence
atgtacaaggagaccgtgtacagcgccttcaacctgctgatgcactatcccccccctagcggcgccggccagcacccacagccacagcctcccctgcataaggccaaccagcccccacacggcgtccctcagctgtcgttatacgagcatttcaatagcccccatccaacaccagcacccgctgatatttcccagaaacaggtgcatcggcccctgcagaccccagatctctccggcttttattccctgaccagcgggagcatggggcaactgccacatacggtaagctggtttacccacccctctttaatgctgggtagcggcgtccctggacaccccgcggctatcccccaccctgccatcgtgccccctagcgggaagcaggagttacagcctttcgatcgcaacttaaaaacccaagcagagagcaaagccgaaaaagaggcaaagaaacctaccattaaaaaacctcttaacgctttcatgttgtatatgaaagagatgagagccaaggtgatagcagaatgtaccctgaaggagagtgctgccatcaaccagattttgggacgaagatggcacgccctttctcgagaagaacaggccaaatattatgagttagcccggaaagagcgacaactgcacatgcagctctacccaggatggagtgccagggataactacggcaagaagaagcgacggtcaagggaaaaacaccaggaatccactactggcggtaagcgaaacgcttttggcacctacccagaaaaggccgctgccccagcaccctttctgccaatgacagtgctatag

SEQ ID NO: 20981 - DNA, 1446 bp, Artificial Sequence
  Description of Artificial Sequence: Synthetic coding sequence
atgccccagctggacagcggcggcggcggcgccggcggcggcgacgacctgggagcccccgatgaactgttggctttccaggatgaaggagaagagcaggatgacaagagcagggactccgctgcaggaccagaacgagacctggcagagctaaagagcagtctggtgaacgagagtgaaggtgcggccgggggcgccggcatcccaggggtgcccggggcaggggctggcgcacgcggcgaggccgaagccctcggccgcgaacatgccgcacaacggctcttcccagataaactgccagagcccctggaggatgggctgaaagcccccgagtgtacaagcggtatgtataaggaaactgtttattctgctttcaacctgctgatgcactacccgccaccctctggagctggccaacatcctcaaccgcagcctccccttcataaggcaaaccagcctccgcacggcgtccctcaactttcactctatgaacactttaattcccctcatccaacacctgcccccgccgatatctcacagaagcaggtccacaggccgttgcagacaccagacttgtctggcttctattctctgacgagcgggagtatggggcaacttcctcacacggtgtcctggttcacacaccctagccttatgctgggctccggcgttcccggacatcccgcagcaatcccgcacccggccatcgtgcctccaagcgggaaacaagagctgcagccatttgatcgtaacctgaagacccaggccgaatccaaggcagagaaagaggccaagaagcctaccatcaagaaacctttgaacgccttcatgctttacatgaaggaaatgcgggcaaaggttatcgctgagtgcaccctcaaagaaagtgccgctattaatcagatcctgggtagaaggtggcacgccctaagtagagaggagcaggcaaaatactatgaactggctcggaaggagcggcagttacatatgcagctttaccccggctggtctgcaagggacaactacggaaaaaagaagcgtaggtcaagagagaaacaccaagagtcaaccacagaccccggctcaccaaagaagtgtagggcccgctttgggcttaaccagcagactgattggtgcgggccctgtcgcagaaagaagaaatgtattcgctaccttccaggggaaggccgatgtccctcccctgttccttcagatgactctgccctcggttgtcccggaagccccgccccccaggattcccctagttaccatctgctgccaagattcccgaccgagctgttgacctcaccggccgaacctgcaccgacctcacctggtctgagcaccgccctttctctaccaacccccggccctccacaagccccgcggtctaccctacagagtactcaggtgcaacaacaagaatcccagcgccaggtggcctag

SEQ ID NO: 20982 - DNA, 1101 bp, Artificial Sequence
  Description of Artificial Sequence: Synthetic coding sequence
atgtacaaggagaccgtgtacagcgccttcaacctgctgatgcactatcccccaccctctggtgccgggcagcacccccaacctcaaccgccgctgcacaaggcaaatcagcccccccacggcgtgccccagcttagcttatacgaacattttaatagccctcatcccacacctgcaccagctgacatttctcaaaaacaggtgcaccgcccgcttcagaccccggatcttagcggattttactccttgacatctgggtccatgggtcagctcccacataccgtgtcctggtttacacatccgtctcttatgcttggtagcggtgtgccaggtcaccctgccgccattccccaccccgccattgttccaccatcgggtaagcaggaactgcaaccattcgatcgaaacctgaagacccaggccgaatccaaggcggagaaggaagctaaaaagcctaccattaaaaagccattgaatgcttttatgctctacatgaaggagatgcgcgccaaggtcattgccgaatgcaccctgaaagagtcagctgcaataaatcagatcctggggcgacggtggcacgccctgagcagggaggagcaggcgaaatactatgagttggccaggaaggaaaggcaattgcacatgcagctctaccccggatggtctgcacgagacaattatggcaagaaaaagcgcagaagccgggagaagcatcaggagtccacaaccgatcctggaagtccgaaaaaatgcagagcccggttcgggctgaatcagcagaccgactggtgtggcccatgccgacggaaaaagaaatgcatcaggtacctccccggggagggccggtgcccaagtccagtgcccagcgatgactccgctctgggctgtcccgggtccccagccccacaagacagcccatcttaccaccttctgccccgcttcccgactgagctgctgacatcccctgcagagcccgcacctacctcacccggcctgtccactgcattgtctctgcctacgcctgggcccccccaagcgccacggtcaacactgcagtcaactcaggtacagcagcaggaatctcagaggcaagttgcctag

SEQ ID NO: 20983 - DNA, 372 bp, Artificial Sequence
  Description of Artificial Sequence: Synthetic coding sequence
atgtacaaggagaccgtgtacagcgccttcaacctgctgatgcactacccgcccccttccggcgcaggccaacacccacagccccagccgcccttacacaaagctaaccagcctccccatggggtaccgcaactgtcgctctatgagcattttaattcaccccaccctacacccgcgcccgcagacattagccaaaagcaggtccataggccgctccagactcctgacctctctggcttctatagtctgacatccgggtctatggggcagttgccccatacggtttcttggtttactcatccatccctgatgctcggaagtggggttccaggccatccagctgcgatcccacacccagccattgtgccatag

SEQ ID NO: 20984 - DNA, 810 bp, Artificial Sequence
  Description of Artificial Sequence: Synthetic coding sequence
atgtacaaggagaccgtgtacagcgccttcaacctgctgatgcactaccccccccctagtggcgcgggacagcaccctcaaccacagccgcccctgcataaagccaaccagccccctcatggagtaccgcaactttcactgtatgagcatttcaactccccccaccctacaccagctcccgccgacatttcacagaagcaagttcaccgccctctgcagaccccagatttatccgggttttacagcttgaccagcggcagcatgggtcagttgccacatacagtttcttggtttacacacccctccctaatgctaggctcaggagttcctgggcatcccgctgctataccacaccccgcaatcgtcccgcctagcggtaaacaggaactccagcctttcgaccgaaaccttaagacccaggcagaaagcaaagccgagaaggaggcgaaaaaacccactataaagaagccgttaaacgctttcatgctgtacatgaaggaaatgcgtgcgaaagtgatcgctgagtgtaccctgaaggagtctgccgccatcaatcagattctgggcaggagatggcatgctctgagcagggaagagcaggcaaagtattatgagctggccagaaaggaacgacagctgcatatgcaactgtatccaggatggtctgcgcgcgataattacggcaaaaaaaaacgtcgttctcgagagaaacatcaagagagtaccacggaaactaattggcccagggagctcaaagacggtaacggccaggagagcttgtcgatgtcaagtagctccagtcctgcctag

SEQ ID NO: 20985 - DNA, 444 bp, Artificial Sequence
  Description of Artificial Sequence: Synthetic coding sequence
atgtacaaggagaccgtgtacagcgccttcaacctgctgatgcactaccctcctccttctggggccggacagcatcctcagcctcagcccccccttcacaaggccaatcagcccccccatggcgttccacagctgtccttgtacgaacactttaattctccccaccccacacccgcacctgccgacatctcgcaaaaacaggttcaccgacctctgcagactccagatctatccggattttatagtcttacctcagggagcatggggcagttaccacatacagtctcttggtttacgcatcctagccttatgctggggtccggtgttccaggccatcccgcggctattccacatcccgctattgtgcccccctcgggcaaacaggagcttcaaccatttgatagaaacctcaaaacccaggccgagagcaaagcagagaagtag

SEQ ID NO: 20986 - DNA, 1767 bp, Artificial Sequence
  Description of Artificial Sequence: Synthetic coding sequence
atgccccagctgggcggcggcggcggcggcggcggcggcggcagcggaggtggtggcggaagcagtgccggggcggccggaggcggggatgatctgggtgctaacgacgagttgattccgtttcaagacgaaggtggtgaggaacaggaaccaagctccgactctgccagtgcgcagcgagaccttgatgaggttaaatcttcgttggtgaatgaatctgaaaaccaatcctctagctctgatagcgaagccgaacgtagaccacagcctgttagagatacatttcaaaaaccacgcgactacttcgctgaagttcgtagaccacaggattctgccttcttcaagggtcccccgtacccagggtacccatttctgatgatccctgacttatcatccccttatttgagtaacggccccctctcccctggaggcgctaggacatacctgcaaatgaagtggcccctcctggatgtgccgagctcagccacggtgaaagatacccgctctcctagccctgcacatcttagtaacaaggtgccagtcgtccagcacccacaccacatgcatcctctgactcctctgattacgtatagcaatgaccacttctcgcctgggtcgccgcctacccatctgtcccccgagatagatccgaagactgggattccgcgccctccacaccctagtgagctctccccctactacccactttcacccggcgctgttgggcaaattcctcacccattgggctggttggtgcctcagcagggccagcccatgtattctctgcctccaggaggatttagacatccctaccccgccctggcgatgaatgcttccatgtcctctctggtgtcctccagattttcgccacacatggttgcccccgctcaccctggactccccacgtctggcatccctcaccctgctattgtttcccctatcgtaaaacaggagcccgctccacccagtctgtctcctgccgtcagtgtcaaatcccccgtgactgtgaaaaaggaggaggagaagaaaccccatgtgaaaaaaccccttaatgctttcatgctgtacatgaaagagatgcgcgctaaggttgttgctgagtgcaccctgaaggagtccgctgccattaatcagatcctgggcagaaagtggcacaacctatctagagaggaacaggctaagtattatgagctggctcgcaaagagcgccagctgcactctcagctttatcctacctggtccgcgcgggataactatgggaaaaagaagaaaagaaaacgcgagaagcagctgtctcagacccagagtcaacagcaggtccaggaagcggaaggagctttagcttccaaaagtaagaagccttgcgttcagtacctccctcctgagaagccttgtgattccccagctagctctcacgggtccatgctcgactcacctgcgactccttccgccgcccttgccagtcccgccgctccggctgccacccactccgaacaggctcagcccttgtctctcactacaaaacctgaaacacgcgcccagctcgccctccactccgctgcctttctatctgccaaagccgccgcaagttccagcggccagatgggctctcaacccccactcctaagcaggcctctgcctctgggaagcatgcccaccgccctgttggcatccccgccatcctttccagccactcttcatgcccatcaagccctccccgtattgcaggcgcaacccctcagtctcgtcaccaagtccgctcactag

SEQ ID NO: 20987 - DNA, 1017 bp, Artificial Sequence
  Description of Artificial Sequence: Synthetic coding sequence
atggagtacttcatggtgcccacccagaaggtgcccagcctgcagcacttccgaaagactgaaaaagaggtcataggcggcctgtgcagtctggccaatatacctctgacaccagagacccaacgagatcaggaacgaaggatcaggcgcgaaatcgcaaactcaaatgaacggaggaggatgcagtctatcaacgctggatttcaatccttgaagacactgatccctcataccgatggggagaagctcagtaaggcggctattctgcagcagaccgcagagtacatattttcccttgagcaggagaagactcggctgctgcaacaaaacacacaactcaagaggttcatccaggagctgagtggtagcagtcccaaaaggcgacgcgctgaggataaagatgagggtattgggtctcctgatatctgggaagatgagaaggcagaagacctccgccgggaaatgatcgagctgcggcagcagctggataaggagcgcagcgtgcggatgatgcttgaggagcaggtacggtcactggaagcccacatgtatccagagaagcttaaagtgatcgcgcagcaggtccaactgcagcaacagcaggagcaggtgaggctgcttcaccaggagaagttggaacgcgaacagcagcaactgcgcacacagttactgcccccgccagctcctacccatcacccaacagttattgtgcccgcacccccgcctccaccctcccatcacatcaatgtcgtaactatgggcccgtctagtgtgattaactcggtttcgacgtcccgacagaatctggacacgattgtccaggctatccagcacattgaaggtacccaggaaaagcaagagctcgaagaagagcagagacgcgctgtgattgtgaaaccagttagatcctgccccgaagcccctacttctgatacagctagcgacagtgaagcctctgattctgacgctatggatcagagccgcgaggagccctcaggagacggagaactaccttag

SEQ ID NO: 20988 - DNA, 741 bp, Artificial Sequence
  Description of Artificial Sequence: Synthetic coding sequence
atgtaccaggtgagcggccagcggcccagcggctgcgacgccccctatggcgctcccagcgcagccccagggccagcacagaccttgtctttgctgccggggctggaagtcgtgaccggatctacacatccagcggaagcagctcccgaggaaggcagtctagaagaagcggcaacgcctatgccccaggggaacgggcccggtatcccccagggtctggactccacagacctggacgtgcctaccgaggctgtaacttgccaaccgcaagggaacccgctcgggtgtactcctttgctaccgaatgattccggccaccctagcgagctcgggggtaccagacgcgccggcaatggtgccttgggcggtccaaaagctcatcgcaagctgcagacgcacccaagccttgcctcccagggctctaaaaaatccaagtcgagttctaagagcacaacttcccaaattcccttgcaggcgcaggaggattgttgcgtgcactgtattctgagttgtttgttttgtgagtttctgaccctgtgcaatatcgtgttagactgcgcaacatgcggctcatgtagctccgaggattcatgcctctgctgctgttgctgcgggagtggcgaatgtgctgattgcgacctgccatgcgatctggattgcggcatcctggacgcatgttgtgagtccgctgactgcctcgagatttgtatggagtgctgtggactgtgtttcagttcatag

SEQ ID NO: 20989 - DNA, 1689 bp, Artificial Sequence
  Description of Artificial Sequence: Synthetic coding sequence
atgagcgaggaggaccggaccttcagcttcggccccggcacccggaaacttgggtttatgagccaactgagtcccgcgtgctctgtgaccctgggtaagagcttgccattatctggactgggagtgtttagtagcaaaatggacgccgtcccagtcatcctggcctcaccctgtcagcctctgtgctttgaagaagatacttgtctcatttacctcttacccctcctcatccatcgcgagcccgcccctgcagccaccatggcctccagaattggcctgcgaatgcaacttatgcgagagcaggcgcagcaagaggagcagcgcgagcgtatgcagcagcaggctgttatgcactacatgcaacagcagcagcagcagcagcagcagcagctgggaggcccccctacccccgccatcaacacccccgtgcatttccagtctcccccaccagttcctggcgaggtactgaaagttcaaagttatctcgagaatcccacctcataccaccttcagcagtcacagcatcagaaggtgcgtgagtacctgtctgaaacctatggtaataagttcgcggctcatatcagccccgctcaaggtagtccaaagccaccccctgccgccagtcccggggtgcgcgcaggccacgtgctttcaagctcagctgggaattcggccccaaattcgccgatggcaatgctgcacatcggcagcaaccccgaaagagagcttgacgatgtcattgataacattatgagactggatgacgtcctcggctacatcaatccagaaatgcagatgcccaataccttaccactctcatctagccatctgaatgtgtattcctcggatccgcaggttacagcctcgctggtgggagtcacttccagctcatgtcctgcagacctgacacagaaacgggaactgacagatgctgagagccgggcactggcaaaagaacgacaaaaaaaggacaatcataacctgatcgagagaaggcggcgctttaatattaacgacaggattaaggagcttggaatgttaataccaaaagctaatgatttagacgtgaggtggaacaagggaactatcctgaaggccagcgtcgattatattcggcgaatgcagaaagacttacagaagtcgagggaactggaaaaccatagcagacgcttggaaatgacaaacaagcagctgtggctccgcattcaagagctggaaatgcaggcaagagtgcacgggttgcctacaacctcgcccagtggcatgaatatggcagaactggcgcagcaagtggtgaaacaagaacttccttctgaggaaggccctggtgaagctctaatgctcggcgccgaggttccggacccagaaccgctgccagccctacctccccaagcaccccttccgttacccacacaacccccctcaccgtttcaccatctagatttttcacacagtctgtcttttggcggtagggaagacgaaggacctcccggatacccagaacccctcgcccccggccatggctctcctttcccaagcctgagtaagaaagacctagacctgatgctgctggatgattcgcttctacccctggcatccgatcccctcctatcaacgatgtctccagaggcttcaaaggcaagttcccgccgatcctcatttagcatggaagaaggggacgttttatag

SEQ ID NO: 20990 - DNA, 1473 bp, Artificial Sequence
  Description of Artificial Sequence: Synthetic coding sequence
atgaccgccagcagcggctgggagcccgcccccgccgccaccatggccagcaggattggtttgagaatgcagctcatgcgggagcaagcccagcaagaggaacagagggagcggatgcagcagcaagcggttatgcactatatgcagcagcagcagcagcagcagcagcagcagctaggcgggccccctacccccgcaatcaacaccccggttcacttccaatcgccaccaccagtgcctggcgaggtccttaaagtgcagtcatatttggagaatcctaccagctaccacttgcagcaaagccagcaccaaaaagtcagagagtacctgtctgaaacttacggtaataaattcgctgcacacatctctccagctcaggggtcaccgaaacctcctcctgcggccagtccaggcgtacgggctgggcatgtgcttagcagcagcgctggtaacagcgcacccaatagccccatggctatgctgcatataggcagtaatcctgaaagagaactcgacgacgtcatagacaatattatgaggctggatgacgtcctgggctacatcaaccccgagatgcaaatgcccaatactcttccactctcctcatctcacttgaatgtgtacagctctgacccccaggtcacagccagcctggttggagtgacttcctcctcttgtcctgccgacctgacacaaaaaagagagttaactgatgctgaatcgcgcgctcttgcaaaagaaagacagaagaaggataatcataatttgatcgagcggcggagacggttcaatatcaacgaccggattaaagaactgggtatgctaatcccgaaggcaaacgatctggacgtgcgatggaataaaggtaccatcctcaaggcctcagtcgactatatacggcgcatgcagaaggacctacagaaaagtagagagctggaaaatcacagccgccgcctcgaaatgactaataagcagctgtggctcaggatccaagagctggaaatgcaggcgcgagtgcatgggttaccaactacctcaccgtcagggatgaatatggcagaactcgcccagcaggtcgtgaaacaggagctgcccagcgaagaagggccaggcgaggcgttgatgcttggggccgaagtgccagaccctgaacctctgcccgctctaccaccgcaggccccgctgcctctgccaacccagccccccagtccattccaccatctagacttctcccatagcctgagctttgggggcagggaagatgaaggaccacctgggtatccagaacctctggcacctggacacggctcaccttttccctcactttctaaaaaggatctggatctgatgctgcttgatgacagtctcctgccacttgcctccgaccctctcctttccactatgagtccagaagccagcaaggcctccagccgcaggagttccttcagcatggaagagggcgatgtcctatag

SEQ ID NO: 20991 - DNA, 1431 bp, Artificial Sequence
  Description of Artificial Sequence: Synthetic coding sequence
atggccagccggatcggcctgcggatgcagctgatgcgggagcaggcgcaacaggaggagcagagagagcggatgcagcaacaggcggtcatgcactacatgcagcaacagcagcagcagcagcaacagcagctgggagggcccccaactcccgctatcaacacaccggtgcacttccagagcccgccaccggtgccaggtgaggttttgaaagtgcagagctacttggagaaccccacaagctatcatttgcagcagtcacagcaccagaaggtgagggagtatttgtcagagacctatgggaacaaatttgctgcccacatcagccccgcccagggatcccccaaacccccccctgccgcgtccccaggcgtccgtgccgggcacgtgctttcctccagcgcaggtaactcagcaccaaacagccctatggccatgctgcacatcggctccaatccggagagggaattggatgatgttattgacaatattatgagactggatgacgtgctggggtatatcaatccagaaatgcaaatgccaaacactctccccctcagctcctcacatctcaacgtttacagctccgatcctcaagttactgcttcgctcgtgggagttacgagctcttcatgccctgctgatctgactcaaaaaagggagttgaccgacgccgaatcccgagctctggccaaagagcggcagaagaaggacaatcacaatctgattgaaagacgacgacgattcaacatcaatgatcggattaaagaactgggaatgttgatcccaaaggccaatgacctcgacgtgcggtggaacaaggggactattttgaaagcctccgttgactacattcgccggatgcaaaaggacctgcaaaaaagcagggaactggagaaccacagcagacggttggaaatgacgaataaacaactatggctcagaatccaggagttggagatgcaagccagggttcacggactgcccacaactagtcctagtggcatgaatatggccgagctcgcccaacaggtcgtaaagcaggagctgccatccgaggaggggccaggcgaggccctgatgttaggagctgaggtccctgatcccgagccactgccggcgctgcctccccaagcacccctgcccctcccaacacagccaccaagccctttccaccaccttgacttctctcacagcctcagtttcggaggccgggaggatgaagggccccctggctatccagagccgctggccccaggacacggatcccctttccccagtttgtcaaagaaggacctggatcttatgcttctcgacgactcactcctcccactggcaagcgacccactgctctcaacaatgtcgcctgaagcttcaaaagcatcgtccagaagatctagcttttccatggaggagggcgatgtgctgtag

SEQ ID NO: 20992 - DNA, 807 bp, Artificial Sequence
  Description of Artificial Sequence: Synthetic coding sequence
atggccagccggatcggcctgcggatgcagctgatgcgggagcaggcccaacaggaagagcagcgggaacgcatgcagcagcaagcagtcatgcactatatgcaacagcagcagcagcagcagcagcaacagctgggtgggccccctacacctgctattaacacacctgttcactttcagtcacctccccctgtgcccggagaggtcttgaaagtgcagtcatacttggagaatcctaccagctatcacctgcagcaaagtcagcaccagaaggtgagagaatacctgtctgagacttatgggaacaagttcgctgcccacatttcacctgctcaaggcagccctaagcccccccccgctgctagcccaggggttagagctgggcatgtactgtcgagtagtgctggcaacagcgcgcccaactctcctatggcaatgcttcatattgggagcaaccctgaaagggagctcgacgacgtgatcgacaacattatgagacttgacgatgttcttgggtatattaatccagaaatgcagatgcctaacaccctgcctctctcttcttcccaccttaatgtgtactcctcggacccgcaggtgaccgcctctcttgtgggcgttacctcttcttcttgcccagccgatcttacgcagaaaagagagttgaccgacgccgagagccgggcattagcaaaagaaaggcagaagaaggataaccataatctcatcgagcggcgccggaggttcaatatcaatgatcgtatcaaagagctgggcatgcttatccctaaggctaatgacctttag

SEQ ID NO: 20993 - DNA, 1431 bp, Artificial Sequence
  Description of Artificial Sequence: Synthetic coding sequence
atggccagccggatcggcctgcggatgcagctgatgcgggagcaggctcagcaggaagaacaacgggagagaatgcaacagcaggccgttatgcactacatgcagcagcaacagcagcagcagcagcagcagttaggaggcccccctactcctgccatcaatactcccgtgcattttcagtctccacctcctgtgccgggggaagttttaaaggtccagtcctatctcgagaaccctacaagctatcacttgcaacagtctcagcatcagaaagtccgcgagtatctgagtgagacatacggtaataagttcgccgctcacatttcccctgcccaggggagtccaaaaccacctccggctgcatcccccggtgttcgcgccggccatgtgctgagctcttcagccggcaattccgctcctaactcaccaatggccatgttgcacataggaagcaatccagagcgagagctagacgacgtgatagataacattatgcgcctggacgacgtgttggggtatattaacccagagatgcagatgcctaataccctgccattatctagtagtcacctgaacgtgtactcctctgaccctcaggtcaccgcttcgctggtgggcgtgacgagctcttcctgtcccgctgatctgacacagaagcgtgaactgaccgacgccgagagtagggctcttgccaaagagaggcagaaaaaagataaccataacctgatcgaaaggagacgacgctttaatataaatgatcgcattaaggagctgggcatgctcattcctaaggctaatgatttggatgtcaggtggaacaaaggcaccatcctgaaggcatctgtggactatattagacgcatgcagaaagatctgcagaagagccgggagcttgaaaaccacagtcgccgactggaaatgaccaataagcaactctggttgagaattcaggagctggaaatgcaggctcgggtccacggactgccaacgacctcacccagcgggatgaacatggccgaactggcccagcaggtcgtgaaacaggaactgccatctgaggaggggccaggggaggctctgatgttaggggcggaagtgcctgaccccgagcctctgccagcactcccaccacaagctcccctccccttgcctacccaacccccgtccccttttcatcacctggattttagccacagtctctctttcggcggcagagaagatgagggaccccctggctatcctgagcctctggcacccgggcatgggtcgccatttccatcactcagcaagaaggatcttgatctgatgcttctagatgactccttactgcctctagcctcggacccacttctaagtacaatgagccccgaagcgtctaaggcctcctcccgaagaagcagttttagcatggaggagggagacgtgctttag

SEQ ID NO: 20994 - DNA, 735 bp, Artificial Sequence
  Description of Artificial Sequence: Synthetic coding sequence
atggccagccggatcggcctgcggatgcagctgatgcgggagcaggcccaacaggaggagcagcgagagcgcatgcagcaacaggctgtgatgcactacatgcagcagcagcagcaacagcagcagcagcaattgggaggtccgcctacccccgccattaacactcccgtccacttccagtctccaccacccgtcccgggcgaagtgctgaaagtgcagtcatatctcgaaaaccccacttcctatcacttgcagcagtcccagcaccaaaaagttagggagtacttgtccgagacgtacggtaataagtttgctgcccacatctcaccggcccagggcagccccaaacctccaccggcggcatcccctggcgtccgcgcagggcacgttttatcttcctccgctggcaatagtgctccaaactcacccatggctatgctccacattgggtctaatccagagcgagagctggatgatgtaatagataatatcatgcgactggacgatgtgctgggctacattaaccctgaaatgcaaatgccgaacactcttcccctgagttcttctcatctgaatgtgtacagtagcgatccacaggtaacagccagcctcgttggtgttactagctcatcctgcccagctgacctaacacagaagcgggaattgacagatgccgaaagccgggcactggcaaaagagagacagaaaaaagataaccataacctcatcgagtag

SEQ ID NO: 20995 - DNA, 807 bp, Artificial Sequence
  Description of Artificial Sequence: Synthetic coding sequence
atggccagccggatcggcctgcggatgcagctgatgcgggagcaggctcaacaggaggagcagcgcgaacgaatgcagcaacaggcagttatgcactacatgcaacagcagcagcagcaacagcagcagcagctcggcgggccaccaactcccgctatcaatacgccggtccattttcagagcccaccccccgtgcccggagaagttctcaaggtgcagtcttatctggaaaacccaactagctaccatttgcagcagagtcagcatcagaaagttcgcgagtacctgagcgagacctatgggaacaaattcgcagcccacatatcacctgctcagggtagcccgaagcctccaccagccgcctcacccggtgtcagagccggtcacgtcctctcttcatctgccggtaattccgcacctaatagccctatggcaatgttgcacatagggtcaaatcccgagagagaattggatgacgtcatagataatataatgaggctggacgacgtgctgggctacatcaaccctgaaatgcagatgcccaataccctgccactttcttcatcccatttgaacgtgtatagttccgacccccaagtgactgccagtcttgtgggcgtgacctcgtcctcctgccccgctgaccttacccagaaaagagaactgactgacgcggagagccgtgctctggccaaagagcgccaaaagaaggacaaccataatcttatcgagagacggaggagattcaatatcaacgaccgcatcaaagaactgggcatgctgattcccaaggcaaatgacctctag

SEQ ID NO: 20996 - DNA, 672 bp, Artificial Sequence
  Description of Artificial Sequence: Synthetic coding sequence
atggccagccggatcggcctgcggatgcagctgatgcgggagcaggcgcaacaggaggagcagagagagaggatgcaacaacaagcagtgatgcactacatgcagcagcagcagcagcaacagcaacagcaactcggtggaccgcctacccctgctattaacacccctgttcacttccaatctccacctccagttcctggtgaagtgttaaaagtccagagctacctggagaatccaacaagttatcaccttcagcagtcgcagcatcaaaaggtacgcgaatatctctccgaaacttatggaaacaagtttgcagcacatatctcccccgcccaaggcagcccaaagccgccaccagcagcgagccctggagtaagagccgggcacgtgctgagctccagtgctggcaactctgcacctaactcccctatggcaatgctgcacataggctctaatcctgagcgcgaactcgatgacgtgattgacaacattatgcgcctggacgatgtcttgggttacatcaaccccgaaatgcaaatgccgaacaccctgcctctatcgagtagccacctcaacgtgtattcttcagatcctcaagtcacagcatcattggttggagtgacttccagctcatgccctgccgatctgacgcaaaagcgggaactgacttag

SEQ ID NO: 20997 - DNA, 216 bp, Artificial Sequence
  Description of Artificial Sequence: Synthetic coding sequence
atggccagccggatcggcctgcggatgcagctgatgcgggagcaggctcagcaggaagagcagcgggaaagaatgcagcaacaggccgtcatgcactatatgcaacaacagcagcagcagcagcagcagcagctgggggggccccctacacctgcaattaatacccctgtacacttccagagcccgccaccagtgccaggggaggttctgaagtag

SEQ ID NO: 20998 - DNA, 1176 bp, Artificial Sequence
  Description of Artificial Sequence: Synthetic coding sequence
atggccagccggatcggcctgcggatgcagctgatgcgggagcaggctcagcaggaggagcagagagaacgcatgcagcaacaggccgtgatgcactatatgcaacagcagcagcagcaacagcagcagcaactgggcggccccccaaccccggcaatcaataccccggtacacttccagtccccgccacccgtgccaggggaggtgctgaagctggacgacgtgatagacaacataatgcggctggacgacgtgcttggatatataaatcccgaaatgcagatgcccaatacattgcctctgagcagctcccatttaaacgtgtacagttccgatcctcaggtgacagcctcccttgtgggggtcacatcttccagctgccccgcggacctgacccagaaacgggaactgaccgatgcagagagccgtgctttagccaaggaaagacaaaagaaagataatcacaatctgatcgaaaggcgccgcagattcaacatcaatgaccggatcaaggagttaggtatgctgatcccgaaagccaatgaccttgacgtacgttggaacaaggggactatcttgaaggcttccgtcgattatattagaagaatgcaaaaagatttgcaaaagtcccgagagttagagaatcatagcaggcggctagaaatgaccaataaacagttgtggctcagaatccaggaattggagatgcaggcccgggtgcacggcttgcccaccacgtcccccagtggcatgaatatggccgaactggcccagcaggttgtgaaacaggagttaccctccgaggaaggccccggggaggctctgatgctcggcgcggaagtaccagaccccgagcccctgcctgcgcttcccccccaggccccattacccctgccaacccagccaccatcgcccttccaccatcttgacttctcccatagtttgagctttggcggcagggaggacgagggcccccctggttaccctgaaccattagctccaggacatggaagtccgtttccgtcccttagcaagaaggatctggacctgatgctcctagacgactcgcttctgccccttgcttccgatccactgctgtcaacgatgtctcccgaggccagtaaagcatcctctagacgttcctccttttctatggaagagggcgacgtgctctag

SEQ ID NO: 20999 - DNA, 240 bp, Artificial Sequence
  Description of Artificial Sequence: Synthetic coding sequence
atggccagccggatcggcctgcggatgcagctgatgcgggagcaggcgcagcaggaggaacagcgggagagaatgcaacagcaggccgttatgcactacatgcagcaacagcagcagcaacagcagcagcagttgggcggccctccgacaccagctattaacacaccagttcatttccagtctcctccccctgtgccgggtgaggtgttaaaagtgcagtcttatttagaaaacccatag

SEQ ID NO: 21000 - DNA, 99 bp, Artificial Sequence
  Description of Artificial Sequence: Synthetic coding sequence
atggccagccggatcggcctgcggatgcagctgatgcgggagcaggcacaacaggaggagcagagagaacgcatgcaacaacaggctgtgatgcattag

SEQ ID NO: 21001 - DNA, 39 bp, Artificial Sequence
  Description of Artificial Sequence: Synthetic coding sequence
atggccagccggatcggcctgcggatgcagctgatgtag

SEQ ID NO: 21002 - DNA, 216 bp, Artificial Sequence
  Description of Artificial Sequence: Synthetic coding sequence
atggccagccggatcggcctgcggatgcagctgatgcgggagcaggcccagcaggaggaacagcgtgaacggatgcagcagcaagccgtgatgcactatatgcagcagcagcagcaacagcagcagcagcaactgggtggcccaccaactccggcaatcaacacccccgttcatttccagtctcccccaccagtgcctggcgaagtgctcaaatag

SEQ ID NO: 21003 - DNA, 39 bp, Artificial Sequence; identical to SEQ ID NO: 21001
  Description of Artificial Sequence: Synthetic coding sequence

SEQ ID NO: 21004 - DNA, 1044 bp, Artificial Sequence
  Description of Artificial Sequence: Synthetic coding sequence
atgaccctggaccaccagatcatcaaccccaccctgaagtggagccagcccgccgtgccaagtggagggcccctcgtacagcacgctcacacgactttagatagcgatgctgggttgacagagaaccctcttaccaagctgctggccatcggaaaggaagatgataatgctcaatggcacatggaggatgtgattgaagatattatcggaatggagtcaagttttaaggaggaaggcgctgacagtcccctgctgatgcaacgaacactttctggatcaatcctggacgtatacagtggcgaacaggggataagtccaatcaacatgggccttacctctgcgagctgcccatccagtctgcccatgaaacgggagatcaccgaaaccgacactagggcgctcgccaaggaacgccagaagaaagataaccataatttaatcgaaagacgtcgcagatataatattaactaccgcattaaggagttaggaacgttgatccctaagagcaatgacccagatatgcgatggaacaagggaaccatcctaaaggccagcgtggagtacatcaagtggctgcaaaaggaacaacagcgggcaagggagctggagcacaggcagaagaagttggaacaggcgaacagacgcctgctcttacggatccaagagctcgaaatacaggctaggacccacggcctgcccacccttgcatcgctggggaccgtggacttaggcgcccatgtgacaaagcagcagagccatcctgaacagaatagcgtggactattgccagcagttaacagtctctcagggaccgagccctgagctgtgcgaccaggcgatcgctttctcagatcctttatcttacttcacagacctcagtttttccgcagctctcaaagaagaacagcggttggacggtatgctccttgacgacaccatttcaccctttgggacagaccctcttctctccgctacttctcccgccgtaagtaaagaatcgtccaggcggagttctttcagcagcgatgacggggacgagttgtag

SEQ ID NO: 21005 - DNA, 957 bp, Artificial Sequence
  Description of Artificial Sequence: Synthetic coding sequence
atgaccctggaccaccagatcatcaaccccaccctgaagtggagccagcccgctgtgccttccggcgggccactggtgcagcacgcgcacactaccctggacagtgatgccggcctcactgaaaaccctttgacaaaattacttgcaattggcaaagaggacgacaatgcccagtggcatctgtctggctcaatactggacgtgtactcaggcgagcaaggcattagcccaatcaatatgggactgacgtcggcaagctgccctagcagtctgcctatgaagagagagatcactgaaaccgatacgagagctctcgctaaagagcggcagaaaaaggacaaccacaacctgatcgagcgccgaagaagatataacataaattatcggattaaggagctgggcactctgattcccaaatcaaatgacccagacatgcgctggaacaaaggtacaattctgaaggcatcagtggaatacattaaatggttgcagaaggagcaacaacgcgccagagaactggaacatagacagaagaagttagaacaagctaacaggcgcttgcttttgaggattcaggagcttgagatccaggctagaactcacgggctgcccactcttgcctccctcggaacagttgatctgggcgcccacgttacaaaacagcagtcgcatcctgagcagaactcagttgattattgccaacaactcactgtgtcccaggggccttcacccgagctctgcgatcaggcaattgccttctccgatccactgtcatacttcacagacctcagcttttcagccgcgttaaaagaagagcagcggctagacggaatgctgctggatgataccattagcccattcggcactgatccacttctttcggccacttcacccgcagtgtctaaagagagctctcgacggagtagcttctccagcgatgacggagatgagttgtag

SEQ ID NO: 21006 - DNA, 594 bp, Artificial Sequence
  Description of Artificial Sequence: Synthetic coding sequence
atgaccctggaccaccagatcatcaaccccaccctgaagtggagccagcctgcagtgccttctggcgggcctctggtgcagcacgctcacacaactctggattcagatgcagggttgactgaaaatccgctgaccaagctgctcgcgatcggtaaggaagatgataatgctcaatggcacctctcagggagcatacttgatgtctattctggggagcagggcatatcgccaattaatatgggtctgacgtctgcgtcctgcccctcctcactgccaatgaagcgcgagattactgaaaccgacactcgcgcactggcaaaggagcgtcagaagaaagataatcataacctcattgagagaagacggaggtataatatcaactatcggatcaaggagctggggaccctgattcccaagagtaacgatccggatatgcgatggaataaaggtactattctgaaagcatccgtcgaatacattaaatggttgcagaaggaacaacagagagcacgggagctggaacacaggcaaaagaagctggaacaggccaaccgccgtcttctgctccgcattcaggtcttcattagaatgtag

SEQ ID NO: 21007 - DNA, 843 bp, Artificial Sequence
  Description of Artificial Sequence: Synthetic coding sequence
atgatgaaggagaaggagaagaccatcgccatcgtgaaggtgatcgacacctctaaacttaagctgttatccgggtctatattggatgtctattcaggggagcagggaatttcccctatcaatatgggcctgacaagcgcctcttgtccgagcagtctgccaatgaagcgcgagatcactgagacagacacccgggccctggcgaaggagagacaaaaaaaggacaatcataacttgatcgagagaaggaggaggtataacatcaactaccggataaaggaactggggacactgatccccaagagcaacgaccccgacatgaggtggaacaagggcacaattctgaaggccagcgtagaatacatcaagtggctgcagaaagaacagcagcgcgccagggagctggaacaccgacaaaaaaagctggagcaggcaaaccgccgtttgctcttacggattcaggagctcgaaattcaggcacgaacccacggattgcccacccttgccagcctgggaacagtggacctgggtgcgcacgtaaccaaacagcagagtcaccctgaacagaattcagtggattattgtcagcagttgaccgtctctcagggcccaagcccggagttatgcgaccaagccatcgccttcagtgacccgcttagctacttcacagatttgagtttcagtgcagcattaaaggaggagcagcgtctcgatggcatgcttttagacgacacaatttcccctttcggaactgatcctctgctgagtgcgaccagccccgccgtctcaaaagaatccagccggcggagttcattttctagcgatgatggggacgagttgtag

SEQ ID NO: 21008 - DNA, 951 bp, Artificial Sequence
  Description of Artificial Sequence: Synthetic coding sequence
atgctgcaggccctgaccggcctgcagttccagctgaaggagcagctaggggagaaggagcggcgcctccagatttcacaggaaatcagtgcccatcgcacagagttccatatgcagttttcctataagccagtcctccatagactcgttcctgctagaccacagatatattcttcacagctgccatctttcacacgagtgccagctcaccttgaatcaagtgcccgacctcagctgcaaaaggcacagcgccagaaggtgaactcttttatgaccctggaccaccagattataaaccctacgttaaaatggtcccaacctgctgtgccttccggcggcccgctggttcagcacgcccatacaactttggacagcgacgcaggactcactgagaaccctctcactaagctactggcaatcggcaaggaggacgataacgcccagtggcacatggaagatgtgatagaggacattatagggatggagtcatcatttaaggaggaaggggcggatagtccgctgctgatgcagcgaacgctgagtggttccattctggacgtctactccggggagcagggtattagccctatcaacatgggtttgaccagcgcatcctgtccttcatcattaccaatgaaacgcgaaattacagagactgatacacgagcactggccaaggagaggcagaagaaagacaaccataacttgatagaaaggcggcgccgatacaatataaattaccgaatcaaagagctcggcaccctgataccaaagagcaacgacccggatatgcgctggaacaagggcactatcctgaaggccagtgtggaatacatcaagtggctgcagaaagagcaacagcgcgcacgcgagctcgagcatagacagaagaagcttgagcaggctaatcggaggcttctgctcagaatccaggtctttattcgcatgtag

SEQ ID NO: 21009 - DNA, 2169 bp, Artificial Sequence
  Description of Artificial Sequence: Synthetic coding sequence
atgcccctgcaccagctgggcgacaagcccctgaccttccccagccccaatagtgctatggaaaacgggctggaccacacaccacccagccgacgagcatcccctgggacccccctgagtccagggtccttgcgctccgccgcccacagcccgctcgatactagcaagcaaccactatgtcagctttgggccgaaaagcacggtgccaggggcactcatgaggttcgatatgtgtctgcgggccagtctgttgcttgcggatggtgggcattcgcgccaccttgcctgcaggttttgaatacacccaagggaattctttttttcctatgcgccgccgccttcctacaaggaatgactgtaaatggattcatcaatacagtgatcacgtccctcgagcgacgctacgacctgcactcctaccagtctggactgatcgcttcaagttatgatatagcagcctgtttgtgcctgacgttcgtttcctatttcggaggcagcgggcataaacctcgctggctagggtggggtgtcctgttaatgggaaccggatctttagtgttcgcgttgccccacttcactgcgggtaggtatgaagtggagctcgacgcaggggtgaggacatgcccggccaacccgggcgctgtctgcgcagattcaacctccggcctcagcagataccagttggtcttcatgctgggccagtttctccatggggttggggctactccactatacacgctgggagtgacatacctggacgaaaacgtgaaatcttcttgcagcccagtgtacatcgctatattttatacggccgcaattcttggaccggccgcggggtatctcatcggcggggccctgctgaatatctataccgagatgggcaggcggacagaattgaccactgaatctcccctatgggtgggggcatggtgggtcggcttcctgggctcaggcgctgcagcgttcttcaccgctgtcccaatccttgggtaccccagacaactgcctggaagccaacggtatgccgtaatgagagccgccgaaatgcatcagttgaaggattcttcaagaggtgaagctagtaatccggacttcgggaagacaataagagatctcccacttagtatatggctgctccttaaaaaccccacatttatactgctctgtctggcgggggctacggaagcgaccctcatcacaggcatgtccactttcagccctaagttcctcgaatctcagtttagcctgagcgcctccgaggcagccactctgttcggatacctggtggttcccgccgggggtggaggaactttcctcggaggcttttttgttaacaagctccgtctgaggggctccgccgttattaaattctgcctgttctgtactgttgtttcactgctggggatcctggttttcagcctacattgtcctagcgtgccaatggcgggcgtgacagcctcatatggtggcagtttgctccccgaaggccatttgaaccttacggccccttgcaatgcagcctgcagctgccagcctgagcactatagtcctgtgtgtggttcggatggactgatgtacttctcgctgtgccacgccggctgcccagccgccacagaaactaacgtggatggccagaaggtttaccgcgattgctcatgcataccccagaacttatcatcagggttcggccacgccacagccggaaagtgcacctcgacttgccaaaggaagcccctgctacttgtgttcatttttgtagtgatcttctttacattcctcagctctatccccgccctcactgctaccctgaggtgcgtgagggacccccagcggtcattcgccctcgggattcagtggattgtggttaggatcctaggaggcattcccggaccaattgcatttggctgggtgatcgataaagcttgcctcctttggcaggatcaatgcggacaacagggttcatgcctggtctaccagaactccgctatgtcccggtatatcctgattatgggattgctgtacaaagtgttgggcgtgctgttctttgccatcgcctgtttcctttataagcccttgtccgaaagtagtgatgggttggagacctgtctgccctcccagagctctgcccccgactctgccacagattcccagctgcaatcgagtgtatag

SEQ ID NO: 21010 - DNA, 1503 bp, Artificial Sequence
  Description of Artificial Sequence: Synthetic coding sequence
atgagcggccccggcccccgggagcccccccccgaggccggcgccgccggaggagaagcggccgtggagggcgctggcggaggggacgccgcccttggggaaccaggactgtcttttacaacaacagatctgtctttggtggagatgacagaagtggagtatactcagttacagcatatcttatgtagccatatggaggccgccgcggatggggaactggagactcgattaaatagcgctctcctggcggcagcgggtcccggagccggcgccgggggcttcgcagccgggggacaagggggcgcagcgcccgtatacccagtgctgtgtcccagtgcgctggctgccgacgcgccatgcctcggccacatagattttcaggagctcagaatgatgctgctgtctgaagcaggagctgcagagaagacgtcaggggggggcgacggcgctcgagccagagccgatggggctgccaaagaaggcgctggagcggccgcagcagcagccggacccgacggagcacccgaggcccgcgctaaacccgctgtcagagtgcgacttgaggataggttcaatagcatcccagcagagcctcctccagctccaagaggccccgagccgccagaacccggaggcgccctaaataatctcgtgacgctgatcagacaccccagcgagctgatgaacgttcctcttcaacagcagaataaatgtaccgccctggttaagaacaagactgcagccacgacgaccgccctgcaatttacttaccctctatttacaactaatgcttgtagtactagtggaaacagtaatctaagccagacccagtcttcatccaactcatgtagcgtcctggaagcagctaagcaccaggatattggtctacctcgcgctttctccttctgttaccagcaggagatcgagtccacaaagcagaccttgggaagccgcaataaggtcctaccagaacaggtctggatcaaagtgggtgaagcagcactctgcaagcaggcactcaagagaaacagatcgaggatgagacagctggataccaacgtggaacggcgcgccctgggagagattcagaacgtcggagagggtgcaaccgctacacagggagcctggcagtcttccgagtcctcacaggcgaatctgggcgagcaggcacagtcaggtccccagggcggaagatcccagagacgggaacggcacaaccgcatggagcgggacaggcggagacgcatccggatctgctgtgatgagctgaacctccttgtccctttctgcaatgcagagacggataaggccactactctgcagtggacgactgctttcctgaagtatattcaggagcggcacggcgatagcctcaaaaaagagtttgagagtgtgttctgcgggaagacaggaagaaggttaaaactgacacgtccagacagcttggtgacctgtcccgcccagggctccctccaatcatccccgtcaatggagattaagtag

SEQ ID NO: 21011 - DNA, 1008 bp, Artificial Sequence
  Description of Artificial Sequence: Synthetic coding sequence
atggccaccttcgtgagcgagctggaggccgccaagaagaacctgagtgaggctcttggtgacaacgtaaagcagtattgggcaaacctcaagctatggttcaaacaaaagatcagtaaagaagaatttgatctggaagcacatcgactgcttacccaggacaacgtgcatagtcacaatgatttcttacttgccatcctcacacgatgccagattcttgtttccacccctgacggagcaggctccctaccctggccaggagggtctgccgctaaaccaggaaaaccaaagggcaagaaaaaattgtccagcgtcagacagaaatttgaccaccggtttcagccacagaatcctttaagcggcgctcaacaatttgtcgctaaggacccccaagatgatgatgacttaaagttgtgctctcacacgatgatgctccccacacgtggacagttagaaggtcggatgattgtcaccgcctatgaacatggcctggataatgtcacagaagaggccgtttctgcggtggtctatgccgtcgaaaatcatttaaaagacattttgactagcgtagtcagtcggcgcaaagcataccgcttacgagatggacactttaaatacgctttcggcagcaatgttacaccacagccttatcttaagaacagcgtcgtggcttacaataacctgatcgaatctcccccagctttcactgccccgtgtgcaggtcagaaccctgcatctcatcccccccctgacgacgcggagcaacaggcggccttacttctcgcttgcagcggagatactctgcctgcctccctgcctcccgtgaacatgtatgatctctttgaagcactccaggttcacagagaggttattcccacccatactgtgtatgccctcaacattgagcggatcatcactaagctgtggcaccctaatcacgaagaactgcagcaggataaagttcatcgacagcgcctggctgcgaaagaaggtttattgctctgctag

SEQ ID NO: 21012 - DNA, 2286 bp, Artificial Sequence
  Description of Artificial Sequence: Synthetic coding sequence
atgagccggaagggcccccgggccgaggtgtgcgccgactgcagcgcgcctgatcctggatgggctagcatttcccgcggtgttctggtgtgcgatgaatgttgctcggttcaccggtccctaggcagacacatttccatcgtgaagcacctgaggcattcagcttggccacctaccctgcttcaaatggtgcataccctggcatctaacggtgcaaattccatttgggaacatagcctcttggatccagcccaggtccagagcggacggcgcaaggcaaatccccaggacaaagtgcatcctataaagtcagagttcatcagagccaagtaccagatgctagcattcgtccacaaactaccctgcagggacgatgacggggtgaccgccaaggatctgagcaagcagctgcatagttccgtccggaccggtaacttagagacctgcctaaggctgctcagcctcggcgcccaggcaaatttctttcatcccgaaaagggcacaactcccttgcatgtggccgcaaaggctggccagactttgcaggcagagctgctggtcgtctacggcgctgatccaggctctccggatgtcaacggacgcacccccatcgactacgcccggcaagccggacatcatgaactggcagagcgactggtggaatgtcagtatgagcttactgaccggctcgctttctacctgtgtggcaggaaacccgaccacaaaaatgggcattatattatcccacagatggcagacagtctcgacctctccgaattagctaaggcagcaaagaagaagcttcaagcattgagcaatcggctatttgaggaattggctatggacgtatacgacgaggtggataggagggagaatgacgccgtgtggcttgccacccagaaccacagtactctggtgactgagagatcagcagtccccttcctccctgtcaatcctgaatattcagcaacaaggaatcaggggaggcagaaactggctagatttaacgcccgtgagttcgctactctgatcattgacatcttatcagaggctaagcgccgacagcaaggtaagtcactgagctcccccacagacaatctggaactgagtttgaggagccagtccgatctcgacgatcaacatgactacgattctgtggcctccgacgaagataccgatcaggagcctctgcgctctacaggcgcgactcgcagtaatcgtgccaggtcaatggacagttccgacctctctgatggtgccgtgactttgcaggaatatctggaactgaaaaaagcccttgccacctccgaagccaaggtgcagcaactgatgaaagtcaatagctcactctcagacgagctgcgccggcttcagcgcgagattcacaaacttcaggccgagaatttgcagctgcggcaacctcctggtccggtacctaccccccctctaccaagcgagcgggctgagcacacaccgatggccccgggtggcagcacacacaggcgcgatcgccaagccttctcgatgtatgaacccggtagcgctctcaaaccctttggagggcctcctggcgacgaacttacgacacggcttcagccattccacagcacagaacttgaggacgacgccatatacagtgttcatgtgcctgcaggactttataggatcagaaagggggtgtctgcaagtgccgtgccatttacaccttcttcacctttactgagctgctcacaggaagggtctcgccacacgagcaagttgtcgcgccacggttccggcgccgatagtgattatgagaatacacagtcgggggatcccctccttggtctggaggggaaacgtttcctggagcttggcaaggaagaggacttccatcccgagcttgagagcctcgatggggatctggaccccgggctgccaagcacagaggacgtgatattgaaaactgagcaggtcaccaagaacatccaagagcttctacgcgctgcccaggagtttaagcacgatagcttcgtgccatgctcggaaaagatacacctcgccgtgacagaaatggcctctctttttcccaagcggcctgccctggaacccgtgaggtcatccttgaggttgcttaacgcatcagcctataggctccagtccgagtgcagaaaaaccgtgccccctgaacccggagcccctgtagacttccagctgctcacccaacaggtaatccagtgcgcgtacgacatagcgaaggcagccaaacagctggtcactatcaccaccagggagaagaaacagtag

SEQ ID NO: 21013 - DNA, 1332 bp, Artificial Sequence
  Description of Artificial Sequence: Synthetic coding sequence
atggaccggctgggccccttcagcaacgaccccagcgacaagcccccttgtagaggctgttcctcgtaccttatggagccttacataaaatgtgccgaatgcggcccaccacctttcttcctctgtctgcaatgttttaccaggggctttgaatataagaaacaccaatctgaccacacgtatgaaataatgacaagcgactttcccgtcctggatcccagctggacagcacaagaagagatggccttactggaggctgtgatggattgcgggttcggaaattggcaggacgttgcaaaccagatgtgcacaaaaactaaagaagaatgcgagaaacattatatgaaacacttcatcaacaatccccttttcgcgtccaccttgctgaatttaaaacaggctgaagaagccaagaccgcagacaccgccatcccgttccactctacagacgatcctccccgtcctaccttcgactctcttctaagccgcgacatggcaggttatatgccagctagagctgattttatcgaggagtttgataattacgctgagtgggacctccgcgacattgacttcgtggaagacgattccgacatcctgcatgctcttaagatggccgtagtggacatttaccattcgagactgaaagagaggcaaaggcgcaaaaagatcatcagggaccacggtctaatcaacctcaggaagttccagctgatggagcggcgatacccaaaagaggtccaggatttatacgaaacgatgcggaggttcgcgcgcattgttggccccgtagagcatgataaatttatcgaatctcacgccctcgagttcgaattacggagagaaataaaacgcctgcaggaatacaggactgcaggcatcaccaatttctgctctgccaggacatatgatcatctgaaaaaaacacgggaagaagaacggcttaaacggaccatgttgtctgaggtcttacagtatatccaggattcctctgcatgccagcaatggttgcgtcggcaagcagacattgactctggattgagcccttctatccccatggcgagcaattcgggccgtagaagtgcacctcctctgaacttgacggggctgcccggaactgagaagctcaacgagaaggaaaaggagctttgccagatggtccgcctcgtccccggcgcctatctcgaatacaagagtgctctcttaaatgagtgtaacaagcagggaggactgcggctcgcgcaagcacgtgctctgattaagatagatgtgaataaaaccaggaagatttacgactttttaatccgagaggggtacattactaagggctag

SEQ ID NO: 21014 - DNA, 918 bp, Artificial Sequence
  Description of Artificial Sequence: Synthetic coding sequence
atggaccggctgggccccttcagcaacgaccccagcgacaagcccccatgccgaggatgttcctcatacctcatggaaccttacataaagtgtgctgagtgcggtccaccacccttcttcctgtgtctgcagtgcttcacgagaggcttcgaatacaaaaaacatcagtctgaccacacctatgagattatgacttcggactttcctgtgctggatccatcttggacagcgcaggaagaaatggctctgttggaagccgttatggattgcggctttggtaactggcaggacgtggctaatcagatgtgcaccaagaccaaggaggaatgcgagaagcattacatgaagcacttcataaataatcctctgttcgcctccactctcctgaatcttaagcaagccgaggaggcgaaaacagccgacacggcaataccctttcactccacggatgacccccctaggccgacatttgactcgctactgagccgggatatggcgggatacatgcctgcaagagcggactttatcgaggagttcgataattacgccgagtgggacttaagagacatagatttcgtggaagacgacagcgatatcctgcacgccctcaagatggctgtggttgacatctaccatagcagactgaaggaacggcaacgccgaaagaagattatccgcgatcatgggctgatcaatctcaggaaatttcaacttatggaacgtaggtatcccaaggaagtgcaggacctgtacgaaaccatgaggcgctttgcgagaattgttgggcccgttgagcatgataagtttattgagtcccacgcatgccgctggtttctaagtttggaacaatatctctgtgtgtacatttacatcaatcggagagacaatggggtcttctacgtgaagttttacaaatag

SEQ ID NO: 21015 - DNA, 1029 bp, Artificial Sequence
  Description of Artificial Sequence: Synthetic coding sequence
atgtgcaccaagaccaaggaggagtgcgagaagcactacatgaagcactttatcaataatccactgttcgctagcacgctgctcaacctgaaacaagccgaggaagccaaaactgcagacacagcaatcccgttccactccaccgacgaccctccgagaccgacattcgactctctgctctctagagacatggctggctatatgccagcccgcgcagactttatcgaagaattcgacaattacgctgagtgggacctgagggatatcgatttcgtggaagacgattctgacatcctccacgctctgaaaatggcggtggtggacatctaccacagcagactgaaggagcgacagaggaggaagaaaataataagggatcacgggcttataaaccttcgtaagttccagctcatggaaaggagatatccaaaggaggtgcaggatctctatgagacgatgcgcaggttcgcgaggattgtgggacctgtagagcacgataaatttattgagtcccacgcactggaattcgaattgagaagagaaatcaagagactgcaagaatatagaacagccggtatcacaaacttttgtagcgcaaggacgtatgaccacctgaagaagactagagaggaggagagactaaaacgaaccatgttgtccgaggtgctgcagtatatacaggattctagcgcatgccaacagtggttaagacggcaggccgacattgactccggcctgtctcccagcatccctatggctagtaactccggccggaggagcgctcctcccctcaatctcacggggctgccggggaccgagaagctgaatgagaaggagaaggagctctgccagatggtcaggctcgtgcccggcgcatatctcgaatacaagtctgcactacttaatgaatgcaacaaacagggaggcctccgacttgctcaggcccgggctttaatcaaaatcgacgtgaacaagacacgcaaaatttacgatttcctgattagggagggatacattaccaaaggatag

SEQ ID NO: 21016 - DNA, 1332 bp, Artificial Sequence
  Description of Artificial Sequence: Synthetic coding sequence
atggaccggctgggccccttcagcaacgaccccagcgacaagcccccttgcagaggttgcagctcatatctgatggaaccgtacataaagtgcgccgaatgtggcccacctcccttctttctgtgcctgcagtgttttacaagggggttcgaatataaaaagcaccagtcggaccacacctacgaaataatgaccagcgactttccagtattagatccctcatggaccgctcaagaggagatggcccttctggaggcagtgatggactgtgggtttggaaactggcaggacgtcgccaatcagatgtgcaccaagaccaaggaggagtgcgaaaagcactatatgaagcactttatcaataatcccctgttcgcgtctacactactcaatttgaagcaggccgaggaagcaaagaccgcagataccgctattcctttccacagcaccgacgatcctccacggccaacctttgatagcttgctaagtcgcgatatggccggctacatgcccgctagagctgatttcatagaagagtttgacaactatgcagagtgggatctgagggatattgactttgtagaagacgacagtgatatcttgcatgctctgaagatggccgttgtcgacatctatcatagtcgacttaaagaaaggcagaggcgaaaaaaaatcatccgggaccacggcctgatcaatctaaggaaatttcagctcatggaaaggaggtacccaaaagaagtccaggatctatacgaaactatgaggcgtttcgcccgtatcgtcggtcctgtggagcacgacaagttcatcgaaagccacgcattggagttcgagctccgaagagagattaagcggttacaggaataccgtacagctgggattacgaatttctgcagcgcgaggacttacgatcatttaaaaaagacacgcgaggaagagcggctgaagcgcaccatgctttctgaagtgctccaatacattcaggatagtagcgcttgccagcagtggctccgccggcaggccgatattgatagtggcctctcaccatcgatcccaatggcttccaacagtggcaggagatccgccccccccttgaacctgaccggactaccaggaacagagaagttaaacgagaaagagaaagagctctgccagatggtgcgattagtgcctggagcgtatctggagtataaaagcgcactgctcaatgagtgcaacaagcagggaggtcttaggctggctcaagcaagggctttgattaagatcgatgtgaacaaaacacgaaagatctacgacttcctcatcagagagggttacatcacgaaagggtag

SEQ ID NO: 21017 - DNA, 3390 bp, Artificial Sequence
  Description of Artificial Sequence: Synthetic coding sequence
atgggcgaccagcagctgtacaagaccaaccacgtggcccacggctccgagaacctattttaccagcaaccaccactcggggtccattccgggctgaatcacaattacggcaatgcagtcaccggaggcggtatggacgccccgcaggctagccccatctccccccacttcccccaggatacacgagacgggctcgggttgcccgtgggttctaagaacctcgggcaaatggacacatccagacagggcggttggggctcccacgcaggcccggggaatcacgtccagctgagaggaaatcttgctaattccaacatgatgtggggtgcccctgcacaggccgagcccacagatgggtaccagtacacgtactcacaggcctcagaaataaggacccagaagctcacctctggcgtgctgcataagttggattcattcacccaagtgtttgccaatcaaaatctgaggattcaggtcaacaacatggcccaagtattacatacccaatctgctgtgatggatggcgctcctgacagtgcccttcgacagctgttgagccaaaaacctatggagcctccggcccctgccatcccgagcaggtatcaacaagtgccccagcaaccgcatccaggtttcaccgggggactttcgaaacccgccctgcaagtgggccagcaccctacacagggccacctgtactacgactaccagcagcctttggcacaagttccagtccagggcggacagcccctgcaggcgccccagatgctatctcagcacatgcagcagatgcagcaacaccagtactacccgcctcagcaacagcagcaggcgggccaacagcggattagcatgcaggagatccagacacaaccacaacagatacggccaagccaacctcagccccctcctcaacaacaacagccacagcagcttcaactgcagcagcggcagggatccatgcaaatccctcagtattaccagccccagccgatgatgcagcatttacaggaacagcagcagcagcagatgcacctgcagcccccttcctaccacagggacccgcaccagtacacgcctgaacaggcgcacaccgtgcagctgataccgcttggatctatgagccagtattattaccaggagccccagcagccatatagtcacccactttaccaacagtcccacttgagtcagcaccaacaacgggaagattcccagttaaagacatacagtagtgatcgtcaggcccaggccatgctcagcagccacggggatctcggacccccagataccggcatgggcgaccctgcttcatctgacctgacccgcgtatccagtaccctgccacaccggcctctcctttccccctctggaatccatttgaataatatggggccccagcaccaacagctcagccctagtgctatgtggcctcaaatgcacttaccagatgggagagcacaacccgggtctccggaatcaagcgggcagcctaagggagctttcggagaacagtttgacgccaagaacaagctgacttgttccatctgcctgaaggaattcaaaaacctgcccgccctcaatggccatatgcgcagtcatggaggaatgcgagcatctcctaatctcaagcaggagatcccccgcaaacatcagccatccgttccaaaggcagaagagcctctgaaaacagttcaggagaagaaaaagtttcggcatcggcctgagccattgtttatacctcctccacctagttataaccccaaccctgccgctagctacagtggtgctacactctaccagagccagcttcgaagcccccgggtcttgggtgatcacctcttgctggatccaacccacgaactgcctccatacactcctcctcctatgctttcccccgtgagacagggcagtgggctgttctctaacgtgctgatctctggccacggtcctggagctcatcctcagctaccactcacacctctaacccccacgccccgagttctcctgtgccggagcaattccatagatggctcgaacgttacggtcaccccaggcccaggtgagcagactgttgatgttgagcccagaattaatatcgggctgagattccaggcagagatcccggaactacaagacatctctgctttggcgcaggatacacataaggccacccttgtttggaaaccctggcccgagctggagaatcatgatcttcagcagcgagtggagaacttgctgaatctgtgttgttcttctgcgctaccaggcggcggcactaactccgagtttgcactccacagcctttttgaggcgaagggtgacgtgatggtcgctcttgaaatgcttctgctgcggaagcctgtgcggctcaagtgccatccactggccaattatcactatgccgggagcgacaagtggacctcgctagagcggaaattgttcaataaagctctggccacttatagcaaggactttatattcgtacagaagatggtgaagagtaagacagtggcccagtgtgtggaatattattacacttggaaaaaaatcatgaggctgggacgcaagcatcgcactaggctggcagaaattatagacgactgcgtaacatccgaagaggaagaggagcttgaggaggaggaggaggaagatccagaagaagatcggaaaagcacaaaggaagaagagagtgaagtgccaaaaagtcccgaaccgcctccagtgccagtgttggccccaaccgaaggacctcctcttcaggctcttggacagccatccggctccttcatctgtgaaatgccgaattgtggggcggattgtagatgccacgtgactcccttcttaccacaggtgttctccagtagacaggctctgaacggccacgctcgcatccacgggggcactaatcaggtgacaaaggccaggggtgccataccttccggcaagcagaaaccaggtggcacgcagtctggctactgcagtgtgaagtcatcaccaagccatagtacaaccagcggggagaccgatccaacaactatcttcccgtgtaaggagtgtggtaaagtgttctttaagatcaaaagcaggaacgcccatatgaagacccaccggcagcaggaggaacagcagaggcagaaggcacagaaggcagcctttgcagctgagatggctgcgaccatcgaacggacaactggacccgtcggggcccccggactgctgccactcgatcagctgtcactgattaagcccatcaaagacgtcgacatcttggacgacgacgtggtgcagcagctgggaggggtgatggaggaagctgaggtagtggatactgacctgctattagatgaccaagactctgtacttcttcagggggatgccgagctgtag

SEQ ID NO: 21018 - DNA, 3603 bp, Artificial Sequence
  Description of Artificial Sequence: Synthetic coding sequence
atgggcgaccagcagctgtacaagaccaaccacgtggcccacggctccgagaacctgttttaccaacaaccaccactaggggtgcactctgggctaaaccacaactacggtaacgccgttaccgggggaggaatggatgccccacaggcctcccccatttctcctcacttcccgcaagacacaagagatggcctaggactgcccgtcggctcaaagaatttgggccaaatggacacctcacggcagggtggatggggatctcatgcgggacctgggaaccacgtgcagctgaggggcaatctggcaaactccaacatgatgtggggggcacccgctcaggccgaacccacagacggttatcaatatacctattctcaggcctccgagattcggactcagaagctaacaagtggagtgctccataagctcgactcctttacccaggtctttgccaaccaaaaccttagaatccaggtcaataacatggcgcaagttctgcacacacaatctgccgttatggatggagcccctgatagcgcactgcgccagctcctaagtcaaaagccaatggagccacctgctcctgctattcccagtagataccagcaggttcctcagcagccacaccccggattcaccggaggactcagcaaacctgctctgcaagtgggccagcaccccacccaggggcatttatattacgattaccaacagccactggctcaggtacctgtccagggtgggcagccattacaggctccacaaatgctgtcacaacacatgcaacagatgcagcaacatcagtactatccccctcagcagcaacagcaggctggtcagcagaggatttcaatgcaagaaattcaaacccagcctcaacagatcaggccctcacagccacagcctcctccacaacaacagcaaccgcagcagttgcagttacagcagagacagggcagcatgcagatcccacagtactaccaaccacagcccatgatgcagcatcttcaggagcagcagcaacaacagatgcatctgcagccaccctcctaccatagggatccacatcagtatactcccgagcaggcacataccgtccagttgatccccctggggagcatgtcgcagtactactatcaggagccgcagcagccttattcccatcctctgtatcagcaatcgcacctctcccagcaccagcagcgagaagacagtcaattgaaaacttacagctctgacaggcaggcccaggcaatgctgagcagccatggtgacttagggccacccgacacaggcatgggagaccctgcctcctccgatttgactagggtctctagtactctccctcatcggccactcctttctccttcaggaattcacctgaacaatatgggaccccaacaccagcagctctccccaagcgctatgtggccccagatgcaccttccggacggacgggcacagcctgggtcacccgagagcagcggtcagcctaaaggagctttcggcgagcaatttgacgccaagaataaactgacatgctctatttgcctgaaggagttcaaaaatctacccgccctgaacggtcatatgcggagccacggcgggatgcgtgccagccctaatttgaaacaggaggagggtgagaaggtcttgccaccacagcctcaacctccattgcctcctccccccccgccacctccccccccacagctgcctcccgaagctgaaagcctaacccctatggttatgcccgtgagcgtacccgtgaaactgctgcctccaaaacctagctcccagggatttacaaattccaccgtggcggccccgtcagcccgagataagcccgcttccagcatgtctgacgatgagatgccggtccttgagattcctcggaaacaccagcccagcgttcctaaagcggaggaacctctaaagacagtgcaagaaaagaagaagtttaggcaccgaccggagcccctattcatacctccacctccctcgtataacccaaatccagccgcttcctattctggtgccacactctatcagtctcagctccgttccccaagagtactgggggaccacttgctcctcgatcctactcatgaacttccgccctatactccacccccaatgctgtctcctgtgcggcaagggagtggactattctccaatgttctgatatcaggccacggccctggggcacaccctcaactgcctctaacacctctaacccccacaccgcgggtactgttatgtaggtctaattctatcgatggctcgaatgtgaccgtcacaccaggtcctggagagcagactgtggacgtggaaccccggattaacattggactcagattccaggccgagatccccgagctgcaggacatatctgccctcgctcaagacactcacaaagctaccctggtgtggaaaccctggccggaattggaaaatcacgatctgcagcaacgcgtagaaaatctattaaatctctgttgttctagtgcccttcctggtggcgggacaaatagcgagttcgctttgcatagccttttcgaggcaaagggcgacgtgatggtggctctggaaatgttgcttctgcggaagcccgtgaggctgaagtgtcatcccctggccaattaccactacgccggcagtgataaatggacctctcttgagcggaaactgttcaacaaggccctcgccacctactccaaggacttcattttcgtgcaaaaaatggtgaagagtaaaaccgtggcgcagtgcgtggagtactattatacttggaagaaaattatgcgtctgggccggaagcatcgaactcggcttgctgagatcatcgatgattgtgttactagcgaggaggaggaagagcttgaggaggaagaagaagaagacccagaagaggaccgtaaaagtacgaaggaggaagaaagcgaagtgcctaaatcgccagagccccctccagtccctgttctagctcccacggagggtccccctctacaagccctgggccaacctagcggaagcttcatttgtgaaatgccaaattgtggagcagtttttagctccagacaggctcttaacggacacgctagaattcatggggggacaaaccaggttacgaaggcaagaggagcaatcccttccggcaagcagaaacccggcgggacccagtccggatattgcagcgttaagagcagcccctcacattccactacctcaggcgaaaccgaccccaccacgatctttccctgcaaagaatgtgggaaggtcttcttcaaaataaagtccagaaacgcccatatgaaaacacatagacagcaagaggagcagcagcggcaaaaagcacagaaagcagcatttgctgcagagatggcggccacgatcgaaaggacaactgggcctgtgggagcaccagggcttctgcctctcgaccaactaagtcttatcaaaccaattaaggatgttgacatcctggacgatgatgttgtgcaacagttgggaggagtgatggaagaggcagaggtagttgacacggacctgctgctggatgaccaggacagcgtgttattgcaaggagacgctgagctatag

SEQ ID NO: 21019 - DNA, 3663 bp, Artificial Sequence
  Description of Artificial Sequence: Synthetic coding sequence
atgggcgaccagcagctgtacaagaccaaccacgtggcccacggctctgagaacctgttctaccagcagccacccttgggtgtgcattccggcctgaaccacaactatggaaatgccgtgactggaggaggcatggacgctccccaggcttcaccaattagccctcacttccctcaggacacacgagacggtctaggcctcccggtggggtccaagaatctaggccagatggatacttcccgccaggggggatggggctcacacgcaggccccggaaaccacgtccaactgcggggaaatttggctaacagcaacatgatgtggggcgcacccgcacaggccgagcctacagacggctaccagtacacctactcccaggcttcagagatcaggacgcagaaactaacatcgggcgtccttcataaacttgactcttttacgcaggtcttcgcgaatcagaacctccgcattcaggtcaataacatggcacaagtcctgcacacccagagcgcagtcatggatggggcacccgattctgcactcaggcagctgctgagccagaaacccatggaaccaccagccccagcgattccatctcgctatcagcaggtgccccagcagcctcaccccggattcacgggcggcctcagtaaacctgccttacaggtggggcagcatcctacacagggccatctgtattacgactatcagcagccactggctcaggtcccggtgcaagggggccagcctctgcaggcgcctcagatgctgagtcagcacatgcagcagatgcagcagcatcagtattaccctcctcaacagcagcagcaggcaggacaacagcgtataagcatgcaggaaatccagacgcagccacagcaaatccggcctagccagccccaaccccctccacaacaacagcagccccagcaactgcaacttcagcagcgccaggggtctatgcaaattccccagtactaccaacctcagcccatgatgcagcatcttcaggaacagcagcagcaacagatgcacttgcagccacccagttaccacagagacccacatcaatatactcccgaacaggctcacacagttcagctgataccgctgggatcgatgagccaatactactatcaggagccgcagcagccctattcccaccccctgtatcaacagtcccatctgtcgcaacaccaacagcgggaagattctcagctgaagacttatagctcggacaggcaggcccaggctatgttgtctagtcacggggacctgggtccgccagataccggaatgggcgaccccgcctcttctgacttgacacgggtgtctagtactctccctcatcgccctctcctttctccatctggaattcacctgaacaacatggggccgcagcaccagcagctctcacccagtgctatgtggccccagatgcacttgcccgatggacgagctcaacccggctctcctgaaagctcaggccagcccaagggggcattcggtgagcaattcgacgctaagaataaactgacctgctctatctgcttaaaggaattcaaaaacctcccagccctgaacggccacatgcgctcacatggaggaatgcgggcttcgcccaatctgaagcaagaggaaggcgaaaaagtcctgcctcctcagcctcagcctcccctgccgccacctcctccgccaccccccccccctcagttgcccccagaagccgaaagtttgaccccgatggtgatgcctgtgtcagtcccagtgaagctgctgccccccaaaccttcaagtcagggatttaccaactccactgtggcagcccctagcgctcgtgataagccagcatcatcaatgagtgacgacgagatgcccgtgctggtgcgtatgaccctgtccccaccccatagcccccagggagccgccccaagaactccagcagaaatcccacggaagcaccagcccagcgtccccaaggcagaggagccccttaagaccgtccaagaaaagaagaaatttagacacagacccgagcccctctttatcccccctcccccgtcatacaaccctaatcccgccgccagctacagcggcgccaccctctatcagtcccaactgagatctccaagagtgttaggcgatcacctgttgctggaccccacacacgaattacccccatatacaccacctccaatgctttcacccgtcaggcaggggtcggggctgttctcaaacgtattaataagcggacatggtcccggcgcgcaccctcaactgccccttactcctctgacccccacccccagggtcctactctgccgatctaatagcatcgatggctctaatgtgacagtgaccccagggccaggcgagcagactgtcgacgtagagccaaggataaatatcggtctccgtttccaggcagagattcccgaacttcaggatatcagcgcattagcccaagatacacataaagctacacttgtctggaagccctggcctgagctggaaaaccacgatctgcagcagcgcgtcgagaacctgttaaacctgtgctgttcaagcgctttgcccggcggcgggacaaattctgagttcgcccttcatagcctgttcgaagccaagggagacgtgatggtcgccttggagatgctcctgctcagaaagcccgttcggctgaagtgtcaccccctcgcgaactatcattacgcaggctccgacaagtggacttctctcgaaagaaagttgtttaataaggccctggccacttactcaaaagacttcatcttcgttcagaagatggtgaaatctaagaccgtcgctcaatgcgttgagtactactatacatggaagaagatcatgagactggggcgtaaacacagaacaagacttgccgaaatcatcgatgactgcgtgacttccgaggaggaggaggaactcgaggaggaggaagaagaagacccagaagaagatcgcaagagcacaaaggaagaggagtccgaagtccccaagtccccggagcccccaccagtgccagtcctcgcccctaccgaaggtccacctttgcaggccctgggccagcccagcggttccttcatctgcgaaatgcccaactgcggcgcagtattctcctccaggcaggccctgaatggccacgcgcgaatccacggtgggacgaaccaggtgaccaaagctcggggtgctattccttcagggaaacagaagcctggcggaacacaatccgggtattgtagcgtgaaaagctcgccaagccattcaacgacatcaggggaaaccgacccgactactatattcccctgcaaggaatgtggaaaggtcttcttcaaaataaaaagcaggaacgcgcatatgaaaacgcatcggcagcaggaggaacagcagcgccagaaagcccagaaagccgcttttgctgcggaaatggcagccaccatcgaaaggactactggtcccgtgggtgctcccggtcttcttccacttgatcagctctcactgataaagccgatcaaagatgttgacattttggatgacgatgtcgtccagcagctaggtggagtgatggaggaggctgaggtagtcgatactgatctgttactggatgaccaagattcagtcctccttcagggggatgctgagctgtag

SEQ ID NO: 21020 - DNA, 2247 bp, Artificial Sequence
  Description of Artificial Sequence: Synthetic coding sequence
atgatccgggacctgagcaagatgtacccccagacccggcaccccgccccacaccagccagctcaaccgttcaagtttacaatcagcgagtcttgtgataggataaaggaggaatttcaattccttcaggcacagtatcacagcttaaaattagaatgcgagaaacttgcatccgagaagactgaaatgcaacgtcattatgttatgtactacgaaatgtcttacggactgaacatcgagatgcacaagcaggctgaaatcgtaaagcgtctgaacgctatatgcgctcaagtgataccattcctatcacaagagcagcagctccaagcccagcatctatcacacggacatgggctgcctgtcccgctgacaccccacccttccggcctgcagccccctgcaattccccccatcggcagctcagcagggttgttggccctgtccagcgccttaggagggcaatcccaccttccaataaaagatgagaagaagcaccacgacaatgatcatcagagggaccgggacagtataaaaagctcttccgtctcaccaagcgcctctttcaggggagccgaaaagcatcgaaactcggcagattacagcagcgaaagtaaaaagcaaaagacagaggagaaggaaattgcagcccggtatgactcagatggggaaaagtcagacgataatcttgttgtggacgtctccaatgaagacccctctagccctcggggatctccagcacacagtccacgagaaaatggtctggacaagacgagactgctgaagaaagacgcacccattagtcctgcctcgatagcatcgtcaagctcaacaccctcttctaagtccaaagaactctcactgaatgagaagtcaacaacccctgtctcaaagagtaatacccccacaccacggactgatgcacccacgccagggagcaacagtacgcctggactgcgtcctgtccctggtaagccccctggtgtagaccctttggcatcctcccttcgtacccctatggccgttccgtgtccttatcctaccccatttggcattgtccctcacgctggaatgaacggggaactcacgagccccggtgctgcctacgctgggcttcataacatttcgcctcaaatgtctgccgcagcagccgccgcagctgccgccgccgcttatggcagatcccccgtggtgggtttcgatcctcaccaccatatgcgggtccccgccatcccgcctaacctgacgggaattcccggaggcaagccggcgtactcattccacgtgagcgccgatggccagatgcaaccggtcccatttcctccggacgccctgattggtcctggaattccaagacatgctcgacagattaacactctaaaccacggcgaagttgtatgtgcagtcacaattagcaacccgaccaggcacgtatacaccggaggaaaaggctgcgtaaaggtgtgggacatttcccacccaggaaacaagtccccggttagtcagctcgattgtctgaatcgagataattacatacgttcctgtcggttattacccgacggacggacactaatcgttggaggagaagcttctactctctcaatttgggatctggctgcccctacaccacgaattaaggctgagctgacaagctcagctcctgcatgctatgccctcgcgatatcacctgactccaaggtgtgtttctcctgctgttcagatgggaacatcgccgtctgggatcttcacaaccagaccttggtgagacagtttcagggtcatacagatggcgcctcatgtatcgacatctcaaacgatgggaccaaactttggactggcgggctagacaacactgtgcggtcctgggatcttcgtgagggcaggcagctgcagcagcatgatttcacatctcaaatattttccttgggctattgccccactggtgaatggttagccgtgggcatggaaaactccaacgtggaagtactgcacgtcaccaagcctgataaatatcagctgcacttacacgagagctgcgtgcttagtcttaagttcgcacactgtggcaaatggttcgtgtccacgggaaaagataatcttcttaatgcatggcgaacgccatatggggctagcatcttccagtctaaagagtccagcagcgtgctctcttgcgacatttctgtcgacgataaatacatagtgaccggtagcggtgacaaaaaggctaccgtatacgaagtgatctactag

SEQ ID NO: 21021 - DNA, 2418 bp, Artificial Sequence
  Description of Artificial Sequence: Synthetic coding sequence
atgatccgggacctgagcaagatgtacccccagacccggcaccccgctcctcaccagccagctcaaccctttaaattcacaatctcagaaagctgcgaccggattaaggaggagttccagttcctgcaggcccagtatcattcactcaagttagaatgtgagaagctcgcttctgaaaaaaccgagatgcagaggcactacgttatgtactacgagatgagctacggattgaatatcgagatgcacaaacaagcagaaattgtaaagaggctgaacgcaatctgtgcccaggtaataccttttctttctcaagagcatcagcagcaggtcgtccaggccgtcgaacgggccaagcaggtcacaatggccgagctcaatgctattatagggcagcaactgcaagcccaacatctgtcacatggacatggcctcccggtgcctctgacaccccatcccagcggactgcaacccccggccatacccccaatcgggtctagcgcaggacttctcgctctctctagtgccctggggggccagtcccatctgcctattaaagacgagaagaagcaccacgacaacgatcatcaacgggagcgggataagcttaatcacaaatcccttagtcccagtgcatcgttcagaggagctgagaagcatcggaactccgccgactatagcagtgaaagcaagaaacagaagacagaggaaaaggaaattgctgccagatatgactctgacggcgagaaatccgatgataacctggtggtcgacgtaagcaatgaagacccttctagccctagggggtcccccgcccactcccccagagagaatggactggataagacccggctcctcaaaaaagatgcccctattagcccagcttccatcgccagctctagcagtaccccaagctctaaatctaaagagttgtcactgaaacgcgacatgggcaaactttccgaaacgcggttgagcgaggatgagcagtgtacactgggattgcagcgatggttctgtcgtttgtggttcatgaacgaaaagtcaacaacgcccgtgtctaagagcaacacccccaccccacggactgatgcacccaccccaggcagcaattcgacaccgggacttagacctgtacctggtaaaccccctggcgttgatcccctggcgagctccctcagaaccccaatggctgtgccttgcccgtatcccactccattcgggattgtacctcatgcagggatgaacggcgaactaacctcccccggcgcagcctacgcaggacttcacaacatttctccgcagatgtctgctgctgcggccgccgccgctgcagccgccgcgtatgggcgctccccagtggtcggctttgatccccaccatcacatgcgcgtgccagcaatccccccgaaccttacaggcatccccggagggaagccagcttatagcttccacgtgtctgccgacgggcagatgcagcccgtgccattcccccccgatgcactgatcggtcccggcatacccaggcatgctcgccaaatcaataccctgaatcacggcgaagtggtctgtgcggtcaccatcagtaacccaacgagacacgtctacactggcggaaaaggctgtgttaaagtttgggacattagccacccaggcaataagagtcctgtatcccagttggattgcctcaatcgtgataattatatccgctcctgccgtctgctgcccgacggaagaacgctgattgtgggcggcgaggctagcacattatccatctgggacctagcagcccccacgcccaggatcaaagctgaattaacgagttctgctccagcttgttatgctctggccattagccctgactcaaaagtgtgcttttcatgttgttccgacggaaatatagctgtctgggacctgcacaaccagactctggtgcgccagtttcaggggcacactgatggggcttcctgtatcgacatcagcaatgatggcacaaaattgtggacaggcggactggacaacactgtgcgatcttgggacctgcgagaagggcggcagctgcaacaacacgatttcacgtctcaaattttctcattaggatactgcccaaccggtgaatggctggccgtcgggatggagaactcaaacgtggaggtgctccatgttaccaaaccagataagtatcagctgcacctccacgagagttgtgtgctgtcccttaaattcgctcactgtggcaagtggtttgtcagtacaggcaaggataacctgctcaacgcgtggcgtactccttatggcgcctctatattccagagtaaagaatcatcgtcagtgttgagctgcgacatctccgttgacgacaagtatattgttactggctccggagacaagaaagccactgtatatgaagtaatttactag

SEQ ID NO: 21022 - DNA, 1233 bp, Artificial Sequence
  Description of Artificial Sequence: Synthetic coding sequence
atggccgtgccctgcccctaccccacccccttcggcatcgtgccccacgcaggtatgaatggtgagcttacttcacctggggctgcatatgcagggctgcacaatatctccccccagatgtctgcggcagcagctgcggctgccgccgcagcggcttacggcagatctcctgtggtgggctttgatccccatcaccatatgcgggttcctgcaatccccccaaatttgactgggatcccgggcggtaaacctgcttattccttccacgtttctgccgatggccaaatgcagccagtaccctttccaccagatgctctaataggacccggcattccccgccacgcaaggcagatcaatacactgaaccacggcgaggtggtgtgcgctgtaacaatctccaatccaacccgacacgtttacaccggcggaaagggctgcgtaaaagtttgggacatttcacatcctggtaacaagtcacctgtctctcaattggattgcctcaaccgggataattacatccggagctgtagactgttaccagacggaagaacactgatcgtcgggggagaagccagcactctttcaatttgggaccttgcagctcccacaccccgcataaaggctgagctgacttcctccgcccccgcctgttatgcattggccatatcgcccgacagtaaagtctgcttttcctgctgttccgacggcaacattgccgtgtgggacctgcacaatcagacactggtgaggcaattccaagggcataccgatggggcttcttgtatcgacattagcaacgatggtaccaaactgtggaccgggggactcgataacacagtcagaagctgggacctgcgcgagggcaggcagttgcagcagcacgattttacaagccaaattttttcgctcggatactgtcccacgggcgaatggctagccgtcggtatggagaacagtaatgtagaggtgttgcacgtgaccaaacccgataaataccaacttcatctgcacgagagctgtgtcctgtccctcaagttcgcgcattgcggtaaatggttcgtgtctacaggtaaagacaatctgctgaacgcatggcgcacaccctacggcgcatctatttttcagtctaaggagagttcatcagtgctatcgtgcgacatcagtgtggatgacaagtacatcgtgactggctctggggataagaaggcaaccgtgtatgaggttatttattag

SEQ ID NO: 21023 - DNA, 2418 bp, Artificial Sequence
  Description of Artificial Sequence: Synthetic coding sequence
atgatccgggacctgagcaagatgtacccccagacccggcaccccgctccacaccagcctgcccagccctttaaattcactattagcgagagttgcgatagaatcaaagaggagtttcagtttctgcaggcacagtatcattctctgaagcttgaatgtgaaaagctggcaagtgagaagaccgagatgcaaagacactatgtcatgtactatgaaatgagttacgggcttaacattgaaatgcacaagcaggcagagattgttaagcggctgaacgcaatctgcgcacaggtgatacctttcctgtctcaggagcaccagcaacaggtggtccaagctgttgaaagagccaagcaggtgactatggcggagttgaatgccatcatcgggcagcagttgcaagcgcagcatctgagtcatgggcatggtctacctgtgccactgacaccgcacccatctgggctgcagccaccagccatcccccctattgggtccagcgccggactactggcccttagcagcgccctcggggggcaatcacatttacctattaaggacgaaaaaaagcaccacgacaacgatcaccaacgcgatcgggattcgataaagagctcctccgtttcaccttctgcaagctttcgaggggcggagaagcaccggaattccgcggactacagctctgaaagcaaaaagcaaaagacagaggaaaaggagattgccgcccgctatgattcggatggtgagaagtcagatgataatctggtcgtggacgtctccaacgaagacccaagcagccctagagggtcacctgctcactcgccacgggagaacggactggataagacccggctcctgaagaaggacgctcccattagccccgcttccatagcctcctcctcgtccactccctcatcaaagagcaaggaactctcattgaagcgagacatgggcaagttgtccgagacccggctgtccgaggatgagcagtgtaccctgggtctgcagagatggttctgtcgactttggtttatgaacgaaaaatcgaccactcctgtgagcaagtcaaacaccccaactccacgaaccgatgcacctacacctggatcgaattctacaccagggctgagacccgtacccggaaagcccccaggggtcgaccccctggccagttctctgcgaacccccatggctgtgccttgcccttacccaacgccctttgggatagtcccacatgcaggaatgaacggagagctcacgtcccccggcgccgcatacgccggtctgcataacatctccccgcagatgagcgccgctgccgctgcggccgccgcagcagcagcatacgggaggtcccctgtagtcggctttgaccctcaccaccatatgcgcgtgcctgctatcccccccaatctgacgggaataccaggggggaagcctgcttatagtttccacgtttcagccgatggccaaatgcaaccagtgccgtttccccccgatgccctgataggcccggggatcccacgtcatgccaggcagatcaacactcttaatcatggcgaggttgtctgcgccgtcactattagtaatcctacgaggcatgtctacaccggtgggaagggatgtgtgaaagtgtgggatatttcacatcctggcaataagtcacctgttagtcaactcgactgcttgaacagggacaattatataagaagctgccggctccttccggatggccggacactgatcgtgggtggcgaggcatcaaccctgagtatttgggatttggcggctcctacaccccggatcaaggccgaactgacaagcagcgcaccagcgtgttacgctctggcaatctcccccgacagtaaggtgtgcttcagctgttgcagcgacggaaacatcgctgtgtgggacctacacaatcaaacccttgtgaggcaatttcaaggccacaccgacggagccagctgcattgatatctccaatgatggaactaagctgtggactggaggactcgacaacaccgtccgctcatgggacctcagggagggcagacaactgcagcagcatgattttactagtcaaatcttcagcctgggatactgtcctacaggagagtggcttgccgtcggaatggagaattcaaatgttgaagtgcttcacgtgaccaagcccgataagtaccaactacacttgcacgagtcatgcgtattgagcttaaagtttgctcactgcggcaaatggtttgtgtctacaggaaaggataatcttctaaatgcgtggagaaccccttatggcgctagtatattccagagcaaagagagctcctctgtattgtcctgcgatatttctgtggacgataagtatatagtcacaggctccggcgacaagaaggctaccgtctatgaggtcatctactag

SEQ ID NO: 21024 - DNA, 2115 bp, Artificial Sequence
  Description of Artificial Sequence: Synthetic coding sequence
atgatccgggacctgagcaagatgtacccccagacccggcaccccgctccccatcagcccgcccaaccgtttaagtttacaatcagtgagtcctgtgacagaattaaggaagagtttcaatttttgcaggcacagtaccactcactcaaacttgagtgtgaaaaactagcttctgaaaagacagaaatgcagagacattacgtcatgtattacgagatgtcatacgggctgaacattgagatgcataaacaggcggagatagtgaaaaggctgaatgctatctgtgcccaagtcatacccttcttgtcccaggagcatcagcagcaggtcgtgcaggcagtggaacgcgctaagcaagttacaatggccgagctcaatgctataataggacagcagctacaggctcagcacctatcacacgggcacgggctgcctgtcccactgactccacaccccagcggactgcagccaccagctattccacccataggctcttccgcgggcctcttagctctgtccagtgctctgggtggccagtcccacttgcccatcaaggacgagaagaagcaccacgacaatgaccatcagcgcgaacgagacaaactcaaccataaatctctctccccgtcagcatcatttcgaggagccgagaaacaccggaactctgctgactacagtagtgagtccaagaagcagaagacagaagaaaaggagattgctgcgcgatacaatgagaagagcactacacccgtgtccaagagcaatactcccacccccaggactgatgcacctactccaggtagcaactctacccctgggttgcgacccgtccctggtaaacccccaggggtggatcctttggcgtcgagcttaagaacaccgatggccgtcccctgtccataccccaccccgttcggcattgtgcctcatgccggaatgaacggcgagctgaccagtcctggggcagcatacgccggcttgcataatatctcaccacagatgtctgccgccgccgccgctgccgctgctgcagctgcctacggtcggagcccagtggtgggtttcgacccacatcaccatatgagggtgcccgctatcccgccaaatttaaccggaattccaggggggaagcccgcttacagttttcatgtgtccgctgacggccaaatgcaacccgtgccctttcccccagacgcactgatcggacccggaatacctcggcacgccaggcagattaataccctcaaccatggcgaggtggtgtgcgcggtcaccatcagtaatcccacacgccatgtttatacagggggaaaagggtgtgtaaaggtttgggacatctcacacccaggcaacaagagcccggtatcacaactggactgcctgaatcgggataattatataaggagttgccggctgctcccagacggcaggactctgatagtcgggggcgaggcctctaccttaagcatatgggatctcgccgctcctacaccccgtatcaaagctgaactgacatctagcgccccagcctgctacgccctggccatctcccccgactctaaagtttgtttcagctgttgttctgatggtaatatcgccgtttgggaccttcataatcagaccctggtgcgacagttccaaggccacactgacggtgcctcgtgtatcgacatatcaaacgatgggacaaagttgtggacaggcggcctggacaatactgtgaggtcatgggaccttcgggagggcagacagctccaacagcacgacttcaccagccagattttcagtctcgggtactgccctacaggcgaatggctcgctgtgggtatggagaactcgaacgtggaggttctccacgttacgaagccagacaagtaccaactccaccttcacgagagctgcgtgctgtccctgaaattcgcacattgcggcaagtggtttgtgtccaccggcaaggacaacctgctcaatgcttggagaacgccatacggcgcttctattttccagtcaaaggagagttcttcagtgttgtcatgtgacatctctgtggacgacaaatacattgtgacaggctccggagataaaaaagccacagtatatgaagtgatatactag

SEQ ID NO: 21025 - DNA, 2322 bp, Artificial Sequence
  Description of Artificial Sequence: Synthetic coding sequence
atgatccgggacctgagcaagatgtacccccagacccggcaccccgcaccccaccagcctgcacagccatttaagtttacaatttcggagagttgcgatcggattaaggaggagttccagtttctgcaggcgcaataccactccctgaagttggagtgcgagaagctggcatcagaaaagactgagatgcaacgccattacgtcatgtactatgaaatgagctatgggctgaatatcgaaatgcacaaacaggccgagatcgtcaagaggttaaacgctatctgcgcccaggttatccctttcttatcccaggaacaccagcagcaggtggtgcaggccgtggaacgtgctaagcaggtcactatggccgagctgaacgcaatcattgggcagcagctgcaggcgcaacacctaagccatggtcacggactgcctgtgcccctcactcctcatcctagcggactacagcccccagccatacccccgatcggatccagtgccggactgctagcgttgagtagtgcgttggggggacagagtcatctgcccattaaggacgagaaaaaacaccatgacaacgatcatcaacgcgacagagatagcattaagagcagctctgtgagccccagtgcctcattcagaggagccgagaaacatagaaatagcgccgattatagcagtgagtctaagaagcagaaaaccgaggaaaaggaaattgcagcccggtatgactcagatggggaaaaatctgacgataatctggtcgttgacgtgagcaatgaagatccctcaagtccccgtggctctcccgcacacagcccaagagagaatgggctggacaaaacaagattactgaagaaagatgcaccaataagcccagccagcatcgcctcatcatcaagcacaccctccagtaagtccaaggagctgagcctgaatgagaagtccacaaccccagtgagcaagtctaatacacctaccccccgaactgatgccccaacccccggctccaactcgacaccaggtctccgcccagtccctggtaaaccccctggagttgatcccctcgccagttctctgcgcactcccatggcagtgccctgtccctatcctacgccgttcggcattgtcccgcatgccgggatgaatggagagttaaccagccccggcgccgcttatgctgggcttcacaacatatcccctcagatgtcagccgcggccgcagccgccgcagcagcagcggcatacggtcgcagtccagtggttggattcgacccgcaccatcatatgagggtacctgctattcctccaaacctaaccggaattcccggcgggaagcccgcgtatagctttcatgtttctgcagacggccaaatgcaacctgttcctttcccacccgacgccctcattggtcctggtataccaagacatgctcgccagataaatactttgaatcacggggaagtcgtttgcgccgtgactatttcgaaccccacgcggcacgtatacactggcgggaagggctgtgtgaaagtctgggatatttctcaccctggcaataaaagtcccgtctcacagctagactgtcttaaccgtgacaactatatacggtcctgtcgtctgctgcccgacggcaggactctgattgttggaggggaggcctcaacccttagcatatgggatttggcagctcccaccccccgaatcaaggcagagttgaccagctctgccccagcctgctatgcgctggcaatctcaccagattcgaaggtgtgcttcagctgttgctccgacggaaacatcgctgtttgggatttacataatcagactctggttcgccaatttcaggggcatactgacggagcctcatgcatcgacatatctaacgatggaacaaaactatggacaggcggcctggataacacagtgcggtcgtgggaccttcgcgagggccgtcagttgcagcagcatgacttcactagtcagatcttctcccttggatattgccctacaggagaatggctcgccgtaggcatggaaaactcgaacgtggaagtgttgcacgtaactaaacccgacaagtaccagctgcacctgcacgagagctgtgtgctcagtctgaagtttgcccactgtgggaagtggttcgtaagtacaggaaaggacaaccttttaaacgcttggaggactccgtatggcgcctctatttttcaaagtaaggaaagctcttccgtcctgtcctgtgatatttcggtggacgacaagtacattgtgaccgggtccggagataagaaagccaccgtctacgaagtgatctactag

SEQ ID NO: 21026 - DNA, 642 bp, Artificial Sequence
  Description of Artificial Sequence: Synthetic coding sequence
atgatccgggacctgagcaagatgtacccccagacccggcaccccgccccacaccaaccggcccagcccttcaaattcaccatcagcgagtcctgtgaccgaatcaaagaggagtttcagtttctgcaagcacagtatcactccttaaagctggaatgtgagaaactcgccagcgaaaagacggaaatgcagcgccattacgtgatgtactatgagatgagttacggtctgaatatcgaaatgcacaagcaggctgagatcgtcaaaagactgaacgctatctgcgcacaggtcattcccttcttgtctcaggaacaccagcagcaggtggtgcaggctgtcgaacgcgcaaaacaagtgaccatggctgagctgaacgctattatcggcgagaagaagaacaagtccgacacccctggctcgctgaaacaacagcagttacaggctcagcatttgagccatggacatggcttgcccgtaccactcactccccacccatcaggcctgcagccccctgccattccacccattgggtcatccgccggcctgctggctctgagttccgccctgggcggccaaagccatctgcccattaaggatgagaaaaagcaccacgataacgatcatcagagaggggaatag

SEQ ID NO: 21027 - DNA, 849 bp, Artificial Sequence
  Description of Artificial Sequence: Synthetic coding sequence
atgagcgacgtggaggagaacaacttcgagggccgggagagccggtcccagagcaagagtcccactggtacacccgcgcgggttaagtcggagtcccgcagcggtagcaggagcccatctcgcgtgtccaagcacagcgaatctcattcacgatccaggagcaaatccaggtctcgatcgaggagacactctcacaggagatacactagatcacggtctcatagtcacagtcacaggagacgctctaggagccgatcctacaccccagagtacagaagaaggagatcacgctctcacagccctatgagcaaccgcaggaggcatactgggtccagagcaaacccagacccaaacacatgccttggcgtattcggcctgtccctatataccactgaacgggacctgagagaagtgttctcacgttatggaccgctgtcgggggtcaacgtcgtgtacgaccagagaactggtcggagtcgaggcttcgccttcgtctatttcgaaagaattgatgattccaaggaagcaatggagcgggcgaacggcatggagcttgatggacgacgcatacgggtcgattattcaatcaccaaacgcgcccacacacctacccccggtatttacatgggaaggcctacccatagtggaggagggggcggcggaggaggcggcggcggtggcggaggagggggtcgaaggagggatagttattatgacaggggctatgatcggggatatgataggtatgaagactacgattaccggtacaggcgacgcagcccttcgccgtattacagcaggtatcgttctcggagcaggtcccgctcttacagcccacgccgctactag

SEQ ID NO: 21028 - DNA, 543 bp, Artificial Sequence
  Description of Artificial Sequence: Synthetic coding sequence
atgagcaaccggcggcggcacaccggcagccgggccaaccccgaccccaatacatgtctgggcgtatttgggttgtccctgtatactactgagcgggacctgcgggaggttttctcgcgctatggacccttaagcggcgtgaatgtggtgtacgatcagcgtaccgggaggagcagaggcttcgcttttgtctacttcgagagaatcgatgactccaaggaggccatggagagggcaaatggaatggaactagacgggcggcgcatcagggtagattactccattacaaaacgagcccatacacccacaccaggtatctacatgggacgtcccacacacagcggggggggagggggtggcgggggggggggaggaggcggagggggaggtcgtagaagagatagttattacgatcgaggatacgacagaggctacgacaggtacgaggactacgattatcgctacaggcgatccccaagtccctattactcaagataccgatcgcggagccgcagccggtcatactctccacgaaggtattag

SEQ ID NO: 21029 - DNA, 546 bp, Artificial Sequence
  Description of Artificial Sequence: Synthetic coding sequence
atgagcaaccggcggcggcacaccggcagccgggccaaccccgaccccaacacttgtttgggggtgtttggcctgtcgctatatactaccgagcgcgatctccgcgaggtattcagtcggtacgggcccttgtccggtgtcaatgtggtgtatgatcagcgaacgggtaggtctcgtgggtttgcctttgtctatttcgaacgcatagacgattctaaggaggcgatggaaagagccaacggtatggaactggacggacgcaggatccgcgtggactactcaattacaaaacgagctcatactcccaccccagggatttacatgggacgaccaactcacagcggcggaggcggcggcgggggtggaggtggggggggaggcggcgggggacgcaggagagacagctattatgatagaggctacgacagaggttacgaccgctacgaggattacgactaccgatatcggcgcagatcccccagcccctactattccagatataggtctcgcagccgttctcgctcttacagccctcgaagatactag

SEQ ID NO: 21030 - DNA, 2508 bp, Artificial Sequence
  Description of Artificial Sequence: Synthetic coding sequence
atggccgccagcgccgccgccgccagcgccgccgccgccagcgccgcctctggctcccctggccccggcgaaggtagcgcagggggtgaaaagcgtagcaccgccccgtcagccgccgcctcagccagcgccagcgcggcagcctcgagcccagctggtgggggggctgaagcgcttgagctgcttgagcattgcggcgtctgccgagaacggctcaggcctgagcgggagcctaggctgctgccttgcctccactccgcctgttccgcctgtctgggccctgcagcacctgcagccgcgaattcttccggtgatgggggtgccgccggggacggcacagtagtagactgcccagtgtgtaaacaacagtgtttcagcaaggacattgtggagaactacttcatgcgggattctggatccaaagcagctacagacgcccaggacgccaaccagtgttgcacgagctgcgaggacaatgcacccgccacgtcctactgcgtagaatgctctgaaccactgtgcgagacctgcgtcgaggctcatcagcgagtgaagtatacgaaggatcatactgttcgtagtaccggacctgccaagtctagggacggagaacggacagtgtattgcaatgtccacaagcatgagcctcttgtgttgttctgcgaatcttgcgataccttgacttgtcgcgattgtcagctgaacgcacacaaagaccatcagtaccaatttttagaggacgctgtgagaaaccagcgcaagctgctggcctcccttgttaagcgtttaggagataagcacgccacgctgcagaagtcaaccaaggaagtgaggagtagcataagacaggtgtccgatgtacagaaacgggttcaggttgatgttaaaatggcgatactgcaaattatgaaagagttgaacaaacggggcagggtcctcgtgaatgacgcccaaaaggtaacagagggtcaacaagagcgcctggagaggcagcactggacaatgacgaagattcagaaacaccaggaacatattctcaggttcgcttcatgggccttagagtccgataacaacaccgcacttctgctgagcaaaaagctaatttactttcagctgcatagagctcttaaaatgatcgttgatcccgttgagcctcatggagagatgaagtttcaatgggatctgaacgcctggactaagtctgccgaggcctttggtaaaatcgtcgctgagcgtccagggaccaattcaacaggacctgctcctatggctcccccgagggcacccgggcctctcagcaagcaaggaagcggatccagccagccaatggaggtccaggagggatatggcttcggtagcggcgacgacccctactcctccgcagagccgcacgtatcaggtgtcaaacgtagtcgcagtggagagggagaggtttccgggctgatgcggaaagtgccccgcgtgagcctggagcgattggatctagacctgacagcagacagtcagccaccagtgttcaaagtatttcccggcagtactaccgaagattataacttaatcgtcattgagcggggagcagctgctgctgcaacgggccagcctgggaccgcgccggctggtactcctggcgctccgccactggcaggcatggcaattgttaaagaggaggagaccgaagcggcaatcggcgcgccacctaccgcaactgagggtcccgaaaccaagcctgtgctgatggcacttgcagagggacccggcgccgagggtccaagactggcgagcccctccggaagtacgagtagcggcctggaggtcgtggcccctgaggggacgtcagctcccggaggcggtccaggcacactcgatgatagcgcgaccatttgtcgggtatgtcagaagcccggagacctggttatgtgtaaccagtgcgaattctgctttcacctcgactgccacctgcctgcattgcaggacgtgcccggggaagaatggtcctgcagcctgtgtcatgtgttgcctgatttgaaggaggaagacggctctctctctctggacggtgcagactccaccggcgttgtcgcgaagttaagcccggcgaaccaaaggaagtgtgagagggtcttattggccctgttttgtcacgagccttgccgaccattgcaccagttggctaccgattcaacattttcgctcgaccaacccggcggaaccctggacttgaccctcattagggcgcgtttacaggaaaaactttcacccccatacagctctcctcaagagttcgcccaggacgtgggccgcatgttcaaacaatttaacaagctgacagaggacaaggcggatgtccagagtatcatcggcctccagaggttttttgagacccgaatgaacgaggcgttcggcgatacgaaatttagtgcagtgctcgtcgaaccaccaccaatgtccttgcccggcgcaggtctgtcttctcaagagctaagcgggggcccaggggatggcccttag

SEQ ID NO: 21031 - DNA, 2262 bp, Artificial Sequence
  Description of Artificial Sequence: Synthetic coding sequence
atggccgccagcgccgccgccgccagcgccgccgccgccagcgccgccagcggctccccgggcccgggggaaggctccgccggtggagagaagaggtccaccgcgccatccgctgcagcctccgcgtctgcctccgccgcagctagctcccctgcgggtggcggcgccgaggctctcgaactcttggagcattgtggagtgtgcagagaacgtctgcggccggaaagagagcccaggttgcttccctgcctccattctgcatgctctgcatgcttaggtcccgcagcacctgcagcagccaacagttcaggggatgggggagccgctggggatggtacaggccccgccaagtcacgtgacggtgaaagaacggtatactgtaatgttcataaacacgagccattggtcctgttctgcgaatcctgcgacaccctcacatgccgcgactgccagctcaacgctcacaaggatcatcagtatcagtttttggaagacgccgtgcgtaatcagagaaagctccttgcctctctggtgaagagattgggtgacaagcacgcaacgctccagaagagtaccaaagaagtaagaagcagtatccgccaggtatccgatgtacagaaacgtgtgcaggttgacgtgaaaatggcaatcttacagattatgaaggagcttaataaacggggccgcgtgttggtgaacgacgcccaaaaagtgactgagggacagcaggagagactggagcgccagcattggactatgacaaaaatccaaaagcatcaggaacacattctgcggttcgcctcgtgggctctagaaagcgataacaataccgcactcctgctttccaagaaactgatctatttccaattgcacagagctctgaagatgatcgtcgatccggtggagccgcacggggagatgaagttccaatgggacttgaatgcctggaccaagtctgccgaggcctttggaaagatagtggctgagcggcctgggaccaacagcactggcccagccccgatggccccccccagagcgcccgggccgttgtctaagcagggaagcggctctagccagcccatggaggttcaagagggatacggattcggatcaggggacgatccctactccagcgctgagccgcatgtcagtggtgttaagcggtcacggtctggcgagggagaagtgagcggcttgatgcgcaaggtgccccgggtttcattagaacgcttagatctggacttgaccgccgactctcagcccccagtatttaaggtgtttccaggttccacaactgaggattacaatctcatcgtgattgaacgaggggccgctgcagccgcaaccggccagcctggaactgctcccgcagggacgcctggagctccaccgctagcaggaatggccatcgtgaaagaggaagagaccgaggcagcaatcggagccccccccactgccactgaagggccggagaccaagcctgtcctgatggcgttggccgaaggcccaggagcggaagggcccagactggcctctccgagcggaagcacatcctcaggtctcgaggtcgtcgctcccgaagggacgtcagccccaggcggtggtcctggaaccttagatgactccgccaccatctgccgggtgtgtcagaagcctggtgatttggttatgtgcaaccagtgcgaattctgctttcacctggattgtcatctccccgccctccaggacgtaccaggcgaagaatggagctgctcgttatgccacgtgctaccggacctcaaagaggaagacgggtcgcttagtcttgacggagccgactctactggcgttgtggcaaagttgagtccagcaaatcagaggaagtgtgaacgggtcctgctcgccttgttttgccacgaaccttgccgtcccttacaccagcttgccaccgattccacattcagcctggatcaaccaggtggcacgctggaccttacactcatccgggccagattacaagaaaagcttagtcctccttacagttccccacaggagttcgcacaggatgtgggccgcatgttcaagcagtttaacaagctaacagaagacaaagcagatgtccagtctataatcggactgcagcggttcttcgaaacccgcatgaacgaggcgttcggagacaccaaattttcagccgtcctggtggagccaccaccaatgagcctgccaggcgctggtcttagttcgcaggagcttagcggtggacctggtgatgggccgtag

SEQ ID NO: 21032 - DNA, 1503 bp, Artificial Sequence
  Description of Artificial Sequence: Synthetic coding sequence
atggaggtgagcaccaaccccagcagcaacatcgaccccggcgactacgtcgaaatgaatgattccattactcatttaccatccaaggtggtgattcaagatattaccatggaactgcactgccctctatgtaatgattggtttcgggaccctctgatgctctcatgtggccacaatttctgcgaggcctgtattcaggatttctggcgcctgcaagccaaagagacattctgtcccgagtgcaagatgctgtgccagtacaataactgcacctttaaccccgtgttggacaaactggtggagaaaataaagaagctgcccctcctgaaaggtcatcctcagtgcccggagcatggcgagaacttaaagctgtttagcaagcctgatggtaaactaatatgcttccaatgcaaggacgctcggctctccgtcggacaatctaaggagtttttacaaatttccgacgccgtgcacttctttactgaggagctggcaattcaacagggacagttagaaacaacactgaaggaactgcaaacactacgcaatatgcagaaggaggccatcgcggcccataaagaaaacaaactgcacctacaacagcatgtcagcatggaatttctgaaactgcaccaatttcttcactcaaaggagaaagatatactgacggagctacgcgaagaaggaaaggcgttaaatgaagaaatggaactgaatctgagtcaactccaggaacagtgcctactggccaaggacatgctcgtctctattcaagccaagaccgagcagcagaacagtttcgacttcctgaaagacatcaccacactgctgcacagcctggaacaggggatgaaggtattagctacgcgggagctcatttcccgcaagctgaatctagggcagtacaagggacccatccaatacatggtctggagagagatgcaggataccctgtgtccaggactgagccctttgaccttagatcctaagaccgctcatccaaatctggtgttgtctaagtcccagacgtcagtttggcacggtgatatcaaaaaaattatgcctgatgatcccgaaagatttgatagctccgtggcggtgttaggatccaggggctttacctctggtaaatggtattgggaagtagaggtggccaagaaaaccaaatggacagttggtgtggtgcgggagtccataatcagaaaaggcagctgcccactgacccctgaacaaggattttggctcttgcggctaagaaatcaaactgacctgaaagctctcgacctgccctctttttcactgacactaactaacaatctcgataaggtcggcatatatctagactacgaaggcggccaactgagcttctataacgccaagacaatgacacatatttataccttctcgaacacgtttatggagaagctgtatccatacttttgtccatgcctcaatgacggaggagaaaataaggagccacttcacatactccacccacagtag

SEQ ID NO: 21033 - DNA, 1026 bp, Artificial Sequence
  Description of Artificial Sequence: Synthetic coding sequence
atggaggaggagctggccatccagcagggccagctggagaccaccctgaaagagttgcagaccttgcgtaacatgcagaaagaagccatcgcagctcacaaggaaaataagcttcacttacagcaacacgtgagcatggaattcctgaagcttcaccagtttctacattctaaggaaaaagacattctgaccgaactgagagaggaaggcaaggccttaaacgaggaaatggagctaaatttgagtcaactgcaggaacagtgtttgcttgctaaggatatgcttgtgagcattcaggccaagaccgagcaacagaactcgttcgactttctaaaggatatcacaactcttctgcatagcctcgaacagggcatgaaggttctggcgacaagggaactcatatcaagaaaacttaatctgggtcagtacaaaggccctattcagtatatggtgtggcgtgaaatgcaggatactctatgccccggcctgtcgccattgaccctcgatcccaagaccgctcacccaaaccttgtcctttcaaagagtcagaccagtgtttggcacggggacataaagaaaatcatgcctgacgatcccgaacgttttgactcctccgttgccgtactaggaagcaggggatttacgtctggaaagtggtactgggaggtggaggtggccaagaagacaaagtggacagtgggcgtcgttcgcgaaagcattatcagaaaaggatcctgcccactcacgcctgagcagggtttctggctgctaagattacggaatcagactgatttaaaagccctcgacttgccatccttctctctgacgctcacaaataacctggacaaagtgggtatctatctggactatgagggagggcaactgtccttttataacgcaaagaccatgacacacatctacaccttctccaacaccttcatggagaagctgtatccctacttttgcccttgtctcaacgacggcggggagaacaaggagcccctgcatatactacaccctcagtag

SEQ ID NO: 21034 - DNA, 891 bp, Artificial Sequence
  Description of Artificial Sequence: Synthetic coding sequence
atggagttcctgaagctgcaccagttcctgcacagcaaggagaaggacatactgactgagttgagggaagagggcaaggcattaaatgaggagatggagctgaaccttagccaactgcaggaacagtgccttctcgccaaagacatgttggtgagcatccaggccaaaaccgaacagcagaattctttcgatttcctgaaggacattaccacactactccactccctcgaacagggtatgaaagttctggccacgagagagctgattagtcgtaagctgaacctagggcaatacaaagggccaatccagtacatggtttggcgcgagatgcaggatacactgtgcccaggcctcagccccctcaccttagaccccaagaccgcccaccccaatcttgtcctcagtaaatcccagacgagcgtttggcatggcgacattaagaaaattatgccagatgatcccgagcggttcgactcctcagtggctgtgctcggatccaggggtttcacctctggcaaatggtactgggaagtggaagtggccaaaaagactaagtggactgtgggcgtggtcagggaatccatcatccgtaagggcagttgccctctcacgcctgagcagggattctggcttttaaggcttagaaatcaaactgatctgaaagccctcgacctcccttccttttcgcttactctaaccaacaatcttgacaaggtgggcatttatctggattacgagggaggccagctgagcttttataacgcaaaaactatgacgcacatctacaccttttctaatacattcatggaaaaactctatccctatttttgcccttgtctgaacgatggaggggaaaataaggagccattgcacattctgcacccgcagtag

SEQ ID NO: 21035 - DNA, 840 bp, Artificial Sequence
  Description of Artificial Sequence: Synthetic coding sequence
atggagttcctgaagctgcaccagttcctgcacagcaaggagaaggacattctgacagaattgagagaggagggcaaagctttaaatgaagagatggaacttaacctgtcccagctccaggagcaatgtctgctggcaaaggatatgctggatattactactctgcttcacagcctggagcaaggcatgaaagtgctggctacacgagagttgatctctcgcaagctcaacctgggccagtataagggacctatccagtatatggtgtggcgcgagatgcaagatactctttgtcctggacttagccctctgactctggacccaaaaaccgcccatcctaatctggtgttatctaagtcccagacgtccgtgtggcacggagatatcaaaaagattatgccagacgatccagaacggtttgattcttctgtggccgtactgggctctcgcggcttcacgtccgggaagtggtattgggaagtcgaggttgctaaaaagacaaagtggaccgtaggcgtagttcgggagagtattattcggaaagggtcatgcccgcttacacccgagcagggcttttggctgctgcgattacgaaaccagaccgacctcaaagccttggacctgccaagcttctcactgacacttactaataatcttgataaagttggcatctacttggattatgaaggtgggcagttgtctttttacaatgctaagacgatgactcacatttatacttttagcaatacttttatggaaaaactttacccgtatttttgcccatgcctaaatgacggtggagagaacaaagagcccctccatattctccatccacagtag

SEQ ID NO: 21036 - DNA, 1503 bp, Artificial Sequence
  Description of Artificial Sequence: Synthetic coding sequence
atggaggtgagcaccaaccccagcagcaacatcgaccccggcgactacgtggagatgaacgatagtatcacacacttgccctctaaggtggtaatccaggacatcacaatggagctgcattgcccactctgcaatgactggtttcgcgatccgcttatgctctcctgcgggcataatttttgtgaggcctgtattcaggatttttggcgcctgcaggctaaagaaaccttctgtcccgagtgcaagatgctatgccagtacaataattgcaccttcaatccggtgctggataaacttgtggaaaaaattaaaaaactgcctctcttgaagggacatccccagtgcccagaacatggcgagaatcttaagctgttcagtaaacccgatggaaagctgatttgcttccagtgtaaagatgctcgcctgtcagtggggcagagcaaggaatttctgcagataagtgatgccgtacatttttttacggaggagctggccatacaacaggggcagctggaaacgacacttaaggagttgcagaccctgaggaatatgcaaaaagaagcaatcgccgcacataaagaaaacaagttacacctgcagcagcacgtaagtatggagtttcttaaactgcaccagtttctgcactccaaagagaaagacatcctcaccgagctgcgcgaagaagggaaggctctgaacgaagagatggaattaaacctgagtcaacttcaggagcaatgccttttggctaaagatatgctcgtgagtattcaggcaaaaactgagcaacagaactccttcgatttcttgaaggacatcacaaccttgctgcactctcttgagcaaggcatgaaagtactggccaccagggagctgatttcacgcaagttaaatttgggccagtataagggcccaatccaatatatggtttggcgggagatgcaggacactttgtgtcccgggctctccccactcacgctggatccgaagacagcccaccctaatctggtgctgtccaagagccagactagtgtgtggcacggcgacattaaaaagatcatgccggatgatcctgagcgctttgacagctctgtggccgtgctggggtcaagaggttttacttctggcaaatggtactgggaggttgaggtggctaaaaagactaagtggacagtgggagtggtccgggagtctataattcgcaaaggcagctgccctcttacccccgagcagggattttggctgctgcgtcttagaaatcagacggatcttaaagcattggatctgcctagcttcagcctgactctaacaaacaatctggacaaagttgggatatacttggactatgaaggcgggcaacttagtttctacaatgctaaaactatgacccacatttacacattttctaacacattcatggaaaagctgtacccctacttttgtccctgtctcaatgatggcggcgaaaacaaggagccgcttcacattttacacccccagtag

SEQ ID NO: 21037 - DNA, 891 bp, Artificial Sequence
  Description of Artificial Sequence: Synthetic coding sequence
atggagttcctgaagctgcaccagttcctgcacagcaaggagaaggacatacttacagagctgcgggaggaagggaaagcacttaacgaggaaatggagctgaacctcagtcagttgcaagagcagtgcctccttgccaaagacatgttggtgtctatccaggccaagaccgagcagcaaaacagcttcgactttttgaaggacatcacgaccctgctgcattctttagaacaaggaatgaaagtgctggcgactcgcgagttgattagccgcaagctgaatctgggccagtataagggacccattcagtacatggtgtggcgcgaaatgcaggacaccctttgtccaggtctctccccgctgactttagatcccaagactgcgcatccaaacctcgtgctcagcaaatcacagacatccgtgtggcacggagacatcaagaaaataatgccagatgaccctgagcgattcgacagcagcgtcgctgtgcttggatcacggggatttacatcggggaagtggtactgggaagtggaggtggctaagaagactaagtggacagtcggagttgtgagggaatctatcatccgcaagggctcttgtcccctgacacccgaacaggggttttggctgctgcgccttcgaaatcaaacggatctgaaggcattagacttgccatcctttagcttaacgctcaccaacaacttggataaggtgggaatctacttggattacgaaggaggccagcttagtttttacaacgccaagactatgacccatatttacacattttctaacacttttatggagaaattatatccctacttctgcccttgcttgaatgacgggggtgagaacaaagaacccctgcacatacttcaccctcaatag

SEQ ID NO: 21038 - DNA, 1494 bp, Artificial Sequence
  Description of Artificial Sequence: Synthetic coding sequence
atggagggcagcggcgagcagcccggcccccagccccagcaccccggtgaccacaggatccgtgatggcgactttgtcgtgctgaagcgtgaagacgtgtttaaagcagttcaggtgcagcggcggaaaaaggttacttttgagaagcaatggttctacctggacaacgtgatcggtcacagttacgggaccgcgtttgaagttacctctggagggagcctgcagcccaaaaaaaagcgagaagagccaacagcggagacgaaggaagctggtacagacaaccgcaacatcgtggacgacgggaagtcacagaaactcacccaggatgacataaaagcccttaaggacaagggcattaagggcgaagaaatcgtccaacagctgatcgagaacagcacaaccttccgggacaaaacagagtttgcacaggataaatatatcaagaagaagaagaaaaaatatgaggccatcatcaccgtggtgaaacccagcacacgcatcttatccatcatgtactatgcgcgagagcccggtaagatcaaccacatgaggtatgatacccttgcacagatgctcacacttggaaatattcgcgccggcaacaaaatgatcgtgatggagacttgcgcgggcctcgtactcggtgctatgatggagcggatgggaggattcggtagcatcattcagttgtatcctggaggtggccccgtacgcgccgccacggcttgctttggctttccaaagtcttttctctctggactgtacgaatttcccctgaataaggtggattccctccttcacggaacattttcagccaaaatgctgagttcagaacccaaggacagcgcactcgttgaagagagtaacggaaccctagaggaaaaacaagcctccgaacaggagaatgaggattccatggcagaagcccccgagtctaatcatccggaggaccaagaaacgatggaaactatctctcaggaccccgagcacaagggcccaaaggaacgaggaagtaaaaaggattacatccaggaaaagcagagacgccaagaagagcagaggaagcgccacctggaggcagccgccctgctcagcgagaggaacgcagatggcctcattgttgcaagccgctttcacccaacgcctctgctgctgtctctcctagacttcgtggcccccagccgacccttcgttgtctactgtcaatacaaggagccattactagagtgctataccaagttgagagaaaggggtggtgtgattaatctgaggctctccgaaacttggttgcgcaactaccaggtgttgcccgacaggtctcacccaaaacttcttatgagcggtggcggaggctatctgctatcaggattcactgtcgcaatggacaatctaaaggctgatacctctctgaaaagcaatgcttcaactctggagtctcacgagactgaagaaccagccgcaaagaagcgtaagtgtcccgagtctgactcctag

SEQ ID NO: 21039 - DNA, 984 bp, Artificial Sequence
  Description of Artificial Sequence: Synthetic coding sequence
atgtactacgcccgggagcccggcaagatcaaccacatgcggtacgacaccctcgctcaaatgctgacattagggaatatccgcgcaggcaacaagatgatagtgatggaaacttgcgccgggctggtgcttggagccatgatggagcgaatgggaggattcgggagcatcatccagctctaccccggtgggggccccgttcgagcagctactgcgtgtttcgggtttccaaagtcttttctaagcgggttgtacgaatttccactcaacaaggtcgattccctgctgcacggcaccttctcagctaagatgctgagttccgaaccaaaggattcagcacttgtggaagaatcgaatggcacactggaggagaagcaggcctctgagcaagaaaatgaagacagcatggccgaggcccccgagagcaaccaccccgaagaccaagagactatggaaaccatctcacaggatccggaacataaaggacctaaagagcgagggtccaaaaaagattacatacaagagaagcagcgacgacaagaagagcaacggaagagacacttggaggccgcggcccttctttccgagagaaatgcagacggattgatagtggcttctcggtttcatcccacccccctgctgctgagcctcctggactttgtagcaccgagtagaccctttgtagtctattgtcaatacaaggagcctttattagagtgttatactaagctgcgagaaagggggggtgttattaatctgaggctgtctgaaacatggctgaggaactatcaggtgctgccagacagatcacacccgaaactccttatgtcaggtggtggcgggtatttgctgtctgggtttaccgtggccatggacaatctcaaagccgacacctccctcaagagcaatgccagcacactcgagagccacgagacggaggagcctgcagccaagaagaggaagtgtcccgaatccgattcatag

SEQ ID NO: 21040 - DNA, 963 bp, Artificial Sequence
  Description of Artificial Sequence: Synthetic coding sequence
atgagcttcgtggcctacgaggagctgatcaaggagggcgacaccgctatcctttccctcgggcacggagcaatggtggctgtcagggtgcagaggggagctcagacacagactaggcatggcgttttgcggcactcagttgacctgattggacggccctttgggtccaaggtcacatgcggaagaggaggctgggtctacgtgctgcaccctacaccagaattatggacattgaatctgccgcatcgcacacagatcctgtattcaacagatatagccctgataaccatgatgctcgaattaaggcccggatctgtggtgtgtgagtctggcacgggtagcggcagtgttagccacgcaatcattcgcaccatcgcacctaccggacatttgcacaccgtagagtttcaccagcagcgggccgagaaggccagagaggagttccaggaacacagggtaggacggtgggttaccgtgcggacccaagatgtgtgcaggtcgggcttcggggtttcacatgtggctgatgctgtatttttagatattccatcgccttgggaggccgttggccacgcttgggatgccctgaaagtcgaaggcggccgattctgctccttctcaccctgtatagaacaggttcaaagaacctgccaagcgctggcagcccgtggctttagtgagctgtccactctggaggtgctcccccaggtctacaatgtccgaaccgtttcactccctccgccagacttaggtaccggtactgacggtcctgccgggtcagatacctccccattcaggtcaggaacacccatgaaagaagctgtaggccataccgggtatctcacccttgccaggagctggggtgagctgacccagaatccctgccccgcgctgccctccgctcgtaggccggggcagcccaggaaccagggtggagaccctgctctgtggccccccgggtag

SEQ ID NO: 21041 - DNA, 870 bp, Artificial Sequence
  Description of Artificial Sequence: Synthetic coding sequence
atgagcttcgtggcctacgaggagctgatcaaggagggcgacaccgcaatactgtccttaggacatggcgcaatggttgccgtcagggtccaacgcggtgcccagacacaaactaggcacggtgtactcaggcactctgtcgatctgatcggcagacctttcggcagcaaggttacatgcggaaggggcgggtgggtctatgttctccaccctacccccgagctgtggaccctgaatctcccacataggacccagattctctacagcacagatattgccctgattactatgatgctggaattgagacccggatccgtggtttgcgagagcggaaccggatcggggtccgtcagccacgccattatacgcaccattgcacccaccggtcacctgcacactgttgagttccaccaacaacgcgccgagaaggcccgtgaagaatttcaggaacaccgagtcggccggtgggttactgttcggacccaggatgtgtgccggagcggctttggcgtgtcgcacgtcgccgatgctgtatttctggacatccctagcccttgggaggccgtggggcacgcctgggatgctctgaaagttgaagggggccggttttgttcgttcagtccatgcatagagcaagttcagaggacgtgccaggctctagccgctcggggattcagtgaactcagtaccctagaggtgcttcctcaggtgtacaatgtgagaaccgtgtcgctgccgccacctgatttagggacaggcaccgacggcccagctgggagtgacaccagcccatttcgctctggtactcccatgaaggaagccgtaggccataccggttacctgacttttgctacgaaaacacctgggtag

SEQ ID NO: 21042 - DNA, 1245 bp, Artificial Sequence
  Description of Artificial Sequence: Synthetic coding sequence
atgagcggcctggacggcggcaacaagctgcccctggcccagaccggaggactggctgcccctgaccacgccagcggagaccctgaccgggaccagtgtcaagggctcagggaggaaactgaggccacacaggtgatggcaaacacaggaggaggtagcctggaaacggttgctgagggaggcgcaagtcaagaccccgttgactgtggacccgcactgcgcgttcctgtcgccgggagtcggggaggggcggctaccaaggccggtcaagaggacgcgccaccttccacgaaaggtctggaggctgcaagtgccgcggaagccgccgactcttcacaaaagaatgggtgccagcttggagaaccccgtgggccagccggacagaaagcccttgaagcttgcggcgctggaggattgggatcccagatgattcctgggaaaaaagccaaggaggtgacaacgaagaagcgtgctattagtgccgccgtggaaaaagagggtgaggccggtgctgccatggaagaaaaaaaggttgttcagaaggagaagaaggtcgccggaggggtgaaggaagaaacccgtccgcgggcccccaagattaataattgcatggacagcctggaagcgatcgatcaggagctatccaatgtcaatgcccaagctgacagagcttttctgcagctagagcgcaaattcggcagaatgcgccgcctgcacatgcaacggcgttcatttataatccaaaatatccccggcttctgggtgacagcctttagaaatcatcctcaattgtcacctatgatcagcggacaggacgaagacatgttacggtatatgataaaccttgaggtggaggagctcaaacaccctagagctggttgtaagttcaaattcatttttcaggggaatccatacttccgcaacgagggactggtgaaagaatatgagagaaggagtagtggccgggtcgtctctctatccacacccatcaggtggcacaggggacaggatcctcaggcccacatccataggaaccgcgagggcaacacaatccctagcttctttaattggttcagtgaccactcactgctcgaattcgatagaatagccgaaattatcaagggcgaactgtggccaaaccccctacagtactacctaatgggcgaggggccccgtagaggaataagggggcctccccggcagcccgtagaaagcgcaaggagctttagattccaaagcggttag

SEQ ID NO: 21043 - DNA, 1254 bp, Artificial Sequence
  Description of Artificial Sequence: Synthetic coding sequence
atgagcggccggagccggggccggaagagcagccgggccaagaaccggggtaagggaagggccaaggcccgagtccgtcctgcacccgacgacgctcctcgggatcccgacccctcccaataccagtctctcggggaggatacacaggccgcccaggttcaggcaggagcgggctggggagggctcgaggcagcagcatctgctcagctcttacgtctcggcgaagaggctgcgtgtcgcctgcccctggactgtggtctggccctgagggcgagggccgccggggaccacggccaggctgctgcgagaccgggacccggaaaagcagcgtcattgtccgagcggttggctgccgacactgtgtttgtaggtaccgcaggtaccgtcggtcgacccaagaatgctcctcgagtcggaaataggaggggccctgccggcaagaaggcacccgagacctgctcaactgccggacggggccctcaggtgattgctggcggccgacagaagaagggggctgcgggagagaatacttcggtgtctgctggcgaggagaaaaaagaggaacgggatgcagggagcggccctcctgcgaccgagggctcaatggacacactcgaaaatgtgcagttaaagctggagaacatgaatgcccaagcagacagggcctatctgcggctgagccgaaaattcgggcagctccggctgcagcatcttgagcgaaggaatcacttaattcagaacatcccaggattctggggacaggcgttccagaaccacccacagttggcaagcttcctgaacagtcaggagaaggaagtcctttcatatctgaatagtctcgaggtcgaagaactgggactagcgcgcctgggttacaagatcaagttttattttgatagaaatccatacttccagaacaaagtgttgatcaaagagtatggctgcggtccctctggccaggtggtgagtcgcagtacgcctatccagtggttgcctggccacgacctgcagtccctctcacagggaaaccccgaaaataataggtcattctttgggtggttttcaaaccattcgagtattgagtccgataaaattgtggagatcatcaacgaggaactgtggcctaatccactgcagttttacctcctttcagaaggcgcccgggtggaaaagggaaaggagaaggaaggccggcagggacccgggaaacagcccatggagaccacacagcctggggtgagccaatctaattag

SEQ ID NO: 21044 - DNA, 1233 bp, Artificial Sequence
  Description of Artificial Sequence: Synthetic coding sequence
atgagcctgcccgagagcccccacagccccgccaccctggactacgctctcgaagatcctcatcagggtcagaggagccgcgagaaatcaaaggccaccgaagtgatggcagatatgtttgatgggcgcctcgaaccaatcgtgtttccaccacctcgccttccagaggagggggtggctcctcaggacccagccgacggcggccatacctttcatattcttgtcgatgcggggagaagccatggcgccataaaggccggtcaagaagtaaccccccctcctgccgaaggcctcgaagcggcttcggcctccctaactacggatgggagcctgaagaatggatttccgggggaagagacccacggactggggggagaaaaagctctggaaacctgtggcgctggacgcagcgagtccgaggtgatcgccgaggggaaggccgaggacgtcaaacccgaagagtgcgccatgttttccgcccctgttgatgaaaagccaggcggagaggagatggatgtagctgaggagaaccgggccatcgatgaggtcaatcgggaagctggtccaggtccagggcctggtccccttaacgtgggcttgcatctgaatcccctggaatccatccagttggagctggattctgtcaatgccgaagccgaccgggccctgctccaagttgagaggcggttcggtcagattcacgagtattacctcgaacaaaggaatgatattattaggaatattccgggcttttgggttactgctttccggcatcacccacagttgtcggctatgatcagagggcaggacgcagaaatgctgagctacctgacaaacctagaagtgaaggagctgcgacacccaaggacagggtgcaagttcaagtttttttttcagagaaacccttactttaggaacaaactaattgtgaaggtctatgaagttagatccttcggacaggtggtgagcttctcaacgctcataatgtggaggcgcggccacggcccacagtccttcatacaccggaacagacacgtgatatgcagcttcttcacttggttttcagaccactcgctgcccgaatctgatagaattgcccagataattaaggaagatctgtggtccaacccgttacagtattacttactaggagaggacgcccaccgagcccgccggaggctggtccgtgaaccagttgaaatccctagacctttcggcttccagtgcggatag

SEQ ID NO: 21045 - DNA, 2415 bp, Artificial Sequence
  Description of Artificial Sequence: Synthetic coding sequence
atggccgcccaccggcccggccccctgaagcagcagaacaaggcccataagggaggtcgccatagggggagaggatcggctcaaagagacggaaagggaaggttggctctgaagacgttgagcaagaaagtccggaaagagctgagtcgggtggatcagcgacatagagctagtcaactgcgaaagcaaaagaaagaagcagtactagctgaaaagcgtcaactgggagggaaagacggacctccccatcaggtcttagtagtgcctctgcacagccggatctccctcccagaggccatgcagctgttgcaggatcgggatacaggcacggtccatctcaatgagctgggcaacactcaaaactttatgctgctatgtcccaggctgaagcaccgctggttctttacctccgctagacctggcgatcttcatgtagtcttggatatggctaaagtggccgacacaatcctgttcttactcgaccctctagaagggtgggacagcactggtgattattgtttgtcttgcttgttcgctcagggcttgcctacttacaccctggccgttcagggaattagcggcctgcccctcaaaaagcaaatcgatactcgcaaaaagttgagcaaggccgtggagaagcggtttccccacgacaaactgttgttactggacacccagcaggaggccgggatgttactccgccagttagcaaatcagaagcagcagcacttagcgtttagagaccgaagagcatacttatttgcccatgccgttgattttgtaccctcagaagaaaataacctcgtcggtaccctcaaaatctccggatacgtgcggggacaaacactgaatgtgaacaggctgttgcatatcgtcggctacggcgattttcagatgaagcagattgatgctcctggcgatcccttccccctgaatcctaggggaatcaaaccccaaaaggatcccgatatggctatggagatctgcgctacagacgccgtcgatgatatggaagaagggctgaaagtgctgatgaaagctgacccagggaggcaggagagcctgcaggcagaggtaattccagaccccatggagggggagcaaacctggcctaccgaagaggaactctctgaggccaaggactttctcaaggaatccagcaaagtggtgaaaaaggtcccaaaagggacctccagctaccaggccgagtggatcttggatggggggtctcagagtggcggggaaggggacgagtatgaatacgacgatatggagcacgaggactttatggaagaagagagccaggacgaatcctccgaggaagaggaagaatatgagaccatgactattggtgaaagtgtgcacgatgacctgtacgataagaaggttgatgaggaggctgaagccaagatgttggaaaagtacaagcaggagaggctcgaggagatgtttcccgacgaggtggacacaccgcgagacgttgcagctagaattcgcttccagaaatacagagggctaaaatcatttagaacctccccttgggatcctaaggagaacctaccacaggattatgcccgaatcttccagttccagaactttacaaatactcgcaaatccattttcaaagaggtggaggagaaggaagttgagggggcagaggtggggtggtacgtgaccctacacgtcagtgaagtgccggtgtctgttgttgagtgctttcgacagggaacacctttgattgcattttctctcctgccccatgagcaaaaaatgtccgtgctgaatatggttgtgagacgggacccagggaatacagagcctgtgaaggccaaggaagaactcatctttcactgcgggtttcggcgtttccgggcctcaccgttgttttctcagcatactgcagctgacaaacacaaacttcagagattcttgaccgccgacatggctctggtcgccaccgtttacgcccctataacgttccctcctgcttccgtgcttttgtttaaacaaaagtccaatggcatgcacagtttgattgcaaccgggcatctgatgtctgtcgaccctgataggatggtgattaagagggtagttctctcaggtcatccattcaagatcttcacaaagatggccgttgtccgttacatgttcttcaatcgcgaggatgtgctatggttcaagccagtagagctgcgtacaaagtggggcaggcgtggacatatcaaggaaccattaggcacccacggacatatgaaatgctccttcgacggcaaactcaagtcgcaagataccgtgctaatgaacttatataagcgcgtgttccccaaatggacctacgacccatacgtgccagagcctgtaccttggctcaaaagtgagatttcctccaccgtacctcagggcggcatggaatag

SEQ ID NO: 21046 - DNA, 57 bp, Artificial Sequence
  Description of Artificial Sequence: Synthetic coding sequence
tgcaagcagagctgcgtgagcatcgccagctgcgaggccgccgagctcaacctgtag

SEQ ID NO: 21047 - DNA, 2319 bp, Artificial Sequence
  Description of Artificial Sequence: Synthetic coding sequence
atgaaccggctgcggaacgccaagatctacgtggagcgggccgtgaaacaaaagaagattttcaccattcagggttgttaccccgttattcgctgtctacttaggcgccgtggttgggtagagaagaaaatggtgcaccgctcagggcccactctgctacccccacagaaagacttggacagcagtgctatgggagatagtgatacaaccgaggacgaagacgaggatgaagatgaggaatttcagccctcacaactatttgatttcgacgacttactgaagtttgatgatctggatggcacgcacgcactaatggtaggcttgtgcctcaatttgaggaaccttccctggttcgacgaggtggatgctaattccttctttcctcggtgttattgtctgggtgcggaagacgataaaaaggcttttattgaagatttctggttgaccgcagcaaggaacgtgttgaagctggtggtaaaatcggagtggaagtcttaccctatccaggccgtagaggaggaggcttctggcgacaaacagcctaagaagcaggagaaaaacccggtgctggtgtcacctgagtttgtcgacgaagccttatgcgcgtgtgaagaatatttgtcaaatctcgcccacatggatatcgataaagatctcgaggctccactgtatctgacacccgagggttggtctctgtttctccaacggtattaccaggtcgttcacgagggtgcagagcttcggcaccttgacacccaggttcagaggtgcgaagacatattacaacagcttcaggctgttgtaccccagatagacatggaaggcgaccgtaatatctggatcgttaagccaggggccaagtcgaggggccgcgggattatgtgcatggaccacctggaagaaatgctaaaattggtgaatggtaaccctgtcgtgatgaaagatgggaaatgggtggtacagaagtacattgagcggcccctcttgattttcggaaccaagtttgacttgaggcaatggtttcttgtgacagattggaaccccttaacagtctggttctaccgcgacagctacatccgattcagcacacagcccttctcactgaaaaacctggacaatagtgtgcacctgtgtaacaacagcatccagaaacatcttgaaaattcatgtcaccgccatcccctgcttccacccgataacatgtggtcctcccagcggtttcaggcacacctgcaagagatgggagcccccaatgcttggtccacaattattgtacccggtatgaaagatgcggtcatccacgcactccagaccagccaagacactgtgcagtgccggaaggcctcttttgagttgtatggggcggacttcgtgttcggggaagatttccagccatggctgattgaaattaacgcaagccccacaatggcacctagcaccgcagtgaccgctagactgtgcgccggcgtgcaagcagacacactccgagtcgttatcgatagaatgcttgatcgcaattgtgacacaggagctttcgagctgatctacaagcagcctgccgttgaagtgcctcagtacgtggggatccggcttctagtcgagggcttcacaattaaaaaacccatggccatgtgccacagacgaatgggggtacggcccgcagtccccctcctaacccagcgtgggtcaggtgaggcgcggcatcatttcccgtctctgcacactaaggctcagttgccatcccctcacgtgctacgccatcagggacaggttttgaggagacagcatagcaaactcgtgggtacaaaggccctgagcaccacagggaaagcactgcggacactgccaacggctaaggtttttatttctctgcctcccaacttggactttaaggtcgcccccagtatcttgaaacctagaaaggcacccgccctgctgtgtctccgcgggccccaactggaagtgccctgttgcctctgccccctgaagtcggagcagtttctggcacccgtggggagatctcgtcctaaagccaacagccgcccagactgcgataagccaagagcagaagcttgccccatgaagcgactctcccctttaaagccactgccgctggtgggaactttccagcgcaggagagggcttggcgatatgaaattgggtaagccgcttctgaggtttcctaccgcacttgtccttgatcccacccctaataagaagaaacaagtgaagtatctcggtctggacagcatcgctgtgggcggttccagggtggatggcgccagaccctgtacccctggaagtactgccagggcgtag

SEQ ID NO: 21048 - DNA, 723 bp, Artificial Sequence
  Description of Artificial Sequence: Synthetic coding sequence
atgttccagcggctgaacaagatgttcgtgggcgaggtgagcagctcctcaaatcaggaaccagaattcaatgagaaagaggacgacgagtggatcttagtcgacttcatagacacctgcacaggcttttcagccgaggaagaagaggaggaggaggacatctctgaggaaagcccaacagagcacccgtccgtattcagctgtctcccggcctctctcgaatgccttgccgataccagtgacagttgcttcctacagtttgagtcttgtcccatggaggagtcctggttcatcactccacctccctgctttacggccggggggctgacgaccatcaaggtggaaacgagtcctatggaaaatctgttgatcgagcaccccagtatgagcgtgtacgccgtgcataacagctgccccggactctcagaagccacacgcggaactgacgagttgcattcaccatcatcaccacgcgtggaggctcagaacgaaatgggccagcacattcattgctacgtcgccgcccttgcagctcatacaaccttcttagagcaacctaagtcattccgcccatcgcagtggattaaagagcacagcgaacggcagccactgaaccgaaactccctgaggaggcaaaacttgacccgcgactgtcacccgcgtcaggttaaacataacggctgggtcgtgcatcagccctgtcccaggcagtacaattattag

SEQ ID NO: 21049 - DNA, 558 bp, Artificial Sequence
  Description of Artificial Sequence: Synthetic coding sequence
atgttccagcggctgaacaagatgttcgtgggcgaggtgagcagctcttcaaatcaggagcctgagttcaatgagaaagaagatgacgaatggattctggttgactttatcgacacatgtacagggttctccgccgaggaagaggaagaagaggaagatatctccgaggaaagtcctaccgaacacccatccgtcttttcttgcttgccggcaagtctggagtgtttggccgatacttctgattcatgctttctgcagttcgagtcttgtcctatggaggaaagctggtttatcaccccgcccccctgtttcacagcaggcggactgactactattaaggtcgaaacaagtcccatggagaatctcctcatcgagcaccctagcatgtccgtatacgccgtccacaattcttgccccggcttaagcgaagcaacccgcggcaccgatgagctacacagcccaagttccccccgatatagtcaagactgtcatcctagacaggtaaaacacaacggatgggtggtccaccagccttgccctcggcagtacaattactag

SEQ ID NO: 21050 - DNA, 495 bp, Artificial Sequence
  Description of Artificial Sequence: Synthetic coding sequence
atgttccagcggctgaacaagatgttcgtgggcgaggtgagcagctccagtaatcaggagccagagttcaacgagaaagaggacgatgaatggattctggtggatttcatcgacacctgcacgggtttctctgcagaggaagaggaggaggaggaagacattagtgaagagtcaccaaccgagcatccatccgttttctcttgcctccccgcctctctcgagtgcctggcagatacctcagacagttgctttctgcagttcgagtcgtgccccatggaggaatcttggttcatcaccccacccccatgcttcacggcaggcgggcttactactatcaaagtagaaaccagccccatggaaaatcttctcatcgagcatccttcaatgtccgtgtacgccgtacataactcatgccctggactatccgaagccacccgaggcaccgacgagctccatagcccttcctccccaagggctagaaagtcctgtttgtag

SEQ ID NO: 21051 - DNA, 663 bp, Artificial Sequence
  Description of Artificial Sequence: Synthetic coding sequence
atgttccagcggctgagcagcctgttcttcagcacccccagcccccccgaagatcccgattgtcctcgggccttcgtttcagaggaggacgaggtggatggttggctgattattgatcttccagattcgtacgcagcccctcccagccccggagcagcccccgccccagcagggcgccccccacccgcacccagcctgatggacgagtcctggtttgtgacgccccccgcatgcttcaccgccgaagggcctggcctgggccccgctcgcctgcaatcctcacctctggaggacttactgatcgaacatcctagcatgtccgtttacgtgaccggaagcaccattgtcctggagccagggagtccatcccccctacccgacgcggcattgcctgacggtgacctgtcggagggcgaactaaccccggccagacgagagccacgcgcagctcgccacgctgctcccctacccgcaagagccgctcttctggagaaagccgggcaagtcaggagactgcagagggcccggcagagagctgagcgtcacgccttgagtgccaaggctgtgcaacgccagaatagagccagagagtcgcggccacgcagatccaagaatcagtcctccttcatctatcagccttgccagcggcagtttaactactag

SEQ ID NO: 21052 - DNA, 663 bp, Artificial Sequence
  Description of Artificial Sequence: Synthetic coding sequence
atgttccagcggctgagcagcctgttcttcagcacccccagcccccctgaagacccagattgccccagggccttcgtatccgaggaggacgaagtggatggctggttgatcatagatctgcctgatagctatgccgcacccccctcccctggtgcagcacccgccccagccggtagacccccaccagccccctccttgatggacgagtcatggtttgtgaccccccccgcttgcttcaccgcggagggccctggtctgggaccggctcgcctgcaaagttcccctttggaggatctgcttatagagcatccctctatgtcggtgtacgtcacaggctctacgatcgtcctggaaccgggatctccatcacctctacccgacgctgccctgcctgacggagatctctccgagggcgaacttacgccggctaggcgggagccaagagcggccagacacgcagcgcctctcccagcgcgcgcagccctacttgagaaggctggacaggtccgtagactgcagcgcgcccgccagcgcgccgaaaggcatgccctgagcgcgaaggctgtccagcgccaaaacagagctagagaatccagacctaggcggagtaagaaccaaagctccttcatttatcagccatgccagcgccagtttaattactag

SEQ ID NO: 21053 - DNA, 234 bp, Artificial Sequence
  Description of Artificial Sequence: Synthetic coding sequence
atgttccagcggctgagcagcctgttcttcagcacccccagcccccctgaggacccagattgcccaagggcctttgtgtctgaggaagacgaggtggatggctggctgatcattgatctccctgacagttatgctgccccaccaagtcccggagccgccccggcacctgccgggcggcccccccccgctccgtccttaatggatgagagctggtttgtgaccccacctgcttag

SEQ ID NO: 21054 - DNA, 267 bp, Artificial Sequence
  Description of Artificial Sequence: Synthetic coding sequence
atgttccagcggctgagcagcctgttcttcagcacccccagcccccccgaggatcccgattgcccccgagcttttgtctcagaggaggacgaggtggatggatggttaattatcgacttaccagaggggcctggtctgggcccggcgaggttgcagtcatcgcctctcgaagacctgctgatcgagcatccatctatgagtgtgtatgtgaccggttcgaccatcgtcctggaaccaggctccccgtcccctctgcccgacgcctag

SEQ ID NO: 21055 - DNA, 915 bp, Artificial Sequence
  Description of Artificial Sequence: Synthetic coding sequence
atggccacctggaagagcccctgcttcctgtactgcctgttcatcttgggcccacggctaaccggtcagaataattcagtggatctgactaacgaagaaaccacagactcaactacatctaaaatctccccctcagaagacacccagcaggagaatgggagcatgttcagtctgatcacctggaacatagacggcctggatctcaataacctgagcgagcgcgcccggggggtgtgctcttatttggcactgtattctcccgacgtcatcttcctgcaggaggtaattcccccatactactcatatcttaaaaagcgtagttcaaactacgaaattatcactggtcacgaagaagggtattttacggcaattatgcttaagaaaagccgagtaaaattgaagagccaggagattatcccattccctagcacaaagatgatgcgcaatcttctgtgcgtacatgtgaacgtctccggtaatgagctttgtctcatgaccagtcatctcgaaagcaccagaggacacgctgccgagagaatgaaccagctcaaaatggtcttgaagaagatgcaggaggccccagaatcggcaaccgtgatttttgccggagacaccaatctgagagatcgggaggtaacgagatgtgggggtctgcctaacaatatagttgacgtctgggagttcctgggcaagccaaagcactgccaatatacatgggatacacagatgaatagcaatctcggcattacagctgcctgcaagttgcgtttcgacaggatattttttcgggctgctgctgaagagggccatatcatcccaagatcactggacttgctgggcctggaaaagctggattgcggccgcttcccaagtgaccactgggggctgctgtgtaacctcgatatcatactgtag

SEQ ID NO: 21056 - DNA, 1089 bp, Artificial Sequence
  Description of Artificial Sequence: Synthetic coding sequence
atggagctgggcagctgcctggagggcggccgggaggccgccgaggaagaaggcgaacctgaggtcaaaaagaggcgcctcttatgcgtggagttcgcatctgtcgccagctgtgatgccgctgtcgctcaatgtttcctggcagagaacgactgggagatggaacgggccctgaactcttatttcgagccccctgtagaggagtccgccttggaacggagaccagaaaccatttcggagcccaagacctacgtggatttaaccaatgaagagacgacggactcaaccaccagcaagatctccccatccgaggatacacagcaagagaacggttctatgtttagtctgattacctggaacatcgacggacttgacctgaataatcttagcgagcgtgcaaggggggtctgctcatatctggcactgtattctccagatgtgatctttctgcaggaagtaatcccaccctattatagttacctgaaaaagcggagttcgaattacgagatcattacggggcacgaagagggctatttcacggccattatgctgaagaaatccagagtcaaattaaagtctcaggaaatcattccatttccatccactaagatgatgagaaacctactctgtgtgcatgtcaatgtctctggaaatgagctgtgtcttatgacgtcacacctcgaaagtacacgcgggcacgctgcggaaagaatgaaccagcttaagatggtgctgaagaaaatgcaggaggccccagaatcagcaacggtaattttcgcgggagacactaacctgcgggacagggaggtgaccaggtgtggggggctccctaataacatcgtggatgtgtgggagtttttgggaaagcccaaacactgccaatacacttgggacacgcagatgaatagtaatctcggcattactgcagcctgcaagctgagattcgatcgcatcttctttagagccgccgcagaggaaggtcacatcattcctcgctctctggatctgctgggcctagaaaagttggattgtggaagatttccctccgaccactgggggcttttgtgcaatcttgacatcatactctag

SEQ ID NO: 21057 - DNA, 855 bp, Artificial Sequence
  Description of Artificial Sequence: Synthetic coding sequence
atggagctgggcagctgcctggagggcggccgggaggccgccgaggaggaaggcgagcctgaggtgaaaaagcggcggttgctatgcgtggaatttgcctccgtggcgagttgtgatgcagccgttgcacaatgtttcctggcggaaaatgattgggaaatggagagggccctgaacagctatttcgagccttactctcccgacgtgatctttctgcaggaagttattcccccttactatagctacctgaagaagcggtcctcgaattacgaaatcatcaccggccacgaggagggatacttcacagccataatgttaaaaaagagccgtgtaaagctaaagtctcaggagatcatccccttcccatccacaaaaatgatgcggaatcttctgtgtgtgcacgtgaatgtgtctgggaatgaattatgcctcatgacctcacacttagagtcaacacgaggacacgctgctgagcgaatgaaccagctgaagatggtgcttaaaaagatgcaggaggctcctgagtcagctaccgtcatcttcgctggagacacaaatctgcgggatcgggaagtgacccggtgtggcggactgcctaataacatagtcgatgtctgggaatttttgggaaaacccaagcattgccagtacacatgggacactcagatgaattcaaatctcggaatcaccgcagcatgcaagctgaggtttgatcggatctttttccgtgccgccgccgaagagggacacataatcccgcgtagccttgatctcctgggtctcgagaagctcgactgcggccgattcccctctgaccattggggtctgctgtgcaacttggacatcatcctgtag

SEQ ID NO: 21058 - DNA, 1179 bp, Artificial Sequence
  Description of Artificial Sequence: Synthetic coding sequence
atgcgggagcggcacgacaccggcgcctgcgccgagccccgggtgggcctgctgtttagactcaaaggccgatgccgcgggggaagaaaaatggaactgggcagctgcctggagggggggagggaagcagcagaggaggagggggaacccgaagttaagaaacgcagacttctgtgcgtggagtttgccagtgtcgcttcatgcgacgccgctgtggctcagtgttttttggcagagaatgactgggaaatggaaagggccctcaattcctactttgaacccccagttgaggaaagcgctcttgagcggaggccggagacaatttcagagcccaaaacctatgtagatctgacgaatgaagagacgacagactctactaccagcaaaatcagccccagtgaagacacccagcaggaaaacggcagtatgttcagtctgatcacttggaatatcgacggcctcgatctcaacaacctgtcggaacgggcccgtggcgtgtgcagctacctggcgctgtactcccctgatgtcatcttcctccaggaggtgatccctccctactacagttatctgaagaagagaagtagcaattatgaaatcattactgggcacgaggagggttactttaccgccatcatgttaaaaaagtcccgcgtgaaactcaaatctcaggagattattccgttcccaagtactaagatgatgcggaaccttttgtgtgtccacgtaaacgtgtccggtaatgagctgtgtctgatgacatcacatttggagtctacacgtgggcacgctgcggagagaatgaaccagttgaagatggtactgaaaaagatgcaggaagcgcctgaatctgccacggtcattttcgcaggcgatactaatttacgggaccgcgaggtcacaagatgtggcggacttccaaataacatagtggacgtgtgggagttcttgggcaagcccaagcattgccagtacacatgggacactcagatgaacagcaatcttggcatcactgcggcttgcaaactccgtttcgaccgtattttcttcagggccgctgcagaggaagggcatataattccccgcagccttgatctgctcgggttggagaagcttgattgtggaagatttccatccgatcactggggattgctctgtaaccttgatattatcctgtag

SEQ ID NO: 21059 - DNA, 1428 bp, Artificial Sequence
  Description of Artificial Sequence: Synthetic coding sequence
atgagcgacttcgacgagttcgagcggcagctgaacgagaacaagcaggagcgcgacaaggaaaatcgccaccgtaaacgaagccattcgagaagcagatcacgggaccgcaagagaaggagtagatccagagacaggcggaatcgcgaccagcggtccgccagcagggatagacgacgccggagcaagccgcttactcgaggcgccaaagaggagcatggcgggctgattcggagcccacggcacgagaagaaaaaaaaagttcggaagtattgggatgtccccccacctggatttgagcatataacccccatgcaatataaggccatgcaagctgccggccagatcccggccacagcacttctccccactatgactcctgatggactggcagtgacaccgacccccgtgccagtggttggaagtcagatgacaaggcaggctcgccgactgtacgtcggcaatatcccgtttggaattacagaggaggcaatgatggacttcttcaacgcccaaatgcgcctgggcggattaactcaggcccctggtaatccggtgctcgctgtccagatcaatcaagacaagaattttgcatttctggaattcagatccgttgatgagaccacacaggcaatggcgtttgatgggattatttttcagggacagagcctgaaaattcgccggccacacgattatcagcccctgcctgggatgtcggaaaacccgtctgtgtacgtgcccggagtggtttcaaccgttgttccggattccgctcataaactgttcattggaggcctgccaaattatctcaatgacgaccaggtgaaggagctgcttacctcattcggtcccttgaaggcctttaacttggttaaagattctgcaacagggctgtctaaggggtacgcattctgcgagtatgtggacatcaacgtgactgaccaggccattgccggcttgaacggcatgcaactgggcgacaagaagttgctcgttcagcgcgcttctgttggtgctaagaacgcaaccctggtgagtccccctagcacaatcaatcagacacccgtgaccctgcaagtgcctggactcatgtccagtcaggttcaaatggggggacaccccacagaggttctttgcctgatgaacatggtactgccagaggagctgctcgacgacgaggaatacgaggaaattgtcgaggacgtcagagatgagtgctcaaagtatggcctcgtgaagtccattgagatccctcggcccgtggacggagtggaagtaccaggttgcggcaaaattttcgtggaattcactagcgtatttgactgtcagaaagccatgcagggcttgaccggaaggaaattcgcgaatcgggtcgtggttacaaaatactgtgatcctgactcgtaccaccgtcgcgacttttggtag

SEQ ID NO: 21060 - DNA, 3090 bp, Artificial Sequence
  Description of Artificial Sequence: Synthetic coding sequence
atggccgacaagacccccggcggcagccagaaggccagcagcaagacccggtcttcagacgtccacagttctggctcttctgatgctcacatggatgcctccgggccatccgatagtgatatgccctcaaggaccaggcccaagagcccgaggaagcacaattatagaaacgaatccgccagggagagcctctgcgattctccccaccaaaatctgagcaggccactgctggagaacaaactaaaagcgttctctattggcaagatgagcacagcaaagcggacattatctaaaaaggaacaggaagaactcaaaaagaaagaggacgagaaagccgccgcggagatctatgaagagttcctcgctgcttttgagggtagcgatggcaacaaggttaagaccttcgtgcgaggcggcgtcgtcaacgccgctaaagaggaacacgagaccgatgaaaagcgtggcaagatttataaaccctcttctagattcgccgatcagaagaatccccccaaccagagttctaatgagcgacccccatctctgcttgtgatcgagaccaaaaaaccacctctcaagaagggagaaaaagaaaaaaagaaaagcaatcttgagctcttcaaagaggaactgaaacagatccaggaggagagagacgagcgccacaagacgaaggggcgcctgagccgttttgagccaccccagtctgattcagatggtcagcgccgctcaatggatgccccgtcgagacgcaaccgcagctcaggtgttctagatgattacgccccaggaagccatgacgtgggagaccccagcacgaccaacttatatctgggaaatatcaacccccaaatgaatgaagagatgctctgccaggagttcgggcggttcgggcctctagctagtgtgaaaataatgtggccaaggactgacgaagaacgggctcgggagagaaactgcggattcgtggctttcatgaacaggcgcgacgccgaacgggctctgaagaatctcaatggcaagatgattatgtccttcgagatgaagctcggctggggaaaggcggtgcccatcccccctcatcccatttacattccaccatcaatgatggagcacactttgcctcccccccccagtggattaccgttcaacgcccagcccagggagcgcctgaagaatcccaatgcccctatgttacctcccccaaagaacaaggaagactttgagaagaccctatcgcaagccattgtgaaagtcgtgattccaaccgagcgaaacctgctagccctcatccatcgcatgattgaattcgtagttagggaaggaccaatgttcgaagcaatgattatgaatcgtgaaattaataatccgatgtttaggtttctctttgaaaaccagacgcctgcccatgtgtactaccggtggaagctgtattctatcctgcagggagactcacccactaagtggagaactgaggatttccggatgttcaaaaacggaagcttttggcgtcctcctcccttgaacccttacctccacggcatgtctgaagagcaggagactgaggctttcgtggaggagccaagcaagaagggagcactgaaggaggagcagcgagacaagctggaagaaatcctgaggggcctcacgcctaggaagaatgacataggagatgccatggtgttttgcctgaacaacgccgaggctgcagaggagatcgtcgactgcattactgagagtttgagcatcctaaagacaccgctgcccaaaaagatcgctcgactttatctcgtcagtgatgtgctatacaactcctccgctaaggtcgccaatgcatcttactaccgaaaatttttcgaaacaaaactgtgtcagatattctcagaccttaatgcaacttaccggacgattcagggacatctacagagcgagaatttcaagcaacgagtgatgacctgttttcgagcgtgggaagattgggccatttaccctgagccctttctgattaagctgcaaaatatctttctgggtctagtgaacattatcgaggaaaaagaaaccgaagatgtgcctgatgacctggacggcgcaccgatagaggaagaattagacggagccccgcttgaggacgtggacggcatacccatcgacgctacccccattgatgacctggatggagttccaattaagagtttggacgacgatttagatggagtacccctggacgccacggaggactccaaaaaaaacgagccaatcttcaaagtcgctccatccaaatgggaagcagttgacgagagtgaactggaggctcaggctgtcactaccagtaaatgggagctattcgatcagcacgaggagtccgaagaggaagaaaaccaaaatcaggaggaagaatctgaagacgaagaggatacacaaagcagcaagtctgaggaacatcacctttacagcaatccaattaaagaggaaatgaccgagtccaagttctccaagtatagcgagatgtcggaggaaaagcgcgccaaactgagagagatcgagttaaaggtgatgaaattccaggacgaattggagagcggcaagcgacccaaaaagcccggacaatcttttcaggagcaagttgagcactaccgtgataagcttcttcaacgggagaaagagaaggaactggagcgggagcgcgagcgcgataagaaggataaggagaaactggaatcccgcagtaaggacaagaaggagaaagacgaatgcacccctactagaaaggagagaaagagacgacattctacctcaccatctccttctcgcagcagctccgggcgacgcgtgaagagtccatctcccaaatctgagaggtcagagagatcggaaagatcccataaggagtctagtaggagtcgcagcagccataaagacagccctcgcgacgtgagcaaaaaggcgaagcgctcccctagcggttcacgaacacccaaaagatcccgaaggagtaggtctaggtcgcctaaaaaatcaggcaaaaagtctcgctcacagtcaaggagcccacaccggagccacaaaaagtccaagaagaacaagcattag

SEQ ID NO: 21061 - DNA, 1863 bp, Artificial Sequence
  Description of Artificial Sequence: Synthetic coding sequence
atgctgctgtgctaccggcacctgaagaccaagcggatcctgcggcggaacctgctcgcactaattcatcggatgatcgagttcgtggtcagggaaggccctatgttcgaagcaatgattatgaatagagaaatcaataatcctatgttcaggttcctgttcgaaaatcagacccctgcccacgtttattaccgctggaagctctacagcatcctgcagggagattcacctaccaagtggcgtactgaggacttcaggatgttcaagaatggaagtttctggcggccaccccccctgaatccctacctccacggcatgtcagaggaacaagagacagaggccttcgttgaggaaccatccaagaaaggcgcgctcaaagaggagcagcgggacaaacttgaggagatcctgcggggcttgacccctagaaaaaatgacatcggtgacgctatggtcttctgtttgaacaacgctgaagcagctgaagaaattgtagattgtatcacggagagcctgtccattctgaaaacacccctgccaaagaaaatagctcgtctttatctagtgtcagacgtgctttacaactcttctgctaaagttgccaacgcatcatattacagaaaattttttgagaccaagctgtgccagatttttagcgatcttaatgcaacttaccgcactattcagggacatctgcagtccgaaaacttcaaacagagagtgatgacttgtttccgggcctgggaggactgggccatctaccctgaacctttcctcattaaactgcagaacatcttccttggcctggtgaacatcattgaggagaaagagaccgaagacgttcctgacgacttggatggggcaccgatcgaagaggaacttgacggcgcccctctagaggatgttgacgggatacccattgacgcaacgccaatcgatgatctggacggcgtacctattaagagcttggacgatgatctcgatggggtgccactcgatgccactgaggactcgaagaagaatgaacctattttcaaggttgcaccgtctaagtgggaggccgtcgacgagtcggagctggaagctcaggccgtgaccacaagcaagtgggagctgtttgatcagcacgaggagagtgaagaggaagaaaaccagaaccaggaggaggagtccgaagatgaggaggatacgcaatcctcaaagagcgaagagcaccatctgtacagcaatcccattaaagaggaaatgactgagagtaagtttagcaagtactctgaaatgagtgaagaaaaacgcgccaagctacgggagatagagcttaaggtcatgaaatttcaggatgaattagaaagtggaaaacgtccgaaaaaacccgggcaatcattccaagagcaggtggaacattatcgcgacaagctgctccagagagaaaaagaaaaggagctggagagagagcgcgaacgcgataagaaggacaaagagaaactcgaaagcaggtctaaagataagaaggagaaagatgagtgcaccccaacccggaaagagcgcaaaaggaggcattcaacctctccctcgccaagccgcagttccagtgggcgaagggttaagtcccctagcccaaaaagtgagaggtcagaaagaagcgagcggagccacaaagaatccagccgcagtcggagcagccacaaggacagccctagagatgtcagtaaaaaagcgaagcggagtccctcgggtagcaggactcccaaacgttcacggaggtctaggtctaggtctcctaagaagtccggaaagaaatccagaagccagagtcgttctccccacagaagtcacaagaaatcaaagaaaaacaaacactag

SEQ ID NO: 21062 - DNA, 3090 bp, Artificial Sequence
  Description of Artificial Sequence: Synthetic coding sequence
atggccgacaagacccccggcggcagccagaaggccagcagcaagacaaggtcctccgacgtccattcctcaggttcctcagacgcacacatggacgcttcaggccccagtgactccgatatgccttctagaacccgtcccaaatccccccgcaagcacaattatcggaatgagagtgcccgcgaatccctgtgtgattctccacaccagaatttgagcagacccctccttgaaaacaagttgaaagcattctccatcgggaagatgtccaccgcgaagcgtactctctcgaaaaaggaacaagaggagttaaaaaagaaagaggacgagaaggcggcagccgaaatttatgaggagttcctagctgcattcgaggggtccgacgggaacaaggtgaaaacctttgtgagagggggcgtggtgaatgccgcaaaggaagagcatgaaacagacgaaaagcggggtaaaatctacaagccaagttcacgattcgctgaccagaaaaatccccccaaccaaagtagtaatgaaagaccgccgagtctcctggttattgaaacaaaaaaaccacctctgaaaaagggtgagaaggagaagaagaagtctaacctcgaactgttcaaggaagagcttaaacagattcaagaggaacgggatgagagacacaagaccaaaggaagacttagtcgcttcgaacccccccagtcagatagcgatggccaaaggaggtcaatggatgctcccagccgtagaaatcgcagctccggcgtgttggatgattacgctcctggttcgcacgatgtgggagatccatccaccaccaacctgtaccttggcaatatcaatccccagatgaacgaggagatgctctgtcaggaattcggtaggtttggaccgctcgccagcgtgaaaatcatgtggccacgcactgatgaagaacgtgcacgtgaaagaaactgcggttttgtagcttttatgaaccgccgggatgccgagcgagccctcaaaaacctgaacggaaaaatgatcatgagcttcgagatgaaattggggtggggaaaagcagtccccatcccaccccaccccatctacattccaccatccatgatggaacataccctgcctcctccaccttccggtttgcccttcaatgcccagcccagggaaagactgaaaaaccccaatgcgcccatgctcccacctcccaagaacaaggaagacttcgagaagactctctctcaggccatcgttaaggtggtcatcccaaccgaaaggaatttgttggcgctgatccaccgcatgatcgagttcgttgtaagagagggacctatgttcgaagcaatgataatgaatcgcgagattaacaatcccatgttcagattcctgttcgaaaatcagaccccagctcatgtgtactaccgctggaagctgtattcaatcctccaaggggactcacctaccaagtggaggactgaggactttcgaatgtttaagaacggtagtttctggcggccgcctcccctgaatccttacctgcacggaatgagcgaagagcaggagaccgaggcattcgtagaagagcccagtaaaaagggggctcttaaggaggagcagcgggacaagctggaggaaatacttcgaggtctaacaccacggaaaaatgatatcggggatgcaatggtgttttgtctcaacaacgcagaggccgctgaggaaattgttgattgcatcactgagagcctgagcatattaaaaactcctttgcccaaaaagatcgcacggctgtacctggtatcagacgtactgtacaattccagtgcgaaagtggccaacgccagctattaccgtaaattctttgagaccaagctgtgccagatttttagtgatttgaatgctacatatcggactatccagggacatctgcaatccgagaatttcaaacaaagagtgatgacatgcttccgggcatgggaggactgggccatctaccctgagccattcctcatcaaactgcagaatatctttcttggccttgtgaacataatagaagagaaggaaactgaggatgtcccagacgacttggatggcgcccccattgaagaagaactcgacggtgcgcctctcgaagacgtggacgggatccccatcgacgccacgcctatcgatgatctagacggtgtaccgattaaatccctcgatgatgatctggacggagtcccattagacgcaacggaggattccaaaaaaaacgagcctattttcaaagtagcgcccagtaagtgggaggctgtggacgagtcagagttagaggctcaggctgtcacaacttctaagtgggagcttttcgaccagcacgaggagagcgaggaagaggagaaccagaaccaggaggaggaaagcgaggatgaagaggatacccaaagtagtaaatcagaggaacaccacctgtattctaaccccattaaggaggaaatgaccgagagcaaattttccaagtactcagaaatgtctgaggagaaaagggctaaactgcgggaaatcgagctcaaagtcatgaaattccaggacgagctggagagcggcaagcggccgaagaaacccgggcagagctttcaggagcaggtggagcattaccgagataagctgttgcagagggagaaggagaaggagttggagagggaacgggagcgggataagaaggataaggagaagctggagtcccgctctaaggataaaaaagaaaaagatgaatgcactcctacccggaaggagcggaagagaagacatagcacatcacctagtccatcccggtcatctagtggccgacgggtgaaatctccttcccccaaatctgagcgaagtgagaggtcagaacgctcacacaaagaaagttcccgcagcagatcgagccacaaagactcccccagagacgtgagcaaaaaggccaagcggtcaccttcagggtcgaggactccaaaacgatcaaggcgatcacgcagccgtagccccaagaaaagcggcaagaaatctcgcagccaaagcaggagtccccaccgttctcacaaaaagtcgaaaaaaaataaacactag

SEQ ID NO: 21063 - DNA, 3087 bp, Artificial Sequence
  Description of Artificial Sequence: Synthetic coding sequence
atggccgacaagacccccggcggcagccagaaggccagcagcaagacaaggtcttcggacgtccatagcagcggctcaagcgacgctcatatggatgcgagcggaccgtcggacagcgatatgccctctagaacaaggccgaagagcccccgcaaacacaattacaggaacgagagcgccagagaatccctgtgcgactccccacaccagaatctctcaaggcctctgctcgagaacaaactaaaagcctttagcatcggaaaaatgagcacagctaagaggaccctgtcaaaaaaagagcaggaagagctaaaaaagaaagaagacgagaaggcagcagctgaaatttacgaggagttcctcgcagcgttcgaaggctctgatggcaacaaggtcaagacatttgttcgcgggggcgtggtgaatgccgcaaaggaagagcacgagactgacgagaaaaggggaaaaatttataaacccagctctagatttgcagatcagaagaacccccccaatcagtcatctaacgagagaccacccagtcttctggtaatcgagacaaaaaagccaccgctgaaaaagggcgaaaaagagaaaaagaagtccaacctcgaactttttaaagaggaattaaaacagatacaggaggagagggacgagcgccacaagacaaaagggcgccttagcaggttcgagcccccccagagtgactccgacggtcagcgccgctcaatggatgcacccagcaggcgcaaccgatcatccgtcctcgatgattatgctccgggttctcacgatgtgggcgaccctagcaccacaaatctctaccttgggaacataaatcctcagatgaacgaggaaatgctgtgccaagagtttggaaggttcggcccactggccagtgtcaaaataatgtggccaagaaccgacgaagagagggcacgcgagagaaactgcggattcgtcgcatttatgaaccgcagagatgctgaaagagccctgaagaatctaaacggcaagatgatcatgtctttcgaaatgaaattaggctggggcaaggctgtcccaattccgcctcaccccatctatatccccccatcaatgatggagcacactctgccaccaccgccctcaggtcttccctttaacgcacagccccgggagcggctaaaaaatccgaacgctccgatgctgcccccccccaagaacaaggaagatttcgagaagacactgtcacaggcgattgtcaaggtcgtgatccccactgagaggaacctgctcgccctcattcatagaatgatagagtttgtggtccgcgagggcccaatgtttgaagcaatgatcatgaacagggagatcaataatcccatgttcaggtttctgtttgaaaatcagacccccgcacatgtttattaccggtggaaattgtactcgatcctgcaggctaactccccaacaaagtggaggactgaagactttcgcatgttcaaaaacggctcgttctggagacctcctcccttgaatccgtacttgcacggcatgagtgaggagcaggagaccgaggcctttgttgaagagcctagcaagaagggcgcccttaaagaggaacagagagacaaactcgaggagatccttcggggactgaccccccgaaagaacgacatcggagacgctatggtgttctgcctaaataacgccgaggctgctgaggagattgtggactgcataactgagtcactctctatattgaagaccccactccccaagaagattgcccgtctctacctcgttagcgacgtcctgtacaatagctccgctaaggtggcaaacgcctcctactaccggaaatttttcgagaccaagctatgtcagatttttagtgacctgaacgctacctacagaacaatacagggacacctccagagcgagaactttaaacaacgcgtgatgacatgtttccgtgcatgggaggactgggcgatttatcctgaacccttcctgattaagctgcagaatatcttcctgggcttggtgaacataatcgaagagaaagagacagaagacgtgcccgacgacttggatggggcgcctatagaggaggaactggacggagctcctctggaagatgtggatggcattcctatcgatgctacgcctatagatgatttagacggggtccctattaaatcgttagacgacgacctggacggtgtgcctctagacgcgacagaagactcaaagaaaaacgagcctatctttaaggtggctccaagcaagtgggaggcagtggacgagagcgaacttgaagctcaggccgtgaccacaagtaaatgggaactgtttgatcagcatgaggagtctgaagaagaggagaaccagaaccaggaggaggagagcgaggatgaggaggacacccagtcttcaaagtcagaggagcaccacctctattcaaatcctataaaggaagaaatgaccgaaagcaaatttagtaagtactccgaaatgagcgaggagaaacgggcaaaactcagggaaattgaactgaaagtgatgaagttccaggatgaactggaatccggaaaacgacctaaaaaaccagggcagtcttttcaggaacaagttgaacactatcgcgacaagctgctgcaacgtgagaaggagaaggagctggagcgggaaagagaaagagacaagaaggacaaagagaagctggaatcgcgctccaaggacaagaaggagaaggacgaatgtacgcccactagaaaagaacgtaagcgcagacactcaactagtccaagtcccagccgtagcagctccggccgacgcgtgaagtccccttcccctaagagcgaacgtagcgaaagatccgaacgaagccataaagagagcagtcggagcagaagttctcataaggactcccctcgagatgtatccaagaaagccaagcgcagcccaagtggttccaggactccaaagcgctctagacgcagccggtctcgttctccgaagaaatccgggaaaaaaagcagatcacagtcacggtcaccccaccgctctcataagaagagcaagaaaaataagcactag

SEQ ID NO: 21064 - DNA, 486 bp, Artificial Sequence
  Description of Artificial Sequence: Synthetic coding sequence
atggccgacaagacccccggcggcagccagaaggccagcagcaagacacgcagcagcgacgtgcattcatccggcagtagcgatgcacatatggatgcatctggtccttctgactccgacatgccctccagaacgcgtccaaaaagcccccgtaagcacaattaccgcaacgagagtgcccgcgaatcactctgcgatagtccacaccagaaccttagtcgccctctgctcgagaataagcttaaagcattctctattggtaagatgtccactgctaagagaacgctctcaaaaaaggagcaggaagagctgaaaaagaaagaggatgagaaagccgctgcagagatatacgaggaatttctggctgcattcgagggatctgacggcaacaaggtgaaaacattcgtgcggggtggagtggtgaacgctgctaaagaggaacatgaaaccgacgagaaaagagggaaaatctacaagccatcttag

SEQ ID NO: 21065 - DNA, 3237 bp, Artificial Sequence
  Description of Artificial Sequence: Synthetic coding sequence
atgatgaccagcgtgggcaccaaccgggcccggggcaactgggagcagcctcaaaatcagaatcaaactcagcacaagcaacgccctcaggcgacagctgagcagattcgcttggcgcagatgatatctgatcataatgacgcagacttcgaagagaaggttaagcagttgattgacattaccggcaagaaccaagacgaatgcgtcatcgctctgcatgattgcaacggcgatgtaaaccgtgccattaatgtccttcttgagggcaatcctgacacccatagctgggagatggtggggaagaagaagggtgtgagtggccaaaaggatggcggacagacagagtctaatgaggaggggaaagagaatcgagaccgcgaccgcgattatagcagacgtcgcggagggccccccagacggggccggggcgcgtccagaggtcgcgagtgtatgcatggggccctgtctaaacccgccgtcgttcgcggccaagaaaacgggctcgacggcaccaaaagtgggggcccatcaggacggggtaccgaaaggggaaggagaggccggggtcggggacgcggcgggagtggaagaaggggcggaaggttcagtgcccaaggaatgggtacatttaacccagcggattacgcagaacctgccaacaccgatgataattatgggaattctagtggcaatacttggaataatacaggacattttgagccagatgacggaaccagcgcctggagaacagctaccgaggagtggggcactgaagattggaacgaggatctgtctgagacgaaaatttttactgcttcaaatgtgtccagtgtgccgctcccagccgaaaacgttacaattactgctggccagagaattgacttagctgtcttactaggaaaaacacccagcaccatggaaaatgactcctcgaatctggatccaagtcaggcaccaagcctggctcaacctctggtattcagcaacagcaaacaaaccgccatttcccagcccgcctcagggaatacattctcacaccactccatggtctcaatgctggggaaaggattcggcgatgtgggagaggcgaagggcgggagcactactggtagtcagttcctcgaacagttcaaaaccgcacaggcactggcgcagctcgctgctcaacactctcaatctggctctacaacaacatcttcttgggatatgggctccactacccagtccccttccttggttcagtatgatttgaagaaccccagtgactccgccgttcacagtcctttcaccaaacggcaggcctttacgccttccagtaccatgatggaagtattcttacaggagaagtcacctgcagttgctacgagcaccgcagcacctccacctcctagttccccgcttcctagcaaatccacgtccgcacctcagatgagcccaggtagctcagacaaccagagcagctcaccgcagcccgcgcagcaaaagcttaaacagcaaaaaaagaaggccagtttaacttcaaaaatcccagcactagctgttgaaatgccaggatctgccgatatttccggccttaatctccaattcggggcgctgcagttcggatcggaaccggtgctgtcagattatgaatctactccaaccacctccgcatcctcgagccaggcacccagctcactttacacttctacagccagcgaaagcagttcaaccatctcatccaatcaaagtcaggaaagcgggtaccagagcggaccgattcagagcacaacctatacatcacagaacaacgcccagggtcccctgtacgaacagaggagcacccaaaccaggcgctatccgagttctatctcctcctctcctcagaaagacctcactcaagctaagaacgggttcagctcagttcaggccacacaattacagaccacacagtcagtcgagggcgccacagggtctgctgtgaaaagtgactctccgagcacctcttccattccgcctctgaacgaaactgtgagtgcggcatcgctgctcactaccactaatcagcattcctcctccttaggcggactgtcccatagcgaagagatacctaacaccaccaccacacagcattcaagtaccttgtcgacgcaacaaaacacactgagcagttctacctcttccggacgcacgagcacatccacactgttgcataccagcgtggagtcagaagcaaatctccattcttcaagctccacgtttagcactacctcaagtaccgtgtccgcgccccctcccgtggtctcggtttcttcttctcttaatagtggttcaagcctgggcttatctttgggctctaactctacggtaacagcttctaccagatcatcagtcgcaacaacctccggcaaggcaccacctaacctgccccctggtgttccgcccctgcttccaaacccttatatcatggcacccggcctgctccatgcctacccgccccaagtgtacgggtacgatgaccttcagatgctccaaactaggttcccactggattactacagcatcccttttcctacccccactacccccctgacaggacgcgacggaagccttgcctctaacccttactcaggagatctcaccaaattcgggcgcggggacgcctcttcacctgcccctgccacaactctagcccagcctcaacagaatcagacacagactcaccataccacacagcagacgtttctaaatcctgccttacctcccgggtacagctatacctccttaccatactacacaggcgtccccggactcccctccacatttcagtacggtccggccgtgttccccgttgcacccacttcatccaagcaacacggagtgaatgtctcagtgaacgcctccgccactccctttcagcaacccagcggatatggctcccacggatataacacgggagtctctgtgacgagcagcaatactggggtgcctgatatctccggcagcgtctacagcaagacccagtcttttgaaaagcagggctttcacagtggaaccccggctgcctcatttaatctgccttccgctctaggttcaggtggccctattaatcccgcgaccgcagccgcttatccacccgccccttttatgcatatcctgacgccacaccagcagccccattcacagatcctgcaccatcatctccaacaggatggacaggacattctcaatttcgtggatgaccagctcggggagtag

SEQ ID NO: 21066 - DNA, 2952 bp, Artificial Sequence
  Description of Artificial Sequence: Synthetic coding sequence
atgatgaccagcgtgggcaccaaccgggcccggggcaactgggagcagccgcaaaatcagaatcagacccaacacaaacagcgtccccaggcaactgctgagcagattaggctggctcagatgatcagcgatcacaacgatgcagactttgaagagaaagtcaagcaactgatcgatattaccggcaagaaccaggacgaatgtgtgatagctctacacgattgtaacggcgacgttaacagagcaataaacgtgctgctggaggggaatcccgatacacactcctgggagatggtcgggaagaaaaagggcgtctcagggcagaaggacggtggccagactgagagtaacgaggagggtaaggaaaacagggatagagatcgcgactatagcaggcggaggggaggcccacccaggcgtggcagaggggcatctaggggccgcgagttcagaggacaggaaaatggtctcgacggaacgaagagcggtgggccctctgggagggggaccgagagagggagaagaggcagggggcgcggacgcggagggagtggacgcagagggggccgtttcagtgcccaaggaatgggtacttttaacccggctgattatgccgaaccagccaatactgacgataattatggaaattcaagtgggaatacttggaacaacacgggccacttcgagcccgacgatggcaccagcgcttggaggaccgcaacagaagaatggggcaccgaggactggaacgaggatctgtctgaaaccaagatttttacggcttctaacgtgtcctctgttccactgccagccgaaaatgtcactatcactgcaggccagaggatagatctcgcagtgctgctggggaagaccccttccacaatggagaatgattccagcaatctggacccgtcccaggccccatcacttgcacagccactcgtcttcagcaacagtaaacagacggccatcagccaaccggccagcggtaacaccttttctcaccactctatggtgagtatgctgggcaagggcttcggcgacgtaggtgaagcaaagggcggatcaaccacaggaagccagttccttgagcagtttaagaccgctcaggctctggctcaacttgctgcccagcactcacagtctggctctacaacaacctcgagctgggacatgggcagcacaactcagagccccagcctcgtccagtatgacttgaagaatccaagcgacagcgccgtgcattcgccattcactaaacgccaagcctttaccccatcatctacaatgatggaggtgtttctgcaggaaaaaagcccagcggttgcaacatctacagccgccccccctcctcctagctccccgcttccttccaagtcaacatccgccccccaaatgtcaccgggcagcagcgacaatcagagctcctctccacagccagcacaacagaagctgaagcagcaaaagaagaaagctagcctgaccagtaagatcccggccctggcagtcgaaatgcctggtagcgcagacatctcgggactgaatctacagttcggggctctgcagttcggatctgagccagtcctctcggattatgagagcacccccacgacatcagcctctagctctcaagccccatcatccttatacactagtaccgcctccgaatccagctcaaccatctcctccaatcaatctcaggagtctggttaccaaagtggtccaatccagtccacaacctacaccagtcaaaacaacgcacagggcccactgtacgaacagcgctcaacacagacacggaggtatcccagctccatcagttccagcccacagaaagatttgactcaagctaagaacggcttctcctcagtgcaggccacacaactgcagacaacacagagcgtcgaaggggctacaggttccgccgtcaaatccgattcaccaagtacgtcatctatcccgcctcttaacgagacagtgagtgcagcatctttgctcactaccaccaaccagcactcatcatctcttggcgggctgtcacactccgaagagatccctaatactacgaccacacagcattcatctacactgtccactcagcagaacactttatcctcatccacctcttcgggcaggacaagtaccagcacactcctgcacactagcgtcgagagcgaggccaatctccactcatcttcgtccactttctctactaccagcagcactgtatcagccccccccccagtggtgtccgttagctcctctctgaattccgggtctagcttgggtttaagcttaggtagcaactctaccgttacagcttcgacccggagttctgtagctaccacctcaggcaaggccccaccaaatcttcctcccggtgtcccgcccctccttcctaatccctacattatggcccctggtctactgcatgcctatcctccccaggtctacggttatgacgatttgcagatgttgcagactaggtttcctctcgactactacagtatcccattccctacccccacaacccctctcacgggacgcgatggatctctcgcatccaatccctattctggggacttaacaaagttcggaaggggcgacgcttcgtcaccagcacccgccacgaccctggcccaaccccagcagaatcagacacaaactcatcacaccacccagcaaacttttctgaatcccgctcttccgcctgggtactcttataccagcttgccgtactacactggggtcccaggcctgccaagtacattccagtatggcccagccgtgtttcctgtcgctcccacatccagcaagcagcatggtgtcaatgtgtccgttaacgcatccgcaactcctttccagcagccttccgggtacgggagtcatggatacaacaccgggagaaagtacccacctccttataagcacttctggacggctgaatcctag

SEQ ID NO: 21067 - DNA, 3264 bp, Artificial Sequence
  Description of Artificial Sequence: Synthetic coding sequence
atgatgaccagcgtgggcaccaaccgggcccggggcaactgggagcagccccaaaatcagaatcagactcagcacaagcaaagacctcaggctaccgctgagcagatcagactggcccaaatgatctcagatcacaacgatgccgattttgaagagaaggtgaagcagctaatcgacattacagggaagaatcaagatgagtgcgtgatcgcccttcacgactgcaacggtgatgtgaaccgcgcgatcaacgtgctcttggagggcaaccccgatactcattcctgggaaatggtgggaaaaaagaaaggagtatctggacaaaaagacgggggccagactgaaagcaacgaagagggcaaagaaaatagggacagggaccgggactactccaggcgccgtggcgggcctcctcgcaggggccgaggagccagcagagggcgcgagttccggggacaggaaaatggtctggatgggaccaaatccggaggtccaagcggacgaggcactgaaagaggacgcaggggcaggggaagagggagaggtgggtctggcagaagaggtggccgtttttccgcacaaggaatgggaacattcaaccccgcggactacgccgaaccagcgaataccgacgacaattacggaaactctagcggaaatacatggaataataccggccacttcgaaccagatgacgggacctctgcttggaggacagctacagaggaatggggcaccgaagattggaatgaggacctgtctgaaactaaaatcttcaccgcttctaatgtcagtagtgtgccactccccgctgagaatgtgacgattacagccggccagagaattgacctagctgtgttgcttgggaagaccccatccactatggagaacgactcttcaaacctggatcccagccaggcaccttccctagcccagccattggtgttctcaaacagcaaacaaacggcaatctctcaaccagcttcaggcaacactttcagccaccactccatggtgagtatgcttggcaaaggattcggcgacgtcggggaagccaaggggggctcgacaaccggttcgcaattcctcgaacagttcaaaacggcccaggcccttgcacagctggcggcccagcactcccagtccggttcgactaccacttcctcttgggacatgggctctaccacccaatccccctcattagttcagtatgacctgaaaaatccgtcagatagcgccgtgcacagcccttttaccaaaagacaggcgtttactcccagcagcaccatgatggaggttttccttcaggagaagtctccggctgtcgcaacgtccacagccgcccctccgccgccttcttcgccgctgccttccaaaagcacttcagctcctcagatgagcccaggctcctccgataatcagtcttcatcccctcaacctgcccaacaaaaactgaagcaacagaagaaaaaggcctcactgacttcgaaaattcccgcactggctgtggaaatgccgggcagcgctgatatctccggcctgaatctccagtttggagcactacagttcggttctgaacccgtgctgagcgattacgagtctaccccaaccacgtccgcatcctcttcccaggcccccagtagcctgtacaccagcaccgcatctgaatcgagctcaacaatctcctctaaccagtcacaggaaagcggttaccagtcgggtcctatccaatccacaacttatacttcccaaaataatgcccagggtcctctttacgagcagagaagcacccagacccgccgctacccatcatctatttctagcagtccacaaaaggatctaacgcaggcaaagaatggattttcctctgtgcaggcgactcagttgcaaaccacacagtccgtggagggagcaaccggatctgcagtaaagtccgattctccatcaacgagttctattcccccactgaacgagaccgtgtctgctgccagcttgctgacgacaacaaaccaacacagtagctcactaggcggtctatcacactcggaagagattccaaacaccaccacaacacagcacagctccacgctttcaacccagcaaaacactttgagttcctccactagctctggacggacatccactagtactctccttcatacttccgttgagtccgaagcgaatttacactcctcatccagtacattttccactacctcatctaccgtttcagctcccccacctgtcgtctctgtaagtagctccctaaacagcggctccagcttgggccttagcttgggtagtaacagtactgtaactgcatctacccgtagttccgtggcaaccacttctgggaaagccccgcccaacctacctcccggcgtccccccactgctccccaatccctatattatggctcccggccttctacatgcttaccctcctcaagtgtacggatacgatgatctgcagatgctccagaccagattccctctggactattactctatcccttttccaacgcctaccacacctctgaccggaagggatggttcgctggcttctaacccttatagtggcgacctgactaagtttggcagaggcgacgcctcttcacctgctccagctacgactctggctcaaccccagcagaaccaaacacagacccatcacactacccagcaaacctttctgaaccccgccctgccaccaggctactcgtacacctcccttccttactacactggtgttcccgggctcccaagcactttccaatacggcccagcggtgttccccgtggcacccaccagctccaagcaacatggcgtgaacgtgtccgtgaatgcatcagccactccgttccagcagccctctggatacggcagccacggctataatacaggagtctctgtgacatcttcaaacaccggggttccagatatctccggcagcgtctactccaagacgcaacagtcttttgagaagcaggggttccattccggcaccccagcagcctccttcaatctccccagcgcacttggtagtggtggacctatcaatcccgcgaccgctgcggcttaccctcccgccccatttatgcatatactcactcctcatcagcagccccatagccagatcttgcaccaccacctgcaacaggacggacagaccggctcagggcagagaagccagactagctcgatcccacaaaaacctcaaacaaacaaatcagcttacaatagttattcctggggcgcgaactag

SEQ ID NO: 21068 - DNA, 1053 bp, Artificial Sequence
  Description of Artificial Sequence: Synthetic coding sequence
atgatgaccagcgtgggcaccaaccgggcccggggcaactgggagcaaccacagaatcaaaaccaaacgcagcataaacagcgtcctcaggctacagccgaacagatccgactggctcagatgattagcgatcataacgacgcagatttcgaagagaaagtcaagcaactcatagacattactgggaagaatcaggatgagtgtgtcatcgccctccacgattgcaacggggatgtgaatcgggcaatcaacgtgcttctggagggcaaccctgatacgcatagttgggaaatggttggaaaaaaaaagggcgtcagcggtcagaaggacggaggccaaacagaaagcaacgaagaggggaaggagaatagagacagagaccgcgactactcccggcgccgcggcgggccaccacgaagaggcaggggcgcctctcgcggccgggagtgcatgcatggagctttgagcaagccagccgttgttagaggtcaggagaacgggctggatggaaccaagtctggcggccctagtggacgaggaaccgaaaggggacgccgcggaagaggcagaggtcgcggagggtcagggcgcagaggtgggcgattttccgcccaaggcatgggcacattcaacccagcagattacgccgaacccgcgaataccgatgataactacggcaattccagtggcaacacctggaataacacgggtcacttcgagcctgatgacggtacttctgcttggcggaccgcaaccgaagagtgggggaccgaggattggaacgaggacctgagcgaaactaaaattttcactgcttcaaacgtgtcttcagtgcccctgcccgccgaaaacgtgacaataactgccggacagcgcatcgacctggcggtgctgctcggaaaaactcctagcacaatggaaaatgattcatctaacctggacccaagccaggcccccagtctcgcacagcctcttgtattctcaaatagcaaacagactgccattagtcaaccagcaagcgggaacacgttcagccatcactccatggtgtag

SEQ ID NO: 21069 - DNA, 843 bp, Artificial Sequence
  Description of Artificial Sequence: Synthetic coding sequence
atgatgaccagcgtgggcaccaaccgggcccggggcaactgggagcagccgcaaaatcaaaaccagacacagcataagcaaagacctcaggccaccgccgagcaaattcgcctggcacagatgattagtgatcacaacgatgcggactttgaggaaaaagtaaaacagctgattgatattacagggaagaaccaggatgagtgcgtaattgccctgcatgactgtaatggcgacgtgaacagagctatcaatgtattgctggagggtaatcctgatacccatagttgggaaatggtgggaaaaaaaaaaggcgtttctggtcagaaagatggaggccagaccgagtctaacgaagaggggaaggagaacagggatagggaccgagattacagtcgccgaagaggcggccccccgcgcaggggaaggggggcttcgaggggccgcgagtttagaggccaagaaaatggactcgatggaaccaagagtggcggccctagtggtaggggcacagaaagagggaggcgcggacggggtcgaggtcgtggaggttcgggccgccgcggtggcaggttctcagcccagggcatggggacattcaatccagcagactacgccgagccagcgaatactgatgataattatggtaatagcagtggaaacacctggaacaacaccggacactttgagccagatgacggcacctctgcttggcgtactgccacggaggaatgggggactgaggactggaatgaggacctttccgaaaccaagatttttaccgcttccaacgtgtcctccgttccactgccagccgaaaacgtgaccatcaccgctggccagtag

SEQ ID NO: 21070 - DNA, 1152 bp, Artificial Sequence
  Description of Artificial Sequence: Synthetic coding sequence
tgagtggagagcgaggccaacctgcacagcagcagcagcaccttctccacaacaagtagtaccgtgtcagccccccctcctgtcgtttccgtcagcagctcccttaactctggaagctccctgggactgagcttaggcagcaacagtacagtcactgcctctactaggagtagcgtggccacaaccagtggaaaagcgcccccaaatctgccacctggggtgccgccattactgccaaatccttacattatggccccaggcttgctgcatgcctacccaccccaggtatacggatacgatgaccttcagatgctgcagacgaggttccccttggactactatagtatcccatttcctactccaactactcctctgacgggtagagacggctctctcgccagcaacccatacagtggcgacctgacgaagtttggacgcggagacgcctccagtcccgccccggccactacccttgcccagccccagcagaaccaaacccagacacaccataccacccagcaaacatttctgaatcccgctctcccgcccgggtattcgtatacctcactgccatactataccggagtcccgggcctgccctcaacttttcagtatggacctgctgtgtttccggtggccccaaccagcagcaaacagcatggggtgaatgttagcgtcaacgcaagcgccacaccttttcagcagccctcagggtacggaagtcacggctataacactggcgtgtccgttacaagttcgaacactggcgtgcctgacatatccggtagcgtctattccaagactcaacagagttttgagaaacaggggttccacagtgggacacccgctgcctcgttcaatttgccttccgcacttggcagtggaggaccaataaacccggctacagccgcggcttacccccccgcgcccttcatgcatatactgacaccccatcaacaacctcacagtcagattctgcaccaccacctccagcaggacggccagcttccatatttgcagatgatcctgtgttgtcagaggcagcaagaagagcagactggttctggccagaggtcacagacctcctctatccctcagaaaccgcagactaacaagtccgcctacaactcctattcatggggcgctaactag

SEQ ID NO: 21071 - DNA, 3264 bp, Artificial Sequence
  Description of Artificial Sequence: Synthetic coding sequence
atgatgaccagcgtgggcaccaaccgggcccggggcaactgggagcagcctcaaaaccagaaccaaactcagcataaacagcggcctcaagcaacagccgagcaaatccgcctggcccagatgatttctgaccacaacgatgctgacttcgaagaaaaggtgaaacagctgatcgacatcaccggcaaaaatcaggacgagtgcgttatcgctctgcatgattgtaatggggacgtgaaccgagccattaacgtattactggagggaaacccggacacgcactcctgggaaatggttggcaaaaaaaaaggggtcagcgggcagaaggacggtggtcagacagagagcaatgaagagggaaaagaaaaccgcgatagggaccgcgattacagtagaagacgaggtgggcctcctagacgcggaaggggtgccagcaggggccgcgagttcagaggtcaggagaatgggctggatgggacaaagagcgggggtccaagcggtcgcggcactgagcgcggtaggagaggcaggggccgcggtagaggtggctctggaaggcggggcggtaggttctcagcgcaggggatgggtacctttaatcctgccgactacgctgaaccggcaaacaccgatgacaactatgggaattcctctgggaatacatggaacaacactggccatttcgagcccgacgacggcacgtctgcctggaggacggcaacggaggaatggggaactgaggactggaacgaggatctgtccgagacaaagatcttcactgcatctaacgtgagctccgtacccctgcctgccgagaatgtgacgattacagccggtcagcgaatcgatttagccgtgttgcttggtaaaacacccagcaccatggaaaacgactcaagcaacctcgacccaagccaggcccccagcctcgctcagcctctcgtcttcagcaactccaaacaaaccgccatctcccagccagccagcggaaacacttttagtcaccattccatggtgagcatgctcgggaagggcttcggcgatgttggtgaggccaagggcggcagcacaaccggatcacagttcctggaacagtttaagacggcacaggcactagcacaactcgccgctcagcattcccagtcaggttccactactaccagttcttgggacatgggttccactacccagagtcctagccttgtgcagtacgacctgaagaacccctcagattctgcagtacactcacccttcacaaaaaggcaggcctttactccaagttccactatgatggaagtcttcctgcaggagaagtcgcccgccgtagctacctcgactgcagccccaccaccccctagcagccccttgccctcaaaaagcacctccgcccctcaaatgagtcccgggagcagtgataatcagagctcgtcaccccagccggctcagcagaaattgaagcagcagaaaaagaaggcatccctaacaagcaagatacctgccctagctgttgagatgccaggctctgctgacatcagtggacttaacttacagtttggcgccctgcaattcggctctgagccagttctgagcgactatgaaagtacccctacaacttccgcatcaagctcgcaggccccctcctcactctacacatccacagcaagcgaatccagctccactatctcttctaatcagtcccaggagtcaggctatcagagcggacccatccaatccaccacgtacacaagccagaacaacgcccagggcccgctgtatgagcaacggagcacgcagacccgaaggtacccaagcagcatcagttcgagtccccagaaggacttgacacaagccaagaatgggtttagctcagtccaggctacacaacttcagactacccagtccgttgagggagccacaggcagcgcagtcaagagtgactcaccctccacttcgtctatcccccctcttaacgagacagtgagcgcggcatccctgctgactaccacaaaccaacactcatcaagtttaggcggcttaagccatagcgaagaaattcctaacacaactaccacacagcactccagcactctcagcactcagcagaatacactgtcctctagtaccagcagtggtagaacatccacatccactctgctgcatacaagcgtggagtcagaagcaaacctccacagcagtagttccacattctccactacttcttccacagttagtgccccgccacctgtggtctccgtgtcatcttcccttaattcaggcagctcgctgggcctgtcactgggcagcaactctactgttactgcaagtaccagaagctccgtagccactacgagtgggaaggctccacctaacctgccccctggcgtgccacccctgctccctaacccctatattatggcccctggcctcctgcacgcttatcccccgcaggtttatggttacgatgaccttcaaatgttacagaccagatttcccctagattactatagtatcccctttcccacaccaaccaccccccttaccggaagagacggctcattggccagtaatccctattctggagatttgacaaagttcggccgcggcgacgcatcaagcccggccccggccaccacactggcccagcctcagcagaatcagactcaaacacaccataccactcaacagacattcctgaaccctgccctgccaccaggctatagctataccagcttgccatattacacaggtgtaccagggctcccctccacttttcagtacgggcccgctgttttccccgtagctccaacttcttccaagcagcacggcgtgaacgtgtcagttaacgcttccgcaactccattccaacaaccttcaggctacggctcacatggttacaatacgggcgtgagcgtgaccagcagcaataccggcgttcctgacatttcagggtccgtgtactctaagacacagcaatctttcgagaagcagggttttcattccgggacacctgctgcctctttcaacctgccaagtgccctggggtctgggggacccataaaccccgctaccgccgccgcttatccacctgcgccatttatgcatatcttgacaccccaccaacaaccacacagccagattctgcaccaccatctgcagcaggatggacagaccggcagcggtcagagatctcagacttctagcatcccgcagaaaccacagacaaataagtccgcttacaactcctactcttggggagccaactag

SEQ ID NO: 21072 - DNA, 1803 bp, Artificial Sequence
  Description of Artificial Sequence: Synthetic coding sequence
atgcccggcagcgccgacatcagcggcctgaacctgcagttcggcgccctgcagtttggttccgagcctgtattgtcggactacgagagtactccgacgaccagtgcctcatcaagtcaggcccccagctcgttgtataccagcactgcctctgaaagttcctctacaattagctctaaccagtcccaggaaagcggctaccagagtggaccaatccagagcaccacctacactagccagaacaatgctcaggggccgttgtatgagcaacggagcacacagacccgtagatatccatcatccatatcatcaagcccccagaaggatctcacacaggccaagaatggcttttcctccgttcaggctacacagctccagactacacagtctgtggagggcgcaacaggttcggcagtcaagtctgacagtccaagcacgagttcaattccccctctcaacgagactgtgagtgctgcttcgctgctcactacgacaaaccagcatagcagcagtctgggagggctttctcattctgaggagatacccaatacaaccaccacacagcatagtagcaccttgagcactcagcaaaacacactgagcagctctacaagcagcggcagaaccagcactagcactctgctgcacacctccgtcgagagtgaggcaaaccttcacagctcatcttccactttttccactacatccagcaccgtcagcgcgcccccacccgtggttagcgtgtctagctcccttaattctggcagttcactgggtttatccctgggttccaattctacagtcaccgcatcgacgcgctcatccgtagccaccacgagcggaaaggcacctcccaatttgccacctggggttccacccttgctgccgaatccttatattatggcacctggcctcctccacgcctaccccccccaggtctacggatacgacgacctacagatgctgcaaacacggttcccccttgactattacagcatcccattccccacacctacaaccccactgacaggccgagacggatctcttgcgtctaatccgtacagcggtgatctcacgaaattcggacgtggggatgcctctagcccagcgcctgctacaaccctcgctcagccccagcagaaccaaactcagactcaccacactacccagcaaaccttcttgaatccagcgttgcctccgggatactcatacacctctctgccctattataccggtgtcccagggctgccatcaactttccagtacggtcctgcagtcttcccggtggcaccaacctcttcaaagcagcatggcgttaatgtgtccgtgaacgcatcagctactccttttcaacagccctcaggctacgggtcacatggatataataccggggtgagcgttaccagttctaatactggtgttcccgacattagtggatccgtttatagtaagactcaacagagtttcgaaaagcaaggcttccactccgggacacccgctgcctccttcaaccttccctccgcgctgggaagcggcgggccaatcaacccggccacggcagcagcatatcctccagccccattcatgcatatccttactccgcatcagcaacctcatagccagattcttcaccatcatctgcagcaggacggccagcttccttatctgcaaatgatcttgtgctgtcagcgtcagcaggaggaacaaacgggctcagggcagcggtcacaaacaagctcaatcccacagaagccacagaccaataaatctgcatacaacagctattcttggggtgctaactag

SEQ ID NO: 21073 - DNA, 1200 bp, Artificial Sequence
  Description of Artificial Sequence: Synthetic coding sequence
tgacagcacagcagcagcctgggcggcctgagccacagcgaggagataccaaatactaccactacacaacactcgtcaaccctctccacccagcagaataccctttcgtcatctacgagtagcggccggacctctaccagtacactactgcacacttcggtcgaatctgaagctaatctccattcatcctcctccacctttagcacaacttcctctaccgtttccgcccctccgcccgtggttagtgtgtcaagttcgctaaattcgggctcaagcctgggcttgagtctaggctctaacagcactgtgactgccagtacccgtagtagcgtggcaaccacctccggcaaggccccacccaacctgccgcccggggtgcccccactgctgccaaatccctacatcatggctcctggtctgctgcatgcttatcccccacaggtgtacggatacgatgacctgcaaatgctccagaccaggtttccacttgattactattctataccattccctacacccaccaccccactaaccggacgcgacggttcactggcgtctaatccctactccggcgatctgactaagttcggtcgtggcgatgcaagctcacctgctccagctaccactttggcgcagccccagcaaaaccagacgcagacccaccatactacacaacaaactttcctaaacccagccctgccccctggctactcatacaccagcctgccctattatacaggcgtccctgggctgccatctacattccaatatgggcccgcggtgtttcccgtggccccaacctcctcaaagcagcatggtgtgaacgtgagcgtcaatgctagcgccaccccattccagcagccctctggctatggttcgcatggatacaataccggagttagtgtgaccagctccaataccggtgtgcctgatatttctggaagcgtttacagcaaaacccagcagagtttcgagaagcaaggctttcatagcgggacacccgccgcatcctttaacctgcccagcgcactgggatctggcggaccgataaaccctgcgacggcagcggcgtatccccctgcaccatttatgcacattctcaccccgcaccagcagcctcacagccagatcctgcatcaccatctccagcaggatggccaggatatcttgaattttgtcgacgatcagcttggcgagtag

SEQ ID NO: 21074 - DNA, 798 bp, Artificial Sequence
  Description of Artificial Sequence: Synthetic coding sequence
atgatgaccagcgtgggcaccaaccgggcccggggcaactgggagcagccccagaaccagaatcagacacagcacaaacagaggccgcaggccaccgcagagcagattcgactcgcccagatgatcagcgaccataatgatgcggatttcgaggagaaggttaaacagctgatcgacatcacaggcaaaaaccaggatgagtgtgttatcgcgctccacgattgcaacggtgacgttaacagagccattaacgtcctcctcgaaggaaaccccgatacccatagttgggagatggtaggcaagaaaaagggggtctcaggacagaaggatggcgggcagactgagtccaatgaggaaggtaaagagaaccgggacagggatcgagactacagtaggcgcagaggagggcctccgcgaaggggtcgggtgcgcggacaggagaacggcctggacgggacgaaatccggcggtccatcagggcggggtacagaaaggggtaggcgcgggcgaggccggggaagaggcggctccggccgacgcggtggccgctttagtgctcaggggatggggaccttcaaccctgcagattacgcagaaccagccaacaccgacgacaattacgggaattcttccggcaatacatggaacaacaccggacatttcgagcctgacgacgggacaagtgcttggagaactgccaccgaggagtgggggactgaggattggaatgaggacctgtccgagactaagatatttaccgcaagcaatgttagctctgttcccttgccagcagaatag

SEQ ID NO: 21075 - DNA, 549 bp, Artificial Sequence
  Description of Artificial Sequence: Synthetic coding sequence
atgatgaccagcgtgggcaccaaccgggcccggggcaactgggagcaaccccagaatcagaaccagactcagcataaacagaggccccaggctactgccgagcaaattcgcctggctcaaatgatcagcgatcataacgacgctgacttcgaggaaaaagtcaaacagcttatcgacatcactgggaagaatcaggatgagtgtgttatcgcattgcacgactgtaacggcgacgtcaatcgagctataaacgtcctcctggaagggaacccggatacccatagctgggaaatggtcggcaagaagaagggagtgtcaggccagaaagacgggggacagactgaatctaatgaggaggggaaggaaaacagagaccgagaccgcgattatagtaggcgcagaggtggccccccccgaagaggtaggggtgcatctaggggccgagagtttcgggggcaggaaaacggcttggacgggacaaaaagcggaggtccctcaggaagaggcactgagcgcggaagaagggggcggggtagaggcaggggctag

SEQ ID NO: 21076 - DNA, 705 bp, Artificial Sequence
  Description of Artificial Sequence: Synthetic coding sequence
atgatgaccagcgtgggcaccaaccgggcccggggcaactgggagcagccccagaaccagaaccagacacagcataaacagcgcccacaggctaccgcagaacaaatccgtcttgcccagatgataagcgaccataacgatgccgatttcgaggaaaaggtgaaacagttgatcgatattactggcaaaaaccaagacgaatgtgttattgccctccacgactgcaatggcgacgttaaccgtgccatcaacgttctgttagagggcaatcctgacactcactcctgggaaatggtggggaaaaagaagggagtgtccgggcagaaagacggcggacagactgaatctaacgaggagggaaaagaaaatagagacagagaccgggattactctcggagaagaggtgggcctccacgcagaggccggggggcaagtcgaggtcgcgagttccggggccaggagaatggactggacggtaccaagagtggggggcccagtggcagaggcactgagagaggccgtagaggccgaggtcggggcagaggcggctccgggcgacgagggggacgcttctctgcgcagggaatgggcaccttcaaccccgccgattatgccgagcctgccaatacagacgacaattatggaaactcctctggcaacacgtggaataatacaggccatttcgagccggacgacggcacctag

SEQ ID NO: 21077 - DNA, 1989 bp, Artificial Sequence
  Description of Artificial Sequence: Synthetic coding sequence
atgcccggcagcgccgacatcagcggcctgaacctgcagttcggcgccctgcagttcggctcagaacctgtgctcagcgactatgaatccacccccacaacttccgctagtagctcacaggccccatccagcctctatacgtccaccgcctcagaatctagttccactatctccagcaaccagtcacaagagtccggttaccaatccgggcccattcagtccacaacttacacttcacagaataacgcccagggacccctgtatgagcagcggtcaactcaaacacgtcgctacccgtcctctatctcatccagtcctcaaaaagacctgacccaagccaaaaacgggttctcaagtgtgcaggctactcagctgcagacgacccagtcagtcgagggagcgacaggctcagccgtgaaatcggactcaccatccacaagctctattcctccccttaatgaaacggttagcgctgccagcttgctgaccactaccaaccagcattcaagctccttagggggactatctcatagcgaggagattcctaacacaaccactactcagcacagttcaacacttagcacccaacaaaatacactgagctcctctactagctccggaagaacaagtacatcaactttactgcacacgtcagtggaatctgaggccaatcttcatagcagctccagtacattcagcactacatctagtacagtgtccgctccgccacctgtggtatccgtgagcagctctctcaacagtggatctagcctggggctgtcgctcggctcaaacagcacagtaactgcctcaacgaggagtagcgtcgcaacgacctcggggaaggcccccccgaacctcccacctggagtccctccattgctcccgaacccctacatcatggcgccaggcttgctgcacgcttacccgcctcaggtctacggatacgatgacctgcagatgctgcagactagattcccactcgactactatagcattcccttccccactcctacaacccctttgacagggagggacgggtccctcgcgagcaatccatacagcggtgacctcaccaagttcggacgcggcgatgcatccagccccgctcctgccacaacactcgctcagcctcagcagaatcagacacagacccatcacactactcagcagacctttcttaatccagcactacccccgggctacagctacaccagtctcccttattacacaggagttcctgggctgccttccacctttcaatatggacccgccgtgtttcctgtggccccaacgagctcaaagcagcacggcgtcaacgtttctgtaaatgcctcagctaccccattccagcagccctccgggtatgggagccacgggtacaatacaggtgtgagcgttactagctccaatactggcgtcccagacatatcagggagtgtctatagtaaaacacagcagtccttcgaaaaacaggggttccactccggaacaccggctgcctcctttaatttaccaagcgccctcggtagcggtggtcccatcaaccctgctaccgccgcagcatacccacccgctccgttcatgcacatccttacaccacatcagcagccccattcacaaattttacatcaccacctgcagcaggatgggcaactcccttacctgcagatgatcttatgctgtcaacgtcagcaggaagagcagacaggcagcgggcagcggagccaaacttcgagcatccctcagaaaccacaaacgaacaagagtgcctataatagctactcatggcccacagaagctctcactttattctcccgctcgcatctcctgagagggcttctgagtctcgagactatggagacggcaagcaagaggaaggagtgtggagggttccccctcccacctacaccatccgggcctcctcacgcctccgcatcgtgcttaagccattcttacacaattcccaccctcctttatgtcctctag

SEQ ID NO: 21078 - DNA, 1593 bp, Artificial Sequence
  Description of Artificial Sequence: Synthetic coding sequence
atggaggacgacagcctgtacctgcggggcgagtggcagttcaaccactttagcaaactgaccagcagtcggcccgatgccgctttcgctgagatccaaagaacttcactcccagaaaaaagccccctgtcctgtgaaacacgtgtggacctgtgtgatgatcttgcacccgttgcacgccagctcgcccccagagaaaaactgcccctgagctcccgccggccagcggccgtgggagcaggtctacaaaatatggggaacacctgctatgtgaacgcaagcctccagtgcctgacttatacaccgccccttgccaactatatgctaagtagagagcactcccagacctgccacaggcacaagggttgcatgctatgtacgatgcaggcccatattacaagggctttgcataaccccgggcacgtgatccagccctcccaggcccttgccgccgggttccaccgggggaagcaggaggacgcgcatgagtttctgatgtttaccgtggatgccatgaaaaaggcctgtctgcctgggcacaaacaggtggatcaccactcaaaggacacgactttgatccatcagatcttcggaggttattggagatcacaaataaaatgtctccactgtcacggtattagtgacacttttgatccctacttggacatcgcccttgacatccaggctgcgcagtccgtacagcaggctctggagcagctggtgaaaccggaagaattgaacggtgaaaacgcgtatcattgtggggtgtgcctacaacgcgctcctgctagtaaaacccttacacttcacaccagtgccaaagtgctgatactggtcctaaaaagattttcagatgtcactggtaacaagattgctaagaacgttcagtatcccgaatgtctggatatgcagccctatatgtctcagccaaacaccggtccgctcgtttacgtgctttatgccgtgctcgtgcacgccggttggtcctgccataatgggcactatttttcctatgtgaaagcacaggaaggccagtggtataagatggatgatgctgaggtgacagcctccagcatcacctcggtgcttagccagcaggcttacgttttgttttatatccaaaagtccgaatgggagagacactccgagtcagtgtccagagggagggaaccccgggccctaggcgccgaggacaccgataggagagctacccagggcgaacttaagcgcgaccatccttgcctccaggctcccgagcttgatgagcatctagtcgaacgcgctacacaggagagcaccctggaccactggaagttccttcaagagcaaaataagacaaaacctgagttcaatgtgcgtaaggtggaaggcacattgcctccggacgtacttgtaattcatcagtccaaatataaatgtggcatgaaaaaccaccacccagagcagcagagttccctcttgaacttgtccagctccacgccgacacaccaggagtctatgaataccggtactttagcaagcctccgcgggcgggcgagacggtccaaggggaagaacaaacactccaaacgggctctgttggtttgtcagtag

SEQ ID NO: 21079 - DNA, 1593 bp, Artificial Sequence
  Description of Artificial Sequence: Synthetic coding sequence
atggaggacgacagcctgtacctgcggggcgagtggcagttcaaccatttctccaagttaacatcaagccggcctgatgcagccttcgcagagatccagagaacgtccttgcccgagaagtctcctctcagctgcgaaacccgcgtagatttgtgtgacgatctggcccccgtcgctaggcagctagctccccgggaaaagctgcctctatcctctaggaggcctgccgccgtgggagcaggcctccagaacatgggtaacacctgctacgtcaatgcaagccttcagtgtctcacctacacccccccactcgcaaactatatgttaagtagggaacattcccagacttgccaccgacacaagggttgtatgctctgtacaatgcaagcccatatcacccgggccttgcacaaccccggacatgtgatacagccttcccaggctctcgcagctggatttcaccgcgggaaacaggaagatgctcacgaattcctgatgtttacagtggatgctatgaagaaggcctgtctacctgggcacaaacaagttgaccaccatagtaaagatactaccttgattcatcaaatcttcggcgggtattggaggtcccagataaaatgcctgcactgccatggaatttccgacaccttcgatccctatcttgacattgctttggacattcaagccgcacaatctgttcagcaggcattggagcaactcgtcaaacccgaggaacttaacggcgaaaacgcgtaccattgcggggtgtgtttgcaacgcgcccctgcttcaaaaacgttgactctccacactagtgctaaagttcttatcctggtcctcaagaggttctccgacgtgacaggcaacaaaatcgcgaagaacgtccaatatcccgagtgcctggatatgcagccttatatgtctcaacctaacaccggccctctggtgtatgttctgtacgcagttctggtgcatgctggttggagttgccacaacggacattattttagttacgtcaaagcccaggagggacagtggtacaagatggatgacgcagaagttactgccagctcaattacctcagtcttatcacagcaagcctatgtgctgttctatatccagaaaagcgaatgggagagacactctgaatcagtcagtcgcggtagggagccgcgtgcgttaggcgctgaggacacggacagacgtgccacccagggtgagctgaaaagggaccacccctgtttgcaggctccagaactagacgagcacctcgtggagcgtgccactcaggagtctacactagatcattggaaatttctgcaggaacagaacaaaacaaaacccgagtttaatgtaagaaaggtagagggaaccttgccccccgatgtcttggtgatccaccagagtaaatacaagtgcggcatgaagaatcatcaccctgaacaacagagttctctgttgaacctcagctcctccactcctacccaccaggaatctatgaacactggtacactcgccagcctgagaggacgcgcgaggcggagcaaaggtaagaacaaacattctaaaagagcactgctagtgtgtcagtag

SEQ ID NO: 21080 - DNA, 1593 bp, Artificial Sequence
  Description of Artificial Sequence: Synthetic coding sequence
atggaggacgacagcctgtacctgcggggcgagtggcagttcaaccacttttcaaagttgacatcctcgcgacccgatgcggccttcgccgagatccagagaacgagtctgccagagaaatcccccctctcttgtgagacgcgggtagacctgtgcgacgacctcgctcctgtggccaggcaactggcacctagagaaaagctcccactctccagcaggcgccccgctgccgtgggagccggcctgcagaacatgggtaatacatgttacgtgaacgcttctctgcagtgcctgacatataccccacctctcgcaaattacatgctatcacgggagcattcacaaacttgccaccgccacaagggatgcatgctctgtactatgcaggcacacattactcgcgccttacacaacccagggcacgtgatacagccctcacaggccctggccgccggcttccacaggggaaagcaggaggatgcacatgaatttcttatgtttaccgtggacgccatgaagaaagcatgccttccaggccacaagcaggtggatcaccacagcaaggatacaaccttaatccaccagatctttggcggctattggcgctctcaaattaagtgtttgcattgccatgggatttcggacacattcgacccatatctggatattgctctcgacattcaggccgcccagtctgttcagcaagcacttgaacaactggtcaaaccggaggaactcaatggcgaaaacgcctaccactgtggagtttgtttgcagagggccccagcatctaagaccttgacacttcacacttcggccaaagtcctgattctcgtgctgaagagatttagcgacgtcaccggcaataagatagcgaagaatgtgcaataccctgagtgcctggatatgcagccatatatgagccagccaaacacaggtccgcttgtgtacgtgctgtacgccgttctggtgcacgctggatggtcctgtcacaatggccattacttctcatacgttaaagcacaggaaggacagtggtacaaaatggatgacgccgaagtgacagcctcaagcatcacttctgtcctttcacagcaggcatacgtgctgttctatattcagaaatccgaatgggaacgccacagcgagagtgttagccggggtcgcgaacctagagccttgggagccgaggacacagatcgcagagccactcaaggagaattgaagcgcgaccacccttgcttacaagcccccgagttggacgagcacttagtggaaagggccacacaggaatcaaccttggaccattggaagttcttgcaagaacagaacaaaaccaagccagagtttaatgtgcgtaaggtggagggcaccctgcccccggacgtgctggtcatccatcagagcaagtataagtgcggaatgaagaatcatcaccctgaacagcagtcatctcttctgaacctgtcatcttcgacaccaactcatcaggagtccatgaatacaggcacactggcgagcctacggggacgggcaagacggtctaaaggaaagaataagcacagtaaaagagcactgctcgtgtgccagtag

SEQ ID NO: 21081 - DNA, 1593 bp, Artificial Sequence
  Description of Artificial Sequence: Synthetic coding sequence
atggaggacgacagcctgtacctgcggggcgagtggcagttcaaccactttagcaagctgacgtctagccgccccgatgctgcctttgccgaaattcaacgaacttctttgccagaaaagtcacccctgagctgcgaaacaagggtggatctgtgtgacgacttagccccggtcgccagacagctggcaccccgcgaaaagctccccctgtctagtagacggcctgccgctgtgggtgctggcctccagaacatgggcaacacatgttatgttaatgcttctctgcagtgcctaacttatacgcctcctttggctaattacatgctctctcgcgagcattctcaaacctgccaccggcacaagggatgcatgctgtgcactatgcaggcgcacatcaccagagccctccacaaccctggacatgtgatacaaccaagccaggcattagcagcaggatttcacaggggtaagcaggaagacgcacacgagttccttatgttcaccgtggatgcaatgaaaaaggcctgtctgcctggacataaacaggtggaccaccacagtaaagacacgactttgatacaccagatcttcggcgggtactggcgcagtcagatcaagtgtctccattgtcatggtattagcgacactttcgacccgtacctggatattgctctcgacattcaggctgcccaatctgttcaacaggctctcgagcagctggtgaaacctgaagagctgaacggtgaaaacgcctatcactgtggagtgtgcctgcaacgtgctcctgccagcaaaactttaactctgcacacctcagccaaggttctgattcttgtgttaaaacgattttctgatgtgactggaaataagattgccaaaaacgttcagtatccagagtgtttggacatgcagccctacatgtcacagcctaacaccggtcccttggtgtatgtgctctacgccgtactggtccatgccgggtggagttgtcacaacggccactacttttcttatgttaaggctcaagaaggtcagtggtacaaaatggacgacgctgaagtaactgccagctctataacatctgtgctcagccagcaggcatatgtcttattttacatccagaagagtgaatgggaaagacacagtgaaagcgtctctcgtggcagagagcccagagcacttggggcggaagataccgaccggagggccactcagggagaactgaagagagatcacccgtgcctacaggctcctgagctcgatgagcatcttgttgaaagagctacacaggagtccactctggatcactggaaattcctccaggagcagaacaagactaaacccgagttcaatgtccgaaaagtggagggaaccctccccccagacgtcctagtgatccaccaaagcaaatacaagtgcggtatgaaaaatcaccaccccgaacaacagagcagtctgcttaatttatcaagtagtacgccaacccatcaggagtcgatgaatactggtacactggctagtttgcgcggcagggcaagacgcagcaaaggcaagaataagcacagcaagagggcactgcttgtgtgtcagtag

SEQ ID NO: 21082 - DNA, 1593 bp, Artificial Sequence
  Description of Artificial Sequence: Synthetic coding sequence
atggaggacgacagcctgtacctgcggggcgagtggcagttcaaccatttcagtaaactgacctcatcccggccggacgcggccttcgcagaaattcagcgtacatccttacctgagaagtcccctctcagttgcgaaacgagggtcgatctgtgtgatgacctggcgcccgttgccaggcaacttgctcctcgtgaaaaactgcctctatcaagcagaagacccgccgctgtgggagccggactccagaatatggggaacacatgctacgtgaacgcctccttgcagtgcctgacttacacccctcctctggcaaactatatgctgtctagggagcatagtcagacctgccataggcataagggatgcatgctgtgtaccatgcaagcacacatcacacgcgccctgcacaacccaggtcatgtcattcaacccagccaagcattggccgccggattccaccggggcaaacaggaggacgctcacgagtttcttatgttcacggttgatgcgatgaaaaaggcttgtcttcccgggcataagcaggttgaccatcatagcaaggataccactcttatccatcagatctttggcgggtactggcgatctcagatcaagtgcctccactgccacggcattagcgacactttcgacccgtatctcgatattgctctcgacatccaggcagcccaatcagttcaacaggctctcgagcaactggtcaagccggaggagctaaatggagaaaatgcataccattgtggtgtgtgcctgcagagagcccctgctagtaagaccctaactctccacacttccgctaaagtactgatcctggttctgaagcggttctcagatgtgaccgggaataagatcgctaagaacgtccagtatccggagtgtctcgatatgcagccctacatgtcccagcctaacacaggacctctcgtgtatgtgctctacgcagttctagtgcatgctggatggtcgtgccacaacggccactatttcagttacgtgaaagctcaggagggtcagtggtataagatggatgacgctgaggtgaccgcatctagcattacttccgtgctatcacaacaggcttacgtccttttctacatccagaagtccgagtgggaacggcattccgaatcggtcagtcggggcagagagccccgggctcttggcgccgaggacacagacaggcgcgctacacagggcgagttgaaacgggatcatccttgcctgcaagcccccgagctggacgagcacctagtcgaacgggctacacaagaaagcaccctcgaccattggaaattcctgcaagagcaaaataagacaaagcctgaattcaacgtgcggaaagtcgaaggaacactgcccccagacgtgctagtcattcaccaatcaaaatacaagtgcggaatgaaaaatcaccaccccgagcagcaatcgtctctgctcaacctcagtagttctacgcctactcatcaggaatccatgaacactggtacacttgcaagtctgagggggcgtgctcggagaagcaaggggaagaataagcactcaaaaagagcactccttgtgtgccagtag

SEQ ID NO: 21083 - DNA, 1593 bp, Artificial Sequence
  Description of Artificial Sequence: Synthetic coding sequence
atggaggacgacagcctgtacctgcggggcgagtggcagttcaaccacttctcaaagttaacatcctcacggcctgatgccgcttttgcggaaattcagcgcactagcctcccagagaaatccccgctaagttgcgagacccgcgtagatttatgtgatgacctcgcacctgtggctcgccaacttgccccccgggagaaattgcctctctcatcccgccgcccggccgccgtgggtgcagggctccaaaacatgggcaatacatgttacgtgaacgcctctctgcagtgtcttacttacacgccacctttggcgaactatatgctgtcacgcgaacacagccagacttgccaccgtcataaaggatgtatgctgtgcactatgcaggcccacattacacgcgccctacataacccaggccatgtcatccaaccatcacaggccctggctgctggattccacagaggcaaacaggaagatgctcatgagtttttgatgtttaccgtggatgccatgaagaaggcctgccttcccggtcacaaacaggttgaccatcattctaaggataccactctgattcatcagatttttggtggttattggcgtagtcagattaagtgtctgcattgtcatgggataagcgatacatttgatccatacctggacatcgctctcgatatccaggcagctcagtcagtgcaacaggcccttgagcaattagtcaagcctgaggaactcaatggggagaacgcttaccactgtggtgtgtgcttgcagagggctcccgcatctaaaaccctcactttgcatacatctgccaaggtattgatactggtgctaaagcggttcagtgatgtgaccggaaacaagatcgcgaaaaatgtccaatatcccgaatgccttgacatgcaaccctacatgagtcagcccaatacggggccgctggtgtacgtcctctacgctgtgctcgtccatgcgggctggtcttgccataacgggcactacttcagctacgtaaaagctcaggaggggcaatggtacaagatggatgacgcggaggtgaccgctagttcaatcacttcagttctttcccagcaagcgtatgtcctgttttatatacagaagagcgaatgggagagacactccgagtcagtcagcagaggccgggaaccacgcgcactgggtgccgaggataccgatcggcgggcgacccagggtgagctcaagagggaccacccatgtttgcaggcgcccgagctagacgaacatctggtagagcgagccacacaggagtccaccctcgatcactggaaatttctgcaggaacagaacaaaaccaaacctgagtttaatgtccggaaggtcgaaggaacattgccccctgatgttttggtgatccatcagagcaaatacaaatgtggcatgaagaaccaccatccagagcaacagtctagtcttttaaacctgtcatcatctacgccaactcaccaggaatccatgaatacaggaaccttggccagtttaagaggccgagcccggaggtctaagggaaaaaataaacattctaagagagccctcctcgtctgccaatag

SEQ ID NO: 21084 - DNA, 1593 bp, Artificial Sequence
  Description of Artificial Sequence: Synthetic coding sequence
atggaggacgacagcctgtacctgcggggcgagtggcagttcaaccacttttcaaagctgacctcctcacgcccagacgccgcattcgctgaaatccagaggacttctttacctgagaaatctccattgtcctgcgagacccgtgtggacctttgtgacgatttggcaccagtcgctagacaactggctcctcgcgaaaagctacccttgtctagtcgcagacccgctgccgttggagctggccttcagaatatggggaatacgtgttacgtgaatgcaagtctccagtgtctgacctataccccccccctggccaattatatgctgtcaagagaacacagtcagacatgccaccgacacaaaggctgtatgctgtgcactatgcaggcccacatcacgagagctttgcataacccaggacatgtaatacagcctagccaagcactggccgctggatttcaccgaggcaagcaggaggacgctcacgaatttctgatgttcacagttgatgcaatgaagaaagcctgtctgcccggccataagcaggtcgaccatcacagtaaagacaccaccttgatccatcagattttcggcgggtattggcggtctcagatcaagtgtctccattgtcatggcatctccgatacattcgacccgtatctggacatcgccctagacatacaagccgcacagagtgtgcagcaggccttagagcaactggttaagcccgaagaactgaatggcgagaatgcctatcactgcggtgtgtgtctccagagagcaccagcatcaaaaacactaactctccacaccagcgctaaggtgctgatcctcgtactgaaacggttctccgatgttaccggcaataagatcgctaagaatgtgcagtaccccgagtgcctggacatgcagccttacatgtcccagcccaataccggccccctagtgtacgttctctacgcggtattggtgcatgccggttggtcctgtcacaatggtcactacttctcatatgttaaagcacaagagggtcaatggtacaaaatggacgacgctgaggtgaccgcttcttccatcacctccgttctgtcacaacaggcctacgtgctgttttatatccagaagagcgagtgggagagacatagtgaatccgtttctcggggcagagagccaagggccctgggggctgaagatactgacagacgtgccacccagggtgagctgaagcgcgaccacccatgcctgcaagcccctgaactcgatgagcacctcgtcgagcgcgccacccaggaaagtacgctcgaccattggaaatttcttcaggagcagaacaaaacaaagcctgaatttaacgtgagaaaagtagagggcaccctgcctccagatgtgcttgtgatacaccagtctaagtacaagtgcggaatgaagaaccaccaccctgaacagcaatcaagtctcctaaatttatcaagtagtacccccacccaccaagagtccatgaataccggcacactcgcctcattgaggggccgcgcccggcgctccaaaggaaagaataaacactctaagcgcgccttactggtctgtcagtag

SEQ ID NO: 21085 - DNA, 477 bp, Artificial Sequence
  Description of Artificial Sequence: Synthetic coding sequence
atgctgctgttcgccctgctgctggccatggagctgcccctggtggctgcctctgcgactatgagagcacagtggacttactccctgagatgtcatgattgcgcggtgattaacgattttaattgtcctaatatccgcgtctgtccttaccatattaggagatgcatgactatttctatacggatcaattcccgtgaactcctggtctataagaattgtacaaataattgcaccttcgtgtacgctgcagagcagcctcctgaagcacccggtaagatctttaaaaccaattcgttttattgggtgtgttgctgtaactccatggtctgcaacgctggaggccccacaaatctggaacgggatatgctgcccgatgaggttacagaagaggagctgccagaaggaacggtaaggctgggcgtgtccaaactgctcctctctttcgccagtattatagttagcaacatcctcccctag

SEQ ID NO: 21086 - DNA, 1584 bp, Artificial Sequence
  Description of Artificial Sequence: Synthetic coding sequence
atggccgtgcaccgggtgaaggtgaccttcaaggacgagcccggcgagggaagcggcgtggctcgcagcttctacacagcgatagcacaggcatttctcagcaatgaaaagctccccaatctagaatgcatccagaacgccaacaagggaactcatacgagtttgatgcagcgactgaggaacagaggcgagcgggatagggagagggaacgcgagcgggaaatgcgacgcagcagcggactccgcgcaggcagccgccgagacagggacagggatttcagaaggcaacttagcatcgacaccaggcccttcaggcccgcttcggaaggtaatcctagtgatgatccagagcctttgcccgcccatcgccaggccctaggggagagactttatccaagagtgcaggctatgcagccagcttttgcgtcaaagatcacggggatgcttctggaactcagtccagcccagcttctgttgcttctggcctccgaggatagcctacgggcaagagtggatgaggccatggagctgatcatcgcccatggaagagagaacggagccgattctattctggacctggggctggtggactcatccgaaaaggtgcaggagaatcgcaaacgtcacggctcatcccggtccgttgtggacatggacctggacgacaccgacgacggagatgataacgccccacttttctaccagcctgggaagcgagggttctacactcctcgacctggcaaaaacactgaggcccgactgaactgcttccgcaatatcggaagaatcctaggcctctgtctccttcagaatgaattatgcccgattaccttgaaccgacatgtcatcaaagtgctgctggggaggaaggtcaactggcacgattttgccttcttcgaccccgtgatgtacgaatctttgaggcaattgatcctagcttctcagagtagcgacgctgatgccgttttctctgccatggacctcgcattcgccatagacctgtgtaaagaagaagggggcgggcaggttgagttgattcctaacggggtgaacatccctgtcacacctcagaatgtttacgagtacgtccggaagtacgccgagcacaggatgctggtggttgctgaacagccattacacgccatgaggaaaggccttctcgatgttctgcccaagaattcactggaggacctaaccgctgaggactttcgcctgcttgtcaatggctgcggcgaggttaatgtgcagatgctgatatcattcacctcatttaatgacgagtctggagagaacgcggagaagttactccagtttaaacgttggttctggagcatagtggagaaaatgtcaatgacagagaggcaggatctggtctatttttggacctcttcccccagcttgcctgcgagcgaagagggcttccaacctatgcctagtatcactatccgcccacccgatgatcagcacctgcctaccgcaaacacatgtatctcgagactctatgtccccttgtactcctcaaagcagatattgaagcaaaaactcctgttggccataaagaccaaaaacttcggcttcgtgtag

SEQ ID NO: 21087 - DNA, 8400 bp, Artificial Sequence
  Description of Artificial Sequence: Synthetic coding sequence
atgaccagcatccacttcgtggtgcaccccctgcccggcaccgaggaccagttgaatgatcgtctgagagaggtctccgagaaattaaacaagtacaacctcaattcacatccacctctcaatgttctcgaacaggccacaatcaaacaatgtgttgtgggccctaaccacgccgcattccttcttgaggacggcagggtgtgtaggattggcttttcagtgcagccggatcggctagaactgggcaaaccagataacaacgatggctccaagctcaactctaatagtggggctggtagaacctcaaggcctggaaggacttcggatagcccatggttcttgagcggtagcgaaacccttggcaggctcgctggaaacaccctggggagcaggtggagctccggcgtcgggggcagtggggggggcagttcagggcgaagttctgctggtgctcgggacagccgaagacagaccagagtgattaggacaggccgggaccgggggtccggccttttaggttcccagccgcaacctgttattccagcaagtgttatccctgaagagctcatatcccaagcacaggtggtgctccaaggcaagagtcggtccgtgattataagagaactgcagagaactaacctagatgtaaatctcgccgtgaacaatcttctgtccagggatgacgaagatggagacgacggagatgacaccgcaagcgagtcatacttgcctggtgaggatctgatgtccctcctggacgccgacatccattctgctcacccaagcgtcattattgacgcagatgctatgttcagtgaggacattagttatttcggttacccttctttcagaaggtcctccctctcacgactcggttctagtcgggtgcttcttctcccattggaacgagacagtgaactcttgagggagagggaatccgttttaagattgagggaacggcgctggttagacggcgcaagcttcgataatgagaggggttcaacctcgaaggaaggtgagccgaatctggacaaaaagaataccccagtccagtctcccgttagtctgggtgaagatctgcagtggtggcccgataaggacggaacaaagtttatctgcatcggggccttatattctgagctgctggctgtatcaagtaagggagagctgtaccaatggaaatggtcggagtctgaaccgtatagaaatgctcagaatccttctttacatcatccccgggctacatttctaggactaacaaacgaaaagattgttctgctttcggccaacagtattcgcgccacagtagctaccgagaacaacaaggtggccacatgggtagacgaaacactgagctccgtcgcctctaagctggaacacaccgcgcagacttattctgagctccaaggcgagcggatcgtatctctacattgctgcgccctgtacacctgcgctcagttggagaattccctctactggtggggcgtggtacctttctcccagaggaagaagatgcttgagaaggctcgcgcaaaaaacaaaaaacctaaatcttcggccgggatctcatccatgccaaatattaccgtaggcacccaggtctgtcttcgcaataatccactctaccatgctggcgccgtggccttttccatctctgcaggtataccgaaggttggggtgttgatggaatccgtctggaacatgaacgatagttgccgtttccaactccggagtccagagagcttgaaaaatatggaaaaagcctcaaaaacaactgaggccaaacctgagtccaagcaggagccagtgaagaccgaaatgggtcctccgcccagccctgcatcaacatgttcagatgctagctctattgccagtagtgctagcatgccgtataaacggcgcagaagtacgcctgctccaaaggaggaagaaaaggtgaacgaggaacaatggagcctgcgagaagtcgtttttgtggaagacgtcaagaatgtaccagtgggcaaggtactgaaggttgatggagcgtatgtcgctgtgaaattcccggggacttcttccaataccaactgccaaaatagttcaggtccggatgctgaccctagctctttactccaggattgccggctgctgcgaatcgacgagctgcaggtggtcaaaaccggcggaacacccaaagtccccgactgttttcaacggacaccaaaaaagctctgtattcccgagaagactgagatacttgccgtgaatgtcgattcgaagggggtgcacgccgtcctgaaaacaggaaactgggtgagatattgtatcttcgatctcgccactggcaaagctgagcaagagaacaacttcccaacgagttctattgctttcctcggtcagaacgaaagaaacgtggcgatttttaccgccggccaggaatccccaattattctaagagatggcaacggtacaatctatcccatggctaaagattgcatgggaggaattagggacccagattggctcgatctgcctcccatctccagcctcggcatgggagtgcactctctcataaatttaccagccaactcgacaatcaaaaagaaagcggccgttatcatcatggccgtcgagaagcaaactctcatgcagcacatacttaggtgtgactatgaggcatgtaggcaatatctcatgaacctagagcaggcagtcgtgcttgagcagaacctacaaatgctgcagacatttattagccaccgttgtgatgggaaccggaatatcctccatgcttgtgttagcgtctgtttccccaccagtaacaaagaaacgaaagaggaagaagaagccgaacggtcagagcggaacaccttcgctgaaagattgtccgccgtggaggccattgccaatgccattagtgtcgtctcctcaaacggacccggaaatcgggcaggcagttcttcctcacggtctttgaggctccgtgagatgatgcgacgatccctccgtgctgcaggactaggaaggcacgaggccggcgcctcttccagtgaccatcaggatccggtctccccacctattgcaccgccatcatgggtgccagatccccccgccatggacccggacggagacattgattttattctggcccccgctgtgggcagcctcaccactgctgcaacagggacaggacagggaccctctacatctaccatccccggtcccagtacagagccctccgtagtggaatcaaaggaccgcaaggcaaacgctcattttatcctcaagctcctgtgcgacagtgtggtgttgcagccatacttgcgagagcttctgtctgccaaagacgccaggggtatgacgcctttcatgagtgccgtttcagggcgcgcctatcctgctgccatcaccattctggaaaccgcccagaagatcgcaaaggctgagataagctcttcagagaaagaggaagacgtatttatgggaatggtatgtccttccggaactaacccagatgactctccactgtatgtgttatgctgcaacgacacctgctcctttacttggaccggggcagaacacatcaaccaagacatttttgaatgtcgtacgtgtggcttgctcgagagtctgtgctgttgtaccgagtgcgcgcgagtgtgtcacaaaggccacgattgtaagctcaagcgcacttctcccacagcatactgtgactgctgggagaagtgtaagtgcaagacacttattgctggccagaaatctgcaagactggacctcctctacaggttgctgacagctacaaatcttgtgactctccccaattcacgtggtgaacacttgctccttttcctggttcaaaccgtggcacggcagacagttgagcactgtcaatacaggcccccccgcatccgggaggacagaaaccggaagacagctagtcctgaggactcagatatgcccgatcacgaccttgaaccacccaggttcgcgcagttagcactggagcgggtgctgcaggactggaatgcactaaaaagcatgatcatgttcggaagtcaggagaacaaggaccccctgagcgcttcgagcagaatcggccacctgctgcccgaagagcaggtatacctgaatcagcaatccgggaccattcgcctggactgcttcacacactgtctaatcgtcaaatgcacagccgacatacttctgttggatacactgctgggtaccctagttaaggaattacagaacaagtacactccaggcagacgggaagaggccatcgccgtgacgatgaggtttctgcgttccgtcgcaagagtgttcgttatcctcagcgtggagatggcttcgtccaagaagaagaataacttcattccccaaccaattggcaagtgcaagagagtttttcaggctctactaccctacgcagtggaggagctgtgtaacgtggctgagtctttgatcgtgcctgttaggatgggtatcgcccggccgactgccccgtttacgcttgcctctacttccattgatgccatgcaaggatccgaagagttgttcagcgtcgaaccgctgcccccccgcccatcaagtgaccaatccagcagtagttctcagagccagagcagttacattatcaggaatccccaacagcgacgtatctcacagtcccagcctgtgagagggcgagatgaggaacaggacgacatagtttcagcagacgtcgaagaggttgaggtggttgaaggcgtagctggggaggaggatcatcatgatgagcaagaagagcacggcgaggaaaacgctgaggcggaggggcaacacgatgaacacgatgaagatggctccgatatggaactggacctactggctgccgccgagacggagagtgacagcgagtccaaccactcaaatcaggataatgcttcgggccgaaggtccgtcgtcaccgccgcaacagctggctctgaagctggagcttcatccgtaccagcatttttcagcgaggacgactcccaaagtaacgatagctccgactccgatagctcatcaagccaatccgatgatattgagcaagagacgtttatgcttgatgaacctctggagcgcaccacaaatagctctcacgctaacggggccgctcaagccccccggagtatgcagtgggctgttagaaatactcagcaccagcgtgcagcctcgacggcaccctcatccacaagcaccccagcggcctcttctgccggtctgatatacattgatccaagcaatctcaggcggagcggcacaatcagtacatctgccgctgcggcggcagccgctctggaagccagcaacgcgagtagttatctcacatctgccagtagtctcgcccgcgcctatagcattgtcataaggcagatctctgatttaatgggcctgatacccaaatataatcacctggtgtatagtcagatccctgctgccgttaagctgacttaccaggacgcagtcaacctacagaactatgtagaagagaaactgatccctacctggaattggatggtgagcatcatggactccacagaggcccagttgcggtatgggagtgcactcgcttctgccggagatccaggtcatcccaatcacccccttcacgcttctcagaattccgccaggcgagagagaatgacagcccgtgaagaagcttcacttagaactctagagggacgacgtcgcgcaaccctcctgtccgccagacagggcatgatgagcgcccggggcgactttctgaattatgcattgagcttgatgagatcccacaatgatgagcacagcgacgttctccccgtcctggatgtttgttctctcaagcatgtagcctacgtctttcaggccctgatatactggatcaaagccatgaatcagcaaaccacattggataccccacagctcgagcgcaaaagaactagggaactgctagaactggggattgataacgaagactctgaacacgagaacgatgacgacaccaatcagtctgcgacactgaatgacaaggatgacgacagtctgcccgctgaaaccggtcagaatcacccattcttccggcggtcggactctatgacgtttctgggttgtatcccccctaatccctttgaggtccctctggcagaagcaatccccctcgcagatcaaccccaccttctccagcctaacgctagaaaagaagatctgttcggccgcccctcacaaggcctgtattcatccagcgcgagttcaggaaaatgtttaatggaggtcacagtagaccggaactgcctggaagtgctgcctaccaaaatgagttatgctgccaacctgaagaatgtgatgaatatgcagaatcggcaaaaaaaggagggcgaggagcagcctgtgctaccggaggaaaccgagtcttcaaaacccggcccaagcgctcatgatctggccgcacaactgaagtcttcactcctggctgagatcggtctgactgagtcagaagggcctcctctaaccagcttccggccccaatgttcattcatgggcatggtgatctctcacgatatgctgctggggcgttggcgcctgagtctcgagctgtttggacgcgtcttcatggaagatgtaggggctgaacccggttccattctcaccgaactgggaggatttgaggtgaaagaatctaagtttaggagagagatggaaaagctacggaatcagcagagccgggatctttctctcgaggtggacagggacagagaccttctgattcaacagacaatgaggcaactgaataatcatttcgggagaaggtgtgcaacaactccgatggctgtgcatcgcgttaaggtgacctttaaggatgaacctggtgaaggcagtggggtggcacgaagtttttatacagctatcgcacaggccttcttgtctaacgagaagttgcctaaccttgagtgcattcagaatgcaaataagggcacacacacttccctcatgcagcggctgcgtaatcggggggaaagggatagggagcgggagagagaacgcgaaatgcggcgttcctcagggctgcgtgcaggcagcaggagagatcgtgatcgcgattttcggcgccagttgagcatagatacccgaccgtttcgcccggccagcgagggcaatccttctgatgaccctgagccactaccagctcatcgtcaggccctaggtgaaagattgtatcccagggtgcaggcaatgcagcccgcttttgcttctaaaattaccggcatgctgctggagctcagccctgcccagctgttgctgctgctcgcctctgaggatagtctaagagccagggttgacgaggctatggagctcattattgcgcacggcagagagaatggggcagactctattctggatctaggcctcgtcgatagttccgagaaggtgcagcaggagaacagaaagcgccatgggtcttcacgatctgtcgtcgacatggatcttgatgacaccgacgacggagacgataatgctcctctattctatcagcccggtaagaggggattctatactccacgccctggtaagaataccgaagctcggctgaattgcttccggaatattggtcgtatcctggggctttgtctgctgcagaatgagctgtgtcctattacccttaatcgtcatgttatcaaggtactgttgggacgtaaagtcaattggcacgactttgcattctttgaccctgtgatgtacgagtccctgagacaactcatccttgcgtcacaatcaagcgacgctgacgcagtattttctgctatggacctcgcatttgcaattgatctgtgcaaagaggaaggcggcggccaggttgagctgatacctaatggagtgaatatccccgtcacacctcagaacgtttacgaatacgtgaggaaatacgccgagcatagaatgctggttgtggcagagcagcctctgcacgcaatgaggaagggcctactcgacgtgttaccaaaaaactcgctggaagatctcacagccgaggacttcagactgctcgtgaacggctgtggtgaggtcaacgtgcagatgctgatctccttcacttcattcaatgacgaaagtggcgagaacgcagaaaaactgctgcagttcaaacgttggttctggagtattgtggaaaagatgtcaatgaccgagaggcaggatctcgtgtatttctggacatctagcccttcgttgcccgcctcggaggaggggttccagcctatgccgtctattacgatccgcccacccgacgatcagcacctgccaacagctaatacatgcataagtcgactctatgttccgctgtatagctctaagcagatactcaagcaaaaattactgcttgctatcaaaactaagaatttcggctttgtatag

SEQ ID NO: 21088 - DNA, 8379 bp, Artificial Sequence
  Description of Artificial Sequence: Synthetic coding sequence
atgaccagcatccacttcgtggtgcaccccctgcccggcaccgaggaccaattaaacgataggctgagggaggtgagcgagaagttaaataagtataaccttaattcacaccccccactaaatgtgctcgagcaggcaaccatcaagcagtgcgtcgttgggccaaaccacgccgcgttcctgctggaagacggacgcgtgtgccggatcggctttagcgtgcaaccagaccgactcgagctaggaaagcccgacaacaacgatggttcaaagttaaactctaacagcggagcgggcagaacgagtcgccctggacgcacaagcgatagcccgtggtttctaagtgggagtgaaactttgggtagattagcaggtaatactttaggatctcggtggtctagtggagtgggaggaagcggcggagggtcatcaggccgatcgtcagcaggggctagggatagtaggagacaaacacgcgtgatcaggaccggacgcgatagaggcagcggtctactgggtagtcagccgcaacctgttatcccagctagtgttatacccgaggagctcattagccaagcccaggtggttctgcaggggaaatcgcggtccgtcattataagagaactccaaagaactaacttagacgtcaatctagcggtgaacaacttgctgagtagggatgacgaggacggcgacgatggtgacgatactgcatccgagagttacctcccaggagaggatttgatgagcctgctagatgcagacattcactccgctcacccatccgtcattatcgacgcagacgcgatgttctctgaagatatatcatacttcggctacccctccttcagacggagcagtcttagccggctgggcagcagccgggaaagagacagcgaactgctgagggagcgcgagagtgtgctgcggctgagagagcgcagatggctggacggagctagcttcgacaacgagagaggctccacatccaaggaaggagagcctaacctggataagaagaacactccagtacagagccccgtatccctgggcgaggatctgcaatggtggcccgataaggatggtactaagtttatctgcatcggcgctctttacagcgagctgctggccgtcagctcgaagggagaactctatcaatggaaatggtccgaatcggagccctataggaatgctcagaacccgtcacttcaccatccacgcgctaccttcctaggacttacaaacgagaagattgttctgctttctgcgaactctattcgcgccacagtggccactgagaataacaaagttgcaacctgggtcgatgagaccctgagcagtgtggcctctaagctggaacatactgcccaaacgtatagtgagctccagggagagcgcattgtgtcactgcattgctgtgcattgtacacatgcgcacagctagagaattctctctattggtggggcgtcgtgcctttttcacaacggaaaaaaatgcttgagaaagcccgggccaagaataaaaaaccgaagagttccgctgggatttcttcaatgcctaatatcacggtggggacacaggtgtgtctgcgaaataacccgctgtatcatgccggagctgtggcatttagtatttcagccggcattcccaaggttggagtactgatggagtcagtttggaacatgaacgattcttgcaggtttcagctgcgtagccccgaatccctcaagaacatggagaaggcaagcaaaacaaccgaagcaaagccagaatccaaacaggaacccgtgaaaacggaaatgggacctccaccctctcccgcgtctacctgcagtgatgcaagttcgatagcttccagcgcatcaatgccgtacaagaggcgacggagcacgcccgctccaaaggaggaggaaaaagtgaatgaggagcagtggagcctgagggaggtcgtatttgtcgaggacgttaagaatgtacccgtcggcaaagtccttaaggtggatggcgcatatgtcgcagtaaaattcccaggtacctccagcaacactaactgtcaaaacagttctggtcccgacgcagacccttctagtctcttgcaggactgccggttactcaggatcgatgagctgcaagttgttaaaacaggcggtacccctaaagtgcccgattgtttccaacgtactcctaaaaagctttgtatacccgagaaaaccgagattctggctgtgaacgtggattctaagggagttcatgcagtgttgaaaacaggcaactgggtgcgctattgtatttttgacctggccactggtaaggcagagcaggagaataactttcctacctcaagtatcgccttcttaggccagaacgaacgcaacgtagccatttttactgcaggacaggagagtccaataattttaagggacggcaatggcacgatttacccaatggctaaggattgtatgggaggcattcgcgatccagattggctggatctccctcccattagctcgctgggcatgggtgttcattcgctgatcaatctcccggccaattccacgatcaaaaaaaaagctgcagtgatcatcatggctgtggaaaaacagaccctcatgcagcacatcttaagatgcgattatgaggcttgccggcagtacttgatgaatctggagcaggctgtggttctggaacagaacctccagatgcttcagacattcatttcccatcggtgtgatgggaatagaaacattttgcatgcctgtgtgtctgtttgttttccaacttcgaataaagagacaaaagaagaagaagaggccgaaaggtctgagaggaacacctttgcagaacgacttagtgccgttgaggcgatcgccaacgcaatctccgttgtgtcgagcaatggacctggaaatagagctgggagcagcagcagcagatctttacggcttcgagaaatgatgcggaggtcattgcgcgcagccgggttggggcggcacgaagccggcgccagctcaagtgatcatcaagatccagttagtccccccattgccccccccagttgggtccccgaccccccagcaatggatccagacggggacatagactttatcttagcccccgccgtcggttcactgacaaccgccgctacggggacaggccaaggaccatccacctccaccatccccggcccatctaccgaaccgtccgtcgtcgagagcaaggaccgcaaagccaacgcccacttcatactgaagctcttgtgcgacagcgtagtactgcagccctacttgcgcgagctcctttccgccaaggatgcaagagggatgaccccttttatgtcagccgttagtggtcgcgcttatcctgctgccattacaatactggagacagcacagaagatcgccaaagcagagatcagttctagcgagaaggaggaagacgtgttcatggggatggtctgtccatctggcaccaatccagatgattcaccgttgtatgtattgtgctgtaacgatacatgttcgttcacatggacaggtgccgagcacataaaccaagacatctttgagtgtcggacctgcggcctgctcgaatcactgtgctgttgtacagaatgtgcccgcgtctgccacaaaggccatgattgcaagctcaagcggaccagtcctactgcatactgcgattgctgggaaaagtgcaaatgtaagactctgatcgctggtcaaaagtctgcccgcctggacctgctctatcggctgctgaccgccaccaacctggtgaccctgccaaactcacggggtgagcacctgctgctattcttggtgcagaccgtggccaggcagacagtcgagcactgccaatatcgacctccccgtatccgtgaagaccgtaacagaaagaccgcatctcccgaagactcggacatgcctgatcatgacctggagccacccaggtttgcccagctagctctggagcgagttctgcaggattggaatgctttgaagagtatgatcatgttcggctcacaggagaataaagatcctctctcagcttccagccgtattggtcatttgctcccagaagaacaagtctacctaaaccagcagtccgggacgatccgacttgattgtttcacccactgtctgatagtgaagtgcactgcagacattctgctgcttgacaccctgctgggaacgcttgtcaaagagttgcagaacaaatataccccaggaaggcgtgaagaggccatcgccgtgaccatgcggttccttcgctccgtggcgagggtctttgtgattcttagcgtggaaatggccagcagcaaaaagaagaataacttcatcccccagcctataggcaaatgcaaacgggtcttccaggccctgcttccctacgcagtggaagagctgtgcaatgtggctgagtctttgattgtaccagtaagaatgggtattgctcggcccactgccccctttactttggctagcacatccatcgatgctatgcagggaagtgaagaactgttttctgtggagcctctccccccacggccatccagcgatcagagttcttccagctcccagtctcagtcttcctacatcatacgaaaccctcagcagagacggatctcgcagagccaacccgttagagggagggatgaggagcaggatgacatcgtgagcgccgacgtcgaggaggtggaggtcgttgagggggtggccggcgaagaagaccaccacgacgagcaagaagaacacggggaggagaacgccgaagctgagggccagcacgatgagcatgacgaagacggatctgacatggagctggatctgctggccgcggctgagacagagtcagattctgagagtaaccattcaaatcaggataacgcgtctggaaggcgttccgtagttaccgccgcaaccgcgggtagcgaagcgggtgcttcttccgtcccagcctttttttcagaggatgactcccagtccaacgactcctctgactctgactcttcatcaagccagagcgatgatattgaacaagagacttttatgttagatgaacctcttgagagaacaacaaattcatcccatgccaatggtgccgcccaggccccccggtcaatgcagtgggcggtgaggaacactcagcaccagagggctgcatccactgcgccatcgagcacttctacgccagccgctagttcggctggtctgatttacattgatccttctaatttgaggagatccgggacaatctcaacatccgcagctgcagcagccgcagcacttgaggcctccaatgcctctagttatcttacctccgctagcagcctggctcgggcttatagcattgtcatccgacaaattagcgatttaatggggctgattccgaagtataaccacctcgtttactcacagatccccgctgctgtgaagctgacatatcaagatgccgtgaatcttcaaaattacgtagaagaaaagcttataccaacatggaactggatggtttccattatggattccaccgaggcccagctgaggtacgggagcgcgttagcatccgcaggtgacccgggccatcctaatcatccactccacgcaagccagaactcagccagacgggagcggatgaccgctcgcgaggaagccagcctgcgtacacttgaaggcagaagacgggctacgctgctgagcgcacggcaggggatgatgtccgctcgtggcgatttcctgaactacgcgttaagtctgatgagaagccataacgatgaacacagcgatgtgttgcccgtgctcgacgtgtgctctctgaagcacgttgcatacgtttttcaggccctcatatattggatcaaggcaatgaaccaacagaccactctagatacaccacagctggaaagaaagcggacccgggagcttcttgagctggggatcgataacgaagattccgaacacgaaaatgatgatgacacaaaccagtctgctaccctcaacgataaggatgacgacagcttgcctgcagagaccgggcaaaaccatccgttcttccggagatctgactcgatgacatttctgggctgcattccccctaacccttttgaagtgcccttagccgaggccatcccactagcagaccagcctcacttgttgcagcccaacgcccgcaaggaggacctgttcggacgaccaagccagggtttgtattcttcgtcagccagcagtggcaagtgcttaatggaagtgaccgtcgatcgtaactgtcttgaggtcttacccacgaaaatgtcttacgccgccaacctgaagaacgtgatgaacatgcagaaccggcagaagaaggagggcgaagagcaaccggtcctgcctgaagagaccgagagcagtaaacccggcccaagtgctcacgatctcgctgctcaactgaaaagctccttgcttgcagaaatcggactgaccgagtccgaagggccccccctcactagctttcggccacagtgcagtttcatgggaatggtgatcagccacgacatgttgctgggcaggtggcgactgagcctggagctgttcggaagagtgtttatggaagacgtgggggccgaacccggaagcatcctgactgaactcggagggtttgaggtgaaagaatcaaagtttcggcgcgagatggagaagttgagaaatcagcaaagtagggacctctctcttgaagttgacagagatcgagacctccttattcagcagacaatgcgccagcttaacaaccatttcggccgccgctgtgccacaacccccatggccgtgcaccgggtcaaagtgacttttaaggacgaacctggcgaaggctccggggtggctcgcagtttctacactgccatcgctcaagctttcttatccaacgagaagctccctaatcttgagtgcattcagaatgccaacaaggggactcatacaagcctgatgcaaagactgcggaacagaggggagcgggacagggagagggaacgcgagagggaaatgcgtcgaagctctgggctgcgcgccggcagccgaagggatcgggatagggattttagacggcagttgagcatcgacacgcggccattccggcctgcttctgagggcaacccctcggatgatccagagcccctccccgcccaccgtcaggctctgggcgaaagactttatcctcgtgttcaagccatgcagccagctttcgctagcaagattacaggtatgctcctggagctctctccagctcaactgctcctgttgctcgcttcagaggatagcctgagggcaagggtcgatgaagctatggagttgatcatcgctcatggcagggagaacggcgctgacagtatcttggacttaggccttgtggactcttccgagaaggttcaggaaaaccggaagaggcacggctcaagccgaagcgtcgtcgatatggatctggacgatactgatgatggtgatgataacgctcctttgttctatcagcccggtaagcggggcttttacacgccaaggcctgggaagaataccgaggctcgactgaattgctttcgcaatataggtaggatcttgggcttgtgcctgctgcagaacgagctctgcccaataacattgaatcgacacgtcataaaagtgctgcttggtcgtaaagttaactggcatgattttgcattcttcgacccagttatgtatgagtcgctgaggcagcttatactcgcgagtcaaagttccgacgccgacgctgtgttctctgccatggacttggcatttgccatcgacctttgcaaggaggaagggggcggtcaggtggagctgatcccgaacggagtaaacatacctgtcacacctcagaacgtttacgaatatgtgagaaagtatgccgaacatcggatgctggtggtggccgagcagcctttgcatgccatgagaaagggcttactggacgtgctgcctaaaaattctctggaagacctgactgccgaagattttcggctgcttgttaacgggtgtggggaggtgaatgtgcagatgttaatttcattcacttccttcaatgatgagagtggcgaaaatgctgagaaactcctgcagttcaaacgctggttctggagtatagtggagaagatgagcatgactgagcgccaagatctggtgtacttctggacctctagtccaagtcttcctgcttctgaagaggggttccagcccatgcccagcatcaccatccgacctcctgatgatcagcatctccctaccgcgaacacatgcatctcaagactgtatgtgccgctgtacagcagcaaacagattcttaaacagaagctgctgctggccatcaagaccaagaactttggcttcgtatag

SEQ ID NO: 21089 - DNA, 1593 bp, Artificial Sequence
  Description of Artificial Sequence: Synthetic coding sequence
atggaggacgacagcctgtacctgggcggcgagtggcagttcaaccacttcagcaaactcacctctagcaggcccgatgccgccttcgccgaaatacagcgtactagcctccccgagaagagtccgctctcgtcagaggccagagtcgacctctgtgatgacctggccccagttgccagacagctcgctcctcgcaagaagctccccttaagctcaaggcgacccgctgctgttggagcaggtttacaaaacatggggaatacatgttacgaaaatgccagcctacaatgtcttacctatactcctcctctagccaactacatgttaagcagggagcactctcaaacttgccaaagacctaagtgttgtatgttgtgcaccatgcaggcccacattacatgggcactccactcgccggggcacgtcattcaaccaagccaggccctcgccgcaggctttcacaggggtaaacaagaagacgcccacgagtttctgatgtttacagttgatgcaatgaaaaaggcctgcttaccagggcataagcaagtcgatcatcattcaaaggatactacactcatacatcagatcttcggcggatgttggcggtcacaaattaaatgtttacactgtcacggaatcagtgatactttcgatccatacctcgatatcgcacttgacatccaggctgcccagagcgtaaagcaggcactcgagcaactggtgaagcctgaagagttaaacggagagaacgcctatcactgcggcctatgcttacagagggccccagcttcaaagactctgacactgcacacaagtgccaaggttctcattctggtcctgaaacgcttttcagatgtcactggaaacaaactggccaagaacgtgcagtatcctgaatgtctggacatgcaaccttacatgtcacagcagaacacgggacctctggtctatgtgctttatgccgttttggtgcatgcgggatggtcatgtcatgatggacattatttctcctatgtgaaggcccaggagggacagtggtacaaaatggacgatgcaaaagtcacagcctgctcaattacctccgtcttaagccagcaagcctatgttttattttacattcagaaaagcgaatgggagcgacactccgagagtgtgtcgagaggacgcgaacctagagcacttggagctgaagacactgacagacgagccactcagggcgagcttaagcgcgatcatccctgccttcaggctccagaactagatgaacgactggtggagagagccacacaagagtctaccctggatcactggaagtttccccaggaacaaaataagacaaaacctgagttcaatgtacgcaaagtcgaagggactttgccaccaaacgtgctggttattcaccagtccaaatacaagtgcggcatgaagaaccaccaccccgaacaacagtcctcccttctcaatcttagctccaccacgagaacagaccaggagtccgttaacactggaaccctggcttcgcttcagggtagaactaggcgctcaaagggtaaaaataagcattccaagagggctctgttggtttgccagtag

SEQ ID NO: 21090 - DNA, 2940 bp, Artificial Sequence
  Description of Artificial Sequence: Synthetic coding sequence
atgagccccctgaagatccacggccccatccggatccggagcatgcaaaccggcattactaagtggaaggagggctccttcgaaatcgtggaaaaggagaacaaagtgtccctggtcgttcattataatactggcggaataccacgcatttttcaactgagtcacaatatcaagaatgtggtcctaaggccctcaggggcgaagcagtcaaggctgatgctgacacttcaagacaacagcttcctctccattgataaggttcctagtaaggacgccgaggagatgcggctgtttctcgacgctgtacaccagaaccgacttcctgccgcaatgaagccttcccaaggttcagggtcctttggagcaatcttaggaagcagaacttctcaaaaggagacctctagacaacttagttactccgataaccaggcctccgccaaaaggggaagcctggaaacaaaggacgatataccatttagaaaagtgctgggcaacccgggacgaggaagcattaagaccgtagcaggctcagggatcgcgcgaactattcctagtcttacatccacctccacccctctgcgatctggcttgctggagaaccggaccgagaaaagaaagaggatgatcagtaccgggagcgaactaaatgaagattaccccaaggagaacgatagctcgtccaacaacaaggctatgacggatcccagcagaaagtatctcaccagtagcagagagaaacagctcagcctcaagcagagcgaagagaacagaacaagcgggctcctccctttgcagagttcttcattctatggttctagagccggctcgaaagagcacagctcgggcggcacaaacctagaccgcaccaatgtgagcagccagacacccagcgccaagaggagcctggggtttctgccgcagcccgtcccgctttcggttaagaaactccggtgtaaccaggactacactggttggaacaaaccacgggtgcccctatcctcccatcaacaacaacagcttcagggctttagcaacctaggcaacacgtgttacatgaacgccatattacagtcccttttcagcttacaatcctttgccaacgacttgctgaagcaggggattccttggaagaaaattcctttgaatgccctgatccggcgatttgctcatctgctggtgaaaaaggacatttgtaactccgagactaagaaggacctactcaaaaaagtaaaaaacgcaatcagtgcaacagcagagcgcttttccgggtatatgcagaacgatgcgcacgagtttctgtcccaatgtctggaccagctgaaggaagacatggagaagttgaacaagacttggaagaccgagccagtgtctggggaggagaatagcccagacatttcagctacacgggcatatacatgccccgtgataacaaatctagagttcgaagtacaacactctattatctgtaaagcatgtggagaaattatcccgaagagggagcaatttaatgatctttcgatcgatctgcccaggcggaagaaacctctgcctcctaggtccatccaagacagcctggatctgttcttccgggcagaggagctagagtattcatgtgagaagtgtggcggtaaatgcgctctggtgagacacaagtttaaccggctgccacgggtgttgatcctgcatctgaaaaggtactcctttaatgtcgccctgtccctgaataacaagatcggccagcaggtcattataccccggtacttgacactgtcctcacattgtacagagaatacaaaaccgccattcactttgggctggtctgcacacatggctatctcccgaccccttaaggcttcacagatggtgaactcttgcatcaccagccctagtacgccctcaaagaaatttacttttaaatctaagagttcacttgccctatgcttggatagcgactccgaggatgagttaaagcgatctgtggcgctcagccaacgtctgtgcgaaatgttaggaaacgagcagcagcaagaagacctcgaaaaagacagcaaactgtgtcccatcgagcccgataaaagcgagctcgagaattccggatttgatcgaatgagtgaggaagagctactcgcagcggtcctggagattagtaagcgggatgcaagccctagcctctctcacgaagatgatgacaaacccacttcctctccggatacaggcttcgccgaagacgacattcaggagatgccagagaatcccgataccatggaaaccgagaaacctaagacaatcaccgagttagatcctgctagcttcacggagatcacaaaagactgtgacgaaaacaaggagaacaaaactcccgagggatcgcagggcgaggtggactggctccagcagtatgatatggagagggagcgtgaggaacaggagctacagcaggccttggcacagtcactccaagagcaggaggcttgggaacagaaagaagacgacgatctgaaacgcgcaacagaactgtcgttgcaagagttcaacaattctttcgttgacgcccttggaagtgacgaggacagtggcaacgaagacgtgttcgacatggagtacacagaggcagaggctgaagagctcaagcgtaatgccgagactggcaacttaccccactcttaccggcttatatctgtggtgtcccacattggctctacgtcgtcgtctgggcactacataagtgatgtctacgatataaagaaacaggcgtggtttacttataacgatctcgaagtctctaagatacaggaggcagccgttcaaagtgaccgggatagaagtgggtacatttttttctatatgcataaggaaatttttgacgaactgttagagacagaaaagaactctcagtccttaagcactgaggtcggaaagacgacccggcaagcactgtag

SEQ ID NO: 21091 - DNA, 2940 bp, Artificial Sequence
  Description of Artificial Sequence: Synthetic coding sequence
atgagccccctgaagatccacggccccatccggatccggagcatgcagaccgggataaccaagtggaaggagggaagtttcgagatagttgagaaggaaaataaggtctccttagttgttcattataacaccgggggcatacctcgcattttccagctgtctcataatatcaaaaacgtggtcctgcggccgtccggtgcaaagcagagtcgactcatgttgaccctgcaggataactctttcctgtcaattgataaggtgccctccaaagatgctgaagaaatgcggctattccttgatgccgtgcaccagaatagactccctgccgccatgaaaccaagccagggatccggctcctttggcgctatccttggcagcagaacctcccagaaagaaacaagcagacagctatcgtattctgacaatcaggcgagcgctaagcgcggctccttagaaacaaaggacgatataccgttccgaaaagtgttgggtaatccagggcgaggttctataaagacggttgccgggagcggcatcgctaggactatccccagtctcactagtacttcaaccccactaaggagtggactattagagaatcggacagaaaagaggaagcgcatgatttccactggatccgagctaaatgaagattaccccaaggaaaacgactcctcctctaacaacaaggctatgacggaccccagccggaagtatttaacttcatcacgggaaaagcagctgtcacttaagcaaagtgaggaaaaccggacttcaggactgctccctctgcaatcctcgtccttttatgggagcagggccgggtctaaggaacactctagcggtggcactaaccttgatagaacaaatgtcagtagccaaacacccagtgccaagaggtctctggggttcttgccacaacctgtgccactgtcagtcaaaaagctgcgatgcaaccaagattacaccggctggaataagcccagagttccactcagcagtcaccaacagcagcagctccaaggtttcagtaatttagggaatacatgttacatgaatgcaatcctccagagccttttttcactgcagtcctttgcaaatgaccttctaaagcaaggcataccttggaaaaaaattcctctgaacgccttaattagaagatttgcccacctgttggtgaaaaaggatatttgtaactcggaaaccaagaaggaccttctgaaaaaagtcaaaaatgctatcagcgcgactgcggaacggttctcgggttatatgcaaaacgatgctcacgaattcctctcccagtgcctggaccagctcaaggaggacatggagaagttgaataaaacttggaagacagaaccagtgtcaggtgaagaaaatagcccggacatttccgcgacgcgggcctacacatgtccggtcataacaaacctggagtttgaggtgcagcacagtatcatatgcaaagcatgtggcgaaattatcccaaagcgggaacagttcaacgacttgagcatagatcttccccggaggaaaaagccactccccccccgaagtattcaggatagccttgacctatttttcagagcggaggaactagagtattcctgtgaaaagtgtggggggaagtgcgctcttgtgaggcataagttcaatcggctgccgcgagtcttgattttgcacttgaaacggtattcattcaacgtcgccctgtctctgaacaataaaataggccagcaagtgattattccgcgctacttgaccctcagcagtcattgtacagagaatacgaaacccccgtttaccctgggctggtctgcacatatggccatatcacgccctttgaaagccagtcaaatggtgaacagttgcattacttccccaagtactccctcaaaaaaatttacattcaaatcaaaaagctctctagctctgtgcctggattctgatagcgaggatgagctgaaacggtcagtagcactctcacagaggctgtgcgagatgctgggaaatgagcagcagcaggaggacctggaaaaggactccaagctttgccccattgaaccagacaagagcgagctcgagaattctggcttcgatcgcatgtcggaagaagagctgctcgccgccgtcctcgagatttcgaaaagagatgcaagcccttcgctgagccacgaagacgacgacaagcctactagttcccctgacactgggtttgccgaggacgacatccaggaaatgccggaaaatcctgatacgatggaaaccgaaaaacctaaaacgatcaccgaactggacccagcctcgttcacagaaatcactaaagattgcgacgagaataaagagaacaagacccctgagggcagccagggcgaagtggactggttacagcaatacgatatggagagagagagagaggagcaggagctccagcaggctctggcacagtctctacaggagcaggaggcttgggaacagaaagaggacgacgacctgaagagagccaccgaactctctttgcaagagtttaacaacagttttgttgacgctctcggcagcgatgaagattccggcaatgaggacgtctttgatatggagtatacagaggcagaagccgaagagctcaagagaaatgcggagacagggaatttaccccacagctatcgcctgatctcagtggtttcgcacatcggcagcacctctagctcaggccactacatctcagatgtctatgacataaagaagcaggcctggtttacctacaacgaccttgaagtgtcaaagatccaggaggctgccgtgcagtcagaccgcgatcgttccggttatatcttcttttacatgcacaaagagatctttgatgagctccttgagacagagaagaactcacagagcctttccactgaggtggggaagacaacccggcaggctttgtag

SEQ ID NO: 21092 - DNA, 2940 bp, Artificial Sequence
  Description of Artificial Sequence: Synthetic coding sequence
atgagccccctgaagatccacggccccatccggatccggagcatgcagacaggaatcacaaaatggaaagaaggttcgttcgaaatcgtggaaaaagagaataaagtctcactagtggtacactataatactggcgggatcccccgcatcttccagttgtcccacaacatcaaaaacgttgtcctgcgccccagcggtgccaaacaaagtcgacttatgctgaccctacaggataattcgttcctttcaattgataaagtgccctccaaggacgccgaggaaatgcgactcttcctggatgcagtgcatcagaacagactgcccgccgccatgaaaccttcacagggctcagggtcctttggtgcgattctgggatcccggacaagtcagaaagagacatctagacagctatcatactcagataaccaggcatccgctaaaaggggttccttggaaacaaaagacgacattcctttccggaaggtgctgggcaaccctggacgagggtccattaagaccgtcgcagggtcagggatagcacgcaccatcccatcgctgacaagcaccagcaccccactgcgttccggcctcttggagaacaggaccgaaaaaaggaaacgtatgatctccaccggatccgagctgaatgaggattatccgaaagagaacgattcttcttcgaataataaggcgatgactgaccccagtcgtaagtatctaacttcctcccgggagaagcagctgtcactgaaacagtccgaagagaataggacctccggcctccttcctcttcagtcctcgagcttctatggaagtcgggctggcagtaaggagcacagctctggaggcacaaacctcgaccgcactaacgtgtcaagccagaccccgagcgctaagcgctcccttggattcctaccccagccggtgccactgagcgttaagaagctgaggtgcaatcaagattataccgggtggaataaacctagggttcccctatctagccatcagcagcaacagctccagggatttagtaaccttggaaacacatgttacatgaacgcgattctccagtctctgttttcactgcagtccttcgcgaacgatctgctgaagcaggggatcccctggaaaaagataccacttaacgcgctcattaggcgctttgcccatcttctggttaagaaggacatctgcaactcagaaacaaagaaagacctgcttaaaaaggtgaaaaatgccatctcagccacagctgaacgcttttctgggtatatgcagaacgacgctcatgagttcctcagccaatgtctggatcaactgaaagaggacatggagaaactgaacaaaacttggaagacagagccagtgtctggcgaagagaatagtcccgatatttccgccacgcgtgcctatacttgccccgtaataacaaatctggagtttgaggttcaacatagcatcatttgtaaggcctgcggagaaatcatacccaagagagaacagttcaatgatctttccattgaccttcctaggcggaagaagcctctgcctccgcggagtatccaggattccctggacctcttctttcgggctgaggaacttgagtacagctgcgagaaatgtggaggaaagtgtgctcttgtgcgacataagttcaaccgactgccccgggtcctgatcctgcacttgaagcggtactctttcaacgttgctctgtccctgaataataagattggccagcaggtgatcatcccacggtaccttaccctgagctctcactgcaccgagaatactaagccaccattcacgcttggctggtctgcccacatggcaatcagcagaccgctgaaggcctcccagatggttaatagctgcatcacaagccccagcactccctcaaagaaattcacattcaaatccaaaagtagcttggccctctgtttggatagtgactctgaggatgaactcaagcgcagcgtggcattgagtcaacggctgtgcgagatgctcggcaatgagcagcagcaggaggatttagaaaaagatagtaagctctgcccaatcgaaccagacaaatcagagctcgagaattccggatttgaccgcatgtcagaggaagaactcttggcggccgtgctcgaaatcagcaagcgagatgcctccccttctctgtcacacgaggacgatgataaacctacttcaagcccagatactggcttcgccgaggacgacatccaggaaatgcctgagaatcccgatactatggagaccgaaaagccaaagacaatcaccgaattagatccagcgtcctttacagaaattacaaaggattgcgatgaaaacaaggaaaataaaacaccagagggatcacagggcgaagtggactggctgcaacaatatgacatggagagagagagggaggagcaagagctacagcaggccctggcccagtctttacaggaacaggaagcctgggaacagaaagaggacgatgacctgaaaagggcgaccgaactcagcttgcaagaatttaacaatagctttgttgacgctctgggaagtgacgaggactccgggaacgaagatgtcttcgatatggagtacaccgaggctgaagcagaagagttaaaaagaaacgcagagaccggaaacctcccccactcttaccggctaatctcagtggtgtcccatatagggtccacgagctcctcaggccactatatctccgacgtctacgatatcaaaaagcaggcatggtttacctataacgatctggaagtcagtaagatccaagaagccgcagtccagtcagatcgtgaccgaagtggatacatcttcttttacatgcacaaggaaattttcgacgaactgttggagaccgaaaagaactctcagagcctgtcaacagaggtcggtaagactaccaggcaggcactgtag

SEQ ID NO: 21093 - DNA, 462 bp, Artificial Sequence
  Description of Artificial Sequence: Synthetic coding sequence
atggccgagctgccccaccggatcatcaaggagacccagcggctgttggccgaaccagtccccggcatcaaagcggaaccagatgaatcaaacgcgcgctactttcacgtagtcattgctggagagtctaaggactccccatttgagggtggcacgtttaagcgagagctgctgcttgctgaagagtatcctatggctgctccaaaggtccggtttatgaccaaaatatatcacccaaatgtggacaaacttgagagaataagcctcgacattctcaaggataagtggtccccagcattgcaaatccggactgtactcctgtccatacaggccctactgaacgccccaaaccccgacgaccccctggcaaacgacgtggtcgaacaatggaaaactaatgaagcccaagccattgagacagcgagagcttggactaggttgtacgcaatgaactctatctag

SEQ ID NO: 21094 - DNA, 1350 bp, Artificial Sequence
  Description of Artificial Sequence: Synthetic coding sequence
atggccgacggcgaggagcccatggccgtggacggcggctgcggcgacaccggcgactgggaagggaggtggaatcacgtgaaaaagtttctggagaggtccgggcccttcacacatcccgatttcgagccctccacggaaagtctgcaattcctgcttgacacttgtaaagtcctggtgatcggggcgggggggctgggctgcgaattactcaagaatttggctctgagcggattccgtcagattcacgttattgacatggacacaattgatgtgtcaaatctcaacagacaattcctatttagacctaaggacatcggccgcccaaaagccgaggttgccgctgagttcctgaatgaccgcgtaccaaattgcaacgtagtgcctcatttcaacaaaatacaggactttaatgacaccttttataggcagttccatatcatcgtgtgcggactagactccattatcgccagacggtggattaatgggatgctaatcagcctgctgaactatgaggatggagttctggacccttcctcgatcgtgccgctgatcgacggaggcaccgaggggttcaagggaaacgccagggttatcctgccgggcatgacggcatgtattgagtgtaccctggagctctatccaccacaggttaacttcccgatgtgtacaatcgcatctatgccacgcctacctgaacactgcatcgagtacgtgcggatgctgcagtggccaaaggagcagccatttggcgagggagttccattggatggcgacgaccccgaacacattcagtggattttccagaaatctttggagagggctagccagtacaacattcgaggtgtcacctatcggctgacccagggtgtggttaagcgaatcatccctgccgtagcttcaaccaatgctgtaatagcagcagtgtgtgcaaccgaggtcttcaagatagcgacaagcgcctacatccctcttaacaattatttagtgttcaacgacgttgacgggttgtatacatataccttcgaggcagagcgtaaagagaattgcccagcctgttctcaactgccacagaacatacagttcagccctagcgccaaactgcaagaagtcctcgactatctcaccaatagtgctagtcttcagatgaaatccccggctatcacagcgaccctggagggaaagaaccggaccctttatcttcagagtgttacatccatcgaagaaaggacccgcccaaatcttagcaagacattgaaagaattgggccttgttgatgggcaggagcttgctgtcgccgacgtcactacaccgcagacagttctgtttaaattgcacttcaccagctag

SEQ ID NO: 21095 - DNA, 1392 bp, Artificial Sequence
  Description of Artificial Sequence: Synthetic coding sequence
atggccgacggcgaggagcccgagaagaagcggcggcggatcgaggaactgctcgcagagaaaatggccgtggatgggggctgcggggatacaggtgattgggaaggtcgatggaatcacgtaaagaagttcctggagcgttccgggccattcacccatcccgatttcgagcctagcactgagagcctgcaatttcttctggacacatgcaaggtcctggtgatcggggcagggggtctcggctgcgagcttttaaaaaacttggccctcagcggatttaggcagattcacgttattgacatggacaccatcgacgttagtaatcttaatagacagttcctgttccgtcctaaggacattggacgacccaaagccgaagttgccgcagagttcctgaacgacagggtgcctaattgtaatgttgttccacactttaataagattcaggacttcaacgataccttctatcgacagttccatataattgtctgcggcttggatagcatcattgcccgccgttggattaatggcatgctgatcagcctgctcaattacgaggatggtgtcctagacccctccagtatcgtgccactcattgatggagggacagaaggattcaagggaaatgccagggtgatactccctggaatgaccgcctgcattgagtgtaccttggaactttatcccccacaggtcaacttcccgatgtgtactattgccagcatgcccaggctgcccgagcattgcatcgagtatgtaaggatgctgcagtggcccaaggagcagcctttcggggaaggcgtaccgctagacggggacgatccagaacacatccagtggattttccagaagagtctcgagcgtgcaagccagtataacatcaggggagtgacctaccggctgacccagggcgtcgtgaagagaattatacccgccgtggcaagcaccaacgctgtgatcgccgctgtttgtgccacagaagtctttaagatcgccacttccgcctacatacctttgaataactacctggtctttaatgacgtggacggcttgtatacttatacattcgaggccgaacgaaaagaaaattgtccggcctgttcacaacttccgcagaatatacagttttctcctagcgcaaaactacaggaggtgttggattacctcacaaattctgccagtcttcagatgaagagccccgcgatcaccgccacattggaaggtaagaaccgtaccctctatttacaatcggtgacaagtattgaggagcgcactcggcccaacctcagtaaaacattaaaggaattaggattagtggacggacaggagctcgcagtcgccgatgttacaacccctcaaactgtactcttcaagctccattttaccagttag

SEQ ID NO: 21096 - DNA, 861 bp, Artificial Sequence
  Description of Artificial Sequence: Synthetic coding sequence
atgctgatcagcctgctgaactacgaggacggcgtgctggacccctcaagcatagtgcctctaatcgacggcggaacggaggggtttaagggcaatgctcgggtgatcctgcctggcatgaccgcctgtatcgaatgtaccctagaactgtacccgccccaagtgaacttccccatgtgcacaatcgcctctatgccccgcctgcccgaacactgcatcgagtacgtgcggatgctgcagtggccaaaagagcagccctttggtgaaggcgtgccgctcgacggggacgacccagaacacatacagtggatattccagaaaagtttggaacgagcctcacagtataatattagaggcgtcacgtatcgattaacccaaggcgtcgtgaaaagaattattccggcagtggcctcaacaaatgccgtcattgccgcagtctgcgcaacggaggtgttcaagatagcgacatctgcgtatatcccactgaataactacctggtctttaacgatgtggacggactctacacctatactttcgaagctgaacgaaaggagaactgccccgcatgctcacagttaccacaaaacatccaattttccccatcagctaaacttcaagaggtcctcgattatctcacaaatagcgcctctttgcagatgaagtcacctgcaattactgctacattggagggtaaaaatcggacactctaccttcagagtgtgacctcaatcgaggagaggacccgaccaaacttgtcaaagactcttaaagaattgggcttagtagacgggcaggaattagccgtcgctgacgttacaaccccccaaaccgtgttatttaagttacactttacaagttag

SEQ ID NO: 21097 - DNA, 2409 bp, Artificial Sequence
  Description of Artificial Sequence: Synthetic coding sequence
atgtggatccaggtgcggaccatcgacggcagcaagacctgcaccatcgaggatgtaagccgcaaagccacgatagaagagctgagggaaagagtttgggcgctattcgatgtgcggcccgaatgccagcgcctgttttaccgaggaaaacagcttgagaacggctatacacttttcgactacgatgtgggtcttaacgacatcatccaattgttggtgcggcctgaccctgatcacttgcccgggaccagcacccagatcgaagcaaaaccctgctccaactcacctcctaaggtgaagaaagcacccagggtgggaccctcaaatcaacccagtaccagcgctcgagcgcggctcatcgacccggggtttgggatatataaggttaatgagctggtggacgcccgggatgtcggcctgggagcatggttcgaggcacacatccacagcgtcacgcgggcatccgatgggcagtcacgaggcaagaccccgctgaagaatgggtcgtcgtgcaaaaggactaacgggaacataaagcacaaaagcaaggaaaatactaataaattggactccgtgccgagtacgtcaaactccgattgtgtggccgctgatgaagatgtgatctaccatattcagtatgacgagtatccggagtcaggaaccctggagatgaatgtgaaagacctccgtcctagagcccggactatcctgaagtggaatgaactgaacgttggagacgtggttatggtcaactacaatgtagagagcccaggacagcggggcttttggttcgatgcagaaattacgactttgaagaccattagccggacaaagaaagagttgagagttaagatctttctcggcgggagcgaggggactctgaacgactgtaagattatttctgttgatgagattttcaagatcgaacgaccaggggcccatcccctgagcttcgctgatgggaagttcctgagaaggaatgaccccgaatgtgacctgtgcgggggggacccggagaaaaaatgccattcctgcagctgcagagtgtgcggcggcaaacatgagcccaatatgcaactgctttgtgatgagtgtaatgttgcttatcatatctactgcctgaaccctcccttggacaaggtgccagaggaggagtattggtattgtccctcctgtaagaccgattcctccgaggtcgtgaaggctggggaaaggctgaagatgtctaagaaaaaggccaaaatgcccagtgcctcaaccgagtccagaagagattggggaagaggtatggcatgcgtggggaggacgagagagtgtaccattgtgccaagcaatcattatggtcccattcccgggatcccagtgggatccacatggaggttccgggtgcaggtctccgaagccggtgttcaccgaccccatgttgggggcatccacggcaggtctaacgacggtgcctacagtttggtcctagctggtggcttcgccgatgaggtggataggggcgacgagttcacgtacacgggaagtggcggcaaaaaccttgcaggaaacaagaggattggcgcgccttccgccgaccaaacactgaccaatatgaaccgagcactagctcttaactgtgacgcccccctggatgataaaataggagctgagtcccgaaactggagggcaggcaagcctgtgagggtcatcagatccttcaaaggaagaaagatcagcaaatacgcccctgaggagggtaatcgctacgacggaatatacaaggtcgtgaagtactggcctgagattagcagctcacacggctttctggtgtggaggtacctgctgagacgggacgatgttgagccagctccctggacatcagagggaatcgaacgctctcgaaggctgtgcctcagactgcagtaccctgctggatatccatcagataaggaagggaaaaaaccgaaaggacagtcgaaaaaacagccctccggtacaacaaaaaggcccattagcgacgatgattgcccttccgcgtcaaaagtgtacaaagcaagcgacagcgcagaggcgatcgaggcattccagctcaccccgcaacaacagcatctcatccgcgaggattgccagaaccagaaactttgggatgaggtactaagccacctcgtggagggacctaacttcctcaagaagctagaacagtctttcatgtgtgtttgttgccaggagctggtgtatcagccagtgacgacggagtgctttcacaatgtgtgcaaagactgtctacagaggtcattcaaagcccaagttttctcctgccctgcgtgccgccacgatttaggccagaattacataatgatcccaaatgagatactgcaaactttactggatctcttctttcccggatattcgaaaggacgctag

SEQ ID NO: 21098 - DNA, 411 bp, Artificial Sequence
  Description of Artificial Sequence: Synthetic coding sequence
atgtggatccaggtgcggaccatcgacggcagcaagacctgcaccattgaagatgtttcacggaaagccactatcgaagaattgagggagcgtgtatgggccctgtttgatgtgaggccagaatgtcagcgtctgttctacagagggaagcagttggaaaatggatataccttgtttgattacgacgtcggtctgaacgatatcatccagttgctcgtgcgccctgaccctgaccaccttccagggacctctacgcaaattgaggccaagccctgctctaattcccccccaaaggtcaagaaagcaccccgggtgggtccaagcaatcagccgtctactagtgcaagagctcgcctcatcgatccgggattcggaatatataaaggcttggcactgtcaccccgcctctag

SEQ ID NO: 21099 - DNA, 339 bp, Artificial Sequence
  Description of Artificial Sequence: Synthetic coding sequence
atgaacgtgaaggacctgcggccccgggcccggaccatcctgaagtggaatgagcttaatgtgggcgacgtggtgatggtcaattacaacgttgagagccccgggcaacgggggttttggtttgacgcggagatcaccacactgaagacaataagccgtacaaaaaaagaattgcgggtcaaaatctttctcggtggaagtgaagggacgctaaatgattgtaaaatcatctctgtggatgagatcttcaagattgaaaggcctggtgcccacccactgagtttcgcggacggaaaattccttcgccggaacgatcccgagtgtgacctttgtggctag

SEQ ID NO: 21100 - DNA, 897 bp, Artificial Sequence
  Description of Artificial Sequence: Synthetic coding sequence
atgggccccaaggacagcgccaagtgcctgcaccggggcccccagccatcacactgggctgccggtgacggccctactcaagaacggtgtgggcctaggagcttgggttctcccgtgctgggactcgacacatgccgtgcctgggaccatgtggatgggcagattctgggtcagctgcgccccctgaccgaggaggaggaggaggaaggcgccggcgctactttgtctcggggccccgcctttcccggcatgggatctgaggagctacggctggcaagcttttacgattggccactcactgctgaggtccctcccgaactccttgctgctgctggctttttccacactggccatcaagacaaggtgcgatgtttcttctgttacgggggccttcaatcttggaaaagaggggatgacccctggacggaacatgctaaatggttccccagctgccagtttttgctgagaagcaagggaagggatttcgtccactctgtccaagagacccattctcaactgctgggctcttgggacccctgggaggagcccgaggatgctgcgccagtggcacccagtgtcccagcgtcaggctaccctgagctaccgaccccaaggcgggaggttcagtccgaaagtgcccaggaacccgggggtgtatccccagccgaggcgcagcgggcttggtgggtgctggagccccctggtgctagagacgttgaggctcaactgcgtagactgcaagaagagagaacatgcaaggtgtgcctggatagagcagtctccattgtcttcgtgccttgtgggcaccttgtttgtgctgagtgcgctcctgggttacagctctgcccaatctgccgggccccggtgcggtccagagtcagaacatttttgagctag

SEQ ID NO: 21101 - DNA, 1464 bp, Artificial Sequence
  Description of Artificial Sequence: Synthetic coding sequence
atggtgatcaacctgtgcctgccccagttccggccccggatccactgcaacaaaatttccgctgacgggtatgaggtcgagaatctcatctctgaagatctcactaagagaagtcatgggttccggaccgaatactttatcaagccccccgtgtacgtcacggtgtcattccctttcaatgtcgagatctgcaggatcaatatagacctgaccgccgggggaggccagaatgtgacaggcctcgaaatgtacacgtctgccagcagttccagagtctcatggaacacccctcagtgcagaacactgggcccagccgagccttccgttcctgataaagaagctttcacactggtcgggaaggtactgctcaagaatcaaagccaagtcgtattctcacaccgcgggttcaaggcaagacccccattcggggccatggaggccacgctgccttcccccgccgtggtggcccaggagctctggaacaagggtgcgctgagcctgtcacacgtcgctcacctgaggatctgcatcacccatgtcactggcggaggcataccctgcatcaaacgattagaggtctggggacagcctgctaagacctgcagccaagaagtcatcgactccatactgttggtcacgagcgagaacctcccccaggatgtagccttacaagcaccagctcttccaatggagtctgactgcgaccctggtgaccagcccgaatctcagcaggctcctagctctctccagaagttagctgagatcattcaagacgtccccgaggagttcttagacccaattaccctggagatcatgccttgtccaatgctcctgccaagcggtaaagtaatcgatcagtctaccctggagaagtgtaatcgaagcgaggctacgtggggacgtgtgccaagtgaccccttcacaggagtggcattcaccccgcatagccagcccctccctcatcccagcctgaaagcccgaattgaccattttctcctgcagcacagcattcctggctgccacttgctggggagagcccagacagcgctagccgtgattcctagctccatcgtgcttccttcacagaagcgaaagattgagcaggcagaacacgttcccgacagtaatttcggagtgaacgcttcatgcttctccgccacttctcctttggtgctgcctacaacctccgagcacacagcgaagaagatgaaagccacaaatgagccttccctgactcatatggactgctccacagagcagcctgggtctatattaggcccagagtgtgcttcttgtaaaagagttttttctccctacttcaaaaaggaaccggtgtaccagctgccctgcggtcatctgctctgcagaccctgcctcggagaaaagcaaaggagtttgccaatgacttgtacagcatgtcagagaccagttgcttctcaggacgtcttacgcgtgcacttctag

SEQ ID NO: 21102 - DNA, 267 bp, Artificial Sequence
  Description of Artificial Sequence: Synthetic coding sequence
atggtgatcaacctgtgcctgccccagttccggccccggatccactgtaacaaaatctcggccgatggctacgaggtggagaatctgatctcagaagacttgacaaaaagatctcacggattccgcactgagtacttcataaagcctccggtctacgtgaccgtgtcattccctttcaacgtagaaatatgccggattaacattgacctgaccgcaggagggggccaaaacgttactggcctcgaaatgtacacctctgcgtcatag

SEQ ID NO: 21103 - DNA, 1605 bp, Artificial Sequence
  Description of Artificial Sequence: Synthetic coding sequence
atggcccggggcctgcaggtgcccctgccccggctggccaccggccttttgctgctcttgagtgtgcagccatgggcagagtctggcaaagttcttgtggttcccaccgacggatcaccctggctcagcatgagggaggcccttagggagctgcacgccaggggccatcaggccgtggtcctgacgcccgaggtcaatatgcatatcaaagaggaaaagtttttcaccttgacggcctacgcagtgccgtggactcaaaaagagtttgatagggtgacattgggttatacacagggattttttgagacggagcatttgctcaaacgatacagccggagtatggctattatgaataacgtatcgcttgcacttcatcggtgctgtgttgaacttttacataacgaagcattaatccgccaccttaatgccacctcattcgacgtggtgctgacagaccctgtgaacctttgtggggctgtgttagctaaatatctgtcgattcccgccgtctttttctggcgctatattccctgtgacctcgattttaagggcacccaatgtccaaacccctcaagctatataccgaaactcttaaccacaaactcagaccacatgacatttctgcagcgcgtaaagaacatgctgtacccactggctttgtcatatatatgccacacctttagtgcgccttatgcttcccttgcttcagagctgtttcagcgcgaggttagtgtggtggacttagtgtcctatgctagtgtgtggctgtttagaggcgactttgtaatggactatcccaggcctatcatgccgaacatggtgtttatcggcggaattaattgcgctaatgggaagccactgagccaggagttcgaggcatacattaacgccagtggcgagcacggtatcgtcgttttctctctcggatccatggtgtcagaaatccctgaaaagaaggctatggctatcgcagacgcattaggtaagataccccagacagtcctgtggagatatactggtaccaggcctagcaatctcgccaacaacactatccttgtcaaatggctgcctcagaatgacctgttgggccacccgatgactcgagcctttattacccacgctggtagtcacggggtttacgagagtatttgcaacggcgtgcccatggtgatgatgcctttatttggcgaccaaatggacaacgccaagcgtatggagaccaaaggcgctggcgtgactctcaatgtcctggagatgacttccgaagacctcgaaaatgcgctcaaagcggtgatcaacgataaatcctataaggagaatatcatgagactgtcttcacttcacaaagatcggccagtggagcctttggacctggctgtcttctgggtggagtttgtcatgcgtcacaagggagctcctcacctgagaccagctgcgcatgatctgacttggtaccagtaccacagcctggacgttatcggattcttgttggctgtagtattgactgtagctttcatcacctttaagtgttgtgcctacggatatagaaaatgtttaggaaagaagggcagagtgaagaaagcccataaatccaagacacactag

SEQ ID NO: 21104 - DNA, 1596 bp, Artificial Sequence
  Description of Artificial Sequence: Synthetic coding sequence
atgatggacggccggctgctggagcacccccacgcccagttcggcgggtccctaggtggcgtagtcggatttccatatccactcggacatcatcatgtgtacgagctggccggccatcagctccagagcgcagcggcggccgccagtgtcccattctcaatcgatggtctgctgggcgggagctgtgccgctgccgcatcagttgtcaatcctacaccactgcttcccgccgcttgcggcgtgggaggtgatggccaacctttcaaactctctgacagtggtgaccccgataaggagtcacctggatgtaagagaaggcgtacccgcacaaacttcactggctggcagctagaggagctggagaaagcctttaacgagagccattaccctgacgtgttcatgagagaagcactggcattgcgcctggaccttgtcgaatcgcgtgtgcaagtctggttccagaacaggcgcgctaagtggcgcaagaaggagaacaccaaaaaaggacccgggcggccagcccataacagccaccctactacgtgttctggcgagccgatggaccccgaggaaatcgcccggaaggagctggaaaaaatggagaagaagaaaagaaaacatgagaagaagcttctcaaatcccagggcagacacctccatagcccaggcggactgagtttgcactccgcaccttcctctgacagcgactcagggggcgggggcctttcccccgaacctcctgagccacccccccccgctgctaagggtcctggtgcacatgcctcaggcgctgccggcacagcccctgctccccctggtgagccgccagcccctggcacctgtgaccccgctttttacccttcccaacggagcggcgcgggacctcagcccaggccaggtcgtccagccgataaagacgctgctagttgtggtcccggcgcggcggtggctgccgttgaaaggggcgctgcaggcttgccaaaggccagcccattcagcgtggagagtttattgtcagattcgccaccaagacgcaaagctgctagcaacgccgccgcagcagccgcggctggtctggacttcgcacctgggctaccttgcgctcctcgcacactgatcggaaagggccactttctcttgtatcccattacgcagcccctcggctttctcgttccgcaagccgctcttaagggaggcgccgggttagaaccagctcccaaagacgctcccccagccccagccgttccacccgccccaccggctcaggcctcattcggcgcattcagcgggcctgggggggccccggatagtgcctttgctagacgaagccccgatgcggtcgcatctcccggggccccagctcctgccccagcccccttcagggatctggcatctgccgccgcaaccgaaggcggcggcggtgattgtgctgatgctgggactgccggaccagccccaccgcccccggctccctctcctagaccaggtccccggcctccgagcccagcagaggagcccgccacatgtggcgtgccagaacccggtgccgcagccgggccctccccacctgagggcgaagaactggatatggattag

SEQ ID NO: 21105 - DNA, 255 bp, Artificial Sequence
  Description of Artificial Sequence: Synthetic coding sequence
atggccctgagcagccagatctgggccgcctgcctgctgctgctgctgctgctcgccagcctgacatcaggctcagtgtttccacaacagacgggtcagctggccgaacttcagccgcaggaccgggccggcgccagggccagctggatgcccatgttccagcgtcgcaggagaagggacacacactttcccatttgcatcttctgctgcggttgttgccataggtccaaatgcggaatgtgctgtaaaacttag

SEQ ID NO: 21106 - DNA, 840 bp, Artificial Sequence
  Description of Artificial Sequence: Synthetic coding sequence
atggacatgctggaccccggcctggaccccgccgccagcgccaccgctgctgccgcggcctctcatgacaaaggacctgaggctgaagagggggtagaactgcaggaaggaggagacgggcccggcgccgaggaacagacagccgtggcgatcacatctgttcagcaggctgctttcggcgaccacaatatacagtatcagttcaggactgaaactaatggaggtcaagcggtcattcaaaaccccttctctaatggtggctcaccagccgccgaagccgttagcggcgaggccagatttgcttatttccctgcaagttccgttggagatactaccgccgtgagcgtacaaactaccgatcagtctctccaggccggagggcagttctatgtcatgatgacaccacaggacgtgttgcagacaggcacccagaggaccatagcccccagaacccatccatattctcccaagattgacggtacccgcactcctagggatgagagacgccgagctcaacacaacgaagtcgagaggcggcggagggataagattaacaactggatagtgcagctgtctaagattataccagattgcaatgcagacaactccaaaacaggcgctagcaagggtgggatcttgagcaaagcttgtgactatataagagagttgcgacaaaccaaccaacggatgcaagagacatttaaggaagccgagcggctgcagatggacaatgagttgttgaggcagcagattgaagaacttaagaacgagaatgctttactgagagcccaactgcaacagcataaccttgaaatggtgggcgaggggaccagacaatag

SEQ ID NO: 21107 - DNA, 648 bp, Artificial Sequence
  Description of Artificial Sequence: Synthetic coding sequence
atggacatgctggaccccggcctggaccccgccgccagcgccaccgccgctgcggccgcctcccacgacaaggggcctgaggctgaggagggggtggaattacaggaaggaggtgacgggccaggtgctgaagaacagaccgccgtggctatcacaagtgtgcagcaagcggccttcggcgaccacaacatccagtaccaattccgcaccgagaccaacggtgggcagacagggactcaaaggaccattgccccgcgaacccatccttacagtcccaaaatagatgggacccggacacctagggacgagagacgaagggctcagcacaacgaagtggagaggagacgaagagacaaaattaacaactggattgtgcagctgtctaagatcatccccgactgcaatgctgacaattctaagactggtgcaagtaagggagggattctaagcaaggcttgcgattacatccgcgaactcaggcagaccaatcagaggatgcaggagacattcaaagaagctgagaggctgcagatggacaacgagctcctacggcaacagattgaggaactgaagaacgagaatgctctgctgcgggctcagttgcagcagcacaacttggagatggttggggagggaacgcgacaatag

SEQ ID NO: 21108 - DNA, 6816 bp, Artificial Sequence
  Description of Artificial Sequence: Synthetic coding sequence
atgggcgtgcccaagcggaaggccagcggcggccaggacggcgccgccagttctgctggcgcagcgaaacgcgcccgtaaagaggagctgactggagtgcggtttaaggcccaactgaaggatcctcagggaccaggcccaggactggaagcgttcgtcagtgccgcaaagaagctgccccgagaagatgtgtacgatgtcgtagagggctacatcaaaattagtgtggagtgcgtggaaatttttcagcttctaagcggagaaaagcggcctgagtcggagaccatgctgatctttcaggtgtttgaggccatacttttgagaactgcgtcggacctgtctcattttcacgtggtgggtacaaatatcgtaaaaaagctgatgaataatcatatgaagctcatttgcgagtcgctctatgcctctggctacagactagcccgcgcctgcctttcactcatgaccgcaatggtgactcaaggacctgaggccgctagagatgtgtgttctcactttgacctgaacaagaagaccctgtatactcttgtgaccaagagagactctaaaggagtctacgatgtcaggcaggcctacgtccagttcgccctcagtttcctgatcgccggggatgacagcactatcgtgcaggtcctggaagtcaaggagtttatcccatgcatatttagctccggcatcaaagaagaccggatatccacaattaatatcctgctgtctactctgaagacgaaggtggtgcataacaaaaatattacaaaaacgcagaaagttcggttcttcacaggtcagctgctgaatcacattgcgtccctgtacaattggaatgggataaccgatgtgaacccggagaatgtcaaggtgtctgcagaggaggcaggcaagacgatggttcgggagcttgtgcataattttctcatggacctttgctgttccctgaaacacggtattaatttttacgacgctagcctgggcacattcggccggggagggaatttgaccctgttgcatttcctgctgggattgaaaaccgctgcagacgacgacctagtcgctgatttggtagttaacattttgaaggtttgccccgatttgctcaataagtattttaaggaggtcacattctcatttattccacgggccaagagcacatggctaaacaatatcaaactgctgaacaaaatctacgaagcacagcccgagatatctagagcatttcagactcgcgagtttatccccttgcctcggttgttggccatggtcatggttactaccgttcctctggtctgtaataaatcaatgttcacacaggcgctcaatttggattccacatcagtgagacacactgccctgtccctgattagcgtgattctgaagagagcccttaaaactgtggatcactgcctgaataaggaggtatggcaggaaagcggtgtgtacacagcagttatgatggaggagttcgttcagctgtttcgtgaagccctgagcaaaattttacctgatctgaatacagtcgtctgggtctggcagtcactgaagaagcaggagacaaaacaggacgacaagaaaggacagaaacggtccgatggaccccctgcggcgtgtgacgcccaccaatgtgacgatgccgagacgattctgctgaaagctgtcttgctgcaggtcatatgcctgtaccaaaaggtggtgccccacgtggtcatgcaatacaacttcgatttcagcaaactgctgaagggggtgatttcagaacaaggactccgcgaggaagtgccacccattctgcagcaccacatgctgaaagtggctttggagctccccgcgagcaaattcctgtggctgaaggcgcaagaaggtcccgacgccgagataattggaggcgagcgcagcgtcttttatctgctgatgaagatgtttgtgacgtccagtcatctgcagctgaagtccttgaccaaactgttaataatgaaaatactgagggatacgggcgtcttcgaacacacatggaaagaattggagctgtggctagaacacttagaaaacaccatggaagaagacaaagaaaccgtgattcagttcctggaaagaatattgctaactctggtagccaacccatacagttacactgacaaggcctctgacttcgtgcaggaggcgtccatgttgcaggccaccatgaccaaacaggaggctgatgacatgtcgattcccatcagtcatattgatgacgtgcttgacatggtggacgtcttggtagagggaagcgagggtcttgacgaagagatcggctttacgctgtccgaagatatgatcctcctcacattccccttttccgcggtggtgccagcagccctagaggctcgcaacaaactgctcctgggaacaggcaacgaggcggcagaaaacgtagttacctatctgacggccgttcttacagatctcttacacacacagagggacccacttgccctctgtttgcttctgcaggcatatgataaactagagcctccttgcctggttccctgctgtcagcaattgagccgcttcaacaggtactactctctctggattccagaacaggcccgagaagcgtggctcctccaggcacagggttcccccagccctcccgccctcccactcgcgtccagctttactgccctgcttcaagccgcgtacgagtctcaggcactcagagatgagcacattcaggtgcaactgcaggccaccatgcctcacctatcaatgcagcaggttctgcttgccgccaaacaggtcctgctgtatctgcggagcaccgtagaaaacttcggtcagctcggacggagcgtcggtccaccgctgctgcagctgtttttggatctccttcgtcgtttagtggtgcactgtgagcaactcgacgcgcaaaatcagcaacgttgcgaggctgcccgggccgaagccgacctgtttctcgacatggagtccgtggcgtctcttgaattggctaatgaccagaccctggaagaggtgctcgtggcaattctgcgccatcccacattagaagggtggtttctggcactcgagcaacaggcactcccaccccacacccttagtccagtgttggtgaaattgctggcaactcatttttccgctggggtgctgcaattgttggcagccagcgcacctatcctccaaaacatagggcagctgggtcttctcgcacgttatagcgaggcaatcacccagagtgttttgaaagaactgcaaaacagacgggccggtccagcaacatctccgccaaagactccaccccagctcgaagctctgcaggagttgcacccatacatggaaggcgcacagctgagagaggtgactttggctctcctgtcactgccagagactcacctcgtcacccagcagccaacgaaaagtccagggaaggagcgtcacttgaatgccctcggcaagacgcttgttcagctgcttacctgctcaccccaagatcaactgcaatcaggggagctcctctggagctccgaatacgtgcgcggcctcggagccctgctgccaaccctggctgtggacgaactggatactgtgctgcttcacacactgcagagagatccagtgctggcacccgccgtgggagccgacctgctggactattgtctcgctagacggacccaggccgctcttagcatcgcagctcttttacttcaagaatcatgcacacacctcctctggttcgagcagtggtgtctgcaagcaggcccgggtctggggctgcagggggatttagatgatttcctacctctgatccacgtgtacctgcagtgtcggacccgctctcattttaccaggcctgccggagtgagttcagccgttatccccgtgttgcgaaaaactctgtggagacaactgcagtcaaggctcctctctacagatagcccccctgcaagcgggctgtaccaggagatacttgcacagctggtgccatttgccagagcgaaagacctgagcgtgttgatggaccgactcccttcgttgttgcacacaccgagtagccacaaacgctggattgtggcagacagtatctcggccgccctggagggctccgctgaggaactgtgcgcatggcggcggacgttgctcgagtcttgtgtgaagtggctcattgtcagcttttctggagggcagcaagatgatgataatacacagaaccaagagaaggaaatgctgctgagacttaatgcccttctccatgccctgaacgaggtggatcccggcgattggcagaagtttgtcaaaaagggactcaaatttcggtatcaggatcacacttttttaaagatgctccttaccgcagtgcagctcctgtatagcccagagagtagcgtgcgcactaaactcattcagttacctgtggtatatgttatgctgatgcagcattccctttttttgccgaccctcctcacctctgatggagaggaatcacctgacagtcaggtgaaagaagccctggtagaccttatgttaacagttgtcgagatgtgtccatccgtctgcgagtcctctcactttgcggtgctgctaggcgcctatggggccaccctctcagtccttgaccaaaaaatccttttgctgctaagagcttacgagcagaataaactcagcctgattaactttagagttttactgtggggacctgcagccgtagagcatcacaagacatgccggagtctgggccgctctctgtggcagcagccaagcgtcggagacatcctgaggctgttggacagagatagaatgatgcagaccatactacatttcccacagaacagaaggctgctcccacctgaggatacccaggaactaatctttaaggacaagagtcgcgtggacttagacggactctacgacccatgttttctactgcagctgttctccgaactgacaaggcctgaatttgtggtggactgtagaaagttcctggactctaacgccctaggtctgaccgtaaccgctctgagcagctacgacccccaaatgagagctatcgcctatcacgtgctcgctgcttactatagccacctagagggcgcacggtttcaagaacaatcccagcttctgtacctgctggacgtggtcagaaacgggatacgaacgcaggatatgcggttgacctttaccctggccctctttatcgctaaagcagccctacagatccttaaacccgaggagcatatgtacctcaaggtgtccaacttccttctgagtcatgaatacttaaacatggataaagtgccgggattttaccagtttttctactcaagtgattttgaacagaagacggaacaaaagtgggtgttcggtgtgctgcggcaaggtattagggataaacaatgctacgagctctgtgctaggcgtgggattttccacattatcctgtcctttttccatagtcccctttgtgacgaggcagcgcagaattggatcctggaaattttacagaacgcggcgcaggttgcacgcagcgcctatgagattatcagagattatagtctgctgacgtggatactgcatatcctcgagtctaaatttctcgagacaccactgctttcaaacgtgatcagcctactccataccctgtgggtcaccaacctcggagacaaagctgtcgaatgggagagtcagcgtttatgccagccaagttcccaagaacctgctaagagactggctctgcacctggtgaacgaattcctgtatgtgctaatcgtgttaatgaaacacctgaggcccacactcgccccggtacagttgacgaatttcttcggaacactcgatagtgtcttgcggtatcgcgcaactgtgatccaggccttccgtgatatgaatagatttactgtaaacgagactgtgttatcgaccaaagacgtcctggtccttcttcacaaatggtccctgatcgaacgggatcttaaattacaggaggacttaagggccgctatagagaaagcccaggccagggagctcatgaagatgctgaaagacaagaataaacccgtgatgccggctagggccaagggtcccagaggccgcaaaagaagacctggagaagccgaagagatggctgatccagaactcatggcaagcactctcgaaacctgtaaaggactgttgcgttctatcttaacatactggcgtcctgtgatcccagggccggaccctacacaagaaccggtcgactccgcatctccagagagtgacgcccctggtcctgtctacgcagccgcctcgctcgcggtatcatgggtactcaggtcagtcgccgagcatccactgagccgcgccgaggccgctgggctcatcgggtggctgaaatcacatatcttgccgcacccggtggtggtggcagatttacttaaagatagtgctgtaagatctagtatttttagactctactcacggctgtgcggagcagaaggccttgccggccctgtccaggaggtcgcttgcctgttcaatactgttatgctgcaacttgtcgccgctcaagggagagccgggtccccattccatccggccatggaggcactgagtttgtccagcctgtccgaaaaagatgaggcaacacaggcatctgctgccttcttggtgtcgctgtacataaaagacatctggctgggtgcgcaacgccctgatacactgctgacacatgtccgcatggtgtgtgaggctgctgacgacgcaccatccagcgaggaggaagccattgtagttctttgtaaagacgcagctagcgcagccagtgatgcctag

SEQ ID NO: 21109 - DNA, 4575 bp, Artificial Sequence
  Description of Artificial Sequence: Synthetic coding sequence
atggccgccgtgtacagcggcatcagcctgaagctgaagagcaagacaacatcttgggaggataagctgaagctcgctcatttcgcttggattagccatcagtgctttttgcctaacaaggaacaggtgctgctggactgggcccgacagtctctcgttgctttctacaaaaagaaattggaactcaaagaggacatcgttgagaggttatggatttacatcgacaatatattgcactcccggaagctccagaacctgcttaagaacggcaagacgattaacttgcaaatctctctggtaaagattataaacgaacgtgtcgccgagttctctctgtctggctcccagagaaatatttgcgcagtcctgagatgttgtcaaggtatcctgtctacgccagcccttgctgtgatctataccgccaaacaggagcttatggtagctctgcttagccagctgtgctggagcgcttgcagacaacctgaaggagctgtggtggctcagctgttcgaagtcattcaccttgccctgggtcattacctccttattctccagcagcaagtaaacccccgaagggcgtttggcgatgtgacagcacatctgttgcagccctgtttggtgctgcggcacctgttatctggtggaacgtggactcaggccggccagggacagttgaggcaagtacttagtcgggatattaggagtcagatcgaggctatgttcaggggcggtatcttccaacctgaactcctgtcatcttataaggaaggcttactggaccaacagcagggggatgtaaaaactggagccatgaagaatctattggctccaatggacaccgtcctaaacaggctcgtggacgctggatactgtgcagcatccctccacacgagcgtcgtggccaacagtgtcgccctgttgtacaagttgtttcttgatagctacttcaaggagggcaatcagctgctgtgcttccaagttcttcctcgacttttcgggtgtctcaagatctcccatctgcaggaagaacaaagtaaagcactgtccactagcgattggacaaccgaattgctggtcgtggaacagctgctgaattccgtcgcaaacaacaacatttataatattgccgccgataggatacgccacgaggaagcacagttcagattctaccgacacgtggcagaactgctgattaatcacgctcaagcaccgatccccgcatggttcagatgcctgaaaacactgatcagccttaaccacttgatcctggagcccgacctggatgatttactggcctccgcttggattgatgctgaggtgaccgagttccgtaccaaaaaggcccaggaggctttgatccggaccgtgttccaaacatatgccaaactgcgccaggtgccgcggctgttcgaggaagtattgggagtgatttgtcgcccggctgccgaagccctgcgacagcctgtcctggcttctggtccctctaccgtcctgtctgcctgcctactcgagctgccgccctcgcagattctggacacttggtcactggttctcgaaaagttccagagtcttgtgttaccctatttacagtcagatgccgacatggctcttaagagtttgagcttgagcctgctgctgcactgtattatgttcaatatgaggagcctggattcctcaacaccgctaccaattgtgaggaggactcagtgtatgatggaaaggatgatgcgcgagcttgtgcagcccctcttggccctcttgccggacacccccgggcccgagcccgaattgtggctgcagaaggtttctgactcagttctcctcctgtcctacacttgggcccaggtcgacgccatgttttcacttaactgtagtcagtaccatagtatgagtggccccctcatcggtgtcgccctcgagatatcaaatctcccgagcctcctgccgggtgtcaagacccagcattggaagaaaattgaaaagttcaccgcccagttctcctcactgggcacatactgtctggaacagctctatctccagaagatgaaaagaacactgatgcaaaccagcttccgtagcgaaggtgctattcaatccttgcgttgcgatgctgcatttatcattggcagcggcagaaaatctcttaatcagcgtacaaccgcatcttgggacggccaggtgggaatggtaagcggactaacatatcccgtggcacattggcatctgatcgtgagcaacctgacaatcttaatcagttacctgtgccccgatgatgtgggttatctcgcctcagtcttgctccggaccctgcccatggggaaggcccaagaagtctcaatagacgaagaagcatatattaccctggagaaaatctcaaaggccttcttgcacagccctttgtttcctgaaatgcagagtctgcatagtgccttccttacgtgcgtaactacaagttgttctagcatcctttgctcgggcgcgcaaagagattcaggtctggtttcacagcaactcccatggctctttgagaaggaccacatggtggtaggacactgggaaaacagattcgccaaagccggacctgaaggaattgaaccccgcggagagattgctcagaacctcttgtctctcgtgaaatccgacttccctatccagctcgagggcgaacagttggaatcgatcctcggcctgctcgaggtaatctctgctctgcagctggactcattgcttccaccctaccacgtgcactatttcctggtcttattatccatggcggtgaccaagctcggctgtagttgtagctccagtttagctttgaagttcctaactacctgctatcaactcctgggatacctgcaaaaaggcaaaagtgccagaagtgtgttcaaaataatgtacggcagcgacattttcgaggtcgtgctgacttccctgttccgcgctagctctcgctttcttatcgaaatggacgaccccgcttggcttgagtttttgcaggtcatcggcaccttcctcgaagagcttatgcagatgctgatccagatgaagctgtccttggtcctcaacttccggaagattactgcgtttctcagttcctctaagccctacacggaggccgccagctcaaagcagctggagaaccagaatcctcaaggtaggcagctcctcttggtgagtctgaccaggctgtgtcacgttcttggacctttcttaaaagagcagaaactcggccaggaagccccggcagccttgagcgagctgctgcagcaagttgtacttcagacaggggctgtgttgcagctctgcagcgtccctggcgcacggggttggcggttgccctctgtcttgatatcttctgtttccaccctcctggaggcagatctgggtcagcactgtcgggatggtggagccgacattagccaaggaagtgaccgtaccctcctgtctcacgttgcactgtaccagggggtttactctcaaatcctgctggagctgcccgcactggccggacatgaccagagttttcaggcagccttgcaatttttgacacttttctttttagcgcccgagttgcatcctaagaaggactctgttttcacatctatgttccatagtgtgcgccgggtgctggcagacccagagattcccgtgcaggtgacacaggacattgagccacatctcggtgcactgtttacacagatgctcgaggtgggcactactgaggacttgagacttgtaatgcaatgtatactacagggtctggacgtgagtaatatgtggaaagcggacgtccaagcagtggtgtcagcagttacgttgctccggctgctgctgaattgtcccctgtcaggagagaaagcttcgctgctgtggcgggcctgccctcagattgtgaccgcactgactctcctaaatagggaggcaagtcaggaacaacctgtcagtctcacagttgttggacctgtgctggatgtgctggccgccctgcttcgccagggggaagaggccataggcaacccccaccacgtctccctggctttctccatcttactcaccgtgccacttgatcatctaaaaccacttgagtatggcagtgtgttcccccgactacacaacgtcctcttctcaattctccagtgtcacccaaaagtgatgcttaaggccattccgagcttcctgaactcattcaatagacttgttttctccgtaatgcgtgagggtcgtcagaaggataagggctccatcgatgaccttcccaccgttttgaagtgtgcccgcctcgtggaacggatgtattcacatattgcggcccgagctgaagaattcgcggtctttagccctttcatggtcgcacagtacgtgctggaggtgcagaaggtgactctgtatcctgcggtaaaatccttactccaggagggaatatatttaatactggacctatgtattgagcccgacgttcagttcctccgggcttctttacagccgggcatgcgggatatctttaaggaattatataacgactacctgaaataccacaaggcgaagcacgaaggcgagaagcgctacaccgcctag

SEQ ID NO: 21110 - DNA, 255 bp, Artificial Sequence
  Description of Artificial Sequence: Synthetic coding sequence
atgctgaaggccatccccagcttcctgaacagcttcaaccggctggtgtttagtgtcatgcgtgagggcagacagaaagacaaaggatccatcgatgacctgcccactgtgctcaagtgtgctcggctggtggaacgcatgtacagtcatattgctgctcgcgccgaagagtttgcagtcttcagcccatttatggtcgctcagtacgtactggaagttcagaaagtcactctgtatccagcagttaagagttag

SEQ ID NO: 21111 - DNA, 1812 bp, Artificial Sequence
  Description of Artificial Sequence: Synthetic coding sequence
atgaagggcgacttccggaagaagaagagcgaggcccggacccccctggaacaggaaatttttaacttgctgcataaaaacaaacagcctgtgaccgaccctttactcacccccgttgagaaagcgagcctgcgcgccatgtcgcttgaagaagcaaagatgcgcagagcggaactccaacgtgctagagcattacagagttattacgaggcgaaagctcgccgagagaagaagatcaaaagcaagaaatatcacaaagtggtgaaaaagggcaaggcaaaaaaggcattaaaggagttcgaacaactacgaaaagtgaatcctgcggccgcgctagaagaattggagaagattgagaaagccagaatgatggaacgcatgagtctgaaacatcagaacagcgggaagtgggccaaatcaaaggccattatggccaaatacgacctggaggcaagacaagcaatgcaggagcagttgagcaaaaataaagagctgactcagaagctgcaggtcgcaagcgaatccgaagaggaagaaggcgggacagaggacgtggaggagctgttggtgccagatgtagtcaatgaggtacagatgaacgctgatggcccaaacccgtggatgcttcggtcctgcacgtccgacacaaaagaggccgccacacaggaagaccccgagcaattgcctgaattggaagcacatggagtgtctgaatccgagggagaggagcgccccgtagccgaggaagagatcctcttgagggaatttgaggagagacgtagcctgagaaagcgcagtgagttgagtcaagacgctgaaccggccggctctcaagaaaccaaagatagtggcagccaggaggtgctctccgagctgcgtgtgctttcccagaagctcaaggagaaccaccaatcccgaaagcagaaggcttcatccgagggtactatccctcaggtccagcgggaagagcccgccccggaggaagaagagccacttctgctgcaaagacccgaaagggtgcagactctcgaggaactggaggagctgggaaaggaagagtgtttccagaacaaggagctgccacggcctgttttggaagggcagcagtcagagcggacccccaataaccggcctgatgcacctaaagagaaaaaaaagaaagagcagatgatagatctgcaaaacctgcttaccacacaatctccatcggtcaagtcactggcagtgccaaccatagaagagctcgaggacgaggaggagagaaaccatcggcagatgattaaggaggcttttgccggcgacgacgttattagagacttcctcaaggagaagcgcgaggctgtcgaagcaagcaaacctaaggatgtggacctgaccctgcccggctggggtgagtggggcggcgtcgggctaaagccttccgcaaagaagagaagacgcttccttataaaggcacccgaagggcctccccggaaagacaaaaatctgccgaatgtgatcatcaacgagaagaggaacattcacgccgccgcacaccaagtcagagtactgccttacccctttactcatcactggcagtttgaacgcaccatccagacgcctataggcagcacatggaacactcaaagggctttccagaagctcactactcccaaggtagtgactaaaccaggccacatcatcaaccctattaaggccgaagacgtgggctacagatccagttcccggagcgacctctcagtcattcagcggaaccccaagaggattacaaccaggcacaagaagcagcttaagaagtgcagtgtggattag

SEQ ID NO: 21112 - DNA, 2154 bp, Artificial Sequence
  Description of Artificial Sequence: Synthetic coding sequence
atgcggggcaccatgatggagcgggagagcatcaagagcttctggaaacaatccgtgccactcatggaaaggattggctcaggagagaagctggtgctcgccgacctgcttgaacccgtgaaaacgtcttcctcactcgccaccgtgaaaaagcaattgtccagggtgaagagtaaaaagaccgtagaacttccgctgaacaaagaggaaattgaaaggatacatagagaagttgcattcaataaaactgcacaggtcctgagtaaatgggacccagttgtgctgaaaaaccgccaggccgagcagttggtgttcccactagaaaaggaggagcctgctattgccccaatagaacacgtcctgtctgggtggaaggcacgaactccccttgagcaagagatattcaacctgctccacaaaaacaagcagcctgtgaccgaccctctgcttacccctgtggagaaggcaagcctgcgggccatgtccctggaggaagctaaaatgcgccgggcggaactgcaaagggcaagagctcttcagtcttactatgaggccaaagcaagacgggagaaaaaaatcaagtctaagaagtaccacaaggttgtgaaaaaaggcaaggcgaaaaaggcactgaaggagtttgagcagctcagaaaggttaatccggccgctgccttggaagagctggagaagatagaaaaggctagaatgatggagagaatgagtctgaaacaccaaaattcagggaagtgggccaaaagcaaagcaatcatggcaaaatacgatctggaggctcggcaggccatgcaagagcaattatcaaagaacaaagaactcacacagaaactccaggttgcctccgagagtgaagaggaggaaggcgggacagaagacgtcgaggaactacttgtcccggacgtcgtcaatgaggtacagatgaatgcagacgggccaaacccatggatgttgcgcagctgtacttcagataccaaggaggcagccacccaggaggatcccgagcagctgcctgaactggaagcacacggcgtgagcgaatctgagggagaagaacgccctgtggccgaagaagaaattttgctgcgcgaatttgaagaaagaagaagtttgaggaagaggtcggagctgagtcaggacgccgagccagccggttctcaggaaacaaaagattccggttcccaggaagttctatctgagttgcgagtcctgtcccaaaaactgaaggagaatcaccaatccagaaaacaaaaggcctcctcagaaggaacaataccacaggtgcagcgcgaagagcccgctccggaggaggaggaacccctgctgctgcaacgtcctgagagggtgcagacactagaggagcttgaagaacttggaaaagaagagtgttttcagaataaggaactgcccaggcccgtgctcgagggccaacagagtgagcggacgcccaacaacaggcctgacgctccaaaagagaagaagaaaaaagagcagatgatcgacctgcagaaccttctgacaacccagtcaccatccgtaaagtctttagcagtgcctacgatagaggaactggaggacgaagaggagcgaaaccaccgtcaaatgatcaaggaagcttttgccggggacgacgttattcgggactttctgaaagaaaagcgagaagccgttgaggcctccaagccaaaggatgtagacctgaccctgcccgggtggggcgaatggggcggcgtggggctcaaacctagcgctaagaagcgaaggcgctttctaatcaaagctcctgaggggcccccgaggaaggataagaacctgccgaatgtaataatcaatgaaaagaggaacatccacgcagccgcgcaccaggtccgcgttctcccctacccttttacccaccattggcagtttgagcgcacaatccagactcccattggttcaacgtggaacacccagagggctttccaaaaacttacgacccctaaagtggtcaccaaacctggccatatcattaacccaataaaagcagaagacgtgggctacagatcctcctccaggagcgacctgtccgtaattcagcggaaccccaagcgtatcacaacacgacataagaaacagttgaagaagtgtagtgtcgattag

SEQ ID NO: 21113 - DNA, 2316 bp, Artificial Sequence
  Description of Artificial Sequence: Synthetic coding sequence
atgaccgccaaccggctggccgagagcctgctggccctgagccagcaggaagaactggcagaccttccgaaggactacttgctgtcagaatccgaagacgagggagacaacgacggagagcggaaacaccagaaactgcttgaagccatttcttccctggacgggaaaaaccgacggaaactggccgagcggtctgaagcaagcttgaaggttagtgagtttaacgtgagtagcgaaggttcaggggagaagctggtcctggccgaccttctcgaacccgttaaaacctcaagtagcttggcgactgtaaagaagcagttgagccgtgtgaagagcaagaagacagtcgagttacccttgaataaggaagagatcgaacggatccaccgggaggtcgcgtttaataagacagctcaggttctgagcaagtgggatcctgtcgtactgaagaataggcaagctgaacagctggtgttccctctggagaaggaggaaccggccatcgccccaatcgaacacgtactgtcaggctggaaggcaagaacacctctggaacaggagatctttaatctgctacacaaaaacaagcagcctgtgacagacccgttgttgacgcctgtcgagaaggcgtcactgcgtgctatgtccctggaggaggctaaaatgcggagagctgagctacagcgggcgcgcgcattgcagtcctactatgaggccaaggcccgccgcgagaagaaaattaagtccaagaagtaccacaaagtagtgaaaaaaggaaaggccaaaaaggcacttaaagaatttgagcagcttcgaaaggtgaacccagcggcagccctggaggaactagagaaaatcgagaaagcacgcatgatggaacgaatgtccctgaagcaccaaaactccggcaagtgggcaaaaagcaaggcgattatggcaaagtacgatctggaggccagacaagcgatgcaggaacaactgtccaagaacaaagaactcacccagaagttgcaggtggcttcggagagtgaggaagaggagggcggaacagaagatgtagaggaactgcttgttcctgatgtggtcaacgaggtccagatgaacgcagatgggcccaacccttggatgcttcgctcgtgcacatccgacaccaaagaggccgcaactcaggaggaccccgaacagctgcccgaactggaggcccatggcgtgtcggagtctgaaggagaggagcggcccgtggcggaagaagagattctgctgagggaatttgaagaacggcgcagcttgcgcaaaagatctgagctctcgcaagatgcagagcccgccggaagccaagagaccaaagactccgggagtcaggaagtcctcagcgaactgcgtgtgctgagccagaagctgaaggagaatcaccagagtcggaagcagaaagccagctctgagggaaccattccacaagtgcagcgggaagaaccagcccccgaagaggaagagccacttctactgcagaggcctgagagggtgcagactttagaagaactcgaggagctgggcaaggaagaatgcttccaaaataaggagctgcctagacccgtcttagagggccaacagtcggaaagaactccaaataaccggccggatgctcccaaagagaagaagaagaaggaacagatgatagaccttcagaacctgctgaccacccagagcccatccgtgaaatctttggccgtccctacaatcgaagaactcgaagacgaagaggaaaggaatcatagacagatgattaaggaagcatttgcaggggatgacgtaatccgtgattttctcaaggaaaagcgagaagctgtcgaagccagtaagccaaaagacgttgatcttacactccccggctggggggagtgggggggcgtgggactcaagcccagtgccaagaagaggcggcgtttcctgatcaaagcccctgagggcccacccagaaaggataagaacctccccaatgtcatcatcaacgaaaagcgtaacatccacgccgccgctcaccaagttcgcgtcctgccatatcctttcacacatcactggcagtttgaaagaacgattcagacgcccataggctcgacctggaatacgcagcgggcgtttcagaaactgaccacacccaaggtggtgactaaacccggacatattataaatcctatcaaagctgaagacgtgggctaccgatcctcatcccgaagcgacctgtctgtgatccaacgaaaccccaaaagaatcactactagacataaaaaacagttgaaaaagtgttcagtggattag

SEQ ID NO: 21114 - DNA, 2160 bp, Artificial Sequence
  Description of Artificial Sequence: Synthetic coding sequence
atgaccgccaaccggctggccgagagcctgctggccctgagccagcaggaggaactagctgatctgcccaaagattatctgttgagcgaatccgaagatgagggggataacgatggcgaacgtaaacatcagaagttgctggaggccatttcaagcctggatgggaagaatcggcggaaactggcggagcgctcagaggcaagtctcaaggtgtccgagtttaatgtctcatctgaaggtagcggagagaaactcgtgcttgcggatttgctggaacctgtcaaaacttcatccagtctcgctacagtcaagaagcaattgtctcgggtgaaaagcaaaaaaacggtagagctcccactcaataaagaggagatagagcgagcgcgaaccccgctcgaacaggagatcttcaaccttttgcataagaacaaacagcccgtgacagacccgcttctcactcccgtggagaaggcttccctgcgcgcaatgagcctggaagaggccaaaatgcgcagggcagagctccagcgggcacgggctttacaatcttattacgaagccaaggcccggcgggaaaagaagatcaagtctaaaaagtaccacaaggtggtcaagaagggtaaagctaagaaggcactgaaggagtttgaacagctcaggaaagtgaaccccgcagccgctctggaagagctggagaaaatagagaaggcccgcatgatggaacgaatgtctctcaagcatcagaatagtgggaagtgggcaaaaagcaaagccattatggcaaagtacgatctcgaggcaaggcaggccatgcaggaacagctctccaagaacaaagagttaacccaaaagctccaagttgcgtccgagagcgaggaagaagaaggcgggactgaggacgttgaagagctgctggttccagacgtggtaaacgaagtgcaaatgaacgcggacggcccaaacccatggatgctccggtcttgcacctcagataccaaagaagcggctacacaggaggatcccgagcagctgcccgaacttgaggcccacggcgtcagcgagtccgaaggagaagaaagacctgtcgcagaagaggaaatcctgctcagagaatttgaggagagaaggagcttgcgaaagcggtccgagttgtcacaggatgctgaaccagccgggtcgcaagaaaccaaggacagtggctcccaggaggtgctttccgagttgcgggtgctttcacaaaagcttaaagaaaatcatcaaagcagaaagcaaaaagcatcttccgagggaacaatcccgcaggtgcaacgagaagagcccgcgcccgaggaggaggagcccctcttactacagcggccggagcgagtgcaaaccctggaagaactcgaagagctgggcaaggaagaatgcttccaaaataaggagcttcccaggcccgtcttagaggggcagcagtctgagcgaacaccaaataaccggccagatgccccgaaggaaaagaaaaaaaaggagcagatgattgatttgcagaatttactgacaacccagagcccatccgtgaagtccctggcagtccctactattgaagaattggaagacgaagaggagcgcaaccatcgtcagatgatcaaggaagcctttgccggagacgacgtgatcagagattttttaaaagagaaaagggaggctgtcgaggcttctaaacccaaagacgtggatttaacactacccggttggggcgaatggggtggagtgggtttaaagcctagcgccaagaagcgcaggcgtttcttaatcaaggcccctgagggaccccccagaaaggataagaaccttcctaacgtgatcataaatgagaagaggaatattcatgccgccgcccatcaagtccgcgtgcttccatatcctttcactcatcattggcaatttgagcgcacaattcagactcccattggttccacttggaacacccagcgcgccttccaaaagctgactacaccgaaagtggtgactaagccaggccatattattaaccccattaaggctgaagatgttggttaccgatcaagttcaaggagcgatctcagcgtgattcagaggaatcccaagcgcataacaacacgacataaaaagcagctgaagaagtgctcagtcgactag

SEQ ID NO: 21115 - DNA, 963 bp, Artificial Sequence
  Description of Artificial Sequence: Synthetic coding sequence
atgaagggcgacttccggaagaagaagagcgaggcccggacccccctcgagcaggagatctttaatctattacataagaataaacagcccgtgaccgaccctctcttgactccagtcgagaaggcttctctccgggctatgtctctggaagaggcaaaaatgaggagggcagagttgcagagggcgagagcactgcagagttattacgaggctaaggccagacgcgagaagaagatcaagagcaagaaatatcataaggtggtgaaaaaaggaaaagctaaaaaagccctcaaagagtttgaacagttacgaaaggttaaccccgctgccgctctggaggagctggaaaaaatcgagaaggctcgcatgatggagcggatgtcgctgaagcaccaaaactcaggcaagtgggccaaaagtaaggcaatcatggccaagtatgatcttgaggctcgccaagcaatgcaggaacagctgtccaaaaataaagaactgacacagaaactgcaggttgcttctgagtcagaggaggaggagggaggcaccgaggatgtcgaggagttgttagttccagatgtggtgaacgaggtgcaaatgaatgcagatggacctaatccttggatgctgagaagctgcacgtcagataccaaggaagcagcaacccaggaagaccccgagcagcttcctgagctcgaggcccacggagtgtccgaatctgagggcgaagaacgcccagtggctgaggaggaaattctgttgcgcgaattcgaggaacggcgatctcttcgtaaacgctcggagctgtcgcaggacgcagagcctgctgggtcccaggagacaaaagactccggcagccaggaggtactgagtgagctgagagtcctatcacagaaactcaaggagaaccaccagtctcgtaaacagaaggcttcctctgaaggaaccattcctcaagtgcagtag

SEQ ID NO: 21116 - DNA, 2301 bp, Artificial Sequence
  Description of Artificial Sequence: Synthetic coding sequence
atgaacgtgaaccaggtggccgagaacctggccctgagccaccaggaagaattggtagatctgcctaaaaactaccccctgtccgaaaacgaagacgaaggcgatagtgatggtgagagaaaacatcagaagctgctagaggccattatttctctggatggcaaaaaccgacggaaactcgccgagcgaagcgaggcaagtctgaaggtgtcggaattttcagtgtcctccgaaggatcaggcgaaaagttgggcttggccgatctcctggaaccagtgaagaccagttccagcttggcgaccgtgaaaaagcagctgaatagggtcaaatccaagaaagttgtcgaattacctttgaacaaagaaaaaatcgaacagatccaccgggaggtcgctttttcaaaaacaagccaagtcctgtctaagtgggacccaatcatcctgaaaaaccaacaagccgagcagctcgtgttcccactcgggaaagagcagccagccatcgcccccattgaacatgcgctctcggggtggaaggcccgcacccctctggagcaggagattttcaatctcctgcataagaataagcaaccagtgacggatcctcttctgacccccatggagaaagcttccctgcaagccatgtccctggaggaagccaagatgcaccgggccgaactgcagcgggccagagcactgcaatcgtactacgaggcgaaagcgaggaaggagaaaaagattaaatcaaaaaaatatcataaggttgtgaaaaaaggtaaggccaaaaaggctctgaaagaatttgagcagctgcagaaagtaaatccaactgtcgcactcgaggagatggagaagattgagaatgctcggatgatggagcggatgagcctgaagcaccaaaatagcggaaagtgggcgaaaagcaaggcaattatggccaaatatgatcttgaggctcggcaggcaatgcaggagcagctggctaagaacaaggaattgacccagaagctgcaggtggccagtgagagcgaggaagaggagggggggaccgaggtagaagaactcctggtcccacacgtggccaatgaagtgcagatgaacgtggacggtccaaacccctggatgttcaggtcttgcacgagtgatacgaaagaggcggccacacaggaagaccccgaacaggtacctgagcttgcagcgcacgaggtctcagcatcagaagctgaagagcggcccgttgctgaagaggagatactcctccgcgagtttgaagaaaggcagtccctacgcaaacggagtgagttgaatcaagacgccgagcctgcgagtagccaggagaccaaagatagcagttcgcaggaagttttgtctgaactccgagcattgtcacagaaactgaaggaaaagcaccagtcgcgtaagcagaaggcttcgagtgagggaactgtgccgcaagtgcagagggaggaacccgcccctgaggaggccgagcctctgctgctacagcggtccgaaagagtccagacattggaggaacttgaggagttaggaaaggaagactgcttccagaacaaggagctgccgcggcccgtgctcgagggtcagcagtctgagcgcacccccaataatcggccggacgcccctaaggagaaaaaggagaaagagcaactgatcaacctgcagaacttccttaccacgcagtcgccctccgtgcggtcactcgctgtgccaactatcattgaagaactagaagacgaggaagaacgtgaccagcggcagatgattaaggaagccttcgccggggatgacgttatcagggactttctcaaagagaaacgcgaggcggtggaggcctcaaaaccaaaggatgtggatctcactttgcctggatggggcgagtggggaggagtgggtctgaagcccagcgcaaagaaacgcaggcagttcctgattaaggcccccgagggtcctccacgcaaggataaaaaccttccaaacgtcatcatctccgagaagagaaatatccacgccgcagcccaccaagtgcaggtcctgccttatccatttacccatcacaggcagttcgagcgcactatccagaccccaatcggcagtacatggaacacacagcgagctttccagaagctcacgaccccgaaggtggtcacaaagcccggacatatcattaagcctataaaagctgaggacgtgggataccagtcgagctccagatctgatttacctgtaatccagaggaacccaaagagaattaccactaggcacaataaggaggaaaagctatag

SEQ ID NO: 21117 - DNA, 1557 bp, Artificial Sequence
  Description of Artificial Sequence: Synthetic coding sequence
atggccggctacaagcccgtggccatccagacctaccccatcctgggggagaagatcacccaggataccctctattggaacaattataaaacaccggttcaaattaaagaattcggtgctgtttctaaagtggacttttcaccgcaaccaccttacaactacgctgtcactgcgtcttcaagaatacatatctacgggagatactcacaggaaccaatcaaaactttctccagatttaaggataccgcatattgtgccacttttcgccaagacgggcgccttctggtcgccggatcagaagacgggggggtccaactcttcgacatttccgggagagcccctctcaggcagtttgaagggcacacaaaggcagtgcatactgtggatttcactgccgataaataccatgtggttagcggagccgatgactacactgtgaagctgtgggacatccccaattctaaggagattctgacctttaaggagcattctgactacgtgcggtgtggctgcgccagtaaactcaacccagacctgtttattaccggaagctacgaccatacagtaaaaatgttcgacgcacggacctcagaatctgtactcagtgtagagcatggccagcctgtggagagcgtcctactgttcccaagtggtggtttacttgtgtccgccggagggcgctacgttaaggtgtgggatatgttgaaaggaggacagctgttagtctccctcaagaaccaccacaaaacagtcacttgcctatgcctcagttcttccggccagcggctgctttctgggtcattagacaggaaggtaaaagtctactccactacctcttataaagtggtccacagttttgattacgccgcgtccattctgtccctggccctcgcgcacgaggatgaaacaatcgtggtcggcatgaccaatggcatactatcggttaaacatagaaagtctgaagctaaaaaggaatccctgccacgccggcgacggcccgcctaccgtacctttatcaaaggaaaaaactacatgaaacaacgtgacgacatcctcattaaccgcccggcgaagaagcacctggaactgtatgaccgcgacttgaaacacttccggattagtaaggccctcgacagagttctggaccccacttgtaccattaaaacacccgaaattacagtcagcataatcaaggaactcaatcgtagaggagtcctggcgaacgcactcgcaggccgcgacgagaaggagatctcacatgtgcttaatttcctgatcaggaacctgtcgcagccccggttcgctcccgtgctgatcaatgcagctgaaataataatcgacatttaccttcctgttattggccagtctcctgtcgtcgataagaagttcctgctgctgcagggccttgtggaaaaggaaattgactatcagcgggagctgctcgagaccctgggtatgatggatatgcttttcgccaccatgcgacgaaaagagggaactagcgtgctggaacacacttctgatggatttcccgagaacaagaaaatcgagtcatag

SEQ ID NO: 21118 - DNA, 1500 bp, Artificial Sequence
  Description of Artificial Sequence: Synthetic coding sequence
atggccggctacaagcccgtggccatccagacctaccccatcctgggagagaagattacgcaggatacactgtactggaacaactacaagccaccttataactacgccgtcacagctagcagtagaatccatatatatggtaggtattcacaagagcccattaagacatttagtcggttcaaagacaccgcatactgtgccaccttcagacaggatggacggctactggtagccggctccgaggatggaggcgtgcaactttttgatatcagcggaagggcccccctgcgccaatttgaaggccacacgaaagccgtgcacactgttgattttactgccgacaagtaccatgtcgtgagcggtgccgatgattacacggtgaagttgtgggatatcccaaacagtaaggaaatcctcacatttaaggaacacagcgattacgtgcggtgtggctgcgcctccaaactgaaccccgacttatttataacagggagctatgaccatacagtgaaaatgttcgatgcccggaccagcgagtcagttctgtcagtagaacacgggcaacccgtggagtccgtgctgctcttcccgagcggcgggctgctcgtgtcagccggtggacggtacgttaaggtctgggatatgttgaagggaggacaactcctcgtcagccttaagaaccatcacaaaaccgtgacatgtctgtgcctctcttctagcggccaacgcctgcttagcggtagcctagatcgcaaagtaaaggtctacagcaccacctcttacaaggtggtccattctttcgactacgccgcctctattctctccctggccctggcacacgaggacgaaacaatcgtggtggggatgacgaacgggatactatccgtgaagcatagaaaaagtgaggcaaaaaaagagtcacttcctagacgccgccgccccgcctatcggacctttatcaaaggtaagaattatatgaagcagagggacgatatacttataaatcggcccgctaagaagcatctagagctgtatgatagggacctcaagcactttcgcatcagcaaggccctggaccgagtcctggacccaacctgcaccatcaagactcctgagatcaccgtgagcataattaaggagctcaacagacgcggggtgctcgctaacgcactggctgggagagatgaaaaggagatttcccacgtgctcaattttttgatcaggaacctgtctcagcctcgatttgctcccgtgctgatcaacgctgccgaaatcatcattgacatctatttgccagtaatcggccagtcaccggtggtggataagaaattcctacttttgcaaggcctggtggaaaaggaaattgactatcagcgagagctgttggaaacgctgggcatgatggatatgctttttgccactatgaggagaaaagaggggacatctgtgcttgagcacacttccgacggcttcccggaaaacaaaaaaattgagtcatag

SEQ ID NO: 21119 - DNA, 24 bp, Artificial Sequence
  Description of Artificial Sequence: Synthetic coding sequence
atggccggctacaagcccgtgtag

SEQ ID NO: 21120 - DNA, 1638 bp, Artificial Sequence
  Description of Artificial Sequence: Synthetic coding sequence
tgagtgatcttcgcccggcggagcgtgcggtgcgtgtgccggcggctcctggaaggcccatgtgatttctacgccagtgccgcagagttatgtcgggtgggatcctggcacagtcccatcaactgcccgtgggttgaagtttctaggaggacattgtgggggagcgtggagactccagtgcagattaaggagtttggagctgtgtctaaagtggatttttctcctcagccaccatataactatgccgtcacagcctcaagtaggatccacatttatggccggtacagccaggaacccatcaaaacttttagccgttttaaagatacggcctattgcgccacgtttcgccaggacggtcgcctgctcgtcgccggctcggaggacggcggcgttcagctattcgatatctctggcagggcaccactcaggcagtttgaggggcataccaaagcagttcataccgtcgactttacagctgacaagtaccacgtcgtgtccggggccgatgactacacagtgaagctatgggatattccaaattccaaagaaatcctgactttcaaagagcactccgattacgtccgatgcggttgcgcttccaaactgaaccctgacctctttatcaccggctcctatgatcacacagttaagatgttcgacgcccggaccagtgagagcgtcctctcagttgagcacgggcagcccgtcgagtcagtgctgctcttcccttccggcggattacttgtttcagcaggcggcagatacgtgaaagtatgggacatgctgaagggaggccagctgcttgtcagtcttaaaaatcatcacaagacggtgacgtgtctgtgtttatcaagctcaggccagcgcctgctctccggatcactcgatcggaaggtgaaggtgtattcgactacaagctacaaagtggtgcactcattcgactatgcggcctcgattttgagccttgcactcgctcatgaagatgagacaatagtcgtaggaatgactaacggcattctgagtgtcaagcataggaaaagtgaggcaaaaaaagaatccctgcccaggcgtagaagacccgcctatagaaccttcattaaagggaaaaactatatgaagcagagagacgacatcttaatcaaccggcctgctaaaaaacaccttgagttgtacgaccgggacctgaagcacttcagaatctcgaaggccctggacagagtgctggaccctacatgtactatcaaaacacctgaaataacagtttcaattataaaggagctgaacaggcgcggcgtgctggcgaatgcgctcgccggacgcgacgagaaggagatatcccacgtgctcaattttctgatccgaaatctctctcaaccaaggtttgcaccagtcctcataaatgccgcagaaataattattgatatttacctgcctgtgattggccaaagccccgtggtcgacaagaagtttctgctgcttcaaggactggttgagaaggagatcgattaccagcgcgagctgctggaaactctgggaatgatggacatgctttttgcaaccatgcgaaggaaggagggcaccagcgtgctggagcatacgagcgatggcttcccggagaataagaagatagagagctag

SEQ ID NO: 21121 - DNA, 198 bp, Artificial Sequence
  Description of Artificial Sequence: Synthetic coding sequence
atggccggctacaagcccgtggccatccagacctaccccatcctgggggagaaaatcacacaagatacactctactggaacaattacaagactccagttcaaatcaaagagtttggggcggtctctaaggtcgatttcagcccacagcccccttataactatgccgtgaccgcttcaagtcgcatccatatttactag

SEQ ID NO: 21122 - DNA, 987 bp, Artificial Sequence
  Description of Artificial Sequence: Synthetic coding sequence
atgttcgacgcccggaccagcgagagcgtgctgagcgtggagcacgggcagccagtggagtctgtcctccttttcccttcaggtgggctgctggtgagtgccggagggcgctacgtaaaggtgtgggacatgctgaaggggggacaactactggtgagtctgaaaaaccatcataaaactgtaacttgcctgtgcctgagttcttctggccagcgtttgctctctggttccttagatcggaaggtgaaagtctacagcactaccagttataaggtagtgcacagctttgactacgctgcctcaattctgagtctagcactggctcatgaggatgagaccatagtggtggggatgacaaacgggattctgagtgttaagcacaggaaaagtgaggccaaaaaagaatccctgccacgccgcagacgaccagcttaccggacattcatcaagggcaaaaactatatgaagcagagggatgatattctcatcaacagaccagcgaagaagcacctagagttgtatgaccgcgacttgaaacacttcaggatcagtaaggccctcgacagagtcctggaccctacttgtaccattaagacaccagagattactgtctcaataatcaaggagttgaaccgcagaggtgttttggccaatgcgctggcgggaagggacgaaaaggagattagccacgtgttgaattttctgatccggaacttgagccaaccgcggttcgctcctgtccttattaatgctgctgaaatcatcattgacatatacctgcctgtaattggccagtcccccgtcgtggacaaaaagttcctgctgctccaagggctagtggagaaagaaatcgactatcagcgggagctgttggagacactcggaatgatggacatgctgttcgctactatgagaaggaaagagggtactagcgtcttggaacacaccagcgatggtttccccgaaaacaagaagatcgagtcatag

SEQ ID NO: 21123 - DNA, 750 bp, Artificial Sequence
  Description of Artificial Sequence: Synthetic coding sequence
atgaagatcacccggcagaagcacgccaagaagcacctgggcttcttccggaataactttggcgtacgcgagccctaccagatcctgctagacggtactttttgccaagcagcattgcgagggcgcattcagctcagggagcagctgccacgatacctgatgggtgagacccaactttgcaccacgagatgcgtcctcaaggagcttgaaacactggggaaggacttatatggcgccaaactcatcgcacagaagtgccaggtgaggaattgtccccatttcaaaaacgccgtgtcagggtccgagtgcctcctatctatggtggaagagggcaatccgcaccattacttcgtggcaacacaggatcagaatctaagcgtaaaggtgaagaagaagcccggtgtgccactcatgttcatcatccagaatactatggtgctagacaagccttctcctaaaacgattgccttcgttaaagctgtggagtctggccagttagtgtctgtccatgaaaaagagagcatcaagcatttgaaagaggaacagggcctggtcaaaaatacagagcagagtaggagaaaaaagcgcaaaaaaatctcaggacctaaccctctcagttgcctgaagaagaaaaaaaaagcaccagatacccagtcctctgcaagcgagaagaaaaggaagcggaaacggattcgcaaccgctccaatcctaaggttctgagcgagaagcagaacgccgagggggaatag

SEQ ID NO: 21124 - DNA, 438 bp, Artificial Sequence
  Description of Artificial Sequence: Synthetic coding sequence
atgaagatcacccggcagaagcacgccaagaagcacctgggcttctttcgcaataactttggggtgagagaaccctaccagatcctgctggacggcacattctgccaggccgccctgagagggcgcattcagctccgggaacaattacccaggtaccttatgggcgagacacagctgtgcactacgcggtgcgtgctgaaagagctggaaaccctcggaaaggatctatacggtgcaaaattgatcgcacagaaatgtcaagtgaggaactgtccacatttcaaaaatgcagtgagcggctcggaatgcctgctgagtatggttgaagaagggaatccacaccactactttgttgctactcagtatatccccaggatgtacaccttctgtaccaattacggtggacaacagtacgtaattgacgccctcattgggtag

SEQ ID NO: 21125 - DNA, 1794 bp, Artificial Sequence
  Description of Artificial Sequence: Synthetic coding sequence
atggccgagatcatccaggagcggatcgaggaccggctgcccgagctcgaacagctggaaagaataggcctcttcagtcatgcggagatcaaagcgataattaagaaagcctccgatctagagtacaaaatccaacgtagaacactgtttaaagaggatttcattaactatgtccaatacgagatcaacctgctcgagcttattcagcgccgccgaactcggatcggctactctttcaagaaagacgagattgagaattctatcgtgcatagggtgcaaggggtttttcagagggcttccgcgaaatggaaagacgacgttcagctttggctctcgtatgtggctttctgtaagaaatgggcaactaagacgcggttaagcaaggttttcagtgcaatgctcgctatccacagtaacaaacctgccctctggatcatggcagcaaagtgggagatggaggataggctgtcatcagaaagcgcccggcagttattcttgcgcgccctaagatttcacccagaatgccctaagctttataaggagtattttcggatggagctgatgcacgccgaaaagctgcgcaaggaaaaggaggagtttgaaaaggcgagtatggatgtcgaaaatccggattactcagaagaaatcctgaagggagaactcgcatggatcatatacaaaaactcagtaagtatcattaaaggcgccgagtttcacgtcagcctcttgtcaatcgcccagctgtttgactttgctaaggatttgcagaaggagatctacgacgaccttcaggccttgcataccgacgatccacttacttgggattatgtagccaggagggagttggagatcgaatcccagaccgaagagcaacctacgaccaaacaggctaaagccgtggaggtgggacggaaggaagagcggtgctgtgcagtatatgaggaagccgtgaagacccttcctacagaagccatgtggaaatgctacatcaccttctgtctggagcgattcaccaagaagtccaatagcggattcttgcggggcaagagattggaaaggactatgactgtgttccgcaaagcacacgagttgaaacttctatcggagtgccagtataaacagttgagtgtatcacttctgtgttataactttttgcgagaggctctagaagtggccgtcgctggcaccgagttgtttcgcgatagtggcacaatgtggcaactcaagctccaggtattgattgaaagcaagtcaccagacatagcaatgctgttcgaagaggcgtttgtgcatcttaaaccccaagtgtgcttacctctgtggatcagctgggcagagtggagtgagggcgccaaaagccaggaagacaccgaggccgtctttaagaaagccctcctcgccgtaattggtgcagactcggtaaccctcaaaaataagtatctggattgggcctaccggtctggaggatacaagaaggccagggccgtcttcaagagccttcaggagtcccgccccttttctgtggacttttttcggaaaatgatccaattcgagaaagaacaagaaagctgcaatatggctaacatccgcgaatattatgagagggccctgagggaattcgggtctgctgactccgatttgtggatggattatatgaaggaagagctgaaccatccccttggtcgacctgagaactgtggtcagatctactggcgggcaatgaaaatgctacaaggggagtctgcagaggcatttgtggccaagcatgctatgcaccagaccggtcatctttag

SEQ ID NO: 21126 - DNA, 1425 bp, Artificial Sequence
  Description of Artificial Sequence: Synthetic coding sequence
atgatcagcttctgccccgactgcggcaagagcatccaggccgcctttaagttctgcccttactgtgggaatagcctgcctgtcgaggagcacgtgggctctcagaccttcgtaaacccccatgtgtcatcctttcaggggagcaagcggggtcttaatagcagctttgagacgagtcccaagaaagtgaagtggagttccaccgtgacgagcccccgactgagtctgttcagcgacggcgattcctcagagtctgaagataccctgtcatcaagcgagcggtcaaaaggctcaggctctcgcccgccaacaccaaaatccagccctcaaaagactcgcaagtcaccgcaggtaacccgcggcagtccacaaaagaccagttgcagtcctcagaaaacacgacagtcaccccagacattaaagaggagccgagttacaacatctcttgaggcccttcctacgggaacagtgttgacagacaaatcaggaaggcaatggaagttgaagtcatttcagacacgggacaaccaagggattttgtacgaggccgccccgacgtcaaccttgacttgcgacagcggacctcagaagcaaaagttctctcttaagttagatgccaaggacgggcggctgtttaacgagcagaacttcttccagagagcggcaaagcctttacaggtgaataaatggaagaaactgtattccacacctctgttagctattcccacttgcatggggtttggggtgcatcaggacaagtatagatttctggtgcttcctagcctgggaaggtcacttcagtctgcactggatgtttctcctaagcatgtgctctcagagcgatccgttctacaggtggcctgtaggttgctagacgcactggaattcctgcatgaaaacgaatatgtacatggcaatgtgactgcagagaacatcttcgttgaccctgaggaccagtcacaggttacattggcagggtacggatttgccttccgctattgcccatccggtaaacatgtagcctacgtggagggatctagaagcccccacgaaggtgacctggaattcatcagcatggacctacataaaggctgtggtccctctcgaagatccgacttacagtcgttgggatattgtatgctaaaatggctatacgggttcctgccgtggactaactgtctccctaacacagaagacattatgaaacaaaagcagaagtttgttgataagcctgggcctttcgtgggcccctgtggacattggatccggccctctgagactctacagaaatacttgaaagtggtcatggcacttacatacgaggaaaagccgccttacgctatgttgcgtaataatctggaggcactactgcaggacctgcgcgtgtcaccgtacgaccctattggtctccccatggtgccctag

SEQ ID NO: 21127 - DNA, 1275 bp, Artificial Sequence
  Description of Artificial Sequence: Synthetic coding sequence
atgatcagcttctgccccgactgcggcaagagcatccaggccgccttcaaattctgcccatattgcggtaattcgctgcccgtggaggagcacgtgggatcacagacctttgtcaatccccatgtaagtagtttccaggggtctgggagccggccaccaacccctaaatctagtcctcaaaagactcgcaaatctccacaagttacaaggggaagcccacaaaagacatcttgctcaccgcaaaagacgaggcagtctccacagaccctcaagcggagtcgggtcaccacgagtctggaagctttacccaccggtaccgtcctgactgataagagtggaaggcagtggaagctcaaatccttccagactagggataaccaagggatcctgtatgaggccgcccccacctcaacactaacatgtgatagcggcccccagaaacagaagttctcccttaaactggacgccaaggatggaaggctgtttaatgaacaaaacttctttcagagagccgcgaagccacttcaggtgaacaaatggaagaagctgtactctacaccattgctggccattcctacttgtatggggtttggcgtgcaccaggataagtaccggtttctggtgctgcccagcttagggcgcagcctacagtcagccctggacgtgtctccaaaacatgtgctcagcgaaaggtcggtgcttcaggtggcttgtcgtcttctggatgctttggagttcttgcatgagaatgaatacgtgcatggaaatgtcaccgccgaaaacatatttgtagaccccgaagaccaatcccaggtgacattggcaggctatggcttcgcatttagatattgcccgagtggcaagcatgtggcctacgttgaagggtcacgaagtccacatgaaggggatcttgaatttatatcgatggatcttcataaagggtgtggaccgtcgcgaaggtctgacttgcagtccttggggtattgcatgctcaagtggttatacggattcctcccctggaccaactgcctgccaaatactgaggacattatgaaacagaagcagaagtttgtggataaaccaggcccatttgtcggcccctgcggacactggattaggccgagcgagacactgcagaagtatctgaaggtcgtcatggctctgacctatgaagagaagcccccctatgctatgcttcggaataatctggaggccctgctgcaagatctccgagtatccccatatgatccaatagggctgccaatggtcccttag

SEQ ID NO: 21128 - DNA, 855 bp, Artificial Sequence
  Description of Artificial Sequence: Synthetic coding sequence
atgatcagcttctgccccgactgcggcaagagcatccaggccgccttcaaattctgcccctactgcggcaattctctgccagtcgaggagcacgtgggaagtcagacatttgtgaatccacacgtgtcttcctttcagggcagcaagagggggctgaattctagcttcgagacgtcccccaagaaggttaaatggtccagtactgtgacttctccgaggctgtcactgttttcagatggtgactcaagcgagagtgaggatacactctccagtagcgagcgctcaaagggatcaggcagccgaccgcctaccccaaagtccagcccccaaaaaaccagaaagtccccacaagtcaccagggggtcaccccaaaaaacttcctgctctccacaaaagacccggcagtctccacagactcttaagcgatctcgcgtcactacttccctggaggccctgccaactggtaccgtcctgacggataagtccggccgacagtggaagctcaaatcctttcaaacccgggacaaccaaggcatactgtacgaagccgcgcctacctctactctgacctgcgactccggcccccaaaaacagaagtttagcctgaagctctccactagcggcagatcttgcacacgacctcactgttggccttcgctgccagcctgggtgagcgtgtttactagaactaacaccggaagctggtgctatccagcatggggcggggcgtttagcagaccctggatgtccgcccagtccatgtgttgtcagcgtggactctgttgtaggtggcccgccgggtgctggatgccatggagctcctctatgcggatgagtatgttcatggagatgtag

SEQ ID NO: 21129 - DNA, 732 bp, Artificial Sequence
  Description of Artificial Sequence: Synthetic coding sequence
atgaagctgcacccccccccccccagccccgtgacccaggaccaccgaagcaaatcctctcatagcaattggttcctggtgctgccctctctagggagatctctgcagtcagcacttgacgtgagtcccaaacacgtcctctcagaacgctcagtgctccaagtggcctgtcggttgttggacgcgctggaattcctacacgagaacgagtacgtccatggaaacgttaccgccgaaaatatctttgttgaccccgaggaccagtcacaggtgacgctggccggctatgggttcgctttccgctactgcccctctggtaaacatgttgcctatgtcgagggcagtcgttcaccgcatgaaggggacctggagttcatctcaatggacctgcacaaagggtgcggccccagcaggcggagcgacttgcaatcactgggctactgcatgctgaaatggttatacggctttctaccatggacaaattgcttgcccaatacagaagatattatgaaacagaagcagaagtttgttgataagcctggcccatttgtgggaccttgtgggcattggatcaggccctctgagacacttcagaagtatctaaaggttgtgatggcgctcacctatgaagaaaagccaccatacgccatgctgcggaacaatctggaggcactcctgcaggatctaagggtaagtccttacgaccctatcggacttcccatggtgccttag

SEQ ID NO: 21130 - DNA, 645 bp, Artificial Sequence
  Description of Artificial Sequence: Synthetic coding sequence
atgagccccaagccccgggccagcggcccccccgccaaggccaaggaagcaggaaagcggaagagttcctcgcagccatctccgtccgacccaaaaaaaaagactaccaaggtggcgaagaaaggcaaggcggtcaggagaggccgcagaggtaaaaaaggagcggccactaagatggctgcagtgactgcccctgaggcagagtctggcccagccgcccctggacctagtgaccaaccttcccaagagctgccccagcacgaattgcctcccgaggagccagtgagcgaagtcgaagagccactgagccaagagtcccaggtcgaggagccattgtcccaggaatccgaggtggaggaaccactttctcaggaaagtcaagtagaagagcctctgtcccaggagagtgaggttgaggagccactcagtcaagaaagccaagttgaggaacctttaagccaggagagtgaggtcgaggaacctttgagccaggagtctcaggtcgaagagccgctcagccaggagtcagaaatggaggagccgttaagtcaggagtcccaagttgaagaaccacttagccaggagagtgaaatggaggagcctctgtcacaggaaagtgagatggaagagctgccctctgtctag

SEQ ID NO: 21131 - DNA, 561 bp, Artificial Sequence
  Description of Artificial Sequence: Synthetic coding sequence
atgagccccaagccccgggccagcggcccccccgccaaggccaaggaagcaggcaagagaaaatcatccagtcagcctagtccaagcgatcctaaaaaaaaaactacaaaagtcgccaagaaaggcaaggctgtacggcggggaagaaggggcaaaaagggagcggctaccaagatggccgccgtaaccgctccggaagccgagtccggccccgctgctcccgggccatcagatcagccatctcaggagctccctcaacacgaacttccccccgaggagcctgtgagcgagggcacacagcacgatccactctcacaggaaagtgagttagaagaacctctgtctcaggaatcggaagttgaggagccccttagccaagagagccaggttgaggagccccttagccaggagagcgaggtcgaagagcccctatcccaagagtcccaggtcgaggaacccctgagccaggagagtgaaatggaggaaccactgagtcaggagagtcaggtggaagagcccctatcacaggagtccgaaatggaggagcttcccagtgtttag

SEQ ID NO: 21132 - DNA, 651 bp, Artificial Sequence
  Description of Artificial Sequence: Synthetic coding sequence
atgagccccaagccccgggccagcggcccccccgccaaggccaaggaggccggcaaacggaagagctcttctcaaccttccccaagcgatcctaagaaaaagacaaccaaggtcgcgaagaaagggaaagctgtacgccgtgggaggcgagggaagaagggtgccgccaccaaaatggccgccgttactgccccagaggcggaaagcggcccggcagccccagggccctcggatcagccctcacaggaactgccacagcacgagctccctcctgaggagccagtaagcgaaggaacccagcacgatcctctgagccaggaatccgaattggaagaacctctctcccaggaatcggaagtcgaagagcctctttctcaagaatcacaagtggaagagcccctgtcccaggagagcgaggtggaagagcctctctcccaagagtcccaggtagaggaaccgctgtctcaggaaagcgaagtggaggaaccactgtctcaagagtctcaggtggaagaacctctgtcgcaagaaagcgagatggaggagccgctgagtcaagagtctcaagtggaagagcccctcagccaagaatcagagatggaggagcccctttcacaggagagcgagatggaggaactgccctccgtttag

SEQ ID NO: 21133 - DNA, 561 bp, Artificial Sequence
  Description of Artificial Sequence: Synthetic coding sequence
atgagccccaagccccgggccagcggcccccccgccaaggccaaggaagcaggcaagagaaagtccagtagtcagcctagcccatctgatcccaagaagaagactacaaaggtggccaagaagggcaaggctgtgcggagaggcagaagaggtaagaagggggccgccaccaagatggcggccgtaactgcgcccgaggctgaatcaggccccgccgccccaggcccatccgaccagcccagccaggagctgccgcagcatgagctccccccagaggaaccagtatctgagggcacccagcatgatccacttagccaggagagtgaattagaagagcctttatcacaggagtcagaggtggaggaacccctctcacaggagtctcaggtcgaggagccgttatcccaggagagtgaagtcgaggaaccactctcccaagagtcgcaagtagaagaacctttaagtcaggagtccgaagtcgaagagccgttgtctcaggaaagtgaggttgaggagcctctcagtcaggaatcagagatggaagagcttccgagcgtgtag

SEQ ID NO: 21134 - DNA, 777 bp, Artificial Sequence
  Description of Artificial Sequence: Synthetic coding sequence
atgcggctgagcagcagccccccccggggcccccagcagctgagctctttcggtagcgttgactggctttcccaatcttcatgtagcggtccaacacacacacctaggccggcagacttttcactgggttccttgcccgggcctggtcagacatccggagccagggaacctccccaggccgtgtctatcaaggaagctgctgggagctctaacctcccagcaccagaaagaacgatggcaggcctgtcaaaggagcctaatacacttcgggctcctagggtgcgcactgcttttaccatggagcaggttcggacattggaaggagtgttccagcaccaccagtatttgtcccctctcgagcgcaagagattggcgagggaaatgcagttgtctgaggtccaaatcaagacctggtttcagaatagacgcatgaagcataagcggcagatgcaggatccccagctccattcacccttctccgggtctctgcatgcccccccagccttttattccacttcttccggtctcgccaacggcctgcaactcctgtgcccctgggccccactgagtggtccccaggccctgatgctccctcccggatctttttggggcttgtgccaggttgctcaggaggctttggccagcgccggcgcatcttgctgcggtcagccactggcaagccatcctcccacgccaggaagaccaagcctcggcccagcactctcaacggggccacgtggcctatgcgcaatgccccagacaggagatgcattttag

SEQ ID NO: 21135 - DNA, 561 bp, Artificial Sequence
  Description of Artificial Sequence: Synthetic coding sequence
atgttcggcaagcccgacaagatggacgtgcggtgccacagcgacgccgaggctgcccgtgtgtcaaaaaacgctcataaagagtcaagagagagcaagggggccgagggaaacttgcccgctgcctttttgaaagagccacagggggcctttagcgcgtccggcgcagctgaggattgtaataaaagtaagagtaacagtgctgcagatcccgactattgtagacgaatcctcgtgcgcgatgctaagggctccatcagggaaatcattctccccaaagggctggacctagatcggcctaagcgaacccggacgagctttacagccgaacagctctaccggttagaaatggaattccagaggtgtcagtacgtggtgggaagagaacgcactgaacttgccagacagcttaatctctcagaaactcaagcgaacagtgaggagaacaatgaacggtttaaacgaggaataaaaaaacagaaaaaaaagcgcaaaaaggaaccagccaacgatgaaagccggagaggagattcaggagggcgtgggtggcaaccactctag

SEQ ID NO: 21136 - DNA, 1005 bp, Artificial Sequence
  Description of Artificial Sequence: Synthetic coding sequence
atgttcggcaagcccgacaagatggacgtgcggtgccacagcgacgccgaggctgcccgggtttccaagaacgcacacaaagaatcacgcgagtcgaagggagctgagggcaatctgccggcggcttttctcaaagaacctcagggcgccttcagtgcgagcggagctgcggaggattgtaacaagagtaagtccaatagcgccgccgatcctgattactgccgcaggattctcgtgagagatgccaaaggtagcataagagagattattctccccaaaggcctagaccttgaccgacccaaacgtacacgcacctccttcacagcagaacagctttaccggctggagatggagtttcagaggtgccaatacgtggttggcagagaacggactgaactggcccgacagctgaacctgtctgaaacccaggtgaaagtttggttccagaataggcgaaccaaacagaagaaggaccagggtaaggattccgaactgcgatcagtcgtatccgagacagctgccacttgttccgtgctgaggctgctggagcaaggccgacttctgagtccaccaggcttgcccgcactcctccctccttgtgccacaggtgcactggggtcagcgctgagggggccaagtttgcccgccctgggagccggagctgcggctggctctgccgccgcagctgctgccgcagcgccgggacccgctggtgccgccagtccccaccctccggcagtggggggtgccccaggtccggggcccgccggacccggcgggctgcacgccggggctccagccgcaggtcatagcctgttcagtcttccagtgccctccctgcttggatccgttgcctcgagactttcttccgctccactaaccatggccggatccctcgccggcaatctgcaggagctgtcagctcggtacctgtctagctctgcctttgaaccatatagccggaccaacaataaggagggtgctgaaaaaaaggccctggattag

SEQ ID NO: 21137 - DNA, 711 bp, Artificial Sequence
  Description of Artificial Sequence: Synthetic coding sequence
atgaccgccgagttcctgagcctgctgtgcctgggcctgtgcctgggatacgaagatgagaaaaaaaacgagaagccccccaagccttcattacacgcatggccttccagcgtggtggaggccgagtcaaacgtcactctgaagtgtcaggcacacagtcagaacgtcacgtttgttctgcggaaggtgaacgactctggatacaaacaagagcagagcagcgccgagaacgaggctgagtttcctttcacagatctcaagccaaaagatgctgggcggtacttctgcgcatacaaaacaaccgcatcacatgaatggtctgagtctagtgaacatctgcagcttgtggttacagataagcatgacgaacttgaggccccttctatgaaaacggacacaagaaccatctttgtggccatcttctcctgtattagtattctgctgctgtttttgagcgtcttcattatctatagatgcagtcagcactcttcttcctccgaagaaagtaccaagaggacatcccactcaaaactcccggaacaggaagccgctgaagcggacctgtccaacatggaaagagtcagcctgtctactgccgatccacagggcgttacatatgcagaactctccacatctgccctgagcgaggccgcttccgatacgacacaggagccacccggtagtcatgagtatgccgctctgaaggtgtag

SEQ ID NO: 21138 - DNA, 447 bp, Artificial Sequence
  Description of Artificial Sequence: Synthetic coding sequence
atgcggaagcggatgggccccacccggctgccccggctggagtgctctggtgctataaccgcacattgttctctcgatttgcccggtcccgataagcacgacgagctagaggcaccgagcatgaaaacagacactaggaccatatttgttgccattttttcctgtatctcgattcttctcctgtttttgtccgttttcattatatacagatgtagtcaacactccagtagttctgaggagagtactaaacgcacatcccatagcaagttacctgaacaggaagctgcggaggcagacctgtcgaacatggaaagggtgtctctctctacagcggacccgcaaggcgtcacctacgcagaactatctaccagtgccctttctgaggccgccagtgacactacacaggagccgcccgggtcgcacgaatacgccgcgctcaaggtgtag

SEQ ID NO: 21139 - DNA, 618 bp, Artificial Sequence
  Description of Artificial Sequence: Synthetic coding sequence
atgaccgccgagttcctgagcctgctgtgcctgggcctgtgcctgggctacgaagacgaaaaaaaaaacgaaaagcctccaaagcccagtctgcatgcgtggcccagcagtgtggtcgaagctgaatccaacgtgaccctgaagtgtcaagcacacagtcagaacgtaacatttgtcctacggaaagtaaatgattccgggtacaaacaggagcagagctcagccgagaatgaggcggaatttccatttacagatctgaaacctaaagatgccggacggtacttctgcgcctataagaccacagcctcccacgaatggtctgagtcaagcgagcatttgcagcttgtcgtgactgacaaacatgacgaacttgaggcccctagcatgaagactggcagtagcagcgaagaatctacaaaacgtactagccactccaagcttccggagcaggaggcagccgaggccgacctgtctaatatggaacgggtgtccctgtctacagcagatccgcagggagtcacctatgctgaattatcaacatcagccctctcggaagccgctagcgacacgactcaggagcctcctgggtctcacgaatacgcagcactgaaggtatag

SEQ ID NO: 21140 - DNA, 432 bp, Artificial Sequence
  Description of Artificial Sequence: Synthetic coding sequence
atgaccgccgagttcctgagcctgctgtgcctgggcctgtgcctgggatatgaagacgagaagaagaacgagaaacctcctaagccttctctccacgcatggccttccagcgttgtcgaagcagaaagcaacgtgaccctgaagtgtcaggcacattcccaaaacgttactttcgtcctcagaaaggtgaacgatagcggatacaaacaggagcagtccagtgcggaaaacgaggctgagttccctttcactgatcttaagcccaaagacgcagggcgttatttttgcgcatacaaaactacagcctcacacgaatggtccgaatcttcagaacatctccagctggttgtgactgacaagcacgatgagctggaggccccgagcatgaaaaccgtggcacatgtgtgcaacacccgtactcttggaagatag

SEQ ID NO: 21141 - DNA, 1272 bp, Artificial Sequence
  Description of Artificial Sequence: Synthetic coding sequence
atggcccagctgcagacccggttctacaccgacaacaagaagtacgccgttgatgacgtgccattttcaattccagcagcttcagaaattgccgacctgagtaacattattaacaaactactaaaagataagaatgagttccataagcatgtagaatttgactttctaattaaaggacaatttctcaggatgcccctggacaaacatatggagatggagaacatcagctcggaagaagtggttgaaatcgaatatgtggagaagtacacagcacctcagccagaacaatgtatgttccatgacgattggatatcgagtataaaaggggcagaagaatggatcttgaccggctcttacgacaaaactagtcgtatttggtccctggagggcaagtccattatgactatcgtcggccacaccgacgtagtgaaggatgtcgcttgggtgaaaaaagacagtcttagctgcctgttactgtcagcgagtatggaccagaccatcttgctgtgggaatggaacgtggagagaaacaaagtgaaagccttacattgctgcaggggtcatgccggcagcgtggacagtatcgccgtggatggcagcgggaccaagttctgttctggctcatgggataagatgcttaaaatctggagtactgtccctactgatgaggaagatgagatggaagagtcaacgaatcggccacggaaaaaacaaaaaacagaacagttgggtctcactcgaactccaatcgtgactctgagtgggcacatggaggcagtgagcagcgtgctttggtccgatgctgaagagatttgttcggcctcatgggatcacacaattcgagtgtgggacgtcgagtctgggagtttaaagagcacccttaccggaaataaggtattcaattgtataagctattccccactttgcaagagactggcctcaggctcaactgaccggcacattcggttatgggatcccaggaccaaggatggctccttggtcagccttagtctgacgtcacacactggctgggtgacttctgtgaagtggagcccaacacacgagcagcagctcatttccggtagcttggacaacattgtgaagttgtgggataccaggtcatgcaaggccccactctatgacctagccgctcacgaagataaggtcctatctgttgactggaccgatactggcctgctgctttctggcggagccgacaacaaactgtatagttacaggtacagccccaccacaagccatgttggagcctag

SEQ ID NO: 21142 - DNA, 2034 bp, Artificial Sequence
  Description of Artificial Sequence: Synthetic coding sequence
atggccgccggcggcggcggcagctgcgaccccctggcccccgccggcgttccttgcgccttcagcccgcactcccaagcctatttcgcactggcttcgactgacgggcaccttagggtctgggaaaccgctaacaacagattgcaccaggagtacgtcccatctgcacatctaagtgggacctgcacatgtttggcgtgggcccccgctcgcctccaggcaaaggagtccccacagcggaaaaaaaggaaaagcgaagctgtgggtatgtcgaaccagacagacctgcttgcactcggcactgccgtggggagcattctgctctactctactgttaagggggagctgcactctaaacttatctccggcggacatgataacagggtgaactgtatccagtggcatcaggactccgggtgtctgtattcttgctccgatgacaagcatatcgttgagtggaatgtgcagacatgtaaggttaagtgcaaatggaaaggggataatagcagtgtgagctcgctgtgtattagtcctgatgggaaaatgctactctctgccgggagaactatcaaattgtgggtcctggagaccaaagaggtgtaccgtcacttcacaggccacgctactcccgtatcttccttaatgtttactaccattcggccgccaaatgagagccagccatttgatggaatcaccggactgtattttctgagtggagctgtgcatgacaggttgctgaacgtctggcaggtcaggtccgagaataaagaaaagagtgctgtaatgtcatttactgttaccgacgaaccagtttacatagatctcaccctatcggaaaataaagaggagcccgtgaagttggcagtcgtgtgtagagatggacaagtgcacctgtttgagcatattctcaacggatactgcaagaagccactgacatcaaattgtacaattcagatcgccacgcccggtaagggcaagaaatctactccaaagccaataccaatcctcgcggctgggttctgcagcgataagatgtctctccttctggtctatggctcctggttccagccaaccatcgagagggtcgctctaaattcaagggaaccacacatgtgtttggttcgagatatctcaaactgctgggcacctaaagtggagacggccatcaccaaagtccgcaccccagttatgaatagcgaggccaaggtactagtaccaggtattccggggcatcatgctgctatcaaacccgctcccccccaaacagaacaagtggagagcaagcgcaagtccggagggaacgaggtgtcgatcgaagagagactcggggccatggacatagacacccataaaaagggcaaagaagacctgcaaactaattcttttcctgtactcctcacccagggactggaaagcaatgactttgagatgctgaacaaggtgctgcaaaccaggaatgtgaatctgatcaaaaagactgttctgcgcatgccgctccatacaataattccactgcttcaggagttaaccaagagattgcagggacatcctaactcagcggtgcttatggtgcagtggctgaaatgcgtcttaactgtacacgcgagctacctcagtacactgcctgatctggtgcctcagcttggcactctgtatcagctgatggaatcacgggttaagactttccagaagctatcgcacctccacggaaaattaatccttttaatcacacaggtgaccgccagtgaaaaaactaagggggcaacatctcctggccaaaaagcgaagctcgtctatgaggaagagtcctcagaagaggagtctgacgatgaaattgctgacaaggacagtgaagataattgggatgaggatgaggaggaaagtgagtcagaaaaagatgaggatgtggaggaagaggatgaagacgctgaggggaaagacgaggagaatggtgaggacagggacaccgcctcagaaaaagagttgaatggggacagcgaccttgacccggagaatgagtcagaagaagagtag

SEQ ID NO: 21143 - DNA, 1005 bp, Artificial Sequence
  Description of Artificial Sequence: Synthetic coding sequence
atggccaccgaggagaagaagcccgagaccgaggccgcccgggcccaacccactccgtctagctctgcaacccaatctaagccaacacctgtcaagcctaactacgcactgaaattcaccctggccggccatactaaggccgtgtctagcgtgaagttctcaccaaacggagagtggttagcttcaagtagcgcggacaaattgatcaagatctggggcgcttacgatggtaagttcgaaaagaccataagcggacataagctgggcatctctgacgtggcttggtcatccgactctaacttactggttagcgcctctgatgacaagaccctgaaaatttgggatgtctcctccggtaaatgccttaagacgctgaaaggccactcaaactacgttttttgttgtaatttcaacccccagagcaatctgatcgtttcgggatccttcgatgagagtgtgaggatttgggatgttaagactgggaagtgcttaaagaccctgcccgcgcactccgacccggtatccgccgtacattttaacagggatgggagcctgatcgtcagtagttcatacgacggcctctgccggatatgggacaccgcgtcgggacaatgcctcaagacactcatcgatgatgataacccaccagtgagctttgttaagttcagcccgaacgggaagtacatcctagccgcaacactcgacaacactctcaaactgtgggactacagcaagggcaaatgtctgaaaacctataccgggcataagaatgagaagtattgtatcttcgctaactttagcgtgacagggggcaaatggatagtcagcggcagtgaagacaacctggtgtatatttggaatctgcagaccaaagaaatcgtccagaagctccaaggccacaccgatgtggtgatctcaacagcatgccatccgactgagaacattatcgccagcgcagccctggagaacgataagactattaagctttggaagagtgactgttag

SEQ ID NO: 21144 - DNA, 1005 bp, Artificial Sequence
  Description of Artificial Sequence: Synthetic coding sequence
atggccaccgaggagaagaagcccgagaccgaggccgcccgggcccaacctacacctagctcttccgccactcagagcaaaccaacaccagtcaagcccaactatgctctgaagttcaccctggctggccatacgaaggctgtatcttccgtcaagttcagccctaatggcgagtggctggccagtagctcggctgacaagttgatcaaaatttggggtgcttacgacgggaagttcgaaaaaacaatcagcggccataaattggggatctcagacgtagcctggtcatccgattccaacctcctggtgtcagcaagcgacgacaaaacactaaaaatctgggatgtcagctccggtaagtgcctgaagacactcaagggacactcgaattacgtgttttgttgcaatttcaacccacagtctaatttgattgttagtggctccttcgatgagagcgtcagaatttgggacgtcaagaccgggaagtgtctgaaaacactcccagctcattcagatcccgtgtctgccgtgcactttaatagagatggttcactgattgtgagtagtagttatgacggcttgtgccggatctgggatacagcaagtgggcagtgcttaaagaccttaatcgatgacgataatccacccgtgtcctttgtgaaattctctcctaacggtaaatacatcctggcagctacattggacaatacactcaagctttgggactacagtaaggggaaatgcctgaagacctatacggggcacaaaaacgagaaatattgcatttttgctaatttctcagttacaggagggaaatggatcgttagtggctcagaggataatttggtctatatatggaacctgcaaaccaaagagattgtgcaaaagctacaaggccacaccgacgtggtgataagcactgcctgtcaccctacagagaatattattgcaagcgccgcacttgaaaatgataagactatcaagctctggaagtcagattgttag

SEQ ID NO: 21145 - DNA, 1158 bp, Artificial Sequence
  Description of Artificial Sequence: Synthetic coding sequence
atggccgccgccgccgcccggtggaaccacgtgtgggtgggcaccgagactggcattctgaaaggagtcaatctgcaaaggaagcaagcagcaaactttaccgctggggggcagcctcgccgcgaggaggcagtatccgcactttgctggggcacaggcggcgagactcaaatgctcgtcggctgtgccgatcgaactgttaaacacttcagtaccgaagatggaatattccaaggacagcgccactgtccgggcggagaaggaatgtttagaggccttgcacaggccgatggaactttgattacttgcgtcgatagcggcattctgagggtctggcacgataaggataaggatacatcctccgatccattgctggagctgcgcgtgggtccgggggtgtgtaggatgagacaggaccccgcacaccctcacgtggtcgcaaccggggggaaagagaacgcgttgaaaatatgggacctgcaagggagcgaggaaccagtgtttcgggccaaaaacgttcgcaacgattggctggatctccgggtccccatatgggatcaagatattcagtttctgcccgggagccagaaactcgtgacttgcaccggatatcatcaggttcgggtgtacgacccagctagtcctcagcgcagaccggtgctggagacgacctatggggagtatccgcttactgctatgaccctaaccccaggcggaaactctgtcattgtggggaatactcacggtcagttagcggaaattgacttacggcagggccgcctcttaggctgccttaagggattggctgggtctgttaggggccttcagtgccatcccagtaagcctttgctcgcgtcatgcggcttggatagagtcctgcgcatacaccgaattcagaacccgcggggactggagcacaaggtgtatttgaagagccaattgaactgtctacttctttcaggccgagataattgggaggacgagccgcaggagcctcaggaacccaataaggtcccactggaagacacagaaacggacgagctttgggcctctctggaggccgcagctaagagaaagctgtcaggtttggaacagccccagggagcacttcaaactagacgtcggaaaaagaaacggccgggatccacgtcaccttag

SEQ ID NO: 21146 - DNA, 1101 bp, Artificial Sequence
  Description of Artificial Sequence: Synthetic coding sequence
atggccgccgccgccgcccggtggaaccacgtgtgggtgggcaccgagacaggaatccttaagggcgtcaatctgcaaaggaagcaggccgctaatttcacagccggtggacagccccggcgcgaggaagccgttagtgctctgtgttggggaaccggaggcgagacgcagatgctggtgggctgcgcagaccgaacagtgaaacacttctcgaccgaggatggaatattccagggacagaggcattgccccggcggcgagggcatgttcagggggcttgcccaagctgacggcactctgatcacatgtgtagatagcgggatcctgagagtgtggcacgacaaggacaaggatacctctagtgacccgctcttggaacttcgggttgggccaggagtgtgcagaatgcgccaggaccccgcgcatccacacgtggttgccactggcgggaaagaaaatgcacttaaaatctgggatcttcaaggttctgaagaacccgtgttcagagcgaagaatgttagaaatgattggttggacctccgtgtgcctatatgggaccaggatatccagtttctgcctggatcgcaaaagctcgtgacgtgcactggctaccaccaggtccgagtctatgaccccgcttctccccagcggagaccagtgttagagactacgtatggcgaataccccctaacagccatgacgctcaccccaggcggcaacagcgtgatcgtaggtaacacccatggacagctggcggagattgatctacgccaggggaggctgctgggctgcctaaaagggctggcagggagcgtgagaggcctgcaatgccatccatcaaaacccctgctggctagctgcggactcgaccgggtgctgcgcattcacagaatccagaacccacggggcctggagcataaggacgagccccaggagccacaggagccgaacaaagtgcccttggaagataccgagactgatgagctgtgggctagcttagaagcagctgccaaacggaagctgtcaggcctcgagcagccacagggggctttgcagacccgccgacgcaaaaaaaaaaggccggggtcaacttcgccctag

SEQ ID NO: 21147 - DNA, 1158 bp, Artificial Sequence
  Description of Artificial Sequence: Synthetic coding sequence
atggccgccgccgccgcccggtggaaccacgtgtgggtgggcaccgagaccggaatcctgaaaggagtgaacctgcagaggaagcaagccgccaatttcacagcagggggacagccacgccgggaggaggcagtgtccgctctgtgttgggggaccgggggagagacccagatgctggtgggatgtgctgaccgaactgtgaaacatttcagcaccgaggatggaatcttccagggacagagacactgtcccggcggagagggcatgtttcgaggcctcgcccaggctgatgggacactcatcacgtgcgtggacagcggtatcttgagggtctggcatgacaaggacaaggacactagttccgaccctctgttggaactccgtgtcgggcccggggtttgccgaatgaggcaggatccggcgcacccacatgtggtggccactggaggcaaggagaacgccctgaaaatatgggatttgcagggctctgaggagcctgtgtttcgagcaaagaatgtcagaaatgactggctcgatttgcgagtgcctatttgggaccaagatatacagtttcttcccggctcccagaagcttgttacatgcactgggtaccaccaggttcgggtctacgaccctgcttccccacagaggaggccagtgcttgagacaacttacggtgaatacccactgacggcgatgaccctgacccccggcggcaacagtgtcatagtcggaaacacacacgggcagctggctgagatcgacttgagacagggacgcctgttgggatgcttaaaggggctggccggaagtgtgcggggcctccagtgccaccctagcaagcctcttctcgcaagctgtggcttagacagagtactccggatacatagaatccaaaatcccaggggactggaacataaggtatatctaaaatcacagcttaattgtcttctcttgtctgggcgagataattgggaagatgaaccccaggagccccaggaacctaataaagtccccttagaggacaccgaaactgacgagttgtgggccagcctcgaggcagctgccaagcgcaaactgagcggacttgaacagccgcagggtgccctccagaccaggagacgaaagaaaaagagacctggatctacttcaccgtag

SEQ ID NO: 21148 - DNA, 1158 bp, Artificial Sequence
  Description of Artificial Sequence: Synthetic coding sequence
atggccgccgccgccgcccggtggaaccacgtgtgggtgggcaccgaaaccggcattctcaagggcgttaacctccagagaaaacaggccgcgaacttcacagccggcggccaaccccggagagaggaggcagtcagcgccctttgttgggggaccggcggcgaaacccagatgctggtcggctgcgccgatcgcacggtgaaacatttctccaccgaggatgggattttccaaggtcagcggcattgtcccggcggggaaggcatgttccgtggcttggcacaggctgatggaacgctgattacttgtgtggattcaggaatcctgagggtttggcacgacaaggataaagacaccagtagcgatccactgttggagttgcgggtgggtccaggcgtctgccggatgaggcaggaccctgcacacccacatgtcgttgctaccggcggaaaggagaatgccctgaaaatctgggacttacaaggcagcgaagagccggtcttcagggcgaagaatgtgcgaaatgattggcttgacctgcgcgtgcctatttgggatcaggacattcagttcctgccaggctcacagaagcttgtgacatgcactggataccatcaagtaagagtgtatgatcccgcgagtccacagcggcggcccgtgcttgaaactacatacggtgaatatccgctgaccgccatgactctgacccctgggggcaattctgtgattgtcgggaatacgcacggacagctcgccgagattgacctgaggcagggccggctgttgggctgcctcaagggactcgcaggctccgtgagaggactccagtgccatccctccaagccgctgcttgcctcttgcggactggacagagttctcaggattcaccgcatacagaacccgcgcggtttagagcacaaggtatatctgaaaagccagttgaactgcctcctgttaagtggtagagataattgggaggatgaaccccaggagcctcaggagcctaataaagtcccgctagaggacacggaaactgatgagctgtgggctagcctggaggctgctgctaagcgcaaacttagcggacttgaacagcctcagggggcactgcagactcggcgccgcaagaagaaaagacctgggtccactagcccatag

SEQ ID NO: 21149 - DNA, 117 bp, Artificial Sequence
  Description of Artificial Sequence: Synthetic coding sequence
tgatgggccagcctggaggccgccgccaagcggaagctgagcggcctggaacagcctcagggagcactgcagacacgccgccggaagaagaaaaggcctggaagtacatccccgtag

SEQ ID NO: 21150 - DNA, 174 bp, Artificial Sequence
  Description of Artificial Sequence: Synthetic coding sequence
atggccgccgccgccgcccggtggaaccacgtgtgggtgggcaccgaaacaggaatactaaagggagtcaacctccagcggaaacaggcagcaaattttacagctgggggccagcctagaagggaagaagctgtctccgcattatgctggggtaccggcggcgagacgcagtag

SEQ ID NO: 21151 - DNA, 2493 bp, Artificial Sequence
  Description of Artificial Sequence: Synthetic coding sequence
atggtggaggaggagaacatccgggtggtgcggtgcggcggcagcgagctcaattttaggagagctgtcttctcggccgatagtaaatacattttttgtgtgagtggtgattttgtgaaggtgtatagcacagtcactgaggaatgcgtccacatccttcacgggcatcgcaacctggtcaccgggatccagctgaaccctaacaatcatctgcagctctacagctgcagcctggacggcactattaagctgtgggactacattgacggtatacttattaagacattcattgtgggatgcaaactacacgcgctattcacacttgctcaggccgaagattctgtgttcgtgattgtgaataaggagaagccggacatattccagttggtgtctgtgaagcttccaaagtcaagcagtcaagaggtcgaggccaaggaactcagtttcgttctcgattatatcaatcaatctcccaagtgtattgcgttcggaaacgagggagtgtacgtggctgctgtccgggaattttacctgtcagtgtattttttcaagaaaaaaactacgagccgcttcactctgtcctcctcacggaataaaaaacacgcgaagaacaacttcacgtgcgtggcctgccatcccacagaggattgcattgcctctggccacatggacggcaaaatccgcctatggagaaatttttacgacgataagaaatacacctatacttgcctgcactggcatcacgacatggtgatggatttggcattctcagtaacaggcaccagccttctctcaggaggaagagaatccgtgctggtcgagtggcgcgatgccactgagaagaacaaagaatttttgccccgcctgggcgccactattgagcacatcagcgtatccccagcgggggatctgttctgtacatcccattcagataacaaaatcataatcattcatcgaaatttggaagcgtcagccgtgattcagggactggtgaaggatcgatccatcttcactggcttgatgatcgatcctcgcacaaaagccctcgtcttaaacggtaagcctgggcacctgcaattttactccctgcaaagtgataagcagctctataatctggacatcattcagcaggaatatatcaacgactatggcctgatccaaatagagctcaccaaagccgcttttggctgttttgggaattggctcgccaccgttgagcaacggcaagaaaaagagaccgaactcgagctgcagatgaagttatggatgtataacaaaaaaacccagggatttatcctgaatacgaaaataaacatgccccatgaagactgcattactgctctttgcttctgcaacgccgaaaaatccgagcagcctacgctcgtgacagcctctaaggatggatacttcaaggtttggatcctgaccgatgatagcgatatctataagaaagccgtgggatggacatgcgactttgtgggatcataccataagtaccaggccactaactgctgcttctccgaagatggtagtcttctcgccgtgagtttcgaggagattgtgacaatttgggactcagtcacttgggaactgaagtgtacattctgccagcgggcaggaaagattcgccacctctgctttggtcgtcttacctgcagcaaatacctgcttggtgcgacagagaatgggattctctgctgttggaaccttttgagctgtgcactggagtggaacgctaagttgaacgtccgcgtgatggaaccagaccctaattctgagaatatagcagctatatcccagagcagcgtgggctcagacttatttgttttcaagccgtcagagcccaggccactgtacattcaaaagggtatatctcgggaaaaagtgcaatggggagttttcgtgccaagagacgtacccgagtcttttacatctgaagcttaccagtggctcaacagaagtcagttttacttcctcaccaagagccagagcctcctcacgttcagtacaaagtctcctgaggagaagctcactccgactagcaaacagctcctggccgaggagtctcttcccacgactcctttttactttattcttgggaagcatcgacagcagcaggacgagaagctcaacgaaaccctggagaatgaacttgttcagctgccactgaccgagaacatacctgccattagtgagttgttacacacccccgcacacgtattgccctcagcagcatttctgtgctctatgtttgtaaactcattgctcctgagcaaagaaacaaagtcagcaaaagagatccctgaagacgtagacatggaggaggaaaaggagagtgaggatagtgacgaggagaatgacttcactgagaaagtgcaggataccagcaacactgggctgggcgaggacatcatccatcagctcagtaagtcagaggaaaaggaactccggaaatttaggaagattgattatagctggatcgctgctctgtag

SEQ ID NO: 21152 - DNA, 1155 bp, Artificial Sequence
  Description of Artificial Sequence: Synthetic coding sequence
atggtgaagctgatccacaccctggccgaccacggcgacgacgtgaattgctgcgccttttctttctcactgctagccacctgttcgttggataagaccatacggttatactcactgagagattttaccgagctgccccatagtcccctgaaattccatacatacgccgtgcattgctgctgtttcagccctagcgggcacattttagccagctgcagcaccgatggcacaacagtattgtggaacaccgaaaatggccagatgctggctgtgatggaacagcccagtggatccccagtcagagtgtgccagttttcgccagactctacttgccttgcttccggtgctgccgatggaacggtggtgttgtggaacgcccagtcatacaagctgtacagatgtggctcggttaaagacggatcactggctgcatgcgcctttagccccaatggtagtttcttcgttactggttcatcctgtggggacctaacggtgtgggatgacaaaatgcgctgcccacactctgagaaggcccatgatttagggattacttgctgcgatttcagttctcagcctgtaagcgacggtgaacaggggctccagttctttaggctcgccagttgtggccaggactgtcaggtcaaaatctggattgtaagtttcacgcacatccttgctcgacgtaccgagcaccagctgaagcagttcaccgaggattggtctgaggaagatgtgagcacatggctctgtgcccaggatctgaaagacttggtgggcatctttaagatgaataatatagacgggaaggagttgctcaatctcacgaaggagagcctggcagatgacctcaagatcgagtcactcgggctcaggagcaaggtgctcagaaaaatagaggagttgcgaaccaaagtgaagtctctaagctctggaatccccgacgagttcatctgccccatcacccgggagctgatgaaagacccagtaattgcctctgatgggtactcatatgaaaaggaggcaatggaaaactggataagcaaaaaaaagcggacatctccaatgaccaatttagtcttgcctagcgctgttctcactcccaaccgcactttaaaaatggcgatcaatcgttggctggagacccatcagaaatag

SEQ ID NO: 21153 - DNA, 1431 bp, Artificial Sequence
  Description of Artificial Sequence: Synthetic coding sequence
atggtgaagctgatccacaccctggccgaccacggcgacgacgtgaactgttgtgcgttcagtttctcgctgctcgctacctgcagcctcgacaaaacaattagactttactccctcagagactttacagagctgcctcactccccgctgaagtttcacacctacgcagtgcactgctgttgcttttcaccatcagggcatatcctcgcatcttgctccactgacggtacaaccgtgctctggaacaccgagaatgggcagatgcttgcagtgatggaacagccctctggtagccctgtgagagtgtgccagttcagtccggactccacttgcctggcatcaggcgccgcagacggtactgtggtactgtggaatgctcagtcttacaagctttaccgatgtgggagtgtcaaggatggctcactagctgcttgcgcattcagccccaacggcagttttttcgtgaccggaagctcctgtggggacctgactgtctgggacgataagatgcgatgccctcacagtgagaaagcccacgatctggggattacttgttgcgatttttcctcccagcccgtcagcgatggggagcagggcctccagtttttcaggctggcgtcctgtggacaggactgccaggtcaagatatggattgtgagcttcacacacattctgggcttcgaactgaaatataagagcactctaagcggccactgcgcccccgtgttagcttgtgctttttcccatgatggacagatgctcgtaagcggctcggtagataagtctgtcatcgtctatgatacaaatacggaaaatatcctgcataccctcacccaacacacccggtacgtgacaacctgtgcttttgcacctaacacgttgcttctggcaaccggaagcatggataaaaccgtcaatatatggcagtttgatctggagacactgtgccaggccagaaggacagagcaccagctgaaacagttcactgaggactggagcgaggaggatgtgtccacctggctatgcgctcaggatcttaaagatctcgttggtattttcaagatgaacaacatagatggtaaggagctgctaaacctcacaaaggagtccctcgctgacgatctcaagatcgaatcgctcgggctgcgctcaaaagtgctgcgaaagatcgaggagttgcgcaccaaagtgaaatctctgtccagcgggataccagatgaattcatctgccctattactcgtgaactgatgaaggaccccgtcatcgctagcgatggctattcttatgaaaaggaggcaatggagaattggatttcaaaaaagaagaggacatcaccaatgactaatttagttttgccaagtgccgttctgacccccaaccgcacacttaaaatggcgataaatcgttggttggaaacccaccagaagtag

SEQ ID NO: 21154 - DNA, 1431 bp, Artificial Sequence
  Description of Artificial Sequence: Synthetic coding sequence
atggtgaagctgatccacaccctggccgaccacggcgacgacgtgaattgttgtgcattcagcttctccctcttagccacctgttctttagacaaaactatccgcctgtatagtctgcgcgacttcacagagctcccccattcaccgctgaaattccacacatatgccgtacactgctgttgtttcagcccttcgggtcatatcctggcatcatgcagtacagatgggaccactgtgctctggaataccgagaacggtcagatgttggcggtgatggaacagcccagcggttcaccagtgcgggtttgccagttctctcccgactccacgtgcttggcatccggtgctgctgacggcactgtcgttctgtggaacgctcagtcttataaactctataggtgtggaagtgtaaaggatgggtctctcgcagcatgtgccttctctcccaatgggtccttctttgtcaccggatcaagttgcggcgacttgacagtatgggatgataagatgagatgcccccactccgagaaagcacacgatcttgggattacatgttgtgactttagttcccagcctgtgtcagatggcgagcagggactccaattcttccggctggcatcctgcggccaggactgccaggtgaagatttggattgtttccttcacccacattctgggatttgaattaaaatataaatcaacattgtctggacactgtgcgcccgtgttagcttgcgcatttagccatgatggtcagatgctcgtgtccggcagtgtagacaagtccgtaattgtgtacgacacaaacacagaaaacatattgcataccttgactcagcacactcgttatgtgaccacatgcgctttcgcccccaacactctgctgcttgctacagggtctatggacaaaactgtgaatatatggcaattcgacctggaaacactgtgccaggccaggcgcaccgagcatcagcttaagcagttcaccgaagattggtcagaggaagatgtgtcgacttggctctgtgctcaagatctaaaagatcttgtcggcattttcaagatgaacaacatagatggcaaggagctgctcaacttaacaaaggagagccttgctgatgacctgaagattgagtcccttggcttgcgctctaaggttcttagaaaaattgaagagctcaggaccaaggttaagtcgctcagtagcggcatccctgacgaatttatatgtccaattacaagagaactcatgaaagacccagtgatcgctagcgatgggtactcctatgaaaaagaagccatggagaactggatcagcaagaagaaaaggacctctccgatgactaatctcgttctgccttccgcagtcctcaccccgaatcgaaccctcaagatggctataaatcgatggttagagacccaccagaagtag

SEQ ID NO: 21155 - DNA, 1431 bp, Artificial Sequence
  Description of Artificial Sequence: Synthetic coding sequence
atggtgaagctgatccacaccctggccgaccacggcgacgacgtgaattgctgtgccttcagtttctctttacttgcgacctgcagcctcgacaaaacgatacgcctgtattcactcagggacttcactgagctaccacactcacccctcaagttccacacctatgccgtgcactgttgttgcttcagcccatccggtcatattctggcctcttgttctacagatgggactacagtgctgtggaacacagagaacggacagatgctggccgtgatggagcagccttctggcagcccagttagagtttgccagttttctcccgactccacctgtctggccagtggcgccgcagatggtaccgttgtcttgtggaacgcccagtcatacaaattgtataggtgtgggagtgtgaaggacgggtcccttgccgcctgtgcattttcccccaatgggtcgttcttcgtcactggatcatcatgtggcgatctgacggtatgggatgacaagatgcgctgcccccattccgaaaaggcacatgatcttggtattacatgctgtgatttcagttcccaacctgtcagcgacggcgagcagggtttacagttcttccgactagcttcctgtggccaggattgtcaggtgaaaatctggattgtcagtttcacgcatattctggggtttgagttaaagtataagagcacgttgtccggacactgcgccccggtgttggcttgcgccttcagtcacgatggccaaatgttggtgagcggaagtgttgataagtcggtcatcgtctatgatacaaataccgagaacattcttcacacactgacccagcacacaaggtacgtaaccacatgcgcgttcgcgccaaatactctgctcctcgccacaggctcaatggataagaccgtgaacatttggcagtttgacctggagacactctgccaggctaggagaacggagcaccaattaaaacagttcaccgaggattggtctgaggaggatgtcagcacttggctttgtgctcaggatctcaaagacctggtcgggatctttaaaatgaacaatatcgatggaaaagagctcctaaacctaaccaaagagagccttgccgacgatctgaagatcgagtctctcgggttgcgatcgaaggtcctccgcaaaattgaagaactccggacaaaagttaaatcactgagttctggcatacccgacgagttcatttgccctattacaagggagctcatgaaggaccccgtgattgccagtgacggctacagttacgagaaagaggccatggaaaactggataagcaagaagaagaggacctctcccatgaccaatctggtgttgccttccgccgtgctcacaccaaatcggaccctgaagatggccatcaatcgttggttggagacacatcaaaagtag

SEQ ID NO: 21156 - DNA, 2385 bp, Artificial Sequence
  Description of Artificial Sequence: Synthetic coding sequence
atggagggcagcctggccggcagcctggccgcccccgaccggccccaggggccagaaaggctgcccggccctgcacctcgggaaaacattgaagggggagcggaagccgccgagggcgagggcggcatttttaggtccacgaggtatctccctgtgaccaaggagggtcctagggacatcctggacggtaggggtgggataagcgtggcaaactttgacccgggcacctttagcttgatgaggtgcgatttttgcggtgcggggtttgatacaagggcaggactttcaagccacgccagagcccatctgcgggactttgggattaccaactgggagttgacagtgagtcctataaatattcttcaggagttgctcgcaacatctgcagcggaacaacctcccagtcctttgggaagggaacctggagggccaccagggtcttttttgaccagcaggcgaccacggctccccttgactgttccattcccccccacttgggctgaggatcccggacccgcttacggcgatgcctccggcccagagcctgctcgagacattcgctgcgagttctgtggggagttttttgaaaatcggaagggtctcagcagccacgctagatcacacctgaggcagatgggcgtgacagagtggtacgtcaacgggtctcccattgatacgctgagggaaatcctcaagcgacgcacccagtcccgccctggcggaccaccaaaccccccggggccatcccccaaggcacttgcgaagatgatgggaggtgccggtccgggctcctccttggaagcacggtctccatctgacttacacatcagccccttggccaagaaactgcctccgcctcctggaagtccccttgggcattccccgaccgcctcgcctccaccaaccgcacgcaagatgttcccaggactcgctgctccaagtctgcctaagaaactcaagcccgagcaaatcagggtggagatcaaacgggaaatgctacccggcgccctccacggtgagctgcatccatccgaaggtccttggggggccccccgagaagacatgaccccactgaacttaagctcacgcgccgagcccgtcagagacatcaggtgtgaattctgcggtgaattcttcgaaaaccgtaagggcctatcatcccacgccaggagtcatctcaggcagatgggggtcacggaatggtccgtgaatggtagccccatcgacaccctgcgtgagatcttgaaaaaaaaatctaagccatgtctgatcaagaaagaacctcctgctggggacctggcccccgccctggctgaggacggccctcctacagtggctccaggtcctgtgcagtcgcctttacccttgtcgcctctggcggggcggccaggaaaacccggcgcaggtcccgcccaggttccccgcgaactgagcctgaccccaatcaccggcgccaaaccttcagcaacggggtacctgggctccgtcgcggccaaaagacctctgcaggaagatagattgctaccggcagaggtcaaggccaagacctatattcagaccgaattgccgtttaaggcaaaaacattgcacgaaaaaacttcccactcaagcacagaagcctgttgtgagctctgtgggctgtacttcgagaatcggaaagcactggcatctcatgctcgggctcatctgagacagttcggagttactgagtggtgcgttaatggatccccaatagagacactaagcgaatggatcaaacacagaccacaaaaagtgggcgcttatagatcctacattcagggcgggaggccctttacgaaaaagttcagatctgcaggacatggcagagatagtgacaaacgcccctcgttggggctagcccctggggggttggctgtggtggggagatcagctgggggagaacctggtcccgaggccgggagagccgctgatggtggcgagcggcctctggccgcgagccctcccgggactgtgaaggccgaggaacatcagaggcagaatataaataaattcgaaaggagacaggctcgtccaccagacgcctctgccgcccggggaggagaagatactaacgacctacagcagaaactggaagaggtgcgacaaccaccccctagggttagacctgtgccctctctcgtgcctagaccccctcagacaagcctcgtcaaattcgttggcaatatctataccttgaaatgccgtttttgtgaagtagaattccaaggccctctctctatacaagaagaatgggtccgccacttgcagagacacatcctggaaatgaattttagcaaggccgaccccccaccggaggagtcccaggccccccaggctcagactgccgctgcggaagccccttag

SEQ ID NO: 21157 - DNA, 4956 bp, Artificial Sequence
  Description of Artificial Sequence: Synthetic coding sequence
atggagggcagcctggccggcagcctggccgcccccgaccggccccaggggccagaaagacttcccggaccagcaccacgggagaatatcgagggcggcgccgaagcagctgagggagagggcggcattttcaggtccactagataccttcctgtgaccaaagaggggcctagagacattctagacggacggggtggaatctcaggcactccagatggacgagggccatgggagcaccccctggttcaggaagccggggaaggcattcttagtgaaagaaggtttgaagatagcgtcattgttcggacaatgaaaccacatgctgagcttgaaggaagccggcggtttcttcatcaccgcggcgaaccgcggctattggagaagcatgcacagggacgccctcgctttgattggctgcaggacgaggatgagcagggtagcccacaggacgcgggtttgcatttggacctgcccgcccaaccaccccccctcgccccgtttcgtagggtgtttgttcctgtagaagacaccccaaagactctcgatatggctgttgtgggggggcgagaagatttggaggaccttgagggccttgctcagccaagcgagtggggactccctacatccgcctccgaggtggctacccaaacttggaccgtgaactccgaggccagcgtggaaagactgcagccactgcttcccccgatacgcacagggccatatctgtgcgagctccttgaagaggtggcggaaggagtcgcttctccagatgaggatgaagatgaggaaccggccgttttcccctgtatcgagtgttccatttactttaagcagaaagagcatctgctggagcatatgtcacagcataggcgagcacctgggcaggaaccaccggccgatcttgcccctcttgcatgcggcgagtgcgggtgggccttcgccgacccaactgccctggagcagcaccgccagctgcatcaggcttctcgggaaaaaattattgaggagatccagaagctgaaacaggtgccgggcgatgaggggcgggaagcgcgtctgcaatgccctaaatgcgttttcggaacaaattcttccagggcctacgttcaacacgcgaaactccacatgcgggaaccccccggccaaaccaccaaagaaccatttgggggctctagtggcgcaggatcgccatctccagaagcttcagccctactttatcaaccatatggcgccgcagttggcctgtctgcctgcgtcttctgcgggtttcctgctcctagcgagtccctgctgcgtgaacatgtcaggctggtgcatgcccatccacattgggaggaggacggcgaagcatacgaagaggaccccgcgagtcaacccggtaccagccaggacgctcacgcatgtttccctgacactgcagtcgactatttcgggaaggcagaacccagtcttgcccccatgtggagagaaaatcccgccggttatgaccctagtcttgccttcggccctggctgtcaacaattatctatccgcgacttcccattgtccaagccacttctccacggcactggacagagacctctgggccggttagcttttccatccacactggccagcactccatattcattacagttaggtcgcaataaaagcactgtacaccctcaaggattaggggaacgtcgccgcccctggagcgaagaagaagaggaggaagaggaagaagaagacgtggttctcacaagcgaaatggatttcagcccagaaaacggtgtgttttcccctctcgccacaccaagcctcatccctcaggctgccctggaacttaaacaggcctttagggaagccctgcaagccgtggaggcgacacaaggccaacaacagcagctgcgggggatggttccaatagtgcttgttgcgaaactggggccacaggtcatggccgcagcccgggtgccccccagactgcagcccgaggagttgggcctggctggcgctcacccattggacttcctgttgcttgacgccccacttggaggtccgctcggcctggacacactcctggatggcgaccctgcaatggccctgaagcacgaggaaaggaaatgcccctattgtccagaccgattccacaatgggatcgggttggccaaccacgtgaggggacacctgaaccgggtgggggtgtcttacaacgtaagacacttcattagtgctgaagaggttaaagctatagaacgcagattctccttccaaaagaagaagaaaaaagttgcgaacttcgatcccggcaccttctctctcatgcgatgtgacttttgcggcgcagggttcgacaccagagctggtctgtcttctcacgcgcgtgcccatctcagggattttggcatcactaattgggaactcaccgtgtcccctatcaacattcttcaggaactgctggccacctccgctgccgaacagccacctagccctctggggcgcgaaccaggggggccccctggcagctttctcaccagtaggaggccgcggctcccactgacagtgccctttccccctacctgggcagaggaccccgggcctgcttacggggacgcacagtcactcaccacctgtgaggtttgtggagcgtgcttcgagaccagaaaaggtttgtcttcgcatgctagaagccatctgcggcagttgggtgttgctgagtcggaatcaagcggagccccaatagatttactctatgagctggtgaagcaaaagggtctcccggatgctcacctgggcctccctcccggattagccaagaagagctcatcactcaaggaagtggttgccggtgcacctcggcctggcctgttgagcctcgcaaaaccgctcgacgcgccagccgttaataaagccataaagtctccaccggggttctccgcaaaagggctggggcaccctccatcatcgccactccttaagaaaacacctttggcgctggccgggtctcctacacctaagaacccagaggacaagtctccacagttgtctttgagccctagacctgccagtccgaaagcacagtggccgcagtccgaggatgaggggccattgaacctcacttcaggccccgagccagccagggacatccgatgtgaattctgcggtgagttttttgaaaatagaaaaggcctttcaagtcatgcccgttctcacctgcgccagatgggagtgactgagtggtatgtcaatggttcaccaatcgatacgctccgggagattctgaagaggagaacacagagtcggccaggggggccccccaacccacccgggccctcaccaaaggcactggccaaaatgatgggaggggcaggcccaggcagcagcctagaggcgagatccccgagcgacttgcatatctctcccttggccaagaaactaccccccccccccgggagtcccttgggacactctcccaccgcctctcctccacctaccgcccgcaaaatgtttcccggtctggctgcaccttccctcccaaaaaagctgaagcctgagcagatccgcgtcgaaattaagcgggaaatgttaccaggggccctgcacggcgaactccacccttctgaggggccctggggcgcgcccagggaggacatgacccccctgaatctgtccagtagagccgagccagtgagggacatcaggtgcgagttttgcggagaattttttgaaaataggaagggcttgagctcgcacgcgagatcacacctccgacaaatgggcgtaaccgaatggagcgtgaacggctcccccattgacacattaagggagatcttgaaaaagaaatcaaagccatgcttgattaaaaaagagccacccgccggcgacctcgcccctgctctcgccgaagacggtcctcccaccgtcgctccgggacccgtccagtctcctttgcctttgtctccattagccgggcggcccggtaaacctggagcaggcccagcccaggtgcctcgtgaattaagtctaacacccatcactggcgcaaagcccagtgctacaggctacttgggcagtgtggctgccaagcgacccttgcaggaggaccgcttactgcccgcggaggtcaaggcgaaaacctatatccagacagagctgccgtttaaagccaagacactgcacgagaagacctcacattcttctactgaagcttgttgcgaattatgcggtctgtatttcgagaatagaaaggccctcgcctcccacgccagggctcacttacggcaattcggtgtgacagagtggtgtgtcaatgggtcccctatcgagacattgagcgagtggatcaaacatagaccacagaaggtcggcgcctacagatcttacattcaaggggggagaccttttactaagaagtttaggtccgccggccatggccgtgactcagataaacgaccgagcctgggactcgccccagggggactcgctgtggtgggccgctcagccgggggagagcccggaccagaggccggcagggctgcagatgggggcgagcgtccattggctgcctcaccacccgggactgttaaagcggaggagcatcagaggcagaacattaacaagttcgaaagaaggcaggcacgaccaccggacgcctcggcagctagaggcggggaggataccaatgatctccagcagaagctggaggaagtccgccagccccctccccgagtgcgtcctgtgcctagtctcgtgccaagaccaccccaaacaagtctggtgaagttcgtggggaacatctataccctgaagtgtaggttttgcgaagtcgagttccagggacctctcagcatccaggaggaatgggtcagacatctgcagcgccatatcttggagatgaattttagcaaagccgaccccccacccgaggagtctcaagctccgcaggcccagactgctgcagccgaagcaccgtag

SEQ ID NO: 21158 - DNA, 2508 bp, Artificial Sequence
  Description of Artificial Sequence: Synthetic coding sequence
atggtggccatggacctgggcagccccagcctgcccaagaagagcctgcctgttccaggtgcactggagcaggtggcatcaaggttaagctcaaaggttgctgccgaggtcccccacggctccaagcaagagttgcaggaccttaaagctcagtccctgacaacctgcgaggtttgtggagcgtgtttcgaaacccgcaagggactgtcatcacatgcgcgatcccatctccgacaactgggtgtcgccgagtctgagtcctctggcgccccaatcgacctgctctatgaacttgtcaagcagaagggcctgccagatgctcatcttggactcccaccaggattagccaagaagagcagctcgctgaaggaggtggttgctggcgctcccagacctggtttacttagcctggcaaagcccctggatgcccctgctgtaaacaaggcaattaagtctcctcctgggttctcagctaaggggctcgggcaccccccctcaagccctctgctgaagaagactccgcttgctttagccggatccccaactccaaagaacccagaggacaaaagcccacagctgtccctctccccgcggccggctagccccaaggctcagtggccacaaagtgaagatgaggggcccttgaacctcaccagcgggccggaaccagcccgtgacattcgatgtgaattttgtggggaattttttgagaatagaaaaggcctgtcgagtcacgcccgaagccacctgagacaaatgggagtgacagaatggtatgtgaacggtagtcctattgacactctgcgtgaaatcctgaagaggcggacccagtctcgtccaggcggaccaccaaatcctccagggccctccccgaaagcgctggctaagatgatgggtggcgcaggtccaggatctagtcttgaggctcggagtccgtcagacctccacatatcacctttggctaagaaactgccaccaccaccagggagcccactcggtcactcacccactgcatcgcctcctcccaccgcccgaaagatgttccccgggctggcagcaccttctctgcccaagaaattgaagccagaacagattagagtcgaaatcaagcgcgaaatgttgcctggtgctttacacggggagctgcacccctctgagggaccgtggggagctccccgcgaggacatgactcccctgaacctctctagtagggcagaaccagtgcgcgacatcaggtgcgaattctgcggagagttttttgaaaatcgcaaaggtctcagttctcatgctaggtcccacctgcgacagatgggtgtcactgaatggagcgtgaatggctctcccattgacaccctccgcgaaattctgaaaaagaaatctaaaccgtgtctgattaagaaggagccacccgcaggggacctcgcgcctgcattggcagaagatggacctccaactgtggcgccaggccccgttcagtcgccgctgcctctgtcacctctcgccggccggcccggcaaacctggcgctggccccgcacaggttcctcgcgaacttagcctcacaccaattactggtgccaaaccctctgcaacaggatatctcggctctgtcgcagccaagaggccattgcaggaggataggcttttacctgcagaggttaaagccaagacctatatacagacagagttgcccttcaaggccaagaccttgcatgaaaaaacaagtcactcaagcaccgaggcctgctgtgaactgtgcggcttgtactttgaaaatcgcaaagccctggcaagccatgccagagcccacctgaggcagtttggtgtgacagagtggtgcgtgaatggcagtccaatagagactttatcggagtggatcaagcaccgaccacagaaagtgggtgcataccggagttacatccagggaggcaggccttttacaaaaaagttccgttctgccggacacggaagggattctgataaacgaccttccctcgggcttgccccgggcggcctggcagtggtggggagaagcgctgggggagagcctggaccggaggcgggtcgggccgcggacggaggggagcgcccacttgctgcctctccacctgggaccgttaaagcggaggagcatcaacgccagaacataaacaaattcgaacgccgccaggctagacctccggacgcctctgcagcccgcggcggcgaggacaccaatgacctccaacagaaactggaggaggtccggcaaccacctccgagggtaagaccagtaccaagcctggttcccaggcctcctcaaaccagccttgtaaagtttgtgggcaatatctatactttgaagtgtcggttttgcgaggtcgagttccagggccccctcagcatccaagaggaatgggtgcggcatctgcaacggcatatccttgagatgaatttttcaaaagccgatccccctccggaagaatcccaggcccctcaggcacaaacggccgccgcagaagccccgtag

SEQ ID NO: 21159 - DNA, 2898 bp, Artificial Sequence
  Description of Artificial Sequence: Synthetic coding sequence
atggacctgggcagccccagcctgcccaagaagagcctgcccgtgcccggagcactggaacaggtagcctcgcgattatcttcaaaagtggctgcagaggtcccacatggaagtaaacaggaactccaggatctgaaagcccaaagtcttactacctgcgaagtctgtggcgcctgttttgagaccagaaagggcctttcttcgcatgctaggagccacctccgtcaacttggagtcgctgaatcagaaagttcaggagctccaatagacctgctctacgagctagtcaagcagaagggccttcccgacgctcatttaggcctcccccctggtttagccaaaaaaagtagttctctgaaagaggttgtggccggtgcaccgcgccctggacttctgtcccttgcaaagccactcgacgctcctgccgtaaacaaggccataaagtccccacctggtttcagtgcaaaagggttgggccacccccccagctcgccgctgctaaaaaagacgcctttagctctggccggttccccaactccgaagaaccctgaggataaatctccccaactgtcgctcagtcctcgacctgcctccccgaaagcacaatggccccaatcagaggatgaggggcctctgaatcttaccctcgactcagatggcggtcgcgagcttgactgccagctgtgcggtgcatggtttgaaaccaggaagggactcagttcccacgcaagagctcacctgagacatctgggggtgtcggacccagacgctaaggggagtccaatagatgtgctgcacggtctgattcggagagacggggtgcagattcgcctccctcccaggcgcggggcattggctcaccctggtcggcctccccccactagcgccgctctctctctgctgcccccccccccgcctgccaaaaaagcaaagttgaaggctgccgggatggccagtccctggggaaaacaggacttaagcgctgccgccgcggccggcatattctgggcttctgacgttgagccttccccgctcaatctgtcttctggtccagaaccagcacgagacattcggtgtgagttctgtggggagttctttgagaacaggaaaggtttatcgagccatgcccgcagtcatcttcggcaaatgggcgtgaccgaatggtatgttaatggatctccaattgacaccctgagggaaatcctcaaaaggagaacgcagagccgtcctggcggacctcctaatcctcctggaccgagcccaaaggctctggctaagatgatgggtggggcagggccaggttccagccttgaagctcgatccccctcggatctgcacatctctccacttgcgaaaaaactgcctcctcctcctggctcaccattaggccatagtcccacagcgtccccaccccctacagcgcgcaagatgttcccaggactggcggccccatcgctgccaaagaagcttaagcctgaacagatcagagtcgaaatcaagagagagatgctccctggtgccctccacggcgagctccatccttctgagggcccctggggtgccccccgagaggatatgaccccactgaacctcagctccagggcagagcctgtgagagatatcagatgtgagttctgcggggagtttttcgaaaataggaagggcctgagtagccacgctaggtctcacctgcgccagatgggcgtgacggaatggtcagttaatggatcccccattgacacgctgagagaaatcctgaagaagaaaagtaaaccatgccttatcaaaaaagaaccacctgctggggacctcgcgcccgctctggctgaggatggcccgcctaccgtggcaccagggccggtgcaatctccattgccactgtccccactggccggccgccccggaaagccaggagccggaccagcacaggtgccccgggaactctcactgacgcctatcaccggtgccaaacctagcgccacgggctaccttggcagcgtagctgctaaaagaccgttgcaggaagaccgtctgctgccagctgaagtgaaggctaaaacgtacatccagaccgaactacccttcaaggctaaaaccttgcacgagaaaacatctcactcctccaccgaggcctgctgtgaactgtgcgggctctactttgagaatcgaaaagccttggcaagccacgctcgagcccacctgagacagttcggggtgactgagtggtgcgtcaatgggtccccaatcgagacgctatctgagtggataaaacaccgcccccagaaagttggcgcctaccggtcatacatccaaggcgggcgcccatttaccaagaaatttcggtctgcgggccatggccgggacagcgataagcgcccatctctcggcctggctccaggtggcttagcagtggtcggaagatccgccggcggtgagccagggcccgaagcggggcgtgcagccgatggtggagaacgtcccctagccgcctcacctcccggtaccgttaaagccgaggagcatcagcgacagaacattaacaaattcgaaagacgtcaggctcggcctccagacgcttctgcagccagagggggagaggacacaaacgatctccagcagaaactggaggaagtgagacagccaccaccccgcgtccggccggttccaagcttggtaccgcgccctccccagacaagcctggtaaaatttgtgggtaacatttacacactgaaatgtcgattttgtgaggtagagttccagggtccgctgagcattcaggaggagtgggttaggcatctccaaagacatatcttggaaatgaacttttcaaaggccgatccgcctcctgaagaatctcaggccccccaggcccagactgctgcagctgaagccccctag

SEQ ID NO: 21160 - DNA, 846 bp, Artificial Sequence
  Description of Artificial Sequence: Synthetic coding sequence
atggccagccggggccggcggcccgagcacggcggcccccccgagctcttttacgatgagacagaagcgaggaaatatgtccgaaactctcgtatgatcgacatccaaacacgaatggcagggcgagccctggagctgttatacttgcctgagaacaagccttgttatctgctcgacataggatgcggcactggactgagtggctcctacctgtcagacgagggccactactgggtagggctcgatattagccccgcaatgctggatgaggctgttgacagagagatcgagggcgatcttcttctgggggatatgggccagggtataccctttaaacccggaactttcgatggatgcatctctataagcgccgtccagtggctctgtaacgcgaataagaagagtgagaaccctgctaaaaggctctattgcttttttgcttctctttttagcgtgttagtgagggggtctcgcgccgtcctccagctttatcccgagaattctgaacagttggaactaataacaacacaggccacgaaggctggcttctccggtggaatggtggtggactacccaaactcggccaaggcaaagaagttctatttgtgcctcttctctgggcctagtacgttcataccagaggggttgagcgagaatcaagacgaggtcgaaccccgggagtcagtgttcactaatgagcggtttcccctcagaatgtcccggagaggtatggtgcgaaaatcacgcgcttgggtgctcgaaaagaaagagcggcacaggcgccagggaagggaggtacgaccagacacccaatatacagggcgaaaacgtaagcccagattttag

SEQ ID NO: 21161 - DNA, 372 bp, Artificial Sequence
  Description of Artificial Sequence: Synthetic coding sequence
atggccgacccccagagctgcttcatgacccggcagaagcccggcaacacatttgcaagcgaaggcagtctgaataccgccggccgccctggagtgggaaaaagacaagttgctcctgtagcaggtgtagcccggaaaggacggaggatttggggcagcaggatgattgacatccagacgagaatggcgggccgagctttggaactactctatctgccagaaaataagccatgttatctgctcgacatcggttgcggaactggtctatccgggagctacctcagtgacgagggacattattgggtcggtctcgacatatccccagctatgttaggtcccggaattccaagctgccctgctgcagttccctag

SEQ ID NO: 21162 - DNA, 897 bp, Artificial Sequence
  Description of Artificial Sequence: Synthetic coding sequence
atggccagccggggccggcggcccgagcacggcggcccccccgagctgttctacgacgaaacagaggccaggaagtacgtccggaactccagaatgattgatattcaaaccaggatggcaggcagagctctcgaacttctctatctccccgaaaacaagccttgttacctgctcgacatcggttgcgggactggactctcaggcagttatcttagtgatgaggggcattactgggttggtctggacatctcccctgccatgctggacgaagctgtggacagggaaattgagggcgatcttctgctaggagatatgggtcagggtataccctttaagcctggcacattcgacgggtgcatttccatctccgcagttcaatggctttgcaatgccaataaaaagtccgagaaccctgcgaagcgtctatattgtttcttcgcatctttgttttccgtcctggtgagaggatctcgggccgtgttgcaactctatcccgagaactctgaacagctggagctaattacaacacaggccacaaaagccggcttcagcggtggtatggtggtggattaccctaatagcgctaaagcgaaaaagttctacctctgtctgttctccggtcctagtacctttatcccagagggcctgtcagagaaccaggacgaggtcgaaccacgtgagagcgtgtttactaatgagcgggagggcggcgcatttgagcggcggggcatccgcggccaccagacacggagatttcccctgaggatgagccgccgggggatggtccggaagagccgagcctgggtgcttgagaagaaagagaggcatcgacgacagggccgggaggtccggccggacacccagtatactgggcgcaagcgcaagccaagattctag

SEQ ID NO: 21163 - DNA, 1131 bp, Artificial Sequence
  Description of Artificial Sequence: Synthetic coding sequence
atggccgactactggaagagccagcccaagaagttctgcgactactgcaagtgttggatcgctgacaatcgcccatccgtagaattccacgagcgtgggaagaatcataaggagaacgttgccaagagaatttcagaaatcaagcagaagtcactggataaggcaaaggaagaggagaaggcttcgaaggaattcgccgccatggaagccgctgctctcaaggcctatcaggaagacctaaagaggcttggcttggaatcagaaatactcgaaccgagtataacaccagtgacgtctaccattccgcctaccagtacgtccaaccaacagaaggaaaagaaggagaagaaaaaacggaaaaaagaccctagtaaaggccgttgggtcgagggaattactagcgaagggtaccactactactatgacctcattagcggggcttcacagtgggaaaagcccgaaggcttccagggcgatctgaaaaagactgccgttaagaccgtctgggtcgaaggcctctctgaagacgggtttacctactattacaacaccgagaccggagagagccgctgggaaaagcccgacgatttcattccgcataccagtgacctgccgtccagtaaagtgaacgagaactccctaggtactcttgatgaaagtaaatcatcagatagtcactccgacagcgatggggaacaggaggcagaggagggaggagttagcaccgagaccgagaaacctaaaataaagttcaaagagaagaacaagaattccgacggggggtcagatccagagacacagaaggaaaaatctatccagaaacagaattcgttggggtcaaatgaagaaaagagtaaaactcttaaaaagagtaacccatatggtgaatggcaggagatcaaacaggaggtggagagtcacgaagaagtagatctcgagctgccctccaccgagaatgagtacgtatcgacgagcgaggccgatggcgggggggaacccaaagttgtgttcaaggaaaagacagtaacctccctcggggtgatggctgacggtgtcgcgcccgtcttcaagaagaggagaaccgagaacggcaagtcaagaaacctgagacagcgcggagacgatcagtag

SEQ ID NO: 21164 - DNA, 1068 bp, Artificial Sequence
  Description of Artificial Sequence: Synthetic coding sequence
atggccgactactggaagagccagcccaagaagttctgcgactactgcaagtgctggattgccgataatcgcccaatcaaacagaaatccctcgacaaggcaaaggaggaagagaaggcgagtaaggagttcgcggcaatggaagcagccgcactaaaagcttaccaggaggatctcaagaggctcggtctggagtccgagattctggaaccatccataacacctgtcacatctacaataccaccaaccagcacaagcaaccagcaaaaggagaaaaaagagaaaaagaagagaaagaaggacccttccaagggccggtgggtggagggcatcacttctgaggggtaccactactattatgatctgataagtggagcctcccaatgggaaaaaccggagggttttcagggcgacttaaagaaaactgctgttaaaacagtatgggtggagggtctgtctgaagatggctttacctactactataatacggaaacaggcgaatcaagatgggagaagccagacgacttcatcccccacacctcagaccttccgagctccaaagtgaacgagaattccttggggactttggatgaatccaaatctagtgattcacattcagactcagatggggagcaggaggcagaagaaggtggtgtaagcacagagacggagaaacccaagattaaattcaaggaaaagaacaagaacagtgacggaggctcggaccccgaaactcagaaggagaagtccattcagaagcagaattcccttggatcaaatgaagaaaagagcaagacattgaagaagagtaatccgtatggggaatggcaggagattaaacaggaggtcgaatcccatgaggaggtggacctcgagctgccatcaaccgaaaatgagtacgtgtccaccagcgaagctgatgggggaggagagcctaaggtggtgtttaaggaaaagacagtaaccagcctgggggtgatggccgatggcgtggccccagtcttcaaaaagcgtcgtacggaaaacggtaagagcaggaacctgcgacagcggggagatgaccagtag

SEQ ID NO: 21165 - DNA, 354 bp, Artificial Sequence
  Description of Artificial Sequence: Synthetic coding sequence
atgagcctgaccagcgacgccagcagcccccggagctacgtgagcccgcgaatctccaccccacagaccaacacagtgcccattaagcctcttatcagtacacctccggtctcctcacagcccaaggtttccacccccgtagtaaagcagggaccggtgagccaatcagcgacacagcaacctgttactgcggacaagtccaaggtaatgaacctgtccctcctggaagtcttcagcgcgcaggtcgccagggaagtgcaccatctagttcctatcatacttctcattgtggtcatgcatcagatgcagcagctctaccacaggatccttctacctgaccctagagtccattag

SEQ ID NO: 21166 - DNA, 1635 bp, Artificial Sequence
  Description of Artificial Sequence: Synthetic coding sequence
atggtgatgtacgcccggaagcagcagcggctgagcgacggctgccatgatcggcggggcgactcacaaccctatcaggctttgaagtactcatccaagagccacccttcgtctggtgatcaccgccacgagaagatgcgagacgcaggtgacccttcaccacccaacaagatgctgaggcgaagtgactcacctgaaaacaagtacagtgactccacggggcacagcaaggcgaagaatgtgcatacgcatcgtgtcagagaaagggacggcggaacctcttattccccacaagagaattctcataatcattccgccctgcacagctccaacagtcactcttctaatccctcaaacaatccctctaaaacaagtgacgctccatacgattccgctgatgactggtcagaacatattagttcctcaggtaaaaagtactactataactgtcgaacagaagtgtcccaatgggaaaaaccgaaggagtggctggagcgggagcagagacagaaagaggccaataagatggctgtcaatagtttccctaaagatcgagattaccggcgtgaagttatgcaggccaccgcgacctccgggttcgccagtggcaagtccaccagtggggacaagcctgtgagccattcatgcaccactcccagcaccagtagcgcaagcggcctgaaccccacttcagccccacccacttccgcctccgccgtaccggtgagcccagtaccacaatcacccattcctccactcctccaagaccccaatctgctgaggcagctcctgccagccctgcaggcgactttacaactgaacaattcaaacgtggacattagcaagatcaatgaggtcctgaccgctgcggtcacacaggcttcacttcagtctataattcacaaatttctgacagctggcccaagtgccttcaatattacatcattgatatcccaggccgctcagttgtcaacgcaggctcaaccatcaaaccagtcacccatgtcactgactagcgatgccagcagcccacgcagctatgtgtccccaagaattagtacccctcagacaaacaccgtaccgattaaaccgctgatctcgactccaccggtatcctctcaacccaaggtgtccaccccagtagtgaaacagggccctgtctcacagtcagccacacaacagcctgtgacagccgataagcaacagggacacgaacctgtatcaccacggtcgctacagcggagtagctcacagaggtctcctagtccaggacccaatcatacctccaacagctcgaatgcttccaatgctactgtggtgccacaaaactcatcagcccgctccacctgtagccttacaccggccttagcggctcatttctccgaaaatcttattaagcacgtccaaggctggcctgccgaccatgcggagaaacaagccagccggctgcgagaggaagcacacaatatgggtacaatccacatgagcgagatttgcactgaactcaagaaccttaggtctctcgtgcgcgtgtgcgagatccaggcaaccttacgcgagcagcgtatcctcttcctgcggcagcagatcaaagagttggaaaagctgaaaaaccagaacagtttcatggtatag

SEQ ID NO: 21167 - DNA, 1944 bp, Artificial Sequence
  Description of Artificial Sequence: Synthetic coding sequence
atggtgatgtacgcccggaagcagcagcggctgagcgacggctgccacgatagaagaggagatagtcaaccgtaccaagcgctgaaatattcctctaaaagtcacccctccagcggcgaccatcgccacgaaaagatgcgtgacgctggagatccttccccccctaacaagatgttgcggagaagtgactcccccgaaaataagtactctgacagtaccggtcattccaaagcaaagaatgtgcacacccacagagtgagagagcgagacggtggtacatcctactccccccaggagaattctcacaaccattcggctctgcacagctcaaatagccattctagcaacccctccaataatcctagtaagacttccgacgctccatatgattccgcagacgattggagcgagcatatcagcagctccggtaaaaaatattactacaattgtaggactgaggtgtcccagtgggaaaagccaaaagaatggctggagcgggagcagcggcagaaggaagcgaataagatggccgtgaactccttccccaaggatagagattatcgcagggaggtaatgcaggctaccgctaccagcggcttcgcgtctggaatggaggataagcatagttctgacgctagctcattgctcccacaaaacattctgagccagactagccggcacaatgaccgggactatcgactgccccgggctgaaactcactcaagcagtacaccagttcagcacccgataaaacctgttgtgcatcccaccgctacccccagcaccgtaccaagctctcccttcacgctgcagagcgaccatcagccaaaaaagagcttcgacgccaacggggccagcacactgtccaaactcccaactcccacatcaagcgttcctgcacagaagaccgagagaaaagagtctacctcaggtgacaagccagtaagccacagctgcaccaccccgtctacatcttccgcctctgggctgaatccgacatcagctccacctacaagcgcctcagcggtgccagtgagcccagtgccccaatccccaatcccccccttgctgcaagatcccaaccttctacgccagctacttcccgccctgcaggccacactccagctgaataattctaacgttgacatcagcaagattaacgaggtgttgaccgccgcagtcacccaggcctccttgcagagcataatacacaagtttttaactgccggaccatcagcatttaatatcacctccctgatatcacaggcagctcagcttagcacacaggcccagccttctaatcaatctcctatgtcgcttacatctgatgcttcgagcccacgtagctacgtgtccccacgtatcagcaccccacagaccaacacagttcccattaagcctctgatctctactccacccgtcagctcccagcccaaggtttccacccccgtggttaagcagggtcctgtgagccagtcagctacccagcagcctgttaccgctgataagcagcagggccacgagcctgtaagcccccggtccctgcagcgaagtagctcacagcgctccccctcacccggccctaaccacacttcaaacagcagcaatgcatctaacgctaccgtcgtcccccaaaattccagcgcccgctctacttgctctctgactccagctttggccgctcattttagcgaaaaccttatcaaacacgtccagggatggcctgcggaccacgccgaaaaacaagcaagtagactccgcgaggaggctcacaatatgggtacgatacatatgagcgaaatctgtaccgaactgaaaaatcttcggtctcttgtgcgtgtgtgtgagatccaagctaccctgcgggaacaacgaatcctgttcctgcgccagcagatcaaagagttggaaaagctcaaaaaccaaaattcattcatggtctag

SEQ ID NO: 21168 - DNA, 1809 bp, Artificial Sequence
  Description of Artificial Sequence: Synthetic coding sequence
atgcgggacgccggcgaccccagcccccccaacaagatgctgcggcggtccgattcccccgagaataaatatagtgattctactggccacagcaaggcgaagaacgtgcacacccaccgggtgagggaacgagacggtggcacatcctacagcccccaggagaattctcacaatcatagtgccctgcattccagcaattctcattcttcaaacccatccaacaatccgtctaaaacgtccgacgctccgtacgacagtgccgatgactggtctgaacacatctcttcgagcggaaaaaaatattactacaattgtagaactgaagtgtctcagtgggagaaaccaaaggaatggctggagagggagcagcgtcagaaagaagccaacaaaatggctgtcaatagttttccaaaagaccgtgactacagaagggaggtgatgcaagcaaccgccacatctggctttgccagtggaatggaagacaagcacagctcagatgcctcgtccttgctaccccagaacatcctgtctcagacgagccgacataacgacagagattacaggttaccacgcgcggagacccattccagctctacacctgtccagcaccctataaagcctgttgttcacccaacagctacaccttcaactgtgcctagctcacccttcaccctgcagagtgaccaccagccaaagaaatctttcgatgctaatggggcttctaccttgtctaagctccctacccctacaagctcagtgcccgcccagaagacggagcgtaaagaaagcaccagcggcgacaaacctgtgtcccactcatgcaccacaccaagtaccagctctgcttcaggactgaacccaacttctgcgccaccaaccagcgcctcagcagtgccagtgagtcccgtgccgcagtctcccattccaccgctattgcaggatcccaatctgcttcgccagcttttgcctgcgttacaagctaccctgcagttaaacaacagcaatgtcgatatctcaaagattaacgaggtgcttaccgctgcggtcacgcaggcctcgttgcagtccatcatccacaaattcttaaccgccggtccgtctgctttcaatatcacttccttaatcagccaggctgcacagctgagcacgcaggcccagccctccaatcagtctcctatgtcccttacgtccgacgcttcgagtccgcggtcatacgtctctcccagaatttctacaccgcaaacaaataccgttccaatcaagcctctcatcagcactccaccagtcagcagccaacccaaagtatccacaccagtcgtcaagcaagggcctgtaagccagtccgctactcagcagccagttacggccgacaagcagcaaggtcacgagcccgtatctccacgctcactgcaaaggtcttcaagtcagcgtagtccctctccagggcccaatcacaccagtaatagctccaatgctagcaatgctacagtggtgcctcagaactccagcgcgcgtagcacatgtagcctgactcccgccctggccgcccatttcagcgagaacctcataaagcacgtgcagggctggcctgcagaccatgcggagaagcaggcatctagactgagagaggaagcccataacatgggcacaattcacatgagcgaaatttgtaccgaattaaagaaccttagaagcttggttcgcgtgtgcgaaattcaggctacgctacgcgaacagcggattctgttcctccggcagcagatcaaggagcttgagaaattgaaaaatcaaaactctttcatggtctag

SEQ ID NO: 21169 - DNA, 702 bp, Artificial Sequence
  Description of Artificial Sequence: Synthetic coding sequence
atgcgggacgccggcgaccccagcccccccaacaagatgctgcggaggtctgactcaccagaaaacaagtattccgattccacgggtcactccaaggccaagaacgtacacacacaccgcgtcagagaacgggatggtgggacgtcatattctccacaagagaatagccacaatcactcggcgctacattcatccaattcccactcctcgaaccctagtaataaccctagtaaaacatctgacgcgccatatgattctgctgatgattggagcgaacacatttcatcctcagggaagaagtattactacaattgtagaactgaggtatctcagtgggagaaaccgaaggagtggctggagcgggaacagaggcagaaagaggccaacaagatggccgtgaactcttttccaaaagaccgggactaccgccgcgaggtgatgcaggctaccgcaaccagtggctttgcgagtggtatggaagataaacactcatctgatgctagctcactgttaccccagaacatactttctcaaacaagcagacacaatgatagagactaccggctgccacgcgcagaaacgcattcatcatctactcccgttcagcacccaattaagcccgtagtacatcccacggcaacaccttctactgtgccttccagcccctttaccttgcagtcagatcaccagcccaagaagtag

SEQ ID NO: 21170 - DNA, 615 bp, Artificial Sequence
  Description of Artificial Sequence: Synthetic coding sequence
atgcgggacgccggcgaccccagcccccccaacaagatgctgcggcgcagtgatagccctgagaacaagtatagtgatagtacaggacactccaaagcgaaaaacgtccatacccaccgagtgagggaacgcgacgggggcacctcctacagtcctcaggagaattcacataatcactcggccttgcactcctcaaactcacacagctccaacccctctaataacccttccaagacttccgatgccccatacgactctgctgacgactggtcagaacacatatcaagcagcgggaagaaatattactacaattgcaggactgaggtcagtcaatgggaaaaaccgaaagagtggctcgaaagggagcagagacagaaggaagcaaacaagatggccgtcaattcatttcccaaagacagggactatagacgggaagtgatgcaggctaccgctacctccggtttcgcctccgggatggaggataagcacagttcagatgcttcctcattgctgccccaaaatatactgtcccagacgagtagacacaacgatcgcgactatcggctgcctagagcagagactcactcaagctccaccccggttcagcacccatag

SEQ ID NO: 21171 - DNA, 1044 bp, Artificial Sequence
  Description of Artificial Sequence: Synthetic coding sequence
atgcgggacgccggcgaccccagcccccccaacaagatgctgcggcggagcgactcaccagaaaataaatactctgactctaccggtcactcgaaagccaagaatgtgcatacccacagagtgagggaaagagacggggggacgagctactctccccaggagaactctcataatcattccgccctgcattccagcaattcacattcctctaacccctctaacaacccatcgaagacaagtgacgcaccatatgatagcgcagatgactggtcagagcacataagctcatccgggaagaagtactactacaattgtagaacagaggtgtctcagtgggagaagcctaaagaatggctcgaacgagagcagaggcagaaggaggccaacaagatggcggtgaactctttccctaaggatagggactatcggagggaggtgatgcaggctactgccaccagtggatttgcaagtgggatggaagacaaacacagtagtgatgcctccagcctactgccccagaacatccttagccagaccagtcggcataatgatcgagactacagactcccccgtgctgaaacccactcatcttccactcccgtgcagcaccccattaaaccggttgtgcatcccacagctaccccgagtactgtcccgagtagtccttttacattgcagagtgaccaccagccaaagaagagcttcgacgcaaacggcgcgtccactctgagcaagcttcctacccctacgtcctcagtgcccgcgcagaagactgagaggaaggaatcaacctccggtgataagccagtgtcacactcttgtactactccttcaaccagttccgcttccggactcaatccaacatcagctcctcctacctcggcttccgcagtaccagtctctcccgtcccgcaatctcctatcccccccttgctgcaagaccctaaccttctgagacagctgcttcccgctctccaagcaactctgcagctaaataattcgaacgtagacatcagtaaaataaacgaggttctcactgcatag

SEQ ID NO: 21172 - DNA, 1311 bp, Artificial Sequence
  Description of Artificial Sequence: Synthetic coding sequence
atgcgggacgccggcgaccccagcccccccaacaagatgctgcggcgcagcgattcacccgaaaataagtatagtgactccacaggacacagtaaagccaagaacgtgcacacacaccgagttcgagagagggacgggggtacctcctactctccacaagagaattctcacaaccatagcgcactgcattctagcaacagtcatagcagcaatccatcaaataatccaagtaaaacctccgacgcaccttatgactcggcagacgactggtctgaacacatttcttcatcgggcaagaaatactactacaactgcaggacagaggtgtcacagtgggagaaaccaaaagaatggctcgaacgagagcagaggcagaaggaggcaaacaagatggccgtcaatagcttccctaaggacagggattatcgacgcgaagttatgcaagccacagctaccagcgggtttgcctccggaatggaggataaacacagctctgacgccagctctctgttgcctcaaaatatcctctcccagacttcacgacataacgatagagattaccgcctcccccgggctgagactcacagctctagcactcccgtgcagcatcccattaagcctgtggtgcatcctactgcaacaccctcaactgtccctagcagccccttcacactgcagtctgatcatcagcccaagaagtcattcgacgcaaatggggcaagcaccctttctaaattaccaactcctacctcgagcgtgcccgcccaaaagaccgaacgtaaagaatctacttcaggtgacaagcctgtttcccatagttgcaccaccccaagcacttccagcgcatccggcttgaatcccacatctgcacctccaactagcgcctccgccgttccggtgagtccagttccacagtcccctattcctccccttctgcaggatcctaaccttctgcgccagttgctgcctgctctgcaggccacactgcagttgaacaatagtaacgtggacatttcaaaaattaacgaagtgctgacagcagcagtaacacaagcttcactccagtcgatcattcacaagttcttgactgccggaccaagtgctttcaatatcactagtctaataagccaggctgcgcagctgtcaacacaggacataccactgcacgagggaattcagatggaacgggatacacacaggagtaagtgggaggtaaaaggctctctgtgtcaaaaagcagataaacagcaggagtgtctggtttggaacgggtctatcatggttcagcggctgctgcagcccagcgggtag

SEQ ID NO: 21173 - DNA, 522 bp, Artificial Sequence
  Description of Artificial Sequence: Synthetic coding sequence
atgcgggacgccggcgaccccagcccccccaacaagatgctgcggcggagcgactctccagaaaacaagtactccgactccactggtcactcgaaagctaagaacgttcatactcatagagttagagaacgcgatggcggcacttcttattctccacaggagaacagccataaccacagtgcgctgcactccagtaacagccattcatctaatccaagtaataatccttctaaaacctcagacgcgccttacgacagtgccgatgattggtcagagcacatatcaagctccgggaaaaaatattattacaattgtcgcaccgaagtgtctcagtgggaaaaaccaaaggagtggctagaacgtgagcaacgccagaaggaggccaacaaaatggccgtaaattccttccccaaagaccgtgattaccgccgcgaggtaatgcaggcaacagccaccagtggcttcgcttcaggaatggaagacaagcacagcagcgacgcatctagtctacttcctcagtag

SEQ ID NO: 21174 - DNA, 180 bp, Artificial Sequence
  Description of Artificial Sequence: Synthetic coding sequence
atgcgggacgccggcgaccccagcccccccaacaagatgctgcggcgctccgactcacccgagaataagtattctgactccacagggcattctaaggccaagaatgtgcatacacatcgggtgcgagaaagagacggcggcacaagctattcgccacaggaaaactcccacaaccactag

SEQ ID NO: 21175 - DNA, 111 bp, Artificial Sequence
  Description of Artificial Sequence: Synthetic coding sequence
atgcgggacgccggcgaccccagcccccccaacaagatgctgcggcgttccgatagcccagaaaacaaatactctgatagtactggccattctaaggcaaaaaacgtttag

SEQ ID NO: 21176 - DNA, 906 bp, Artificial Sequence
  Description of Artificial Sequence: Synthetic coding sequence
atgcgggacgccggcgaccccagcccccccaacaagatgctgcggcggagcgacagtcccgagaataaatatagcgatagcaccggacattccaaagctaagaatgtgcatacacacagagttcgcgagcgagatggcggtacttcctattcccctcaggagaactcccataaccactctgccctccactcaagtaattcacattcaagtaatcccagcaacaatccatccaagacatccgacgccccctacgactcggccgatgattggagcgagcatatttcttcatctgggaagaagtactactacaattgtcgaactgaggtgagccagtgggaaaagcctaaagagtggttggagcgagagcagcgccaaaaggaagccaacaaaatggctgttaacagtttcccgaaggatagggactataggcgcgaagtgatgcaggccaccgctacatctgggtttgccagcggcatggaggacaagcactcctctgatgccagcagtctgttgccccagaacattctgtctcagacctccagacataatgaccgggactaccgactgccccgcgccgaaacgcactctagtagtacacctgtgcagcaccccattaagcctgtggtccatcccaccgcaaccccatcaaccgtgcctagctcacctttcaccctgcagtccgaccaccaacccaagaaaagctttgatgccaatggcgcctccaccctctccaagctccctactcctacttcttcagtccccgcacagaaaacggaaagaaaagagagcacgtctggagataagcccgtttcccacagttgtaccacgcccagcacaagctccgcaagcggattgaatccaacttcggctccccccaccagcgcttccggacccaaatcatcgtag

SEQ ID NO: 21177 - DNA, 5469 bp, Artificial Sequence
  Description of Artificial Sequence: Synthetic coding sequence
atgtaccccaactggggccggtacggcggcagcagccactaccccccaccaccggttccacctccgccccctgtggcgcttcccgaggcgagtccagggcctggatattcttcaagtactacacctgccgccccatcgtcttccggttttatgagctttagggagcaacacctcgcacagctgcagcagttgcaacagatgcatcaaaaacagatgcagtgtgttcttcagcctcaccaccttccccctccccctcttcctcctcctcccgtcatgccagggggaggctatggcgattggcagcccccgccgccacctatgccaccccctccaggccctgcactcagctaccagaaacagcagcagtacaagcatcagatgctgcaccaccagcgtgacggaccaccaggcctggtccccatggaactcgagagtccccctgaatctcccccagtgccaccaggatcctacatgccaccatcacagagttacatgcctcctcctcagccaccaccgagctactatccaccgactagttcacagccctacctgcctccagctcagccaagccccagccagagtcctccttcccagtcctacctggccccaaccccatcatactctagttcttcatcgtctagccaaagctatcttagtcacagtcagtcctatctgccgtctagccaagcatctccctccaggccctcacagggtcattccaagtcccagctccttgcacctcctccccccagcgcacccccagggaataagaccacagtgcagcaggagccgcttgagagtggtgctaaaaacaaaagcacagaacagcaacaggcagctccagaaccggatccctcaaccatgacaccccaggagcaacagcagtactggtataggcagcacctgctgtctctgcagcagcgcaccaaagtccacctccctggacataagaaggggcccgtcgttgccaaagacacacctgagccagtgaaggaagaagtgacagtaccagccacctcccaggtgccagagagcccctccagcgaggaacctccattgcctccgcccaacgaagaagtgcctccccccctgcctcccgaagaaccccaatctgaggatcctgaggaggacgctaggctgaaacagcttcaggccgccgccgcacattggcagcagcaccaacagcaccgggtggggtttcagtatcagggtataatgcaaaagcacacccaactacagcagatactgcaacagtaccagcagattattcagcccccacctcacatacaggccacgactcccccaccaggcatcccacccccaggtgttcctcagggaatcccccctcagctgactgcagctccagtaccgccagcatcctccagccagtcctcccaggtacccgagaagcctcgtcccgccctgctgcccacaccggttagcttcggttccgcaccacctacaacttatcacccgcctctccagagcgcagggccttcagagcaagtgaattcaaaggcacccctgtctaaatccgcgctcccttattccagcttcagctcagaccagggactgggggagtcctctgcggccccttcccagcctatcacagccgttaaagatatgccagttagatcgggcggactgctgcccgacccccccagaagttcatacctggagtcccctaggggtcctaggttcgatggacctcgccgatttgaagatctgggatcccggtgcgaaggcccgaggccgaaaggtcctcgattcgagggcaacaggcccgatgggcccaggcctaggtacgaggggcatccagccgagggcacgaagagtaagtgggggatgatccctcgcggacctgcatcccagttctatataactccctccacgtctctcagccctcgacagagcggcccacaatggaaaggcccaaaacccgcattcggtcagcagcaccagcagcagccaaaatctcaggccgaacccttgagcggaaataaagaacccctggccgatacttcctctaaccagcagaaaaattttaagatgcagagcgccgcgttctctattgcagcggacgtgaaagacgttaaagcagcacagtcaaatgaaaacctgagcgacagtcagcaggaaccccctaaaagcgaagtgtctgaaggccctgtggaaccatctaattgggatcagaatgtccagtcaatggagacccagattgacaaggcacaggccgtcacccaacccgtcccactcgctaacaagcccgtcccagctcagtctacttttccgagtaaaacaggaggaatggagggagggactgcagtggcaacctcctcgctgacagctgataatgactttaaaccagtggggatcggattgcctcactccgaaaataatcaggataaggggctccccaggcctgacaacagggataatagactggagggcaacagagggaacagttcgagctaccgcgggcctggccagagcaggatggaggacacacgcgacaaaggtctggtcaatcgtggccgcggtcaggccatctcccgggggcccggtctggtgaagcaggaggattttcgggacaaaatgatgggaagacgagaggactcccgcgaaaagatgaacagaggagaaggatcacgggaccggggcctggtgcgcccgggttcttcaagggaaaaagtccccggcggccttcaaggctcacaggacaggggggcagcaggcagccgggaaagggggcctcctagaagagccggaagccaggagagggggcctctgcggagggcaggatcacgtgagaggataccacctaggagggccggctccagagagcggggccccccgcgcggtcctgggagtagagaacgcggtctggggcgcagtgactttggcagagacaggggaccctttcggcctgaacctggcgatggaggtgagaaaatgtatccataccaccgggacgagcctccaagggcaccttggaatcacggcgaagagcggggccatgaggagtttccattggatggcagaaacgcccctatggagcgggagcgactggacgattgggatcgggagagatactggcgcgagtgcgagcgggactatcaggatgacacgctcgaactatataaccgtgaggatcgtttcagtgctccaccaagccgttcacacgacggagaccggagaggcccctggtgggacgactgggaacgggaccaagatatggatgaggactataatcgcgagatggagcgcgacatggatcgcgatgtcgatcggattagccgccccatggacatgtatgacagatcacttgataatgagtgggatagagactatggacggcccctggatgagcaggagagtcagttccgggagcgagacatcccaagtctgccacccctgccaccactgcctcccctccctccactggaccgatatagagacgataggtggcgggaagaacgaaacagggagcatgggtacgacagagactttcgggacagaggcgaattaagaataagagaatatccagaacggggagatacatggcgcgaaaaacgtgattatgtgcctgacagaatggactgggagcgggagcggctctcagacaggtggtatccatctgacgtagatagacacagccctatggcggaacatatgcctagctcccatcactcctcggagatgatgggaagtgacgcttccctcgattctgatcaagggctcgggggcgtgatggttttatcccagaggcagcatgagatcatactcaaggccgcgcaggagctgaagatgttacgagaacagaaagaacagttgcaaaaaatgaaagatttcgggtctgaaccacagatggctgatcatctgccccctcaggaatccagactccagaatacatctagcaggcctggcatgtaccctcctcctgggtcctaccgtccaccaccaccaatggggaagcctcctggcagcatagtgcggccctccgctccaccagcccgcagcagtgtccccgtcacacgacccccagttcccattccgccccccccccccccccctcctctccctcctcccccgcccgtgatcaagcctcagacatccgccgtagagcaggagcgctgggatgaggattctttttatgggctgtgggatactaatgatgagcaagggcttaacagcgagttcaaatctgaaacagcggcaatcccttctgctccagtgctcccccccccccccgtccattctagcataccgccaccaggtcctgtccccatggggatgcctcccatgagcaaacctccacctgtgcagcagaccgtggactacggtcatggccgggacatttcaaccaacaaggtcgagcaaatcccttatggcgagcggatcaccctgaggcccgaccctctccccgaaaggtccacgttcgagaccgagcacgctgggcagagagaccggtatgatcgggaacgcgatcgagaaccttactttgaccggcagagcaacgtcatagccgaccatagagacttcaagagggaccgggagactcatcgggaccgggaccgggaccgcggtgtcatcgattacgacagagacaggtttgatcgcgagcgacgcccccgtgacgatagagctcagtcataccgtgataaaaaagatcatagttccagtcggcgcggaggattcgatcgaccaagttacgaccggaaaagcgacaggccagtttatgagggtcctagtatgtttgggggagaacgacgaacgtatcccgaagaacggatgcccctgcctgccccatcactgtcacaccaacccccacccgccccccgcgttgagaaaaagccagaaagcaagaatgtggacgacatcctgaagccacctggtagagagtcaaggcccgagcgtatcgtggttatcatgcggggactgccggggtccgggaaaactcacgttgccaaactgatccgagtgatggagtacgagtacgaggcagaaatggaggaaacataccggacctccatgtttaaaacatttaagaaaacactggacgatggcttcttcccttttattatcctggacgctattaatgatcgagtgaggcatttcgatcagttctggtctgccgctaagaccaaaggctttgaagtatatttagcagagatgagtgccgacaatcagacttgtggtaaacgaaacatccacggacgcaagctgaaggaaatcaacaaaatggctgatcattgggagaccgctcccagacatatgatgcgcctggacatcagaagcctacttcaggacgctgctatcgaagaggtggagatggaggacttcgacgcaaatattgaggagcaaaaggaggagaagaaggacgccgaagaggaggagagtgagctggtgggggatcggcccaccacacttaattcagtgtcattactgaaattcttaaaaaaggtttag

SEQ ID NO: 21178 - DNA, 6441 bp, Artificial Sequence
  Description of Artificial Sequence: Synthetic coding sequence
atgtaccccaactggggccggtacggcggcagcagccactacccccctccccccgtcccccccccccccccagtggcactgccggaagcatcccccggcccaggctacagctcatcaacaacacccgcagctcctagttcctcaggattcatgtctttcagggaacaacatctcgctcagctgcaacagttgcaacagatgcaccagaagcagatgcagtgcgtgctgcagccacatcacctgccccctccacctctgccccctcctcccgttatgcccggcggcggatacggcgattggcaacctccacctccacccatgccgcccccgcccggccccgccctgtcctaccagaagcaacaacagtacaagcatcagatgctacaccatcagcgagacggcccccctggcctcgtcccaatggagctggaaagcccacctgagagccccccagtgccgccgggctcttacatgccaccctcacaatcctatatgcctccaccacaacctcctcctagctactaccctcctacctcatcccagccgtacctgccacctgcccaaccctcaccgtctcagtcacctccgtcgcagagttacctcgcgccgacgccttcttattcaagtagctcctcaagtagtcagagctatctttcacactcacagtcctacctgcctagctctcaagctagcccttcccggccctctcaggggcatagcaagtctcagttgctggctcccccgcccccctcggcgccaccgggaaacaagacaacagtccaacaggaaccgctcgagtcgggagctaaaaacaaaagcactgagcagcaacaggccgctcctgagccagaccctagcaccatgacaccacaagagcagcagcaatactggtacagacagcacctcttgtccctccaacagcgtactaaggtgcacctgcccggccataaaaagggtccggtggtggcaaaagatacacctgagcctgttaaggaagaggttaccgtgccagctacctctcaagttcctgagagtccttcgtccgaagaaccacccctgcccccacccaacgaggaagtgccccctccattaccaccagaggagccacaatctgaggatcctgaagaagatgcccgactgaagcagttacaagctgctgccgcccattggcaacaacatcagcaacaccgagttggcttccagtaccagggtataatgcaaaagcatacccaattgcagcagatcttgcagcagtaccagcagattatccagcccccaccacacatccagaccatgtcagtggacatgcagctcagacattatgaaatgcagcaacaacagttccaacacttgtatcaagaatgggaaagagaatttcagctatgggaggaacagctccatagctacccgcacaaagatcagctacaggagtacgagaaacagtggaagacgtggcagggccatatgaaggcgactcagtcctacctgcaggagaaggtgaactcttttcagaatatgaagaatcagtacatgggcaatatgagcatgcctccacccttcgtgccctacagccagatgcctcctccactgccaacaatgcctccaccagtcctgccccctagcctcccacctccggtgatgcctccggcactcccggccacagttcccccaccaggcatgcctcctcctgtgatgcccccatctctgcctacgtcagttcctcctcctggaatgcctccttcactgagcagcgcgggcccgccccccgtactgccgccgccctccctaagttccgccggcccgcctcctgtgttaccacctccatcccttagttcgaccgcacctcctcccgtgatgcctctgcctcccctgagcagtgccaccccccctccaggaattccccctcccggagtcccccaaggaattcctccacaactgactgccgcacctgtccctcctgccagtagctctcaaagctctcaagtcccagagaaacctcgccctgctctgctgcccactccagtgtccttcggtagtgctccccctaccacatatcacccaccactgcagagcgccggacctagcgaacaggtgaacagtaaagcccccctgtcaaaaagtgccctgccatactccagctttagctcagaccagggtcttggtgagagcagtgccgcccctagccaacccattactgccgtcaaggatatgccagtgcggtcaggaggattacttccagaccccccccgctccagttacctcgagagccctcgcggaccgaggtttgacgggcctagacgatttgaggacctgggatcaagatgcgaaggcccacggccgaaagggcctagattcgaaggcaaccggccagatggcccacgacctcgctatgaaggccatcccgccgaggggacaaagtcaaaatggggaatgattcctcggggtccggcatcccagttttacatcacaccctccacatccctttccccaagacagagcgggccccagtggaagggcccaaagcccgcatttggacagcaacaccagcagcagcccaagagtcaggcggagccactttccggcaataaagagccactggccgatacatcctcaaatcagcaaaaaaacttcaagatgcagtcagctgctttctccatcgcggcagatgtcaaagatgtcaaggccgcccaatccaatgagaacttgagtgattcccaacaggagcctccaaaaagcgaggtctcagaaggccccgtagaaccttccaactgggatcagaacgtccagagcatggagacccagatcgataaagctcaggcggtcacacagccagtcccgctggctaacaagccagtgccagctcaaagcacctttccatctaagacaggtgggatggaaggcggtactgctgttgccacctcctccctgacagccgacaacgactttaagcctgtgggaattggcctgccccacagcgagaataatcaagacaaggggctcccccgccctgataatcgtgataataggctagaggggaacaggggtaactcttcatcatataggggccccggtcagtcaagaatggaagacacccgggataaaggcttagtcaacagaggtagaggccaggccatctcacgcggacccggccttgtaaaacaggaagatttccgggataaaatgatgggacggcgcgaggactcaagagagaagatgaatcgcggtgagggatctagggataggggattggtgcggcccggctcaagcagggaaaaagtgccgggggggctgcaaggaagccaggaccgtggagccgctggatccagagagcggggaccaccccggcgcgccgggagccaggaacgcgggccactgagacgggcaggcagcagagagcgcatcccccctcgccgggcaggcagccgcgaacgaggtcccccccggggaccgggatccagagaacgaggtctcggcagatccgactttggtagagacaggggcccgtttcggcctgagccaggggacggcggggaaaagatgtatccatatcacagagacgagcctcctagagccccctggaaccacggagaggaacgcggacatgaggagtttccactagacggacgcaacgcaccaatggagagggaaaggttagatgactgggaccgtgaaagatactggagggaatgcgagagagactatcaggacgatactctggagttgtacaaccgcgaggacaggttttcagcgcctccctcacgtagtcacgatggtgaccgccgcggcccttggtgggatgattgggaaagggatcaagacatggacgaagactacaatcgggaaatggaaagagacatggatcgagacgtggatagaatctcccgtccgatggatatgtatgatagatcacttgataatgaatgggatcgcgactatggcagaccacttgatgagcaggagtcacagtttcgtgaaagggatattccgtctttaccccccctaccgccactgcctccccttcctcctctcgatcggtacagggacgataggtggagggaagagcgcaacagagagcacggctacgatagagacttcagggacaggggagagctgcgcattcgagagtatccagaaaggggggatacttggcgggaaaagagagactatgtcccggatcgaatggattgggaacgcgaacgcctgagtgatcgatggtatccctccgatgtggaccgacactcccccatggccgaacacatgcctagttcccaccacagcagcgagatgatgggaagcgatgcctcattagatagcgaccagggcttaggtggtgtgatggttctcagtcagaggcaacacgagataattttaaaggcagctcaagagctgaagatgcttcgcgaacagaaggaacagcttcaaaagatgaaggactttggttccgaaccacagatggcggaccatctgcccccacaggagtctcggctgcaaaacacatccagccggccaggcatgtatccaccgccaggtagctatcggcccccccctccaatgggcaagccacccggaagcattgtgagaccgagcgcccctccagcaagaagctccgtgccagtcactcggccccctgtccctatacctccgccgccaccaccccctccgttacccccaccacctccagttataaaaccacagacctctgccgttgaacaggagcggtgggacgaagatagcttctatggcctctgggatactaatgatgaacaggggctcaactcagaatttaagtccgagacagccgcaatcccatccgctcccgtcctgcctccccctccagtgcactctagtatcccccctcccggacctgtccccatgggcatgccacccatgtccaaacccccccccgtgcaacagactgtagattatggccatggcagagatatttccactaacaaggtggagcagatcccatacggagagaggataaccctccgccctgatcctctccctgagcggtccacctttgagactgagcacgccggccagagggaccgctatgatcgtgaacgcgacagggagccatacttcgaccgacagtctaatgttattgcagaccaccgcgactttaagagggatcgcgagacccatagggaccgagaccgggataggggtgtcatagattacgatcgcgaccgctttgatagagaaagacggcctcgggatgaccgcgcccagagttaccgcgataaaaaggatcattcaagctcacgacggggtggatttgataggccatcatacgataggaagtcagatcgtccggtctatgaggggccatctatgttcgggggtgaaaggcgcacttacccggaagagcgcatgccattgcccgcccctagtctgtctcatcaaccaccacctgctccgcgagtcgagaagaagcctgagtctaagaacgtggatgacatcctgaaacccccaggccgtgaatcgcgtccagagagaattgtcgtgatcatgagaggcctcccagggtcgggaaaaacccacgttgccaaactgatccgcgataaggaagtggaatttggcggacccgcaccccgggtcctgtcactcgatgactatttcattacagaggtggagaaagaggagaaagaccccgattcgggtaagaaagtgaagaagaaggtgatggagtacgaatacgaggcagaaatggaagagacatacaggacaagtatgttcaaaacgtttaagaaaacactggacgatggcttttttccattcattatcctggatgcaataaacgatagggtccgccatttcgatcaattttggtctgccgccaagacaaaagggttcgaagtgtacttagccgaaatgtcggcagataatcagacctgtggaaagaggaatattcacggcagaaaacttaaagagataaacaaaatggcggaccactgggagacagcgccccggcacatgatgcgtttagatattcggagcctgttacaggacgccgctattgaggaggtggagatggaggacttcgatgcaaatatcgaggagcagaaagaggagaaaaaggacgctgaagaggaagagtctgaactgggatacatccccaaaagcaagtgggaaatggatacatcagaggcaaagttagataaattggacgggctcaggacaggcacaaagcggaagcgagactgggaggccattgctagccggatggaggactacctccaactgcctgatgactacgatactcgtgccagcgagccaggcaaaaagagagtgcggtgggcagatctggaagagaaaaaggacgccgacaggaagcgcgcgatcggcttcgtcgtgggccagaccgattgggagaaaatcactgatgagtccgggcatctcgcagagaaagccctgaataggaccaagtacatttag

SEQ ID NO: 21179 - DNA, 5565 bp, Artificial Sequence
  Description of Artificial Sequence: Synthetic coding sequence
atgaccccccaggagcagcagcagtactggtaccggcagcacctgcttagccttcagcagagaacaaaggttcatctacccgggcataagaaggggcccgtcgttgccaaggacacacctgagcctgtgaaagaggaggtcaccgttccggctactagccaggtccccgagtctccctcatccgaggaaccccccctccctccccctaatgaggaagtcccccccccgctgccacccgaggaaccacagagcgaggatcccgaagaagacgcacgccttaaacaattgcaagctgctgccgcccactggcaacagcaccagcagcacagggtagggtttcagtaccagggcatcatgcagaagcatacgcaactgcaacagattctgcaacagtaccagcaaattatccagcctcctccacatattcagactatgagcgtagatatgcaattacgccactacgagatgcagcagcagcagtttcagcatttataccaagagtgggaaagagaatttcagctctgggaggaacagctgcactcctatccgcacaaagatcagttgcaggaatacgaaaagcagtggaagacctggcagggccatatgaaggccactcagtcgtacctgcaggagaaagttaatagtttccagaatatgaagaatcagtatatggggaacatgtctatgccaccaccatttgtgccttacagtcagatgcctccacctctccccaccatgcctccaccagtgctgccaccatcgctgccaccgccagtaatgccgcccgccttgcctgcgaccgtaccgcctcctggtatgccgccgccagtcatgcccccgtccttgcctacaagtgttcctcctcccgggatgcccccctcgctgtcaagtgccggacctccccccgtgttgcctcctcctagtttgagttccgccggacctccccccgtgttgccccctccttctctttcaagcaccgccccccctcctgtcatgcctctgcctccactgtctagcgccactccaccacccggtattccgcctcctggagtacctcaggggatcccaccccagttgaccgcagccccagtgccaccagcatcctcaagccagagcagccaggtgcccgaaaaacctcgccccgctctgctgcccaccccagtgtcctttgggagtgcccctcctaccacatatcaccccccccttcagtctgcgggacccagcgaacaggtgaattccaaggccccactgtcaaagtccgcgctcccctactccagcttttcctctgaccagggcttaggtgaatccagtgcagcaccatcacagcccatcacagcagtgaaggatatgccggtgcgatctggaggactcctccccgaccccccaaggagctcctatcttgagtcccctcgcggccctcgcttcgatgggccccgccgtttcgaggatctaggatcaaggtgcgaaggtccacgtccaaaaggcccacgttttgaaggtaacaggcccgacggacccaggccacggtatgagggccatccggccgagggcaccaagagtaagtgggggatgatccccagaggtcctgcctcgcagttctatatcacgccgtctacatccctgagcccacgacagtctggtccccagtggaagggccccaagcctgcatttggccagcaacatcagcaacagcccaagagccaagccgagcccctgagcggaaataaagagcccctggctgatacatccagtaaccaacagaagaacttcaaaatgcagtctgccgccttttcgatagccgctgacgtgaaagacgtaaaggctgctcagtctaacgaaaacctttctgattctcaacaggagcctccaaaatccgaagtatccgaagggcccgtggaaccctccaattgggatcagaatgtccagtccatggagacccagatcgacaaggcccaagctgtaacccagcctgtgcccctggcgaataaacccgtccctgcgcagtcgacttttcctagcaagaccggcggaatggaggggggaaccgctgtagcaacttcatcactgacagccgacaatgatttcaaaccagtcggaattggcctgccccacagtgaaaacaaccaggacaaagggctaccgagacccgacaatcgtgataatcggttggagggcaatcgtggcaactcatcttcctataggggccccggacaaagtagaatggaagatactcgcgacaaagggctcgtaaacagggggcgcgggcaggccatctcccgggggcctgggctcgtgaagcaggaagacttccgtgataaaatgatggggcggagggaagatagccgtgaaaagatgaatcgaggcgaggggagccgtgatcgggggctggtacgcccgggctccagcagggaaaaggttcctggaggactccaggggtctcaagaccggggagctgcgggcagtagagagcgcggcccacccagaagagctggatcccaggagcggggccccctgcgacgagccggctctcgtgaacgcatccccccaaggagagccggtagcagggagaggggcccaccaagaggccccggatccagagaaagggggctggggcgaagcgacttcggccgagaccgtggcccttttagacctgagcccggcgacgggggggaaaagatgtatccctatcatagagatgagccacccagggctccctggaatcacggcgaggagaggggtcatgaggagtttcctctcgacggcaggaacgcacccatggaacgcgaaaggctggatgattgggacagggaacggtattggcgggagtgcgagagagactaccaagatgacacactggaactctacaatcgcgaggataggttttctgcaccaccctcccggtcacatgacggtgataggcgagggccatggtgggacgactgggagcgcgaccaggatatggatgaggattacaacagggagatggagcgagatatggacagggatgtggaccggatttccaggcctatggatatgtatgaccgctctctggataacgaatgggaccgagattatggccgccctctggacgagcaggaatcccagttccgagagagggatattcccagtttgccccctttgcctccattgcccccccttccaccactggatcgctaccgcgacgaccggtggagagaggagagaaacagggagcatgggtacgatagagactttcgagaccgcggcgagcttaggatcagagagtaccctgaacggggcgatacttggagagaaaagagagattatgttcctgacagaatggactgggagagagagcggctttccgaccgatggtatccatcagatgtcgatcgtcactccccaatggccgagcacatgccctcttcccaccactcttctgaaatgatggggagtgacgccagcctggacagtgaccaggggctggggggcgtgatggtgttgagtcagagacagcacgagatcattttgaaagcagcccaggagctgaagatgctccgcgagcagaaagagcagctgcagaagatgaaggacttcggtagtgaacctcagatggctgatcatctgcccccacaagagtcaaggctgcagaatacatcctcaaggccgggaatgtatcctcccccgggttcttacagaccgcccccccctatgggaaaacccccaggaagcattgtacgcccttctgccccaccggccaggagtagcgtgccagtaacccgtcctccagttccaattccaccaccccccccaccaccgcccctgcccccgccgccaccggtgatcaagcctcagaccagcgcggtagagcaagaaaggtgggacgaagacagtttttacggcctgtgggacacgaacgacgagcaaggcctcaactctgaattcaaaagcgaaaccgccgccattccaagtgcccccgtcctacccccgccacctgtgcactcatctattccaccaccagggccagtccctatgggaatgccccctatgtccaagccccctcccgtgcaacaaaccgtggactatggccacggtagagatatttctacgaacaaagttgagcaaatcccttacggcgagcggataacactgcgccctgacccacttccggagaggagtacgttcgaaacagagcatgctggccagcgggaccgctatgacagggagagagaccgagagccttactttgacagacagtctaatgtcatcgcggaccaccgagacttcaaaagagaccgggagactcatcgagacagggaccgggacaggggcgtgattgactatgaccgggaccggttcgatcgtgagagacgacctagggacgaccgagcccagtcctatagggacaagaaagaccacagttccagccggcgcggtgggtttgacaggccttcctatgatagaaagtccgatcggcccgtatacgaaggaccctcaatgtttggcggggagaggcgtacctaccctgaggagaggatgccgctacccgccccgagcctgagccaccagcctccgccggctccccgagtggagaaaaagcccgaatccaaaaatgtggatgatattctaaaaccacctggacgtgaatcccggcccgaacgtatcgtagtcattatgagaggacttcctggatcaggcaagactcacgtggccaaacttatcagagacaaagaggtcgagttcggtggtcctgcgccccgtgttctgagtctggatgactatttcattacagaagttgaaaaggaggagaaggatccagactccggaaagaaggtgaagaagaaggtaatggaatatgagtatgaggcggagatggaggagacttatcgtacatccatgttcaaaacctttaaaaaaacattggacgacggcttcttcccgttcattattctcgatgccattaatgatcgtgtgaggcatttcgatcaattctggtccgccgcaaagacaaaggggttcgaggtctatctggccgagatgtccgctgataatcagacctgtgggaaacgcaacattcacggcagaaaattgaaggagattaacaaaatggcagatcactgggagacggcccccagacacatgatgcggttagacattagatccctactgcaggacgccgccatagaggaagtggagatggaggatttcgacgctaatatcgaagagcagaaagaagaaaagaaagatgcagaagaagaagaatcagagttaggttatatcccaaagtctaagtgggagatggacacaagtgaggcaaaactggacaaactggacggacttcgcaccggaactaaaagaaaaagggattgggaagcgatcgcctctcgcatggaagattatctgcagcttcctgatgactacgacacccgagcatctgagcccccccggcccagaggagccagcctgtgtgtgacgctgctgccaaggttctcatcctgtttcgttagtacagccctggtctttttcaaagtattgcagtgtcctcaggaagtgctcgagagttgttgtactcaagcaagaagatag

SEQ ID NO: 21180 - DNA, 2184 bp, Artificial Sequence
  Description of Artificial Sequence: Synthetic coding sequence
atggccgccgacagccgggaggagaaggacggcgagctgaacgtgctggacgacattctgacggaggtgcccgaacaagatgacgaactatacaaccctgagagcgaacaggataagaatgagaagaaaggatcgaaacgcaagtctgatcgcatggaatcaaccgacaccaagcgccaaaagccctcagtccatagtaggcagctagtatccaagcctcttagctcctccgtttctaataataaacgaatcgtgtcgacaaagggtaagagtgccacagaatataagaacgaggagtaccagcgaagtgagcggaacaaaaggttggatgcagatcgcaagatccgactgtcctctagcgcgtccagagaaccctacaagaaccagcccgaaaagacttgtgtgaggaagagggaccccgaacgaagggcaaaaagcccgacccctgacggtagtgagagaatcggcctagaagtggatcggcgagccagcaggtcctctcagagttcaaaagaagaggtgaacagtgaggaatatggctctgaccacgagacaggctctagtggctcctccgatgagcaggggaataatacggagaacgaagaggagggtgtggaggaagatgttgaagaagatgaagaagtggaggaagacgctgaggaagatgaggaggtagatgaagacggggaggaggaagaagaagaggaagaggaggaagaggaggaggaggaggaagaggaggaagaatacgagcaggatgaacgggatcagaaggaagagggcaatgactatgacacccgttctgaggcatcagactccggtagcgagtcagtctcgtttacagatggttctgtcaggtctggcagcggcaccgatggtagcgacgaaaagaaaaaagagcgcaaacgggctaggggcatctcaccaatcgtgtttgataggagcggttccagtgcgtccgagtcctacgccggtagcgaaaagaaacacgaaaagctgagctcaagcgttcgagctgtgcgcaaagatcagacaagcaagctgaagtacgtccttcaggacgcccgcttttttttgataaagtccaacaatcatgagaacgtcagcttggcaaaggccaaaggtgtttggagcaccctccccgtcaatgaaaagaaactgaacctggcattcaggtccgccaggtccgtaattttaattttctccgtccgcgaaagtgggaagtttcaaggctttgcccggctgtctagcgagagtcaccatggcgggagtccaattcactgggttttgcccgctgggatgtcggccaaaatgcttggaggggtattcaagatcgattggatttgtcgacgagaactcccttttacaaagagcgctcacctcaccaacccatggaacgaacataagcctgtaaagatagggcgggacggacaagagattgaattggagtgcggtacacaactgtgcctgcttttccctcccgacgaatcaattgatctgtaccaggttatacacaagatgagacacaaacgacgcatgcatagtcagccaagaagccggggacgccctagccgccgagaaccggtgcgcgacgtcgggaggcggcgccctgaggactatgacattcacaattcgagaaaaaagccacgcatcgactaccccccagagttccaccagcggcccggctacttgaaggaccctcgataccaagaggtcgaccgaagattcagcggggtccgacgtgacgtgttcctcaacgggtcttacaacgattatgtcagagagttccacaatatgggtccgccaccaccctggcaaggcatgcccccatacccgggaatggaacaaccaccccatcacccatattaccaacaccacgcaccaccgccgcaggcgcatcccccttactccggccaccatcccgtcccacacgaggcgcggtacagagacaagcgcgtacacgattacgatatgcgcgtcgacgatttccttcgccgcacgcaagccgtggtctctgggagacgcagcaggcctcgggaacgagaccgggaacgggaaagggataggcccagagataacagacgcgatcgggaaagagatagaggacgtgaccgggaacgagagagagaacggctttgcgaccgggatcgggaccgcggcgagaggggaagatacagaaggtag

SEQ ID NO: 21181 - DNA, 2130 bp, Artificial Sequence
  Description of Artificial Sequence: Synthetic coding sequence
atggccgccgacagccgggaggagaaggacggcgagctgaacgtgctggacgacatactgacagaagtcccagagcaagatgacgaattatataaccccgagagtgaacaggacaagaatgaaaagaagggcagcaagaggaaaagcgaccgaatggagtctacggatactaaacggcagaagccatcagttcattcacggcagctcgtgtccaagccactgagttcttctgtgtcgaataataaacgtattgtgagtactaaggggaaaagcgctaccgaatacaagaacgaggaatatcagaggagtgaaaggaataaaagactagacgctgaccgaaagatcagactcagctcctctgcctcccgcgagccatataaaaaccaacccgagaaaacttgcgtgcgcaaacgcgaccctgagcggcgggctaagtcacccactccagacggcagtgagcggattgggttggaggtggaccgacgagcctctcgatctagtcagtcatcaaaggaggaggtgaattctgaggaatatggttctgatcacgaaaccggcagcagtgggtcctcagacgagcagggaaataacacggaaaacgaggaagagggcgttgaagaggacgttgaagaagacgaagaggtggaggaggacgctgaagaagatgaagaggttgacgaagatggagaagaggaagaagaggaggaagaggaggaggaagaagaggaggaggaagaagaagaagaatatgagcaagatgaacgtgatcagaaagaggaaggcaacgactacgacacaagatctgaagcttctgacagcggttctgaatccgtgtccttcaccgatggttcagtgagaagtggcagtggaactgatgggagtgacgagaaaaaaaaagagcgcaagagagcccgcggcatttcccctattgttttcgaccggtcgggatctagcgcaagtgaatcttatgccgatcagacctcgaaactcaaatacgtactgcaggacgcacgattctttctgatcaaaagtaacaatcacgagaacgtgtctctggccaaggccaagggggtatggagcacactccccgtgaacgagaagaaactgaatctcgctttcaggtctgctaggtcagtgattctgattttttctgtgcgtgaaagtgggaaatttcagggttttgcaaggctcagctccgaatcgcaccacggcgggtcccctatccactgggtgttgcctgcgggtatgtctgccaagatgctggggggagtttttaagatcgactggatctgtcgacgcgagttgccttttacaaagtccgcacacctcaccaatccctggaacgaacacaagcccgtgaagatcggacgagatggccaggaaatcgagctggaatgcggcacccaactgtgcctccttttcccgcccgacgagagcatcgatttgtatcaggtcatccacaaaatgcgccataaaagacggatgcactcccagcctaggagccgggggaggccatctcgtagggaacctgtgagggacgtggggcgccggagacctgaggactatgacatacataactcaagaaaaaagcctagaatcgactaccctcccgagttccatcaacgaccaggctaccttaaggatcctcggtaccaagaggttgataggagattttccggcgtgcggcgcgacgtcttcctgaacgggtcatacaatgactatgtgagagagttccacaacatgggaccgcctccaccatggcagggcatgccgccctaccccggaatggaacagcctccccaccatccttactatcagcatcacgccccaccaccacaggctcaccctccctatagcggccatcaccccgttccccacgaggcgcgctacagggacaagcgcgtacacgattatgacatgcgggtggacgactttttaagacgtacccaagcggtggtaagcggtcggcgatcccgcccccgggagcgtgatagagagagggagcgcgacagacccagagataacaggcgcgacagggaacgtgatagagggcgagatcgagaacgggagcgggaaaggctgtgtgatcgcgaccgagacagaggagagcgtggtaggtacagaagatag

SEQ ID NO: 21182 - DNA, 2130 bp, Artificial Sequence
  Description of Artificial Sequence: Synthetic coding sequence
atggccgccgacagccgggaggagaaggacggcgagctgaacgtgttggatgatatacttactgaagtgccagaacaagacgacgaactttacaacccagagtccgagcaagacaagaacgaaaaaaagggttccaaaaggaagagtgatcgaatggagagtacagacacgaagcgccagaaaccgtcagtacatagcaggcagctcgtatcaaagcctctgagttcatctgtttctaacaataagagaattgtgtccacaaaggggaagtctgcgacagaatataagaacgaggagtaccagaggagtgagagaaacaagcgactggacgcagaccgtaagatcaggctgtcatcttcggcatctagagaaccgtataaaaatcagcccgagaagacctgcgtgcgaaagagagacccggagcggagggccaaaagccccactcctgatggatcagaaagaataggacttgaagtagacaggcgtgccagtcggagtagtcagtcttctaaggaagaagtcaactccgaggagtacgggagtgatcacgagacaggatcttccggaagctccgacgaacagggaaataacacagagaatgaagaggagggagttgaggaagatgtggaggaagatgaagaagttgaagaagacgccgaggaggacgaggaagtcgatgaggacggggaagaagaggaagaggaagaggaagaagaggaggaagaggaagaggaggaggaggaagaatacgaacaggatgagcgagaccagaaagaagaggggaatgactacgatactaggtccgaagccagcgacagcgggtccgaaagcgtgagctttacggatggcagtgtgagatctggttctggcaccgacgggtccgacgagaaaaaaaaggaacggaaaagagcaagggggattagccccatcgtttttgataggagcgggtcttccgctagtgagtcatacgccgaccaaacctccaagcttaaatacgtccttcaggatgcaaggttcttcctgattaagtctaacaatcatgagaacgtgtcactcgcaaaggccaaaggcgtttggagcaccctgcccgtgaatgagaagaagctcaacctggcctttagaagtgccagaagcgtcatcctgattttctcagtgagagaaagtggaaaattccaaggctttgcacggcttagtagcgagagccatcacgggggctcacccattcactgggtacttccggctgggatgagcgccaaaatgctgggcggtgtttttaagattgattggatctgcagacgcgaactccccttcaccaaaagcgcccaccttactaacccatggaacgaacacaagcccgtcaagattggtcgcgatgggcaagagatcgagctcgaatgtgggacgcagctgtgtctgctttttcctccagacgaatctatagatttgtatcaggtgattcacaagatgcgtcacaagaggcgtatgcatagtcagccccggtctagggggaggccatctcggagagagcctgtgcgcgatgtgggacggagaagacctgaggattacgatattcataatagccgtaagaagcctagaattgactaccccccggaattccaccagcgccccgggtacctgaaagaccctcgttaccaagaggtggataggcggttctccggggttaggcgagacgtgtttctcaacggcagttataacgactatgttcgggagtttcataacatgggccctcccccaccttggcaggggatgccaccgtatcccggcatggaacaacctccacatcatccctactaccagcatcatgccccacccccacaggcccatcccccttacagtggtcatcatcctgtcccccacgaagcgcggtatcgagataagcgcgttcatgattacgacatgagagttgacgatttcctccgacgaacccaggcagtcgtgtcaggccgaagatccagaccgagggaacgggatagagaaagagaaagagatcgcccgcgagacaataggagagatcgtgagcgtgaccgaggcagggatcgggagagagaacgggagcgtctgtgtgatcgcgaccgcgatcgcggagaacggggccggtataggagatag

SEQ ID NO: 21183 - DNA, 2184 bp, Artificial Sequence
  Description of Artificial Sequence: Synthetic coding sequence
atggccgccgacagccgggaggagaaggacggcgagctgaacgtgctcgatgatatcctgacggaagtgcctgagcaagacgacgagctgtacaacccagaaagtgaacaggataaaaacgagaaaaaaggatctaagcggaagagtgatcgcatggaatccaccgataccaagcgacagaaacctagcgtgcactcaagacagttagtctccaaacctctgagctcaagtgtaagcaataataagcgcattgtgtcaaccaagggcaagtctgcaacagagtacaagaacgaagaataccagcgcagcgagcggaataaacggctcgatgcagatcgtaaaatccgtctgtcatcctctgccagccgcgagccctataagaaccagcccgaaaagacctgtgtcaggaaaagggaccccgagcgcagagctaagtcccctacccccgatgggtcagagaggattggtcttgaagtggatagacgggccagtcggagcagtcagtcttctaaagaggaggttaacagcgaggagtatggatcagatcatgaaaccggctcctccggaagttccgacgagcaggggaacaatacagagaacgaggaagagggcgttgaggaagatgtggaagaggacgaagaggtagaggaggatgctgaggaggatgaggaagtcgacgaggacggggaggaggaagaggaggaggaggaggaggaagaagaggaagaagaagaggaagaagaagagtatgaacaagacgaacgagatcagaaggaagagggcaatgattatgatacacgaagcgaagcaagcgatagcggctctgagtctgttagcttcaccgacggatccgtgcgcagcggctcaggcacagacgggtctgacgaaaagaaaaaggagcgcaagcgcgcccgtgggatctctcctattgtgttcgaccggtccggaagctccgcttctgaaagctatgcaggttctgagaagaaacatgagaagttatcttcatctgtgagagcagtgcggaaggaccagactagcaagttaaaatatgtgcttcaggatgcaaggttcttcttgattaaatctaataatcacgagaatgttagcctggccaaagcaaagggcgtctggagcaccctgcccgtgaatgagaagaagttgaacctcgccttccgaagtgctcgcagcgtgattcttatcttttccgtgcgggagtcaggcaagttccaggggttcgctcgcctttcttccgaaagccatcatggtggatctcccatccattgggtgctgcccgccggcatgagtgccaagatgctgggtggcgtgttcaaaatcgactggatctgccgtcgagaactcccatttacaaagtctgcccacttgactaacccttggaacgaacacaagcctgtaaagataggccgggacggacaagagattgaacttgagtgtggcacgcagttgtgtctcctgtttccccctgatgaaagtatcgacctttaccaggtgattcacaaaatgaggcacaagcgccggatgcatagccagccccggtccaggggtcggccttcccggagagagccagtccgggacgtagggcgccgcaggcctgaggactacgacatacacaattcaagaaaaaaaccaagaatcgattacccacccgagttccatcagcgccctggctacctgaaagatccacgctatcaggaagtcgatcggcgcttcagcggggtgaggcgcgacgtctttctgaacggctcctataatgattacgtgcgggagttccacaatatggggccgcctccaccctggcaggggatgccgccataccccggaatggagcagcccccacatcacccatattatcagcaccacgctcccccaccccaagcccatccgccctattcaggtcaccaccccgtgccccatgaggcgcggtatcgagataaacgagtccatgattacgatatgcgcgtagacgatttcctgcgccgcacacaggctgtggtgagcggtcgaaggtcaagaccacgggagcgcgaccgggagcgagagcgagaccggccacgggataatagaagagatagggaaagagatcggggcagagatagagaaagggagagggagcgcttatgcgaccgggatcgggacaggggagaacgcggccggtataggcgttag

SEQ ID NO: 21184 - DNA, 1992 bp, Artificial Sequence
  Description of Artificial Sequence: Synthetic coding sequence
atgttcctgaaggccggccggggcaacaaggtgccccccgtgcgggtgtatggccctgattgcgttgtgctcatggaaccgcccctctccaagcgaaatccaccagcattgcgtctcgctgaccttgctacggcccaagtgcagccgttgcaaaacatgaccggctttcccgcccttgccggacctcctgctcactctcagcttcgagccgctgtggctcacttgcggctccgggacctgggggccgatccaggtgttgccacaactccccttgggcccgagcatatggcacaagcaagcactcttggattgtcccctccatcccaggcatttccggcccaccctgaggcccctgcagctgcagcccgggccgctgccctggttgcccatcctggagccggtagctatccgtgtgggggggggagctctggagcgcagcctagtgcgccacccccccccgctccacccctgccccccacaccctcgccaccaccaccacctcctccgcccccaccgccggccttgtcaggttacactacaacgaattcgggaggcggggggagtagtgggaaggggcattcacgggactttgtgttgaggagagatctgagcgcgaccgcaccagcagctgccatgcacggagctccactaggcggcgagcagcgtagcggaaccggcagtcctcagcatccagcacctccaccccacagtgctggtatgttcatcagtgcctctggaacctacgccgggccggatggcagcggaggccctgccctttttcctgctctgcacgacacccctggtgcccctggcggccatccccacccgctgaatggacaaatgcgcctgggcctcgccgctgctgccgctgccgcagcagccgagctgtacggtcgagccgagcctcccttcgccccccgctctggagacgcccactatggggccgtcgctgctgctgcagccgcagcacttcacggttacggagcagtcaatttgaatctgaacctggccgcagctgcagctgccgcagccgccggccccggcccccacctacaacaccacgctcccccacccgctccgccaccccctcccgctcccgctcagcatcctcatcaacaccacccccacctgcccggagctgctggcgcatttctgaggtacatgagacagccaataaagcaggagctcatttgcaagtggattgatccagatgagctggccggcttgcctccacctccaccaccaccacctccccctccccccccccctccagctggtggggccaagccgtgttctaagacattcggcaccatgcatgagctggtgaaccacgtcacagtagaacatgtaggaggaccagagcagagcagccacgtgtgcttctgggaagattgcccccgagagggaaagccctttaaagctaaatacaaactgatcaatcatataagagtgcatacaggtgaaaagccatttccctgcccatttcctggatgtggcaaagtttttgcaaggtccgagaatcttaagatccataagcgaactcatacaggtgaaaaacccttcaaatgcgaatttgacggatgcgacaggaaattcgctaatagctctgaccgcaaaaagcatagtcacgttcacactagcgacaagccctattattgtaaaatcagaggctgcgacaagtcatacacccatccttcatcactgcgtaaacacatgaagatccattgcaaatctccaccaccatctccggggccattgggctactcgagtgtgggtacgcccgttggagcccctctttctccagttctggaccccgcaaggagtcattcttcgactctctcgcctcaggtgacaaatctgaacgagtggtacgtttgccaggcgtctggggccccgagccacctccatacccctagctctaacggaacaaccagtgagaccgaagacgaggagatatacggcaatcctgaggtggttcggaccatacactag

SEQ ID NO: 21185 - DNA, 654 bp, Artificial Sequence
  Description of Artificial Sequence: Synthetic coding sequence
gccgccgccgccctgcacggctacggcgccgtgaacctgaacctgaatttggccgccgcagccgcggccgctcatccacaccagcaccaccctcacttgccgggtgcggccggcgcctttttgcggtacatgcgccagccaatcaagcaggagctcatatgtaaatggatcgacccggacgagctcgctggaagagctaagccttgtagcaagacctttgggaccatgcacgaactagtcaatcacgtgacggtggagcacgttgggggccccgagcagtcaagtcatgtgtgtttttgggaagactgccctagggagggaaaacctttcaaggccaagtataagttgattaaccatattcgtgtgcacaccggggaaaagcctttcccttgccccttcccagggtgtggaaaagtgtttgcacgctccgaaaatctcaagatccataagagaactcacacgggtgagaaacccttcaagtgcgagttcgatggatgtgaccggaaattcgcaaactccagcgatcggaagaaacatagccatgtgcatacctctgataagccctactactgcaaaattcggggctgcgacaaatcatatacacatccttcctcactccgaaaacacatgaagattcactgcaaaagtccctag

SEQ ID NO: 21186 - DNA, 3696 bp, Artificial Sequence
  Description of Artificial Sequence: Synthetic coding sequence
atgtgcaagtgctgcaacctgttcagccccaaccagagcgagctgctgtcacatgtgagcgaaaaacatatggaagaaggcgtgaacgtagacgaaattattattccactcaggcccctgagcactccagagcctcccaactctagcaagactggcgatgagttcctggtgatgaaacgcaagcgcggtcgccccaaaggctccacaaaaaagtccagtacagaagaggaactggctgagaacattgtgagccctactgaagatagtcctctggcacctgaagagggaaattccctgcctccaagttctttggagtgcagcaagtgctgtcgcaagtttagcaacacaaggcagctcaggaaacacatctgtatcatagttttgaatctaggcgaagaagaaggcgaggccggaaatgagtctgatctggagctggagaaaaagtgtaaagaggacgatagagaaaaagcttccaaacgacccagatctcagaaaaccgagaaggtgcagaagatttcaggcaaggaggctcggcagctgtctggcgcgaagaaacccatcatctctgttgtactgactgctcacgaggcgataccaggtgccactaaaattgtgcccgtggaagctggccctccagagaccggggcaaccaactcagaaacaacctcagctgatctggtgcctcgaagggggtatcaggaatacgccattcagcagaccccttacgaacagccaatgaagtccagtcgactcggacctacgcaattgaaaattttcacttgtgaatattgcaataaggtttttaaatttaaacactctcttcaggcccatctcaggattcacaccaacgaaaaaccatataagtgtccgcagtgcagttatgcttcggccatcaaggccaatctgaatgtccacttacgaaaacatactggcgaaaaattcgcatgcgactactgttcctttacttgcctgtccaagggacacctaaaagtccacattgaacgggtccataagaaaattaagcaacactgcagattttgcaaaaaaaagtatagcgacgtgaagaaccttattaaacatatcagggacgcccatgatcctcaggacaagaaggtgaaagaggcactggacgaattatgcttaatgacacgtgaaggaaagcgccagttgctctacgattgccacatctgtgaaaggaagttcaaaaacgaacttgacagggatcggcacatgttggtgcacggcgataagtggccttttgcttgcgagctgtgcgggcatggggcaactaagtaccaggcgctggagctgcacgtgagaaagcacccatttgtctacgtgtgtgcagtctgtcggaagaaatttgtgtcatctattcggcttcgtacacatataaaagaggttcatggcgccgctcaggaagccttggtcttcacgagctccatcaatcagtctttttgtctgctcgagccaggcggggatattcagcaggaagcattaggggatcagctccagcttgtggaggaagagttcgccctgcagggcgttaatgccctgaaagaggaagcatgtccaggtgacactcagctcgaagaagggcggaaggagcctgaggcgcctggtgagatgccggcaccggctgtgcacctcgccagccctcaggccgaaagcaccgccctccccccgtgcgaactcgaaaccaccgtggtctctagcagcgatctgcacagtcaggaagtggttagcgacgacttcttgctgaaaaatgatacgtcctctgccgaggcccatgcggccccggaaaaaccccctgacatgcagcaccggtcttccgtgcagacacagggcgaagtgatcactctgctgctctccaaagcccagtctgcagggtccgaccaggaatcccatggtgcccagagccctctcggcgagggccaaaacatggccgttctgagcgcaggggatcccgatccttcacgatgcttgaggtccaaccctgccgaggccagcgacctgttacccccggtggcaggtggaggggatacaatcacccaccaacctgattcttgtaaagcagcacctgagcacagaagcgggattaccgccttcatgaaggtactgaactccctccagaagaaacagatgaacacttctctctgcgaacgtatcagaaaggtgtacggagatcttgaatgcgagtactgtgggaagctattttggtatcaggtacactttgacatgcacgtcagaacgcacactcgggaacatttatattattgcagccagtgccactatagctccataaccaagaattgcctgaaacggcatgttatccagaagcactccaacatcctgctgaaatgccctactgacggctgcgattactctactcccgataagtacaagctacaggcccacttaaaggtgcacacggccttggacaagagatcctattcatgtcccgtttgtgagaagtccttttccgaggatcgtctaattaaatcacatatcaaaaccaaccacccagaggtatccatgtcaacaattagcgaagtgcttggtagaagagtgcagctcaaaggcctgatcggcaagcgcgcaatgaagtgcccttattgcgacttctactttatgaagaatggctccgaccttcaaagacacatctgggcacacgagggcgtgaagcccttcaaatgctctctgtgtgagtatgccacccgctcgaagagcaacctgaaagcccacatgaataggcactcaaccgagaagacccatctgtgcgacatgtgcgggaagaagtttaagagtaaggggaccctgaagtcacacaagctcctgcacaccgctgatgggaagcagttcaagtgtaccgtgtgcgattataccgccgctcaaaaaccccaacttctccgacacatggagcagcacgtgagcttcaagcccttcagatgcgcccattgtcactattcctgtaacatctccgggtccctcaagcgccactacaaccgcaaacatcccaacgaagagtacgcaaatgtgggaacgggcgagttagcagccgaggtgctgatccagcaaggagggttaaagtgccctgtgtgctcttttgtgtacggtactaagtgggagtttaacaggcacctaaaaaataaacacgggctgaaggtggtcgagattgatggtgaccccaagtgggagaccgcaacggaagcaccagaggagccctcaacgcaatatctgcatatcacagaagctgaggaggatgtccagggcacccaagcggcagtagcggccctccaggacctgaggtacacgtcagaaagcggggatagactggaccctaccgccgtgaatattctacagcagatcatcgaattaggggccgagacgcacgacgccactgctttagcttctgtggttgcaatggctccaggcacagtgacagttgtcaaacaggtgactgaggaagagccatcctctaaccataccgtcatgatccaggaaaccgtccagcaggctagcgtggaactagccgagcagcaccacctcgtagtgtcttccgacgatgtagaggggatcgaaacagtcacggtgtacacgcagggcggagaggccagcgaatttatcgtctatgtgcaggaggccatgcagcccgtggaagagcaggccgttgagcagccagcgcaggagctgtag

SEQ ID NO: 21187 - DNA, 1935 bp, Artificial Sequence
  Description of Artificial Sequence: Synthetic coding sequence
atggccaagcccagccacagcagctacgtgctgcagcagctgaacaaccaaagggagtggggcttcctgtgcgactgttgtatcgccatagacgatatatatttccaggcgcataaggctgttctggcagcttgtagctcctacttcagaatgtttttcatgaatcaccagcactccacggcacagcttaacctctctaacatgaaaattagcgctgaatgtttcgatctaatcttacagttcatgtatttaggcaagataatgacagccccatccagcttcgagcagttcaaagtggccatgaattacctgcagttgtataacgtgccagattgcctcgaggacatccaagacgcagactgtagctcatccaagtgctcgtctagcgccagtagtaagcaaaactcgaaaatgatcttcggtgtcagaatgtacgaggatacagttgccagaaatggcaatgaagccaatcggtggtgcgctgaaccttctagcacagtgaacaccccccataatagagaggcagacgaagagtccctacaactgggtaattttccagagccattgtttgacgtatgcaagaagtcttcggtgtccaagctctccacacctaaagagagagtttctaggcggtttggtcgctcttttacgtgcgattcttgcggatttggctttagttgtgagaagttgctggacgagcacgttctgacgtgtactaacaggcatctgtaccagaatactagatcctatcatagaattgtggacatccgtgacggcaaggactccaacattaaagccgagttcggcgagaaggatagttccaaaacattttccgcccagaccgataagtacagaggagacactagccaggctgcggacgactctgcttccacaacaggctcacggaagtcttcaactgttgagtcggaaatcgcctctgaagagaagagtcgagcagcggagcgaaagagaatcattattaaaatggagcctgaagacatacctaccgatgagctcaaggattttaatatcattaaagtaacggacaaggactgcaatgagagcaccgacaatgacgagctggaggacgaaccagaagagccattttacagatattacgtggaggaggacgtgtctattaaaaagagtggccgaaagacattgaaaccacgcatgtcagtgagtgccgatgagcgcggaggacttgagaatatgcgcccccccaataactcttcccctgtacaggaggacgccgagaacgcatcatgcgaactgtgtggcttgacaatcactgaggaagatctttcctctcattatcttgccaaacacattgaaaatatatgtgcctgcgggaagtgcggtcagattcttgttaagggcaggcagcttcaggaacacgcacagcgatgcggcgagcctcaagatctgactatgaacggactgggtaatacagaagagaaaatggatctcgaggaaaatcctgacgaacagagcgaaatcagggacatgtttgtcgagatgctcgacgatttccgcgacaatcactatcagatcaactccatccagaaaaagcagctgtttaaacattccgcatgcccctttcggtgcccaaactgcgggcaacgctttgaaacagagaatcttgtggtggagcacatgtcgtcctgtctggatcaggacatgttcaagtcagctatcatggaagaaaatgagagggatcatcgacggaagcacttctgtaatctctgtggcaaaggcttttatcagagatgtcatttacgagaacactacactgtgcacactaaggagaagcagttcgtatgtcaaacttgcggaaaacaattcctgagagagagacaacttagactgcacaacgatatgcataagggcatggcgtccggggagattgggcccagtaaaccagtggagaaatag

SEQ ID NO: 21188 - DNA, 2142 bp, Artificial Sequence
  Description of Artificial Sequence: Synthetic coding sequence
atggccaagcccagccacagcagctacgtgctgcagcagctgaacaaccagcgcgagtgggggtttctgtgtgattgttgtatcgcaatagacgacatctacttccaggctcacaaagccgtcctggccgcttgttcatcctattttcggatgttttttatgaatcaccagcatagcacagcacagctcaacctgagcaacatgaagatttcagcagaatgcttcgacctgatcctccagtttatgtacttaggcaaaattatgacagctccctctagcttcgaacagtttaaagtggcgatgaattaccttcagctctacaacgtgcccgactgtcttgaggatatccaggatgcagactgttcatcttcaaagtgcagttctagcgcctcgtcgaagcagaattccaagatgatctttggtgtgcgaatgtacgaggatacagtagctaggaacggcaacgaggcgaatcgttggtgtgcggagccttcttccaccgtcaatactccccacaatagggaggcggacgaagagtctcttcaactggggaatttcccagaacccttatttgacgtttgcaagaaatcatctgtgtctaagttgtccactccaaaggagcgggtttctcggagattcggaagatcattcacatgcgattcgtgcggcttcggcttcagctgtgagaaactcctcgacgagcacgttctgacatgtaccaacagacatctctatcagaatactcgatcctaccaccgtattgttgacatcagagatgggaaagacagtaatatcaaggccgagtttggtgagaaggactcatctaagacgttttctgcccagacggataagtacagaggtgataccagtcaggcagctgatgacagcgcgtccactaccggatctagaaaaagttctaccgtggaatccgagattgccagtgaagaaaagagccgggcagcagaaagaaaacgcatcatcattaagatggaacctgaagatatacccaccgatgagctgaaagactttaatattatcaaggtgaccgataaggactgcaacgagtctaccgataatgacgagctagaggatgaaccggaggagccattttataggtactatgtggaggaggacgtcagtattaagaagtcaggcagaaagacactcaagccccgcatgtctgtttctgcggatgagcggggcggcttagaaaacatgcgacctcctaacaactccagtcctgtgcaggaagacgctgaaaatgctagctgtgaactgtgcggtctcaccattactgaggaagacctaagctcccactatctcgcaaaacacatcgagaatatctgtgcttgcgggaaatgtggccagatcttggtcaaaggccggcagctgcaggaacacgcacagagatgcggcgagccacaggatttgaccatgaatggtctgggaaacaccgaggagaagatggatctggaagaaaatccagacgagcagagtgaaatcagggatatgtttgtggagatgttggatgatttcagggacaaccactaccaaattaacagcattcagaaaaaacagctctttaaacactccgcctgcccatttcgatgccccaactgcgggcagaggtttgagactgaaaacctagtggtggaacacatgagtagctgccttgatcaagacatgtttaagagcgcgataatggaggaaaacgagagggaccaccgccggaaacacttttgtaacctgtgtggcaagggcttttatcagcgttgccacctgcgtgaacactacactgtacataccaaggaaaaacagtttgtttgccagacctgtgggaagcagttcctgagagaaagacaattgaggctacacaacgatatgcataagggtatggctcggtacgtgtgctctatctgcgatcagggcaacttccgcaagcacgatcacgttcgtcatatgatttctcacctgtctgctggggagaccatttgtcaggtttgcttccagattttccctaacaatgaacagctcgaacaacacatggacgtgcacctctacacatgcggtatatgtggcgcgaaattcaaccttcgaaaggacatgcgctcccactacaatgcaaagcacctgaaaagaacctag

SEQ ID NO: 21189 - DNA, 468 bp, Artificial Sequence
  Description of Artificial Sequence: Synthetic coding sequence
atggccaagcccagccacagcagctacgtgctgcagcagctgaacaaccagcgagaatggggatttctgtgtgattgctgcatcgctattgacgacatctactttcaggcgcataaggccgtgctggctgcgtgcagcagctacttcaggatgttctttatgaatcatcagcattccactgcacagcttaatctgtcaaacatgaagatctcagccgagtgttttgacctgatccttcagtttatgtacctaggtaagatcatgaccgccccctcttcgtttgaacaattcaaggtggccatgaactacctccagctgtataatgtgcccgactgtctggaagacattcaggacgccgattgctcttcatcgaaatgctcaagtagtgcctctagcaagcagaactctaagatgatttttggggtgagaatgtacgaggacaccgttgccagaaacggcaatgaatag

SEQ ID NO: 21190 - DNA, 2142 bp, Artificial Sequence
  Description of Artificial Sequence: Synthetic coding sequence
atggccaagcccagccacagcagctacgtgctgcagcagctgaacaatcaacgggagtgggggttcttgtgcgactgttgcattgccattgacgacatttattttcaggcccataaggccgtgctagcggcttgttctagctacttccgcatgttcttcatgaatcatcagcattccacggcgcagctcaatctgtccaatatgaagataagtgctgaatgctttgacctgatccttcagttcatgtatttaggaaaaattatgactgcccctagttctttcgagcagtttaaggtggcaatgaactaccttcaattgtacaatgttcccgactgcctcgaggacattcaggatgctgattgctcttctagcaagtgttcatcatccgctagcagcaagcagaattccaaaatgatctttggagtgaggatgtatgaggataccgtcgcccgaaacggaaacgaagccaatcgctggtgtgctgaacctagttcgactgttaacacgccccacaatagggaggccgacgaggagtctttgcaacttggaaacttccctgaacccctgttcgatgtgtgcaaaaagtcaagtgtgtccaaactgagcacacccaaggagcgtgtcagtcgccgcttcggaagatcttttacatgcgacagttgtggatttggattcagttgtgaaaaactgctagacgagcatgtcttgacctgcaccaataggcatctgtaccaaaatactagatcctatcatcgcatcgtggatatacgcgatgggaaggacagcaatattaaggccgagtttggtgagaaagattctagtaagactttcagcgcacagacagataagtaccgcggtgacacctctcaggctgctgatgattctgctagcaccacaggatctcgcaaatcttccaccgtggagtccgagatcgcgtccgaagagaagagcagggcagcggagaggaagcgcattataattaaaatggaaccagaagatatcccaaccgatgagttgaaggacttcaacataatcaaagttaccgacaaggactgcaatgagtctacagataacgatgagctcgaggatgagccagaggagcccttctacagatactatgtggaggaagacgtatccatcaagaaaagcggcaggaaaaccctcaagcccagaatgagcgtaagcgccgacgaacgggggggacttgaaaacatgcggccgccaaacaacagctctcctgttcaagaggacgccgagaatgctagttgcgagctgtgtggcctgacaattacagaggaagatctctccagtcactatttagctaagcacattgaaaacatctgtgcctgcggaaagtgcgggcagatcttggtgaagggcaggcagcttcaggagcacgcccagcggtgcggagagcctcaggacttgaccatgaatggccttgggaataccgaagaaaagatggacctggaagaaaatcctgacgagcaatccgagatccgggacatgtttgtggagatgctggacgactttagggacaaccactaccagattaacagcatccagaagaagcaactatttaagcattccgcctgcccattcaggtgtccaaactgtggacagagatttgagaccgaaaatcttgttgttgagcacatgtcatcctgtcttgaccaggacatgtttaagtctgctattatggaggaaaatgagagggaccatcggaggaagcacttttgcaatctctgtggaaagggcttttatcagcgctgtcacctgagggaacattataccgtccataccaaggaaaaacagttcgtttgtcagacctgtggcaagcagttcctgcgggaacgccaattaagactacacaacgacatgcacaagggaatggcccggtatgtttgttccatttgcgaccaagggaatttcagaaagcatgatcatgtgcggcacatgatctctcacctgagcgccggggagaccatctgccaagtgtgtttccaaatcttccctaataacgaacagttagaacagcacatggacgtccacctgtacacctgcgggatttgtggggctaagtttaatctgcgaaaggatatgcgctcccattataacgcaaagcacctgaagagaacctag

SEQ ID NO: 21191 - DNA, 105 bp, Artificial Sequence
  Description of Artificial Sequence: Synthetic coding sequence
atggccaagcccagccacagcagctacgtgctgcagcagctgaacaaccagcgtgaatggggcttcctgtgtgattgctgcattgctattgacgatatctactag

SEQ ID NO: 21192 - DNA, 393 bp, Artificial Sequence
  Description of Artificial Sequence: Synthetic coding sequence
atggccaagcccagccacagcagctacgtgctgcagcagctgaacaatcagagagagtggggtttcctgtgtgattgctgcattgcaatcgatgacatctacttccaggcgcataaggccgtcttggccgcctgctccagctatttccgcatgttcttcatgaatcaccagcactcaacagctcagctgaatctgagtaacatgaagatttccgcagaatgctttgatttgattttgcaatttatgtacctgggaaaaataatgaccgccccttcctcattcgaacagttcaaggtcgcaatgaattacctccaactatacaacgtgcccgattgcctcgaggacattcaggatgcagattgctcctcgtccaagtgctcatcaagcgcctag

SEQ ID NO: 21193 - DNA, 1740 bp, Artificial Sequence
  Description of Artificial Sequence: Synthetic coding sequence
atgacccggctggagcggagcagccaccggaccgtgatctgcaaggtcccaggcgagctggttgcaagggagggcaagtgtgcaagcagggcacgcgaaagtgaaatcccttcagaggagggatactgcgatttcaacagcagacctaacgagaacagctactgctaccagctcctcaggcagttgaatgagcagcgcaagaagggaatcctgtgtgatgtctcgatagtagttagcggcaagatattcaaagcccataagaacattctggtggctggttcccggtttttcaagaccctgtactgttttagcaataaggagagccctaatcagaataacaccactcatctcgatatcgccgcagtgcaaggtttctccgtaattctggacttcctctattcaggcaatctggtgcttacatcacaaaatgccattgaggttatgaccgttgcaagttacctccaaatgagcgaagtggtgcagacatgccggaacttcattaaggatgccctcaacatttcaatcaagagcgaagctcctgagtccgtggtcgtggactataataatagaaaacccgttaaccgggatggcctgagctctagcagggaccagaagatcgccagcttctgggccacgcgaaaccttaccaatctggcctcaaacgtaaaaatcgagaacgacggctgtaacgtggacgagggacagatcgagaactaccaaatgaacgactcaagttgggtgcaagatggatctcctgaaatggctgagaacgagtcagaaggacaaaccaaagtgtttatatggaacaatatgggatcccaagggattcaggaaactggaaaaactcgtcgcaagaatcagaccactaaaagatttatttacaatataccccccaacaatgagacaaatctggaggactgttccgtcatgcagcctccagtggcctatccagaggagaatacactccttattaaggaagagcctgacttggatggcgccctgctctccggtccggacggcgaccgaaatgtgaatgccaacctgctcgccgaggccggcaccagccaagacggcggtgatgctggtacaagtcatgatttcaaatatggcctgatgcctggaccatcaaacgatttcaaatatggacttatccccggcacctctaatgatttcaaatacggactgatcccaggcgcaagcaatgacttcaagtatggcctgttacctgagagttggccaaagcaggagacatgggagaatggcgagagttctctcataatgaataaactcaagtgcccacactgttcgtatgtggccaaataccggaggaccttgaaaagacatttgctgatccacacaggcgtgagaagcttctcctgcgacatctgcgggaagctgtttacaagaagggaacacgtcaagcgacatagcctggtacacaagaaggacaagaagtacaagtgcatggtgtgcaagaaaattttcatgctggctgcttccgtgggaatcagacacggctccagaagatatggcgtttgtgtggattgtgctgacaaatcgcagcccgggggccaggagggggtggatcagggccaggacacagaatttcctcgcgatgaagaatacgaggaaaacgaggtcggggaggcagatgaggagctcgttgatgacggcgaggaccagaacgacccctcccgatgggatgaatcaggcgaagtctgtatgagtctggatgactag

SEQ ID NO: 21194 - DNA, 2616 bp, Artificial Sequence
  Description of Artificial Sequence: Synthetic coding sequence
atgagcttcagcgagatgaaccggcggaccctggccttccggggcggtggtctcgtgacggcctctggaggtggttcgaccaataataacgctgggggtgaggcctcagcctggcctcctcagccccagccaagacagcctccacccccagctcctcctgccctgcagccaccaaacgggcgcggcgctgatgaggaagtagagctcgaaggtctcgagccacaggatctcgaggcgagtgctggaccagcggccggcgctgctgaggaagcgaaggaactcctcctccctcaggacgctggaggaccaactagtctgggcgggggagcaggtggacctctactggccgagcggaatcggcgaaccctcgccttcaggggcggggggggtggcgggctggggaacaatggctcctctcgaggaagacccgagacttcagtgtggcccctgcgccactttaatgggaggggccccgctaccgtggacttggaactggatgcgctggagggcaaggaactcatgcaagatggtgccagtctttcagattccacagaggacgaagaagaaggcgctagccttggcgatggttcgggcgcggaaggagggtcttgcagttcttctcggaggagcggcggtgatgggggggatgaagtggaaggctccggggtgggcgccggagaaggcgaaaccgtgcagcactttccactcgctaggccaaagtcgcttatgcagaagctacaatgctccttccaaacatcatggctgaaagacttcccgtggttacgctatagcaaagatactggcctcatgtcctgtgggtggtgccagaagacacccgctgatggcggcagcgtcgacttgccccctgtaggtcacgacgaactgagcaggggaactcggaattataaaaagactctcctgctgcgacaccatgtttctacagagcataagctacatgaggccaacgcccaggagtccgagattccttccgaagaggggtactgtgacttcaactctcgcccaaacgaaaacagctactgttaccaactcctcaggcaattgaatgaacagaggaaaaaagggatcctatgcgatgtttctatcgtggtgtcgggtaaaatcttcaaagctcataagaatatactagtggcaggctctcgcttcttcaaaacgctgtactgcttttcgaataaggagagtcctaatcagaacaatacaacccaccttgatatagctgccgtccaggggttcagtgtcatcttggatttcttgtattctgggaatctcgtattgactagtcaaaacgccatcgaagttatgacagtggctagctacctgcagatgtctgaagtggtgcagacttgtagaaattttatcaaagatgccctgaacatctccattaagtcggaggcccccgaatccgttgtagttgactataacaatagaaaacctgttaatagagacggactcagctcgtcacgagatcagaagatcgcctcattttgggccacaaggaatctaacaaatttggcctcaaatgtgaagatagagaacgatggatgtaacgttgatgaagggcagatcgaaaactatcagatgaacgatagttcttgggtccaggatggctctcctgagatggccgagaacgaatccgaggggcaaacgaaagtcttcatttggaataacatgggttctcagggtatacaagaaaccggcaagaccagacgtaaaaaccagactacaaagcggtttatctacaatatcccgccgaacaatgagacaaatttggaggactgctccgtcatgcagccgcccgtcgcgtacccagaagagaataccctgcttatcaaagaggagcccgacttggatggggccctgctgtctggcccagacggggaccgaaacgtgaacgccaatcttctcgccgaggccggaacttcacaggatggcggtgacgcagggacatcacatgatttcaagtatggattaatgcctggaccatcaaacgacttcaagtacggcctcatcccaggtacttcgaacgacttcaaatatgggcttatcccgggcgcttcaaatgattttaaatatggtctcctgccggaaagctggcccaaacaagagacatgggagaacggcgagtcttctctgattatgaataaactgaagtgcccgcactgtagctacgtggcgaagtatagaaggactcttaagcggcacttgcttattcataccggcgtccgttctttctcctgtgacatctgtgggaaattgtttaccagacgtgagcatgttaaaagacacagcttggtccataagaaggacaagaagtataagtgtatggtgtgcaagaagatttttatgctcgccgcctccgtgggtatcaggcatggctctcggcggtatggcgtatgcgtggactgtgctgacaagtcgcagcctggaggacaggagggcgtagatcagggacaggacaccgaatttccacgagacgaggaatatgaagagaacgaagtgggagaggcagacgaggagctggtcgatgatggagaggatcaaaatgacccatcacggtgggatgaatctggcgaggtgtgcatgagtctggatgattag

SEQ ID NO: 21195 - DNA, 2616 bp, Artificial Sequence
  Description of Artificial Sequence: Synthetic coding sequence
atgagcttcagcgagatgaaccggcggaccctggccttccggggcggaggtcttgtgaccgcctccggtgggggttcaactaacaataacgccggcggggaggcctctgcatggccaccccagcctcagcccagacaaccaccaccccctgccccacctgcattgcagcctccaaatggtcgcggcgccgatgaggaggtggaactcgaaggactcgaacctcaagatctcgaggcctctgcggggcccgcagcaggggcggctgaggaggcgaaagaactcctgctgccacaggatgctggcggccccacgtctcttggaggcggcgctggcggccctctgcttgccgagaggaacagaagaaccttggcatttcgcggaggcggaggaggtgggctaggaaacaacggctcctcaagaggccgtcctgagaccagcgtgtggccccttcggcacttcaatggacgcgggcctgctaccgttgatctggagctcgacgccttggaaggcaaagagttaatgcaagacggcgcgtccttaagcgacagcaccgaagatgaggaagaaggagccagcttgggtgatggctcaggggcagaaggcggatcctgttcaagctcacggcgctctggcggggacggcggcgacgaggtggagggttcaggcgtgggggcaggcgaaggggagacagtgcaacattttcctctggcccggcccaagtccctcatgcagaaactacagtgctccttccagacctcctggctcaaagatttcccgtggctgcgctatagcaaggacaccggcctgatgtcctgcggctggtgtcagaagactcctgcggatggagggagtgtagatctgcctcctgtgggccatgacgagctctctcgcggcacacgcaactataaaaagacgcttctcctgcgtcatcatgtgtccaccgaacacaagttgcacgaagctaacgctcaggaaagtgaaattccgtctgaagaagggtactgtgatttcaatagcaggccgaatgagaactcttactgctaccagctcctgagacagcttaatgaacagaggaagaaggggatactttgcgatgtttccatcgtggtctccggcaagatttttaaggcccataagaatatccttgtggcgggatcaagatttttcaaaaccttatactgtttttccaacaaggaatcccctaatcagaacaatactacccatctggacatagctgccgtccaggggttctcagttattctggattttctgtacagcggcaatttagtcctgacatcacagaatgcaattgaggtgatgacagtcgcatcatatctgcaaatgtcagaggtagtgcagacctgcaggaatttcataaaagacgccctgaacatctcaatcaagagcgaggctcccgagtctgtagttgtggactataataatagaaagccagttaatcgtgacggactctcatcttcgcgcgatcagaaaatcgcttctttctgggcaacccgcaatctcaccaacctcgctagtaacgtgaaaatcgaaaacgatgggtgtaacgtggacgaggggcaaattgaaaactaccagatgaatgacagcagctgggtccaggatgggtctcccgaaatggccgagaatgagtcagaaggacaaactaaggtgtttatttggaacaacatgggttcccagggcatccaggaaactggcaagacaaggcgcaagaaccaaaccactaagaggttcatttacaacatcccaccgaacaacgagactaatctggaggattgtagcgtcatgcagccaccggtggcatatccagaggaaaatactctcctgatcaaagaggagcctgatctggatggggcgttgctgtctggccctgatggcgatcgcaacgttaacgccaatttattggccgaggccggcacttcccaggatggcggggatgcagggacctcacacgactttaaatacgggctaatgcctgggccatctaatgattttaaatacggcctgattccaggaaccagcaacgatttcaaatacggcctcattcccggcgcctctaatgatttcaagtacggcctcctgccagaatcctggcccaagcaggaaacatgggagaatggcgagagcagtctgatcatgaacaagttgaagtgcccccattgttcgtacgtagcgaaatacaggaggacactgaagaggcatctcctgatccatacaggagtgcggtcattctcatgtgacatatgcggaaaactcttcaccaggagagagcatgtgaagaggcactctctggtgcacaaaaaggataaaaagtacaaatgtatggtgtgcaaaaagatcttcatgcttgccgcctccgtgggtattcgccatggatcgcgcaggtatggagtctgtgtggattgtgcagataagagccagccgggtggccaggagggagtcgaccagggtcaggacaccgagttccctcgcgatgaggaatacgaagagaatgaagtcggcgaggctgacgaggagctggtggacgacggagaggaccagaatgacccctcccggtgggacgagagcggggaggtatgcatgtctctcgacgattag

SEQ ID NO: 21196 - DNA, 2544 bp, Artificial Sequence
  Description of Artificial Sequence: Synthetic coding sequence
atgagcttcagcgagatgaaccggcggaccctggccttccggggcggaggactggtcacagcctcaggaggaggttcaaccaacaataatgccgggggggaagcatccgcttggccgccccaaccacaaccaaggcagccacccccccccgcgccacccgcattgcagccgccgaacggccgcggcgcagacgaagaagtggagcttgaaggcctagagccacaggacttggaagccagtgctggccccgcagcgggagccgccgaggaagcgaaagagctgttgctgcctcaggacgcgggtgggccaacgtctctcggaggtggtgccggtggacctctactggcagagcgcaacagacgtacactagcttttcgcggcggaggtggcggcggacttggtaataatgggtcaagcagaggacgcccagagacctctgtgtggcccctgagacacttcaatggcagaggtccggcgaccgtagatctggagctggatgcactggaggggaaagagctcatgcaggacggcgccagcctctccgatagcactgaggatgaggaagaaggtgcgagcttaggggacggaagtggcgctgaaggcgggagctgttctagctcccgccgctccgggggcgacggtggtgatgaggtcgaaggctctggtgtgggcgccggcgagggagagactgtgcagcatttcccattagcacggccaaagtcgttaatgcagaagctacagtgttctttccagacttcctggctgaaggacttcccatggctccgttattcaaaagacaccggcctcatgtcttgcggctggtgtcagaagactccagccgatggcgggagtgtcgacttaccaccggtaggccacgacgagctcagcagaggaaccaggaattacaaaaagactctcctcctcagacaccatgtgtctacagaacataagctgcacgaagcaaacgcacaggagagtgagattccttcggaggagggctactgtgacttcaactcccgtccaaacgaaaattcttactgctaccagctgctgcgacaactgaatgaacagagaaagaaggggatcctttgcgatgtcagtattgtggtgtctggcaagatttttaaagcccataagaacatattggttgccggaagtcgtttttttaaaaccctgtactgtttctcaaataaagagagccccaaccagaacaacaccacccatctcgacattgccgccgtgcagggcttctctgtcatccttgatttcctttattctggtaatctggtactgacatcgcaaaacgccatcgaggtaatgactgtggcgtcctacctgcagatgtctgaggtggtacagacgtgtcgcaattttatcaaggacgctctcaacattagtattaagtcggaggcccccgaatctgtggttgtggattacaacaaccgcaaacccgtgaatcgcgacggcctcagcagttctcgggaccaaaagatcgcatcattctgggcaacccggaatctgaccaatctggcttcaaacgttaaaatcgagaacgatggctgcaacgtggacgagggtcagattgaaaactaccagatgaatgattcttcttgggtgcaggatggctcacctgagatggccgagaacgagtctgaagggcagactaaggtgtttatatggaacaatatgggcagccagggtattcaagagacaggaaagacaagacgaaagaatcagacgacgaagcgatttatatataatattccacctaacaatgagaccaacctcgaggattgttcagtaatgcaacctccagtggcatatccagaagaaaacaccctcttaatcaaggaagagcccgacctggacggagcactcctttctggccccgatggggatagaaatgtaaacgccaacctccttgccgaggccggaacatcgcaagacggcggtgacgctggaactagccacgatttcaagtacgggctgatgcccggcgcatctaatgacttcaagtacggtcttctgcccgagagctggccaaagcaggaaacctgggagaatggtgagtcctcccttatcatgaataaactcaagtgtccccactgtagttatgtggctaaatatagacggactttgaagcgccaccttctgattcacactggagtccgctctttcagctgtgatatctgtggtaagctgtttactagacgggaacacgtgaaacgccactcgctggtccacaagaaggacaagaagtacaaatgcatggtgtgtaaaaagatctttatgttggcagcttccgttggtattagacacggatccaggcggtatggggtgtgcgtggactgtgctgacaagagccagcctggcggccaggaaggagtcgatcagggccaggacaccgagttcccaagggatgaggagtacgaggaaaatgaggttggcgaggctgacgaagaactggtggacgatggcgaggatcagaacgatccatcaagatgggacgagtctggggaggtttgcatgtctctggacgattag

SEQ ID NO: 21197 - DNA, 3162 bp, Artificial Sequence
  Description of Artificial Sequence: Synthetic coding sequence
atgagcagcgaggagagctaccgggccatcctgcggtacctgaccaatgagagggagccttacgcgccaggcacagagggtaacgtgaagagaaaaattaggaaggccgccgcttgttatgtggtcaggggcgggacactgtactaccaacggaggcagcggcaccgcaaaaccttcgctgaactagaggtggtgctccagccggagcggcgacgggacctgattgaagctgcccatctggggccagggggcactcaccatacacgacatcagacctggcattatctgtccaaaacgtactggtggaggggaattctcaaacaggtcaaggattatattaaacagtgcagcaagtgccaggaaaagctcgataggtctcggcctatttccgacgtgtctgaaatgctggaggagctgggtctggatcttgagtccggtgaggagtccaacgagtctgaggacgacctgtcaaattttacaagttcaccaacaaccgcatctaaacccgcaaaaaaaaagccagtgagtaaacacgaactcgttttcgttgatactaagggcgtggtaaaaaggagctctcctaaacactgccaggctgttttgaagcagttaaatgagcagcgcctctccaaccagttctgtgacgtcacactgctaattgagggggaggagtacaaagctcacaaatctgtgctgtctgctaactccgaatatttccgggacttatttatcgaaaagggtgctgtgtcttctcacgaggccgtggtagacttgtcaggtttttgcaaggcatcctttcttccgctgctcgagttcgcctataccagcgtattatcattcgatttctgctccatggccgacgtcgccatactcgctaggcacctcttcatgagtgaagtgcttgagatttgtgagtcagttcacaagttgatggaagaaaaacagctcaccgtgtacaagaaaggcgaggtacaaacagtcgctagcacacaagatttaagggtgcaaaatggcggtaccgccccacccgtggcttctagcgagggtaccactaccagtctacctactgagctgggggattgtgagatagttctgctggtgaatggcgaacttcctgaggcagaacagaacggcgaagtaggccggcagcccgaaccacaggtgagtagtgaggctgagagcgctctgagtagtgtcggctgtatcgccgatagtcacccggagatggagtctgtcgacctgatcacgaagaacaaccagaccgaactcgagacctcaaataaccgtgagaacaacacagtcagtaatattcaccctaaactaagcaaggagaatgttatctcatcctcccccgaggattctggcatggggaatgatatctcagcagaagacatatgtgcagaagacatccccaaacatagacaaaaagtcgaccagcctctcaaggatcaagaaaatttggtggcctcaaccgctaagactgactttggaccagatgacgatacgtatcggtctagactgagacagagatcagttaatgaaggggcttacatacggttacacaagggaatggagaagaaacttcagaagagaaaggcagtgccgaaatctgctgtacagcaagttgcgcagaaactggtgcagagggggaagaaaatgaagcagccgaaacgagatgccaaagagaacacagaggaagctagtcacaaatgtggagaatgtgggatggtctttcagcggcgatatgccctgatcatgcacaagctcaaacacgagagggctcgggattacaagtgcccactgtgtaaaaagcagttccaatacagtgcatcactgcgcgctcacttaattaggcatacccgaaaggacgcccccagcagttcctccagcaactcaacctcaaatgaggccagcggaacttcttccgagaagggcaggaccaaacgggagtttatttgcagcatctgtggacgcaccctccccaagctgtattctcttcgaatccacatgctgaagcacacaggcgtcaagccgcacgcatgccaagtttgcggaaagacgtttatatacaagcacgggctgaaactgcaccagagtctgcaccagtctcagaaacagttccagtgtgaactttgcgttaaatcatttgtgaccaaacgtagtctgcaggagcacatgtctattcacaccggagagagtaagtacctgtgtagcgtctgtggcaaaagctttcatcgggggagtggcttaagcaaacacttcaaaaagcaccaacctaaacctgaggtcaggggataccactgtacacagtgtgagaaatccttcttcgaggctcgggacctgaggcaacacatgaacaagcacctgggcgtgaagcctttccagtgccaattctgcgacaaatgctatagttggaaaaaagactggtactcccacgttaaatctcatagtgtgaccgaaccctaccggtgcaatatttgcggaaaggagttttacgaaaaagccctgttccggcgccacgtgaagaaagccacgcatggcaagaaaggcagggccaaacagaacctggagcgagtgtgcgagaaatgtggcaggaagttcactcagctgagggagtaccggaggcatatgaacaaccacgaaggcgtcaaacccttcgaatgcctgacttgcggagtcgcctgggccgacgctaggtccttgaaaagacatgtccgcacgcacaccggagaacgcccttatgtttgccctgtatgtagcgaggcatatatagatgccaggactctgcggaaacacatgacaaaattccatcgtgattatgtgccctgtaaaattatgctagagaaggacacacttcaattccataatcaagggacccaagttgcccacgcagtaagcatcctgaccgcagggatgcaggagcaggaatccagtggaccacaagagctggagactgtcgtggtaaccggcgagacaatggaggcactggaagcagttgccgccaccgaagaatacccatctgtgagtaccctgtcagatcagtcaattatgcaggtcgtgaactacgtgctggcccagcagcaaggtcagaagcttagcgaggtcgccgaggccatccagaccgtcaaagtagaagtggcccatattagcggcggagaatag

SEQ ID NO: 21198 - DNA, 1380 bp, Artificial Sequence
  Description of Artificial Sequence: Synthetic coding sequence
atggccagcggcgtggaggtgctgcggttccagctgcccggccacgaagctgccaccctccgaaatatgaaccagctaagagccgaagaacggttttgtgacgttaccattgttgcggacagtcttaagttcagaggccacaaggttatccttgctgcatgctcccccttcctaagggatcagttcttgttgaatcccagttcggagctgcaagtgagcctgatgcattctgctcgcattgttgcagacctcttgctgagttgttatacaggagctctggaatttgccgtgagggatatagttaattacctgacggctgcctcttatcttcagatggaacatgtcgtggagaaatgccgcaacgctctgtcacagtttattgaacctaagattgggctgaaggaagatggagtgtccgaggcgtcactggtcagttctatcagtgccacgaagtcccttctgccacctgcacgcacgccaaaaccagccccaaaaccacctccaccaccgcccctgcccccacccctgctgcgccctgtgaaattagagttcccactggacgaagatcttgaactgaaggcagaggaggaggacgaggacgaggatgaggatgtctccgatatctgtatcgttaaggtagaaagcgccctggaggtggcccaccggttaaagcctcccgggggtcttgggggtggactgggtatcgggggctcggtgggcgggcatcttggagagcttgcccaatctagcgtgccaccatcgaccgtggcaccaccacagggggtggttaaagcttgctacagtctgagcgaggacgcagaaggagaggggctgctactcattccgggtggcagggcttctgtgggcgcaaccagcggcttagtggaggccgccgctgttgccatggcagcgagaggagctggggggagtctgggggctggaggcagccgggggcccctgcccggaggattttccggagggaacccattaaagaacataaaatgcaccaaatgtcccgaggtatttcagggggtggaaaagctggtgtttcatatgcgggcacaacattttatatttatgtgcccacggtgcggcaagcagtttaatcactcatctaacctgaatcgccacatgaatgtgcaccgtggcgtcaaatctcactcatgtggaatatgtggaaaatgtttcacccaaaagagcaccctgcacgaccatttgaacctgcactctggagcacgcccatatcggtgcagctactgcgatgttaggtttgcgcataaacctgcgattagacgacacctgaaggaacagcacggaaaaacaactgccgagaacgtgctcgaagctagcgtcgccgagatcaatgtactgattaggtag

SEQ ID NO: 21199 - DNA, 1380 bp, Artificial Sequence
  Description of Artificial Sequence: Synthetic coding sequence
atggccagcggcgtggaggtgctgcggttccagctgcccggccacgaggctgctactttgcgaaatatgaaccagttacgggcagaagagagattttgcgacgttaccatcgtggccgacagtcttaagttccggggccacaaagtaattctggctgcatgcagcccattcctacgcgaccagtttttgctgaacccttcttccgagctgcaggtctccttgatgcactcagcacgcattgtggcagacctcctgttatcttgctatacaggtgccctcgagttcgctgtacgggatatcgtgaactacctgaccgcagcgtcctacttgcaaatggaacatgtcgtggagaagtgtagaaatgcactgagtcagttcatcgagcctaagattggcttgaaggaagatggcgttagtgaagcgtctctagtgtcaagcattagcgcaacgaagtccctgctccctcctgctcggaccccgaagcctgcacccaaacctcctccaccaccccccctgccccctcctctcctgcggccagtcaagctcgaattcccactcgacgaggacttggaactcaaagccgaagaggaagacgaggatgaagacgaagatgtatcggatatctgtattgtaaaagtcgaaagcgctctggaggtggctcacagactcaagcctcccggcggcttagggggcggcctgggaatcggcggatccgtggggggccatttaggcgagctggcccagtcctccgtcccaccttccacggttgcccctccccaaggggtggtaaaggcatgttactccctctccgaggatgcagagggcgagggcctgttgcttatccctggtgggagggcgagtgttggagcaacaagtggtctggttgaagcggccgctgtagcaatggccgcaaggggggctggagggagtctgggggccggggggtcccgggggcccctgccagggggattttccggagggaatcccttaaaaaatatcaagtgtacaaaatgtcctgaggtgttccagggggtggagaagcttgtgtttcacatgagagcccaacacttcatattcatgtgcccaaggtgtggcaaacagttcaaccactcctctaacctcaatcgccacatgaatgtgcatcggggtgtcaagtctcatagttgtggaatttgtggaaagtgttttactcaaaaaagtaccctgcatgatcatttgaatcttcacagcggagctaggccttacagatgtagctactgtgatgtgagatttgcacacaagccagccataaggaggcatcttaaagagcagcacggaaagaccaccgccgaaaatgtattagaggctagcgttgccgagattaatgtgctcattaggtag

SEQ ID NO: 21200 - DNA, 1380 bp, Artificial Sequence
  Description of Artificial Sequence: Synthetic coding sequence
atggccagcggcgtggaggtgctgcggttccagctgcccggccacgaagcagcaacactccggaatatgaatcagctacgagcagaagaacgtttctgtgatgtcaccattgtcgctgatagtctaaaatttcgtggtcataaagtcattctggccgcatgctctcccttcctccgggatcagtttcttctgaacccttcttccgagctccaggtaagtctgatgcacagtgctcgcatcgtagcagatctgctgttgagttgctacaccggagccctcgagttcgctgtgcgggatattgtcaactacctaaccgccgcctcttacctgcaaatggagcacgtggtggaaaagtgtcgaaacgctctgtcccagttcatcgagcccaaaatcggcctgaaagaggatggcgttagcgaggcaagtctcgtttcctcaatcagtgctactaagagtctcttgccacccgcacgaacacccaagcctgctccaaaacccccgcctccgccccccctaccccccccactcctgcgacctgtcaagcttgaattccccctggacgaagatctggagcttaaagctgaagaagaagacgaagacgaggatgaggatgtgagtgacatatgcatcgtgaaggtggaatccgccctagaggtggctcataggctgaagccgccaggaggactgggagggggactaggaatcggcgggagtgtgggtggacatctaggcgagctggctcagtcaagtgtcccacccagcacagttgcacccccgcaaggcgtggttaaggcctgctacagcctcagtgaagacgcagagggggaggggctcttactgatacccggaggcagggcgtccgtaggcgccacatccgggttagtggaggcagccgctgttgctatggctgctaggggggcgggaggcagcctgggggctggcggatctagaggccccctgcccgggggcttctcagggggcaaccctttaaagaatattaaatgtacgaaatgcccggaagtgtttcagggagttgagaaactggtgtttcatatgcgtgctcaacactttatctttatgtgcccccgctgtgggaagcagttcaatcattctagcaacctcaatagacacatgaatgttcataggggggtgaagtcccattcttgtgggatctgcgggaagtgcttcactcagaagtctaccctgcacgatcaccttaatctacactcaggtgccaggccttacaggtgtagctattgtgacgtgaggttcgctcacaaaccagccatacggcgccacctgaaagagcagcacggaaaaactacagcggagaacgtcttggaggcatccgtggctgaaatcaacgttttgattcggtag

SEQ ID NO: 21201 - DNA, 1380 bp, Artificial Sequence
  Description of Artificial Sequence: Synthetic coding sequence
atggccagcggcgtggaggtgctgcggttccagctgcccggccacgaagccgcaactctacgaaatatgaaccagttgcgagctgaggagaggttctgcgacgttaccatcgtcgctgattcgctcaaattcagaggccataaggttatcctggcagcttgtagtccttttctgagggaccagtttctgcttaatcccagctctgaacttcaagtgagtctcatgcattcagccaggattgtcgccgacttactgctgagttgctacactggggctctggaatttgccgttcgcgacattgtaaattatttaaccgctgcatcttacctgcagatggagcatgtggtggaaaaatgtcggaatgctttgagtcaatttatcgaacctaagattggcctgaaggaagacggcgtctcagaagcctctctcgtcagtagtatttcagctacaaagagcctactcccccctgcacgtacacccaaaccagcaccgaagccacctcctccccccccgctgccaccacccttactgagaccagtcaagttggagtttcctctagacgaggatttggagctaaaagccgaggaggaagatgaggatgaggatgaggatgtgtctgacatctgtattgtgaaggtagagtctgcacttgaggtggcccataggctcaagccgccaggcggattaggcggaggactgggaataggtggttccgtgggggggcatctgggtgaactggcacaatcatccgtccctccatcaactgtagcgccgccgcagggagtggtgaaggcttgctatagtctttccgaggacgcggagggagagggcttactgctgattcccgggggtagggcttccgtgggtgccacttccggcttggtagaagcagcagccgttgccatggccgcccggggtgctgggggctccctgggcgcaggcggctccaggggtccccttcccgggggcttttctggcggtaatccactgaaaaatataaaatgtactaaatgtcccgaagtcttccagggcgtggagaagcttgttttccatatgcgcgcccagcacttcatctttatgtgtccgcgttgtgggaagcagttcaaccactctagtaatttaaataggcacatgaacgtgcaccgaggagttaaaagccacagttgtggaatttgtgggaagtgttttactcagaaatctactctacacgaccatctgaaccttcacagtggggcacggccttaccggtgctcctattgtgatgtgaggttcgcgcacaagcccgccatcagacgccatctcaaggagcagcacggtaaaactacagccgaaaacgttctcgaggccagcgtggcggagattaacgtgcttatcaggtag

SEQ ID NO: 21202 - DNA, 1380 bp, Artificial Sequence
  Description of Artificial Sequence: Synthetic coding sequence
atggccagcggcgtggaggtgctgcggttccagctgcccggccacgaggccgccacactgaggaatatgaaccagctgagagccgaagagcgtttctgtgatgtgaccatcgtagcggacagtctcaagttccgcggtcacaaagtgatattggctgcctgtagcccgttcctgcgggaccaatttcttctgaatccgtcatcagagctccaggtttccttaatgcactctgcacgaatcgtcgccgatttactcctcagctgttacacgggcgccctggagtttgccgtgcgcgatatagttaactaccttaccgccgcatcttaccttcaaatggaacatgttgtcgaaaagtgtcgtaacgctttgtcccagttcatcgagccaaaaatcggcttgaaggaagatggcgtgagcgaggcttccctcgtgtcatctatttccgccactaagtccctcctgccaccagcaaggaccccaaagcctgcacccaagccccccccaccccccccactgcctcccccgctcctccggccagtaaaacttgagtttcccctagatgaggatctggaacttaaggccgaggaggaggacgaagatgaggacgaagacgtctcagacatttgcattgtgaaggtggagtccgcccttgaggtcgcccacaggctgaaacccccagggggtcttggtggcgggcttggcatcggcgggtccgtaggcggtcacctcggagaattggcccagtccagcgtgccgccgtcaactgttgcacctccacagggcgttgtaaaagcatgctattctctgtccgaggacgcggaaggggagggcctgctgctgattccaggaggcagagctagcgtcggtgctacttccggactcgtcgaagccgcggccgtagccatggccgcaagaggcgccgggggatctctgggtgccggggggagccgtggaccgctcccagggggcttttccggcggtaaccccctaaagaacattaagtgtaccaagtgtccagaagtgttccagggggttgaaaaactggtctttcacatgcgagcacagcactttattttcatgtgtccacgctgtggtaaacagtttaaccacagctcaaatctgaacaggcacatgaatgtccacaggggcgtgaaaagccactcgtgcggtatatgtgggaagtgcttcacccagaagagtaccctacacgaccacctcaacctccatagcggcgcccgcccctaccggtgttcttactgcgacgttagattcgcacataaaccagccatcagacggcacctcaaggagcagcacgggaaaacaactgccgaaaatgtgctggaagctagcgtcgcggagatcaacgtcctaatccgatag

SEQ ID NO: 21203 - DNA, 1545 bp, Artificial Sequence
  Description of Artificial Sequence: Synthetic coding sequence
atggacctggccaaccacggcctgatcctgctgcagcagctgaacgctcagcgcgaattcggtttcctttgcgattgtacagtagcgatcggcgacgtctactttaaagcccacaagtcagtgttggcttctttctctaactactttaagatgcttttcgttcaccagacgagcgagtgtgtaaggctaaagcctactgatatacaacctgatattttcagctatctgttgcatttgatgtatacaggaaagatggctccacagctgatcgaccccgtgaggttagagcagggcataaagtttctccacgcctatcctcttatccaggaggcaagcctcgcatcacagggtgccttctctcaccccgaccaagtctttcccctcgcctcatccctgtatggtatccagatcgccgaccaccagctaaggcaggcaaccaagattgcatctgctcccgaaaagctggggcgggatccacgtcctcagacttctaggatctcgcaggaacaagtgcccgaagcctcacagctgagtcagctgacatcaaacttggcccaggtaaatagaaccaatatgactcccagtgacccacttcagacttctctctcccccgagctggtcagcacaccggtcccaccgcctcctccaggggaagaaacgaatttggaagctagttcatccgatgagcagcccgcctccctgaccattgcccacgtgaaaccaagtattatgaaacgcaatggatcttttcctaaatattatgcatgccatctttgtggtcgacggttcaccctgagaagttccctccgcgagcacttgcaaatccacactggggtgccatttacctcaagccaacagggcgagtctcgtgtgccattgaccttatgttccaatgcggcggatctaggaaaagacgctatggaagtccctgaggccggaatgatctccgattctgaactccagcacatttcagacagccccattatcgatggacagcagcagtccgaaacaccccctccctctgacatcgcagacattgacaatttggagcaggcggatcaagaaagagaggttaaaaggagaaaatacgagtgtaccatctgtggacgtaagtttatccagaagtctcattggcgcgagcacatgtatattcataccggcaagccttttaaatgtagtacatgtgataaaagtttttgtcgagccaaccaggccgcgcgccacgtttgtctcaaccaaagcatcgatacatacaccatggtcgataagcagacgttggagctgtgcaccttcgaagagggcagccagatggataacatgctcgtgcaaaccaacaagccttataagtgcaacctgtgcgataaaaccttcagcactccaaatgaggtcgtcaaacatagctgccagaaccagaattcagacgttttcgctctggatgaggggagaagcattctccttggttcgggggacagcgaggtgacggagccagatcatcctgtcctggccagtatcaaaaaagagcaggagaccgtcctgcttgactag

SEQ ID NO: 21204 - DNA, 1905 bp, Artificial Sequence
  Description of Artificial Sequence: Synthetic coding sequence
atggagcccagccccctgagccccagcggcgccgccctgcccctgccactgtcactcgcccctcctccattacctctgcccgcagcagccgttgtgcacgtttctttccctgaggtgacttcagctctgctggagtcgctcaaccaacaacggttacagggccaactgtgcgacgtgtccatccgggtgcagggccgggagtttagggcccaccgtgcggtgctggctgcttcatcgccgtactttcacgaccaagtgctgctgaaagggatgacatccattagcctgccgtccgtcatggatccgggtgcattcgagactgtactcgcctcagcatatacaggcaggctgagcatggccgcagcagacatcgtgaattttttgaccgtaggatcagttttacagatgtggcacattgtggacaaatgtaccgagctcctgcgggaaggaagagccagtgctacaacaaccatcactactgccgccgccacttctgttaccgtgcctggtgccggtgttccgtcaggctcaggaggtaccgtggcgccagcaacaatggggagtgcgcgtagccatgcttcctctcgcgcttcagagaaccagtcacccagcagtagtaattacttttcccccagagagtcaactgacttctcctcatcttcacaggaagcattcgccgcttctgccgttggctccggggaaagacgcgggggtgggcccgtgtttcccgctcctgtcgtggggtctgggggggcaacctccggaaaactgctacttgaagctgatgagctctgcgatgatgggggtgacggaaggggcgcagtcgtcccgggggccggcctccgaagacccacatataccccacccagcattatgcctcagaaacattgggtatacgtcaagcgtggaggcaattgccccgctcctacgccacttgtgccacaggatcctgacctcgaagaggaggaggaagaggaggacctagtgttgacgtgcgaggacgatgaggatgaagaactgggcggctcctctagggtgcccgttggcggaggacctgaagcgactctgtccatctcggacgttcgaacgttaagcgaaccccctgataaaggggaagaacaggtgaacttctgcgaatctagcaacgacttcggaccttacgagggaggaggcccggtggcaggactcgatgactccggcggccccacaccctcctcctatgcaccaagtcatccaccgcggccgctgctccccctggacatgcaggggaaccagattctagtgttcccctccagtagttcctctagctcctcccaggcccccgggcagccccctggcaaccaggctgagcacggcgcggtaaccgtcggcggaacttccgtgggttccctgggggttcccggatcagtgggaggagttcctggcgggaccgggtctggggacggcaataagatttttctgtgccactgcgggaaggcatttagccacaagtcaatgagggatagacatgtgaacatgcatctgaacctgcgcccattcgactgcccagtctgtaataaaaaatttaagatgaaacaccacctgaccgaacacatgaagacacacacaggtttaaaaccttatgaatgtggtgtttgcgccaaaaagttcatgtggagagatagctttatgcggcaccgtggtcactgcgaacggagacaccggcttgggggggtgggcgccgtgcccggtcccggaacccctacagggccgtccctcccaagcaaacgtgagtctcctggagtgggggggggctcaggggacgaggcatctgctgccacaccccccagctcacgtcgagtatggagcccccctagggtacacaaggtcgagatgggctttggagggggtggtggagccaactag

SEQ ID NO: 21205 - DNA, 1905 bp, Artificial Sequence
  Description of Artificial Sequence: Synthetic coding sequence
atggagcccagccccctgagccccagcggcgccgccctgcccctgccgctatccctggcacctcctccgttaccgctgcccgcagcagccgtcgtacacgtgtcttttcctgaagtaacgagcgcattactggagagcctgaaccagcagcgcctgcagggccaactctgcgatgtgtcaattagggtgcagggtcgggagttccgagctcatcgggcagtactcgccgcaagttctccatacttccatgaccaagttcttctgaagggaatgacatctatctctttacctagtgtgatggaccctggtgctttcgagacagtgttggcttccgcctacaccggacgcctctctatggcagcagccgacatagtgaattttctcacggtgggatcggtacttcaaatgtggcacatcgtagacaaatgcaccgaactcctgcgtgaaggccgggcctcggcgaccactacaatcacgaccgccgccgccactagcgtgactgtgcccggggcaggtgtgccctcaggttctggcgggactgtggccccagcgacaatgggctccgcgcggagtcacgctagttcccgagcctcggaaaatcagtcacccagctccagtaattacttcagcccacgagagtctacagacttttcaagcagctcccaagaagcttttgcagccagcgctgtgggatcaggagaaagacgaggaggaggacccgtcttcccggcgcccgttgtgggctctggaggagctacttctggaaaattactcctggaggcggacgagctctgtgacgatgggggtgatggtagaggcgctgtggtgccaggcgctgggctcagacgacccacttatacacccccttccattatgcctcagaagcattgggtgtacgtgaagaggggaggaaactgccccgcacccactcctctcgtgccacaggatcccgatctggaagaagaggaggaagaggaagacctggtgttgacctgtgaggacgatgaggacgaggaactcggaggatccagcagggttcccgtaggaggagggcccgaggcgacactgtccatctcggacgtgagaaccctgtcagaaccccccgacaagggagaagagcaagtgaacttctgtgagtccagcaatgattttggcccctacgagggtggcggccccgtggctgggctcgacgatagcgggggtcccacaccttccagctacgctccatctcacccgcctagaccgctcctgccactggacatgcagggcaatcagatcctggtctttcccagcagctctagtagttcctccagtcaagcaccaggacagccccctggcaatcaggctgagcatggagccgttaccgtgggaggaacctccgtggggtcactgggagtgccaggtagcgtgggaggggttcccggaggcaccggttcaggtgatgggaataaaattttcctgtgtcactgcggaaaagcgttttctcataagtcaatgagggataggcatgttaatatgcacttgaacttgaggccttttgactgtcccgtatgcaacaaaaagtttaaaatgaagcaccacttgactgagcacatgaaaacgcatacgggactgaagccatacgagtgcggagtttgcgccaaaaagttcatgtggcgcgattctttcatgaggcaccgaggccattgtgaacggagacaccggcttggcggtgtcggcgcagtccccggacccggaaccccaactgggccctctcttccttccaagagggagtccccaggcgtgggaggtggctccggtgatgaggcatccgccgcgacccccccatctagtcggcgcgtgtggagcccacctcgggtgcacaaggtggagatgggattcggagggggaggtggcgccaactag

SEQ ID NO: 21206 - DNA, 450 bp, Artificial Sequence
  Description of Artificial Sequence: Synthetic coding sequence
atggagcccagccccctgagccccagcggcgccgccctgcccctgccgctgtcgcttgcccccccacctctgcccctcccagccgctgcagttgttcatgtttcatttcccgaagtaacttcagccctgttggagagtctcaatcagcagcggctgcaggggcagctttgcgacgtttcaattcgagtgcagggtcgggaatttcgcgcacaccgcgcagttctggcagcctcatcaccttatttccacgaccaggtgttattgaagggtatgacctctatctctctcccgtccgtgatggatcccggggcattcgagacagtgctcgcttcagcttatactggccggcttagtatggccgctgccgatatcgtgaactttttaactgtcggtagcgtcttgcaaatgtggcacatagtggataagtgcacagagttgctgcgcgaatag

SEQ ID NO: 21207 - DNA, 450 bp, Artificial Sequence
  Description of Artificial Sequence: Synthetic coding sequence
atggagcccagccccctgagccccagcggcgccgccctgcccctgcccctgtctctggctccgcctcctttacctctgcccgccgcggctgtggtacacgtctcctttccagaagtcacttcagcccttttagaatccttgaaccaacagaggcttcagggccaattgtgcgacgtttctatccgtgtgcaagggcgcgaattcagagcccatcgcgctgttctagctgcgagcagcccttattttcacgatcaggtgctgttaaaaggcatgacttccattagtctgccttcggttatggaccccggcgccttcgagactgtgctggcctccgcttacaccggccgcctgagcatggcggccgcagacatcgtgaacttccttacagtcggtagcgtcctccaaatgtggcatatcgtggataagtgtactgagctgttgcgtgagtag

SEQ ID NO: 21208 - DNA, 1905 bp, Artificial Sequence
  Description of Artificial Sequence: Synthetic coding sequence
atggagcccagccccctgagccccagcggcgccgccctgcccctgcctctctcactggcgcccccaccactccccctacccgctgctgcagtggtgcacgttagttttcctgaggttacaagcgcgttgttggagagccttaatcagcagcggcttcaggggcagttgtgtgatgtgtcgatccgggttcaaggcagggagtttagggcgcacagagccgtactggctgccagcagtccttacttccacgaccaagtgctgttaaagggcatgacctctatctcgctgccttcagtgatggatcctggcgcttttgagactgtattagcctcagcatatactgggcgcctctccatggctgctgctgatatcgttaattttctgaccgtggggtccgtgcttcagatgtggcacattgtggacaaatgtaccgagctattgcgcgaggggcgggccagtgccaccacgacaataaccactgccgctgcaaccagcgtgacagtcccaggcgccggcgttccatcaggcagcggcggaactgtcgctcccgctacaatggggtcagcccgctcacacgctagcagccgagcctctgaaaaccagagtccatcaagctctaattatttcagtcctcgagagtcaacagatttttctagtagttcacaggaggccttcgcagcgtcagcagttggttccggggaacgtcgaggaggcggccccgtcttcccggcccctgttgtagggtcaggcggcgcaacatctggcaagctgctactggaggcagacgaattgtgtgatgacggaggggacggacgtggagcggtggtgcccggggcaggtctgcgcaggccgacctacactccaccctccattatgcctcagaagcactgggtatacgtgaaacggggtggaaattgcccagcccccacccccctggtgccacaagatcccgacctggaagaggaagaggaggaagaggatttagtgctgacctgcgaggacgacgaagacgaagagctcggcggatcaagtcgagtgccagtaggcgggggaccagaggcaaccctttccatttccgatgtgcgcacactttcggagccgcctgacaaaggagaggagcaggtgaatttctgtgagagttctaacgactttggaccttatgagggaggagggcccgtcgccgggctggatgactcgggcgggccaacaccgtctagctacgccccttctcaccctcccaggcccttattgccgctggacatgcaggggaaccagatcctggttttcccttcaagttctagctccagttcgtctcaggcccctggtcagcccccgggaaatcaagccgaacacggcgcggttaccgtaggcggaactagcgttggaagccttggcgtgccgggatctgttggaggcgtccccggaggaacagggagcggcgacggaaacaagatttttttgtgccactgcggaaaggctttttcccataagagcatgcgggatagacacgtcaatatgcatctgaatctgcgtcccttcgactgtcctgtgtgcaataaaaaatttaagatgaaacaccacctgaccgagcacatgaaaacccatacggggctaaagccttatgagtgcggtgtttgcgcaaagaagttcatgtggagagattcattcatgcggcatcgtggtcactgcgagcggcggcacagactcggaggcgtcggcgctgtgccgggtcccggtaccccaacaggtccatcattgccgtcaaaaagggagtcgccaggggtgggcgggggttcaggtgacgaggctagcgctgcaaccccacccagtagcagacgagtgtggtctccacccagggttcacaaggttgaaatggggtttggcggaggtggcggcgccaattag

SEQ ID NO: 21209 - DNA, 1905 bp, Artificial Sequence
  Description of Artificial Sequence: Synthetic coding sequence
atggagcccagccccctgagccccagcggcgccgccctgcccctgccgttgtccctggccccacccccgcttcccctcccagccgccgctgtagtgcacgtgtcatttcccgaggtgacgagcgcactcttggaaagcctcaatcaacagcggctgcagggccaactctgcgatgtctccatccgggtgcagggcagggaattcagagcccatagagcggttctggcagcatcaagcccatatttccacgatcaagtgttgctgaagggcatgacaagtatctcacttccatccgtcatggaccctggagcttttgaaacagtcctggctagcgcttatacagggaggctcagcatggcagcagctgatattgtgaattttctcaccgtgggttcggtgctacagatgtggcacatagtcgataaatgcaccgagcttctgagagagggacgcgcgtccgcaacaaccaccatcaccacagcagctgccactagtgtaaccgtgcctggggccggcgtgccttcaggttcaggcggcacagtcgccccagccacaatggggagcgctaggtctcacgcgagttcccgtgccagcgaaaaccaatccccgagttccagcaattatttctctccccgcgagtctacggattttagtagtagcagtcaggaagcatttgctgcctcagcagtgggcagtggtgaacgtaggggtggcgggcccgttttccctgcccctgtggtgggctctggcggggccacttctggaaaactcttgctggaagccgatgagctgtgcgatgatggcggcgacggaagaggggccgttgtgcccggagccggcttaagaaggcccacatacacccccccctccatcatgcctcagaagcattgggtgtacgtgaaacgcggcgggaattgccccgcgccaactccactcgtaccccaagaccctgacctggaagaggaagaggaggaagaggatctggttctcacttgcgaggatgatgaggatgaggagcttggtggaagttcacgcgtcccagtaggtggtgggcccgaggcgaccctatccatttctgatgtgcggaccttgtcagaaccacccgataagggagaggagcaagttaacttttgcgagtcaagtaatgactttggcccttacgagggcggcggacctgtggcaggactggacgattccggtgggcctactccatcttcttatgcaccatcgcacccaccacggccactccttccgctggacatgcaggggaatcaaatactagtctttccaagttctagctcgagcagttcctcccaggctccaggccaacctcccggaaatcaggccgaacatggagcggtaacagttggcgggacttcagtcggatccctcggtgtgccgggcagtgtgggaggtgtgcctggtggcaccggcagcggagatgggaacaaaattttcctgtgtcactgtgggaaggccttttcacataagagcatgagggataggcatgtcaatatgcacttaaacctgaggccattcgactgccccgtttgcaataaaaaatttaaaatgaaacatcatctgactgagcatatgaaaacacacactggcctgaagccctacgagtgtggggtgtgtgccaaaaaatttatgtggcgtgactcatttatgagacaccgggggcattgcgagcgacggcataggttaggaggtgtcggcgctgttcccgggcccggaactcctacgggtcccagcctccctagcaaaagggagagccctggcgtgggcgggggctcaggtgatgaagcttccgccgctactcccccttccagccgacgcgtctggtctccgcctagggtccacaaggtggagatgggcttcgggggtgggggaggggcaaattag

SEQ ID NO: 21210 - DNA, 1326 bp, Artificial Sequence
  Description of Artificial Sequence: Synthetic coding sequence
atgagcgagcggagcgacctgctgcacttcaagttcgagaactacggtgatagcatgcttcagaagatgaataagttaagggaggagaacaaattttgtgatgtgaccgtgcttattgatgatatcgaagttcaggggcataagattgtgtttgcggccggatcgccttttctgcgagatcaattcttactcaatgactcccgcgaggtgaaaattagcatcctccagtcttctgaagtgggccgtcagctcctgctctcctgctatagcggcgtactggaattcccggaaatggagctggtgaattatcttaccgctgcctcctttctgcagatgtctcatatagtggaacggtgtacccaggctctctggaagttcatcaagcctaagcagcccatggatagtaaggagggttgtgagcctcagagtgcctctccccaaagtaaagagcagcagggagatgctcgaggctcccctaagcaggactctccctgtatccatccttccgaggactcaatggacatggaagattcagacattcagatcgtaaaggttgagtccatcggagatgtgagtgaggtccggagcaaaaaagaccagaaccagttcatttcatcagagccgaccgccctacacagtagtgaaccccagcattcactgataaactctactgttgaaaaccgggtgtccgaaatagagcagaaccacctgcacaactatgcactttcttacactggatccgacaacatcataatggcttcaaaggatgtgtttgggcctaatatccgtggggtggacaagggactgcaatggcaccatcagtgcccaaagtgcacgcgtgtgtttaggcacctcgaaaactatgctaaccatttaaagatgcataagctcttcatgtgcctgctgtgcgggaagaccttcacacagaaggggaacctgcatcgccacatgcgcgtccatgctgggattaagccgttccagtgcaagatctgtggaaagactttttcccagaagtgctcgttacaagatcacctgaatctgcactcaggtgataagccccataagtgcaactactgcgatatggtgtttgctcataagccggtccttcgcaagcacctgaaacagctacacggcaaaaacagcttcgataacgctaacgagagaaacgtgcaggatctgactgtggacttcgactcatttgcatgtacaaccgtcacggattcaaaagggtgccagccccagccagatgccacccaggtgttagatgcagggaagctcgctcaagcagtgctgaaccttcggaatgactcaacctgtgttaattag

SEQ ID NO: 21211 - DNA, 1326 bp, Artificial Sequence
  Description of Artificial Sequence: Synthetic coding sequence
atgagcgagcggagcgacctgctgcacttcaagttcgagaactacggagactccatgttgcaaaagatgaacaaattaagagaagagaataaattctgcgatgttactgtgctgatcgatgatattgaggtgcagggacacaaaattgttttcgccgctgggtccccatttctgcgtgaccagttcctacttaacgattcccgcgaggtgaaaatttctatcctgcaatcatccgaggttgggagacagctcctcttgtcatgttactcgggggtgctcgagttcccggagatggaactggtgaactatcttacagccgcatcattcctgcagatgagtcatatcgtggagcgttgcactcaagccctatggaagttcatcaagcctaagcagcccatggatagcaaggaaggctgcgaacctcagagtgcctcaccccaaagtaaagaacagcagggggacgcgaggggaagcccaaagcaggactccccatgtatccatccttctgaggactcaatggatatggaggactctgacattcagatcgtgaaggtggaatccataggtgatgtaagcgaagtgcgatccaaaaaagaccagaaccagtttatctctagcgagcctactgccctccactccagtgagccccagcatagtctgatcaattccactgttgagaatagagtgagtgagattgaacaaaaccacctgcacaactacgcgcttagctatactggcagcgataacataattatggcctccaaagatgtgtttggacccaacattagaggagtcgacaaggggctacagtggcaccaccagtgcccgaagtgcaccagagtcttccggcatctggagaactacgcgaatcacctgaagatgcacaagctgttcatgtgtctgctgtgtgggaagaccttcacccagaagggcaaccttcaccgccatatgcgggtgcatgcaggcatcaaacctttccagtgtaagatttgcggtaagactttttcgcaaaagtgtagcctccaggatcacctgaatctgcatagtggggataagcctcataaatgtaattattgtgacatggttttcgcccataaacctgtactgaggaaacacctaaaacagctgcacggtaagaactcctttgataacgccaatgagcggaatgttcaggacttgactgtcgactttgactcgttcgcctgcacaacagtcacagatagcaaaggttgtcagccccagcctgacgccactcaggttctcgatgcaggtaagctggcccaggctgtcctaaatttgcgcaatgacagtacttgtgttaactag

SEQ ID NO: 21212 - DNA, 1725 bp, Artificial Sequence
  Description of Artificial Sequence: Synthetic coding sequence
atgctgcgggagttcagcaagtggggcgtggaggccagccccggcaaggcttgggagaggaagaggtccctcctgagaggtgctgtgggacgttaccgtggggcaaccggtggagacctgttctgggcacctttcccatcctggggaacaatggagtttccggagcactcacaacagctgctgcagtctcttcgagaacagcgctcacaaggattcctgtgcgattgtaccgttatggtaggctcaacccaattcctcgcacacagagctgtgctcgcttcatgttcacctttttttcaactgttttataaggagagagaacttgataagcgcgaccttgtgtgtatccataatgaaattgtgacggcaccagcctttgggcttttgctggacttcatgtatgctggtcagcttacactccgcggtgacaccccagtggaggatgttctggccgcagcttcctacctgcacatgaatgacatcgtgaaggtgtgcaaaaggcgtttgcaggcacgggccctggccgaagctgatagcacaaaaaaggaggaggagacaaacagtcaactgccctctcttgaattcctgtccagcacttcaaggggaacgcaaccctcactcgcctcagccgaaacgagtggacattggggcaaaggggagtggaagggaagcgccgcccctagtcccactgtgcgacctccagatgaacctccgatgagctcaggtgctgacaccacgcagccgggcatggaggtggatgctcctcacctgagggccccgcatccacccgttgctgacgtctctctcgcatccccctcctcgtccactgaaactatccctacaaactatttttcctccggtatcagcgccgtgtccctggaacctctaccatcactggacgtgggacccgaatcgctgcgggtggtagagcccaaggatcctggcgggcccctgcagggcttttatcccccggcaagcgctcctacaagcgcaccagcacctgtgagtgctcctgtgccaagccaggcacccgcacctgcagaagctgagctcgtgcaggtaaaggtggaagcgatagtcatctcagacgaagagacagacgtgagcgatgagcagccccaaggacctgaaagagcgttccctagcggcggagcagtgtacggagctcagccgagtcagcccgaagccttcgaggacccaggtgccgccggtctcgaagaagttggcccatctgatcacttcctgccaaccgatccacatctcccttatcacctattaccaggagcgggtcagtaccacagaggactggtgaccagccctctgcctgcccctgcgagtttgcacgagcccctttacctgtctagtgagtacgaggctgcgcctggctctttcggcgtattcaccgaagacgtccccacctgcaagacgtgcggaaagacattttcatgcagctatacgcttcggaggcacgcgacagtgcacacacgggaacggccctatgagtgcaggtattgtcttaggtcctacacccagagcggagatttataccggcacattcgcaaggcacacaatgaggacttagccaaaagaagtaaaccagaccccgaggtgggtccactcctcggtgtgcagccactgcccggcagtcccactgcagacaggcagtccagcagcggtggaggtccgcctaaggacttcgtgctcgccccaaaaacaaatatttag

SEQ ID NO: 21213 - DNA, 1512 bp, Artificial Sequence
  Description of Artificial Sequence: Synthetic coding sequence
atggagaagggcggcaacatccagctggagatccccgacttcagcaactccgtgctgtcccacttgaaccaactgaggatgcaaggacgtctgtgtgacattgtcgtaaacgtccagggacaggccttccgtgcccacaaagtcgtgttagccgcaagtagtccatactttagggaccatatgagcctgaacgagatgtcaactgtctctattagcgtcatcaagaatcctacagtttttgagcagctgttgagcttttgctacaccggccgtatttgcctccagctggcagatattatcagctatctgaccgccgccagtttccttcagatgcaacatattatcgataagtgcacccagattctggagggcatccactttaaaatcaatgtcgctgaggtggaagccgaactcagccagactcgcacaaagcaccaggagcgaccgcccgaatcccaccgagtgactccaaatctgaatcggtccctttcccccagacacaatacacccaagggaaaccgacggggacaggtctccgcagtactcgatatccgggagttgagtccgcctgaggagagtacatcgccccagattatcgagccatccagtgacgtcgagtcccgagaacctattctcagaatcaatcgggcaggccagtggtacgtggagactggagtggcagatagggggggacggtccgacgacgaagtgcgggtgctgggtgctgtgcacattaaaacagaaaatctcgaagagtggctcggccccgaaaaccagccttctggcgaggatggaagtagcgccgaggaggtcaccgcgatggtcatagacacgaccggacacgggtctgtgggccaggaaaattatacactcggatcctcaggggccaaagtagcccggccaacctcatctgaagttgatagattcagccccagcggaagcgtcgtgcccctgaccgagcgtcaccgggcacgtagtgagtcacctggtcggatggatgagcccaaacaacctagcagccaagttgaggagtccgctatgatgggggtatcagggtatgttgagtatctacgtgagcaagaagtgtcggaaaggtggtttcggtacaaccctagactaacttgcatttattgtgcaaagtcatttaatcagaagggttctctggaccggcatatgcgacttcacatgggaatcactccctttgtatgtcggatgtgcggtaaaaagtacacgcggaaggatcaactcgaatatcacattcggaaacacactggaaacaagccttttcactgtcacgtctgcggcaagtcctttcccttccaggccatactgaaccagcactttcgcaagaaccaccccggctgcatcccacttgagggtccccacagcatatctcctgagactactgtcacttcacgcggccaagccgaagaagagtctccatcccaggaagagaccgtagcgccgggagaggctgtccaggggtccgtttctactacgggtcccgactag

SEQ ID NO: 21214 - DNA, 1236 bp, Artificial Sequence
  Description of Artificial Sequence: Synthetic coding sequence
atgcccgccaccggccggtaccaccagctgcccaacagctgccagttttccgcaaatgcagcgtattataggcagatgtatactgatcctgggggacactcttttaaaatcaacgtggcagaagtggaggcagaactttcacagacgcgcaccaagcaccaggagaggccacctgagagccatcgtgtcacccccaatttgaacagatctctttcaccacgtcacaacacacccaaaggaaacagacggggacaggtcagtgccgtgctggatatccgggaactgtctccccctgaggaatcaacgtcccctcagataattgagccctcttctgatgtcgagtctagggaaccaatccttcgaataaacagagccggacagtggtacgttgagactggtgtggctgaccgcggcgggagatctgatgatgaagttcgggtgttgggggctgtgcacatcaagactgaaaacctggaagagtggttagggcctgagaatcaacctagcggagaagatggaagctcagccgaggaagtcaccgccatggtgatagacacaactggccacggttctgtgggtcaggagaattacactctggggtcgagtggtgccaaggtagctcggcccacgtcctccgaagtggatcggtttagcccttcagggtctgtggtgccactcacagagcggcacagggcgcgctctgagtccccaggacggatggatgagcctaaacaacccagttctcaggtcgaggagagtgcgatgatgggggtcagcgggtacgtcgagtacttaagagaacaagaggtctccgagcgatggttcaggtacaaccctcggctgacttgcatttattgtgcgaagagcttcaatcaaaagggatctctcgaccggcacatgcggctgcatatggggatcacacctttcgtctgcaggatgtgtggaaaaaaatataccagaaaggaccagctggaataccatattcggaaacataccggaaataagcccttccactgtcacgtgtgtggcaaatccttcccattccaagccattctcaatcaacatttccgaaagaatcaccccggctgcattccactagagggcccccatagtattagtccagagaccactgtgacatcccggggccaggccgaagaagagagcccaagccaggaggaaaccgtggcaccaggtgaggccgtgcaggggagcgtgtcgaccaccggtcccgattag

SEQ ID NO: 21215 - DNA, 927 bp, Artificial Sequence
  Description of Artificial Sequence: Synthetic coding sequence
atggagaagggcggcaacatccagctggagatccccgacttcagcaattctgtgctcagtcacctcaatcagcttcgcatgcagggtaggctgtgtgatatcgttgtgaacgtgcaggggcaggcctttagagcccacaaggtcgtccttgcagccagttcaccatactttcgagatcatatgagcctgaatgaaatgagcacagtgagtatctcagttataaaaaatccgactgtattcgagcagctgttgtccttctgttacacaggacgcatctgtcttcaactggcagacattatctcctacctgaccgctgcatcgtttctgcagatgcagcacattatcgacaaatgtacccagattctcgaaggaattcacttcaaaattaatgtagccgaggtcgaggcggaactgtcgcagacccggactaagcaccaggaacgaccacctgaatctcacagagtgacccccaacctcaatcgttccctcagtcctcgccacaatacacctaaggggaatcggagaggtcaggtatcagcggtgctggacatccgcgaactgtcacctcctgaggagtcaaccagcccccagatcattgagccatccagtgatgtggaatcccgggagcctatcctcagaatcaaccgggccggccaatggtatgtggaaactggagtggcggatcgtggcggccgctccgacgatgaagtgagggtcctgggcgctgtgcatatcaaaacagaaaatctcgaagagtggttgggtccagaaaaccagcccagcggcgaagacggatctagcgccgaagaggtgacggccatggtgatagatactaccggccacggttcagtgggacaggaaaactacacacttggaagcagcggtgccaaggtggcgcgccctaccagctctgaggtggaccgctag

SEQ ID NO: 21216 - DNA, 1512 bp, Artificial Sequence
  Description of Artificial Sequence: Synthetic coding sequence
atggagaagggcggcaacatccagctggagatccccgacttcagcaactccgtgctttcccacctcaatcagctcaggatgcagggccgtctatgcgacatcgtggtgaacgtccaaggccaggcgttccgggctcacaaagtggttttggcagcctctagtccatattttagagaccacatgtccttgaatgaaatgagcaccgtgtccatctctgtgataaaaaacccaaccgtgttcgagcagctgctctctttttgctataccggtaggatttgcctccagctagctgatattatcagttatctcaccgctgcttcatttctgcaaatgcagcacatcatagataaatgcacccagattttagaaggaatacacttcaaaatcaacgtagccgaggtggaggcggagctgtcccagacgcggactaaacatcaagaaagacctccagagagccacagggtgaccccaaatcttaatcgtagcctgtcccctcggcacaataccccaaagggcaataggaggggacaggtatcagcagtgctggacattcgcgagctctctccgcccgaggagtccacaagcccgcagataatcgaaccctctagcgacgtcgagagtcgcgagccaatactcagaatcaaccgtgctggccaatggtatgtggagacaggggtcgccgatcgcggtggcagaagcgatgacgaggtgagggtactgggcgcagtccacataaagacagaaaaccttgaggagtggttaggtcctgagaatcagccatccggggaggatggcagcagtgccgaagaagtgaccgccatggtcatagacacaacagggcacgggtctgttggccaagagaattacactctaggttccagcggggccaaagtagccagacccacttcttccgaggtggacagattctcccctagcgggtcagtggtgcccttaacagagcggcaccgggctcgcagtgagtcccctggccgcatggatgagcccaaacagccctcatcccaggtggaggaatcagcaatgatgggcgtctctggatatgtggagtatctgcgggaacaggaggtctctgagcgttggttcaggtacaacccgcggctcacgtgtatctattgcgctaaatcctttaaccagaaagggtctctggatagacatatgcgactccacatgggtatcactccctttgtatgcaggatgtgcggtaaaaagtataccagaaaggaccaattggaataccatatcagaaaacataccggaaacaagccctttcactgccacgtctgcggtaagagctttccattccaggccattctgaaccagcacttcaggaagaatcaccccggctgtatacccctggagggcccccatagtatctcaccggagaccacagtaacctccagggggcaagccgaggaagagtcaccaagccaagaagagaccgtggcccctggggaggccgtgcaggggtctgtgtccactacaggcccagactag

SEQ ID NO: 21217 - DNA, 1086 bp, Artificial Sequence
  Description of Artificial Sequence: Synthetic coding sequence
atggagaagggcggcaacatccagctggagatccccgacttcagcaactctgtcctgagccatttgaaccagcttcgaatgcagggccgcttgtgtgacatcgtggtcaatgtccagggccaggcgttcagggcacataaggtcgtactggctgcctcaagtccttatttccgcgaccatatgagtttgaacgaaatgagcacagtctctatcagcgtaataaagaatccaacggtgttcgaacagctcctctcgttctgctacacaggtaggatttgcttacagctcgcagatatcataagttacttgaccgctgcaagcttcctacagatgcagcatattatcgacaagtgcacacagatattagagggtattcattttaagattaacgtcgcagaggtggaggcggagctcagccaaaccagaaccaagcaccaggaacgtccgcctgagtcgcacagggtgaccccaaacttaaaccgatcattgagcccaaggcataacacgccaaaagggaacagaagaggccaagtctccgccgttctagacatacgggaactgagcccccctgaagaatcaactagcccccagatcattgagccaagttctgatgtcgagtctcgagaacccatattgaggataaacagagcgggacagtggtacgttgagaccggcgtggccgacaggggtggaagatcagacgacgaggtcagagtcctcggtgccgtgcacatcaaaacagaaaatttggaggagtggctcggacctgagaaccaaccctccggagaggatggcagttccgctgaagaggttaccgcaatggtgattgacaccacaggccatggatcagtcggacaggagaactacacgcttgggtccagtggagccaaagtcgcacgaccaaccagtagcgaggtagatagattctctccgtctggctctgtggtgcccctgacagagcgacacagggctaggtctgaatccccaggccggatggacgagccaaagcaacccagtagccaggtgtggtcgtgcgggtttagaacggcgctggtggtggggggaatcgccaccgtctacgagtag

SEQ ID NO: 21218 - DNA, 1512 bp, Artificial Sequence
  Description of Artificial Sequence: Synthetic coding sequence
atggagaagggcggcaacatccagctggagatccccgacttcagcaacagcgtcctttcacacctaaatcagttgaggatgcagggtcgtctttgtgacatcgtcgtgaacgttcaggggcaggccttccgggctcataaagtggtgctggctgcttccagcccttactttagggaccacatgtcactgaacgaaatgtcgaccgtatctatctccgttatcaaaaacccaactgtattcgagcagcttctgtcattttgctacaccggccgaatctgcctccagctggccgacattatttcctacctgacagccgccagcttcctccaaatgcagcacattatagacaagtgcactcagatcctcgaaggtatccacttcaagattaatgtggccgaggtggaggctgagctgtctcaaacccgcactaaacatcaggaacgaccacccgaatctcacagggtgacacccaaccttaaccgatccctgtcacctaggcacaacactcctaagggcaataggcgagggcaagttagtgcagtcctcgatataagggaattaagcccacccgaggagagcaccagccctcagatcatcgagccatcctctgacgtggagagcagggaaccaattttgcgcatcaaccgcgccggccagtggtacgtggagactggcgtcgcagatcgaggcggacgaagtgacgacgaggtccgggtgctgggagctgttcatattaagactgagaacctcgaagagtggctgggcccagaaaaccagccttccggtgaagacgggtcatcggccgaggaggtcaccgccatggtgatcgatacaactggacacggcagcgtgggccaagagaactacacacttggctcttctggggctaaagtggcaagacccacatcatccgaagtcgacaggttttctccatccggctctgtggtccctctaaccgaacgccatcgggctcgcagtgaaagccccggccgtatggatgagccaaaacagccaagttcccaggtcgaggagagcgctatgatgggagtaagtggttacgtcgagtatttgcgcgaacaggaggtgagcgagagatggttcagatacaaccctcggcttacttgtatatattgtgccaagtctttcaaccagaaaggatctttggatcggcatatgagactgcacatgggaatcaccccatttgtctgtcgcatgtgcggtaaaaaatatacaagaaaagaccagctcgagtaccatattcggaaacacaccggcaacaagcctttccattgccatgtgtgtgggaagtccttcccgtttcaggcaatactgaatcagcattttaggaagaaccatcccggatgcatcccgctggaagggccgcatagcatctcccccgagaccacggtgacgagccgtggacaggctgaggaggagtcaccttcacaggaggagaccgtcgcacccggggaggctgtccagggcagcgtgtctactaccggaccagattag

SEQ ID NO: 21219 - DNA, 2139 bp, Artificial Sequence
  Description of Artificial Sequence: Synthetic coding sequence
atgggcatgcggatcaagctgcagagcaccaaccaccccaacaacctcttgaaggaactgaacaagtgtcggctctcagaaacaatgtgtgacgtaactatagtcgtgggaagtcgcagctttcctgcccacaaggctgtgttagcatgcgctgccggctactttcaaaatctgtttctaaatactggcctggacgctgcaaggacgtacgtggttgattttataacacctgcgaactttgaaaaggttctatccttcgtgtacactagtgagttgtttactgacctgattaacgtcggagtgatctacgaagtggcggagcggctgggcatggaggaccttttgcaagcttgtcactcgacgttccctgacctggaatctacagccagggctaaacctctcacttctacatcggagtcacatagcgggactctgagctgcccctctgctgaacctgcacaccctcttggggagctgcgaggggggggggattatctgggcgcggatcggaactacgtactgccctcagacgccggaggcagttacaaagaggaggagaaaaacgtcgcctctgatgcgaaccactctctacatctcccccagccccctccccccccaccaaagacggaggaccacgacactccagctcccttcacctccatcccctcaatgatgacgcagcccttattaggcaccgtctcaaccggaattcagacctctacctcctcatgccaaccatacaaagtgcagagtaatggagatttctcgaagaacagttttttgactcccgataatgctgtggatattacaacgggtactaatagctgcctatcaaattctgagcatagcaaggacccaggtttcggacagatggatgagctgcagttagaggatctgggtgacgatgatctccagttcgaggatcccgcagaagatatcggcactactgaggaagtgattgagttaagtgacgattccgaagatgagctggccttcggtgaaaatgataatagggaaaacaaggccatgccctgtcaagtgtgcaaaaaggttctcgagccaaacattcagttgatccggcaacacgcccgcgaccatgtcgacctgttaaccggcaactgtaaggtgtgcgagacccattttcaagacaggaactcccgggtaacccacgtgctgagccacatagggatttttctattttcatgtgacatgtgcgaaactaagttcttcacacagtggcagctgaccctccaccgccgagatgggatcttcgaaaataatatcattgtccacccaaatgatccccttccaggaaagctaggacttttctcaggcgccgcctcgcctgagcttaaatgcgctgcgtgcgggaaggtgctggccaaagattttcacgtggtacgaggccacattcttgatcacttaaacctgaagggccaggcctgcagtgtgtgtgaccagcgacatttgaacctttgtagtctgatgtggcacaccctgagccatctcggcatctctgtgttctcttgcagcgtgtgtgccaacagctttgtcgactggcatctcctggagaagcacatggctgtgcatcagtctctagaagacgccctatttcactgcaggttatgctctcaatctttcaagtctgaggcggcctatcggtatcacgtgtcccagcataagtgcaattccggcttagacgctaggccggggttcgggctgcaacaccctgcactgcagaaaagaaagctgcctgctgaggaatttctgggagaagagcttgccttacaaggacaacccggcaactctaaatattcttgtaaggtctgtggcaagcggtttgcgcatacatccgaattcaactatcatcgaaggatacacacgggcgagaaaccatatcagtgcaaagtgtgccataagtttttccgggggcggtcaaccattaaatgtcacttgaagacccactctggggctttgatgtaccggtgtaccgtgtgcgggcactactcatcaacattgaatctcatgagcaaacacgttggtgtccacaaaggttcgttgccccctgatttcactattgaacagacattcatgtacatcatccattccaaggaggctgataaaaaccccgacagttag

SEQ ID NO: 21220 - DNA, 2730 bp, Artificial Sequence
  Description of Artificial Sequence: Synthetic coding sequence
atgaagaagcggcggaaggtgaccagcaacctggagaagatccacctaggataccataaagactcctctgaaggaaacgttgcagtcgagtgcgatcaggtgacgtatactcattctgccggtcggcctaccccggaggccctacattgttatcaagagctacctccctcccctgaccagcgcaagcttctgtcatccctgcagtataacaagaatctgttgaagtacctgaatgatgaccggcagaaacagccaagcttctgcgacttgctgattatcgtggagggcaaggagttcagtgcacacaaggtggtggtggccgtgggctcctcctactttcacgcatgcctcagcaaaaatccgagtaccgacgtggtcaccctcgatcatgttacgcattctgtcttccaacatcttttagagtttctgtacacgtctgaattcttcgtgtataagtacgagattcctctcgtgctggaggcggccaaattcctggacattatcgacgccgtcaaactcctaaacaacgaaaacgtagcccctttccattcagagctgactgaaaagagctccccagaagagactttaaacgagctaactggcaggttgtctaataatcaccagtgtaagttctgctcaagacacttttgctacaagaagtctctcgagaatcaccttgcaaagactcaccggagtttgctgctgggcaaaaagcatggcctgaagatgctggagaggtcattttccgccagaaggagcaagcgtaatcggaagtgccccgtcaagttcgacgatacgtccgacgatgaacaggagtctggggatggctcagacaatttaaaccaggaaaatttcgataaggagaagtctgacaggaatgacagcgaggatcctgggtccgagtacaacgctgaagaggatgaactcgaagaggagatgagcgacgagtactccgatatcgaggaacagtccgaaaaggaccacaatgacgctgaggaggaaccagaggccggggacagcgtagggaacgtacacgaaggtcttacccccgtagtgatccaaaacagcaataagaaaatactgcagtgcccgaaatgtgataagactttcgaccggattgggaagtatgagtctcacacccgggtacacacaggggaaaaacctttcgaatgcgacatctgtcaccaacggtactccaccaagagcaatctaacagtccaccgcaagaagcatagcaatgagaccgagtttcacaaaaaagaacacaagtgcccttattgtaacaagcttcacgctagcaagaagaccctggctaagcacgtcaagaggtttcatccagaaaatgcccaggagttcatctcaattaagaaaacaaagtctgaatcctggaagtgtgatatctgtaagaagtcattcaccaggaggccccacctggaagagcatatgatcttgcacagccaggacaaaccattcaaatgtacctattgcgaagaacatttcaaatctcggtttgctcgcttaaagcatcaagaaaagtttcacttgggcccttttccttgcgacatctgtggtagacagttcaacgacacagggaatctcaaacggcacatagaatgtactcatggaggaaagagaaagtggacctgtttcatctgtggtaaatctgtacgagagcgcactaccctgaaagagcatcttagaatccatagtggagaaaaacctcacctgtgcagcatctgcggccagagttttagacacggtagttcctacaggctccacctccgggtgcatcatgatgacaagaggtatgagtgcgatgagtgcggcaaaacctttatcagacatgatcacttgactaagcacaaaaagatacacagcggtgagaaagcgcaccagtgtgaagagtgtgggaagtgctttggccggagagaccaccttaccgtacattataaatcagtacacttgggtgagaaggtgtggcagaagtacaaagccacatttcatcagtgtgatgtgtgtaagaaaattttcaaggggaaaagctcccttgaaatgcatttccgtacccactcaggtgaaaagccatacaaatgccagatctgcaaccaaagctttcgaatcaaaaaaacccttaccaagcacctcgtgattcatagcgatgcacgacctttcaattgtcaacactgcaatgctactttcaaacgaaaggacaagctgaagtaccatattgaccacgtacatgagattaagtcgcccgatgacccattatccacatcagaggaaaagctggtttctctaccagtggagtattcaagcgacgacaaaatttttcagacagagactaagcagtacatggatcagccaaaggtgtaccagtccgaggccaagactatgcttcagaatgtatctgccgaggtttgtgtaccagtgacactcgttcccgtgcagatgcccgacacccccagtgaccttgtgcggcataccaccacgttacctcctagtagccatgaaatccttagtccacagccgcaatctaccgattatccgagggcagccgacttggctttcctggagaaatatacgctgacgccccagcctgccaatatcgtccatccggttagacctgagcagatgcttgacccacgcgagcagtcatacctcggaacgctcctgggactggactcaaccactggcgtacaaaatataagtaccaatgagcaccacagctag

SEQ ID NO: 21221 - DNA, 1404 bp, Artificial Sequence
  Description of Artificial Sequence: Synthetic coding sequence
atggagcccggcaccaacagcttccgggtggagttccccgacttctcgagtacaattcttcagaagctgaaccagcaacggcaacaggggcagctttgcgatgtgagtatcgtcgtacaaggacacatcttccgcgcccacaaggccgtgctggcagcctcatctccatatttctgcgatcaggtcctgcttaagaattctcgcaggattgttttgcctgacgttatgaacccaagggttttcgaaaatatcctgctcagctcttacacaggtaggctggtcatgccagcccctgagattgtcagttacctgacagcggcctccttcctccaaatgtggcatgtggtcgataagtgtactgaagttctggagggaaatcccacagtgctgtgccaaaaactgaaccatggcagcgaccatcagagccctagctcaagctcatataatggcctggtggagtcattcgaactgggctcaggcggccatactgactttcccaaagctcaagaattacgagacggggaaaatgaggaggaatctaccaaagacgaactgagctcccaattaacagaacacgagtatctcccttcgaacagctctactgagcatgatagactcagcaccgagatggcatcccaggacggggaagaaggcgcctctgacagtgcagaattccattacacccgccctatgtactctaagccttctatcatggcccacaaacggtggattcacgtcaaacccgaacggttggagcaagcttgcgagggtatggacgtgcatgccacctatgacgagcaccaggtgacagagtcaattaacacagtacagacggagcacaccgtgcagccatcaggggtggaagaagactttcatatcggagagaaaaaagtagaagcagagtttgacgagcaggcagacgagtccaactacgatgagcaggtggacttctacgggtcttcaatggaggagttctccggcgagcgatctgacgggaacttaattggtcacagacaagaagctgcgctggctgctgggtacagtgagaacatcgaaatggttacaggaattaaggaggaggcttcccatctgggtttttctgccacagacaaactgtatccatgtcagtgcgggaaaagttttactcataagagccagagagacaggcatatgtcaatgcatctgggacttcggccctatggttgcggcgtgtgcgggaagaagtttaagatgaagcatcacttggttggccatatgaagatccatactgggatcaaaccctatgaatgcaacatctgcgccaaaagatttatgtggagggactcttttcacagacatgtaacgagctgcaccaagtcctacgaggccgctaaggctgaacagaacactacagaagccaactag

SEQ ID NO: 21222 - DNA, 1404 bp, Artificial Sequence
  Description of Artificial Sequence: Synthetic coding sequence
atggagcccggcaccaacagcttccgggtggagttccccgacttctcatccaccattcttcagaagcttaatcagcagcgacagcaaggccagttgtgcgatgtgagtatcgtggtgcaaggccacattttccgtgcacataaagcggtgctcgccgcctctagcccatatttctgtgaccaggtgctcctgaagaactctcggaggatcgttctacccgatgtgatgaatcctcgcgtttttgagaatatacttctgagcagctacacagggcgcctggtgatgcccgcacccgagattgtgagttatctcacagcagcgagctttctacagatgtggcacgtcgttgataaatgcactgaggtcttagagggcaaccccaccgtcctgtgtcagaagctcaaccacggctctgatcaccaaagcccttcttctagttcctataacggtctcgtggaaagtttcgagctaggttcaggagggcacaccgacttcccaaaggcccaggagctccgggacggggaaaacgaggaagagtcaactaaggacgagctgagttcccagcttactgagcacgaatacctgccctccaactcctctacggaacatgatcgcctaagtacagaaatggctagtcaagacggagaggagggagcctctgacagcgccgagttccattacacaagaccaatgtactctaaaccctcaataatggcccacaagaggtggattcacgtcaaacctgagagattggagcaggcctgcgagggcatggacgttcacgctacctacgacgagcaccaggtaaccgaatccataaacaccgttcagacagagcatacagtccaaccttccggcgtggaggaagatttccatattggggagaagaaggtggaggctgagtttgatgaacaggcagacgaaagtaactatgacgaacaggtcgatttctacggaagcagcatggaagagttctctggggagcggtccgacgggaatctgataggtcaccgccaagaagccgctctggccgctggttattctgaaaatattgagatggtgacaggaatcaaagaggaggcctcccatctcggattcagcgctacggataaactgtatccctgtcaatgtggtaaatctttcacccacaaatcacagagggatcgccatatgtccatgcacctcgggctccggccctatggctgcggagtttgtggcaagaagtttaagatgaaacaccaccttgttggccatatgaagatacatacaggtatcaagccatacgagtgcaacatctgcgctaagcgctttatgtggcgggatagcttccacaggcatgtaacctcctgcacaaaatcctatgaggccgccaaagcagagcagaacactaccgaggcgaactag

SEQ ID NO: 21223 - DNA, 1404 bp, Artificial Sequence
  Description of Artificial Sequence: Synthetic coding sequence
atggagcccggcaccaacagcttccgggtggagttccccgacttctcctctactatcctgcagaagttgaatcagcagcggcaacagggccagctctgcgatgtgtccattgttgtccagggccacattttcagagcacacaaagcggtgctcgctgcctccagcccttacttttgtgaccaggtacttctcaaaaactccaggcgaatcgtgcttcccgatgtcatgaacccgcgcgtctttgaaaacattctgctatcaagctacaccggcaggctggtgatgccagccccagaaatcgtaagttatctgacagcggcgtcctttcttcagatgtggcatgttgtcgataaatgcactgaagtgctggaaggcaacccgacggttctatgtcagaaacttaatcatggtagcgaccatcagtccccatcctcctcctcctataacggtctggtggagtcatttgagctcgggtccggtggccatacagactttccgaaggcccaggagctcagggatggcgagaacgaggaggaatccactaaagatgaactgtcatcccaacttactgagcacgagtacttaccatcaaattcctcaacagagcatgatcgactctccaccgagatggcatcgcaggacggagaagagggtgcttccgattctgccgaatttcattatacacgccccatgtattctaaaccttctatcatggcacataagcggtggattcacgtcaagccagaacggttggagcaggcctgtgagggtatggacgtgcacgctacttatgacgaacaccaagtgaccgagtccatcaatacagtgcagacagagcacacggtgcaacctagtggagtggaggaggatttccacataggggaaaagaaggtggaggcagagttcgacgagcaggccgatgagtccaattacgacgagcaggtggatttctacgggagctccatggaggaattcagtggtgagcgctctgatggtaacctaatcggccataggcaagaggccgctctggccgctggctactctgaaaatatcgaaatggttacagggataaaagaagaagcaagccacttggggttcagtgccactgataagttgtatccttgccaatgcggaaaatcatttactcacaaatctcagcgtgatcgacacatgtctatgcacctgggcctgcgtccatacgggtgcggggtctgcggcaagaagttcaagatgaaacatcacctggtggggcacatgaagattcacactggtataaagccctatgaatgcaacatctgcgccaagcggtttatgtggagagattcttttcatcggcatgttacaagctgcacgaagtcctacgaagcagctaaagcagaacagaatactacggaagcaaattag

SEQ ID NO: 21224 - DNA, 591 bp, Artificial Sequence
  Description of Artificial Sequence: Synthetic coding sequence
atggagcccggcaccaacagcttccgggtggagttccccgacttctcttctaccattctgcaaaaactcaatcagcagcgacagcagggtcaactgtgcgatgtttcaatcgtcgtccagggccacatctttagagcgcacaaggctgtactagccgcctcatccccctacttctgcgaccaggtgctcttgaaaaattctcgacgcatcgtgctgccagacgtgatgaacccaagagtgttcgagaacattctgttgtcaagctacaccgggcgcctagtaatgcccgcacctgaaatcgtctcctacctcaccgccgcctcctttctgcaaatgtggcacgtcgtcgacaaatgcaccgaggtgctcgaggggaaccctactgtcttgtgccagaaactaaaccacgggagcgatcaccagagcccaagctcttcctcatataatggcctggtggaatcctttgagctcggaagcggcggccacactgatttccctaaggcacaagaactgcgagacggtgaaaacgaggaggaatcaacaaaagacgaattaagctcccagctgacagagcacgaatatctgccatag

SEQ ID NO: 21225 - DNA, 1536 bp, Artificial Sequence
  Description of Artificial Sequence: Synthetic coding sequence
atggccgccgccgaggccgtgcaccacatccacctgcagaacttctccagatctctgctggagacccttaacgggcagagactcgggggacacttctgcgatgtgacggtgcggatacgcgaagcttctttacgtgcccatcgttgtgtgttagctgctggcagtccattcttccaggacaagttattactgggccacagtgagatacgggtaccaccagtggtacccgcgcagacggtgcgacaactcgtagaatttctctacagtggcagtctggttgttgcccagggggaggcactccaagtcctcacggctgcctccgtactacggatccagactgttatagacgagtgcacccagattatcgcccgggctagggctcccggaacttccgcaccgaccccgctgccgactccagtgccgccccccctggcgcctgctcagctacgccatcgattgagacacttgctggctgcccgccccccgggccacccaggagccgcacattcaagaaaacaacgacagcctgcccgcctgcagttgcctgccccacccacacctgcaaaggccgaaggtccagatgctgacccctctttgtccgccgcccccgacgatcggggcgatgaggacgatgaagagtcggatgacgaaacggacggcgaggatggggagggggggggaccaggtgagggtcaagcacctccctcttttcccgactgcgccgctggattcctcacagcagctgcagactccgcctgtgaggagccacctgccccaacagggctggctgattattctggcgccgggcgtgacttcctaaggggggccggctcagcggaggatgtctttcccgattcttacgtgtcgacatggcacgatgaggacggtgcggttcctgaggggtgccctaccgaaacccctgtacagccagactgcatcctgtctggcagccgtcctccaggtgttaaaacccctggacctcccgttgccctcttcccattccacctgggcgcccccggccctcccgctcctcccccatctgctccctcaggaccggcaccagcccctcctcccgcattttacccaacccttcagccagaggctgccccctctacacagttgggggaggttccagcgcccagcgcggccccgactaccgccccctcgggtacgccagctcgtaccccgggggccgaacctcctacatacgaatgtagtcactgtcggaaaacgttctccagtagaaagaactatacaaagcacatgttcatccatagcggagagaagccacatcagtgtgctgtgtgctggagatcttttagccttcgagactatctgctcaagcacatggttacgcacacaggggtccgcgcttttcagtgcgcagtgtgcgctaaacggttcacgcagaagtctagtctgaatgttcacatgcgcacacaccgtcctgaaagagccccatgtcccgcgtgtgggaaagtgtttagccacagggcactgctcgagcggcacctggcagctcacccagccccctag

SEQ ID NO: 21226 - DNA, 1770 bp, Artificial Sequence
  Description of Artificial Sequence: Synthetic coding sequence
atgaacaaccggaaggaggacatggagatcaccagccactaccggcatttgttacgggaacttaatgagcagaggcagcacggtgtgttgtgcgacgtgtgcgtcgtggttgaggggaaagtgtttaaagctcacaaaaacgtactactcgggtcctctcgatatttcaaaactctttattgccaggtacaaaagacaagtgagcaggctacagtgacccatctggacatcgtgacggcgcaggggtttaaagcaataatagacttcatgtactccgcacacttagccctgacctcacggaacgtgatcgaagtaatgagcgctgccagtttccttcagatgacagatattgtgcaggcctgccacgactttatcaaagcggcgctggatataagcataaagtctgatgcaagtgacgagttagccgagttcgaaataggagccagttcgtctagctccacagaggcactgatcagtgctgtgatggccgggagatctatctccccatggttggctcgccgcacgagccctgcgaactcgagtggggatagcgcaatcgcctcatgccacgatggaggatcaagttatggaaaggaagatcaggaaccgaaggcagatggtcctgacgatgtctcatctcagcccttgtggccaggtgatgtcggctatggcccactacgaatcaaggaggaacaggtgtcaccatctcagtacggcggcagtgagctaccttcagcaaaagacggagcggtgcagaacagtttctcagagcaatcagcaggagacgcttggcagcctaccggaagaagaaagaacaggaagaataaggaaacagtccggcatattacccagcaagtcgaagatgacagtagggctagcagtcctgtgccgtccttcctccctaccagtggctggccattctcctcccgggactcgaacgccgatctctccgtcaccgaggcctcttctagcgacagccgcggtgaacgtgccgagctgtatgctcaggtagaggaaggtctgctcgggggtgaggcctcatacctggggcctccactgacccctgagaaggacgacgcgctacaccaggctacagcagtggccaacctgagggccgcattgatgtctaagaacagcctgctgtctctgaaggccgacgtgctgggtgatgatggtagtttgctgtttgagtatctgccccgcggtgctcacagcctgagcctgaatgagtttaccgtgatcaggaagaaattcaagtgcccttattgctccttcagcgccatgcaccagtgtatccttaaaaggcatatgcgtagccacacgggcgagcggccttatccttgtgaaatatgcggaaagaagttcacccgacgagaacacatgaaacggcacactctcgtccatagcaaggataaaaagtatgtgtgtaaggtctgtagccgagtgttcatgagtgccgcatctgtgggaatccgtcatgggagcaggcgccacggggtgtgcacagattgtgctggacggggaatggcaggccctctagaccacggggggggggggggggaaggctcccctgaggcactgttccccggtgatggaccttatctggaagatcccgaggaccctaggggcgaggccgaagagctcggcgaagacgacgagggattggcccccgaggacgctctgctggcggatgacaaagatgaggaggatagcccacgccctcgtagccctccgggtggtcccgataaagacttcgcgtggctgagctag

SEQ ID NO: 21227 - DNA, 1770 bp, Artificial Sequence
  Description of Artificial Sequence: Synthetic coding sequence
atgaacaaccggaaggaggacatggagatcaccagccactaccggcacctgttgcgggagcttaacgaacagcgacagcacggtgtcttatgtgatgtatgcgttgtggtagaagggaaggtcttcaaggctcataagaatgttctgcttggctcttcgagatattttaagaccctgtactgccaggtccagaaaacatcagagcaagctaccgtgacccacctggatatagtgacagctcagggattcaaagctattattgactttatgtatagcgcccatctggcattaacatcaaggaacgttattgaggtcatgtccgcagcaagcttccttcagatgacagacattgtccaggcttgccacgatttcatcaaagcagctctggacatctcaatcaaatccgacgcaagcgatgaactagcggagttcgaaatcggtgcttcaagcagctcctccaccgaagccctcataagtgcagtgatggctgggcggtccatatccccgtggcttgcacggagaacatctccggccaactcttccggagactcagccattgcaagctgccacgacggaggcagctcgtatggaaaggaggatcaggaacccaaagctgacggcccggacgacgtgtcatcacagcctctgtggcctggcgacgtgggatatggcccacttcgcataaaggaagagcaggtgagtccctctcaatacggcggctcagaattgccttccgcaaaggacggcgctgtccagaactcattctccgaacaatccgccggtgatgcatggcagcctacgggacgccggaagaacagaaaaaataaagagactgttaggcatattacgcagcaggtggaagacgactccagagcatccagccccgtccctagcttcctgcctacctcaggctggccgttcagctcccgggacagcaacgcagacctgtcagtgacagaggcatcgtcgtccgactccaggggagaacgagctgagctatatgcccaggtcgaagaaggacttctcggcggtgaagcttcctatctgggccctcctctgaccccagagaaagatgacgccctgcaccaggccaccgctgtggctaatttgagggcagccttaatgtctaaaaactccctcttgtcgctgaaggcagacgtcttgggagatgatggtagtctgctcttcgagtatctccctcgcggcgcacattctctgagtctaaatgaattcacagtgatccggaaaaagtttaagtgcccctactgcagctttagcgcaatgcaccagtgcattttaaaacgccatatgcgctcccataccggagaacgaccttacccctgcgagatctgcggcaaaaagttcacccgtcgagaacatatgaaacgccacaccctcgtgcatagcaaagataaaaagtacgtctgtaaagtgtgcagtcgtgtctttatgagtgccgcgtcagttggcatacggcacggatcccggcgccacggcgtctgcacagattgcgccggcaggggaatggcaggccccctcgaccacggcggaggagggggcgagggctcccccgaggcactcttcccgggggacgggccgtatctggaagaccctgaggaccccagaggcgaggccgaagaactcggcgaagatgatgagggtcttgctcctgaagatgctctgcttgcagatgataaggacgaagaggatagccctcgcccgcggagcccccccggcggacctgataaggatttcgcgtggctatcatag

SEQ ID NO: 21228 - DNA, 1770 bp, Artificial Sequence
  Description of Artificial Sequence: Synthetic coding sequence
atgaacaaccggaaggaggacatggagatcaccagccactaccggcacctcctgcgcgaacttaacgagcaacggcagcacggggttctgtgtgatgtgtgtgtagtcgtcgaaggaaaagtgttcaaggcccataagaacgtcctgttaggttccagtcggtatttcaaaactttgtactgtcaggtccagaaaacttccgagcaggcgactgtcacacacctggatatcgttacggcacaaggcttcaaagccataattgacttcatgtactctgctcatctggctttgacctcgaggaacgtgattgaagttatgtctgcggcctcgtttctgcagatgacggatatagtccaggcttgccatgatttcattaaagcagctctagacatctccatcaagagcgatgcgtcagatgagctggctgaattcgaaattggcgcaagttcctcctcatccactgaggctctgattagcgccgtgatggcagggagatctatatcaccttggttggccaggagaacctcacccgctaactctagcggagattccgctattgcatcctgccacgacgggggctcctcctatgggaaagaggaccaagaaccaaaagctgatggtcctgacgacgtctcatcccagcccctctggcccggggacgtcggctatggacctctacgtattaaggaagagcaggtgtctcctagccagtatggtggatccgaattgccttctgctaaggatggcgccgtacaaaatagcttctctgagcagagtgcgggtgacgcctggcagcccacagggcggagaaagaacaggaaaaataaggagaccgtgaggcacattacccagcaggtggaggacgattctcgagccagtagcccagttccctccttcctgcctacaagtggatggcctttctcttctcgtgatagcaatgcagatcttagtgtgacagaagccagctcttctgacagtcggggagaacgggctgagctgtacgcacaggtggaagagggcctgctggggggcgaagccagttacttgggacctcctctcacaccggagaaagacgacgcactccaccaagccacagccgtcgcaaaccttcgggcagcccttatgagtaaaaactcgctactttccctaaaggctgacgtgctgggtgacgatggaagcctgttgttcgagtacctcccaaggggcgctcacagcctcagccttaatgaattcaccgtgatccgcaaaaagttcaagtgcccttactgctcgtttagcgcgatgcaccagtgtatccttaagagacacatgaggagccatactggggaaaggccatatccttgtgaaatatgtggaaagaagtttacccgcagagagcacatgaagaggcatacactggttcactccaaagataaaaagtacgtgtgtaaggtctgtagccgagtatttatgtccgccgccagtgtcggaatcaggcatgggagtagacgacacggcgtgtgtacagattgtgccggccggggcatggcgggacctctggatcacggaggtgggggaggcgagggctcaccagaggcactgtttccaggcgacggaccttacctcgaggaccccgaggaccccaggggagaagccgaggagttgggcgaggacgacgaggggctcgcacctgaggacgccctcctggcagacgataaggacgaagaagacagtcctcggccacggtctccgcccggaggacctgataaggattttgcctggctctcttag

SEQ ID NO: 21229 - DNA, 342 bp, Artificial Sequence
  Description of Artificial Sequence: Synthetic coding sequence
atgagcaccatccagaacctgcagagcttcgaccccttcgccgacgcgaccaaaggggatgacctgctgcccgcaggcaccgaggactatatccatattcgcatccagcagcgtaacggaagaaaaacactgaccaccgtgcagggcattgctgatgattatgataagaaaaagctggtgaaggcctttaagaagaagttcgcctgcaatggaacggtcatcgagcatccggagtacggcgaagtgatccagctgcagggtgaccagcgcaaaaatatttgccagtttcttctcgaggtcggcattgtaaaagaagaacagctcaaggtgcacggcttctag

SEQ ID NO: 21230 - DNA, 1116 bp, Artificial Sequence
  Description of Artificial Sequence: Synthetic coding sequence
atggccacccggagccgggagaacgcccggcggcggggcacccccgagcccgaagaagcgggcagacgcggtggaaaacgtcccaagccaccccccggggttgcatcagccagtgctcgcgggccccctgcaaccgacggactgggagccaaagtcaagctggaagagaaacagcatcacccttgtcagaagtgtcccagggttttcaataacaggtggtatctggagaaacatatgaatgtaacccattcacgtatgcagatctgcgatcagtgcgggaagagatttctgttggagagcgaattgttactgcacaggcagaccgactgcgagaggaatatccagtgtgtaacttgtgggaaggcgtttaaaaagctatggagcctgcatgaacataacaaaattgttcacggatacgccgaaaagaagttctcttgtgaaatctgtgaaaagaagttttataccatggcgcatgtacgtaaacatatggtggcacataccaaggacatgccattcacctgtgaaacgtgtgggaagtcattcaagcggtctatgtcgcttaaagtgcactccctgcagcactcgggcgagaaaccttttaggtgcgagaactgtaacgagaggttccagtacaaataccagctgaggagtcatatgagtatacacattgggcataaacaatttatgtgccagtggtgtggcaaggattttaacatgaaacagtacttcgacgagcacatgaagacacacaccggggagaaaccttacatttgtgagatctgtgggaaatctttcactagtcgccccaacatgaaaagacaccggcgaacgcataccggcgaaaaaccatacccctgcgatgtatgcgggcaacggtttagattcagcaacatgttgaaggcccataaggagaagtgtttccgcgtctctcatacgctcgccggggacggagtacctgccgcacctgggctgccaccgactcaaccccaggctcacgctctccctctcctgcccggtctgccccagacactgccacccccccctcacctcccacccccgccccccttgttcccaacaaccgcttcccccggaggacgcatgaatgccaataattag

SEQ ID NO: 21231 - DNA, 1941 bp, Artificial Sequence
  Description of Artificial Sequence: Synthetic coding sequence
atgggccggctgaacgagcagcggctgttccagcccgacctgtgcgatgtcgacctggttctggtgccacagagatcagtgttcccagctcacaaaggggttcttgccgcatatagccagtttttccattctctcttcactcaaaacaagcagctgcagagagtggagttgtctcttgaggcactggcccccggtggcttacagcagatcttaaattttatctacaccagtaaactgctcgtcaacgctgcgaacgtccacgaggttctgagtgcagcgtctctgttgcagatggcagatatcgctgcaagttgtcaagaacttctagacgcacgcagcttaggacctccagggcccggcactgtagcgctggctcagcccgccgcatcttgcacaccggccgctccaccctactattgtgatataaagcaggaggcggatactcccgggcttccaaagatctacgctcgtgagggacccgacccctactctgtgcgggtggaggacggggcggggaccgcaggtggcacagtcccggccacaataggaccggcacagcccttcttcaaagaagaaaaggagggaggagtggaagaagcgggcggcccacctgcctccttatgtaagctggagggcggagaagaactggaggaggagctggggggaagcggcacttactccaggcgggagcaatcacagatcattgtggaagttaacctcaataatcagacactccatgtcagtacaggaccagaagggaagcctggtgctgggccatctccagcgaccgtggtcctgggcagggaggatgggctgcagcgacatagcgatgaagaagaagaggatgatgaagaagaggaagaggaagaggaggaggaagaaggggggggctcagggcgggaggaagaggaggaagaagaagggggctctcagggtgaagaggaagaggaggaggaggacgggcattccgagcaagaagaggaagaggaagagaagcaacaccacccatgccagaaatgtcctcgcgtgtttaataatagatggtatctggaaaagcatatgaacgtgacacacagtagaatgcagatttgcgaccagtgcggaaagagattcctgctcgaaagcgaactgcttttgcaccgtcagaccgattgtgaaaggaacattcaatgtgttacctgcgggaaggccttcaagaaactgtggtcactacatgagcataacaaaattgtccatgggtacgcagagaagaagttctcctgtgaaatctgcgagaaaaagttttataccatggcccatgtgcgaaaacatatggttgctcacaccaaggatatgccttttacatgtgagacctgcggtaaaagctttaagcgaagtatgagcctgaaggtccacagtctacagcatagtggagaaaagcctttccggtgtgagaactgtaacgaacgttttcagtacaaatatcagctgcggtcacacatgtctattcacatcgggcataagcagttcatgtgtcagtggtgcggcaaggacttcaatatgaagcagtatttcgatgagcacatgaagactcacaccggggaaaaaccctatatatgtgagatctgcggcaaaagttttactagcaggccgaacatgaaaaggcacaggaggacccacaccggcgagaagccatacccatgtgacgtgtgcggccagcgctttcgattctcaaacatgctgaaagcccataaagaaaagtgtttccgggtctcccatactctcgccggcgacggtgtccccgccgcgcctggacttccgccaactcagcctcaggctcacgccttacccttactgcccggccttccacagactttaccgcctcctcctcatctacctcccccaccaccactgttcccgaccacggcatcacctggcggcagaatgaatgccaataactag

SEQ ID NO: 21232 - DNA, 2298 bp, Artificial Sequence
  Description of Artificial Sequence: Synthetic coding sequence
atggaccccgtggccacccacagctgccacctgctgcagcagctgcacgaacagcgaatccaggggctgctgtgcgattgtatgctcgtagtaaagggggtttgtttcaaggcacataagaacgtgctggccgcattctcccagtactttcgatctctgtttcagaactccagctctcagaaaaacgatgtttttcaccttgacgtgaagaacgtaagcggcataggccagatactggacttcatgtatacctcacatctggacctaaatcaggataacatccaggttatgctcgacacggcccaatgtctgcaggtccagaacgttttgagcctttgccacacttttttaaagtctgccactgtggttcagccacctggcatgccctgcaactctactctctctctgcaatccacactgacacccgacgcgacatgcgttattagtgaaaactaccccccccatctgctgcaggaatgctccgccgacgcacagcagaataagacccttgacgaaagccacccacatgcatcaccaagcgtgaatcggcatcattctgccggcgagatatccaagcaggctccggacacctctgacggctcctgcacggaactgccgtttaaacagccaaactattattataaactgagaaacttttattccaagcagtatcacaagcatgccgccggcccaagccaagagagagtcgtcgagcagcccttcgccttttcaacttccacggacctgaccaccgtggaaagccagccctgcgctgtgtcccacagcgagtgcattctcgagtcaccagagcatttgccgagcaattttctggcccagcccgtgaatgatagtgctccacacccagagagcgacgccacctgtcagcaaccagtgaagcagatgagactgaagaaggccatccatctgaaaaagctgaatttcttaaagagccagaaatatgccgagcaagtatcagagccaaagtcggacgacggcctaaccaaacggcttgaaagcgccagcaaaaataccctagaaaaggcctctagccaaagcgccgaggagaaggaatcagaggaggtggtttcatgcgagaacttcaattgcattagcgaaactgagcggcccgaggacccggccgctttggaggaccagtctcagaccctgcagtctcagcgccagtatgcctgtgaattatgcggtaaaccttttaagcatcccagtaacctggagcttcacaaacgatcacacacaggcgagaagccattcgagtgtaacatatgcggaaaacacttttctcaagctggaaatttgcaaactcatctgagacgacatagcggtgagaaaccttatatctgcgaaatttgcggcaaacgattcgcagcaagtggtgatgtgcaacggcatattattatccattctggagaaaaaccacacctctgcgacatatgcggccgggggtttagcaattttagtaacctgaaggagcacaagaagacgcatacagcagataaggtttttacgtgcgatgagtgtggcaaatcattcaatatgcaacgcaagctggtgaaacaccgcattaggcatactggagagcgtccctatagttgcagtgcatgcggaaagtgcttcggaggttccggggaccttcgaagacatgtacgaacgcatactggcgaaaaaccctacacatgtgagatttgcaacaagtgctttacgcgctctgcagtgcttaggcgacacaaaaagatgcactgcaaagccggcgacgagtcacccgacgtcctcgaggagcttagtcaggcaatagagacaagcgacctggagaaatcgcagtcatcagattcattttcccaggatacctctgtcacacttatgcccgtgtctgtcaagttgcccgtccatcccgtagagaatagtgtggcggagtttgacagccatagtggcgggtcttactgcaagctgagatccatgattcagccccatggggttagtgaccaggagaagctctcattggacccggggaagctggccaagcctcagatgcagcaaactcagccgcaggcatatgcctactcagacgtggacacgccagctggcggggaaccactgcaggccgatggcatggctatgatccggagcagcctggccgcgcttgacaaccatggtggtgacccgctcgggagtcgcgcctcatccacaacttaccgcaactcagaaggacagttcttctccagcatgaccctgtgggggctagctatgaagactctgcaaaacgaaaacgagctcgaccaatag

SEQ ID NO: 21233 - DNA, 1932 bp, Artificial Sequence
  Description of Artificial Sequence: Synthetic coding sequence
atggaccccgtggccacccacagctgccacctgctgcagcagctgcatgaacaaagaatccaggggttactgtgcgattgtatgttggttgtgaaaggcgtttgcttcaaggctcacaagaatgtcctagccgctttcagtcagtactttcgctcattgttccagaattcgtcctcacaaaagaacgacgtcttccatctagacgtgaaaaatgtgtccggcatcggacaaattcttgattttatgtacacaagccatctggatttgaaccaggacaacatacaggtcatgctcgataccgctcagtgcttgcaggtgcaaaacgtgctgagcctatgccacacattcctgaagtccgccaccgtggtgcagccccctggtatgccatgcaattccacgctcagcctacaaagcaccctcacaccggatgctacctgtgtaatatccgaaaattaccccccgcacctcctccaagaatgctctgctgatgcacagcagaacaaaacgttagacgaatcccacccccacgcctcgccatctgtgaacaggcatcactccgcaggagagatctctaagcaggccccagacacaagtgacgggagctgcaccgagttgcctttcaagcaaccgaactattattataaactgcggaacttctatagtaagcagtaccacaaacacgcagccgggcctagtcaggagagagttgtcgaacaaccctttgcattctctacctccaccgatcttacaactgtggagtcccagccctgcgccgtatcccattcagagtgcattctggagtctccagagcacctcccgtctaattttctggctcagccagtgaacgactcggcgccacacccagaatcagacgcaacatgccagcagccagtaaagcagatgaggctgaaaaaagcaatccaccttaagaaattaaattttctgaaatcccaaaagtatgccgagcaggtgagcgagccaaaatcagatgatggcctgacgaagcgtctggagagcgcgtcaaaaaacactctcgagaaagcaagcagccagagtgcagaggagaaggaatctgaggaggttgtgtcatgcgagaatttcaattgcattagcgaaacagagcgccccgaagaccccgcagccctggaagaccagagccagaccctgcagagccaacggcaatacgcatgtgagttgtgtggaaaaccatttaagcatcccagcaatttagagctgcataaaaggtctcacaccgggaaatgttttggagggtcgggagacctgaggcggcacgttcggacccacaccggcgaaaaaccatacacttgtgagatctgtaataaatgtttcacccggtctgcagtgctccggagacataaaaaaatgcattgtaaagctggcgatgagtctccggatgtgcttgaagagctgagccaggccatcgaaacttctgatcttgagaagtcccaaagttctgatagttttagtcaggataccagcgtgacccttatgcccgtctcagtcaaactgcctgtccacccagtggaaaattccgtggcggaattcgactctcattctgggggaagttactgcaagttacggtctatgattcaaccacatggtgtgtccgaccaggagaaattatctctggaccccggaaagctcgccaaaccccagatgcagcagacccagccccaagcctatgcatatagtgatgtagataccccggcaggcggagagcccctgcaggcagacggaatggcaatgattaggtctagtctcgctgccctcgataatcatggcggagaccctcttggtagcagagcgagctcgactacctaccgcaattcagaaggccaatttttttcctcaatgacactgtggggcctagctatgaagactctgcaaaatgagaacgagctcgatcagtag

SEQ ID NO: 21234 - DNA, 441 bp, Artificial Sequence
  Description of Artificial Sequence: Synthetic coding sequence
atggaccccgtggccacccacagctgccacctgctgcagcagctgcacgaacaaagaattcagggcctcttgtgtgactgcatgctggtggtaaagggtgtctgtttcaaggcccataaaaacgttcttgccgccttcagtcagtattttcgcagtcttttccagaatagctcatcgcaaaagaacgacgtgtttcaccttgatgtcaagaatgtctcagggatcgggcagatcctcgatttcatgtacactagccacctggacctgaaccaagacaacatccaggtgatgctagatacagcacaatgcctgcaggtccaaaatgtcctgagcttgtgtcataccttcctgaaatccgctaccgtggtccagccgcctggtatgccttgcaactctacccttagtttacaatccactttgacaccagatgccacttgttag

SEQ ID NO: 21235 - DNA, 747 bp, Artificial Sequence
  Description of Artificial Sequence: Synthetic coding sequence
atgcagcggaagctggtgaagcaccggatccggcacaccggcgagcggccttatagttgttccgcctgtggcaagtgcttcggaggtagcggcgatttgcggaggcacgtcaggactcacaccggagaaaagccatatacctgtgaaatttgtaacaaatgtttcactagatctgccgtgctgagacggcataagaagatgcactgtaaggctggggatgagtcaccagatgttctggaggagctgagtcaggctatcgagacttccgacctggaaaaaagccagagcagtgacagcttctcccaagatactagcgtgaccctcatgcctgtgtctgttaaactacctgtccatcccgtggagaattccgtcgccgaatttgactcccacagtgggggttcctactgtaaactcagatcaatgattcagccccacggtgtgagcgaccaggagaagttaagcttagatcccgggaagctcgccaaaccccaaatgcagcagacccagcctcaagcctacgcctactctgatgtggacacacctgcagggggcgagcccctccaggctgatggcatggcgatgatccgcagcagcctggccgcgctggataaccatggcggagaccctcttggctcccgggcgagctcaaccacttatagaaacagcgagggacaattcttctcctctatgacgctgtgggggctggcgatgaaaaccctgcagaatgagaacgaactggaccaatag

SEQ ID NO: 21236 - DNA, 2034 bp, Artificial Sequence
  Description of Artificial Sequence: Synthetic coding sequence
atggacttccccggccacttcgagcagatcttccagcagctgaactaccaaagattgcacgggcagttgtgcgactgcgtaattgtcgtgggcaacaggcacttcaaggcacacaggagcgtgctcgctgcgtgtagcacacactttcgagccctgtttagtgtagcggagggcgatcagactatgaacatgatccaactagattctgaggtagtgaccgcagaggcattcgcagcactgattgatatgatgtatacaagtactcttatgttaggagaatcgaacgtaatggacgtgttgctggctgcctcacacttgcatctcaattccgttgtgaaagcttgcaagcactatctgaccacgagaaccctccccatgtctccaccatccgagagggtgcaagaacagtcagctagaatgcaaagatctttcatgctccaacagctgggtctttcaattgttagctctgccctgaattccagccagaatggtgaggaacagccagcacccatgtcctcatcaatgcgtagcaatctggatcagcgcacacctttcccaatgaggagactgcacaagcggaaacagtcggccgaggaaagggcaagacagcgtctcaggccatccattgacgagtctgctatctccgacgtcacccccgagaacggcccaagcggagttcatagccgagaggagttcttctcacccgattccttgaagatcgtggataatcccaaggcagacggaatgaccgacaaccaagaagattcagccatcatgtttgatcagagcttcggaacgcaagaagatgcacaagttccaagccaatcagataattcagcgggaaacatggcgcaactgagcatggcgtctagagcaacgcaggttgagacatcttttgaccaagaagccgctccagaaaaatcctctttccagtgcgagaacccagaagtgggccttggtgagaaggagcatatgagggtagtcgtaaagtcggagcccctgagttcaccagagccacaggatgaggtgagcgacgttacgagccaggctgaagggtccgaatccgtggaagttgagggggtcgtggtgtccgcagagaaaattgatctgagtcctgagtccagtgataggagctttagtgacccacaaagctctaccgatagggtaggagatattcatatcttggaggtgaccaataacctggagcataaaagtacttttagcatctccaacttcctgaataagagtcgtggcaacaactttaccgccaatcagaataatgatgacaacattcccaacacaaccagcgactgtcgtttggaatctgaggctccttacctgctatcacccgaggcagggcccgccggcggcccctcctcagctccaggatcccatgtggaaaatccattttcagaaccagccgatagccacttcgtgagaccgatgcaggaagttatgggattgccctgcgtacagacatccggctatcaggggggcgagcaattcgggatggatttctctcgttcagggctggggttacactcaagctttagtagagtcatgatcggctcaccaagaggtggcgctagcaatttcccatattataggagaattgcaccaaagatgcccgtcgtaaccagtgtcagaagcagccagatccctgagaactcaaccagttcccagttgatgatgaacggggctacctcctcctttgagaatggccacccctcacagccaggtccacctcaactcacccgtgcttcggcagatgtcctgtctaagtgcaagaaggccctgtccgaacataatgtgctagtggtggagggagctcggaaatatgcgtgcaagatttgctgcaaaacattcctgacacttacagactgtaaaaaacacatccgggtccacaccggggagaaaccatatgcatgtctgaaatgcggaaagcggttctcccagtccagccacttgtataaacattctaaaaccacctgtctgagatggcaatcctcaaatctgccttccaccctactttag

SEQ ID NO: 21237 - DNA, 1275 bp, Artificial Sequence
  Description of Artificial Sequence: Synthetic coding sequence
atggccgccgagagcgacgtgctgcacttccagttcgagcagcagggggacgtggtgctgcaaaagatgaatctcttgcgccagcagaatctgttttgcgacgtgtccatctacatcaacgataccgaattccaaggccacaaagtcatcctggccgcctgtagcacttttatgcgggatcagttcctccttacacagtcaaagcatgtccgcattacaatcttacaatcagctgaagtggggcgcaagctgctgctcagctgttatacaggtgccctggaagttaaacgaaaggagcttctcaaatacctgaccgccgcatcgtatctacaaatggtgcacattgttgagaagtgcacagaggcattgagtaagtatctcgagatcgatttgagtatgaagaataataaccaacatactgacttatgccagtcaagtgaccccgacgtgaagaacgaggatgagaactctgataaggactgcgaaattatagaaataagcgaggactccccggtaaacatagacttccacgtgaaggaggaggagtcgaacgctttgcagagcaccgtggagagcttaacaagcgaaaggaaggagatgaagtctcccgaactgagtactgtggatatcgggttcaaggataatgagatttgcattctgcacgtggagtctatatccacggcaggagtagaaaacggtcagttctctcagccatgcacaagttcaaaagcctcaatgtatttctctgaaactcagcattctctaatcaactccacagtggaatcacgagttgctgaagtgccagggaaccaagaccagggcctattttgtgagaatactgaagggagttatggaacagtgagcgagattcagaacttggaggagggatactccctgaggcaccagtgtccaagatgcccccgtgggtttctgcatgttgaaaattatctgagacacctcaagatgcacaagcttttcctctgcctgcagtgtggaaagacgtttacccaaaaaaagaatctgaaccggcatattagaggccacatgggtatcagaccatttcagtgcactgtatgcctgaaaacattcaccgcgaaaagcacgctgcaggaccatctcaatatccattctggcgatcggccctacaagtgtcactgttgtgatatggatttcaaacacaagtctgcactgaagaagcatttgacctccgtgcacggccgttcatctggtgagaaactctcacgccctgatctgaaacgtcagagcctactgtag

SEQ ID NO: 21238 - DNA, 1755 bp, Artificial Sequence
  Description of Artificial Sequence: Synthetic coding sequence
atggccggcggcgtggacggccccatcggcatccccttccccgaccactccagtgacatactaagtggcttaaacgaacagcgaacacagggccttctttgcgacgtagtgattttggttgaagggcgcgagttccctactcaccgaagcgttcttgccgcctgcagtcagtattttaagaagctgttcactagtggggccgtggttgatcagcagaatgtgtatgagattgacttcgttagcgcagaagctttaactgcactcatggatttcgcctacaccgcaacattaaccgtgagcaccgcaaacgttggagacattctaagtgctgctagacttctcgaaattcccgcagtaagccacgtctgcgctgacttacttgacaggcaaatcttggctgccgacgccggtgctgatgctggccaactggatctcgtggaccagatcgatcagaggaacctgcttcgggctaaggagtacctcgaattcttccaatctaacccgatgaactctctgccaccagcagcagctgcggccgcagcatcttttccatggagcgccttcggcgcctctgatgatgaccttgacgccactaaggaggcggtcgccgctgcagtcgccgccgtagcagctggagactgcaacggccttgatttctatgggcccggccccccggccgagaggccgcctactggcgacggcgacgaaggtgatagtaaccccggtttgtggcccgaaagggatgaggatgccccgacaggtggtctgttccctcctccagtagcccccccagccgctactcagaacggacattacggacgcggtggagaagaggaggcagcctccctgtcagaggcggcaccagagcctggcgactcccctggtttcttgtctggagccgccgaaggagaagatggggacggccctgatgtcgacggactagccgcaagcacactacttcagcaaatgatgtcttctgtgggcagagctggcgctgccgccggtgactccgatgaggagagtcgtgctgacgacaagggggtcatggactactacttaaagtacttcagcggggcccacgatggtgacgtctaccccgcgtggtcacagaaagtcgaaaagaagatccgcgctaaagccttccagaaatgcccaatttgtgagaaggttatacagggcgctggcaaactgccacgacatatccggacacacaccggtgagaagccctatgaatgtaacatatgtaaggttcggttcactaggcaagacaagctcaaagtacatatgcgcaaacataccggcgaaaaaccctatctctgccagcagtgcggagcagcttttgcacacaattacgatcttaaaaaccatatgcgagttcatacgggtctgcggccctatcaatgcgactcatgctgtaaaacatttgtgagaagtgaccacctgcacagacacctgaagaaggatgggtgcaatggcgtgcctagcagaagagggagaaagcctcgggtcagaggtggagcacctgacccaagccccggcgcaacagcaaccccgggtgctccagcccagccatcatcacccgacgcgaggagaaatggtcaggagaaacattttaaagacgaagacgaggatgaagacgtcgcaagccctgacggcctagggcgccttaatgtcgccggtgcgggaggcggaggcgacagcggaggaggtcccggagctgcgactgatggtaacttcaccgctggtctcgcctag

SEQ ID NO: 21239 - DNA, 1620 bp, Artificial Sequence
  Description of Artificial Sequence: Synthetic coding sequence
atgggcagccccgaggacgacctgatcggcatccccttccccgaccattcttccgagctgttatcatgcctcaacgaacagagacagctgggacacctctgcgaccttacgattagaacacagggcctggaatatcgaacccatagggccgtgctggctgcatgcagccactacttcaagaagctctttacagaggggggcggcggagcggtgatgggggccgggggcagcggcacggccacaggcggggctggcgccggtgtgtgtgagttggacttcgtcgggcccgaagcacttggagccctgttggaattcgcgtacaccgccactctgaccacttccagtgccaacatgcccgcagttttgcaggccgccagactactggaaattccatgtgtgatagcagcctgcatggagattcttcagggttccggacttgaggctcccagccctgatgaggacgactgtgagcgcgctcgccaatacctcgaggcatttgccacagccaccgccagcggggtccctaacggggaagactcgccgccgcaagtgccactgcccccgccccccccccctccacctagacccgtggctcgacgctctaggaagcccagaaaggcattcctccaaactaagggggccagggcaaaccacttggtgccggaagttcctacggtgcccgcccacccactgacatacgaggaggaagaagtcgccgggcgggtgggatcatcggggggcagcggaccaggggacagttatagcccgcccactggaaccgcctcgccaccagaagggcctcagagttatgagccatatgaaggagaggaggaggaagaggaactagtctacccacctgcctacgggcttgctcagggcggtggacctccactgtccccggaggagctcggctctgacgaagatgccatcgatccggacctgatggcatacctcagtagtcttcaccaagacaacctcgcccccggcctagactctcaggataagctagttcgtaaacgcagaagccagatgccacaggaatgtcccgtatgtcacaagattattcacggtgccggaaagctcccccgtcacatgagaacccacacaggcgagaagcctttcgcatgtgaggtctgtggcgtgcgtttcactcggaatgataaacttaagatccatatgcgcaagcacaccggcgaaaggccttattcctgcccccactgtccggcccgctttctccattcctatgacttgaagaatcacatgcatctccacactggcgatagaccttacgaatgtcacttatgtcataaagccttcgctaaggaggaccacttacagcggcacttgaagggccaaaattgcttagaagtgcggacgagacgccgcagaaaagacgatgcacccccccactacccccctccgtctacggccgccgcctctccagccggtctggatctaagcaatgggcacctcgacacattccggctctccctggcccgcttttgggagcagagcgctccaaccggacccccagtgagtactcccggtcccccggacgatgacgaggaggaaggtgcccctactactccacaagctgagggagcaatggagtctagttag

SEQ ID NO: 21240 - DNA, 1620 bp, Artificial Sequence
  Description of Artificial Sequence: Synthetic coding sequence
atgggcagccccgaggacgacctgatcggcatccccttccccgaccatagctcggagctgttaagctgtctgaatgaacagcggcagctgggtcatctctgcgacctcactatcaggacccagggcctagaatatcggacacatagggccgtcctggccgcctgcagccactacttcaagaaacttttcactgagggaggcggaggcgcagttatgggcgcaggtgggtctggaaccgccactgggggggccggcgctggcgtctgcgaactcgattttgtggggcccgaggcgctcggggccctccttgagttcgcctataccgccacacttacgacttcctccgctaacatgcccgctgttctgcaggctgcccggctactggaaatcccatgtgttatagctgcctgcatggaaatcctccaagggagcggcctggaagccccttcccccgatgaggacgattgcgaaagagcacgacagtacctggaagcttttgctacagccactgctagcggagtgccaaacggcgaggattctcccccccaggtgccccttccacctccaccccctccgccacccagacccgtggcccgtagatcccgaaagcccagaaaggccttcctgcagaccaaaggggctcgcgctaatcacctagtgcccgaagttcccactgtcccggctcatccattgacttacgaagaggaagaggtcgctggtagggtgggttcttccggcggtagtggtcctggagatagctactctccccctacgggaaccgccagcccccctgaaggaccccagtcctatgagccctatgagggtgaggaagaggaggaggagctggtctacccccccgcctacggcctggcgcaaggcgggggcccacctctatccccagaagagctgggaagtgatgaagatgccatcgatccagacctgatggcttatctgtcttcactccaccaggataacttggcccctgggttggacagccaggacaagctggtgcgcaagagacggtctcagatgccccaggagtgtcccgtttgccacaagatcattcatggtgcaggaaagctgccgaggcacatgcggacacacacgggtgagaaaccctttgcttgtgaggtgtgcggtgttagattcacacgtaacgacaagttgaagatccacatgagaaaacatacaggcgaacgaccatacagctgccctcattgtcctgctagatttctgcactcctatgatctgaaaaatcatatgcacctgcatactggcgaccggccatatgaatgtcacctgtgccacaaagcatttgccaaggaagaccacctgcaaaggcatctgaaaggacaaaattgcctcgaagtccggactcgtcgtcggaggaaggatgacgctccaccacattatccaccacctagcaccgctgcggcctctcctgccgggttggatctgagcaacggacatttagatactttccgtttatccctcgcccgcttttgggagcagtctgctccaaccggcccaccagtttcaacacccggtccaccggatgatgacgaagaggagggggcccccaccacaccccaggctgaaggtgctatggaatcatcatag

SEQ ID NO: 21241 - DNA, 1722 bp, Artificial Sequence
  Description of Artificial Sequence: Synthetic coding sequence
atgctgcagcccggcccccacccccccagcccccaggccgccgccccaggagaggcctggcccgggcctagccaagccccatggcagtccctcgaggagaagatggggtccccagaggacgatttgatcggcattccattccccgaccattcctccgaactcctctcctgccttaacgagcagaggcaactcgggcatctgtgcgatctaaccataagaacacagggtctagagtatcggacacaccgggctgtgctggccgcctgtagccattactttaaaaagctgtttacagaaggggggggcggcgctgtcatgggcgcaggcggttcaggcactgcgacaggaggcgcgggagccggggtgtgcgaactggactttgtcggaccagaggcactgggggctctgcttgaatttgcctacacagctacattgactacttcgtctgcaaacatgcctgccgttctccaggcagctaggctgctcgagatcccttgcgttattgctgcttgtatggaaatcctgcaggggtccggcctcgaggcccccagtcccgacgaagatgattgcgagcgggcccgccagtatctggaagccttcgcaacagctaccgccagtggagtgcctaatggcgaggattccccacctcaagttccactcccgcctcctccacctccgcctcctaggcccgtagctcggcgttccagaaaaccaaggaaggcgtttctccagacaaaaggcgcgcgagccaatcaccttgtgcccgaagtcccgactgttccagcccatccgctcacatatgaggaagaggaagtagccgggagagtgggctcgagcggcggctccggtccaggcgacagttatagccccccaacgggcactgcctccccacctgaaggaccccagtcatacgagccatacgagggcgaagaagaagaggaggaactagtatatcctccagcctacggacttgctcaggggggcgggccaccgctatcgcccgaggaactcggcagcgatgaggacgctatcgatcccgatctgatggcatacctttcctcattacatcaggacaaccttgctcctggtctagactctcaggataaactagtcaggaagagaaggagccaaatgccgcaagagtgcccagtgtgccacaagattatccatggggccggcaagctcccacggcatatgcgtacgcacaccggggagaaacccttcgcatgtgaagtctgcggtgtcaggtttacgaggaatgataaacttaagattcatatgagaaaacacactggagaacgcccatacagctgtccccactgccccgccaggtttctccattcttatgatctgaagaatcacatgcatctgcacaccggagaccgaccttacgagtgtcatttatgtcataaagcatttgctaaggaagatcacctgcagaggcatctgaagggacaaaactgcttagaggtccgtactcggcgacgcagaaaagacgacgcccccccacactatcccccaccttccacagcagcggcttctccagcaggcttagatttaagcaacgggcacctcgacactttccgcctgagcctcgctagattctgggagcaatcagcccccactggaccacctgtgtctacccctggacctcccgacgacgacgaagaggaaggcgcgccgaccactcctcaagccgaaggcgccatggaatcaagttag

SEQ ID NO: 21242 - DNA, 1620 bp, Artificial Sequence
  Description of Artificial Sequence: Synthetic coding sequence
atgggcagccccgaggacgacctgatcggcatccccttccccgaccactccagtgagctcctgtcatgcctgaatgaacagagacaactcggccacctgtgcgatcttactattcggacccaagggttggaatataggacccatagagctgtgcttgctgcctgttcacattattttaaaaagttgtttacagagggggggggcggcgccgtgatgggagcaggcggctcaggcaccgcaaccggcggcgccggtgctggcgtatgtgagctggactttgtggggccagaggccctaggggctcttctcgaattcgcatacaccgccactctaactacttcttcggccaacatgccagccgtcctacaggccgcgcggttgctggaaataccctgcgtgatcgcagcgtgcatggagatcctgcagggctctggattggaggcaccatcacctgacgaggatgactgcgagagagccagacagtacctggaggccttcgcgaccgcgaccgcttctggcgtacctaacggtgaagattcgccgccgcaggttccactaccgcccccgccaccgccacccccgcggccagttgctcggaggtcccgcaagccccgcaaagcctttcttcagacaaagggcgcgagagccaaccacctggtgcctgaagtcccgactgtgcctgctcatcccttgacttacgaagaggaggaggtggccggcagggtgggatcttctggcggaagtggcccaggcgactcctacagcccacctactggaacagcgtcgccaccagaaggcccccagagttacgagccatacgagggtgaggaagaggaggaagaactggtataccctcctgcctacggactcgctcagggaggcggtccacccctgagtccagaagagctcgggtcggatgaggacgccattgacccagacctgatggcctacctcagtagtctgcaccaggacaacttagcgcccggcctagattcacaagacaaactagtcaggaagcgtcgatcacagatgcctcaggaatgtcccgtatgtcataagatcatccatggtgcgggtaaacttccccggcatatgagaacgcacactggggaaaagcccttcgcctgtgaagtctgtggagtcagatttacgaggaacgacaaattgaaaattcatatgagaaagcacactggcgagcgtccttattcctgcccacactgtccggccagattcctgcatagttacgaccttaaaaatcacatgcatctccataccggcgatagaccatacgagtgccatctttgccacaaagcattcgccaaggaggatcatctgcaaaggcacctgaaaggtcagaactgccttgaagtacgcacgcggcggagacgtaaggacgacgctccccctcattaccctcctccttcaacagcggctgcttctccagcgggactagacctgtccaacggacatctcgacacttttagactctcactggccaggttctgggaacaatccgctcctaccgggccccccgtgagtacacctggcccaccagacgatgacgaggaagagggcgcccctacgacacctcaggccgaaggggcgatggaatcatcttag

SEQ ID NO: 21243 - DNA, 1023 bp, Artificial Sequence
  Description of Artificial Sequence: Synthetic coding sequence
atggagatcagcagccaccagagccacctgctgcagcagctgaacgagcaacggagacaggacgtcttttgtgattgcagtatccttgtggaggggaaggtcttcaaggcccatagaaatgtgctgttcgccagtagcggatacttcaaaatgcttctgagccaaaattctaaagagacttcccagcccacgacagcgacattccaggcgtttagcccggatacatttaccgtcatcttagactttgtgtattctggaaagctctccctaaccgggcagaatgttatcgaagtgatgtccgcagccagtttcctgcagatgacagatgtgatcagtgtgtgtaagactttcattaagtcctcactggatattagcgaaaaggagaaggaccgatacttcagcctaagtgataaggatgcgaatagtaatggggtagaacgaagtagtttttactccggtggctggcaagagggctccagctcccctcgctctcatttaagccccgaacagggaaccggtataattagcggaaaatcttggaataagtacaactaccatccagcctcccagaagaacactcagcagccgctcgccaaacacgagcccagaaaagaaagcattaaaaagactaagcatctgaggctgtcccagcccagcgaggtaactcactacaagtcctcaaagcgcgaggtacggacctcagactcctcgtcccatgtatctcagagcgaggagcaggcgcaaatcgacgccgagatggacagcacccccgtcggctaccagtacggacagggctctgacgtcacatccaaaagtttccctgacgatctgcctcggatgagatttaaatgcccatactgcacccacgtagttaagcggaaagccgacctcaagaggcacctcagatgtcacaccggggaacgcccatacccctgccaggcttgcggtaagcgattcagccggttggatcacctttctagccatttccggacaatggagatccggattccagacggcacctag

SEQ ID NO: 21244 - DNA, 1326 bp, Artificial Sequence
  Description of Artificial Sequence: Synthetic coding sequence
atggagatcagcagccaccagagccacctgctgcagcagctgaacgagcaaagacggcaggacgtcttctgcgactgcagtatcctggttgaaggcaaggttttcaaagcccaccgaaatgtcttatttgccagttccggatatttcaaaatgctcctttctcagaattcaaaggagacctcacagcccacaaccgctacttttcaggccttttcccccgatacattcacagtgatcctggacttcgtatactcgggcaaactgtctctcacaggacaaaatgttatagaggtgatgagcgctgcttcctttcttcagatgacagatgttatcagcgtttgtaaaacatttattaagtcatccctggatatcagtgagaaggagaaggaccggtatttctcactcagtgataaagacgcaaactctaatggcgtggagaggtcctcattttattccgggggttggcaagaaggttcgtctagccccaggagtcacctatctcctgagcagggtaccggcattatcagcggaaagtcttggaataaatacaactatcaccccgcctctcaaaagaacacacagcagccactcgcaaagcatgagcctcggaaggagagtattaagaagacaaaacatttacgcttaagccagccaagcgaagtgacccactataagtcgtctaagcgggaggtccggacgtccgattccagttcccacgtttcccagtccgaggaacaagctcagatcgatgcggagatggattcaaccccagtcggttatcagtatgggcaaggctccgacgtaacctccaagtcttttccagatgacctaccgcggatgcgtttcaagtgtccttattgtacccacgttgtcaaacggaaggctgacctcaagaggcacctgcgttgccacacaggtgaacgaccgtacccctgccaagcttgcggcaagaggttcagtcgactagatcacctgtctagtcattttcgaaccattcaccaggcctgcaagctgatttgccgtaaatgtaagaggcatgtcacggatctgacaggacaggtggttcaggaaggcaccaggcgatacaggctctgtaatgagtgtctcgctgaatttggcatagactcgctgcccatcgacttagaggcagaacagcacctgatgagcccttcagatggggataaggacagccgatggcatctgagcgaagatgagaaccgttcttacgtggagatagtcgaagacggtagtggtgacctcgtgatacagcaggtggatgattctgaggaggaggaagaaaaagagatcaagcccaacatccggtag

SEQ ID NO: 21245 - DNA, 1488 bp, Artificial Sequence
  Description of Artificial Sequence: Synthetic coding sequence
atggagatgcagagctactacgccaagctgctgggcgagctgaacgagcagcggaagagggactttttttgtgattgttcaataattgtggagggtagaattttcaaggctcatagaaatatcctcttcgccaattccggctacttcagggctttgttgatccactatatccaggattcaggccggcactcgacggcgagccttgacatcgtgactagcgatgccttttctattattcttgattttctttattctggtaaactggacctgtgcggggagaatgtgattgaagtcatgtcagccgcttcatacttacaaatgaatgacgtggtcaatttctgtaagacatacattagaagttctttagatatatgcaggaagatggagaaggaagccgccgttgcggctgccgtagcggcagcagctgctgcagccgccgccgccgccgccgccgctgctcatcaagtcgactcggagtccccatctagcggtagggaggggacctcctgtggcaccaaaagccttgtgagttctcccgcagaaggggaaaagagcgttgaatgcctgcgtgagtctccctgcggtgattgcggagactgccaccccttagaactggtggttagagattccttgggaggaggatcggctgattcaaacttgtcgaccccgccaaaaaggatcgagccaaaagtggaatttgatgcggacgaggtggaggtggacgtcggggagcagttgcaacagtatgcggctccattgaacctggcacacgtcgaggaagcgctgccttccgggcaagcggtggacctcgcttattccaactatcatgtgaaacagttcttggaggccttactgcggaactcggccgccccatctaaagacgacgcagatcatcatttttctcggtccctggagggccggccggaaggagccggcgtagccatgtcctcaatgatggacgtccaagccgattggtacggcgaggactctggggatgttctggtggtaccaatcaagctccataaatgccctttctgtccttacaccgccaagcaaaagggaattctcaagaggcacatccgcagccacaccggagaaaggccatacccgtgcgaaacttgtggaaaaagatttacaagacaggaacatctgcgatctcacgctttgagtgtgcatcgcagtaatcgccccatcatctgcaaggggtgccgtcggactttcacttctcatctgtcccaagggctgagaaggtttggtctgtgtgattcatgtacatgcgtgaccgataccccagacgatgatgacgacctgatgcccattaatctgtctttggtagaggcaagctctgagagccaggaaaagtctgataccgacaacgactggcctatctacgtggaatctggggaggagaacgaccccgcaggagacgattcagacgacaagccacagattcagcccaacctgtcagatagagaaacccttacttag

SEQ ID NO: 21246 - DNA, 1422 bp, Artificial Sequence
  Description of Artificial Sequence: Synthetic coding sequence
atggagacccccacccccctgccccccgtgcccgccagccccacctgtaatcccgcaccacgtaccatccagattgagttccctcagcattcctctagcctgcttgagagtctgaatcgacatcggctcgaaggtaagttctgtgacgtttcactgctagtgcagggcagggaactgcgcgcccacaaggcagtgctggcagcagcatcaccctacttccacgataaactgctcctgggcgacgcacccagactgacactgccctccgtgattgaggcggacgccttcgagggattactgcagttgatttattctgggcgtctaagactgcccctagatgcattgccggcccacctgctggtcgcaagtggacttcagatgtggcaggtggtcgatcaatgcagtgagattctgcgcgagctggagaccagcggcgggggtatttcggctcgcgggggcaactcttaccatgcgctgctgtccacgacatccagtaccggcgggtggtgcatccggtcctcaccttttcagacacctgtgcagtcctcggcgtctaccgagtcacctgcaagcactgagtcccctgtaggcggcgagggatctgaactgggagaggtgttgcagattcaggtggaggaagaagaggaggaggaggaagatgacgatgatgaggatcaagggtccgccactctctcacagactccccaaccgcaaagagtatctggcgttttcccacggccacacggaccccatcccctgccaatgacagcgacacccagaaagctgcctgagggtgagtccgcccccctagagctccccgctccccccgccttgcctccgaagatcttctatatcaagcaagagccattcgagcccaaggaggagatctctggtagcgggacacagccgggcggtgccaaggaggagactaaagtgtttagcggtggcgacaccgagggcaatggagaactggggtttctgctaccctcgggacccgggcctacgagtggcggggggggacccagctggaaaccagtcgacctgcacgggaacgagattctgagcggcggaggaggacccgggggcgctgggcaagcggtccatggacctgtcaagctcggcggaaccccaccggctgatggtaagcgtttcggctgtttgtgtgggaagcgattcgcagtgaaacctaaaagggatcgccatatcatgctgacattttcactgaggccttttggctgtggcatttgtaataagcggtttaagctgaagcatcaccttaccgaacatatgaagacccacgcgggcgccctgcacgcttgcccgcactgcggccggcgattcagagtacatgcctgctttctccggcatcgagatttgtgtaagggacaaggctgggcaactgcacactggacttataagtag

SEQ ID NO: 21247 - DNA, 1422 bp, Artificial Sequence
  Description of Artificial Sequence: Synthetic coding sequence
atggagacccccacccccctgccccccgtgcccgccagccccacctgcaatccggccccgcgaacaatccagatcgagttcccccagcactcatcttctctgctggaatccctgaaccgccaccgcctggagggcaagttctgcgatgtatcattgctcgtgcaggggagagagttgagagcccacaaagccgtgctggccgctgcctcgccctacttccatgacaaactgctgctcggcgacgcccctcggctgaccttgcctagcgtgatcgaggcagacgcctttgaagggcttctccagctgatctacagcggccgcctccgcttaccccttgatgctttacccgcccacctgctcgtagccagcgggctgcagatgtggcaggtcgtggaccagtgtagcgagatcttaagggaactcgagaccagcggcggaggcatctccgcccgggggggaaactcctatcacgccctcctttcaactacatcttctaccggggggtggtgtatccgctccagcccctttcagactccggtgcagagctccgcgtccacggagagtcctgcgagcacagaatccccagtcggaggggagggatcagaactgggggaggtcctgcaaatccaggtggaagaagaagaggaggaggaggaagacgacgatgacgaggaccagggatccgctacattatcccaaaccccacaaccccagagggtgtcgggggtgtttccgagacctcatgggccccacccccttcctatgaccgcaaccccaaggaaactgcccgagggggagtctgcaccgctggagctgcctgccccaccagctctgcccccgaagattttttatattaagcaggaaccatttgagcctaaagaagagatcagcgggtcagggacacagccagggggcgcgaaggaggagacaaaggttttttccgggggcgacacagagggaaacggggagctgggcttcctccttccatcggggccaggtccaacaagtggcggtggtggccccagctggaaaccagtggatctccatgggaacgagatccttagtgggggcgggggacccggcggggccggacaagcggttcacggccctgtgaagctgggaggtaccccaccggcagacgggaaaaggttcggctgcctgtgcgggaaacggtttgccgttaagccaaagcgcgaccgacatatcatgctgaccttctcccttagaccattcgggtgcgggatctgtaacaagaggttcaagctgaagcaccatcttactgagcacatgaagactcatgctggggcgctgcacgcttgtccccactgcggtcgcagattcagggttcacgcttgtttcctgcgtcaccgggacctgtgtaagggacagggatgggccacagcacactggacatataagtag

SEQ ID NO: 21248 - DNA, 1227 bp, Artificial Sequence
  Description of Artificial Sequence: Synthetic coding sequence
atgctgccccggcccaaggcccccgccagcccccggcggccccagacacccacgcctagtgagcaagatgccgatccaggtcctgcctcccccagggatacggaagcgcaacgactgcggtttagacagtttcagtaccacgtcgcctcaggacctcatcttgccctgggccaactctggaccctttgcagacagtggcttagaccggaagctcgatccaaggagcagatgctcgagctccttgtgctcgagcagtttctcggggccttgccttctaagatgcggacatgggtccagagtcaaggaccaagatcttgccgcgaagctgccagcctggtcgaggacctgactcagatgtgccagcaggaagtattagtgtccctggatagcgtggaaccacaagactggtctttcggcgaagaggaagatggcaagagccccagatcccagaaagagccatcacaagccagcgaattgatcctggacgccgtggccgccgccccagccctgccggaggaatcagagtggctcgagactacccagcttcaacagtcactccatacccgtgctgaggccgaggccccacgcgctccaggtctcttgggctctcgcgctcggcttccgctcaagccgagcatctgggacgaacctgaggacttgctagcgggaccttcatccgaccttcgtgccgagggcaccgttatcagctcacccaaggggcctagtgcgcagcggataagtccccgcaggcgaaaccgcaacaccgaccaatccggaaggcatcagcccagtctgaagcacaccaaagggggaacacaggaggcagtcgcgggcatttcagttgtgcctagaggacccagaggcgggagaccttttcagtgtgcagactgcggtatggtgtttacttgggtgactcacttcatcgagcaccagaagacccaccgtgaggagggaccttttccctgcccagaatgcggcaaggtctttctgcacaattcagtgctgacagagcatggaaaaatacacctgctggagccccctcgaaagaaggcacccaggtccaagggtccacgtgagtcagtgccgccacgagacggtgctcagggccctgtggcaccgaggtcccccaagcgcccctttcaatgttcagtatgcggaaaggccttcccctggatggtccacttaatcgaccatcagaagcttcacactgcacacggccatatgtag

SEQ ID NO: 21249 - DNA, 537 bp, Artificial Sequence
  Description of Artificial Sequence: Synthetic coding sequence
atgctgccccggcccaaggcccccgccagcccccggcggccccagactccgaccccgtccgagcaagacgcagatcctgggcccgcgtctccgagagacaccgaggcccagagactaaggttccgacaattccaataccatgttgctagtggcccacatcttgccctgggtcagctgtggaccctgtgtaggcaatggttgaggccagaagcacgctccaaggaacagatgctggagctgctggtgttagagcagtttctaggggctctgccctcaaagatgcggacatgggtacagtcgcaaggacctagaagctgcagggaggcagcttcattagtagaggatctcactcagatgtgccagcaagagggagagcggcgcaggttgcctgcgccgggacgagctcggggtccagatgtgtccgaggacagaaccgccctactgcctgcccacattgctccaacacccgctaggccactcccaacttctaagcctttgttacccagaggctgtgtctttaactacttctacatttag

SEQ ID NO: 21250 - DNA, 2178 bp, Artificial Sequence
  Description of Artificial Sequence: Synthetic coding sequence
atgggcccccgggccagcctgagccggctgcgggagctgtgcggccactggcttcgcccggcactccacaccaaaaagcagatcctggaattactggtactggaacagttcctcagtgtcttgcctcctcacctgttagggcggttgcaggggcaacctttgagggacggggaggaagtcgtccttttgctggagggcattcatcgggagccgtcacacgccggacctctggacttcagctgcaatgccggcaaaagctgcccacgagctgacgtgacgctggaagaaaagggatgcgcctcccaggtgccatcccatagcccaaaaaaggagttaccagcagaggagccgagcgtgctgggaccttccgatgagccgccacggccacaacccagagccgctcaacctgccgagcctggtcaatggcgcctgccaccgtcaagtaagcagcccctgtcccctgggccccaaaagacctttcaggcgctccaggagtcatctccccagggtccttccccttggcccgaggaatcatctcgggaccaggaactggctgcagtcctagagtgtctgacttttgaggatgttcccgaaaacaaggcatggcccgcccaccccctgggcttcggatctcgcactcccgacaaagaagaattcaagcaagaggaaccgaaaggggcggcttggcctactcctatcctcgccgagtcacaggccgactctccaggcgtccccggggaaccttgtgcccaatcacttggcagaggagcggcagctagtggaccaggcgaggacggctcacttctcggcagttcagagattctggaggtgaaagtggctgagggcgtaccagaacctaaccccgagttacagttcatctgcgccgattgtggagtctcatttccacagctgagtagattgaaggctcatcagcttcgatctcaccctgctggaaggtcatttctgtgcctgtgttgtggaaaaagcttcgggagatcgtcaattctgaagttgcacatgcgtactcatacagatgagcgccctcacgcatgccatctgtgtgggcatagatttcgtcagagcagccacttatccaaacatctcttgactcattcatctgagcctgccttcctgtgtgctgagtgtggcagaggttttcagaggcgggcctcacttgttcagcacttgttagctcatgcccaggaccagaaacccccctgcgctccagaaagtaaggcagaggcaccacccctaactgacgttctgtgcagccactgcggccaatcattccaacgacggtcttctttgaagaggcaccttagaattcacgcgcgcgataaggaccgcagatcaagcgaaggtagtgggtcccgtaggcgggactcagatcgtcgacctttcgtgtgcagtgactgcggtaaagccttcagacgctccgaacatctcgtcgctcatcggcgggtacatactggtgaacgcccattttcgtgccaggcgtgtggacgatctttcacacaaagctctcagctcgtaagccaccagagagtgcacaccggagaaaagccttacgcttgtccacaatgcggcaagaggttcgttcgcagagcatctttggcccggcatcttctcacacacggtggcccgaggcctcatcactgcacccaatgcggcaagtcattcggccagacgcaggacttggcgcggcatcagcgtagccacaccggcgaaaaaccgtgtcgatgttccgagtgcggcgagggtttctcacaaagtgcccacttggctaggcaccagcggattcacaccggcgagaagcctcacgcttgtgacacatgcggccaccgctttagaaattctagcaacctggcccgacataggaggtcacatactggcgagcgaccatattcttgtcagacatgcggacggagcttcagacgtaacgctcacctcagacgacatctcgcgacccacgccgaacctggtcaggaacaggccgagccaccgcaggagtgcgtggaatgcggaaagagtttttctaggtcctgtaatctgttacgacacctgttggttcataccggagcaaggccatactcctgcacacagtgtggacggagttttagccgtaatagccacctgcttaggcaccttcgtacccacgcaagggaaaccctttattag

SEQ ID NO: 21251 - DNA, 1977 bp, Artificial Sequence
  Description of Artificial Sequence: Synthetic coding sequence
acccgggtgcaggccgaggcccggggcggcagccccgccgtgcagatgctgccagttagtggcggccacggcgccaccggggtgcccgagcccgcgcccggggccctgcgcccgctcgctgcagccggctccgcccatcaagagacagacccgggagcagcgggggcaggcgctgtgcccgaatgcgctgctagcgccccccctggccctcccgccggagctgctgctcagggctggggcggcggcggagccgcagcccgcgggcatcctcctggtgctcaaccaagaggggctgccggtccgcagggacccagtccttggccagaggaatcgtctcgtgatcaggaactcgccgctgtccttgaatgtctgacctttgaggacgtacctgaaaacaaggcctggccagctcacccactgggctttgggtccagaactcctgataaggaagagtttaaacaggaggagccaaagggagccgcctggcctacccctatactggccgagtcccaggccgacagtccgggagtgccaggagagccctgcgcccaatcccttggtagaggggccgctgcttccggaccaggcgaggatggttctctgttaggctcttccgagatcctggaagtcaaagtggcggaaggcgtgcctgagccaaacccggagttgcagtttatttgtgctgactgtggagtttcctttcctcagctctccagacttaaagcccatcagctccgatctcacccagcgggaagaagctttctgtgcctttgttgcggtaagtctttcggcaggagctccattcttaagctgcatatgaggacccacacagacgagaggccccacgcctgtcatctttgcggacacaggtttcgccagtcctcacatctcagcaaacacttgttgactcattcgtccgaaccagcctttctgtgcgcagagtgcgggcgcgggttccaaaggagagcttcgctagtacagcatttactggcccacgcgcaagatcagaagccaccgtgcgcgcctgagtcaaaggcagaagcgccgccacttactgacgttctctgttcacattgcggtcagtcttttcagcggagatcttcgctaaagcgccatctcaggatccacgcgcgtgacaaagacaggaggtcatcggaaggaagtgggtctcgtcgccgcgactccgaccggcggccctttgtctgcagcgactgcggaaaagcattccgccgctcggagcacctggtggcccataggagagtgcacacgggcgaaagacctttttcctgccaggcctgcggtcgcagcttcacgcagtcaagccagttagtgagtcatcagcgcgtccatacaggcgaaaaaccatatgcctgcccccagtgcggaaaacgattcgttcggagagccagcctggctcgccacttgctaacacacggcggtccgaggccgcatcattgcacacagtgtggcaaaagtttcggacagactcaggacttggcaaggcaccaacgctctcataccggtgaaaagccatgtagatgttctgaatgtggggagggttttagtcagtccgcccacctggcaagacaccagagaattcataccggagaaaaacctcacgcatgcgatacctgtggccatagattccgcaacagctccaacctagccaggcatcggagaagccataccggggagcgcccatattcctgtcaaacatgtgggagaagctttcgccgtaatgctcacctgcggaggcatttggctacgcatgcggagcccggccaggaacaagctgaacctccccaggagtgtgttgagtgtggtaagagcttctcaagatcgtgcaatcttctaagacacctgctcgtccacaccggtgcccggccgtattcttgtacccagtgcggtcgcagcttttctaggaattcacatctgctgagacaccttcgcacacatgcccgtgagaccctgtattag

SEQ ID NO: 21252 - DNA, 1047 bp, Artificial Sequence
  Description of Artificial Sequence: Synthetic coding sequence
atgaccaccgccctggagcccgaggaccagaagggcctgctgatcatcaaagccgaggatcattattggggacaagatagtagttcgcagaaatgctcacctcatcgtcgcgaactgtatagacagcacttccgaaaactgtgttatcaggacgctcccggaccacgggaggccctgactcagctgtgggaactgtgtcggcagtggttacggcccgagtgtcacactaaggaacagatcttggatctgctagtgctggagcagttcttgtccatcctgccaaaggatctgcaggcatgggtacgcgcccaccatcctgaaacgggagaggaggctgtcactgtgttggaagacctggagcgggaactcgatgagcctgggaagcaggtgcccgggaacagcgagcggagagacatcctaatggataaactggcacccctgggtcgaccgtatgaaagtctcacagtccagctgcatcccaaaaagacacagttggagcaagaagcgggtaaaccacaacgcaacggggataagactcgcactaagaatgaagagctatttcagaaggaggatatgcctaaggacaaggagttcctcggtgaaatcaacgacaggttgaataaagacactccacagcatccgaagtccaaagacatcatcgagaacgagggccgtagcgagtggcaacagcgcgagcgcagaagatataaatgtgacgagtgcggaaagtccttcagtcactcaagcgacttgtccaaacaccgcagaacccacactggcgaaaaaccctataaatgcgacgagtgtgggaaggctttcattcagcgttcccacctgatcggccaccatcgtgtccacactggagtgaaaccctataagtgcaaggaatgtggcaaagacttttctggcagaacggggctcattcagcaccagcgtattcacacaggagagaagccatatgagtgtgatgagtgcgggaggccctttagagtgagttccgcgctcatccggcatcagcgaatccacaccgctaacaaattatattag

SEQ ID NO: 21253 - DNA, 1533 bp, Artificial Sequence
  Description of Artificial Sequence: Synthetic coding sequence
atgctgcccctggagaaggccttcgccagcccccggagcagccccgctcctccagacctgcctacacccggatccgcggcgggggtacagcaagaggaaccggagaccataccagagcgtacgcccgctgacctggaatttagcaggctcaggttccgcgaattcgtgtaccaggaagctgcggggcctcaccagacgctagcacggctccacgaactgtgccgccagtggctgatgcctgaggcacgtagtaaggagcagatgctggaactgctggttctggagcaattcttaggtattttacctgataaagttcggccctgggtggtggcgcagtaccctgaatcctgtaagaaggcagcgtccttggtggagggactggctgacgtactggaggagcctggaatgttattgggctcacccgctggcagctcatctatcctgtcggacggcgtttacgagcgtcatatggatccgctgctccttcccggtgaactagcctctccttctcaagccctgggagcaggagaaatccctgcgcccagcgaaacaccctggctgagtcctgaccccctatttctggagcagagaagagtcagggaggccaaaacagaggaagatggacccgccaatacagaacagaaactcaagagcttccctgaagacccacaacaccttggcgaatggggtcacttagatcccgccgaggagaacctcaagtcctacagaaagttgctactgtggggttaccagcttagccagcctgatgcagcgtccagactggacacggaagagcttcgcctcgtagagagagacccccagggtagcagcctccctgagggcggacgtcggcaggaatctgccggctgcgcctgtgaggaggctgcccctgcaggagtgctccccgaactgccaacagaggctcctccgggcgacgcattagcagacccacccagcgggacgactgaggaagaagaggagcagccagggaaagcccccgacccccaggatccacaggatgctgaatccgattcagccacaggatcccagcgacaatccgtgattcagcagccagcacccgacagagggacggccaagctgggtaccaaaagaccacatccagaagatggggatggccagtcactggaaggcgtgagtagctcaggtgactctgccggcctggaagccggccagggccctggcgccgacgaaccagggctgtctagaggaaaaccatatgcgtgcggtgagtgcggggaggcatttgcctggcttagccatctcatggagcatcacagctctcatgggggtagaaaacggtacgcttgtcaagggtgctggaaaacttttcatttctctctagctctcgccgagcaccagaagacccacgagaaggagaagagttacgctctcggtggggcaagagggcctcagccctcgacccgggaagcgcaggctggagcccgagccggcggccctccagagtccgttgagggcgaggctccgccagctcccccagaagcccagcgctag

SEQ ID NO: 21254 - DNA, 1125 bp, Artificial Sequence
  Description of Artificial Sequence: Synthetic coding sequence
atgctgctgggcagccccgccggcagcagcagcatcctgagcgacggggtttacgaacggcatatggatcccctgcttctgcccggcgaactggcctctccctctcaggcccttggagcaggggagattcccgcgccttccgaaaccccctggctgagcccggatccattattcctcgagcagagacgtgttcgagaagcaaaaaccgaggaggacgggcctgctaacacagagcagaaactcaagtcattccctgaggatccccaacatcttggagagtggggccatctggatcctgctgaagagaatctgaaaagttacagaaagttattactatggggttaccagctctcccagcctgatgctgcttcccgtctggacacggaggaactcaggcttgtggaaagggatccccagggatcatcccttccaggcggcagaaggcaggaatctgccggatgtgcctgtgaagaggccgccccagccggagtgttgcccgaactccccaccgaggctccacctggcgacgccctggccgatcccccctctggaacaaccgaggaagaggaggagcagccaggcaaggctccagaccctcaagacccccaggatgccgagtccgactctgcaaccggaagccagaggcagtcagtgatccagcaacccgctccagacaggggaacagcgaaactagggacaaagcgcccccatccagaggacggtgatgggcaatctttagagggagtttccagcagcggagactccgccggcctcgaggcagggcagggccctggagctgacgaacctggcctctcacgcggtaaaccttacgcatgcggcgaatgtggagaagccttcgcttggctaagccacctgatggagcatcactcaagtcacggcggcagaaaaaggtacgcttgtcaggggtgttggaaaacattccacttcagtctcgccctggccgagcaccaaaagacacacgagaaggagaagagttacgccttgggaggcgctcggggcccgcagcctagcaccagggaggcacaggcgggagcacgggccggtggccctcccgaatccgtggaaggcgaggcaccccccgcccccccggaggcccagcgatag

SEQ ID NO: 21255 - DNA, 1701 bp, Artificial Sequence
  Description of Artificial Sequence: Synthetic coding sequence
atgcggcgggtgggcggccgggccgacgaggacgccaccgccgccggcagtctgtgggtcctggcacctccagagccaacaggccacctggtgataccagggacttcaccacttgagcccccttgtccatggctggatagccatatcttccagtgccggttcggtaagatgttacccttggaaaaggcgtttgcatccccgcggtcaagcccggccccccctgacttgccgacaccaggctcagccgcaggcgttcagcaggaagagcctgaaaccattcctgagcggacaccagccgacttggaatttagcaggctccgcttcagagaatttgtttatcaggaagcagccggcccccatcagacacttgcccgactgcacgaattgtgccgccaatggctcatgcccgaggccagaagcaaagaacaaatgcttgaattgctcgtgctggaacagttcctcggtatcctgccagacaaggtgagaccatgggtggtggctcaatatcctgagtcctgtaagaaggctgcttcgctagttgaaggattagcagatgttttagaggagcctgggatgctgctgggaagccctgcagggtctagctcaatactttcagatggagtctacgaacgccacatggacccgctcctgctacccggggagttggcttccccaagtcaggctctgggtgctggagagatccctgcaccctctgagaccccctggctgagccctgatcccctgtttctggaacagcgaagggtcagggaagccaagaccgaagaagatggcccggccaatacagagcagaaactaaaatctttccccgaggacccgcaacatttgggagaatggggacacctagaccctgccgaggaaaatttaaagagttacaggaaactgctgctgtggggttatcaactctctcaaccagatgctgcctctcggctggacacagaagaattgcgtctggtggagagggatccacaggggtcttccctccccgagggcggaaggagacaggagtcagctgggtgcgcatgtgaggaggcggctccagctggcgtgctccctgagctacctaccgaggcccctcccggagacgccctcgcagatcccccctcagggacaacagaggaggaagaagagcagcctggcaaggctcctgacccccaggatccccaggatgctgaatctgattctgcaactggctcccagcggcagtctgtgatacagcaacccgccccagacagaggtactgccaaactggggacaaaacggccacacccggaagacggggatggccagagcctggagggcgtttcttcgagtggcgattccgccggcctggaagccggccaaggcccaggcgctgacgagcccggtctgagccgagggaagccatacgcttgcggcgaatgtggagaggcattcgcctggctgtcccatttaatggaacaccactcatctcatggcggccggaaaaggtacgcctgtcagggatgctggaaaacctttcatttctcgctggctctggctgagcaccagaagacccacgagaaggaaaagtcttacgcactgggcggcgcaagagggccccagcctagcacccgcgaggcccaggccggcgccagagctggcgggcctcctgaatcggtggaaggcgaagctccccccgcaccacctgaagcacagaggtag

SEQ ID NO: 21256 - DNA, 1701 bp, Artificial Sequence
  Description of Artificial Sequence: Synthetic coding sequence
atgcggcgggtgggcggccgggccgacgaggacgccaccgccgccgggtctctttgggtactcgcacccccagagcccacaggacacctagtcattccaggtaccagccccctggagcctccgtgtccatggttggacagtcacattttccaatgtcgattcggaaaaatgttgccactggaaaaagccttcgcttctccacgttcgtctcccgcaccgcctgatctgcctactcccggaagtgcggccggggtccaacaagaagaacccgagactatccccgagcgcactccagcagatctcgagttcagccgcttgcggttccgggaattcgtgtaccaagaggcggctgggccccaccagactttggctcgcctgcacgagctgtgccgtcagtggctaatgccagaggcgcgcagtaaggaacaaatgctcgagttgctcgtcctcgagcagttcctgggcattctgccggataaggtgcgaccatgggtggtggcccagtacccagagtcatgtaaaaaagctgcctccctcgtggaggggctagctgacgtgctcgaggagcctggcatgttgttaggttctcctgctggaagcagcagtatcttatcagatggcgtgtatgagcggcatatggatcctctacttcttcccggcgaattagcctcaccatcccaagccctcggggcaggggaaattccggcaccgtcagaaacgccatggctatcacccgatcctctttttcttgagcagagacgggtaagagaggccaaaactgaggaggatggcccagcaaatactgagcagaagttaaaatcctttcccgaagatccacagcacttgggcgaatgggggcaccttgacccagcagaagaaaatttgaagtcgtacagaaagctattactttggggctatcagttgagtcagccagacgccgcctcccgtcttgatacagaagagttgaggctggtggaacgggacccccaaggctcttccctgccagagggggggcgacggcaggaatccgcgggttgtgcctgcgaagaggctgctcctgccggcgtgctgcccgagctgccaactgaggcccccccaggggacgccctggcagatccaccttcaggaaccaccgaggaagaagaagaacaaccggggaaagctcccgacccacaggatccacaggacgcggagagtgactcagcaacagggtcacagcggcagtccgtaatccaacagcccgcccctgatcgggggactgcaaagcttggaactaaaaggcctcatccggaagatggtgacggacaatccctggagggggtatctagtagtggagatagcgctggtcttgaagctggtcagggcccaggcgccgacgagcccggactctctagaggaaagccttatgcttgcggggaatgcggagaggcgttcgcatggctcagccacctgatggaacaccattccagccacggcgggcgaaaaaggtatgcatgtcaaggctgttggaagactttccacttcagtttggccctggccgagcaccagaagacccacgagaaggagaagagctacgccctaggaggtgctcgcggcccccagccttctacccgcgaggcccaagcaggggcacgcgcagggggaccacctgagtccgtcgagggggaggcaccacccgctccccctgaagcccagcgctag

SEQ ID NO: 21257 - DNA, 453 bp, Artificial Sequence
  Description of Artificial Sequence: Synthetic coding sequence
atgatggccgccgacatcccccgggtgaccacccccctgagcagcttggtccaggtcccccaggaggaggatcgacaggaggaagaagtgactacaatgattttagaggacgattcatgggtgcaggaagcagtactacaggaagacggccccgagtccgagcccttcccacagtcagcgggcaaaggggggccccaggaggaagtgacacgcggcccacagggggccctgggacggctgagagagctctgtcgcagatggctgcgacctgaagttcacacaaaggaacagatgctgacgatgcttcccaaggaaatccaggcctggctccaggagcataggcctgagtcatcagaagaagccgccgccctggtggaagatctgactcagaccctccaggactccgcagtagcagttgtggcttcgctaccggtcgaagtaacatcattatag

SEQ ID NO: 21258 - DNA, 1788 bp, Artificial Sequence
  Description of Artificial Sequence: Synthetic coding sequence
atgatggccgccgacatcccccgggtgaccacccccctgagcagcttggtccaggtgccacaggaggaggatcgacaggaggaagaggtgactacaatgattttagaggacgactcttgggtacaggaggccgtcttgcaggaggaagtcacgcgcgggccgcagggggctctcgggcggttacgcgaattgtgtcgcagatggcttcgccctgaggtgcacacaaaggaacagatgctcactatgttacccaaggagatccaggcctggctgcaagagcacaggcccgagtcctcagaagaagcggctgccctggtagaagacctgacacaaacactgcaggactccgatttcgaaattcaaagtgagaatggggaaaattgtaatcaagacatgttcgaaaacgaatctcggaaaattttcagcgagatgccggagggcgagagcgcccaacattctgacggagagagtgactttgagcgagacgcaggcatccagaggcttcaagggcactcacccggggaagaccatggagaagtagtcagccaagatcgggaggttggccaactgatcggactgcagggaacctatctcggagagaagccctacgagtgcccgcaatgcgggaagaccttctcaagaaaatcccatctgatcacccatgagcgcacccatacgggtgagaagtactacaagtgtgacgagtgcggtaaatccttctccgacggatctaatttttccaggcatcagactacccacacaggcgagaaaccgtacaaatgccgagactgtggaaaatccttcagtcggtctgccaatttgatcacccaccaacgtatccataccggagaaaagccctttcagtgtgccgagtgtggcaaatcatttagtaggagccctaatctgattgcccatcagcgaacacacacaggtgagaaaccatatagctgtccagaatgcggtaaatcttttggcaatagatcctcactgaacacacaccagggaatccacaccggcgagaagccctacgaatgcaaggaatgtggggaatcattctcctacaattcgaacttaatccgacaccagcgcatccatacgggagaaaaaccttacaaatgcacggattgtggacagcgattctcccagtcctcagccctgatcacccaccgaagaacccacacaggggaaaagccctatcagtgttccgagtgcggaaaatcctttagtcgctcttcgaacctggccacacaccgcagaactcacatggttgagaagccttataagtgcggagtgtgcggaaagtctttttcccaatcttccagtctgattgctcatcagggcatgcatactggtgaaaagccttatgagtgcctaacatgcggggagagcttttcttggagctctaatctcctcaagcaccaaagaatccacaccggtgagaaaccctacaagtgttcagagtgcggaaaatgtttcagtcagcgctctcagctggtcgtacatcagagaacacacacaggcgaaaagccatacaagtgtctgatgtgtgggaaatctttcagtcgaggatcgattttggtcatgcatcagagagcacacctgggagacaaaccatatagatgccctgagtgcggcaaaggcttcagctggaactctgtgttgattattcatcaaagaatccataccggtgaaaagccctataagtgccctgaatgcggaaaggggttcagcaattcgtctaacttcattacacaccaacggactcacatgaaagaaaagctttactag

SEQ ID NO: 21259 - DNA, 441 bp, Artificial Sequence
  Description of Artificial Sequence: Synthetic coding sequence
atgatggccgccgacatcccccgggtgaccacccccctgagcagcctggtgcaggtgcctcaggaggaagatcgccaggaggaggaagtcaccaccatgatcttggaagatgactcatgggtccaggaagcagtactgcaggaagacggaccggagtctgagcctttcccgcagtctgcaggtaaagggggcccacaagaagaggttacgcgcggccctcagggtgcgctgggaaggctccgtgaactctgccgacggtggctccggcctgaggtccacaccaaagaacagatgctcactatgctgcctaaggaaatccaggcttggctgcaggaacatcgcccagaatcctccgaggaggcagccgccctggtcgaggacctcacacaaactctgcaagattccgagacagccagctgtgtccatggctgtccagtatag

SEQ ID NO: 21260 - DNA, 99 bp, Artificial Sequence
  Description of Artificial Sequence: Synthetic coding sequence
atgatggccgccgacatcccccgggtgaccacccccctgagcagcctcgtgcaggtccctcaggaggaagaccgccaggaggaagaggtcactacatag

SEQ ID NO: 21261 - DNA, 1845 bp, Artificial Sequence
  Description of Artificial Sequence: Synthetic coding sequence
atgatggccgccgacatcccccgggtgaccacccccctgagcagcctggtgcaggtgccccaggaagaagatcgccaggaggaggaggtgaccactatgatcctggaggacgatagctgggtgcaagaagctgtgcttcaggaagacggaccagagagtgagccttttccacagagtgctggcaagggaggtcctcaggaggaagtgacacggggccctcagggagccctgggcagactgcgggagttatgccggaggtggttgcggcctgaggtgcatacaaaagagcaaatgctgacaatgctgcctaaggagatccaggcttggctccaggagcatcggcctgagagtagcgaggaagccgccgctcttgtggaggatctgacccagacacttcaggatagcgacttcgagatccaatcagaaaacggtgaaaattgcaatcaagatatgtttgaaaatgagtcccgcaagattttcagcgagatgcccgaaggcgaatccgcccaacattccgatggggagagcgacttcgaacgcgacgccggcatccagcggcttcagggccactctcccggagaggaccacggcgaagttgttagccaggacagagaagttggccagctgatcggactccagggtacttatctcggcgaaaaaccttatgagtgtccacagtgtgggaagacattctccagaaaaagtcatctcatcacacatgagcggacccacactggcgagaagtactacaagtgtgacgagtgcgggaaaagcttctccgacggcagtaacttcagcaggcatcagaccactcacacgggcgaaaaaccgtacaaatgccgcgattgtggcaaaagcttcagccgctctgccaacctaataacccaccaacggatccataccggcgagaaacctttccagtgtgccgaatgtggcaagtcatttagccggtcccccaatttaattgcccatcagcgcacacataccggggaaaagccatattcttgtcccgagtgtggtaagagtttcggtaatcgctcaagcctgaacacccaccaaggcatacataccggagaaaagccttatgaatgcaaagaatgcggagagtccttttcatacaactccaacctcataaggcaccagcgtatccatacaggagaaaagccatacaagtgtaccgactgtggccaaaggttttctcagagctctgccctgatcactcatagacggacacataccggagagaagccgtaccaatgttctgaatgtggtaagagcttctcccgttcatccaatctggcaactcatcgcagaacacacatggtggagaagccctataagtgtggcgtgtgcggcaaatctttctcccagagctcctccctcattgcacatcaggggatgcacacaggcgagaagccatacgagtgcctcacttgcggggagtcatttagctggtcaagcaatctgctcaagcaccagcgcatccataccggcgagaagccttacaagtgctcagagtgtgggaaatgtttctcccagcgctctcaactggtggtgcatcagaggacgcacactggggaaaagccgtataagtgtctaatgtgcggcaagagtttttcacggggtagtatacttgtcatgcatcagagggctcacctgggagataagccatatcggtgccccgaatgtggcaagggatttagctggaattccgtgctgatcattcaccaaaggatccacaccggcgaaaaaccatacaaatgccctgagtgtgggaagggttttagtaatagcagtaatttcatcacccaccagaggacacatatgaaggaaaagttatactag

SEQ ID NO: 21262 - DNA, 84 bp, Artificial Sequence
  Description of Artificial Sequence: Synthetic coding sequence
atgatggccgccgacatcccccgggtgaccacccccctgagcagcctggtgcaagtcccccaggaagaggatcgacaggaatag

SEQ ID NO: 21263 - DNA, 1845 bp, Artificial Sequence
  Description of Artificial Sequence: Synthetic coding sequence
atgatggccgccgacatcccccgggtgaccacccccctgagcagcctggtgcaggtgccgcaggaagaggatcggcaagaggaggaggtgactacgatgatcctggaggatgattcctgggtacaagaagcggtgctccaagaggatgggcccgagtccgagccttttccccaaagtgctggcaagggcggcccacaagaggaggtcaccaggggaccgcaaggagccctggggaggctgagggaactgtgcagacgatggcttcggcctgaggtccacacaaaggagcagatgcttaccatgctaccgaaggaaatccaggcctggttgcaggagcaccgccccgaatcgagtgaggaggccgccgctctggttgaggacctgacgcagacgttgcaggacagcgacttcgaaattcagagcgaaaacggtgagaactgcaatcaggatatgttcgagaacgaaagccgaaaaatcttctcagaaatgccggagggagagagtgctcagcattcagacggcgaaagtgattttgagcgggatgccggcatccagcgcctgcaaggccactcccctggggaagaccacggcgaggtggttagccaggatcgtgaggtcgggcagcttatcggcctccagggtacttacctgggggaaaaaccttacgaatgtcctcaatgtgggaagacttttagccgtaagtcacatcttatcacacacgagcggacacacactggagagaagtattataaatgtgatgagtgcgggaagtcatttagcgacgggtcaaatttctcccggcaccaaacgacacatacgggcgagaaaccgtataaatgtcgcgactgtggaaagagcttcagcagaagcgccaaccttatcactcaccagcgtatccacaccggagagaagcctttccaatgtgccgaatgtggaaagagcttcagtagatcaccaaacctgatagcgcaccagcggacgcacaccggcgagaaaccctactcttgcccggagtgcggaaagagtttcggaaatagatcttcgctcaacacccaccagggaatccacaccggagaaaagccttacgagtgtaaggaatgtggggagtctttcagctacaactcaaacctgattcgtcatcagcgcattcatacaggtgagaaaccatataagtgtactgactgtggtcaacgcttcagccaatcgagtgctctgatcacccataggcgcacccatactggtgaaaagccttaccagtgcagcgagtgtggaaagagtttctcccgaagcagcaatctggccacacatcggagaacacatatggttgaaaagccatacaagtgcggagtttgtggcaagagcttctctcagagctcaagccttattgcacaccagggaatgcacacaggtgagaagccttacgagtgtttgacatgcggcgaatcattttcatggtcctccaatctgctcaagcaccagaggatccacaccggcgaaaaaccttataagtgctccgaatgcggaaaatgcttcagccaacgttctcaactggttgtccatcagcgcacccacacgggggagaagccttacaaatgccttatgtgtggcaaatcattctcaagaggaagcatactcgtaatgcaccagagggcgcatcttggagataagccttacagatgcccagagtgcggcaaggggttctcttggaattcagtcctcatcatacaccagagaatccacacgggcgagaaaccctacaagtgtcctgaatgcggaaaaggatttagcaactcatccaattttattacacatcagaggacccacatgaaagaaaaactgtactag

SEQ ID NO: 21264 - DNA, 1845 bp, Artificial Sequence
  Description of Artificial Sequence: Synthetic coding sequence
atgatggccgccgacatcccccgggtgaccacccccctgagcagcctggtgcaagtgccacaggaagaggaccgccaggaagaggaggttacgacaatgatcctggaggacgattcttgggtgcaggaggctgttttacaagaggatggccccgagtcggaaccctttccccaaagcgccggcaaaggcggcccccaagaagaagttactcgagggccccagggagctctggggaggcttcgggagctatgccggaggtggctaaggccagaggtccacacaaaagagcagatgctgactatgctcccaaaagagatacaggcttggctgcaggagcacaggcctgaaagttcggaggaggcagctgctctcgtagaagatcttacacagacgcttcaggactctgactttgagattcagtcagaaaacggagagaattgcaatcaggacatgtttgagaatgaaagcagaaaaatcttctcagaaatgcccgagggagaatcagcacagcattcagacggggaatccgacttcgagcgggatgcggggatccagcgtttgcaaggacactcacccggagaagatcacggggaggtggtctctcaggatcgcgaagtgggccagcttataggcctccagggaacatacctgggcgaaaagccatatgagtgtcctcagtgtggaaagactttttcccgtaagagccacctgatcacccatgagagaactcacaccggcgaaaagtactacaaatgtgacgagtgtggcaagagctttagtgacgggtcaaactttagtcgacaccagactacccacaccggagaaaagccttataaatgccgggactgcggcaagtctttttcccggtccgcgaacttaattacacaccagcggatccacactggagagaagcctttccagtgtgccgagtgtggcaagtcatttagtcggtccccaaatctaatcgcgcatcagcgtacacacaccggagagaagccgtattcctgccccgagtgtggcaaatcctttggaaatagatcgtcattgaatacccatcagggaattcatactggtgaaaagccttacgagtgcaaagagtgtggtgaaagcttctcttacaatagtaatctcataaggcaccagagaattcatactggggagaagccctacaagtgcactgattgcggacagcggttttcccagagctcagcacttatcacccaccgccggacacacaccggcgaaaaaccttaccagtgttcagaatgcggcaaatccttctcccggtcgtctaacctggctacgcaccggcggacgcatatggtggaaaaaccttacaagtgcggagtgtgcgggaagagtttttcccaatcctccagcctgatcgcccaccagggaatgcacacaggcgaaaaaccctatgagtgcttgacttgtggagagtctttctcttggtcatcaaacctcctcaagcatcagagaatacacactggagaaaaaccctacaaatgctcagaatgtggaaaatgtttctcccagcgctctcagctcgtggtgcaccaacgaacccatacaggagagaaaccgtataagtgcttgatgtgtgggaaaagcttctcacgtggctcaatactggtcatgcatcagagagcccacctcggcgataagccgtataggtgccctgaatgtggcaagggatttagttggaattccgtgctgatcatacatcagcggattcacacaggggaaaaaccttacaaatgcccggaatgcggcaagggttttagcaatagctctaattttatcactcatcagaggacgcatatgaaggagaagttatactag

SEQ ID NO: 21265 - DNA, 162 bp, Artificial Sequence
  Description of Artificial Sequence: Synthetic coding sequence
atgatggccgccgacatcccccgggtgaccacccccctgagcagcctggtccaggtgccccaggaggaagatcggcaagaggaggaggtaacgacgatgatactggaagatgacagctgggtgcaggaagcagtgctccaggaggatggacctgagagttag

SEQ ID NO: 21266 - DNA, 1422 bp, Artificial Sequence
  Description of Artificial Sequence: Synthetic coding sequence
atgatgaccaaggtgctgggcatggcccccgtgctgggcccccggcctccgcaggagcaggtaggcccactgatggtcaaagtagaggaaaaggaagagaaggggaagtacctaccttccctcgagatgtttcgtcagcggtttcgccagttcgggtaccacgatacgcccgggccaagagaagctcttagtcaacttagggtgctctgttgcgaatggctgcgcccggaaattcacaccaaagagcagatcttggagctcctggtgttggagcagttcctgactatcttgccgcaggagttgcaagcttgggtgcaggaacactgcccagagtccgcagaggaggctgtgaccttgctcgaagatctggaaagagaactggacgagccagggcatcaggtgtccactccgcccaatgagcagaaaccggtgtgggaaaaaatctccagcagtggtacagccaaggagtctccatcaagcatgcaaccacagcccctcgagacaagccacaaatacgaaagttgggggcctctgtacatccaggagtccggtgaggagcaggagtttgcacaggatcccaggaaagtgcgagactgcagactgtcaacccagcatgaagaatcagcagacgagcagaaagggtctgaagccgaggggctaaaaggcgatattatcagtgttatcattgcaaacaagcctgaagcatccttggaacggcagtgtgtgaatctggagaatgaaaagggtacgaagcccccgctgcaggaggccggaagtaagaaaggcagagagtcagtgcccacaaaaccaacacctggcgagcgccgatacatttgtgcagaatgcggcaaggctttttctaactccagcaatctcaccaagcatcggaggactcacacaggtgaaaagccctatgtgtgcactaagtgcggaaaggccttctcccactccagcaacctgactctccattacaggacccacctggtggaccgcccctatgattgcaagtgtggtaaggctttcggacagtctagcgatctgctgaagcaccaacggatgcacacggaggaagctccgtatcagtgtaaagattgtggcaaggccttttctggtaaagggtctctgattaggcactataggattcacaccggtgaaaagccctaccagtgcaatgaatgcgggaagagcttcagccagcacgctggcctgagctcacatcagcgcctgcacaccggagagaagccatataaatgtaaagagtgtggcaaggccttcaaccattcaagtaactttaataaacaccaccggattcacacaggcgaaaagccttattggtgccaccactgtgggaagactttctgctctaagtctaaccttagtaagcaccaaagggtccacaccggggaaggtgaagcaccatag

SEQ ID NO: 21267 - DNA, 1347 bp, Artificial Sequence
  Description of Artificial Sequence: Synthetic coding sequence
atgatgaccaaggtgctgggcatggcccccgtgctgggcccccggcctccacaggagcaggtcggacctctgatggtaaaagttgaagagaaggaggagaaaggtaaatacctgccatcactggaaatgtttcgccagagattccgacagtttgggtatcacgacactcctggcccacgcgaagcactgtcccaacttcgtgtcctttgttgtgagtggctcagacctgaaatacacacaaaggaacattgtcccgagagcgcagaggaggccgtcaccctcctggaggacctggagcgggagctggacgagccagggcaccaggtaagcaccccacctaacgaacagaagccagtgtgggagaaaatttcgtcatcggggactgccaaggagtccccgtccagcatgcagcctcagccattagaaaccagccacaaatacgagtcctggggccctctatacattcaggaaagtggggaggaacaggagttcgcacaagatccacggaaggtgagggactgtcgcctctctactcaacacgaagagagcgcagacgagcagaaaggcagtgaggctgagggtctgaagggggacattatcagtgtgatcattgccaataagcctgaggcaagcctggaaaggcagtgcgttaatttggaaaacgagaagggcacaaagccgcccctgcaggaagccggctcaaagaaggggagggaaagcgttcccactaaaccaacacccggcgagcgacgatacatatgcgctgaatgcggcaaggccttttccaactccagtaatctgacaaagcataggcgtacacacacaggagagaagccctacgtgtgcacaaaatgtggtaaggccttttcacactcctccaacctgactcttcactaccgcacccacctggtcgacaggccttacgattgcaaatgcggtaaagcgtttgggcaatcctctgatctgctcaagcaccaaagaatgcatacggaggaagccccataccagtgtaaggactgcgggaaagcgttcagcggtaaaggaagcctgatcagacactatcgaatccacactggagaaaaaccctatcagtgcaatgaatgtgggaagagcttctcccagcacgctggattgtcatcccaccagcgactgcatacaggtgagaaaccatacaaatgtaaagagtgtgggaaggcctttaatcatagttccaattttaacaaacaccaccggatccacacgggggagaaaccctactggtgccatcactgtggcaagaccttctgtagcaaaagcaacttatctaagcatcagcgagttcacacaggggaaggtgaggcgccgtag

SEQ ID NO: 21268 - DNA, 546 bp, Artificial Sequence
  Description of Artificial Sequence: Synthetic coding sequence
atgatgaccaaggtgctgggcatggcccccgtgctgggcccccggccccctcaggagcaggtgggaccactgatggtcaaggtggaagagaaggaggaaaagggcaagtacctgccatctttagagatgtttaggcagagatttcgacaatttggttatcacgatacacccggaccacgtgaagccctttcacagctgagagtgttgtgttgtgagtggcttcgacctgagatacacacaaaggaacagatcctggaattgctggtgttggagcaattcctcacaatcctgccgcaggaactacaagcgtgggttcaggagcactgcccagaatctgccgaagaggcggtaaccctgctcgaggatctggagagagagctggatgaacccgggcatcaggttagcacaccccctaatgaacagaagcctgtatgggagaagatctcaagctctggaaccgcgaaagaaagcccgtcttcgatgcagccccagcctctcgaaacatcccacaagtacgagtcttggggcccactgtacatccaatag

SEQ ID NO: 21269 - DNA, 1353 bp, Artificial Sequence
  Description of Artificial Sequence: Synthetic coding sequence
atgatgaccaaggtgctgggcatggcccccgtgctgggcccccggcccccacaggagcaggtgggtcccctgatggtgaaggttgaagaaaaggaagagaagggaaaatatctgcccagtcttgagatgttcagacaaaggtttcggcagtttgggtatcacgacacccctggtccaagggaggctttgagccagctgagggtcctatgctgtgagtggctccggcctgagattcacaccaaagagcagatcctcgagctgctggtactggagcaatttcttactattcttccgcaagagctgcaagcgtgggtccaggaacactgtcccgagagcgcagaggaggcggtgacactcctggaagatctggagcgggaactggatgaacccggacaccaggtgtccacccccccaaatgaacaaaagccagtttgggaaaagatttcatccagcggcaccgcaaaagaaagtccttcatctatgcagccccagccactggaaactagccataagtatgagtcttggggtcctctgtacatccaggaatctggagaggagcaggagtttgctcaggatccaagaaaggtgcgggactgcaggttatcaactcagcatgaggagtcagctgatgaacagaaggggagtgaggccgaggggctcaaaggagacattatttcggttattatagcaaataagcccgaggcctctctggagcgtcagtgcgtcaacttggagaacgagaaaggaactaagccacctctgcaagaggccgggtcgaaaaagggcgaacataccctcggccgcaatctgacttgcgctccatccgttggaaagctgagtgctaccgctcagacaagtccatccacgacagagcacacttggtggacgggccccatgactgtctccgttgagaagctcctcgggcgggcccagacatttttaaacatcagagagtgtacgcaaaagcggaggcatatctcagccaaaattgtagcaagactctccgcgggaaaagctgcttcctttgttaccatcggatctacactgggtagaagtctgatctccgtgacaaatgtaggcagagctagcgtctccatgagagcttcagcccctacccgggactcaacacccgagcggagtcacatatctgttaggagtgttggcaagccctcaaccaccgcaccaacctcaataaataccacggagagtacgccagggaaaagcccaaccggggtaatcacagtcgagcgcccatccgtggcgagtcctatctttcctaacatctcagagagtaccctggagagagagaagcatagaaatttccaagcactgctgttgctttctttattctag

SEQ ID NO: 21270 - DNA, 1170 bp, Artificial Sequence
  Description of Artificial Sequence: Synthetic coding sequence
atggccatcaccctgaccctgcagaccgccgagatgcaggagggcctgttggccgtgaaagtaaaggaagaggaggaggaacattcttgtggaccagagagcggtctgtcccggaacaatccccacacccgcgaaatcttccggcgccggttccggcagttttgttatcaagaatccccaggaccccgcgaggccctccagcgtttgcaggagttgtgccaccagtggctgcggcccgaaatgcacaccaaagagcagatcttagaactgctcgttttggaacaattcctgacaatcctacccgaagagctgcaggcatgggtgcggcagcataggccagtatctggagaagaagccgtgacagtgctagaggatctggagcgtgagctggacgatccaggcgagcaagttctcagccacgctcacgaacaggaggagttcgtaaaggaaaaagccacaccgggtgcagcccaggagtcatctaatgaccaatttcagaccctagaagaacagctgggatataatttgagggaagtctgtcccgtccaggagatagatggaaaggctggcacctggaatgtagaactggcacccaagcgcgagatcagccaggaggtgaaaagtctaatccaggtgctcggcaaacagaatgggaacattacccagattccagaatacggcgacacttgcgacagagagggaaggttggagaagcagcgagtttcctctagcgtggaaagaccatatatctgctccgaatgtggcaagtcttttactcagaacagtatactgatcgagcatcagaggactcacacaggggaaaagccatacgagtgtgacgagtgcggcagagctttcagccaacggtctgggctgtttcagcaccagcgccttcacaccggcgaaaagcggtaccagtgttctgtatgtgggaaagctttctctcagaacgcaggactatttcatcaccttagaatccacaccggagagaaaccatatcagtgtaaccagtgcaataaatcgttctcacgccgatctgtcctgatcaagcatcagcggattcacactggagaacgtccctatgagtgtgaggagtgcggcaaaaatttcatctaccactgtaatctgattcagcacagaaaagttcatccggttgccgaatcaagctag

SEQ ID NO: 21271 - DNA, 1392 bp, Artificial Sequence
  Description of Artificial Sequence: Synthetic coding sequence
atgatggccaagagcgccctgcgggagaacggcaccaacagcgagacctttcggcaaaggtttcgcaggtttcactaccaggaggtggcaggtcctagagaagcgttttcccagttgtgggagctgtgctgtaggtggctacggcctgaagtacgcaccaaagaacagatcgtcgagcttctggtgctggaacagttcttaaccgtcctgcccggtgaaattcagaactgggtgcaggaacaatgtcctgaaaatggagaagaggcagtcacactcgttgaagacctggaaagagagccaggcagacccaggtcctcggtcacagtttccgtaaaaggccaggaggtccggctcgaaaagatgacccccccgaagagctctcaggagctccttagcgtccggcaggagtccgtggaaccacagccccgaggggttccaaagaaggagcgtgctagatctcctgatctggggcctcaggaacaaatgaacccaaaggaaaagttaaaacctttccagaggtctggcttcgaagccgggtttgaaaacgaggataattcgaaaagagatatatccgaggaagtgcagcttcaccggacgctcctggctcggagtgagcgaaagataccccggtacctgcaccagggtaagggcaacgagagtgattgccgctcaggccgccagtgggccaaaacttccggtgagaaaagagggaagttgacactgccagagaaatctctctccgaggtcctgtcacagcagcgaccatgtcttggcgagagaccttataaatacctgaagtattctaaaagctttggccctaattcactcttgatgcatcaggtctctcaccaggtcgaaaatccgtacaagtgcgccgattgcgggaagtctttcagccggagtgcccgtcttatcagacatcgtcgcattcatactggcgaaaaaccatacaagtgcttggattgcggtaagtcttttcgagattctagcaatttcatcactcatcggcgcattcatactggcgagaagccataccagtgcggcgaatgtgggaaatgttttaaccagtcatcctcgttgataattcatcagaggactcacactggtgaaaagccataccagtgtgaagaatgtggcaaaagcttcaataacagttcacatttctcagcacaccgtagaattcacactggcgagaggccccatgtctgccccgattgcggcaagagcttttcaaaatcatcagatctccgcgcccatcataggactcataccggtgagaagccttacggatgccacgattgcggcaaatgcttctctaagtcatcagccctgaacaaacacggggagatccacgctagagagaaattgctgacacaatccgcaccaaagtag

SEQ ID NO: 21272 - DNA, 2559 bp, Artificial Sequence
  Description of Artificial Sequence: Synthetic coding sequence
atgatggccaagagcgccctgcgggagaacggcaccaacagcgagacttttcgacagagatttcgtagattccattaccaagaagttgctggcccacgagaggcattttcccaactttgggagttgtgctgccgatggcttagaccagaggtcaggacaaaggagcagatagtggagctgctagtcctggagcagttcttgacggtcctgcctggggagattcaaaattgggtgcaagagcagtgtcctgaaaacggggaagaggccgttactctggtggaagatctggagagagaacccgggcgtcctcggagtagcgtaactgtcagcgtcaagggccaggaggttcggcttgaaaaaatgacaccacctaagtccagccaggagctgctctccgtgaggcaggagtccgtggaaccacagcccaggggggtgcccaaaaaagagagagcgcgcagtcccgatctaggaccacaggagcaaatgaacccaaaagagaaactaaagccatttcagagaagcggactgcctttcccaaagagcggagttgtgtcccgcctcgaacagggtgagccctggattcctgaccttctcggaagcaaggagaaggagctgccctcaggttctcacattggagacagacgggtgcacgccgacctccttccaagtaaaaaagacaggcggtcgtgggtggagcaggatcactggagtttcgaggatgaaaaggtggctggcgtgcactggggctacgaggagactcgcactttgctggccattctcagccaaacagagttctacgaagctttgaggaactgccaccgcaactcccaggtctatggggcagtagccgaacgactgagggaatatggcttcctcagaaccctcgagcaatgccgcacaaagttcaagggactgcagaagtcctacagaaaagtgaaaagcgggcacccccctgaaacatgcccattctttgaggaaatggaggccctcatgtcggcccaagtaattgctctgccttccaacgggctggaagctgcagcttctcatagtgggttggtcggcagcgatgcggaaacagaagagccagggcagcggggatggcagcacgaggagggcgcagaagaagctgtcgcgcaagaatcagacagcgacgacatggacttggaagccactcctcaagaccccaattctgcggctcccgtggttttccgatctccagggggggtgcactggggctacgaggaaacgaaaacttatctggcgatcctgtctgagacccagttttacgaagctctgagaaactgccacaggaactctcaactttatggagccgtcgctgagagactttgggaatatggtttccttcgcactcctgaacagtgtagaacgaagttcaaatctctccagacaagctataggaaagtgaagaatggccaggccccggaaacgtgtccctttttcgaggagatggacgccttggtgagtgtccgcgtggcggcgccccccaatgacggccaagaggaaacggcatcctgtcctgttcagggaacctctgaggctgaggcccagaagcaggccgaggaagccgatgaagccactgaggaggattccgatgacgacgaggaagatactgagattccaccaggcgctgtcattacacgtgcccccgtattgtttcagtctcctcgggggtttgaggctggatttgagaacgaggacaactccaagcgggatatttccgaagaggtccagctgcaccggacactgcttgcccggtccgagagaaagataccacgctacttgcaccaaggaaaaggaaacgagtctgattgcaggtccggacgccaatgggcaaaaacgtcaggggagaagcggggcaagctgaccctcccggaaaagagtctttcagaagtgctgagtcagcagagaccttgtctcggcgaacgcccttacaagtatcttaagtactccaagtccttcggacccaactcgcttctgatgcatcaggtgtcacaccaagtagaaaacccctataagtgcgcagactgtgggaagtctttctcacgctccgcccgcctgataaggcaccgtcgcatccacaccggagagaagccatacaaatgccttgattgtgggaagtccttcagagatagctccaacttcatcacccatcggcgtatccacactggggaaaagccataccagtgcggggaatgcggaaaatgcttcaatcaaagctcgagcctgatcatacaccagcgaacccatacaggcgaaaagccctatcaatgcgaagagtgtggaaaatcattcaacaattcgagccacttttctgcccaccggaggatccataccggagagaggccacatgtctgccctgattgcggaaagagcttctcaaaaagttctgaccttcgagctcaccataggacacacacaggcgaaaaaccgtatggctgccatgattgcggcaagtgcttttctaagtcctccgcactcaataagcacggtgagatccatgctcgcgaaaaacttctgactcaaagtgccccgaagtag

SEQ ID NO: 21273 - DNA, 1485 bp, Artificial Sequence
  Description of Artificial Sequence: Synthetic coding sequence
atgagcggcgaggccaccgtgctggcctaccacgcccccgaggagcaggaagggcttctggttgttaaggttgaagaggaaaactatgtattggatcaggattttggcctgcaggagaacccttggtcccaggaggtgtttcggcagaaattccgccaattctcatattcagactctactggcccgagagaagctcttagtcggctccgcgaactttgctgccagtggcttaggcctgaagttcatagtaaggaacagattctcgaactgttaatgctagagcaatttctggctatattgcccgaagagctccaggcctggctgagagagcatcgccctgaaaatggagaggaagctgtcacgatgctggaggaacttgagaaagagctcgaagaaccccgtcagcaggataccacacacggtcaggaaatgttctggcaggagatgacgagtacaggagccttaaagagcctgagcctcaattcacctgtccagcccctggagaatcagtgcaagaccgagactcaggaaagccaggctttccaggagcgtgacggcagaatggtggcagggaaggttctcatggcaaagcaggagattgtggaatgcgtggcctctgccgctatgattagcccaggaaagctgcccggtgaaacccattcccagcgtatagccgaagaagccctcggaggccttgataatagcaaaaagcaaaagggcaacgctgctggcaataaaattagtcagctccctagccaagatagacattttagcctggcaacattcaatcgtcggatccccactgagcattctgttctcgaatcccacgaatccgagggatccttcagcatgaacagcaatgacataacgcagcagtcagtcgacacaagggagaagttgtacgaatgcttcgactgcgggaaagcgttttgtcaaagttcaaagctcatacgacaccagagaatccacactggagagaggccctacgcctgtaaggagtgtggaaaggcattttcactatctagcgatcttgtccggcatcagcggatccactcaggtgaaaaaccatatgaatgttgtgaatgcggaaaggcttttagagggagttctgagttgatccgccacagacgtatacacacaggcgagaagccgtatgaatgtggtgaatgcggcaaggcatttagccgctctagtgccctgattcagcacaagaagattcatacgggcgacaagagctatgagtgtatcgcgtgtggcaaggccttcggccgctcatcaatcttaatcgagcaccagcgaatacacacaggcgaaaaaccttacgagtgcaacgaatgcgggaaatcttttaatcagtcaagtgcgcttactcagcatcaaaggatccatactggtgagaaaccctacgaatgctcagagtgtcggaaaactttccgtcataggagcggtttgatgcaacatcagaggacacacactagagtatag

SEQ ID NO: 21274 - DNA, 1284 bp, Artificial Sequence
  Description of Artificial Sequence: Synthetic coding sequence
caggaggtgttccggcagaagttccggcagttcagctacagcgactcaaccggaccgcgggaggccttgtcccggctgcgggagctatgttgccagtggcttcggcctgaagtgcacagcaaagagcaaatcttggaactcttgatgctggagcagttcctggccatcttgccagaagagcttcaggcctggctcagggaacaccggcctgagaacggcgaggaggccgtaaccatgttagaagaactcgagaaggagctggaggagcctcgccagcaggtgagaagcaagcatttcttctgcgtgcccgcaactactgtctcctcggtaatgggaagcaagatcctgacactgtccatccacatttttcgctggcaggacggcgggtggcagtctgtggacgggaaagctcggaattcatccgctgcaatgatttccccaggcaagctccccggtgaaacccactcccagaggattgccgaagaagctctgggtggcttagataattcgaaaaaacagaagggaaatgcagctggtaacaaaatctcccagctgcccagccaagatcggcatttctccctcgctactttcaatcgccgtattcctacagaacactcagttctggaatcgcatgagtctgagggctccttttcgatgaactcgaacgatattactcagcagtccgtcgataccagagagaagctgtatgaatgcttcgactgcggcaaggccttctgtcaaagcagcaaactgatcaggcaccagcgtattcatacaggggaacgcccctatgcgtgcaaggagtgtgggaaggcattttctctctccagcgatttagtcagacatcagaggatccacagcggggaaaaaccctatgaatgttgcgagtgcggtaaagctttccggggctctagtgagcttatacggcatcggaggatccatactggcgagaagccttacgagtgcggggagtgcggcaaggccttcagcagatctagcgctctcatacagcacaagaagatccacaccggggacaaaagttatgagtgtattgcctgtggaaaggcctttggcagatcttctatactgatcgaacaccagaggatccataccggcgagaagccgtacgaatgcaacgagtgtggaaaatcattcaatcaaagttccgccttgacccagcatcagcgcattcatacgggcgaaaaaccttatgagtgcagcgagtgccgaaaaaccttcaggcaccggtccgggctgatgcaacaccaacgaacccatacatag

SEQ ID NO: 21275 - DNA, 666 bp, Artificial Sequence
  Description of Artificial Sequence: Synthetic coding sequence
atgagcggcgaggccaccgtgctggcctaccacgcccccgaggagcaggaggggctcctggtagtgaaggtggaagaagaaaactacgttctagaccaggactttggtctgcaggaaaatccttggagtcaagaagtctttagacagaaatttaggcagtttagttactcagacagtaccggaccgagggaagccctgagtcggttacgagaactgtgttgtcaatggctacggcccgaggtgcattcaaaggagcaaattttggaactcctgatgctcgagcagttcttggcaatactgccggaagaactgcaagcctggctgcgcgagcataggccggagaacggggaggaagcggtgacgatgctggaggaattggaaaaggaactcgaagagcccagacagcaggacactactcatggtcaggaaatgttttggcaggaaatgacctccacaggcgctctgaagagcctctctttaaatagtccagtgcaacctctggaaaatcagtgcaaaacagaaactcaggaatcacaggcctttcaagagagggatggggtgtctctgtaccatccaggatggtctgcagtggtgcagccccagttgaccgcagccgccctgaacccatgggtgaaggttatcctgctacctcagcccccagagtag

SEQ ID NO: 21276 - DNA, 1485 bp, Artificial Sequence
  Description of Artificial Sequence: Synthetic coding sequence
atgagcggcgaggccaccgtgctggcctaccacgcccccgaggagcaggagggtctgctcgttgtgaaagtcgaggaagaaaattacgttttagaccaggattttggcctccaggaaaatccctggtcacaggaggtgttcaggcagaagttccgacagtttagctactccgacagcacaggaccacgagaagcactgagtcggctgagggaactgtgttgtcaatggcttcggccggaagtgcatagcaaagagcaaattctagaacttttgatgcttgagcagttcttggccattttacccgaagagcttcaggcctggttgcgcgaacatagacctgagaatggtgaggaagcagtgaccatgttagaagagctggaaaaggaactggaggaacccagacagcaggacaccacacatggacaggaaatgttttggcaggaaatgacaagcactggggccctgaagagcttgtctcttaacagccctgtacagccactggaaaatcagtgcaagactgaaactcaggagtcacaggcttttcaggaacgtgacggccgtatggttgccggcaaagttctgatggccaaacaagagattgtcgagtgtgttgcgtctgcggctatgatttcccctggcaagcttccaggagaaactcacagtcagagaatagccgaggaggcactcggggggttggataattccaagaagcaaaagggcaatgcagccggcaacaagatttcccagttaccatcccaggaccgacatttcagcctggctacgtttaaccgcagaatacctacagaacactccgttttagagtcccacgagagtgaagggtcatttagtatgaactccaatgatataactcaacaatcagtggacacaagggagaagttgtacgagtgttttgattgcggaaaggctttctgtcagtcaagcaaattgatccggcatcaacgaatccatactggagagagaccgtatgcttgcaaggagtgtggcaaggcattttccttaagttccgatctcgtgcggcaccagcggatccactctggcgagaagccatacgaatgctgcgagtgcggaaaggcattccgcggcagctcagagctgatccgccacaggcggatccacacaggcgaaaaaccgtacgaatgtggtgaatgtggcaaggcattctcgaggagtagcgccctgattcagcataagaaaattcatactggagataaatcgtacgagtgcattgcatgcggtaaggctttcggccgaagttcaattttaattgagcatcagaggatccatacaggagagaaaccgtatgagtgtaacgagtgtggaaagagctttaaccagagttccgccctgacacagcaccagcgcatacatacaggagaaaaaccgtatgaatgctctgaatgtaggaagaccttccgacatcggtccgggctgatgcaacatcagagaacccatacgcgtgtttag

SEQ ID NO: 21277 - DNA, 1140 bp, Artificial Sequence
  Description of Artificial Sequence: Synthetic coding sequence
atgatcgtgcggcccccccagccccgggagaccagcgtggtgacctttcatggaaaagaatatattgtgcaggatagtgacatagaaatggctgaagcaccaagctctgtgcgggacgatctgaaggacgtatcaagtcaaagggcatcaagcgtgaaccagatgcgacctggagaaggacaagcacatcgggagctccagatcctgccccgcgtgcctgccctgagccgtcggcaaggagaagacttccttcttcataagagtatagatgtaaccggagaccccaagagcttaagacctaagcagacactggaaaaagatctcaaggagaatcgagaggagaatcccgggctgacttctcccgaacctcagctacccaaaagcccaactgacctggtaagagccaaggaaggcaaagacccaccaaagatcgcaagcgtagagaatgttgacgctgacacaccttctgcctgcgttgtagagcgggaagccagcactcactccggcaacagaggcgatgctctgaatttgagctctcctaaaaggtccaaacccgatgcaagttctatcagtcaggaagaacctcaaggcgaagccacccccgtgggcaatagggagagtcctggccaggcagggatgaacagcatccacagtccaggaccagcctcaccagtctcgcaccctgacggccaagaggctaaggctctgcctccttttgcatgcgacgtgtgcgagaagaggttcacctgtaattccaagctggtgattcataaaaggagccacacaggtgagcgccttttccagtgtaacctctgtggcaagagattcatgcagctcatttcattgcagtttcaccagcggacacatacgggcgagaggccatacacttgcgacgtgtgccagaagcagttcacgcagaaatcttacctaaagtgccacaaacgcagccacacaggcgagaagccatttgagtgcaaggattgtaagaaggtttttacttatcggggaagtcttaaagagcaccagaggattcatagtggagaaaagccctacaaatgttcgaagtgcccccgcgcttttagcaggcttaagctgctgcgaaggcaccagaagacccatcccgaggcaacttctcagtag

SEQ ID NO: 21278 - DNA, 1491 bp, Artificial Sequence
  Description of Artificial Sequence: Synthetic coding sequence
atggccgccaactgcaccagcagctggagcctgggcgagagctgcaatagacctggactggagctgcctcggtccatggcaagttctgaaacacagctgggaaatcatgacgtggatcccgaaattagccacgtgaatttccgcatgtttagctgtccaaaagaatccgaccctattcaagcactgcggaaactcactgaactctgtcatctttggctgcgacctgacttacataccaaagagcagatactcgacatgttagtaatggagcagttcatgatcagcatgccgcaggaattacaggtgctagttatgatgaacggagttcagtcatgtaaggatctggaggatctcttaagaaataataggcgtccaaagaagtggtctgtggtgacgttccatgggaaggaatatattgtccaggactcggatatcgagatggctgaggcgccatctagcgtcagggacgacctgaaagacgtctcatcccagagagcatcttccgtaaatcagatgcggcccggagaaggccaggcacacagggagctacaaattctccctcgggtccccgccctgtcccgcaggcagggagaagattttctgctccacaaaagcatcgatgtgacgggtgatccgaagtccctgaggcccaagcagacgctcgagaaggatctgaaggagaatagagaggagaatccaggcctgacttcacctgaaccccaactgcccaaatccccgacagatctggtccgggccaaagagggtaaagacccacctaaaattgcctctgtggagaacgtagacgcagatacccccagcgcatgtgtggtggagagagaggctagcacgcacagtggaaatcgaggcgacgcgttaaacctcagcagccccaagagatctaagccggacgccagctccatctcacaagaggagccacagggcgaggccacccctgtcggcaacagggagtccccaggtcaggctggtatgaatagcatccactcccctggcccagctagccccgtctcccaccccgacggccaggaggccaaggcacttcctccttttgcatgcgatgtgtgtgaaaaacgctttacctgtaactctaagctcgtgatccacaagagatcacacacaggcgagcgtctattccagtgcaacctttgcggaaagaggttcatgcagttgatcagtttacagtttcaccagaggacccacacaggagaacgcccttacacctgcgatgtctgccagaagcagttcacacagaagagttatcttaaatgccacaaacggtcgcacacgggagaaaagcccttcgaatgtaaagactgcaagaaggtgttcacttacagaggaagcctgaaggagcaccagagaatccattccggcgagaagccttacaaatgtagtaagtgtcctagagcttttagtaggctaaagttgcttcggaggcaccagaaaacacatcccgaggcgactagccaatag

SEQ ID NO: 21279 - DNA, 2274 bp, Artificial Sequence
  Description of Artificial Sequence: Synthetic coding sequence
atggacgtggccgagagccccgagcgggacccccacagccccgaggacgaggagcaacctcaaggtctgagcgatgacgatatcctgcgagatagcgggtccgaccaggatttggacggcgcgggcgtgcgcgccagcgatctggaagatgaggaaagtgccgcaagggggccctctcaagaagaggaagacaaccactctgatgaggaagatagagcgtccgaaccaaaaagtcaagatcaggatagcgaggtgaatgagttgagcaggggacctacttcatcaccatgtgaggaggagggagatgaaggcgaagaagaccgaacctcagacctgcgcgacgaagccagttcggtgacgagagaattagacgagcacgagctggattacgatgaggaggtgccagaggaacccgcgccagcagtacaggaggacgaggccgaaaaggctggcgctgaagacgacgaggagaaaggggagggaacccctagagaagagggcaaggccggggtgcagtctgtgggtgagaaggagtccctggaagccgcgaaggaaaaaaagaaggaggatgatgacggcgagatcgatgacggagagatcgacgatgacgatctggaggagggtgaggtgaaggatccttcagaccgaaaggtccgccctcgcccaacatgtaggttttttatgaaggatgtcgttacaccactatccaccttactgccacccattagcaactctatacccttccgcggccaggtcaaaggcaactgcacctggggaatgaattgcagatttattcacccaggcgtgaatgacaaaggaaattactcactcatcactaaagcagaccccttccccccaaatggcgctcctcctctggggccccaccctttaatgcccgccaacccttggggcggaccagtggtcgacgaaattttgccccctccccctccggagccgccaactgaatctgcttgggaacgcggccttaggcatgccaaggaggtgctgaaaaaagcaaccatccgcaaggagcaagagcctgatttcgaggagaaacggttcaccgtgaccatcggtgaggacgaacgagaattcgacaaagagaatgaagtgtttcgtgattggaactccagaatcccaagagacgtgcgagatacagttctcgagccttacgctgacccatactatgactatgagatcgagagattttggcgcggcggacaatacgagaactttagggtacaatacacagagaccgaaccctaccacaactaccgagagcgggagagggagagagagcgcgagcgggaccgtgaccgcgagaaggagagagagaaagagaagggaaagcccaagcctcgcagcccgcagcccccatcgcgccaggctgaacctcccaagaaggaagcggctaccacaggcccgcaggttaagagggctgacgagtggaaagacccgtggaggagaagcaagagtccaaagaaaaagctgggggtgtctgtgtccccctccagggcccgccgacgcagaaagacctctgctagttctgcctcagcttcaaacagctcccgctcatcatctcgctctagtagctactcagggagtggaagttcccggtcccgaagccggtcctcttcctacagctcatattcttctagaagtagtaggcacagcagtttctccggctcccgaagtagatcacgctccttctctagtagcccgagtcccagtcctactccttctcctcaccgaccatccatacggactaaaggagaacctgcccctccacctggcaaggctggcgaaaaatccgttaaaaagccagccccccctcctgccccaccgcaggcaactaagaccactgcaccagttccagagcccactaaaccaggagaccctcgggaagcaaggcgcaaggagcgaccagcaagaaccccaccccgcaggaggttaatcaaagaagctgggagcgctatgaaccaccagacacgaactggcagagccttgttgcagcccagtggccctacccacccccagaccgaagtcctgggtacgggttcccaggtcggcgactgggccccgaggagccagtccggacgggaagccagaactcccaagcccctgcagcccagactgactgggtctgcgtcttgccaccctagcccccgcgccccagcaaggtctagagcctgtcccgccaagccacgtatccccgctcccccagctccgaaccagggtagaccggccagatgcctggggggtcggtcctgctag

SEQ ID NO: 21280 - DNA, 2862 bp, Artificial Sequence
  Description of Artificial Sequence: Synthetic coding sequence
atggacgtggccgagagccccgagcgggacccccacagccccgaggatgaagaacagcctcaaggtctgagtgatgatgacattcttagggacagcgggtcggatcaggatctggacggggcgggggtgcgggctagcgatcttgaggacgaggagtctgccgcgcgcggaccaagtcaggaggaggaagacaaccactcggatgaagaagatagggccagcgagcccaagtctcaggatcaagacagcgaagttaatgagctgtccagaggtcctacctcctcgccttgcgaagaagagggagatgaaggagaagaagaccgcacctctgaccttcgggatgaggccagttcagtaaccagagagttggacgaacacgagctggattatgacgaggaagtgccagaggagcctgcacctgccgtacaagaggatgaggccgaaaaggctggagctgaggatgacgaggagaaaggcgaaggaacccccagagaggagggcaaagcaggcgtccagtcagttggggagaaggaatccctggaagcagccaaagaaaagaaaaaagaggacgacgacggagagatagacgatggggaaatcgacgacgacgacctggaagagggcgaggtgaaagatcccagtgatcgcaaagtgcgccccagaccaacctgtaggttttttatgaagggcaattgtacttggggcatgaactgccggtttatacaccccggcgtcaacgataaagggaactattctctgatcactaaggctgacccattccctccaaacggcgcaccccctctggggccccaccccctgatgccagcgaatccatggggagggccagttgtagacgagatacttccgccccctcctccagagcctcctacagagagcgcatgggagcgcggcctgaggcatgccaaagaagttcttaaaaaggctacaatccgtaaagaacaggagccagactttgaagagaaaagatttacagtcaccattggtgaggacgaaagagaatttgataaggaaaatgaagtcttcagggattggaattcccgcattcctcgggacgtgagagacacagtgctcgaaccttacgctgacccctactacgactatgagattgaacgcttctggcggggcggccaatacgagaacttcagagttcagtacacagagaccgaaccctaccacaattatagggaacgggagcgggagcgcgaacgggagaatcgacagagggagcgggaacgggagagggagagggatcgcgagcgggagcgaagacagagggagcgggaaagggagcgggaacgcgagcgtgacaaagagcgccagcggagaaaagaagagtgggaaagggagcgggccaagagagatgagaaggaccgccagcatagggaccgggatcgtgagaaagaaagggagaaagagaaaggcaagcctaagccgcggtcccctcagcccccatcaagacaggccgagccccctaaaaaggaagctgcgacaacggggccccaggtgaagcgcgctgacgagtggaaggatccgtggaggcgatctaaatctcccaagaaaaagttaggtgtgagcgtgtcaccaagccgggcccgccgccggcggaaaacaagtgcgtcgtcagcaagcgccagtaactctagtagatcttcttctagaagttctagttatagcggttcaggatcatctaggtcacgctcacgtagctcatcatattcatcttactctagccgaagttcaagacatagcagctttagcggaagccgctcacgaagccgctcattctcatccagcccttccccgagccctacacctagcccgcatagaccatcaatccgaactaaaggggaaccagcaccaccgccaggaaaagccggcgaaaaatctgtaaagaagcccgctcctccacccgcccccccccaggctactaagaccaccgcacctgtgcctgaacccacgaagcccggtgacccccgcgaggctcggcgaaaggaacgccctgcgagaaccccaccacgacgccgaactcttagtggctccggctctgggagcggcagctcctattccggctcttcatctagatccaggtccctgtctgtctcatccgtgtccagtgttagtagcgctacaagcagctccagctcagcccattccgtagacagcgaggatatgtacgctgatttggcgtctcccgtctcatctgctagtagtcgatctccggcccctgcccaaacgagaaaggagaagggcaaatctaaaaaagaagatggagtcaaggaagaaaagaggaagcgcgatagttccacacagcctcccaaatcagcaaaaccaccagcaggtggcaaatcgagccagcagccatcaaccccccagcaagccccacccggacagccgcaacaggggaccttcgtggcccacaaagaaattaagcttaccctgcttaataaggctgctgacaaggggagcagaaagcgctatgagccttctgacaaggaccgacagagcccccctcccgcaaagaggcccaacacttccccagatcgaggcagtcgggatcgcaaatctgggggacggctcgggagccctaaacctgagcgccagaggggccagaatagtaaagctccagcagctcccgctgaccgcaaacgccagctctccccccagtctaagagctcgagtaaggtcaccagcgttcctggtaaagcctcagatcctggggcagcatcaaccaaaagtggaaaggccagcaccctttccagaagagaggagttgctcaaacagcttaaggctgtcgaggacgcgatcgcccggaaacgggcgaagatccctggaaaagcttag

SEQ ID NO: 21281 - DNA, 2934 bp, Artificial Sequence
  Description of Artificial Sequence: Synthetic coding sequence
atggacgtggccgagagccccgagcgggacccccacagccccgaggacgaggagcagccgcagggactgagcgatgacgatatcctgagggattcgggaagcgatcaggatctcgatggagccggtgtgcgcgcaagcgacctcgaagatgaagaatcagcagcccgtggtcctagtcaggaggaggaggataaccattccgacgaggaagacagagcctcggagcctaagagccaggaccaggacagcgaggttaacgagctgagccgaggacccacgagctctccttgtgaggaagagggcgacgagggggaggaagatagaacctccgacttaagagacgaagcatccagtgtaacccgggaactggatgagcatgagctcgactacgacgaagaggtgcccgaggagcccgctcccgccgtgcaagaggatgaggcagaaaaagccggcgctgaagacgacgaggagaagggcgagggaactccaagagaggaaggcaaagccggcgtgcagtctgtgggtgaaaaggagagtcttgaggctgccaaggagaagaaaaaagaggatgatgacggcgagatcgacgacggggagatcgatgacgacgaccttgaagaaggagaagtgaaggatccctctgaccgtaaggtacggcccaggcctacttgtcgattttttatgaaagatgtggttactccccttagtaccctgttgccaccaatttccaattccatacctttccggggacaggtcaagggcaattgtacctggggtatgaattgcaggttcatccaccccggcgtcaacgacaagggcaattatagcttgattaccaaggccgatccattccctcctaatggagccccaccactcgggccacaccctttaatgcctgcaaatccctgggggggccccgtcgtggatgaaattctgcctccgcctccccccgagcctcctaccgagtctgcctgggaacgggggttgagacatgccaaggaagtgctcaaaaaagcgactatccggaaggaacaggagcctgactttgaggaaaagcgtttcaccgtaaccattggcgaagacgagcgcgagtttgacaaagaaaatgaagtattccgtgattggaatagtaggattcctcgggatgtgagggacaccgtgctggagccttacgccgatccttattatgactacgagattgaaaggttctggagaggaggacagtacgagaatttccgtgtccagtataccgagaccgagccctaccataactatagggaacgagagagagagagagagcgcgagaatcgacaacgagaacgggagcgcgaacgtgagagggatagagaacgtgagcgtaggcagagagagagggagagagagcgcgagagggaacgggacaaagagagacagagaagaaaggaggagtgggagagggagagggccaagagagatgaaaaggaccgacaacaccgggatcgggacagagagaaggaaagagaaaaagagaaaggtaagcccaaaccccggtccccgcagccgccttcacgacaagcagagccaccgaaaaaggaagcagccacaaccggcccacaggtcaagagggccgacgaatggaaggatccctggcgcaggtccaaaagccctaagaagaagttgggggtctcagtatccccttctagagctagacgcaggaggaaaacctcagcttcctctgccagtgcttcaaacagcagccgtagctcttcccgctccagcagttacagcggctctggctcttcaaggagcaggtcaaggagttcttcatacagctcatacagctcgagaagtagcagacactcttcgttctccgggtccagatcccgctcccgcagtttctcttccagtccatctccatctcctacaccatccccacataggcccagcatcaggacgaagggtgaaccagctcccccgcccggtaaggccggtgagaagtctgtgaagaaacccgcacctccgcccgcccctccacaggccacgaaaaccacagcaccagttcccgagcccacgaagccgggtgacccaagggaagcaagacgcaaagagaggccggcgcggactccacccaggcgtcggaccctgtcaggaagcggttctgggagtggctcctcatactcaggcagctcctcccggagtcggtctctgtctgtctcctctgtgtccagcgtttccagtgcaacatcatcctccagtagcgcccactcagttgacagcgaggatatgtacgccgatctggcttctccagtgtcctccgcttcctcccggagtccagcacctgctcagacacgtaaggagaaaggcaagagcaagaaggaggacggggtgaaggaggagaaaaggaagagggactctagtacacagccgcccaagagcgcaaagccacctgccgggggcaaatcaagccaacagccatctactccccagcaggctccccctggccaaccacagcagggaacattcgtcgcccacaaggagattaaacttactttgcttaataaagcagcagataaggggtcgcgcaagcggtacgagccatcggacaaagacagacaatctccgccccccgcgaaaaggcctaacaccagccccgaccgtggatccagggatcggaagagcggtggcagactcggttccccgaagccagaaaggcaaaggggacagaatagcaaggcccccgcggccccagcagacagaaagcggcagttatccccccagtcaaagagctcgagtaaggtgacgtccgttccaggcaaggccagcgatccaggggcagcttccacgaagagcgggaaggcgagcacactttcacgccgtgaagaactgcttaaacagctcaaagccgtggaagatgctatcgctcggaagagagccaagattcctggaaaggcctag

SEQ ID NO: 21282 - DNA, 999 bp, Artificial Sequence
  Description of Artificial Sequence: Synthetic coding sequence
atggacgtggccgagagccccgagcgggacccccacagccccgaggacgaagagcagccacaggggctgagcgacgatgatatcctgcgcgactctggcagtgaccaagatctcgatggagccggagtcagggctagcgaccttgaggatgaagaatcagccgcccggggcccatctcaagaggaagaggataaccactccgatgaggaggaccgggctagcgaacccaagtcccaggaccaggattctgaggatgacgacctcgaagaaggtgaagtcaaagatccctcagatcggaaggtcaggcccaggcccacctgtaggtttttcatgaagggaaactgcacctggggaatgaactgtcgtttcatacatcccggcgtgaacgacaaaggaaactatagtctcatcacgaaagctgacccattccctccaaacggggcaccacccctggggcctcatccactgatgcctgccaatccctggggcggccccgtggttgacgagatcctgccgcctccacccccggaaccacccactgaatcggcttgggagagaggtcttcgtcatgctaaggaggtactgaaaaaagccaccatacgcaaggagcaggagccagactttgaggagaagaggtttactgtgacgattggagaagacgaaagagagttcgataaggaaaacgaggtctttagggactggaattcccgcattccccgcgacgtacgcgatactgtacttgagccttatgccgatccatactacgattacgaaatagaacgcttttggagagggggacagtacgagaattttcgagtccagtacaccgaaacagaaccatatcacaactaccgggagagggagagggagcgagagcgagagaatagacagcgtgagagagacaaggaaagacaacggcgcaaggaggaatgggaaagggaaagagccgctaagctatcccaccagagacggcgactgcctcccaggggcaggagatag

SEQ ID NO: 21283 - DNA, 2847 bp, Artificial Sequence
  Description of Artificial Sequence: Synthetic coding sequence
atggaggagaaggagatcctgcggcggcagatccggctgctgcagggactgatcgacgactataaaaccctgcacggtaatgccccagccccaggtactcccgctgccagtggatggcagcctcccacgtatcacagtggcagggcgttttcagcccggtatccgcgcccaagcaggagaggttatagttctcatcacggccccagctggaggaaaaagtactctctagtcaatagaccaccgggaccatctgatccaccagcagaccatgcagtgcgacccctgcatggagctagagggggtcagccaccggtccctcagcagcacgtcctagaacgacaggtacaactgagccaaggtcagaatgtggtgatcaaggtgaagccaccatctaaatcgggctcggcatctgcaagtggggcacaaaggggaagcctcgaagagttcgaggaaacgccttggtccgaccagcgccctcgcgagggcgagggcgagcctcccaggggtcagctgcagccctctcggccaactcgggctagggggacatgttccgtcgaggacccactgctggtgtgccagaaggaacccgggaagcctaggatggtcaaatcagtcggctccgtgggggacagtccccgggagccccgaaggacagtgtccgaatccgtcatagccgtgaaggcctcttttccttcatctgcactgccccctagaacaggagtggcgctcggcaggaagttaggctcccactcagtggcatcatgtgcaccccagctgttgggcgaccggagagtggatgcgggccatacagaccagccagtgccaagtggatctgtgggaggcccagcgcgtcccgcctctggaccaagacaagctagggaggcctccctggtggtcacctgccgtacaaataaatttcgcaagaacaactacaagtgggttgccgcgtccagcaagtctcccagagtcgcccgcagggcattatcaccacgggtggctgcagaaaacgtatgcaaagccagtgccgggatggccaataaagtggagaaacctcagctgattgccgacccggaacccaagcctcgtaaaccggccacctcgtctaagcccggatccgcaccttccaagtacaagtggaaggcctcatctcctagcgcatcttcctcatccagctttcgctggcagagtgaagcctcatctaaggaccacgcctcacagctctcccctgtgctctcgaggtcccccagtggagatagaccggcagtcggccatagcggattgaaacccttaagcggtgaaactcctttgtcagcctataaggtcaagtctagaaccaagattattcgacgccgatccagtactagcctgcccggcgataagaagtccggcaccagcccggccgctacagctaaaagtcacctgtctctaaggaggagacaggcattacggggcaaaagtagccctgtcctgaaaaaaacacctaataaagggctcgtccaggtgaccacacacaggctctgcagactgccaccttccagagcccatctgccaacaaaagaggcctcttccctacacgcggtacggacagcccccacatcaaaagtaatcaagactagatatagaatagtgaaaaagacacctgcgtctccgcttagcgctcccccattcccactctccttgccaagctggagagcccggcggctgtcattaagtcggtcattggtgctgaacagactacggcccgtcgccagcggcggcgggaaggcacagccgggctccccctggtggagatctaagggctacaggtgcattggaggtgtgctgtacaaagtgagtgcgaataaactgagtaaaactagcggtcagcccagcgacgcagggtccaggcctctgttgagaacggggagattggaccctgctgggtcttgtagccggtctcttgcgtcaagagcagtgcagcgctccttagccattattcgccaggctcgtcagaggcgagagaaacgcaaagaatactgtatgtactataaccgattcggacgctgtaaccggggcgaacggtgcccatacatccatgaccccgagaaggttgcagtctgtacccgctttgttaggggaacatgtaagaaaacagatgggacttgccccttttcacatcacgtctctaaggagaagatgcctgtctgttcctatttcctcaaggggatttgcagtaatagtaattgcccatacagtcacgtctacgtgtctcgaaaggcagaggtgtgtagcgacttcctcaagggctactgcccgctcggggctaagtgtaagaaaaagcatacgctgctgtgccctgacttcgccaggcgcggagcttgtccccgcggagcacagtgccagttactgcaccgaactcaaaaacggcattccagaagggctgctacttctccggcacctggtccctcggatgctacggcaaggtctagagtgtccgcatcccacggcccccgaaagccgagtgcttctcagaggcctaccagacagacacccagctctgccgcccttaccgctgctgccgtggctgccccgccacactgtccgggaggtagtgccagcccttccagttctaaggcgagttcttcttcctcatcctcctcgtcgccacctgcgtctcttgaccatgaggctccaagcctccaggaggccgccctggctgccgcttgtagcaacagactttgcaagcttcctagtttcatatccctgcagagcagcccgtcccccggggcacagcctagagtgagggctccgcgcgctccactaactaaagatagtggcaagcccttgcacatcaaacccagactatag

SEQ ID NO: 21284 - DNA, 2916 bp, Artificial Sequence
  Description of Artificial Sequence: Synthetic coding sequence
atgagcaacgtgagcgaggagcggcggaagcggcagcagaacatcaaagagggtctccagtttatccagtcacccctgagttatccggggactcaggaacaatacgcagtgtaccttcgtgctttggtcaggaatctcttcaacgagggcaacgacgtgtatcgagaacacgactggaataattcgattagtcaatatactgaggcactcaatatcgccgattacgcgaagtctgaggaaatcttgatacctaaggagataatcgaaaaactgtacattaatcgcatagcctgctacagcaacatgggattccacgacaaagtacttgaagactgcaacatcgtcctgtcactcaatgcctctaactgtaaggccttgtaccggaaaagcaaagcactgtccgatctcgggcgctataagaaggcctacgatgccgttgctaagtgttccttggctgtgcctcaggatgagcatgtgattaaattaacacaggagctggcccagaagcttggattcaagatccgcaaggcttacgtaagagcagagctgtctctcaagtccgtgcccggagatggggcaacaaaagcacttaaccactccgtagaggacatagagcctgacctgctgacacccagacaggaggccgtgcccgttgttagcttaccagccccgtcattttcccatgaagtgggaagcgagctcgcctctgtgcctgtcatgcccctaacatctatcctgcccctccaggttgaagagtccgctttgcccagtgcggtattagccaatggtggaaaaatgccttttacaatgcccgaggcgtttctcgacgatggggacatggttcttggcgacgagctggatgatctgcttgactcagcacctgaaaccaacgagactgtgatgccttcggcactggtccggggacctcttcagactgcttccgtatcaccaagcatgccttttagcgcctccctcctcggcacccttccaattggagctaggtacgctcctcccccctccttctcagagttctacccgccattaacgtcttccttggaagacttctgcagctccctcaattccttctccatgagtgagtccaagagggacttgtccacatctacttctagggagggtacaccccttaataattccaattcctcattattactcatgaatggcccggggagtctgtttgcatccgagaactttcttggtatctctagtcaaccgcgaaatgattttggaaacttctttggtagcgctgtcaccaagccttcctcttccgtaacacctcgtcatcccctggaaggcacacacgagctaaggcaggcctgtcagatctgcttcgtgaagtctggccctaaactcatggacttcacctaccacgcgaatatcgatcataagtgcaaaaaggacatcctgatcggccggattaagaatgtggaagacaagtcttggaagaagatccgcccacgtcccaccaaaaccaactacgaggggccctattacatctgtaaggatgtggcagctgaggaggagtgcaggtatagcggacactgcaccttcgcctattgccaggaggaaattgacgtatggactctggagagaaagggcgccttcagcagggaggcattcttcggcggcaatgggaagatcaatctcaccgtgtttaagctgcttcaagagcatctaggggagtttatctttctctgcgaaaaatgttttgatcataaacctcggatgatctcaaaacgaaataaggacaatagtacagcgtgcagccatcccgtaacaaagcacgagtttgaggacaataagtgtctggttcacatcctgagggagacgactgtaaagtattcgaagatccgttccttccatggccagtgccagcttgatctttgtaggcacgaagttaggtatgggtgccttagggaagacgagtgcttctacgcccattcgctggtggagctcaaggtatggattatgcagaatgagacagggatatctcatgacgccatcgcgcaggaaagtaagaggtactggcagaatctggaggcaaacgtgccaggcgcacaggtcctcggcaatcaaatcatgccgggattcttaaatatgaagatcaagtttgtttgcgcccagtgtctgcgcaatggccaagtgattgaacctgataaaaacagaaagtactgctctgcaaaggctaggcatagctggaccaaagataggcgggccatgcgggtgatgagcattgagaggaaaaagtggatgaacattcggccactgccaaccaaaaagcaaatgcccctgcagtttgacctgtgcaaccacatcgcatccggaaaaaagtgtcaatacgttgggaactgctccttcgcacatagtccagaagagcgcgaagtctggacctatatgaaagagaacggcatccaagatatggagcagttttatgagctgtggctgaagtcccagaagaatgaaaagagtgaggacatcgcgagccagagcaacaaagagaacgggaaacagatccacatgccaaccgattacgcagaagtgaccgtcgattttcactgctggatgtgcggaaaaaactgcaattccgaaaagcagtggcagggccacatatccagtgaaaagcacaaggaaaaggtattccataccgaagatgaccagtactgctggcagcatcggtttccaactggctacttcagtatatgtgatcggtacatgaatggcacctgccctgaggggaacagttgtaagttcgcccacggcaacgccgaattgcatgagtgggaggaacggcgcgatgctctgaaaatgaagctcaataaagcccggaaggaccacctaattggccctaacgacaacgacttcggcaagtatagttttttatttaaggacctcaactag

SEQ ID NO: 21285 - DNA, 2916 bp, Artificial Sequence
  Description of Artificial Sequence: Synthetic coding sequence
atgagcaacgtgagcgaggagcggcggaagcggcagcagaacatcaaggagggcttgcagtttatccagagcccactgagttatcccggaacccaggagcagtatgcagtttacctgagggcacttgtcagaaaccttttcaatgaaggcaatgacgtgtaccgagagcacgattggaataattcaatctctcaatatacagaggcgttaaacattgccgattatgcaaaatccgaagaaattttgattccaaaggagatcattgagaaattgtacatcaataggattgcctgctattcgaacatgggctttcatgataaagtgcttgaagactgtaatatagtgctgagcctgaatgcgagcaactgcaaggcactgtacagaaaatctaaggctctcagcgacttggggaggtataagaaagcatacgacgctgtagcgaaatgcagccttgctgtgccccaggacgagcatgttatcaagctgacacaagagctggcccagaagctggggttcaaaatcaggaaggcctatgtccgcgcggagttaagcctgaagtccgtgcctggcgatggagctactaaggcactgaaccactccgttgaggatatagagccagacctgcttacacctagacaggaggctgtgcctgttgtgtctttgccagctccgagcttcagccacgaagtgggttccgaactagcctccgtgccagtgatgcctctaactagtattctgccccttcaggtggaggagtccgccctgcccagtgcagtcttggctaatggcggcaagatgccttttactatgcctgaggccttcctggatgatggggacatggtcctgggagacgagctggatgatctgctggattcggcacctgagacaaatgagacggtgatgccaagcgcgctcgtgcgcggaccgttgcagaccgcttccgtttccccttcaatgcccttctccgcaagtctgctcggaaccctccccatcggcgcccggtacgccccaccccctagcttctctgaattctatccacctttgaccagctccctggaagatttttgctcctccctcaactcgttctcgatgtcagaatccaagcgggacctgtccacgtcgaccagccgggagggcacgccattaaataattcaaacagctcactactactaatgaacggaccggggtctctgttcgcctcagagaattttctggggatatcctctcagcccaggaatgactttgggaatttttttggcagtgctgtgactaaacccagctcatccgtgactcctagacaccccctcgaggggacccatgagctgagacaggcatgccagatctgttttgtgaaatcagggcctaagctgatggactttacctatcatgccaatatcgaccacaaatgtaaaaaagacatcctaattggacgaatcaaaaatgtggaggacaagtcatggaagaagattaggccgagaccgactaagacaaactacgaggggccgtactacatctgtaaggacgtggcagccgaggaggagtgcaggtacagtgggcattgcacgttcgcctattgccaggaagaaatcgacgtgtggaccttagaacgaaaaggggcctttagccgcgaggccttttttggggggaacggcaagatcaacctgaccgtcttcaaattgctgcaggagcacttgggggagtttatctttctctgtgaaaagtgcttcgaccacaagccccgcatgattagcaagcggaacaaggacaattcgaccgcgtgttcccatccagtcacaaaacatgaatttgaggacaacaagtgccttgtgcatatattgcgagaaactaccgttaagtactctaaaattcgatcctttcacggtcagtgccagttggacctctgcagacacgaagtacggtacggctgtttgagggaggacgaatgtttctatgctcatagcctcgtcgagctaaaggtgtggattatgcagaatgagacaggaatctcccatgacgcaatcgcccaggagagcaaacgttattggcagaacctcgaggctaatgtgcctggggctcaggtcctcggaaatcagattatgccagggtttctaaatatgaagattaagtttgtgtgcgcccagtgtctgagaaatgggcaagtgatcgaaccagataagaataggaaatattgttctgccaaggcccgtcatagctggactaaggacagacgagcaatgcgggtaatgtccatcgagcggaagaagtggatgaacatccgtccactcccgacaaaaaagcagatgcccttgcagtttgacctgtgcaatcacatagcatcaggcaaaaagtgccaatatgtgggaaattgctcatttgcccacagtcccgaggagcgcgaagtctggacctatatgaaagaaaatggcatccaggacatggaacaattttacgagctttggctaaaaagtcagaagaacgagaagtcggaggatatagcatcgcagtcaaataaagagaatggtaagcagatccacatgcctactgactatgcagaggttactgtagactttcactgctggatgtgtggtaaaaactgcaatagcgaaaagcagtggcagggccacataagcagtgaaaaacacaaggaaaaagtgtttcacacggaagacgaccagtattgctggcagcaccgattccctaccggttacttcagcatctgcgatcggtacatgaatggaacctgccctgaaggaaactcatgtaaattcgcccatgggaacgcggagctgcatgaatgggaagagcgaagggatgccctgaagatgaaacttaacaaggctagaaaggatcacttgatcgggcctaacgataacgatttcggcaagtatagttttctcttcaaagatctaaactag

SEQ ID NO: 21286 - DNA, 2934 bp, Artificial Sequence
  Description of Artificial Sequence: Synthetic coding sequence
atggagcggcagaagcggaaggccgacatcgagaagggcctgcagttcatacagagcacattaccgttgaaacaagaggaatatgaggccttcttactgaagctggtccagaatctttttgcagagggaaacgatcttttccgcgagaaagactacaagcaggccttagttcagtatatggagggcctgaatgtggccgattatgccgcctccgaccaggttgccctccctcgagagctgctgtgtaagctgcacgtgaaccgagcggcctgctacttcaccatgggactctatgaaaaggccttggaagattcagaaaaagcactgggccttgacagcgagagtattagagcgctcttcaggaaagctcgggctctgaatgaacttggccggcacaaagaggcctacgagtgttcttcccggtgttccttagctttgccccatgacgagtccgtgactcagttaggccaggagttggcgcagaaactcgggctcagagttagaaaggcctacaagcgtccacaggaactagaaacctttagcctactttccaacggaacagccgcaggggtcgctgatcagggaacttctaatggcctgggcagcatcgatgacatcgagactgactgctatgtcgacccgcgcgggtcaccagctttactcccatccacccccaccatgcccttgttcccccacgttttagatctgctcgcgcccctggacagctccagaacactccccagcaccgattctctggacgactttagtgacggcgacgtctttggacctgaactggatacccttctcgacagcctttcccttgtccaaggcggactaagtggcagcggggtcccctccgagctgccacagctgatccccgtgttcccgggtggcacgcctctgctgccaccggtggtcgggggctctattcccgtgtccagcccccttccccccgctagcttcggccttgtcatggatccttcaaaaaagctggctgcctccgttctcgatgcgctggacccacctggcccgacgctggaccctctcgatctcctcccatactctgagacaaggttggatgctttggactccttcggctcaacccgtggcagcttggacaaacctgatagctttatggaagaaactaattctcaggatcacagaccccccagtggggctcaaaaacccgcacccagcccagaaccttgtatgcctaataccgctctcctaataaagaacccactcgccgcgactcacgaattcaaacaggcctgccagctgtgttatccaaagacgggcccaagggctggggattacacttatcgggaagggttggaacataagtgtaaaagggacatcttactgggccgcctgcgctcctccgaggatcagacctggaaaaggatcagaccccggccgaccaaaacgagcttcgtgggcagctactatctttgtaaggacatgatcaataagcaggattgtaagtatggcgacaattgcacgtttgcttatcaccaagaggaaattgacgtctggaccgaggagcggaaagggaccctcaaccgcgacctcctgttcgatcccttgggtggggtcaagagaggaagcttgaccatagctaaactcctgaaagagcaccaagggatctttaccttcctgtgtgaaatttgcttcgactctaagccacgaatcatctctaagggaaccaaagattcgcccagcgtgtgtagtaatttggcagccaagcatagcttctataacaataagtgcctggtccacatcgtgaggtctaccagtcttaagtactcgaagatcagacaatttcaggagcattttcaattcgacgtgtgtcggcatgaagtcaggtacggttgcctgagagaagatagttgtcatttcgctcacagcttcattgagctgaaagtgtggctgttacagcagtactccggaatgacccacgaggacatagtgcaggaatccaagaagtactggcaacagatggaggcccacgctggcaaagcaagcagttcgatgggtgctccacggacgcatggaccatctacattcgatcttcagatgaagttcgtctgtgggcagtgctggcgtaacgggcaggttgtggagcctgataaggatttgaagtactgctccgccaaggctagacactgttggacaaaagaacggagggttctgctggttatgtccaaggcaaagagaaagtgggtatctgttagacctctcccatcgatccgtaacttccctcagcagtatgacctgtgtatccacgcccaaaatggtaggaaatgccagtatgtcggaaattgctccttcgctcactcaccggaggaacgagacatgtggacatttatgaaggaaaacaaaatcctggacatgcagcagacatacgatatgtggctgaaaaagcataatcctgggaaacccggagagggtacccccatctctagtcgggagggggaaaagcagattcagatgccaaccgactacgcagatattatgatggggtatcactgctggctgtgtggtaagaacagtaactctaagaagcagtggcagcaacacatccagtccgaaaaacataaagaaaaagtcttcaccagtgatagtgacgcatcgggatgggcgttcagatttcctatgggggaattcaggctttgcgaccgacttcagaaaggaaaagcctgccccgacggcgataaatgccgctgtgcacacggccaagaagagctgaacgagtggctggacaggcgggaggtgctgaagcaaaagctcgccaaagctcgaaaggatatgctgctgtgtccccgagacgacgattttggtaaatacaatttccttctgcaggaggatggtgacctggcgggtgccacccccgaagctcccgcggcggctgccaccgcaaccacgggcgagtag

SEQ ID NO: 21287 - DNA, 2934 bp, Artificial Sequence
  Description of Artificial Sequence: Synthetic coding sequence
atggagcggcagaagcggaaggccgacatcgagaagggcctgcagttcatccaatcaacgctacccctgaagcaggaagagtacgaggcattcttgctgaagctcgtccagaatctgttcgccgaaggcaacgatctgttcagagagaaggactataaacaagccttggtccaatacatggaggggctcaatgttgcagactacgctgcttcagatcaagttgcccttcctcgggagctcttgtgcaaattacacgtaaatagggctgcttgctacttcacaatggggctgtacgagaaggcactcgaggatagtgagaaagctctgggccttgacagcgaaagtattcgagctttatttcggaaggcacgggctctgaacgagctcgggcgccataaggaggcatacgagtgttccagtaggtgcagcctggctttaccacatgacgagtctgtcacgcagttgggccaggagctggcccagaagttagggcttcgcgtgcgtaaggcctacaaaaggccacaggagttagagacattctctctgctgtcgaacgggactgcagccggagtggctgatcaagggacatccaacgggctcggatccattgacgacattgaaaccgactgttacgtggacccaagaggaagccccgccctccttccctccacgcccacaatgcctctgttccctcacgtattagacctacttgctccccttgatagttcccgcactctgccctccaccgactccctcgacgatttcagcgatggggatgtctttggccctgaactggataccctgctcgacagcttgagcctggtacaggggggtctgagtgggagcggagtaccttctgagttgcctcagctgattccagtgttccccggcgggacccccctgttaccacctgtggtggggggaagcatacccgttagttctcctctgccgccggccagttttggccttgttatggacccaagcaagaaactggccgccagcgtgttagacgctctggatccccccggacccaccctcgaccctctggatttgttgccctattctgaaacccgccttgacgcgctggattcgtttgggtcaacgcgagggagtttagataaacctgacagcttcatggaagagacgaacagtcaggatcatcgccctccctcaggagcacaaaagccagccccatctccagaaccttgtatgcccaataccgctctcctgattaaaaaccccctcgccgctacacatgagtttaagcaggcctgtcaactgtgctaccccaaaacagggcccagggccggagactatacgtatagagaaggcctggaacacaagtgcaagagggatatcctcctgggacggctccgttcctcggaagatcagacatggaaacggattaggccccgaccaacgaagacttcatttgttggatcttactacctctgtaaagatatgatcaataaacaggactgtaaatatggagacaattgtactttcgcataccaccaggaagaaattgatgtgtggaccgaagagagaaagggaacgctgaatcgcgacctgttatttgatcctctcgggggagtgaaacgtggatcactgacaattgcaaagctgttgaaagagcaccagggaatattcacatttttgtgtgagatctgctttgacagcaaacctcgcataatttctaagggaacaaaagactctccctccgtttgctccaacctggccgccaagcactctttctataataacaaatgtttggttcacatcgtccgatccacttcattgaaatactccaagatcaggcagttccaggagcatttccagtttgatgtgtgccgtcacgaggtgcggtacgggtgcctcagagaggactcttgccactttgcccactccttcatcgaattgaaagtttggttactgcagcagtactccggcatgacacacgaggatatcgtgcaggagtctaaaaagtactggcagcagatggaagcgcacgctggcaaggcttctagcagtatgggcgctcccagaacacatggtccctctacctttgatctgcagatgaagttcgtctgcggtcaatgctggaggaatggacaggtggttgagcctgataaagatcttaagtactgcagcgcgaaagcccggcactgttggaccaaagagcgtagagtgctgctcgtcatgtctaaggctaagcgcaaatgggtgtctgttcgcccattgccaagcattaggaatttcccgcagcagtatgacctgtgcatccatgcgcagaatggccgcaaatgtcagtacgttggcaactgcagcttcgcccattcacccgaggagagggacatgtggacattcatgaaggagaataaaatcctagacatgcaacagacgtatgatatgtggctgaagaagcataatccaggaaagccaggcgagggaacgcctatctctagccgggagggagagaaacagattcagatgcctacggactatgccgacatcatgatgggataccactgctggctgtgtgggaaaaacagcaacagcaagaagcagtggcagcagcacatccagagcgagaagcacaaagaaaaagtttttaccagcgactcagacgcatctgggtgggcctttagatttcccatgggtgagtttaggctctgcgatcgcttacagaaaggaaaagcgtgtcccgacggagacaagtgtcgttgcgctcatggacaagaagagctgaacgaatggcttgaccgaagagaagtccttaagcaaaagcttgccaaggcaaggaaagatatgctgttatgcccgcgggatgatgatttcggcaagtacaatttcctactgcaggaggatggtgacctagcaggcgctacccccgaggcccccgcggcggcagctaccgcaactactggcgagtag

SEQ ID NO: 21288 - DNA, 876 bp, Artificial Sequence
  Description of Artificial Sequence: Synthetic coding sequence
atggacttcgagaacctgttcagcaagccccccaaccccgccctgggtaaaaccgctaccgactccgacgagcggattgacgacgaaattgatactgaagtcgaggaaacccaggaagagaaaattaaactggagtgcgaacagattcctaaaaagtttcggcactccgctatttcacccaaatccagcctacacaggaagagccgatccaaggattatgatgtgtatagcgacaatgatatatgtagccaggaaagcgaagacaacttcgccaaagaacttcagcagtacatccaggctagagagatggccaatgcagcacagcccgaggaaagtacaaaaaaagagggtgtgaaagacactccgcaagcagccaaacaaaaaaacaagaatctcaaggctggccataaaaatggtaagcagaagaaaatgaaacggaaatggcccggaccaggaaacaaagggtctaatgcactgctcagaaactcaggctcccaggaagaagatgggaagccaaaggaaaagcagcagcacctgtctcaggctttcatcaaccagcataccgtggagagaaaaggtaaacagatttgcaaatatttcttggaaagaaaatgcataaaaggggatcaatgcaagtttgaccatgacgcagagatcgagaagaagaaggaaatgtgcaagttctatgtccaagggtactgcacccgcggcgagaattgcctttacctgcataacgagtacccttgtaagttctaccacaccggtactaaatgctaccaaggtgagtactgcaaattctctcatgctccgttaaccccagaaacacaggagctgctggctaaggtcctggacactgaaaagaagtcttgcaaatag

SEQ ID NO: 21289 - DNA, 876 bp, Artificial Sequence
  Description of Artificial Sequence: Synthetic coding sequence
atggacttcgagaacctgttcagcaagccccccaaccccgccctgggcaagacggctacggactctgatgagcggatcgatgatgagattgatacggaggtcgaggagacacaagaggagaaaatcaaattagagtgcgaacagatccccaaaaaattccgccattccgctattagtcccaaatcatcccttcatcgcaaatcccggagcaaagattacgatgtatactccgataatgacatctgttcacaggaaagtgaagataattttgctaaggaactgcaacagtatatacaggccagggagatggccaatgccgcccagcccgaggagtctacaaagaaggagggggtaaaagatacaccccaagccgcaaagcagaaaaataagaatctgaaggcagggcacaaaaacggtaaacagaaaaaaatgaaacggaagtggccgggacctggaaacaaggggtcgaacgccctcctccggaattccgggagccaggaggaagacggtaaacctaaagaaaagcagcaacacttgagtcaggcatttattaaccagcacacggtcgagagaaagggcaaacaaatctgcaagtattttctggagcggaagtgtattaagggggatcagtgcaagtttgaccacgacgctgaaatcgagaaaaagaaggaaatgtgcaagttctatgtgcagggttattgtactcgaggcgagaactgtttgtacctccacaatgagtacccgtgtaaattttatcataccggtacaaaatgttaccaaggcgagtattgcaagtttagtcacgccccactgacacccgaaacacaggaactgcttgcaaaggttctggacaccgagaaaaagagctgcaagtag

SEQ ID NO: 21290 - DNA, 846 bp, Artificial Sequence
  Description of Artificial Sequence: Synthetic coding sequence
atggccgaggccgcccccgcccgggaccccgagaccgacaagcacaccgaggatcaatcaccaagtacccccttacctcagcctgccgccgaaaagaactcatacctctactcaaccgaaatcactctgtggaccgtagttgccgctattcaagccttggaaaagaaggtcgatagttgcctgacccggcttcttaccctggaagggcgtaccggcaccgccgaaaaaaagctcgccgattgtgaaaagacagccgtcgagtttgggaatcagttagaaggtaaatgggccgttcttggtacattgctacaggaatatggtctgttgcagcgtcgcctggagaatgtcgaaaatctgctgagaaaccggaacttttggatcctgcgcctgccacctggctctaaaggtgaggcaccaaaggtgccagttacctttgacgatgtggccgtatactttagtgaactagagtgggggaagttggaggactggcagaaagagttgtacaagcatgtcatgcgtgggaactatgagacgcttgtctcacttgactatgccatctcaaaaccagatattctcacgcgtattgaacggggggaagagccctgtttggatagatgggggcaagaaaagggtaacgaagtggaagtgggaagacccaggatgatggggacagggcttcctccttatccggaacacctcacctcccctctgagccccgcccaggaagaactgaaagagggtcaggcaccaaagcaacagcaagactctgaagcacgtgtggcacctgctggacccgaagcaggcctggccttgcgcacggacctgcagggcgaagcccaaatttag

SEQ ID NO: 21291 - DNA, 540 bp, Artificial Sequence
  Description of Artificial Sequence: Synthetic coding sequence
atggccgaggccgccgccccccccgactggcactgcggcctgaccagccgggagcgtccaagatcagaccttcagagatcccccttccgattaagttggctgctgtttcgctggtggcggaggcggtggaacccgagactgcccggctatcgcgcatggcgcgacgcttgtggccagccacggcgcagctggctgactgcccggcgctggctgtggagctcaggcacatcctggcgcgccctggtcaatggcggcgcctccctggtatgcggatcccaagtcggactggtgtcttcagagtggctgtgccagaaggggctcgtttacgaccggaatgctggacagctcgagaggccccaagccttctgccctggttcctctaagagaaagggacaggtggggggggctagccgcgctcaccgccgccccctctggcatacttgcgcccaggttagacatgcagggccctgcttgctgcgccctgtctctcttggtttgaggcgacatggcgttccgtggggagctagccagagactgtag

SEQ ID NO: 21292 - DNA, 1641 bp, Artificial Sequence
  Description of Artificial Sequence: Synthetic coding sequence
atggccgaggccgcccccgcccgggaccccgagaccgacaagcacactgaggatcagtcaccatccacgcctctgccccagccagcagccgaaaaaaatagctacctgtactcgacagagatcaccctctggactgtggtagcagcgattcaggctttggagaagaaagttgatagttgcttaacccggctccttaccctcgagggccggaccggcaccgctgagaaaaaactggccgattgcgaaaagacagccgtagagttcggcaaccagctggaaggtaaatgggcagtactcggcaccctgctgcaagagtacgggctgttgcaaagacggctcgagaacgtggaaaatctccttcggaacaggaatttctggatcctgcgactcccacccggaagtaagggggaggcacctaaagtacctgtgacctttgacgacgtggccgtctatttttccgagctcgagtggggcaagctagaggattggcagaaagagctatataagcacgtgatgagaggcaattatgaaactctggtctcgctggactacgcaatctccaagcccgacatactgacgcgtatcgagcgcggtgaagagccttgccttgatcgctggggtcaggagaagggaaatgaagttgaggtagggcgacctagaatgatgggcaccggcctgccgccatacccagagcacctcaccagcccgttatcacctgcccaagaggagctgaaggagggacaggcacccaagcaacagcaggactctgaggcaagagtggctccagctggacccgaagccggcgggggagttgcaattaagacagaggcccagagtgaagacgagatgactccggagcggctctttctaggggtttctcgtggccagacagagtgccgcatcccgcgcgggcctcgaaaccgacccgggggtccctcacggcatcaagcccaaggtatgccacgggtacgggctggcgagccacgaccacccggcgcctcaggcgaaacaccaagagtcctaagtagacgccgacagagggcgtttccgtgtccggactgcggtcagagcttcaggctgaaaataaatctgactatccatcagcgcacccatgtcgaagaaggtcgccaagaggccccgggtcggtccccaacctcttgcggggactcccaggccatgctcgaacctggggaggtggtggtgcccgggcccgtgataaggtggctgcctgaggaaccggaggggagaagaagtgtggccggcggcagagcattggtaggacggcgacccgccgctagtaagatgtaccactgcagcgagtgcctgaggttttttcagcagcgtaagagtctcctcctgcatcagaggctccacaccggaaatggccagggctggcccgcctgtccctattgcggaaaagccttcaggagacctagtgacctctttcgccaccagcgcatacatactggagaacgaccctatcaatgcccacagtgtgggcggactttcaataggaatcaccatctcgccgtacacatgcagacccacgcccgcggtcaggtcgggcctcacttccctgctgccccagcccgtcacgggtctttaccgctaccatggccatcccgtaaggaagaaggttag

SEQ ID NO: 21293 - DNA, 846 bp, Artificial Sequence
  Description of Artificial Sequence: Synthetic coding sequence
atggccgaggccgcccccgcccgggaccccgagaccgacaagcacacagaggatcagtctcctagcactccactgccacagccagctgctgagaagaattcttacttatattctactgaaatcacactctggacagtagtggcagcgattcaggccctcgaaaaaaaggtggactcctgtctcacccggctgctgactctggaaggacgcaccggtacggctgaaaaaaagctggctgattgcgagaaaaccgcggttgaattcggaaatcagttggagggtaaatgggcagtgctggggaccctgcttcaggagtatggcttgttacagcgccgtttggaaaatgtagagaatctcttgcgcaacagaaatttctggattctgagactcccgcctggcagtaagggagaggcccctaaagtaccagtcacatttgatgatgtggccgtttatttctccgagttggaatggggaaagctggaggactggcagaaggaactctacaaacacgtcatgaggggcaattacgagactttagtctccttggattacgcaatttctaaacctgacatattaacccgcattgagcgaggagaggagccttgtttagacaggtggggacaggaaaaagggaatgaggtagaggtaggaaggccccgcatgatgggaactgggcttcccccttacccggaacacctgaccagccctctgagtcctgcgcaggaagagttgaaggaaggccaggctcctaagcagcagcaggattccgaggcccgcgtggcgcctgcgggtccagaggccgggctggcgctgaggactgacctacagggggaggcccagatatag

SEQ ID NO: 21294 - DNA, 2589 bp, Artificial Sequence
  Description of Artificial Sequence: Synthetic coding sequence
atggccaccctgaacagcgccagcaccaccggcaccacccccagccccgggcacaatgcacccagcctgccatctgacaccttctcttcttcaaccccgtccgaccccgtgaccaaggaccctcctgctgcctcaagtacgagtgagaatatgcgctcaagcgaaccgggcggtcaattgctggaatcaggttgcggccttgtaccgccgaaggagatcggggagcctcaggaagggcccgactgcggccactttcccccaaatgatcctggcgtagagaaggacaaagaacaagaggaggaggaggaaggcttgcccccgatggatctgagcaatcacctcttctttaccgcggggggcgaagcctacttggtggccaaactcagcttgccaggcggcagtgagctgctgctcccaaagggcttcccatggggggaagctggcattaaggaagagcctagcttacctttcctagcttatcccccaccatcccacctgactgccctccatatccagcacgggtttgaccccatccaaggattttcttcctcagaccagattctgtcacatgacacctctgctccctctcctgccgcttgtgaagagaggcatggggctttttggtcttaccagttagctccgaacccacccggtgatccaaaggacggcccgatgggcaactctggaggaaaccacgtcgccgtcttctggctatgtttactctgtcgtttagggttttcaaagcctcaggcatttatggatcatactcaatcccacggagtaaagctcactcccgctcagtaccaaggactttcagggagtcccgcagtacttcaggaaggtgacgaaggatgtaaggctcttattagcttcctggagccaaagttgccagcacgaccttcatcggatattcctttggacaattccagcaccgtgaatatggaagccaatgtcgctcagaccgaggacggcccgccggaggcagaggttcaggccctcatcttgctcgacgaggaggtgatggctctcagtccacccagccctcccactgctacatgggaccccagccctactcaagctaaggaatctcccgtcgcagctggggaggctggtccagactggtttcctgagggacaggaggaggatggggggctttgtccaccacttaaccagtctagtccaacttcaaaagagggcggtaccttgccagcccccgtcgggagccctgaggacccgtccgatcctccccagccttatagacttgcggatgattacacccctgccccagcagctttccagggactatccttgagttcccacatgagccttttgcactccagaaacagctgtaagaccttgaaatgtcctaagtgtaactggcactacaaatatcagcagacactcgatgttcatatgcgggaaaagcacccagagtccaatagtcattgtagctattgcagcgcgggaggggcccaccctaggcttgctaggggtgagtcttacaattgcggctataaaccttaccgttgtgacgtatgcaattattcaaccaccaccaaagggaacctgtctatccatatgcagagtgataaacacttggcgaacctgcagggcttccaagcaggcccaggaggccaggggtccccccctgaggcttccctcccaccatccgctggggataaagagcccaagaccaagagtagctggcagtgtaaggtgtgttcctacgaaactaatatatctaggaacctcagaatacacatgacatccgagaagcacatgcagaatgtgcttatgctgcaccaggggctacctttaggccttcctcctggattaatgggcccgggacccccccccccacccggagccacccctacttcacctccagaattattccagtactttggaccccaagcattggggcaaccacagacccccctggcgggacccggattgaggcccgataaaccactggaggcccaactgctgttgaatggtttccatcatgtgggggcaccagcaaggaagttccccacttctgcacccgggagcttgtcgccagatgctcatttgcctccctctcagctgttaggctccagctccgatagccttccaacttcacccccacccgatgactccttgtcactcaaggtgttcaggtgcctggtctgtcaggcattctccactgattccctggagctgcttctctaccactgttcaattggtcgcagtctgcccgaagctgagtggaaggaagtggcgggcgacacacacaggtgtaagttgtgttgttatggaacccagctgaaagctaattttcagttgcatctgaaaactgataaacatgcacagaagtatcagctagccgcacacctgcgtgaaggaggtggggccatgggcactcctagcccggcgagcctgggcgacggcgcgccctatggttcggttagccccctacacctgcgttgcaacatctgtgatttcgagtctaacagtaaggagaagatgcagctccatgcacgcggggccgctcacgaggaaaactcgcaaatctataaaaggacagggacgggactgctaatcaaatag

SEQ ID NO: 21295 - DNA, 303 bp, Artificial Sequence
  Description of Artificial Sequence: Synthetic coding sequence
atggccaccctgaacagcgccagcaccaccggcaccacccccagccctggacacaatgcaccttctctgcccagcgataccttctcatcaagcacgccatctgacccagttaccaaggacccgcccgccgcatccagcacctctgaaaacatgaggtcctccgaaccggggggacagctcttagagtctggatgtggtttagtgcctcctaaggagattggggaaccgcaggaagggccggattgtggacactttcccccaaatgatcccggtgtcgagaaagacaaggaacaagaggagtag

SEQ ID NO: 21296 - DNA, 7719 bp, Artificial Sequence
  Description of Artificial Sequence: Synthetic coding sequence
atggccaccctgaacagcgccagcaccaccggcaccacccccagcccaggtcataacgccccaagcctaccgagcgatactttctccagttcgactccgagcgacccggtgaccaaggatcctccagccgctagttcaacctccgagaatatgaggagcagtgaacccggcggacagttgttggagagcgggtgcggtcttgtgcctcccaaggagatcggagaaccccaggagggacccgactgtggccactttccccccaacgatcccggtgtagagaaggataaagagcaggaggaagaggaagagggcctgcccccaatggacctgtccaaccatctgttttttaccgccggaggcgaggcttatcttgtggccaagttgagtctcccgggaggttccgagctactgcttcccaaaggatttccatggggtgaagctggaatcaaggaggagccaagcctgcccttcttggcctacccccctccaagccaccttacggctctccatattcagcatgggtttgatccaatccaaggctttagcagctcagaccagattctgtcacatgataccagcgccccctcccctgcagcctgcgaggaaaggcacggggctttctggagttatcagcttgcaccaaacccccccggagaccctaaggatggacccatgggaaactcaggcggcaatcacgtggccgtcttttggctttgcctcctatgcagacttggattcagtaaacctcaggcatttatggaccatacccagtcccatggggtgaaactgacacccgcccagtaccagggcctttccggatctcccgccgtgctgcaggagggggatgagggctgcaaggctctcatcagtttcctggagcctaagctgcccgcgcgtccttcctcagatatccctctcgataattcttctactgtcaatatggaggccaatgtggctcagaccgaggatggacctcccgaagccgaggtccaggctcttatactcctagacgaagaagtaatggccctgtctccaccctctccccccactgctacgtgggacccatctcccacgcaggcgaaagagtcccctgttgccgccggcgaggccgggcccgattggttcccagaagggcaggaggaagacgggggactgtgccctcctctcaaccagagctcaccaacctctaaagagggcggtacactccccgctcccgtgggaagtcctgaggacccttcagaccctccccagccctaccggctcgctgacgactatactccagcacccgccgcctttcagggattgtctcttagcagtcatatgagtcttctgcacagccggaattcatgcaaaaccctcaagtgtcctaagtgtaattggcattataagtatcaacagacgctcgacgtgcacatgcgggagaaacacccagaaagcaatagtcactgttcctattgttctgccggtggagcgcacccaagactggccagaggtgagtcctacaactgcggctacaagccttaccgatgtgatgtttgtaactactcaactacaacaaagggtaatttgtcaattcacatgcagtctgacaaacacctggccaaccttcagggatttcaagcggggcctggtggacaaggttctcctcccgaggcctccctgccaccatctgcgggggataaggaacctaaaacgaagtcttcttggcagtgtaaggtgtgcagttacgagaccaacatttcaaggaatcttcgcatccacatgaccagtgaaaagcatatgcagaatgtgctgatgctgcaccagggactgccattggggttgcctccaggactcatgggaccaggcccccctccacctccaggcgcaaccccaactagtccacctgaactgtttcagtatttcggacctcaggctttaggccagccccaaactcctctcgctggccctggactcaggccagacaagccacttgaagctcaattgctgttaaatggtttccatcacgttggtgcccccgcccgcaagtttcccacttccgctcctggcagtctctcccctgatgcccacctgcctccaagccagctcttgggcagcagctccgattctttgccgacttcccccccgcctgacgactcactgagcctgaaggtgtttcggtgcctagtgtgccaagcgttttccaccgatagtctcgagctgctgctctaccattgttccatcggaaggtcactacctgaagctgagtggaaagaggtggctggcgacacccacaggtgtaagctgtgctgctatggtactcaactcaaggctaactttcaactgcacctgaaaactgacaaacatgctcagaagtaccaactggccgcacatctgcgggagggaggcggcgccatgggaactcctagccctgcttccctcggggatggcgcaccctatggatccgtgtcacccctccatctccgatgcaatatctgcgacttcgagtcgaactccaaagaaaagatgcaattacatgctcggggagctgctcacgaggagaacagccagatttataaattcctgctcgatatggagggagccgaagccggggccgaactggggctctatcattgcctgctgtgcgcatgggagacaccgtcccgactagctgtgctacagcatttacgcacacctgcccatcgcgacgcccaggcccagagacggcttcagctgttgcaaaatggccccacaacagaggagggcttggcagctctgcaatccatcctgtccttcagccatggccagttgcggaccccaggtaaagcacccgtaaccccattggctgagccgcccacccccgaaaaggatgcgcagaacaagactgagcaactcgcctctgaggagactgagaacaagacaggcccctccagggattctgctaatcaaacaacagtttactgttgtccatactgcagtttcctgtcaccagaaagttcccaggtgagggctcacacactgtctcagcatgctgtgcaaccaaagtatcgatgccccctctgccaggagcagctcgttggccggcccgccctgcacttccatcttagtcacctgcacaatgtggtcccagagtgtgtcgagaagcttctgctggtcgccaccactgtggaaatgactttcactaccaaagtgttgtccgcccctacactctcccccttggataacggtcaagagcccccaactcatggaccagaacctaccccatcaagggaccaggccgcagaggggcctaacctcactcctgaggccagtccagaccctcttccggaacccccccttgcatccgtcgaggtacctgacaagccttccggatcacccgggcagccaccttcgcctgctccgagcccagttccggagccagatgctcaggccgaggatgtggccccaccacctacaatggctgaagaagaagaaggaacgaccggcgagcttcgttctgcagaacccgcaccagccgactcaaggcatcctctgacatataggaaaactaccaacttcgcacttgataagttccttgatccagcgcggccatataaatgcactgtttgcaaagaaagctttacccaaaagaacatcctcctggtccattataactccgtctcccatctgcacaaaatgaagaaggctgctatcgacccctctgcacccgcacggggggaagccggtgcaccccccactaccactgcagccaccgataagccattcaagtgcacagtgtgccgggtctcatataatcagagcagtacgcttgagatacacatgagaagcgtcctgcatcagactaggagtagaggaaccaagacagatagcaagatcgaaggacccgagaggagtcaggaagaacccaaggagggggagaccgagggggaagtcggaaccgagaagaaaggccctgatacaagtggctttatcagtgggttaccttttttatctccacccccacctccactcgacctacaccgctttcccgctcccctgtttacgcccccagtcctgccaccattccctctcgtcccggaaagcctgctgaagctccagcaacaacaactgttacttcctttctacctccacgacctgaaggtcggacccaaacttacactcgccggcccggcccctgtcctttctctccccgccgctacccccccaccacccccacagcctccaaaggccgaactagctgagcgggaatgggaaagacctcctatggcaaaggaagggaacgaagccggtccttcttcccctccagacccgctcccaaacgaggccgcccggacagcagcgaaagctctactcgagaacttcggctttgaactggtgatccaatataatgaaggaaagcaggccgtgccccctccccccaccccgcccccgcctgaagccttaggcggtggtgacaagctggcctgcggcgcctgtggaaaactgtttagtaatatgctgattttaaagacccatgaggagcacgtccaccgcaggtttctgcccttcgaggcgctctcaaggtacgctgctcagtttcggaaaagctatgactcgctctatccccctttggcagaaccccctaagcccccagacggaagtttagatagtcctgttcctcatttgggcccaccatttttggttcccgagcccgaggccggcggtactagagctccagaagagcggagccgggcagggggccattggcccattgaggaggaagagagctctcggggtaacctgccgcctcttgtgcccgccgggagacgattttctcgaaccaaatttactgagtttcaaacccaggcccttcagagtttctttgagaccagcgcttaccctaaagacggcgaggtggaacgcctggcttcactgttgggtctggcttccagagtggttgtggtgtggtttcagaacgctaggcagaaagccagaaagaacgcatgcgaaggcgggtcgatgcccacagggggcggaactggaggggcatccgggtgccgcaggtgccacgccactttctcttgtgttttcgaactcgtccgccatctcaagaagtgttacgatgaccagaccttggaggaggaagaggaagaagccgagcgaggcgaggaagaggaagaggtggaagaagaggaggtcgaggaggaacaggggctagagccaccagcagggcctgaggggcctctgccagagccccctgatggggaggaactgagccaagccgaagctacaaaggcgggagggaaagagccagaagaaaaggccaccccgagcccttcccccgcccatacctgtgatcagtgtgctatatcattctcatctcaggacctgctgactagccatcggcggttacacttccttccctccctacagccaagtgcacctccccagcttctcgacctgccactgttggtgttcggcgagagaaatccgctcgtagccgcgacatcaccaatgcccggcccgccacttaagcgtaagcacgaggatggaagcttgtctccgacgggctctgaggctggcgggggcggggagggcgagccccctagggacaaacggctcagaacaacaatcctcccagagcaactcgagatcctctaccggtggtatatgcaggacagcaatccaaccaggaaaatgttagattgtatcagtgaggaggttgggctgaaaaaacgtgtggtgcaggtgtggtttcagaacaccagagcccgcgaaaggaagggtcagtttaggagcacgcccggaggcgtcccgtcccccgccgtgaaaccacccgccaccgcaacaccagcaagtctccctaagttcaatttgttactcggaaaggtggatgatggcacaggcagagaggctcctaagcgcgaggcacccgccttcccataccctacagccacactggcgagcggaccccaacccttcctgccacccggaaaagaggcgacgactcctacccccgagcctcccctgcccctgctgcctcctcctcctcctagtgaggaagaaggccctgaggaaccgccaaaagcttcgcccgaatctgaggcctgcagcctttccgcaggcgatctctcagactcttccgcaagcagcctggctgaacccgaaagcccaggagccgggggtacttctggcggtccggggggaggaacaggcgtgcccgatggcatgggacagcgtaggtatcgcacccagatgagctccctgcagctcaagatcatgaaggcatgctatgaggcttataggacccctacgatgcaggaatgcgaagtgctcggtgaagagattggtttaccgaaacgcgtgatccaggtgtggttccaaaatgcgcgggctaaggagaagaaggccaaactccagggtactgccgcaggcagcaccggcggatcttcagaaggccttctagcagctcagaggacggattgtccatattgcgacgtcaaatacgatttttacgtttcctgtagaggtcaccttttttccagacagcacctcgcgaagttgaaagaagcggtgcgagcgcaactgaaaagtgaatccaaatgttacgatctagctccagccccagaggctcctcctgccctgaaagcccctcccgcaacaacccccgccagcatgcccctcggcgcggctccaacattgcctcggctggcgccggtgttgctgtctggcccagcactggcccaaccccctcttggaaaccttgcacctttcaattccggaccagctgcatcaagcggactcctaggcctcgcgacaagcgtactgccaaccacaactgtagttcagaccgccggacctggcagaccccttccacagaggcctatgcccgaccagacaaacacatctaccgctgggacaactgacccggtgcccggcccgcccacagaacctctgggcgataaagtgtcatctgaacgcaagcctgtggctgggcccactagtagctcgaacgatgccctcaagaatctgaaagctctgaagacaaccgtcccagcactcttaggcggtcagtttttaccgttccccctcccacctgctggtgggactgctccgcccgctgtgtttggcccccagctccaaggagcctatttccagcaattatatggtatgaagaaaggcctgtttcctatgaatcctatgatcccccaaacactgattggactgttgccaaatgccctcctgcagccgcccccacagcccccagaacctaccgccacagccccacccaagcctcccgagctgccagcacctggcgagggcgaggccggcgaggtggatgagcttttgacaggatccacaggcatctcaacagtggatgtgacccaccgctacttgtgtagacagtgcaaaatggctttcgacggagaagcacccgccactgcccaccagcggtcattttgcttctttggccgggggtcagggggatctatgccgcctcccctgagggtaccaatttgcacctaccattgcctcgcatgcgaggtactgttgagcgggcgtgaggccctcgcttctcatctccgctcatctgcgcaccgcaggaaggctgcacccccacaaggcgggccccccatcagcatcaccaatgctgccacggctgcctctgcagccgtcgcatttgcaaaagaggaggccaggcttcctcatactgacagtaaccccaagaccactaccacatctaccttgttggctctctag

SEQ ID NO: 21297 - DNA, 1227 bp, Artificial Sequence
  Description of Artificial Sequence: Synthetic coding sequence
atggccaccctgaacagcgccagcaccaccggcaccacccccagcccaggccacaacgcgccttctttgcctagcgataccttctcgtcttctacacccagtgacccagtcacaaaagatccacccgccgctagcagcactagcgagaatatgcgctcatccgaacctgggggccagctactggagtctggctgcggactcgtcccacctaaggaaattggagagccccaggaaggacccgactgtgggcattttccccctaatgacccaggagtcgaaaaagataaggaacaagaggaagaggaggaggggcttccacccatggacctgagcaaccacctgtttttcactgcagggggggaagcataccttgttgctaagctgtccttgcctgggggcagcgaactgttattgcccaagggcttcccatggggggaagcagggatcaaggaagagcctagtctgccctttctggcatatccccctccgagccatctcactgctctgcacattcagcatggatttgatcccatccagggattctcctcttcagatcaaatcttgagccatgatacatccgctccatctccagccgcgtgtgaggagcgccacggagctttttggagttaccaattagctccaaaccccccaggcgaccccaaggatggcccaatggggaattctggtggaaaccacgttgccgtattctggctatgtctcttgtgtcgcctaggcttttccaagcctcaagcatttatggatcatactcagtcccatggtgtgaagctgacgcctgcgcagtaccagggactaagcggcagccccgcggtgcttcaagagggtgatgaagggtgtaaagccctgatttccttccttgagccgaagttacccgccaggcctagcagcgatataccccttgataatagctccactgtgaatatggaggccaatgtcgcccaaaccgaggacggtccccccgaagcagaggtgcaagccctaatactcctggatgaggaagtaatggccctgtcccctccgtccccccctacagcgacctggggatatacgaccgcctgctgtgtcaggggtagacaccctccagcctggttgtgctgcaatacctgtgctcatcttccaacagctatgccccgtccccgaggtgtctgtagttgttacagaatggcccagcccctgaggaaagactcccaactcttccgggcaagctag

SEQ ID NO: 21298 - DNA, 741 bp, Artificial Sequence
  Description of Artificial Sequence: Synthetic coding sequence
atggccaccctgaacagcgccagcaccaccggcaccacccccagccccggccacaacgcccctagtctcccgtccgatactttttcctcctcaaccccttccgatcccgtcaccaaagacccacccgccgcgtcatcaacatcagaaaacatgagaagtagtgagcccggcggacagctgcttgagagcggatgcggattggtcccacctaaggaaattggcgaaccccaggagggacctgactgtgggcatttcccacctaacgaccccggcgtggaaaaagataaggaacaggaagaagaggaagaaggacttcccccaatggatctcagcaatcacctctttttcaccgccggtggagaggcatatctggtggctaaactgagccttcccggtggctccgaacttctgctgcccaagggcttcccgtggggggaggctggaatcaaggaagagccatccctcccctttctggcatatcccccaccaagtcacctcacagctttgcatatccagcacggattcgacccaatccagggattctccagtagtgaccagattctgagtcacgatacttccgctccaagccccgcagcatgcgaggagaggcatggagccttctggtcctaccagctcgcacccaacccgcctggtgatcctaaggatgggcctatggggaacagcgggggcaatcatgtggccgtgttctggctgtgtctgctgtgcaggcttgggttttag

SEQ ID NO: 21299 - DNA, 1563 bp, Artificial Sequence
  Description of Artificial Sequence: Synthetic coding sequence
atgagccagctgagcctgagctggctgggcctgtggcccgtggccgccagtccttggctcctattgctgctcgtaggcgctagttggcttctcgcacacgtgctggcttggacatatgctttctacgacaattgtcggaggctgagatgcttcccgcaaccaccacggcgaaattggttctggggtcatcagggaatggtcaatccaaccgaggaggggatgagagtgctgacacagctagtggccacctacccccaagggttcaaggtttggatggggccaattagtcccctcctgtccctatgtcatccggatatcattcgatcggtcatcaacgcttctgctgccatcgcccctaaggacaaattcttttatagctttttagaaccatggctgggagacggtctcctgttatcggctggagacaaatggtcccggcacaggcgcatgcttacccctgccttccactttaacatactgaaaccttacatgaagatattcaatgagtccgtaaacatcatgcacgcaaagtggcaactgctggcctcggagggatctgcttgcctggacatgttcgagcacatttcactcatgacgctggacagcctccagaagtgtgtttttagtttcgatagtcattgtcaagagaaaccatctgaatacatcgccgccatattagagctgtctgccctcgttagcaagcggcaccatgagatccttctgcacattgacttcttgtactaccttacaccggatggccagcgcttcagacgagcctgtcgcctggtgcacgatttcacagacgccgtcatccaggagcgaagacgcaccctgccatctcaaggggtggacgattttctgcaggcgaaggccaaatccaagactcttgactttatagatgtattacttctgtccaaagacgaggacggaaagaagcttagcgacgaagacatcagggctgaagccgacacttttatgttcgagggccacgataccaccgccagcggcctttcctgggtgctctatcacctagctaagcatccagagtatcaggagagatgtcgccaggaagtccaggagctcctcaaggaccgtgagcctaaagaaatcgaatgggatgacctggctcatctgcctttcctaaccatgtgcatgaaagagtctctgcgcctgcatccgcctgtccctgtcatctcgagacacgtcactcaggacattgtactacctgatggccgagtgattcctaagggaatcatttgccttattagcgttttcggcacgcaccacaaccccgccgtgtggcccgatccggaagtctacgatcccttcaggttcgatccagaaaacataaaggagcgctccccgctggcatttattcctttcagcgctggacctcgcaactgtattggccagacatttgccatggccgagatgaaggttgtactggcccttaccctgctgcgctttagggtgttgccagatcacactgagccaagacgtaagcccgagctggtgctgcgtgccgaggggggcctttggctgcgcgtcgagcctttatcctag

SEQ ID NO: 21300 - DNA, 1584 bp, Artificial Sequence
  Description of Artificial Sequence: Synthetic coding sequence
atgtaccagcccgaggacgacaacaacagcgacgtgaccagcgacgatgacatgacccggaatcgtagagaatcatctcctccacattctgtgcacagttttagcggcgacagagattgggacaggcgaggcagatcccgcgatatggagcctcgagacaggtggtcacacacccggaatcctaggagccgaatgcccccaagagacctgtcactgccggttgtcgcaaaaacaagtttcgagatggatcgcgaagatgatcgcgatagtagagcttatgagtcacggtcccaggacgccgaaagctaccagaacgtggtggacctggcagaagaccgtaagcctcacaacactatccaggataacatggagaattaccgaaagctgctcagcttggggtttctggcacaagattccgttccagctgagaagcgcaacacagaaatgttggacaatctgccctctgccgggtctcagtttccggacttcaaacatctagggacatttctcgtgttcgaggagctggtaacctttgaggacgtactggtggacttttcccctgaagagctgagcagcctatctgcggcacagcgcaatctctatcgcgaagtgatgctggagaattacaggaacctggtgtccttggggcatcaattctctaaacctgatattatcagcaggctggaagaggaggaatcttacgcaatggagacagattccaggcatactgtaatatgtcagggagaatcccatgacgatcccctcgaaccccatcaggggaaccaggagaaactcctaacaccaataacaatgaacgaccctaaaacactgactccagaacgatcttacggtagcgacgagttcgaacgctcgtccaatctgtctaagcagtctaaggatccattgggcaaggatccccaagaagggaccgcccctggaatctgtacatcgcctcagtcagcgtcgcaggagaataagcacaaccgttgcgagttctgtaaacgcaccttcagtactcaggtcgccctcaggagacatgaaaggatacacacgggaaagaagccctacgaatgcaaacagtgtgctgaggctttctacttaatgccccatctgaatcggcaccaaaaaactcacagtgggcggaaaacaagtggctgcaacgaaggacgcaaacctagcgtgcaatgcgccaacctgtgcgagcgtgtccgcattcactcccaggaggactacttcgaatgcttccagtgtggaaaagctttccttcagaatgtgcatttgcttcagcacctgaaggcccacgaagctgctagagtgcttccccccgggctgtcacatagtaagacgtatctgatccgctaccagcggaagcacgactacgtgggggaaagagcctgccagtgttgcgactgtggtagggtgttttcccgaaactcttatctgatccagcactatcggactcacacacaggaaaggccgtaccagtgtcagttgtgcggaaaatgtttcgggagaccttcgtacctgacccagcattaccagctgcacagtcaagagaagacagttgaatgtgaccactgctag

SEQ ID NO: 21301 - DNA, 1584 bp, Artificial Sequence
  Description of Artificial Sequence: Synthetic coding sequence
atgtaccagcccgaggacgacaacaacagcgacgtgaccagcgacgatgatatgaccagaaatcgacgcgagtcaagccccccgcattcagtacatagtttcagtggggatagagattgggatcggcgggggcgcagcagagatatggagccccgggatcgctggtcacacactaggaatcctcgatcccggatgcctcctcgggatttaagtctgccagtggtagctaaaacaagcttcgaaatggatagagaggacgatcgggatagcagagcctacgaatctcgcagccaggatgccgagtcttaccagaatgtggttgatcttgcagaggaccgaaagccccacaatacaattcaggataatatggaaaattaccgtaagttgctgtccttgggttttctggctcaagacagtgtgcctgctgagaagcgtaatacggaaatgctcgacaacctgccttctgccggatctcaatttccagattttaaacatttgggtactttccttgtcttcgaagaattggtaaccttcgaggacgttctggtagatttctcacctgaggaactatcttccctttccgccgctcagcggaacttatacagagaagttatgctggagaattaccgcaatctcgtcagcttaggccatcagttctcaaaaccggacatcatctctcggctggaagaagaagagtcttacgcgatggagactgattcccggcacaccgtcatctgtcaaggagagagccatgacgaccccctagagccccatcagggcaatcaggagaaactactaaccccgatcaccatgaatgaccctaaaacgttaacccccgaaaggtcatatgggagtgacgaattcgaaagatcaagcaacttgtccaagcagagcaaggacccgcttggcaaggacccacaggagggaaccgctcctgggatttgcaccagtccgcagtctgcctcgcaggaaaataagcacaataggtgcgagttctgcaagcgtactttcagtacacaggtggctcttcggagacatgagcggattcacacaggtaagaagccctacgaatgcaagcagtgtgcagaggccttctacctaatgcctcaccttaacaggcatcaaaagacccactccggcagaaagacttccgggtgtaacgaggggaggaaaccaagcgtacagtgcgccaacctttgtgaaagggtgagaatccacagtcaggaggactactttgagtgttttcagtgcggcaaagcgttcctccagaacgtgcaccttcttcagcacctcaaagcccatgaagccgcacgggtcctgccacccggtctcagtcatagtaagacatatcttatcaggtatcaaaggaagcacgattatgtcggcgaaagagcttgtcaatgctgtgactgcggtcgcgtcttctcacgaaactcttacctcatacagcactatagaactcacacccaggagaggccatatcagtgccagctgtgtggaaaatgcttcggccggccttcatatctgactcagcactaccagctgcactcacaggaaaaaacagttgagtgtgatcactgctag

SEQ ID NO: 21302 - DNA, 1584 bp, Artificial Sequence
  Description of Artificial Sequence: Synthetic coding sequence
atgtaccagcccgaggacgacaacaacagcgacgtgaccagcgacgatgacatgacccggaatcgccgggagtcttcacccccgcattctgtacattcattctctggtgacagagactgggacagaaggggaaggtctagggacatggagcctcgagataggtggtctcatactcgtaaccctcgatctcgcatgcctcccagagatctctcattacccgtggtggctaagactagttttgagatggacagagaggacgaccgagattctcgagcgtatgagagcaggagtcaggatgctgaatcttaccagaacgttgtggatttagccgaagatcgcaagcctcacaatactatacaggataacatggagaactaccgtaagttgctgagtcttggttttcttgcccaggattctgtgccagcagagaagcgcaacaccgaaatgctagacaatctgccatcagccggatcccaatttcccgatttcaagcacctggggaccttcctcgttttcgaagaactggtgaccttcgaagacgtgcttgttgacttttcaccagaggagctttcctctctctcagccgctcagcggaatctgtaccgggaagttatgctagaaaactatagaaacctggtgtccttgggccatcagttttctaaacccgacatcatctcccggctcgaagaggaggaatcctacgccatggaaaccgattctagacacaccgtcatttgccagggagagtcccatgacgaccccctggagcctcatcagggaaatcaggaaaagttactcactccaataacaatgaacgatccaaagactcttacgcctgagcgcagttatggatctgacgagttcgagcggtcatccaatctctctaaacaaagcaaagaccccctggggaaggacccccaggaaggaaccgcccctggcatttgcacatccccccagagtgcgtcgcaagagaacaaacacaatcggtgtgagttttgcaagcgaactttcagcacacaagtggcattaagaagacacgaaagaattcatactgggaaaaaaccctacgagtgcaagcagtgtgccgaggccttttacctcatgccacacctcaatcggcaccaaaaaacgcactctggtagaaagacgtccgggtgcaatgaaggacgtaagcctagcgtccaatgtgcaaacttatgcgagcgagtacgtatccacagccaggaggactactttgaatgcttccagtgcgggaaggcattcctgcagaacgttcatctcttacagcacctgaaagcccatgaggctgctagagttctgccaccaggcctgagccactcaaaaacttacttgatcagataccagaggaagcacgattatgtgggagaacgtgcctgccagtgctgcgactgtggacgcgtcttttcaagaaacagctacctgatccagcattacaggactcacactcaagaaaggccataccaatgtcagctgtgtggcaagtgcttcggtcggccgtcttacctgacccaacactaccagctccattcacaggaaaagaccgtggagtgtgaccattgctag

SEQ ID NO: 21303 - DNA, 1584 bp, Artificial Sequence
  Description of Artificial Sequence: Synthetic coding sequence
atgtaccagcccgaggacgacaacaacagcgacgtgaccagcgacgatgatatgacacgaaatagacgagaatcgtccccccctcactccgttcactctttctcaggcgatagggattgggacaggcgtggcaggtcaagagatatggagcctagagacagatggtcccacactagaaatccgaggagccggatgcctccccgagatctgtctctgccagttgtcgccaaaacatcctttgagatggaccgtgaggacgacagagacagtagggcctatgagagcaggtcccaagacgcggagagctaccaaaatgtcgtggacctcgcagaggaccggaagccacacaacaccatccaagataatatggaaaactatagaaagctgttatctttgggcttcctcgcccaggatagcgttcccgcagagaagcgcaacacagaaatgctcgataacctgccgtccgccggctcacagttcccggactttaagcacctaggcaccttcctggtgttcgaggaactagtaacattcgaagacgtgcttgtggatttctcacctgaggagctgtcatcactctccgcagcccagagaaacttgtaccgggaggtgatgctggaaaactacaggaaccttgtttctttgggtcatcagttttccaagccagacattatttctcgcttggaagaagaagagagctacgcaatggaaaccgattcccgacacacagtgatctgccaaggtgagagtcacgatgaccccctagagccacaccaggggaaccaagagaagcttctgactcccattacgatgaacgatccaaagacgctcactccagaaaggagctacgggtctgacgagttcgaaaggtcctcaaacttgtcaaaacaatctaaagacccactaggcaaagacccacaagaaggcacagcccctgggatctgcacctctcctcaaagtgccagccaggagaacaagcacaatcgctgtgagttttgtaagcgaacattctccacgcaggtggcactgcgaaggcacgaacggatccacacaggaaagaaaccatacgagtgcaagcagtgcgcggaggccttctaccttatgccccatctgaataggcaccagaagacacattctgggcgaaagaccagtggttgcaacgaaggacggaagcctagtgtgcaatgcgccaatctgtgtgaacgggttcgtattcactcccaagaagattattttgagtgtttccagtgcggcaaagcctttttacaaaatgtgcaccttttgcagcatctgaaagcgcatgaagccgcacgcgtcctccctccaggtctgagccattctaaaacttacctaattagataccagcggaaacatgactacgtgggggaacgcgcttgtcagtgctgcgattgtggacgtgtcttttctagaaattcctatctgatccaacattacaggacccacacccaggagcggccataccagtgtcagctgtgcggaaaatgtttcgggagacccagttacctgacacaacactaccagctgcacagccaggaaaagaccgtggaatgcgatcactgctag

SEQ ID NO: 21304 - DNA, 1707 bp, Artificial Sequence
  Description of Artificial Sequence: Synthetic coding sequence
atggcccggctgaccaagcggcggcaggccgacaccaaggccatccagcacctgtgggcagccattgaaatcattcgcaaccagaaacagattgcgaacattgatcggatcacaaaatatatgagcagggtccacggaatgcacccgaaagagacaaccagacagttatctttagctgtgaaagatggcctcatcgtggaaaccctcaccgtgggatgtaaagggtccaaggctggaatcgagcaggaagggtattggttacctggtgatgaaatcgattgggaaacggagaatcacgattggtattgcttcgagtgtcacctccctggcgaggtgttaatttgcgacttgtgctttagagtctaccatagtaagtgtctcagcgacgagtttcgcctgagagactctagctctccgtggcagtgcccggtttgtcgttccatcaagaaaaaaaatacaaataagcaggagatgggaacctatctcaggtttattgtttcacgcatgaaggagcgcgctatcgatctgaataagaagggcaaggataacaaacatcctatgtaccgacggctggtgcattcagctgttgacgtccctacaatacaggaaaaagtgaacgaggggaagtaccggtcctacgaggaattcaaagcagatgcacagttattgcttcataatacagtgatattctacggtgccgacagtgagcaggcagatatagccagaatgctgtacaaggacacttgccacgagctcgacgagctccagctgtgtaagaactgcttttacctgagcaacgcacgacccgataactggttttgctacccatgcattcctaaccacgaactcgtgtgggccaaaatgaaaggcttcgggttctggcccgctaaggtgatgcagaaagaagacaaccaggttgacgtgcgtttctttggacaccaccaccagcgcgcttggattccaagcgagaacatccaggacattaccgtcaatatacatcgtctacacgtgaagagatccatgggttggaaaaaagcctgtgacgaattggagttacatcagcgcttcctaagggaagggcgcttttggaagagtaagaacgaagatcgcggtgaagaggaggccgaaagctctatctcttcaacctcaaacgagcagctgaaggtgacacaggaaccaagagctaaaaagggacgacggaaccagtccgtggagccaaaaaaggaggagcccgagcccgagacagaagccgtttcctcaagtcaggaaattcccacaatgccccaacccatcgaaaaagttagcgtcagcactcagaccaagaagctttctgcctcatcgcctcgaatgctgcatagaagtacacaaaccacaaacgacggagtctgccaatctatgtgtcatgataagtacactaaaatttttaacgatttcaaggacaggatgaagtctgatcataagcgagagacggagcgggtcgttagggaggccctcgaaaagctacggtccgagatggaggaggaaaagagacaggccgtgaataaggctgttgcgaatatgcagggggagatggacaggaaatgtaagcaagtcaaagagaaatgtaaagaggaatttgtcgaagagatcaagaagctggctacccaacacaaacagcttatctctcaaacgaagaaaaaacaatgggtgaacaccagcctcttttag

SEQ ID NO: 21305 - DNA, 1224 bp, Artificial Sequence
  Description of Artificial Sequence: Synthetic coding sequence
atgaacaagagccagggcagcgtgagcttcaccgacgtgaccgtggattttacacaggaagaatgggaacagctggacccatcacagcgaatcttgtacatggatgtcatgttagagaattattccaacctcctgagcgtggaagtatggaaagcagacgaccagatggagcgtgatcatcgcaatcccgacgagcaggctcggcaattccttattttgaaaaaccagacacccatcgaagagcgaggcgacttgttcggtaaagccctgaatctaaatacagacttcgtctctttgcgccaggttccttacaagtacgacctgtacgagaaaactttgaagtacaactccgacctgctgaattcgaatcgaagctatgctggaaagcagaccgatgagtgcaacgaatttggcaaggctttgctgtatctaaagcaggagaagacacactctggggtcgaatattctgaatacaataagtctgggaaggccctgagtcacaaggccgcgatcttcaagcaccagaaaatcaagaacctggttcagccgttcatctgcacatattgcgataaggccttttccttcaaatcattactgatttcacataagagaattcacacaggtgaaaagccttacgaatgcaatgtttgcaagaagacctttagccacaaggcaaacctgataaaacatcagaggatacacacgggagagaagccattcgaatgtcctgaatgtggtaaggcttttacacaccaatctaatctgattgtgcaccagcgcgctcacatggaaaagaaaccctatgaatgttctgagtgcggaaaaaccttcgctcaaaagtttgagttgacgacccatcagagaatacatacgggcgagagaccctacgaatgtaatgagtgcgccaagaccttcttcaagaagagcaatctcattatccaccagaaaatacacacaggtgaaaagaggtatgaatgtagtgaatgtgggaagagctttatccagaatagtcagctgattatacacatgaggacccacacaggggagaaaccatacgagtgtacagagtgcggaaagactttctcacaaaggagcacattgaggctacacctgagaatacatacaggggagaagccctacgaatgtagcgaatgcggaaaggcctttagcaggaagtccaggctgagcgttcatcaaagggtacatattggggaaaagccctag

SEQ ID NO: 21306 - DNA, 1224 bp, Artificial Sequence
  Description of Artificial Sequence: Synthetic coding sequence
atgaacaagagccagggcagcgtgagcttcaccgacgtgaccgtggactttacacaggaggagtgggaacagctggaccctagccaacgtatcctttacatggatgtcatgttggagaactattctaatttgttgtctgtggaagtttggaaggccgatgaccaaatggagagggaccacagaaatccagacgagcaggcaagacaatttctgatcctgaagaatcagactcctattgaagaaagaggcgacttatttgggaaagccttaaatctaaatactgactttgtttcactgcgtcaggtgccttacaagtatgatttgtatgaaaagacactgaaatataattcagatttactgaacagcaatcgatcctacgccggcaaacagaccgatgagtgcaacgagttcgggaaagccttgctttacctgaagcaggaaaaaactcactctggggtggaatacagcgaatacaacaaatccggcaaagccctatcccataaggcggccatctttaaacatcagaaaatcaagaatttggtccagccatttatttgtacttattgtgataaggcattctccttcaagtccctgctcatctctcacaagagaatccacactggggaaaagccttacgagtgtaacgtttgcaaaaagaccttctctcacaaggcaaatctgataaagcaccaacggatccatactggggagaagcccttcgagtgccctgaatgcggtaaagcgttcacgcaccagtccaacttaattgtgcatcagagagctcacatggagaaaaagccgtacgagtgcagcgagtgtggaaagacctttgcccaaaagtttgagctgaccacacatcagcgaatacacaccggcgagaggccctacgagtgcaatgagtgtgcaaaaacctttttcaagaaaagtaacctgattatccaccagaagatccacactggtgagaagagatacgagtgctcagagtgcggaaaaagcttcatccagaactcgcagcttattatccatatgcgcacacatacgggcgagaagccttatgaatgtacggaatgcggcaaaacgttcagccagcggagcactctgcggctgcacctgcgaatacatacgggcgagaagccctacgaatgctccgagtgtggcaaggcctttagccgtaagagccgactgtctgtgcaccaacgcgttcacattggagagaagccttag

SEQ ID NO: 21307 - DNA, 1602 bp, Artificial Sequence
  Description of Artificial Sequence: Synthetic coding sequence
atggcccacggcagcgtgaccttccgggacgtggccatcgacttctcacaggaggagtgggagtttctcgatccagcgcagcgggacctgtatagagatgtgatgtgggaaaactatagcaattttatcagcctcgggccaagtatctctaaacccgacgtgatcaccctcttggatgaggagcgaaaggaacccggcatggtcgtgagagagggcacacggaggtactgccctgatcttgagtcacgctacaggaccaacaccctgagccccgaaaaagatatctacgagatctattcttttcagtgggatattatggagaggataaagtcatactccttgcagggctctatatttcgcaacgattgggaatgtaaatcgaagattgagggcgagaaagagcagcaggagggctactttgggcaggtcaaaattaccagcgaaaagatgacaacttacaaaaggcacaactttctcaccgagtatcagattgtacacaacggcgaaaaagtgtatgaatgtaaggaatgtcgcaagacattcataaggcgcagcactttatcccagcacctcagaattcacaccggagaaaaaccctacaagtgcaaagaatgtggtcaggcttttcgtcagagggcccatctgattaggcaccacaaattgcataccggcgaaaagccctatgaatgcaaggaatgtggcaaggcattcactgtgctccaggagctgacgcagcaccaaaggcttcataccggggagaagccgtatgaatgcaaggagtgcggaaaagcctttagagtgcaccagcagctagccaggcaccagagaattcatacaggtgaaaagccatacgaatgtaaggactgcggtaagaccttcaggcagtgtacgcatttgacccggcaccagcgactgcacacggctgagaagctgtacgaatgcaaagaatgcggcaaggcgttcgtgtgcggaccagatctccgcgtacatcagaagatacacttcggagaaaagccgtatgagtgcaaggagtgtgggaaggccttccgaatctgtcaacagctgaccgtccaccagagtatccacacaggtgagaagccctatgagtgcaaggaatgtgggaagacgttccgcctgagacaacagctggtcagacaccaaagaattcacactagagagaagccatatgagtgcatggaatgttggaagacatttagttcctactctcagctaatcagtcatcagagtattcacatcggagaaaggccctacgagtgtgaagagtgtgggaaagcattccgcctgctctcccaactcactcagcatcaatctatccataccggcgaaaaaccatacgaatgcaaggaatgtcgaaagcccttccggttactgtcacagctgacccagcaccagtccatacacacaggtgagaagccgtacgagtgtaaagagtgtggcaaggcttttcgtctatatagcttcctgacccagcaccagaggatacacacaggagaaaagccgtataagtgcaaggaatgcaagaaagccttccgtcagcacagtcatttgacacagcaccaaaagattcacaacggaatatag

SEQ ID NO: 21308 - DNA, 1602 bp, Artificial Sequence
  Description of Artificial Sequence: Synthetic coding sequence
gtggcccacggcagcgtgaccttccgggacgtggccatcgacttctcgcaagaggaatgggagttcctggacccagctcagcgggatctgtacagagacgtcatgtgggagaactatagcaactttattagcttgggacccagcatcagtaaacctgacgtgatcaccttgcttgatgaggagcggaaggagccgggcatggtggttcgggaaggcacccgccgatactgcccagatctcgagtcccggtataggactaataccctttctccagaaaaagacatctacgagatctacagtttccaatgggatatcatggaacggataaagtcatatagcctgcagggatctatttttaggaatgattgggagtgtaagagcaagattgaaggcgagaaggaacagcaggagggttacttcggccaggtgaagataacatccgagaagatgactacatataagcggcataactttctcaccgaatatcagatcgtgcataacggggagaaggtgtatgaatgcaaagagtgtcgaaaaacattcataaggaggtctactctgtcccagcaccttcgaattcatacgggagaaaagccgtataagtgtaaagagtgtgggcaggccttccgccagcgcgcccatttgattagacaccataaactccacaccggcgagaaaccctacgaatgcaaggagtgcggcaaagcctttaccgttttgcaagagctgacccagcatcagaggctgcacacaggggaaaagccttacgaatgtaaggagtgcggaaaagcatttcgggtccaccagcagctagcacgccaccaacgaatccatactggagagaaaccttatgagtgtaaggactgcgggaagaccttcagacagtgcacgcatctgacaagacatcagaggcttcacacagcagagaaactgtacgaatgcaaggaatgtggcaaagccttcgtgtgtggcccagatctacgggtccatcagaaaatacatttcggggaaaaaccctacgagtgcaaagagtgcggcaaggccttcaggatttgtcaacaattgacagtccaccagtccattcatacaggtgaaaagccttacgaatgtaaggaatgtggaaagacctttcgcttaagacagcaactggttcggcatcaacgtatccacacccgagagaagccttacgaatgcatggaatgctggaagaccttctcaagctactctcagcttatatctcatcagtctatacatatcggcgagaggccatatgaatgtgaggagtgtggaaaggcctttagactgctgtcccagctcacccagcaccagtccattcacacaggtgaaaaaccgtacgaatgcaaagagtgtcggaaacctttccggttgttatctcaactaacacagcatcaatctatccacactggggagaagccttacgagtgcaaggagtgtggcaaggcctttagactttatagcttcctgacgcagcatcagcgaatacacacgggcgaaaagccttacaagtgcaaagagtgcaagaaagcgttcaggcagcacagtcacttaactcaacaccagaagatccataatgggatttag

SEQ ID NO: 21309 - DNA, 2265 bp, Artificial Sequence
  Description of Artificial Sequence: Synthetic coding sequence
atgaccaccgccggccggggcaacctgggcctgatcccccggagcaccgccttccagaagcaagaaggtcgacttacagtaaagcaggaaccagcgaaccagacatggggccagggctccagcttacagaagaactacccaccagtgtgcgaaatctttagactgcattttcggcagctatgctatcacgaaatgtctggcccacaggaggctctaagcaggctgagagaactgtgtcgatggtggctcatgcctgaagtccacaccaaggagcagatcctggaactccttgttctggaacaatttttgagcatcttgcctggagagctgcggacctgggtgcaactccatcatcctgagagtggggaagaagctgtggccgttgttgaggacttccagcgacacctatctgggagcgaggaggtgtctgcccccgctcagaaacaagagatgcactttgaggagaccacggctctcggtaccaccaaagagagccctcctacttctcctctttccggcggttctgctcctggggcgcatctcgagccaccttatgacccgggtacacaccacctcccctccggcgactttgcacaatgtacaagcccagtgccgaccctgccgcaagtcggcaacagcggcgaccaggccggggcaaccgtgttgcggatggtgagaccgcaggatacagttgcttacgaggacttatccgtggattatactcagaaaaaatggaaaagtcttaccctatcccagcgcgccctgcaatggaacatgatgcccgaaaatcaccacagcatggcctccctggcaggtgagaatatgatgaagggcagcgaacttacacctaagcaagagtttttcaaaggcagcgaatctagcaatcgcacttcaggagggctgttcggagttgttccgggggctgccgagactggtgatgtctgcgaggacacattcaaagagctcgaaggacagacctctgacgaggagggctccaggttggagaacgacttccttgaaataactgacgaagataaaaagaagtcaaccaaggacaggtatgacaagtacaaggaggtcggagaacatccaccgctttccagcagtccggtcgaacacgagggagtacttaagggccagaagtcatatcggtgtgatgaatgtggaaaagcttttaacaggagcagccacttaattggccaccagcgcatacacactggcgaaaaaccatacgagtgcaacgaatgtggcaagacgttccgccagaccagtcaactgatcgttcacctgagaacccacactggagaaaagccgtatgaatgctctgaatgtggcaaggcttaccgccacagcagccacctcatccagcaccaaaggctgcataacggcgagaaaccatacaagtgtaacgagtgtgccaaggcctttactcagtctagccggctcactgatcaccagagaacccatacaggcgagaagccatacgaatgtaacgaatgcggagaggcctttattcggtcaaaaagcttagcaagacaccaggtcctccatactggaaagaagccctataaatgtaacgagtgtggacgcgccttttgctccaataggaacttgatcgatcaccagaggattcacactggagaaaagccctatgagtgcagcgagtgcggcaaggcctttagtcgaagtaagtgcctcatcagacatcaaagcttacataccggtgagaagccatacaaatgcagcgaatgtggcaaagcctttaatcagaacagtcagctcatcgagcacgagaggatccatactggggagaagccctttgagtgtagcgaatgcggcaaagcctttgggctctccaaatgcctgattaggcatcagcgcctccatactggcgaaaaaccttataagtgcaatgagtgcgggaagtcattcaatcagaattcccacttaatcatccaccaaaggatccacacaggagagaagccatacgaatgtaatgaatgtggcaaggtgttctcatactcaagcagcttgatggtgcaccagcgtacccacacgggtgagaagccatacaagtgcaatgactgtggaaaggctttctctgatagcagtcagttaattgtgcaccagcgggtgcacactggagaaaagccatacgagtgttcggagtgtggaaaagctttctcacagcgtagcactttcaatcatcaccagcgtacccacacaggcgaaaagtcctcaggacttgcgtggtcggttagctag

SEQ ID NO: 21310 - DNA, 612 bp, Artificial Sequence
  Description of Artificial Sequence: Synthetic coding sequence
agcaagtgcctgatccggcaccagagcctgcacaccggcgagaagccgtacaagtgtagcgaatgtggaaaggcttttaatcaaaactctcagctaatagaacacgagcgtatacacaccggcgagaagccatttgagtgctcagaatgcggcaaggcctttggactgagtaagtgcctcatacggcaccaaaggttgcacaccggggagaagccgtataaatgcaatgaatgtgggaagtcatttaaccagaactcccatctgattatccaccagagaattcatacgggcgagaagccgtacgagtgcaatgagtgcggtaaggtgttcagttactctagctcactgatggtgcaccaacgcactcataccggtgagaagccatacaagtgtaatgattgtgggaaggcctttagtgatagctcacagttaatcgtccatcagcgcgtgcacaccggcgagaagccctacgagtgctcagagtgcggaaaagccttctcgcaaagaagcaccttcaatcaccatcagaggactcacacaggcgaagtcttgcgtagtggcctcgtgtcctttttgaggtacggctctgaaaccgaatctaacgatttatag

SEQ ID NO: 21311 - DNA, 831 bp, Artificial Sequence
  Description of Artificial Sequence: Synthetic coding sequence
atgaccaccgccggccggggcaacctgggcctgatcccccggagcacagcctttcaaaagcaggagggccgcctcactgttaaacaggagcccgccaaccaaacttgggggcagggctcttccctgcagaaaaattacccccctgtgtgtgaaatctttagactgcacttcaggcagctctgctaccacgagatgtccgggccgcaagaggccctttcccggctgcgcgaattgtgccggtggtggctgatgccagaggttcacaccaaggaacagatactggaactcctggtgctggagcagttcttatctatcttacctggagagctgcgcacctgggttcagttacatcaccccgaaagcggagaagaagcggttgccgtggtggaagattttcagcgacacctcagcggttccgaagaggtgtcagcccctgctcaaaagcaagagatgcactttgaggagactacagcactagggacgacaaaggagtctcctccgacgagccccctatccggagggagtgcccccggggcacatttggaaccaccctatgacccaggcactcaccatctgccgtccggggactttgcacagtgtactagtccggtgccaacactacctcaggtcggaaactcaggcgaccaagccggagccaccgtacttcggatggtgcggccccaagatacagtggcctacgaagacctcagcgtggactacacacagaagaagtggaagtcactgaccctgtcgcagcgcgcattacagtggaacatgatgcctgaaaaccatcacagcatggcatcactcggatggtctactatggcatag

SEQ ID NO: 21312 - DNA, 2265 bp, Artificial Sequence
  Description of Artificial Sequence: Synthetic coding sequence
atgaccaccgccggccggggcaacctgggcctgatcccccggagcacggcatttcagaagcaagaggggcggctcaccgtgaagcaggaacccgccaatcagacatggggccagggcagctcactccagaagaattatcctcccgtgtgcgagatatttcggctgcatttccgccagctgtgctatcacgaaatgtctggcccacaggaggctctctcacgcctaagggaactttgccgctggtggttgatgccagaagttcatacaaaagagcaaattctagagctccttgtcctcgagcagtttctgtccattctgccaggcgaactgaggacttgggtccaactgcatcaccccgaatccggcgaggaggcggtcgcagtcgttgaagacttccagcgacatctctccggcagcgaagaggtatcagccccggctcagaagcaggaaatgcatttcgaagagaccacggccctgggtaccaccaaagaatcgccaccgaccagtcctttgtcagggggctccgcaccaggtgctcatctcgaacccccctatgacccagggacccaccatctaccaagcggtgacttcgcccaatgtacatcaccagtacccactcttccccaagtcggcaacagcggtgaccaggccggggcaaccgtgctgcgcatggtccgcccacaggatacggtcgcgtacgaggatctgagcgtggactatacacaaaagaaatggaaatccctcaccctatcacaaagagctctccagtggaacatgatgcccgaaaaccatcatagcatggcttctctcgccggtgagaatatgatgaagggaagcgaacttacgccaaagcaggagtttttcaagggaagcgaatcatcaaacagaacctccggcgggttattcggcgtggtacccggcgctgccgaaaccggggacgtgtgtgaagataccttcaaggagttagaagggcagactagcgatgaagaaggtagccgcctggagaacgacttcctggagataactgacgaggacaagaaaaaaagtaccaaggatcggtacgacaaatacaaggaagtcggtgagcaccccccattgtctagttccccagtagagcatgaaggggtgctcaaaggacagaagagctatagatgtgacgagtgcgggaaagctttcaatagatctagccacctaattggtcatcagcggattcacactggagagaagccttacgagtgtaacgaatgtggcaaaacttttcgccagacatcccaacttattgtccatctgcggactcatacaggagaaaagccgtacgagtgttcggaatgtggaaaagcgtaccgccacagtagccacctgatccagcatcaaagattacacaatggtgagaaaccatacaaatgtaacgagtgcgctaaggctttcacacagagttcccgtttaacagatcatcaacgcacacacacaggcgagaagccatacgagtgcaatgagtgtggagaggcctttattcggtccaagagtttggcccggcaccaggttctgcacacgggcaagaaaccctataaatgcaacgagtgtggccgggccttctgcagcaacaggaatctgatcgaccaccaaagaattcataccggcgagaagccgtacgagtgctcagaatgtggcaaggccttctcaaggtcaaagtgcctgattagacaccagtcactgcacaccggagaaaaaccatacaagtgtagcgagtgtggcaaggcgttcaaccagaatagccagttaatcgagcacgaacgaatacacactggggaaaaaccattcgaatgttcagagtgcgggaaagcttttgggctttccaagtgtttaattcgtcatcagaggctgcacacaggagaaaagccatacaaatgtaacgagtgcggcaagtcctttaaccagaactcacacctgatcatacaccagcgaattcacaccggcgagaaaccatacgaatgcaacgaatgcggcaaggtgtttagttactcctcttcacttatggttcaccagaggacgcatacaggagaaaaaccatataagtgcaacgattgcggcaaagcattctccgactcttcccagctcattgtgcatcagcgtgttcacactggggagaaaccctacgaatgtagtgaatgcggtaaggctttcagccagaggtccacctttaatcatcatcagaggacccacacaggagagaagagttctggccttgcctggagcgtgtcatag

SEQ ID NO: 21313 - DNA, 831 bp, Artificial Sequence
  Description of Artificial Sequence: Synthetic coding sequence
atgaccaccgccggccggggcaacctgggcctgatcccccggagcaccgccttccagaagcaggaaggaaggctcaccgtcaaacaagagcctgccaatcagacgtggggtcagggcagctcccttcagaagaattatcctcctgtatgcgaaatttttaggctgcatttccggcagctgtgctatcatgagatgtctggaccacaggaggcactgtctaggctccgggaactttgccgctggtggctcatgccggaggtccacacaaaggagcagatcctggaattgcttgttcttgagcaatttctttccattctgccaggcgagctacgcacctgggtgcaattgcaccatcccgaatcgggggaggaagctgtagccgtggtggaggattttcagagacacctgagcggtagcgaggaagtctccgcccccgcacagaaacaggagatgcacttcgaggaaaccacagcccttggcacgacgaaggagtctcctccaacatctccgctgagtggaggctcagccccaggagcacacctagaacccccctacgaccccggaactcaccaccttccatctggtgacttcgcacaatgtacctctccggtgcccacgcttccacaggtggggaattcgggagaccaggctggggcgacggttctgcgtatggtgcgccctcaggatactgttgcatacgaggatctgtccgttgactatacgcagaagaaatggaaatcactcactctgagccagcgagccctgcaatggaatatgatgcccgaaaaccaccattctatggcatctctcggctggtctactatggcatag

SEQ ID NO: 21314 - DNA, 1989 bp, Artificial Sequence
  Description of Artificial Sequence: Synthetic coding sequence
atgaacctgaccgaggactacatggtgttcgaggacgtggccatccatttctcgcaggaagagtgggggatcttgaatgacgtgcaacggcatctgcactccgacgtcatgctggagaattttgccctgctgagctcagtaggatgttggcacggtgcaaaggacgaagaagctcctagtaagcagtgcgtgtccgtcggcgtcagccaagtgactacactcaagcccgccctatcgacacagaaggcgcagccgtgcgaaacttgttcttctttgctgaaggacatccttcatcttgccgaacacgatggtacacaccctaagcgtaccgcaaagctctatctgcatcaaaaggaacatctgcgcgagaagctgacccgcagtgatgaggggcgtccgtcctttgtgaatgactccgtccacctagcgaagcggaaccttacctgcatgcagggtggaaaggactttaccggggactccgatttacagcagcaagccctgcactccggatggaagccccaccgggacactcacggcgtggaggcattccagtcaggccaaaataattactcttgcacccaatgtggaaaggatttttgtcatcagcataccctatttgagcatcaaaagatccacacggaagaacggccttatgagtgttctgaatgtggcaagctcttccgctacaattctgatctcatcaaacaccagcggaaccatacaggcgaacgcccctacaaatgctccgagtgtgggaaggcattcagtttaaagtataacgtggtccagcaccagaaaattcatacaggcgaacgcccctatgagtgcagtgagtgtggcaaagcattcctgcggaagtcgcatttgttacagcaccaaaggatccacaccaggccccggccttacgtgtgtagcgaatgcggtaaggctttcctaacccaggcgcaccttgtcggtcaccagaagatccataccggagaacgcccatatgggtgcaacgaatgtggcaagtacttcatgtactcaagtgcactgattaggcatcagaaggttcacacgggggagaggccgttttactgctgtgagtgtggcaagttcttcatggactcctgtactctgatcatccaccagcgcgttcatacaggagagaaaccttatgaatgcaatgaatgcgggaagtttttccgctatagatctactctgatcaggcaccagaaggtccacaccggcgaaaaaccttacgaatgcagtgagtgcggcaagttcttcatggacacttccactctcatcatccatcaacgcgtgcatactggagagaaaccgtacgagtgcaataagtgcggcaagttcttcaggtactgtttcactttgaatcggcaccagagggtgcactcgggcgaacgaccgtacgaatgttcagagtgcggtaaatttttcgtagactcctgcacactgaagtctcaccagagggtgcatacaggagaacgccctttcgagtgcagcatatgcgggaagagctttcggtgcaggtctaccctggatacacaccaacgcattcacactggggagcggccatatgagtgtagcgagtgcgggaaattttttcggcacaatagtaaccacatccggcacagacggaatcacttcggcgaaaggagttttgagtgcactgagtgcgggagagtctttagccaaaacagccacttgattcgccatcagaaggtacacaccagagaaagaacatacaagtgtagcaagtgcggcaagttttttatggactcaagtacactgatctcccatgagagagtccacacaggcgaaaaaccttatgagtgcagcgaatgtggtaaggtcttcaggtataactcaagcctcataaaacaccggcgaattcacacaggcgagcgaccttatcaatgcagtgaatgtggtagagtgttcaaccagaatagccacttgattcaacatcagaaggtgcacaccaggtag

SEQ ID NO: 21315 - DNA, 1989 bp, Artificial Sequence
  Description of Artificial Sequence: Synthetic coding sequence
atgaacctgaccgaggactacatggtgttcgaggacgtggccatccacttctcacaggaggaatggggtatcctgaacgacgtacagagacacctccactccgacgttatgctggaaaacttcgcattgttgtcttctgttgggtgttggcacggagccaaagacgaggaagcccccagtaagcaatgtgtatccgttggcgtgagccaagtaaccactctgaaacctgcattgagcacccagaaggcgcagccatgtgagacctgcagctctctgttgaaggatattctgcatctggctgagcacgacggaacacacccgaaaagaactgccaaattgtatcttcaccagaaggaacacctgcgcgagaagttaactcggagtgacgaaggcagaccgtcctttgtaaatgacagtgtgcacttggcaaagagaaatttgacttgtatgcagggcgggaaggatttcacaggcgacagcgatcttcagcagcaggccctccatagtggttggaagcctcatcgcgacacacacggggtggaagcctttcagagcggccaaaataattattcctgcactcagtgcggtaaagatttttgccaccagcatactctgttcgaacaccagaaaattcacacagaagaacggccttacgaatgctctgagtgcggtaagctttttagatacaacagcgatttgatcaaacaccagagaaatcacaccggggaacgtccatataaatgtagtgaatgcgggaaggctttcagcctgaagtataacgtagtgcagcatcagaagatccacacaggtgagaggccctatgagtgctccgaatgcgggaaggccttcctcagaaaaagccacctgctacagcaccagcggattcatacacggccgcgtccctacgtgtgcagcgagtgcggaaaggctttcctcacgcaggcacacctggtcggtcaccagaaaatccacaccggagaaagaccgtacggatgtaatgaatgtggtaaatacttcatgtactcttcggccctcatccgccaccaaaaggtacatacaggagagagacctttttattgctgtgagtgcggaaaattctttatggattcatgtacgctcatcattcaccagcgtgtgcacacaggcgaaaagccctatgaatgtaacgaatgtgggaaattttttcggtatcgctctacacttatccggcaccagaaggtccacactggggaaaagccttatgagtgttccgagtgcggtaagttttttatggataccagcacgctgattatccaccaaagagtccacactggggagaaaccctacgagtgcaataagtgtggtaaattctttaggtactgtttcacattgaatcggcatcaacgagttcatagcggcgagaggccctacgagtgttcagagtgcggtaagttctttgtcgatagctgtactctgaagagccatcagagagtccatacaggagaacgtccttttgagtgtagtatctgtgggaaatcatttagatgtcgctcaactctggacacccaccagcggatccacaccggtgaaaggccctatgagtgcagtgaatgcggaaagttcttcagacataactccaaccacatcagacacaggcggaaccattttggagaaagaagcttcgaatgcaccgagtgcggaagagtgttctcgcaaaattcccacctaatacgacaccagaaggtccacacacgagaacgcacttataagtgcagcaagtgtggaaaattcttcatggactcatccacactgattagccatgagagagtccatacaggcgaaaagccctatgagtgctccgaatgtggcaaagtgttccgctacaactcctctcttatcaagcatcggcgcattcatactggggaaaggccgtatcagtgctccgagtgcggtagagtttttaatcagaactcgcatctgatccagcaccagaaggtgcatactcggtag

SEQ ID NO: 21316 - DNA, 3090 bp, Artificial Sequence
  Description of Artificial Sequence: Synthetic coding sequence
atgacccgggagaacgtggcccacaacgccctgcggcaggagggcttagtcaaagggaaagacgacacttggaagtgggggacttcattccagggttccagctcatccgtatgggagacgagccaccttcatttcaggcagttacgataccatgagactagcggacctcaggaggcactcagcaggttacgggaactttgccggaggtggttgagacctgaagcacggaccaaagcccagattctggagctgctcgtccttgagcaattcctgtccatcctgccaggagagatccgtacttgggtgcagctccaccaccccgggagcggagaagaagcagttgccctggtggaagagctccagaaggacctggacgggcccgcaatccaggtgcctgtgttggttaaggaccaagacactttgcaaaaggtcgtgtccgcccctggcacgaccttgcctcccgtcctgccagggagtcatatcgctgctgaaatatgcccacatccaccaacggatctggtggctttcaacctgcaagacccacagcacgactctcctgcccccgaagccagcgcgctgagtcaggaagagaaccctcgaaatcaactgatggctcttatgctgttgacagcccaaccccaggaacttgtaatgttcgaggaagtttcagtctgctttacatctgaggagtgggcatgcctgggacccatacagcgcgcattgtactgggacgtgatgttagaaaactatgggaacgtgactagccttgagtgggagacgatgacagagaacgaggaggtcacttctaagcctagctccagtcagcgcgcagactcccacaagggaacgagtaagagacttcaaggatctgtgccgcaagtgttggacttcgaagaagagtgcgagtggcaggtactggcatcccagtggggcaacgaaacagatgaaagggccgatacagttaaaaaggtgtcattgtgcgagcgcgacaaaaagaaacgcacgcccccagagaaacaggggcagaaatggaaggaactgggcgattccctgactttcggtagcgcaatttcggagagcttgattggaacagaaggcaaaaagttctacaagtgcgacatgtgctgtaagcactttaacaagatctcccacctgataaaccacagaaggattcatacgggggagaagccgcacaagtgtaaagaatgtgggaagggcttcatccagcgcagttctcttctgatgcacctgcggaaccatagcggggaaaagccttacaagtgtaacgaatgtggtaaggcattttctcagtctgcttacttgctcaatcaccagaggattcacacaggggagaagccctacaaatgcaaggaatgcggtaagggattctatcgtcactctggcctgattattcatctacgccgacactcaggcgagaggccctacaagtgtaacgaatgtggaaaggtgttcagccagaacgcatacctgatagatcaccagaggcttcataaaggggaggagccatacaaatgtaacaaatgtcagaaagcctttatcctgaagaaatctttgatcctgcaccagcgcattcattcaggagaaaagccgtacaaatgtgacgagtgtggcaaaacgttcgcccagaccacatatctaattgaccatcaaaggctgcacagcgcggagaatccctataaatgcaaagaatgcggaaaagtgttcattaggtcaaagtccttgctccttcaccagcgtgtgcacactgaaaagaaaaccttcggttgtaaaaagtgcggtaagatattctcctctaagtcaaactttatcgatcacaagcgtatgcacagccgcgagaaaccatacaagtgcaccgagtgcggaaaggcctttacccagagtgcctatctattcgatcaccagaggctccacaatggcgagaagccttatgagtgcaatgaatgtggcaaagtgtttatcctgaaaaaatcactgatcttgcatcagaggttccatacaggagaaaatctttacgagtgcaaggattgcggaaaggtctttggctcaaatagaaaccttatagatcacgagcgtttacataatggcgagaaaccctacgaatgccgcgagtgcggaaagacctttatcatgagcaagtctttcatggtccaccaaaaattgcatactcaggagaaggcttacaagtgcgaggattgcggcaaggcattttcatacaactcctcacttctggtacaccgaagaatccatacaggagagaaaccctttgaatgcagcgagtgcggcagggccttctcttccaacaggaacctcatcgagcacaaaaggatccacagcggcgagaaaccttatgagtgtgacgagtgtggcaaatgcttcattctgaagaagtccttgatagggcaccagaggatccatacccgggagaaaagctacaagtgcaacgattgcggcaaagtgttcagctacagaagcaatctcatcgctcaccagcggattcacacaggagaaaagccgtacgcttgctcagagtgcggcaaaggattcacctataatcgcaatctaatcgaacatcagagaattcattctggggaaaaaacttacgagtgccatgtgtgccggaaggtgttaacatccagtagaaacttgatggttcatcagcgcattcataccggagagaagccttacaagtgcaacgaatgtgggaaggacttctcccagaataaaaacctcgtggtccatcaacgcatgcacaccggcgagaagccgtacgaatgcgacaaatgtagaaagtcgttcaccagtaaacgcaatctggtgggacaccagcgtatccataccggagaaaagccctacggttgtaacgattgttctaaagtgttcagacaacgaaagaacctcaccgtccatcagaagattcatactgatgagaagccctgcgaatgcgatgtcagcgaaaaggaattctcccagaccagtaacctgcacctgcagcagaaaatccatactatcgaggagttcagctggcttcagaatacaaacgagtcaaagatcgaaatccagaagatctag

SEQ ID NO: 21317 - DNA, 804 bp, Artificial Sequence
  Description of Artificial Sequence: Synthetic coding sequence
atgacccgggagaacgtggcccacaacgccctgcggcaggagggccttgtgaaggggaaagacgatacctggaagtggggaacttcattccaagggagctctagcagcgtatgggaaacctcccacctgcattttaggcagttacgttaccacgagacgagcggaccccaggaggccctttccagacttcgagaactatgcagaagatggttacggcccgaagcgcgaacaaaagcccaaattctggaactgcttgtgctggagcaattcttatcaattctcccaggagagataaggacctgggtgcagctccatcaccctggatctggcgaagaggccgtagccctggtggaagagctccagaaagatcttgacggacccgccatccaggtgccagttttggtgaaagaccaggataccctacagaaggtagtgtctgctcctgggaccactctccctcctgtcctccccggttctcacatagctgcagagatatgcccccatcctccgacagacttggtcgcttttaatctgcaggacccccaacatgattctcccgcccctgaggctagcgccttgagtcaagaagagaacccacggaatcaactcatggcactgatgttgctgacagcccaaccccaggaacttgtaatgttcgaggaagtctctgtttgttttacatctgaggaatgggcttgtctgggtcctatccagagagccttgtactgggatgtgatgttggagaattacggcaacgtcacgagcctcggataccggaaataccgacgccaaaggaacaagtag

SEQ ID NO: 21318 - DNA, 804 bp, Artificial Sequence
  Description of Artificial Sequence: Synthetic coding sequence
atgacccgggagaacgtggcccacaacgccctgcggcaggagggcctcgttaaagggaaggatgatacctggaagtgggggactagtttccagggttccagctcttccgtgtgggaaacgagccatctgcacttccgccagctacgttatcatgagacttctggcccccaggaagctctaagccggctccgtgaactgtgtcggaggtggctgcgtcctgaagcccgtaccaaagcacagattcttgagctgctagtgttagagcaattcctcagcattcttccaggcgaaatacgcacttgggtacagttgcaccatccaggcagcggcgaggaagctgtcgccctggtcgaagagcttcagaaggacctggatggccctgctattcaagtcccagtcttagtaaaggatcaagatacactccagaaggttgtcagtgcccctggtacaaccctgcctcccgtacttcccggaagccacatagcggcggagatatgcccccatccccctacagaccttgttgccttcaacctccaagatcctcagcatgacagtccagccccggaggcatctgctctctcacaggaggaaaaccccagaaatcaacttatggcactaatgctgcttacagcgcagccccaggaactggtcatgttcgaggaggtaagcgtgtgctttacgtccgaagaatgggcttgtctgggcccaatccagagggcgttgtactgggatgttatgttagaaaattatggcaatgttaccagtctaggctacagaaagtataggcgacagaggaacaaatag

SEQ ID NO: 21319 - DNA, 3090 bp, Artificial Sequence
  Description of Artificial Sequence: Synthetic coding sequence
atgacccgggagaacgtggcccacaacgccctgcggcaggagggccttgtcaagggcaaggatgatacgtggaaatgggggacatccttccagggttcctccagctctgtttgggaaacctcccatctgcatttccgccagcttaggtatcacgagacatccggaccccaggaagcgctgagtcggctgcgggagctgtgccgtagatggctgcgccctgaagcccgcaccaaagctcagatcctggaactgcttgttcttgagcaattcttatcgatacttcccggcgaaatccgcacctgggtccagctacaccatcctggttcaggagaagaggccgtggctcttgtggaagaactgcaaaaggatctggatggtcccgccattcaagtcccggttctggtgaaggatcaggataccctgcagaaggttgtgtcagcccctggaaccacattacctccagtcctgccaggctcccatatcgccgccgaaatctgtccccatccccccaccgatctggtggcatttaacctccaggatccccaacatgattctcccgctcccgaggcctctgctctttctcaggaggagaaccccagaaaccaactgatggcattaatgttgttgacagcgcagccacaggagctcgtgatgttcgaagaagtttccgtgtgttttacctctgaggaatgggcttgtctgggaccaatacagcgggccctctactgggacgttatgttggagaattatggcaacgttacttcactcgagtgggaaaccatgacagaaaatgaggaggttactagtaagcccagcagctcacagcgtgccgatagccataaaggaacctctaaacggctgcaggggtcagtaccacaggtattagatttcgaggaagagtgtgagtggcaagtgttagctagccagtgggggaacgagacagacgaacgagctgatacagtaaaaaaagtgtccttatgcgagcgggacaagaagaagcggacgccccccgagaagcagggacagaagtggaaagaactcggagatagcctgaccttcggaagcgcaatttcagagtctctcattgggactgaaggaaagaagttttataagtgtgacatgtgctgtaaacattttaacaagatcagccacctcattaaccatcgtagaatacatactggggaaaagccccacaagtgcaaggagtgcggaaaaggatttatccagcgatccagtttgttgatgcatctgagaaaccactcgggagagaaaccatataaatgtaacgagtgcggtaaggccttctcccagagtgcctacctcttgaatcatcaaagaattcatacaggggagaagccatacaaatgtaaggaatgtggtaaagggttttaccgtcactccggtctgatcatccatctgcgacgccacagcggcgagcgtccatacaagtgcaatgaatgcggcaaggtatttagccaaaacgcgtatctgattgatcaccaacggctgcataagggtgaggagccgtataagtgtaataaatgccagaaagcttttatcctgaagaagtctctgattctccatcagagaatccatagtggagaaaaaccttataaatgcgacgaatgcggaaaaacattcgcgcagactacttatctaattgaccaccagcgccttcactcggccgaaaacccctacaagtgcaaagaatgtggcaaggtgtttatccgcagcaagagtctgctcctacaccagagggtgcacacagaaaagaagaccttcggctgcaagaagtgcggcaaaatttttagctccaaaagtaatttcatagaccataagcgtatgcactcccgcgagaagccctataaatgtaccgagtgtggtaaagctttcacccagagcgcttatcttttcgatcaccagaggctgcataatggagagaaaccatatgagtgcaatgagtgcgggaaggtcttcatactgaaaaaaagcttaatcctccatcagcgttttcacacgggagagaacctctatgagtgcaaagactgcggtaaagtgttcggatctaacaggaatcttatagaccacgaaaggcttcacaacggagaaaaaccatacgagtgcagagaatgcggaaaaaccttcatcatgagcaaaagcttcatggtgcatcaaaagctgcacacacaggagaaagcttacaaatgcgaggattgtggcaaggcttttagttacaactctagtttgctggtgcacaggagaatccataccggcgagaaaccgtttgaatgtagcgaatgcggccgcgcattttctagcaaccgaaacctcatcgagcacaagaggatacacagtggcgagaaaccctatgaatgcgatgaatgtggaaagtgcttcattttgaaaaagagcctcataggacaccaaaggatccatacaagagaaaagagctataagtgcaatgactgcgggaaggtgttcagctaccggagcaacctgatcgcacatcagcggatacataccggtgaaaagccttacgcatgtagtgaatgtggaaagggattcacatacaaccggaacctgattgagcatcaacgcattcacagcggagagaagacctatgaatgccatgtgtgccggaaagtgctcacctcttcccgcaatctgatggtgcatcagaggatccacaccggggagaaaccctataagtgcaatgagtgcgggaaggactttagtcagaataaaaacctagtggtgcaccagcgaatgcacactggagaaaagccatacgaatgcgacaaatgccgaaaatcatttacgtccaaaagaaatctcgtcgggcaccagcgaatccacaccggagaaaaaccttacggctgtaatgactgcagtaaggttttccgccagcgcaagaatctgactgtgcaccaaaagatacataccgatgagaaaccctgcgagtgtgatgtgtccgaaaaagagttctcgcaaacgtctaacctgcatctgcagcagaaaatccacacaatcgaagaatttagttggctgcagaatacaaacgagtctaagatcgaaatccaaaaaatttag

SEQ ID NO: 21320 - DNA, 240 bp, Artificial Sequence
  Description of Artificial Sequence: Synthetic coding sequence
atgacccgggagaacgtggcccacaacgccctgcggcaggagggcctggtaaaaggcaaagacgacacctggaaatggggaacctcatttcaaggcagtagctcctccgtctgggagacctctcacctgcactttaggcagctccggtaccatgaaacctcaggaccccaggaggccctgagtaggttaagagagctttgcaggcgctggttaaggccagaagcccgcaccaaggcctag

SEQ ID NO: 21321 - DNA, 966 bp, Artificial Sequence
  Description of Artificial Sequence: Synthetic coding sequence
atgacccgggagaacgtggcccacaacgccctgcggcaggagggcttggtgaaaggaaaggacgatacatggaagtggggcacttctttccaggggtcctcctcgagcgtgtgggaaacgtctcatttgcacttccggcaactcaggtatcatgagacctccggcccccaggaagctttgagccggcttcgggagctttgcagacgctggctccgacctgaagctcgaactaaggcccagatcttagagctgctggtgctcgaacagttcctgtctatccttccaggagagatcaggacgtgggtgcagctccaccaccctggaagcggcgaggaggcagtcgctctggtggaggagctccaaaaggaccttgacggaccagcaattcaggtgcctgttctggtgaaggatcaggatacgctgcaaaaagtggtgagtgcccccggcacaacgctgccaccagtgctgcctggtagccacatcgctgcagaaatctgcccgcatccccccaccgatttagtggcctttaacctacaggatcctcaacatgattctcctgcgccggaggccagtgcactaagccaagaggagaacccgcgcaatcagttgatggccttaatgctgctgactgcacaaccccaggagctcgttatgttcgaggaggtcagcgtgtgctttacttcagaagaatgggcttgtctgggccctatccagcgtgccctctactgggacgtcatgcttgagaactatggaaacgttacgagtctcgaatgggagaccatgaccgagaacgaggaggtgacatcaaaacctagttcctcgcagcgggctgactcccataaagggacctccaagaggcttcaaggatctgtcccacaggtgttagattttgaagaggagtgtgagtggcaggtgctggcttcacagtgggggaatgaaactgacgagcgagccgataccgtctag

SEQ ID NO: 21322 - DNA, 1386 bp, Artificial Sequence
  Description of Artificial Sequence: Synthetic coding sequence
atggagcgggagggcatctggcacagcaccctgggcgagacctgggagcccaataattggctagagggtcagcaggattctcacctgtcgcaggtgggtgtgacgcacaaggagactttcacggagatgagggtgtgcgggggtaacgaatttgaaaggtgttcaagccaggactctatcctcgacactcagcagtcgatacctatggttaagcgccctcataactgcaatagtcatggggaggatgcgacccaaaattcagaactaatcaagacccagcgcatgtttgtgggcaagaagatctatgagtgcaaccagtgctcaaaaacctttagccagtctagctctttactgaaacaccagaggatccacaccggagagaagccctataagtgtaatgtgtgcggaaaacacttcattgagcgttcgtcattaactgttcatcaacggatccatacaggcgagaaaccctataaatgtaacgagtgcggcaaagcgttctctcaatctatgaatctgacagtacaccagagaactcataccggagagaagccgtaccaatgtaaagagtgcggcaaggccttccataaaaactcttcgctcattcagcacgaacggattcacactggcgagaaaccttacaagtgcaatgaatgcgggaaggcattcactcaatccatgaatctgacagtgcatcagcgcacccacactggtgaaaagccttacgagtgtaacgaatgtggcaaagcattctcacagagcatgcacctcattgtacatcagcggtcccatactggcgagaagccatacgaatgcagccagtgtggtaaggcttttagcaagtccagcacgctcacgcttcaccagcgaaaccacactggcgagaaaccatacaaatgtaataaatgtggaaaatcattttcacagagcacttacctgattgagcaccaacggctgcatagcggcgtcaagccatttgagtgtaacgagtgtggcaaagcattttcaaagaacagctccctgacccaacatcggaggatccacacaggagagaaaccctatgagtgtatggtttgtgggaaacattttaccggacggagctctttgactgtacaccaggttattcatactggagagaaaccctatgagtgcaatgaatgtgggaaagcctttagtcaaagtgcctatctgattgagcatcagaggattcatacgggcgaaaagccttacgagtgcgaccagtgcggcaaagcttttatcaaaaacagcagcctgaccgtgcaccagaggacgcacactggggaaaagccctatcagtgtaacgagtgtggtaaagccttctctagatccacgaatctgacacgtcatcagagaacccatacttag

SEQ ID NO: 21323 - DNA, 1386 bp, Artificial Sequence
  Description of Artificial Sequence: Synthetic coding sequence
atggagcgggagggcatctggcacagcaccctgggcgagacctgggaacctaacaactggctagaggggcaacaagactcacatttgagtcaggtcggtgtcactcacaaagaaacatttacggagatgagggtgtgcggcggcaacgaattcgagcgatgctcatcccaggacagcatcctggacacgcagcagagcatccccatggttaaacgcccccataattgcaatagccacggcgaggacgctacgcaaaacagcgagctgattaaaacacagcgtatgtttgtcggaaaaaagatttacgaatgcaaccagtgtagtaaaacttttagccagtctagttctctgttgaaacaccagcggattcatacaggagaaaaaccatataagtgcaatgtgtgcggtaagcatttcatagaacgatcaagcctgacagtgcaccaaaggatccatacaggtgaaaaaccttataagtgcaacgaatgtggcaaggcttttagccagtccatgaatctgactgtgcatcagcgtacacacaccggtgaaaagccataccagtgtaaggagtgcggtaaggcctttcataagaactcatcgctgatacagcacgagaggattcacactggcgagaaaccatacaaatgtaatgagtgcggaaaggccttcactcagagtatgaatcttactgtccatcagcgaacccatactggagaaaaaccctatgaatgtaacgagtgtggaaaggcctttagccagagcatgcatctgatcgttcatcagcggtcacataccggagagaaaccatatgagtgttcacagtgtggcaaagccttcagcaaatcctccacccttactctgcatcagagaaatcataccggtgagaagccctataaatgcaacaaatgtggtaaatctttctcgcagagtacttacctgatcgaacatcaacgcttgcatagcggggtgaaaccattcgagtgcaatgaatgcggtaaagccttttcgaagaacagctctctcacccagcaccgaaggattcacaccggtgagaagccatatgagtgtatggtctgtgggaaacactttaccgggagatcttcactaacagtgcatcaagtaattcacaccggagaaaagccttacgagtgtaacgaatgcggcaaagccttctcgcaaagcgcttatctcatagagcatcagcggatccacacgggagagaagccctacgagtgcgaccagtgtggtaaggcctttatcaagaatagctctcttactgtgcatcagcgaactcacacaggggaaaaaccttaccagtgcaacgaatgtggaaaggcttttagcagatctaccaatctgactaggcaccagcgaacccacacatag

SEQ ID NO: 21324 - DNA, 1386 bp, Artificial Sequence
  Description of Artificial Sequence: Synthetic coding sequence
atggagcgggagggcatctggcacagcaccctgggcgagacctgggagcctaacaactggcttgagggccagcaagacagtcatctttcacaagttggtgtcacgcataaggagacattcacagagatgagagtgtgcggtggaaatgaatttgagcgctgctctagtcaggactctatactagacacacaacagtcaatcccaatggtgaaaagaccacataattgtaactcccatggggaggacgctacccagaactcagaactaataaagacccagcgcatgtttgtgggaaaaaaaatctatgagtgcaaccaatgctcaaagacattttcccaaagttcctcacttttgaagcaccagagaatccataccggtgagaaaccctacaagtgcaatgtgtgtggcaaacacttcattgagcggtcctcgctgaccgttcatcagaggatccatacaggtgaaaaaccctacaagtgtaacgagtgcggcaaggcgttcagccagtccatgaatcttaccgtccatcaacggacgcataccggagagaagccctatcagtgtaaggagtgcggcaaggcatttcacaaaaacagtagcttaatacagcatgagcgcattcataccggggaaaagccctataagtgtaatgaatgcgggaaagcttttactcaaagtatgaacctgactgttcaccagcgtacgcatacaggggaaaagccctatgaatgcaacgagtgtggtaaggcctttagccagagcatgcacctgattgtgcatcagaggagccacacaggggagaaaccctatgaatgctcccagtgcggcaaggcgttctccaagagcagtacactaactctccatcagcgcaatcacacaggggagaagccatacaaatgtaacaaatgcggaaaaagcttttcgcaatcgacatatctcattgaacatcagcggctgcacagtggtgttaaaccctttgagtgtaatgagtgcggtaaggcgttctccaagaacagttccctgacacagcaccgtcgtatacacacaggagagaaaccctacgaatgcatggtgtgcggaaagcacttcacaggcagatcctccctgactgttcaccaggtgatccataccggtgagaaaccctatgagtgtaatgagtgcggtaaagccttctcgcagtcagcctacctgatcgaacaccagcggattcatactggggagaaaccctatgagtgcgatcagtgtggaaaggcattcatcaagaattcaagcctgactgtgcaccaacgcacacacaccggcgaaaagccgtaccagtgcaacgaatgcggtaaggctttcagccgatctaccaatcttactaggcatcaaaggacgcatacatag

SEQ ID NO: 21325 - DNA, 72 bp, Artificial Sequence
  Description of Artificial Sequence: Synthetic coding sequence
atggagcgggagggcatctggcacagcaccctgggcgagacctgggagccaaacaactggctcgaggggtag

SEQ ID NO: 21326 - DNA, 30 bp, Artificial Sequence; identical to SEQ ID NO: 17624
  Description of Artificial Sequence: Synthetic coding sequence

SEQ ID NO: 21327 - DNA, 1386 bp, Artificial Sequence
  Description of Artificial Sequence: Synthetic coding sequence
atggagcgggagggcatctggcacagcaccctgggcgagacctgggagcccaataactggctagaaggccagcaggatagtcacctttctcaagtgggcgttacacataaggagacattcacagaaatgagggtctgcggcgggaacgagtttgaaagatgcagttcccaggattctatcctcgacactcagcagtcaatccctatggtcaaacgtcctcacaactgtaactcccatggggaagatgcaacccaaaacagcgaactcatcaagacccagagaatgtttgtgggcaaaaagatctatgaatgtaaccagtgttccaaaactttctcgcaatcaagctctctgttgaagcaccagaggatccacacaggagaaaagccgtataaatgcaacgtgtgcggcaagcatttcatagaaagaagctctctcacagtgcaccagcgcattcataccggagagaagccatataaatgtaacgagtgtggtaaggcattttcccaatccatgaatcttactgttcaccagcggacccacactggggagaagccttatcagtgtaaagaatgcggtaaggcgtttcacaaaaatagtagtttgatccaacacgagaggatccataccggcgaaaagccttacaagtgtaacgaatgcgggaaagcctttactcaaagcatgaacctgacagttcatcagcggacacacactggggaaaaaccttacgagtgcaacgagtgtggaaaagcgttctctcagtctatgcacctgatcgtacaccagcgaagccacacaggcgagaagccatatgagtgctcccagtgtggcaaggcttttagcaagtcttccaccctcacactgcaccagcgcaaccataccggggagaagccctacaaatgcaacaagtgtgggaaatcattcagtcagagcacttatctgatcgagcaccagcgcttgcattccggcgttaagcctttcgaatgcaatgaatgtggcaaagcttttagtaaaaactcttccctgacacagcatcggcgtatccacaccggtgagaagccatacgagtgcatggtgtgtggtaaacacttcacaggtcggtcttctctcactgtgcaccaggtgattcacactggagagaagccttatgagtgcaatgaatgcggtaaagcattctcccagtctgcttatcttatcgaacaccagagaatccacacaggcgaaaagccttatgagtgtgaccagtgcggtaaagcgttcatcaagaatagttctcttaccgtgcaccagcggacacacactggagagaaaccttaccagtgtaacgagtgcggcaaggcattttcaaggagtactaatttaacacgccaccaacggacgcacacctag

SEQ ID NO: 21328 - DNA, 1734 bp, Artificial Sequence
  Description of Artificial Sequence: Synthetic coding sequence
atgctgggcttcccccccggccggccccagctgcccgtgcagctgaggccccagacaagaatggctacagctttgcgggacccagcttcagtgcccatcgcgactgaagtgctgttcaagttgactcagggatctgtgacattcgaggacgtcgcagtctatttctcctgggaggagtgggatctcttagatgaggctcagaagcacctgtattttgatgtaatgctcgagaattttgccctgacatcatccttgggatgttggtgtggggttgaacacgaagagaccccgtccgaacagaggattagcggcgagagagttccgcagttccggacatcaaaagagggctcgtcctcacaaaacgccgacagttgtgaaatctgttgccttgtgttgagggatatcttgcatctagcagagcatcagggaacaaactgcggacaaaaacttcacacgtgtggaaagcagttctatattagcgccaacctgcaacaacaccaacggcagcacatcacggaagcccccttcaggtcttatgtggacaccgccagcttcacccaaagctgcattgtgcatgttagcgaaaagccctttacatgcagggaaatccgaaaggattttctggcgaatatgcgctttctgcatcaagacgcaacccagaccggagaaaaacctaacaattccaacaagtgcgccgtcgcattctattccggaaagagccaccataattggggaaagtgctccaaagcatttagccacatcgacaccttggtgcaggatcagcgcatcctgacccgggagggcctgtttgaatgcagtaagtgtggtaaggcttgtacacggagatgcaaccttatccagcatcaaaaggtgcattccgaagagaggccgtatgaatgtaatgagtgcggcaaattcttcacgtattactccagtttcatcattcatcaacgggtgcatactggtgagagaccttacgcctgcccggagtgcggcaagtcttttagtcagatttattccctcaacagtcatcggaaggtacacaccggagagcgtccttacgagtgcggtgagtgtgggaagagcttcagccagcggtccaatctcatgcagcataggcgcgtgcacacaggcgaacgcccttacgaatgctctgaatgtgggaaaagctttagccagaacttttcactcatctatcaccagcgtgtgcacactggcgagcgccctcacgagtgtaatgaatgtggcaaatctttcagccgttcttcaagtctgatccaccacaggaggctccatactggcgagaggccttacgagtgttccaaatgtggaaagtcgttcaaacaaagcagcagtttctcatcccataggaaggtgcatactggggaaaggccttacgtctgtggagagtgcggcaagagcttctctcacagcagtaacctaaagaaccatcagcgcgttcacaccggggaaagaccagttgagtgctccgagtgtagtaagagtttcagctgcaagagcaacctgatcaaacacctacgcgttcatactggggagcggccgtatgaatgcagcgagtgcggaaaatccttttcccaatcctcgagtcttatccagcaccggcgtgtgcacacgggtaaaagaccatatcagtgctcccaatgcggaaagagctttggctgtaaaagcgtccttatccaacaccaaagggtgcacatcggtgaaaaaccttag

SEQ ID NO: 21329 - DNA, 1668 bp, Artificial Sequence
  Description of Artificial Sequence: Synthetic coding sequence
atgctggagaacttcgccctgaccagcagcctgggcctgatcagcagttggtcccacgtggtggctcagctgggactgggcgaggtgccaagtgtgctccatcgcatgttcatgacacctgcctccgccagatgggaccagcgcggcccaggactccatgaatggcatctcggcaaaggcatgtcatcgggttgctggtgcggagttgaacacgaagagacgcccagtgagcaacgaatttctggcgaaagggtgcctcaattccggactagcaaagaaggttctagctctcagaacgctgattcttgtgagatatgttgtttggtactgcgggacatactccatctggctgaacaccagggcacgaactgtgggcaaaagctgcatacctgcggtaagcagttttacatcagcgctaacctccagcagcaccagcggcaacatatcaccgaggcaccgttccgaagctatgtggacacagccagtttcacgcagagctgcatagtccacgtgtccgagaagcctttcacatgcagagaaatcagaaaagacttcctcgcaaatatgcgctttcttcatcaggatgccactcagacgggcgaaaagcccaataatagcaataaatgtgctgtcgctttctactctgggaaatctcaccacaactgggggaagtgctccaaggccttttcccacatcgacacgctcgtccaggatcaacgaatcctcacgcgcgagggcctgttcgaatgtagcaagtgtggaaaggcctgcacgcgacgttgcaatctaattcagcatcagaaagtgcatagtgaggagagaccttacgaatgtaatgagtgcggcaagtttttcacatactattcctcattcatcattcatcaaagggtgcacaccggagagagaccctatgcctgccctgagtgcgggaagagcttttcgcagatatactctctcaatagtcaccggaaggtccatactggtgagagaccttatgaatgcggcgagtgtggaaagtcatttagccagagatctaatttgatgcaacatcgccgcgtacatacgggggagcgaccgtacgaatgcagtgaatgtgggaagtctttcagtcagaacttttctctgatttaccatcagagggtccacaccggcgagcgcccacacgagtgtaacgaatgcggcaaatctttttcacgctcgtcatccctcatacaccatagacgactgcacacaggggaacggccctacgagtgctcaaagtgtggtaaatccttcaagcagagcagcagcttcagcagtcacagaaaagttcacacaggcgagcggccttacgtgtgtggagagtgtggcaaaagtttctctcattctagtaacttgaagaaccatcagcgagtacatactggcgagcgccctgtcgaatgttctgaatgcagtaagtcttttagctgcaagtccaatttaatcaagcatctgcgggtgcacaccggagagagaccctacgagtgcagcgaatgcgggaagtctttctctcagtcttccagtctgatccaacacagacgagtgcacacaggcaagcggccatatcagtgttcacagtgtggcaagtcgtttggatgtaaatctgtattaatccaacatcagcgcgtgcacattggtgaaaagccatag

SEQ ID NO: 21330 - DNA, 1695 bp, Artificial Sequence
  Description of Artificial Sequence: Synthetic coding sequence
atgctgggcttcccccccggccggccccagctgcccgtgcagctgagaccccagacgagaatggccactgccttacgggatcctgcctccggctcagttacctttgaagatgttgctgtgtatttttcttgggaggaatgggatctcttagacgaggcacagaagcacttgtacttcgacgttatgttagagaacttcgcattgactagctccctgggctgctggtgtggagtggagcatgaggagacaccatctgaacagcggatctctggagagcgggtaccacaattccggacttccaaggagggaagcagctcacaaaatgctgactcgtgtgaaatttgctgtttggtgctcagagatatactacacctagctgaacatcaggggaccaattgtggtcagaaactacacacatgtggaaagcagttttacattagcgccaacttacagcagcatcagagacaacatatcaccgaagctccttttcggtcatatgtcgacaccgctagcttcacacagagctgcatcgtgcacgtgagtgagaaacctttcacatgcagagaaatcaggaaagattttctagccaatatgcgtttcttgcaccaggacgctacccagacaggggaaaagcccaacaactccaacaagtgtgcagtcgccttctatagcgggaaatcccaccacaactggggaaagtgcagtaaagcctttagccacatcgatacactggtccaggaccagcgaatcttgaccagagaagggctgttcgagtgtagcaagtgcggaaaggcttgcacacggagatgcaacctgatacagcaccagaaggtgcactcagaggaacgaccatatgagtgtaatgagtgcggcaagtttttcacgtactatagttctttcattatccatcagcgtgtccacactggagagagaccctacgcgtgtcccgagtgcggtaagtcgttcagtcagatctactctttgaacagtcacaggaaggtgcataccggggaacggccgtatgagtgtggcgaatgcggaaagagcttctcccaacggtccaatctgatgcagcacagaagggtgcacaccggggaacgaccctatgagtgttctgagtgtgggaagagcttcagccagaattttagtctgatttaccatcaacgcgtccacacgggcgagaggcctcacgaatgcaatgagtgtggcaagagtttctcccggtcatcctcgctgatccaccataggcggttgcacaccggagaacgcccctatgagtgcagcaaatgcgggaaatcctttaaacagagtagcagcttctctagtcatcgaaaagtccataccggtgaaagaccctacgtatgcggcgaatgtggcaagtcattcagccactcaagtaatctgaaaaaccaccagcgagtccataccggggagaggcccgtcgagtgcagcgagtgtagcaaaagtttcagttgtaagtccaatttgataaagcatctgagagtgcatactggcgaacggccatatgaatgctccgaatgcggaaaatctttcagccagagttcctcattaatccagcatcgcagagttcacaccggaaagagaccttaccaatgtagccagtgtggaaaaagcttcggctgcaagtctgtccttattcagcatcagcgtgttcacataggggagaaaccttag

SEQ ID NO: 21331 - DNA, 1512 bp, Artificial Sequence
  Description of Artificial Sequence: Synthetic coding sequence
atgctggagaacttcgccctgaccagcagcctgggctgctggtgcggagtagagcacgaggaaacaccatcagaacagagaatctcaggcgagcgcgtccctcagtttcgtacaagcaaggagggcagtagctcccaaaacgctgatagctgtgaaatctgttgtcttgtgttacgcgacatattgcatttagctgagcaccaagggaccaattgcggacaaaaactgcacacatgtgggaaacaattctatatctcagccaacctgcagcagcatcagagacagcatattaccgaagccccttttagatcatacgtcgacaccgcctccttcacccagtcctgtatagtccacgtttctgaaaagccttttacgtgtcgcgaaatccgcaaggactttctggccaacatgcgattcctccaccaggatgctacccaaacaggagaaaaaccaaacaactcaaataaatgtgcagtcgctttctacagcgggaaatcccatcacaattggggtaaatgttcaaaagccttttcccatatcgatactctagttcaggatcagcgcattctgaccagagagggactgtttgagtgttcaaaatgtggaaaagcctgcacaaggagatgcaacctaattcagcaccagaaagtgcacagtgaggagcgcccatacgaatgcaacgaatgtggtaagtttttcacgtactacagctcctttatcattcaccaacgtgtgcacactggcgaacgcccatacgcatgtcccgaatgtggcaagtcatttagccagatttattcgttgaactcccatagaaaagtacacaccggcgaacgtccctatgaatgcggcgagtgcggaaaaagcttcagtcagaggtctaatctgatgcagcatcgcagagtgcatactggtgagagaccatacgagtgttctgagtgtgggaagtcgttttcacagaatttctctcttatttaccaccaacgcgtgcacacgggcgaacgtcctcacgaatgcaatgaatgcgggaagagcttctccagatcctcctccttaatccaccacaggcggctgcacaccggcgagagaccgtacgaatgcagcaagtgtggcaagtccttcaaacagtcctcatccttttcaagccataggaaagtacatactggggaacgcccctatgtttgtggcgaatgtggcaaatcgttcagtcactcctcaaaccttaagaatcaccagagagttcacacgggcgagcggcctgtcgagtgttctgaatgctccaaatcatttagttgtaagtctaacctcataaagcacctgagggtccatacaggggagcggccctatgaatgtagcgagtgcggcaaaagcttcagccagagcagctccctgatccagcatcgacgtgtccataccggtaagaggccctatcaatgtagccagtgcggcaaatcttttggctgtaagtccgtcctcatccagcaccagagagttcacataggggagaaaccttag

SEQ ID NO: 21332 - DNA, 1707 bp, Artificial Sequence
  Description of Artificial Sequence: Synthetic coding sequence
atgatcagcgcctactgcaacctgcacctgctgggcagcagcgactcgcctgcttccgcctcccaggtcgctgggactaccggtatgaggcaccacgcgcagggatctgttacattcgaagatgtcgccgtatatttttcctgggaggagtgggacctgttggacgaggcccagaaacacctgtactttgacgttatgctggagaatttcgctttgacctcctcactgggatgctggtgtggcgttgaacacgaggaaacacccagcgagcaacggatctcaggcgagcgggttcctcaattcagaaccagcaaggaagggagttctagccagaatgctgactcctgcgaaatttgttgcctggtcctgcgtgacatcctacacctagccgagcaccaggggacgaattgcggccagaaactccatacttgtggaaagcagttttatatcagtgcaaacctccaacagcaccaacggcagcatattactgaagccccttttcggtcatacgtggacactgcaagtttcacacagtcctgcattgtccacgtgagcgagaaaccctttacgtgtcgggaaatccgcaaggactttcttgctaatatgaggtttctccatcaggacgctactcaaaccggggaaaagcccaacaacagcaacaaatgtgccgttgctttttattctggcaagtcccaccacaattggggcaaatgctctaaagcattcagccatatagacacactggtgcaggaccagaggattctgacaagggagggcctatttgagtgtagcaagtgtgggaaggcatgtacacggcggtgtaacctcatccagcatcagaaagtgcattccgaagagagaccgtatgagtgcaatgagtgcggcaaattcttcacctattatagtagcttcattatccatcagcgggtgcatacaggggagagaccctacgcctgtcctgagtgtgggaagtcattctctcagatatattccctcaactctcacaggaaagtccatacaggtgagagaccctatgagtgcggcgaatgtgggaagagcttcagccagcgcagcaatctgatgcagcaccggcgggtgcataccggagaacgcccatacgagtgctccgagtgcggtaaatcattctcgcagaacttctccctgatatatcatcaaagagtgcacactggggagcggccccatgagtgtaatgagtgcggaaaatcgttcagtcgttcatcctcacttatacaccaccgccgactgcataccggagaacgcccttatgagtgctctaaatgcggaaaatcttttaagcagtcgagttccttctcgtcccatagaaaagttcacaccggtgagcggccgtatgtatgtggcgagtgtggcaaatccttctcacactcttctaacctgaagaatcatcaacgagtgcacactggcgaacgtcctgttgagtgttctgagtgcagcaagagctttagctgtaaatccaaccttataaaacaccttagagtacatacaggagagagaccttacgaatgcagcgaatgtggcaagagtttttcacagagttcctccctcatacagcacagaagggttcacacaggcaagaggccgtaccagtgctctcagtgcggcaagtcctttggttgtaagagcgtgctgatccaacaccagcgcgtccacattggggagaaaccctag

SEQ ID NO: 21333 - DNA, 1668 bp, Artificial Sequence
  Description of Artificial Sequence: Synthetic coding sequence
atgctggagaacttcgccctgaccagcagcctgggcctgatcagctcttggagccatgtggttgcccagctcggactgggagaagttccgtcggttctacacaggatgttcatgactccagccagcgccaggtgggatcaacgtgggcccggactgcacgagtggcatttgggaaagggtatgagttctggctgttggtgcggggtagaacacgaagagacaccttctgagcagaggatctcaggggagagagtgccacagttccgaacctccaaagaaggatctagctcacagaacgctgactcctgtgagatttgctgtctcgtgcttcgggacattctgcatcttgcagagcaccaaggtactaactgcggccagaagcttcacacttgtgggaagcaattttacatcagtgcaaatctgcagcagcaccagaggcagcacattacagaggctccttttagaagctacgtcgacactgcctcctttacacaaagctgcattgtgcacgtgagcgaaaagccctttacatgcagagagatcaggaaggattttctggctaatatgcggtttctgcaccaggacgctacacaaacgggagagaaacccaataatagcaataagtgcgccgttgccttctatagcggaaaatcccaccacaactggggcaagtgctcaaaagctttttcccatatagacacgctggtccaggaccagcgcattctgaccagggaagggctcttcgaatgctccaagtgtggaaaggcatgcacacgtcggtgcaacctgattcaacaccagaaggtgcactctgaggagaggccctatgagtgtaacgaatgtggcaaattctttacatattactcttcattcatcatccatcaaagagttcataccggtgaacgcccctacgcttgtcctgagtgcggcaaatcattcagccaaatttactctctgaacagccatcggaaggtccacactggcgagcgtccctacgagtgcggcgaatgcggaaaatcttttagccagcgctcaaatctgatgcaacaccgcagagtacatactggggaaagaccatatgagtgtagcgagtgcggtaaatccttctcacaaaacttttccttgatatatcaccagcgcgtgcatactggtgagcggccccacgagtgcaacgaatgcggaaagagctttagccggagctccagcctcatccaccacagacgattgcacacaggggaaagaccttacgagtgttccaagtgtggcaaatcattcaagcagtcttcgagtttcagttcacatcggaaggtgcacaccggggagcgcccatatgtctgcggggaatgtggaaagagcttctcgcactcctctaatttaaaaaaccatcagagagttcatacaggagaacgccccgtggaatgttcagagtgctccaagagcttttcttgtaagagcaatctgatcaagcacctgcgggtccacaccggtgagagaccgtacgaatgcagcgagtgtggcaaatccttctcacagagctcatcccttatccagcaccggagggtccacaccggcaaacggccttatcagtgttcccaatgcggcaagtcattcggctgtaagtctgtgctgatccagcaccagcgcgtgcatataggcgaaaagccatag

SEQ ID NO: 21334 - DNA, 1731 bp, Artificial Sequence
  Description of Artificial Sequence: Synthetic coding sequence
atgcggaccctgcggcagcgggaggtggagtacttcagcaaggccacacagctcgttcgcggctcgacaaaagatagaggtgcacaggtgccaatcgcgactgaggtgcttttcaaacttacccagggatcagtgacctttgaagacgtggccgtgtatttctcttgggaagagtgggatctgttagatgaagcccagaaacacctgtacttcgacgtcatgctcgaaaattttgccctcacctcttctctgggttgttggtgcggggtggagcacgaagaaacccccagtgagcaacgcatcagcggcgagcgggttcctcagttcagaacctctaaagagggctcaagctcccagaatgctgactcatgtgagatttgctgcctggtgctccgagacatcttacacctcgccgagcatcagggcacgaattgcggacaaaaactgcacacgtgcgggaagcagttctacatttccgccaacctgcagcagcaccagagacagcacatcacggaagcccctttcaggagctacgtagatacagcctcctttacccaatcctgtattgtgcacgtcagtgagaagccgtttacttgtagagagattagaaaggactttctcgctaatatgcggttcctgcaccaggatgcaacccagaccggcgagaaacctaacaattctaataagtgtgctgttgccttctactctgggaaatcccaccacaattggggtaagtgctcaaaagcatttagccacattgacacgttagtgcaagatcaacggatcctcacgcgtgaaggactgttcgagtgctccaaatgcgggaaagcgtgcactcgcagatgtaaccttattcagcatcagaaggtgcacagcgaggagcggccctacgaatgcaatgaatgcggaaaattcttcacctactacagttcctttatcatccatcaaagggtgcataccggagaaagaccctacgcctgtcccgagtgcgggaagtctttttcacaaatttattccctcaattctcacaggaaagtacacaccggggagagaccttacgaatgcggtgagtgtggaaaatccttctcacagcggtctaacctgatgcagcaccgtagagtacacacgggagagaggccttacgagtgctccgagtgcggcaaaagcttcagccagaacttctcgctaatctaccatcagcgggtccatacgggggagcgaccgcacgaatgcaacgagtgcggcaagagcttcagcagaagctcctcactcattcatcataggagattacatactggtgagcgtccctacgagtgttccaaatgcggtaaatcttttaagcaaagctcaagcttttcatctcaccgaaaggtacacaccggtgagcgaccctacgtttgcggcgagtgcgggaagtctttcagtcactccagcaatctcaaaaaccatcaaagggtacacactggtgaacggcccgtcgagtgcagcgagtgctccaagtcctttagctgtaaaagcaatctcattaaacatctccgagtgcacaccggcgaacgcccttacgaatgttctgagtgtggcaaatctttcagccagtccagtagcctcatacagcataggcgtgtacatacaggaaaaaggccataccagtgtagccagtgcggcaagagcttcggttgcaaatccgtgcttatacagcaccaacgggtccacattggtgagaaaccctag

SEQ ID NO: 21335 - DNA, 1890 bp, Artificial Sequence
  Description of Artificial Sequence: Synthetic coding sequence
atgctgggcttcccccccggccggccccagctgcccgtgcagctgcggccccaaactcgcatggctactgctctgcgcgatcccgcaagcgttccaatcgctacagaagtcctgtttaagctgacccagggcagtgtgaccttcgaagacgtagctgtgtatttttcttgggaggagtgggacctgctcgatgaggcacagaagcacctttattttgacgtgatgctggaaaacttcgcactcacctcttccctgggtcttatcagtagctggtctcatgttgtggcccaattgggactcggggaagtgcctagtgtgcttcatagaatgtttatgactcctgccagcgctcggtgggaccagagaggccccggacttcatgaatggcatctgggaaaaggtatgagttctgggtgctggtgcggagtggagcatgaggagaccccatccgagcaaagaatttcaggcgagcgcgtcccacaatttcggacatccaaggagggctcttcctctcagaacgcagacagctgtgaaatctgttgtttggtgctgcgggacattcttcatctggcggaacaccaaggaacaaattgtggccagaaactgcacacttgcgggaagcagttttatattagcgccaatctccagcagcaccagcgccagcacatcactgaggcacccttcagatcttatgtggacaccgcatcatttacacagagttgcattgttcacgtgtccgaaaaaccttttacatgccgcgagattaggaaagatttcttggctaacatgaggttcctacaccaggacgccacacaaactggcgagaagcctaacaattcgaacaagtgcgccgttgctttttactccggcaagtctcaccataactggggcaagtgctccaaagccttttctcacatcgacaccctcgtacaggatcagaggattctgacacgggaaggcctgtttgaatgctccaaatgcggtaaagcctgcaccagaaggtgcaacctgatccagcatcagaaagtccacagcgaagagcgaccttatgagtgcaacgagtgtggtaagtttttcacttattattcttcattcattatccatcagagggtccacacgggcgagagaccatatgcgtgccctgaatgtgggaagtccttctcacaaatttatagcctcaacagtcataggaaggtgcacacgggagaaaggccatatgaatgcggcgagtgcggaaaaagtttcagccaacggtccaacctgatgcagcacaggagagtgcataccggcgaacggccttacgagtgcagcgagtgcggaaagtccttttctcagaattttagcctgatttaccaccagcgagtgcacaccggagaaaggccgcacgagtgtaatgagtgtgggaagagcttctctcggtcatcatctctaatccatcacagacgtctccacactggggaacggccttatgagtgctcgaagtgtggcaagtcctttaagcaaagcagctccttctcttcccatcgaaaggtgcacactggggaacgcccgtacgtgtgtggcgagtgcggtaagagcttctcccattcctcgaatctaaaaaaccaccagagggtgcatactggagagcgccctgttgagtgttccgagtgcagcaagagtttttcttgtaagtcaaatctcattaagcatctaagggttcataccggggaacgcccttatgaatgtagtgagtgcggaaagagtttttctcaatccagctcactaatccagcaccgaagagtccacaccggcaaacgaccgtaccagtgtagtcagtgtggaaagtcttttggttgtaagagcgtactgatccagcaccagcgggtgcacataggggagaagccctag

SEQ ID NO: 21336 - DNA, 117 bp, Artificial Sequence
  Description of Artificial Sequence: Synthetic coding sequence
atgctgggcttcccccccggccggccccagctgcccgtgcagctgaggccacaaacacgtatggccaccgcactgagagacccagcatccgccgtgcagtggaagaagcggctatag

SEQ ID NO: 21337 - DNA, 1854 bp, Artificial Sequence
  Description of Artificial Sequence: Synthetic coding sequence
atgatcagccccagcctggagctgctgcacagcggcctgtgcaagtttccggaggtcgaggggaagatgaccacctttaaagaagcagttactttcaaagacgtggccgtggtgttcacagaagaggagctcgggctcttagaccccgctcagagaaagctgtatcgagacgttatgctggaaaattttcgtaacttgttaagtgtgggtaatcaacccttccaccaagataccttccacttccttggcaaagagaagttctggaaaatgaaaacaacctctcaacgggaaggtaattctggcggtaaaatccagatcgaaatggagacagtacctgaagctggcccccacgaggagtggtcatgtcagcaaatctgggagcagattgcctcagacctgacacgctctcaaaactccattcgcaactcttcgcaattcttcaaagagggtgacgtcccctgtcagattgaggctagactgtctatcagtcatgtgcagcagaagccttatcgctgcaatgaatgcaagcaatcttttagcgatgtgtctgtctttgatctgcaccagcagagtcactctggggaaaagagccacacatgcggagagtgcggaaaatctttctgctactccccggcactccatatacaccagagggttcacatgggagagaaatgctataaatgcgacgtgtgtggtaaggagttcaatcagtcctctcatcttcagactcaccagcgcgttcacaccggtgaaaagccctttaagtgtggccaatgtggcaaaggcttccacagcagatctgccttgaatgtccactgcaaattgcataccggcgagaaaccatataactgtgaggagtgcgggaaggcattcatccacgatagccagctacaagagcatcagcgtattcatacaggtgagaaacccttcaagtgcgatatctgcggaaaaagctttcgcgtaagaagcagattgaatcggcattccatggtacacacaggtgaaaaggcgtttcgctgcgatacctgtgggaaaaacttccgacagcgcagtgctttgaactcacattcaatggtgcacatcgaagagaagccatacaagtgtgagcagtgtgggaaaggcttcatctgccggcgcgacttttgtaagcatcagatggtgcatacaggagagaaaccttacaactgcaaggaatgtggcaagacctttaggtggtcatcttgcctgctgaaccaccagcaggtgcacagtggtcagaagtcattcaagtgcgaggaatgtggcaaagggttctatacaaattctaggagaagctcacaccagcgctctcacaatggtgagaagccttataactgcgaagagtgtggaaaagactataaaaggaggctcgacctcgaattccatcagcgcgtgcacactggagagcgaccgtataattgtaaagagtgtggcaagagctttggatgggccagttgcttgctgaagcaccagcgcctgcactccggtgagaaaccatttaagtgtgaagaatgtgggaagcgctttacccagtccagccaacttcacagccatcaaacctgtcacactggcgaaaaactctacaagtgcgaacagtgcgagaaggggtataacagtaagtttaatctggacatgcatcagagggtgcacggaggcgaaagaccctataattgcaaagagtgcggaaagagctttgggtgggcctcatgcctgttaaaacatcaaaggctccacagcggcgagaagcccttaaaatcaggtgtatgggaagaaatttattccgagtttactgcgtcttttacaagcgtcagtctgtgtgggagaaaagccatctag

SEQ ID NO: 21338 - DNA, 144 bp, Artificial Sequence
  Description of Artificial Sequence: Synthetic coding sequence
atgaccaccttcaaggaggccgtgaccttcaaggacgtggccgtggttttcactgaggaagagctaggactgctggaccctgcgcagaggaaattgtaccgcgacgtcatgttggaaaatttcagaaacctgttatctgtatag

SEQ ID NO: 21339 - DNA, 1356 bp, Artificial Sequence
  Description of Artificial Sequence: Synthetic coding sequence
atggccaagctgtacgaggccgtgaccttcaaggacgtggccgtgatctttacggaggaagaattaggactgctggacccagcccaacgtaaactttacagagatgttatgctggaaaacttccgtaacctgttaagcgtgggaggcaagatccagacagaaatggagacagtgcccgaggccggcactcacgaggagttcagttgcaagcagatctgggaacagattgcaagcgatttaacccggtcacaggacactactatcagcaactcgcagctgttcgaacaagatgacaatccctcacagatcaaggctcgactatccactgtacataccagagagaaacctttccagggcgaaaactgtaaacagtttttctccgacgtgagcttctttgaccttccccagcaactatattccggcgaaaaaagccatacatgtgacgaatgcggaaagtcattttgttacatttcggccttgcatatccaccagagggtacacatgggggtgaagtgttataaatgtgacgtgtgcggcaaagagttctcgcagagctcccgcctgcagactcatcagcgagtccatacaggcgagaaaccttttaagtgtgagcagtgcggtaagggctttcggtgtcgctccgctttaaaagtgcactgcaaactgcacatgcgggagaaaccctataattgcgagaagtgcggaaaggcctttatgcataactttcagctccaaaagcatcaccgcattcatacaggtgaaaaaccatttaagtgtgaaatctgtggcaaaagcttttgcttacgcagttcactcaatagacactgtatggtccatactgctgagaagctttataagtctgaaaagtacgggcgggggtttatcgaccgtctggatctgcacaagcaccagatgattcacatgggacagaaaccctataattgcaaggagtgcgggaagtccttcaaatggtccagctaccttctcgtccatcagcgtgtgcataccggcgaaaagccctataagtgcgaggagtgtggcaaaggctacatatcaaaaagtggactagattttcaccaccgcacacacaccggggaaagaagttataattgtgataactgcggcaaaagtttccgccacgcttcctcaattcttaaccataagaagctccattgccaaagaaaaccactgaagtgtgaagactgtgggaaacgcctggtgtgtcgaagctattgcaaagatcagcagcgcgaccatagcggcgagaatccctcgaagtgcgaggactgtggcaagaggtacaagcgaaggctcaatctggatatcatcctgagcctcttcctgaatgacatttag

SEQ ID NO: 21340 - DNA, 1194 bp, Artificial Sequence
  Description of Artificial Sequence: Synthetic coding sequence
atggagaccgtgcccgaggccggcacccacgaggagttcagctgcaaacagatttgggaacagatagcttcggacctgacgaggtcacaggatacgacaattagcaactcccaactttttgagcaggacgacaatccgtctcaaatcaaggcgcgacttagtacagtgcatacccgggagaaaccattccagggagaaaattgtaaacagtttttcagtgatgtcagttttttcgacttacctcagcagctctattctggcgaaaagtcccacacatgcgatgagtgtgggaagtccttctgctatatttctgccctgcatatccatcagagggtgcatatgggcgtgaagtgttataaatgtgacgtttgtggtaaagagtttagccagtccagccgtctgcagacacaccagagggtccatacgggagaaaagccattcaaatgcgaacagtgcggaaagggctttagatgcaggagcgccctaaaggtgcactgtaaacttcacatgcgagaaaaaccttataactgtgaaaaatgtggcaaagccttcatgcataatttccagctgcagaagcaccacagaatacacactggagaaaagccattcaaatgtgagatctgcggcaaatctttttgtctgcgatcatccctgaatcgtcattgcatggtccacacagcggaaaaactttacaagtccgagaagtatggaagaggattcatcgaccgcttggacttgcataagcatcagatgatacacatggggcagaaaccttacaactgcaaagagtgtgggaaaagctttaaatggagttcttacttactcgttcatcagagagtccacacgggcgagaaaccgtacaagtgcgaagaatgtggcaagggatacatttccaaatccggccttgattttcaccacaggacccacaccggggagcggtcatacaactgcgacaattgcggaaaatcctttaggcacgcatcaagcatacttaatcacaagaaacttcactgccagcgtaaacccctgaagtgcgaggattgtggtaaacgcctagtgtgccggtcctactgcaaagatcagcaaagggaccactccggagagaatccatccaagtgcgaagactgcggaaagcgttataaaagacgactaaatctggatataattctgagcttgtttctcaatgatatctag

SEQ ID NO: 21341 - DNA, 1476 bp, Artificial Sequence
  Description of Artificial Sequence: Synthetic coding sequence
atgatcgacagcggcgagaagaagcccggccggcgggccgaggaggctgtgacattcaaggatgtcgcagtgatcttcacggaagaggagctgggcttgctcgatcctgctcagcgtaagctttatcgagatgtgatgcttgagaacttcaggaatctgctctccgtgggccaccagccttttcacggcgacacatttcactttctcagggaagaaaaattttgggtgatgggaacaaccagccagagggaaggtaacctcgggggcaagattcagaccgagatggaaacagtgcctgaggcaggcacacacgaggagttttcgtgtaagcagatttgggagcagatagccagcgaccttacccgctctcaagatactacaattagtaattcccagctgttcgaacaggatgacaatccgtcccagatcaaggccaggctgtctactgtgcacacccgtgagaaaccttttcagggagaaaactgtaagcagttcttctcagacgtgagcttttttgatctaccccaacagttgtattcgggggagaagtctcacacctgtgatgaatgcggcaagagtttctgctacatctcagcacttcacattcaccagagggtgcacatgggcgtgaagtgctataagtgtgacgtttgcggtaaagagttttcacagtcctcacgcttgcagacccaccagcgtgttcatacaggcgagaaacctttcaagtgcgagcagtgcggcaagggattccggtgtcgcagcgctctaaaggtacattgcaagctacacatgagagagaagccctataactgtgaaaaatgtggcaaagcatttatgcataatttccagcttcagaaacaccaccggattcacactggcgagaagccgttcaagtgcgaaatatgcggaaaatccttctgcctgcgctcaagtctgaaccgtcactgcatggtacataccgctgaaaaactctacaagtcggagaagtatgggcgcgggtttatcgacaggctggatctgcacaaacaccaaatgattcacatggggcagaagccatacaattgcaaagagtgcggtaagtcattcaaatggtcaagttacctcctggtccatcagagagtgcacactggagaaaagccttataaatgcgaggagtgtggaaaaggatacatctctaagtccggccttgactttcaccatcgcacccacactggtgagagaagctacaattgcgataattgcgggaaatccttcaggcatgcctcatcgatccttaatcataagaaactccactgccagcgcaaaccgctgaaatgcgaggactgcggaaaacgactggtttgcaggtcttactgcaaagatcagcagagggatcacagtggagaaaatccttccaagtgcgaagattgtggaaaaagatacaagagacgcttgaatctggatatcatcctgtccttgttcctaaacgacatttag

SEQ ID NO: 21342 - DNA, 1449 bp, Artificial Sequence
  Description of Artificial Sequence: Synthetic coding sequence
atgaccatgagcaaggaggccgtgaccttcaaggacgtggccgtggttttcactgaagaggaacttgggttgctggacctggcacaaagaaaactgtatagggacgtgatgctggagaactttaggaacctgctaagcgtgggacatcagccattccaccgagataccttccactttctgcgggaggagaaattctggatgatggacatcgctacccagcgcgaagggaactccggcggaaagattcagcctgagatgaagacctttcctgaagctggcccccatgagggttggtcctgccagcagatttgggaagaaatcgcctccgatctgactcgacctcaggatagcacgatcaagtcttctcagttcttcgaacagggagacgcccacagccaggtcgaagagggcctgtctatcatgcatacgggccagaaaccaagcaattgcggaaagtgtaaacagtctttttccgacatgagtatttttgacctccctcagcagataagaagcgcagagaaatcccactcgtgtgacgagtgtggaaaatctttctgctacatctccgccctccacatccaccagcgcgtgcatctcggcgagaaattatttaaatgcgacgtctgcgggaaggaattttcccaatccctccacttacagactcatcagagggtgcacaccggcgagaaaccatttaagtgtgagcagtgtggaagggggttccgatgcagatctgccctcacagtgcactgcaagcttcacatgggagagaaacattacaactgtgaagcatgcggacgtgcatttatccacgatttccaactgcagaagcaccaaagaattcatactggagaaaagccattcaaatgtgagatttgttccgtttcatttagattgaggagcagccttaatcgccattgcgtggtccacacagggaagaagccgaacagcaccggagaatatggcaaaggatttatacggagattggacctctgcaaacaccaaaccattcatacaggcgaaaagccctataattgcaaggaatgcggaaagtcattccgccgctcctcatacctcctgattcaccagagagttcatacaggcgagaaaccctacaaatgcgataaatgtggtaagtcctacattaccaagtcaggcttagatctgcatcatcgggcccatacaggagagcggccatacaactgtgacgactgcggcaagtcttttcggcaggcaagctcaatactgaatcacaagagactccactgtaggaagaagccttttaagtgcgaagactgcggcaaaaaactcgtgtatagaagttaccggaaggaccaacagaagaaccacagtggggagaatccttctaagtgtgaagattgcgggaaaagatacaagcgtagactcaatcttgacatcattttaagcctgttcctcaacgacacctag

SEQ ID NO: 21343 - DNA, 2121 bp, Artificial Sequence
  Description of Artificial Sequence: Synthetic coding sequence
atgaccaccctgaaggaggccgtgaccttcaaggacgtggccgtggtgtttacggaagaggagttgaggctgctggacctcgctcagcgcaagctttatcgcgaggtgatgctagaaaattttcgtaatctcctctctgtgggccatcagtctttacacagggacacatttcactttctgaaggaggaaaagttttggatgatggaaaccgctacacagagagaaggaaacttgggaggtaaaattcagatggagatggaaaccgtgtcagagagtggaactcacgaggggctgttcagtcaccagacatgggagcaaatttcgtcagatctgaccagattccaagacagtatggtaaacagttttcaattcagcaagcaggacgatatgccctgccaggtggacgctgggctcagcattatccacgtgagacaaaagcccagtgaaggtagaacctgcaaaaagagcttctccgatgtttcagtccttgaccttcatcaacagctgcaaagcagagagaaatcacatacttgcgacgagtgcgggaagtccttttgttactcaagcgctctcagaattcaccagagagtgcacatgggggaaaagctatacaactgtgacgtgtgcggcaaagagtttaatcaaagcagccacctccagattcaccagagaattcacacaggggagaagccgtttaaatgcgagcaatgtggcaaagggttctctaggcgatctgggctgtatgtgcaccgcaaactgcatactggagtcaaaccacacatatgtgaaaagtgcggcaaagccttcatacacgacagtcaactccaggagcatcagaggatccacactggagaaaagcctttcaaatgtgatatctgttgtaaatcctttagatctagggctaacttaaacagacactccatggtgcatatgagggaaaaaccattccgctgcgacacatgcggcaaatccttcggcctcaaaagcgcactgaattcccatcgtatggtccataccggggagaaacggtataaatgcgaggaatgtggcaagcggttcatatataggcaagacctttacaagcatcagatcgaccacaccggagagaagccctataactgcaaagaatgcggtaagtcttttagatgggcttctggtctgagcaggcatgtcagagtgcatagcggcgagacaacatttaagtgcgaagagtgtggaaaaggcttctacaccaacagccagcgatactctcatcagagagcccacagcggggagaaaccatatcgctgtgaagagtgcggcaaagggtataaaagaaggctcgacctagactttcatcaacgagtgcatcgaggtgagaagccttataactgtaaagaatgcggcaaaagcttcggctgggcaagctgcttactcaatcatcagcgcatccattccggtgagaagccctttaagtgcgaagaatgcggcaaaaggttcacccagaatagccagctgtacactcatcgcagggtccacagcggcgagaaacctttcaagtgcgaagagtgcggcaagaggtttacccagaattcccagctgtattcccaccgacgggtccatactggggttaaaccttacaagtgcgaagagtgtggtaagggctttaactctaagttcaatctggatatgcatcagcgcgtgcatacgggcgaacggccttacaattgtaaagagtgtggcaaaagcttcagccgagcttcgtccatactcaatcacaagcgcctgcatggggatgagaaaccatttaagtgcgaggagtgtggtaaaagattcacagaaaactctcaactgcactcccatcagagggtacacactggagagaagccttataaatgcgagaaatgcgggaagtcattccggtgggcctcgactcatctgactcatcagagactgcacagccgagagaagttactccaatgtgaggactgcggaaagtccattgtacactcgagttgtttaaaggaccagcagcgggatcagtcaggcgagaagactagcaagtgcgaagattgcggcaaaaggtataaacggaggctcaacctggacactttgcttagtttgtttctcaacgatacttag

SEQ ID NO: 21344 - DNA, 2013 bp, Artificial Sequence
  Description of Artificial Sequence: Synthetic coding sequence
atgctggagaacttccggaacctgctgagcgtgggccaccagagcttgcatagagacacttttcattttctcaaggaggaaaagttctggatgatggagactgccactcagcgagagggtaatctaggcggaaaaatccaaatggagatggagacagtgagtgaatcaggaacgcatgagggtttgttttcccaccaaacatgggagcagattagcagtgacctgactaggttccaggattctatggtgaatagtttccagttctccaagcaggatgatatgccctgccaggtagatgctggcctgagcattatccatgttcgacagaagccctcggagggccgcacttgcaagaaatctttctctgacgtgagtgtgctggacctccaccagcagctgcaatctagggaaaagtctcacacttgtgacgagtgtggaaaaagcttttgctactctagtgctttacggattcaccagcgagtgcacatgggtgagaaattatacaactgtgacgtatgcggcaaggagttcaaccagtcttcacacctgcaaatccaccaaaggatccatactggagaaaagccctttaagtgtgaacagtgcgggaaaggattttcccgacgctctggactttatgttcaccgcaaacttcacacaggagtgaaaccccatatctgtgaaaagtgcgggaaggcattcattcacgactcacagctgcaggaacaccagcggattcatacaggcgagaaacctttcaaatgcgacatttgttgtaagtcgttcaggagtcgtgcaaaccttaatagacattccatggttcacatgcgagaaaagcccttccgatgcgacacatgcgggaagagtttcgggctcaagtctgccctgaatagtcaccgaatggtccacactggcgagaaaaggtacaaatgtgaggaatgcggcaagcgcttcatttatcggcaggatctgtacaagcaccagatcgatcatacaggagaaaaaccttacaattgcaaggaatgcgggaagtcatttagatgggcctcaggattgagcaggcacgtgagagtgcacagtggcgaaacgacattcaagtgcgaggagtgtggcaagggattctacaccaattctcagcgctactcccatcagcgcgcccactctggggagaaaccttacaggtgtgaagaatgtggtaaagggtacaagcggaggcttgacctggatttccatcagcgggtgcacagaggtgagaagccttataattgcaaggagtgcgggaagagttttgggtgggccagttgccttctgaatcaccagcgaatccactccggagaaaagccctttaagtgtgaggaatgcggtaagaggtttacccagaactctcaactgtacacacaccgtcgggtacactccggagagaaacctttcaagtgtgaggagtgcggcaaacggttcacgcagaacagccaactgtactcccatcgccgcgtgcacacaggtgtcaagccatataaatgcgaggaatgtggtaagggcttcaactcaaagttcaacttggacatgcatcagcgcgtacacaccggtgagcgaccctataactgtaaagagtgcggcaagagcttcagcagagcgagcagcatactgaaccacaagcgcctgcacggagacgagaagcctttcaagtgcgaggagtgcggcaagaggttcaccgaaaacagccagctgcactctcaccagagagtacacactggcgagaagccttacaagtgcgaaaagtgcggcaaatccttccggtgggcttccacacacctaacccaccagaggctgcacagtagagagaagttgttacagtgtgaagattgtggaaagagcatcgtgcactcttcgtgtcttaaagatcagcaacgggaccaaagcggcgaaaagacctctaagtgcgaagattgcggaaagcggtataagagacgactgaacctggatactctgctctctctctttctgaacgatacctag

SEQ ID NO: 21345 - DNA, 285 bp, Artificial Sequence
  Description of Artificial Sequence: Synthetic coding sequence
atgaacatgttcaaggaggccgtgaccttcaaggacgtggccgtggcctttactgaggaggaactgggactcttgggccccgctcagagaaagctttatcgcgacgttatggtggaaaattttaggaatcttctgtctgtagggcacccaccatttaagcaagacgtgtccccaatcgagagaaatgagcagctttggattatgacgaccgccacccgcaggcaaggcaacctcgatacactcctggtgaaagccctcctcctgtatgatctggcccagacttag

SEQ ID NO: 21346 - DNA, 2412 bp, Artificial Sequence
  Description of Artificial Sequence: Synthetic coding sequence
atgaacatgttcaaggaggccgtgaccttcaaggacgtggccgtggctttcactgaggaagaactgggactccttggcccagcccagcgaaagctgtacagggacgtgatggtcgagaactttcgcaatctattgagcgtaggccacccaccattcaaacaagacgtatcacccatagaacgaaatgagcagctttggattatgacaacagccacccgcaggcaaggtaacttgggcgagaaaaaccagagtaaattaatcaccgtccaggaccgagagtctgaagaagagctctcatgctggcagatctggcaacaaatagcaaacgacctgaccagatgccaggactcaatgattaacaacagccaatgccacaagcagggagacttcccataccaagtaggcacagaattgtccattcaaatctccgaagatgagaattacattgtaaataaagccgacggccccaacaataccggcaaccccgagtttcctatcttaaggacacaggactcttggaggaagacatttctgactgagtcccagcgattgaatagagaccagcaaatttctatcaagaacaaactgtgccagtgtaagaaaggcgttgaccccatcggctggatcagtcatcacgacgggcacagggtgcacaaatccgagaaatcctataggccgaacgattatgagaaagacaatatgaagattcttacttttgatcacaactcaatgatccatactgggcaaaaaagttaccagtgcaacgaatgtaagaagccattttccgacctgagcagtttcgatttgcatcagcagctgcagtcaggggaaaagtcactcacttgcgtagagaggggtaaaggtttctgttatagcccggtgcttcctgtccatcagaaagtgcacgtaggggaaaagctgaaatgtgatgagtgcggtaaggaattctctcagggagcccacctgcagactcaccagaaggtgcacgtaatcgagaagccttataagtgtaaacagtgtggcaaagggtttagcagacggtccgctctcaacgtgcactgtaaggtccataccgcagaaaaaccatataattgtgaagagtgtggccgcgcctttagccaagccagtcacttgcaggatcaccaacgcttgcatactggcgagaagcccttcaaatgcgatgcctgcgggaaatctttctctagaaatagccatctgcaaagccatcagcgtgtgcataccggcgagaaaccatataagtgcgaggaatgcggcaaaggatttatctgttcctctaatctatacatccaccagcgtgtgcacactggtgaaaagccatacaagtgtgaagaatgcgggaaagggttctccaggccgtccagtctgcaagcacatcaaggcgtccataccggagagaaatcctatatctgcaccgtctgcggcaaaggtttcactctatcctcaaatctacaggcccatcagcgagtccacaccggggaaaaaccttataagtgcaacgaatgtggcaagtccttccgccgcaactcgcactaccaggtgcacttggtcgtccatacaggcgagaaaccttacaaatgtgagatttgtggtaaagggtttagccaatccagctatttacagatccatcagaaagcgcactctatcgaaaagccattcaaatgtgaggagtgtggccaaggttttaaccagagctctcggcttcagatacaccagctgatccacacaggagagaagccctacaagtgcgaagaatgtggcaagggattcagccggcgagctgacctcaagatccactgtcggatccacactggagagaaaccctataactgcgaagagtgcggcaaggttttccgacaggcatccaacttgcttgcgcaccagagagtgcactccggagaaaaaccatttaaatgcgaggagtgcggtaagagctttgggaggtcggcccacctgcaggctcaccagaaggtacacacgggggataaaccctataagtgcgatgagtgcggcaagggctttaaatggagcctgaatctggatatgcaccagcgagtccacaccggtgaaaagccatataaatgcggggaatgcggcaaatacttctcacaggcctcttctctgcaactgcaccagagcgtgcatacaggcgaaaaaccatataagtgcgatgtgtgcggcaaggttttttctagaagctcacagcttcagtcccaccagagggttcacaccggcgagaagccttataagtgcgaaatctgtgggaagtctttttcctggcgcagcaacctgaccgtccaccatcggattcatgttggagacaagtcgtataagtccaacagaggaggaaaaaatattcgggagagtacccaggagaagaagtctattaagtag

SEQ ID NO: 21347 - DNA, 285 bp, Artificial Sequence
  Description of Artificial Sequence: Synthetic coding sequence
atgaacatgttcaaggaggccgtgaccttcaaggacgtggccgtggccttcaccgaagaagaacttggcctgctggggccggcccagcgcaaactttacagagacgtaatggttgagaacttccggaatctgttgtctgtcggccacccaccttttaaacaggacgtctcaccaatagaacgcaatgagcagctctggataatgaccactgctaccaggcgtcagggtaatctagatactctgctggtgaaagcccttctgctctacgatttggcccaaacctag

SEQ ID NO: 21348 - DNA, 2103 bp, Artificial Sequence
  Description of Artificial Sequence: Synthetic coding sequence
atgaccaccttcaaggagggcctgaccttcaaggacgtggccgtggtattcaccgaggaagaactggggctgctggaccctgttcagcgcaatctataccaggacgtgatgctggagaatttcaggaacttgctgtcagtgggccaccaccctttcaagcacgatgtattcctgttggagaaggaaaagaaattggacataatgaagaccgctactcagcgcaagggaaaatccgccgacaaaattcaaagcgaagttgagaccgttcctgaagctggacgccatgaggagctgtattgggggcagatatggaaacagatcgcctcggatctcattaaatatgaagattctatgatctcgataagtcgattccccagacagggcgatctgtcttgccaagtgcgagcgggtctctataccacgcatactggtcagaaattctaccagtgcgacgagtataaaaagagttttacggacgtgttcaacttcgacctgcaccagcagcttcacagcggggaaaagtctcacacctgcgatgagtgtgggaagtccttctgttatatttctgctctgcacattcatcagcgcgttcacatgggggagaaatgctataagtgcgacgtttgtggaaaagagttcagtcagtcttctcacctgcaaacacatcagagggtccataccgtcgagaagccattcaaatgcgttgaatgtggcaaagggttttcgcggaggagtactctgaccgttcattgtaagctacacagtggcgagaagccctacaattgcgaggaatgtggcagggcctttatccatgcttctcacctgcaggagcatcagcggatccataccggtgagaagcccttcaaatgcgatacctgtggaaagaatttcagaagacgcagcgcactgaacaatcactgcatggtgcacaccggcgagaagccgtataagtgcgaggattgcggcaagtgctttacctgcagctcgaacctacgcatccaccaaagagtgcataccggcgaaaagccttacaaatgcgaggagtgtgggaagtgcttcatacagcctagtcagttccaggcgcatcgtagaatccataccggggagaagccctacgtctgtaaagtgtgtggcaaggggttcatatactcttcttccttccaagctcatcagggcgtgcacacgggtgaaaaaccctacaaatgtaacgagtgcgggaagtctttccgcatgaagattcattatcaggtccatcttgtcgttcacacaggcgagaaaccgtataagtgtgaggtatgcgggaaagccttcaggcagtcttcttacttgaagatccatctgaaagcccatagcgtacagaagccttttaagtgcgaagaatgcgggcagggttttaatcaatcaagtaggctgcaaattcaccagctcatccacacaggcgaaaagccctataagtgtgaagagtgcggcaagggctttagtcgaagggcagacctgaagatccactgtagaatccacaccggtgagaaaccgtataactgcgaggagtgcggaaaagtgttcagccaagcctcccacttgctgacccaccagagggtacatagtggcgaaaaaccttttaagtgcgaggagtgtggaaagagttttagccgaagtgcccacctgcaggctcaccagaaggtgcacacaggcgaaaaaccttacaagtgtggtgagtgtggaaagggattcaaatggtcactaaacctagatatgcatcaacgcgtgcataccggggaaaagccatacacttgcggcgaatgcgggaaacatttcagtcaggcgagctccctgcagctccatcaatctgtgcacacgggcgaaaaaccatataaatgtgacgtgtgcggtaaagtgttcagccgctcttcccagctgcagtatcaccgccgcgtacatactggagagaaaccttacaaatgtgaaatttgtggtaagcgatttagctggcgttccaatctggtcagtcatcacaaaatccacgccgcgggtaccttctatgagaacgacgaaaatagtaaaaatattcgggagctgtctgaaggcggatcaagtaccagatag

SEQ ID NO: 21349 - DNA, 2412 bp, Artificial Sequence
  Description of Artificial Sequence: Synthetic coding sequence
atgaacatgttcaaggaggccgtgaccttcaaggacgtggccgtggccttcacagaagaggagctcggcctcctcggcccagcccaaagaaagctgtatagagatgtgatggtagaaaacttcaggaacctactgtccgtgggccatccgcctttcaagcaagacgtgtccccaattgagcggaacgaacagctgtggattatgaccacggctactcggagacagggaaatcttggagagaagaatcagagtaagttaataaccgtgcaagatagggagtctgaagaggagctgtcttgctggcagatctggcagcagatcgccaacgatctgaccaggtgtcaagatagtatgattaataattctcaatgtcataagcaaggcgactttccctaccaggtggggacagaactgagtattcagattagcgaggatgagaattacattgtgaacaaggctgacggccccaacaataccgggaaccctgagttcccaatcctcagaacacaggacagctggcgtaaaactttcctcacagagtcacaaaggctgaatagggatcagcaaatttccatcaaaaacaaactctgtcagtgtaagaagggtgtggatcccatcggctggattagccatcacgacggacaccgggtgcataagagtgagaaatcataccgccctaacgactacgaaaaggataacatgaaaatcctcacattcgatcacaattctatgattcataccggccagaagagttaccagtgcaatgaatgcaagaaacccttctcagacctgagctcattcgatctgcatcaacagcttcagtctggcgagaagagcctgacgtgcgttgagaggggcaagggcttctgttatagtcccgttctgcctgtccaccaaaaggttcacgttggcgagaaactgaagtgcgacgagtgtgggaaagagtttagtcaaggcgcgcaccttcagacccatcagaaggtccatgttatcgagaaaccctataaatgtaagcaatgcggaaaggggtttagtcgaaggtcagcgcttaacgtccactgtaaggtgcataccgccgagaagccgtacaattgcgaagaatgcggaagggccttttcccaggcttctcatctgcaggatcaccagcggctgcatactggagagaagcccttcaaatgcgatgcctgcgggaagtccttctctcggaactctcatttgcagagccaccagcgcgtccacaccggtgaaaagccctacaaatgcgaggaatgcgggaagggcttcatttgttctagtaatctttacatacaccagcgggttcataccggcgagaagccttacaaatgtgaggagtgcgggaagggattctcaagaccaagttccctccaagcccaccagggggttcataccggagaaaagtcgtatatctgcacagtgtgtggcaagggttttacactgagcagcaatctgcaggcacaccagcgcgttcacacgggtgaaaagccctataagtgcaacgagtgtggaaaatctttcaggcggaacagccattatcaagtgcatctggtggttcacaccggggagaagccatataaatgtgaaatctgtggcaagggatttagccagtctagttacctgcaaattcaccagaaggcacattcgatcgaaaaaccgttcaagtgcgaggaatgcggtcaggggttcaaccagtcgtcaagattgcaaatccaccagctcatccatactggagagaagccgtacaaatgcgaagaatgtggaaagggcttctcccgaagagctgacctcaaaattcactgcaggattcacacaggcgagaagccgtacaattgcgaggaatgcgggaaggtgttcagacaggcctccaacctgctcgcccaccagagggtccattcaggcgaaaagccctttaagtgtgaggaatgcggcaagagtttcggccgctctgcgcacctgcaggcccatcagaaggttcacactggggacaagccgtataagtgtgacgaatgcgggaaggggtttaaatggagtctgaatttggatatgcatcagcgggtgcataccggtgagaagccatacaagtgtggtgagtgtgggaagtacttcagccaggccagctcgttgcaattacaccagagcgtgcatactggcgaaaaaccttacaaatgtgacgtctgcgggaaggtgttcagtcgatcaagtcagctgcagtcccatcagagagtgcacacaggcgagaagccatataaatgcgagatctgtggcaaaagcttcagctggagatcaaaccttactgtgcatcaccggatccacgtcggggacaagagctacaagtcaaatagaggtgggaagaacatccgtgaatcgacacaggagaagaaaagtatcaagtag

SEQ ID NO: 21350 - DNA, 207 bp, Artificial Sequence
  Description of Artificial Sequence: Synthetic coding sequence
ctgaagagccccaccagcagcgagctgcacgtgggcgagaagctgaagtgtgatgagtgcggcaaggagttcagccagggagctcacctccagacccaccagaaagtccacgtgatagaaaaaccctacaaatgcaagcagtgcggaaagggtttcagtcggcgcagtgcactgaacgtgcattgcaaagtccacacagctgaatag

SEQ ID NO: 21351 - DNA, 207 bp, Artificial Sequence
  Description of Artificial Sequence: Synthetic coding sequence
cacagcggcgagaagagccacacctgcgacgagtgcaaggccagcgttaccagccagccttttatccatcagagagtccacatgggagaaaagtgctacaagtgcgatgtctgcggcaaggaatttagccagtccagtcacctgcaaacacaccagagagtgcacacagtggaaaagcccttcaagtgcgtggagtgcgggaaatag

SEQ ID NO: 21352 - DNA, 2400 bp, Artificial Sequence
  Description of Artificial Sequence: Synthetic coding sequence
atgcccagccagaactacgacctgccccagaagaagcaggagaagatgaccaagttccaggaagccgtgactttcaaggatgtagccgttgttttctcccgtgaggaacttagactgttggaccttacacagaggaaactgtaccgggacgtgatggtcgaaaacttcaaaaacctggtggcggtgggtcatctgccgttccagccggatatggtgagtcagctcgaggcagaggagaaactttggatgatggaaaccgaaacccagagatcttcaaaacaccaaaacaaaatggaaacactccagaaattcgcattgaagtacctttctaatcaggaactgagttgctggcaaatctggaagcaggtggccagtgagttgaccaggtgcctgcaaggcaaaagcagtcagcttctgcagggagactcaatccaagtgtccgagaatgagaacaacataatgaatccaaagggcgacagctctatttacattgagaatcaggagtttcctttctggcggactcagcactcttgcggcaacacctatttatcagaatcacaaatacaaagccggggaaagcagatcgatgtgaaaaacaatctgcagatccacgaggacttcatgaagaagtcccccttccacgaacatatcaaaacagatactgagccaaagccctgcaaaggcaatgaatatggcaagataatatccgacggctcaaaccagaaattgcccttaggggaaaagccccatccttgcggcgagtgtggacggggcttctcttacagtccccgtctgccattgcaccccaatgttcatacaggggagaagtgcttctcacagtcctcacacctaagaacacaccagcggatccaccccggagaaaagcttaaccgatgccatgagagcggcgattgtttcaataaaagcagcttccatagttaccaatctaatcacacaggagaaaagtcataccgctgtgacagctgcggtaagggcttcagctcttccaccggcctgataatccactatcggacccacacaggggaaaaaccctacaaatgcgaggagtgtggtaaatgtttctcccagagttccaatttccagtgccaccaacgcgttcataccgaagaaaagccctataagtgtgaggaatgtggcaaaggtttcggctggagtgtgaacctccgcgtgcaccaacgagtgcaccgcggggagaagccatataagtgcgaggagtgtggaaaaggattcacccaggcagcccactttcatatccatcagcgcgtccacacaggcgagaaaccctataaatgcgatgtctgtggtaaggggttctcgcataatagtccacttatttgccacaggcgtgtgcatacgggggagaagccttataaatgcgaagcctgcgggaagggttttacaagaaacactgacctgcacatccactttcgcgtgcacactggcgaaaagccttataaatgtaaggaatgtggcaaggggtttagtcaggcaagcaacttgcaggtgcaccaaaatgtccatacaggcgaaaaacgatttaaatgcgagacgtgtggtaagggctttagccaaagttcgaagttacaaacgcaccagcgtgttcataccggggagaagccttaccgctgcgatgtctgcggcaaggacttttcctattcttccaacttgaagcttcaccaggtcattcacacgggcgaaaagccctataaatgcgaagaatgcggtaaaggttttagctggagatccaacctgcatgcccaccagcgagttcactctggcgaaaagccatataaatgcgagcagtgcgacaagtcattctctcaggcaatcgatttccgtgtgcatcagcgcgtgcatactggagagaagccttacaagtgcggggtgtgcggtaagggcttttcccagagctctgggctgcagtctcaccaacgggtacatactggggagaaaccttacaaatgcgacgtctgcggcaaaggctttaggtacagttcccagtttatttaccaccagaggggtcacacaggcgaaaaaccctataagtgcgaggagtgtggcaaggggttcgggcgaagcctcaacttgcggcaccaccagcgggtgcataccggcgaaaaaccacacatttgcgaggaatgtggaaaggccttttccttgccaagcaaccttcgggtgcatcttggtgtgcatacaagagaaaaactctttaagtgcgaggagtgcggaaaagggttcagtcaatcagcccgtctggaggcccaccaacgggtacacacgggcgaaaagccctataagtgtgatatctgcgataaggacttcagacatagatcccgtcttacttaccatcagaaggtgcacaccggcaagaagttgtag

SEQ ID NO: 21353 - DNA, 2271 bp, Artificial Sequence
  Description of Artificial Sequence: Synthetic coding sequence
atgaccaagttccaggaggccgtgaccttcaaggacgtggccgtggtttttagtagagaggagctgcgactgctcgatttgactcagagaaaattgtaccgcgatgtaatggtagaaaatttcaaaaacttagttgctgtggggtccaaacaccaaaataaaatggaaacccttcagaaatttgccctgaagtatctctcaaaccaggagctgtcttgctggcagatatggaaacaggtagcaagtgagctgacacgctgcttgcagggaaagagctcgcagctactgcagggtgatagcatccaggtcagcgagaatgagaacaacattatgaaccctaagggagattcaagcatctatatcgagaatcaagagttcccattctggcggactcagcatagctgtggcaacacctacctgtccgaatctcagattcaaagcagagggaagcagattgacgttaagaacaacctgcaaattcacgaggatttcatgaaaaaaagcccattccacgaacacataaaaaccgatactgaaccaaaaccctgcaagggcaatgaatatgggaaaatcatttcagacgggtctaatcaaaagctacctctgggggaaaagccgcacccttgcggggagtgtggaaggggattttcgtacagccccaggttgcctctgcaccctaatgtgcacaccggggaaaaatgcttcagtcagtcgagccatctgagaacacatcagagaattcatccgggggagaagctgaacaggtgccacgaatccggggattgtttcaacaagagtagtttccacagctatcagagtaatcacacgggcgaaaagtcttatcgctgcgacagttgcggcaagggattctcctctagcactgggctgattattcactatcgcacccacacaggagagaaaccttataagtgtgaggaatgcggcaaatgcttttcccagtctagcaactttcagtgtcatcagcgggtgcataccgaggagaagccctataaatgtgaagagtgcgggaaaggcttcggatggtcggtcaatctaagagtgcaccagcgcgtgcatcgaggcgaaaagccctataagtgtgaggagtgcgggaaagggttcacccaagccgcccactttcacatccatcaaagggtgcacaccggagaaaagccctataagtgcgacgtctgtggtaaagggttcagtcataactcacctctgatttgccaccgacgcgtgcatacgggggagaagccatataagtgcgaagcctgtggcaaaggatttactcgcaacacagatcttcacatccacttccgcgtgcacaccggagagaagccctataagtgtaaggaatgcggtaaaggctttagtcaggcctccaatctacaggtgcatcagaatgtgcacacaggtgagaaaagatttaagtgcgaaacttgcgggaaggggtttagtcagtctagtaaattacaaacccaccagcgcgtacacacaggagaaaagccttaccgctgcgacgtctgtggcaaagattttagctactcgagcaatctgaagctacaccaggtgattcacactggagagaagccatacaaatgcgaggagtgcgggaagggattttcctggcggtccaacctgcatgcacaccagcgcgtccattcaggcgagaaaccatacaagtgtgaacaatgtgataagtcttttagccaggctatcgatttccgcgtgcaccagagggtgcatacaggggagaagccatacaaatgtggtgtctgcggtaagggcttcagtcagagtagtggactgcagtcgcaccagcgcgtccataccggcgaaaagccttacaaatgtgacgtgtgcggaaagggattccggtactcaagtcaatttatctatcatcagcgcggccacactggcgagaagccctataaatgtgaagagtgcggcaaaggcttcgggcgctcattaaacttgagacatcaccagcgagtccacactggagagaagcctcacatctgtgaggagtgtggaaaggccttttcgctcccttcgaatctgagggtccatctaggcgtgcacactcgggagaaactgttcaagtgcgaggaatgtggcaagggcttcagccagagcgccaggctggaagctcatcagcgcgtgcacactggggagaaaccttacaagtgtgatatttgtgataaagactttcgccaccggtctcggttgacatatcatcagaaagtccacacaggcaagaaactgtag

SEQ ID NO: 21354 - DNA, 1317 bp, Artificial Sequence
  Description of Artificial Sequence: Synthetic coding sequence
cacgagagcggcgactgcttcaacaagagcagcttccacagctaccagtcaaaccacacgggcgagaagtcatacaggtgcgatagctgcggcaaggggttctctagctcaaccggattaattattcactaccggactcacactggcgagaagccatataaatgcgaagagtgcggcaagtgtttttcccagagtagtaacttccagtgccaccagagggtccacactgaagaaaagccctacaagtgtgaggaatgcggtaagggctttggatggagcgttaacctcagggttcaccagcgggttcaccggggagagaaaccttataaatgtgaagagtgcggcaagggcttcacccaggcagcccattttcacatccatcagcgggttcacaccggggagaaaccctacaagtgcgacgtgtgcggaaagggtttcagccacaactcccccctgatctgccaccgccgcgtgcataccggggagaagccctataaatgtgaggcctgcggaaaaggtttcacccggaacaccgacttacacatccattttagagttcacacaggcgaaaaaccgtataaatgtaaggagtgtggcaaaggattcagccaggcctccaatctccaagtccaccagaacgtccatacgggggagaagaggttcaaatgcgagacctgtgggaaagggttctctcagagctcaaaactgcaaacgagagagaagccttacaaatgcgaacaatgcgataagagcttttcccaggctattgacttccgagtgcaccagagagtccatacaggagaaaaaccctacaaatgtggggtgtgtggcaaggggttcagccaatcgagtggcttgcaatctcatcagcgcgtgcacaccggagaaaaaccctataaatgcgacgtgtgcggcaaagggtttaggtattcaagtcagtttatttatcaccagagaggccataccggcgagaaaccctacaagtgtgaggagtgtgggaagggatttggccggtccctcaatttgaggcaccatcagagggtgcacaccggagagaagcctcacatctgcgaggagtgcggtaaggcatttagcctgccttctaacttgcgggtccaccttggggttcacaccagggagaaactgtttaaatgtgaagaatgtggcaagggcttcagccagagtgcccgtctggaagcccaccagcgcgtccatacgggcgagaaaccatacaaatgcgacatttgtgataaagattttcggcaccggtcgagattgacctatcaccagaaagtgcacacggggaagaaactttag

SEQ ID NO: 21355 - DNA, 2247 bp, Artificial Sequence
  Description of Artificial Sequence: Synthetic coding sequence
atggtggagaacttcaagaacctggtggccgtgggccacctgccctttcagcccgacatggtgtcacagctggaagcagaagagaaattgtggatgatggagacagaaacacagcgctcttctaaacaccagaataagatggagacgctgcagaaatttgcgctgaaatatctctccaatcaggagctgagttgttggcaaatctggaagcaggtggcgagtgaattaacgaggtgtctccagggtaaatctagccagctgttacagggtgattccattcaggttagcgaaaatgaaaataacatcatgaatcccaaaggcgattcctcaatatacatcgaaaaccaagagtttcctttctggcgaacccagcactcatgcggaaatacttacttatccgaatcccagatccaaagccggggcaaacagattgacgtgaaaaacaacctccagatacacgaagacttcatgaagaaatcccctttccacgaacacattaagacggacaccgaaccaaagccgtgtaaaggcaatgaatatggaaagatcatatcagatgggagtaatcagaaactccccttgggtgaaaagccccacccatgtggagaatgcggacgaggcttttcatattccccccgcctgccactccaccctaatgtgcacactggcgagaaatgtttttctcagagtagtcacctgcggactcaccagagaatccatcctggggagaaactgaaccgctgccacgagtccggtgactgcttcaataagtcttcattccattcttaccagtccaaccacacgggcgaaaagtcatacagatgcgactcctgcggcaagggctttagcagctccacagggttaatcattcattatcgtacccacacaggggagaaaccttacaaatgtgaggagtgtggtaagtgcttttcacagtcctctaattttcagtgccaccagcgggtgcacacagaagaaaagccgtacaagtgtgaggagtgtgggaagggctttggctggagcgtgaacctgcgcgtgcaccagcgcgtccatcggggcgagaaaccctataaatgcgaagagtgcggcaaaggctttacacaggcagcacactttcacattcaccagagggtccataccggagagaagccctacaaatgcgacgtatgcgggaagggcttctcacacaatagtcctctcatatgtcacagacgggtgcacactggggagaaaccatataagtgtgaggcttgcggcaaaggatttaccaggaacactgacctccatatccacttccgtgttcatactggggagaaaccatacaagtgcaaggaatgtggcaaaggattttcccaagcctcgaatttacaggtgcatcaaaacgtgcacactggggagaagagattcaagtgcgaaacctgcgggaaaggcttcagccaatcatcaaagcttcagacacaccagagagtgcataccggggagaagccatacaggtgcgatgtatgcggaaaagacttttcttacagctccaatttaaagctgcaccaagtcatccacacaggagaaaagccatataagtgcgaggagtgcggtaaggggttttcctggcggtccaatctgcacgctcatcagcgggttcacagtggtgagaaaccatataagtgcgagcagtgcgataaatctttctcccaggctattgattttcgagtccaccagcgggtgcacacaggggaaaagccctataagtgtggcgtgtgtgggaagggctttagtcaatcctctgggctccagtcccaccagcgggtccataccggcgagaaaccttacaagtgtgatgtgtgcgggaaggggttcagatacagctcgcaatttatctaccaccagcgcgggcacacaggagaaaaaccctacaaatgcgaggaatgcggaaaggggttcggcaggtcccttaacctacgtcatcatcagcgcgtgcacacaggcgagaaaccccacatctgtgaggaatgcggcaaggctttctccttgccgagcaatttgagagttcacctgggagttcacacaagagagaaactgttcaagtgtgaagaatgcgggaaaggtttttcacagtctgcacggctggaggcacaccagcgagtccacaccggagagaaaccttataaatgcgatatctgtgacaaggattttcgtcacaggagccgtctcacttaccaccaaaaggttcatactggtaaaaagctctag

SEQ ID NO: 21356 - DNA, 2337 bp, Artificial Sequence
  Description of Artificial Sequence: Synthetic coding sequence
aaggtgacccagctgcaggaggccgtgaccttcaaggacgtggccgttgttttcagcagagaggagctaaggttgcttgacctcactcaacgcaagttataccgagatgttatggtcgagaacttcaagaacttggttgctgtagacatggtgagtcagttggaagccgaagaaaaactctggatgatggaaacagagacacagcgctcttcgaaacaccagaacaagatggagaccttgcagaagttcgctctgaagtacctttcaaaccaggaactcagctgttggcagatttggaagcaggtggcctcagaactgacccgatgcctacagggcaagtcttcgcaactgctccagggggactctatccaggtgagcgagaacgagaacaatatcatgaaccctaaaggagatagtagcatttatattgaaaaccaggaatttccgttctggaggacccagcactcttgcgggaatacatacttgtccgagtctcagattcagtcccggggaaagcaaatagacgtgaaaaataatctgcagatccatgaagactttatgaagaagtcaccttttcacgaacacattaaaaccgacacagagccgaaaccctgcaagggaaatgagtatgggaagattatttctgatggtagcaatcagaagcttcccctcggagagaaacctcatccctgtggggaatgcggtagaggattcagttacagccctaggctgcctttgcaccctaacgtccataccggtgagaagtgtttttcccaaagctctcacttgcgcactcaccagcgtattcatcctggagagaaactaaataggtgtcatgaatccggggactgttttaataagagtagtttccactcctatcagtctaaccataccggggagaaatcctacaggtgtgactcttgtggcaagggctttagctcttccaccggcttaataatccattaccgaactcacaccggggaaaagccctacaaatgcgaggaatgtgggaaatgcttctcccaaagcagcaattttcagtgtcatcagcgggtccatactgaagaaaaaccgtacaagtgcgaggagtgcggcaaaggatttgggtggagtgtgaacctgcgagtgcatcagcgggtgcacagaggtgaaaaaccttataagtgtgaggaatgtggcaaggggttcactcaggcagcacacttccatatccaccagcgcgtgcatactggcgaaaagccatacaaatgtgacgtgtgcggaaaagggttttcccacaatagccccctgatttgccacagaagagtacataccggcgaaaagccctacaagtgcgaggcctgcggaaaaggatttacgagaaatacagatctccacatacatttcagagtgcatacaggcgaaaagccatacaaatgcaaagagtgtggcaagggttttagtcaagcctcaaatcttcaggtgcaccaaaatgtacatactggtgagaagcgatttaagtgcgagacttgtgggaaaggatttagtcagtcatctaaactgcaaactcaccaaagagtacataccggggagaagccctaccgttgtgatgtgtgcggtaaggattttagctactcaagtaacctgaaactccatcaggtgatccataccggcgagaagccttacaagtgcgaagagtgtggaaaagggtttagctggaggtccaacctgcatgcccatcagcgtgtgcatagtggcgaaaagccttataagtgtgaacagtgcgataagagcttcagccaggcgatcgacttccgcgtgcaccagcgagttcataccggagagaagccttacaaatgtggagtttgcggcaaagggttctcacagagtagcgggctgcagtctcatcaaagggtccacacaggagaaaaaccatacaaatgcgacgtatgcggcaaggggttcagatattccagccagttcatttatcatcagagggggcataccggagaaaaaccatataagtgtgaagagtgcggaaagggattcggccggtcactgaatctgaggcaccatcaacgtgtgcacacaggtgagaaaccccacatttgcgaagagtgtggcaaggccttctccctcccatcaaatcttcgcgtgcatctgggagtccatacaagggagaaactgttcaagtgcgaggagtgtggtaaggggtttagtcagtccgctcgcttagaagcccatcagagagtccacactggtgaaaaaccctacaagtgtgatatctgcgacaaggatttccgacatcgttcccgtctgacatatcatcagaaagtgcatactggcaagaagctctag

SEQ ID NO: 21357 - DNA, 2478 bp, Artificial Sequence
  Description of Artificial Sequence: Synthetic coding sequence
atggagaccctgaccagccggcacgagaagcgggccctgcacagccaggcatccgctattagccaagaccgggaagaaaaaatcatgtcgcaggaaccgctgagtttcaaggacgttgccgtggtcttcactgaagaagaactggagttgctggattcaacccagcggcaattatatcaagatgtgatgcaagagaacttcaggaacttactcagtgtgggtgagcggaatcccctcggcgacaaaaacggtaaggacactgagtatatccaagatgaggagttgagattctttagccataaagagctgtcgtcttgcaagatctgggaggaggtggctggggagctgccaggaagccaggattgccgggtcaacttgcagggtaaggacttccagttctccgaagatgccgccccacatcaaggatgggagggagcatccacaccatgctttccgatagaaaactcccttgatagtttacagggagacgggcttattggtttggaaaaccagcagttcccagcctggcgcgccattcgccccatccctatccaaggtagctgggctaaagcctttgttaatcagctaggcgatgtgcaggagcgatgcaagaacctggacaccgaggatacagtctacaagtgtaattgggatgatgacagcttctgctggatttcttgccacgttgaccatcgttttccagaaattgacaagccatgtggctgtaataaatgccggaaggattgcataaagaattctgtcctgcaccggattaacccaggcgaaaacggcctcaagtcgaatgagtacaggaatggatttcgagacgacgcagatctcccacctcatccccgcgtcccactcaaggagaaattgtgtcaatatgatgaattctccgaaggcctccggcatagcgcacacctgaatcgtcaccagcgggtgccaacgggagaaaagtccgttaagtcattggaacgcgggcggggcgtgcggcagaacacccacattagaaatcatcctcgggcacctgtgggcgacatgccatatcggtgtgatgtctgtggcaaaggattcagatacaaatctgtgctgctgattcaccagggagtccataccggtcgccgaccttataagtgtgaggaatgcggtaaagcgttcgggcgctcctccaacctcttggttcatcagagagttcacactggcgaaaaaccttataagtgttccgagtgcggcaagggcttctcctactcttccgtgttgcaagttcatcagaggctgcatacaggggagaaaccctacacatgtagtgaatgtgggaaaggcttttgtgctaagtctgcgctgcacaaacatcagcacattcatcccggcgagaagccgtactcgtgtggcgaatgcgggaaaggattttcctgctcaagtcatctctcctcccaccaaaagacacacacgggagaacgcccctatcagtgtgacaagtgcggcaaagggttttctcacaactcctatttacaggcacatcaaagggtacacatgggccagcacctgtacaaatgcaacgtatgcggcaaatccttttcatactctagcggacttcttatgcaccagcgactgcacaccggggaaaagccttataagtgcgaatgtggcaaatcctttggtaggagcagtgatcttcatatccaccagagggtgcatactggtgagaagccctataagtgtagcgaatgtggaaaagggtttcgacggaactcggaccttcacagccaccagcgggtacataccggggaaagaccctatgtgtgtgatgtatgtgggaaaggatttatctacagctctgatctgcttattcaccagagagtccacaccggtgagaaaccctacaagtgtgctgaatgcggcaagggcttcagctactccagtggcctccttattcaccagcgtgtgcacactggggaaaaaccgtaccggtgtcaggagtgcggcaagggtttcaggtgtacttcaagcctacataaacaccagagagtccatactggtaagaaaccatacacgtgcgaccagtgtggcaagggttttagttacggcagcaatctccgaactcaccagcgccttcacacaggagaaaagccgtatacttgctgtgaatgcggtaaggggttccggtacggctccggcctgctttcacataaaagggtacataccggagaaaagccataccgatgtcatgtctgtggtaagggctatagccagagcagtcatctccagggtcatcagcgagtgcataccggcgagaagccctataaatgtgaggagtgcgggaagggttttggacggaacagttgccttcatgtccatcagcgagtacacacgggcgaaaagccctacacatgcggggtgtgcggtaagggcttttcgtatacctctggactgcgaaatcaccaacgagttcacctgggcgagaacccatacaagtag

SEQ ID NO: 21358 - DNA, 2478 bp, Artificial Sequence
  Description of Artificial Sequence: Synthetic coding sequence
atggagaccctgaccagccggcacgagaagcgggccctgcacagccaggccagcgcgatcagccaggacagggaggagaaaattatgtcccaagagcctctctcattcaaagacgtcgcagttgtctttaccgaagaggaactggaactgctggatagtacccagcgacagctgtatcaagatgtaatgcaggagaattttagaaacctgctgtctgtgggagaacggaatccactgggggacaagaacggtaaagatactgagtatatccaggacgaggagctaaggttcttttcccataaagaactgtcttcttgtaaaatttgggaagaagttgccggtgagctgccaggctcacaggactgccgagttaacctccagggtaaggatttccagttctcagaggatgctgccccccaccaaggctgggaaggtgctagcacgccctgcttccccatagagaatagcttggacagtctgcagggagacgggctcataggccttgagaatcaacaattcccagcatggcgcgcaattcgccccatacctattcaaggcagctgggccaaggccttcgtcaatcaactcggcgatgttcaggagaggtgtaagaatctggacacggaggacacggtctacaaatgcaattgggacgacgattctttttgttggattagctgtcacgtcgaccatcggtttcccgagattgataaaccttgcggctgcaacaaatgccgtaaggactgcatcaagaacagcgtgcttcataggatcaaccctggggagaacgggttgaaaagtaatgaatatcgaaatggctttcgagacgatgccgatcttcctccccatcccagggttccacttaaagagaagctctgtcagtacgatgagtttagcgaaggactgagacatagcgcccaccttaacagacaccagcgcgtccctaccggggagaagtctgtgaaaagtttggagcgggggcgcggcgtgaggcagaatactcacatcaggaatcacccacgggctcctgtgggcgacatgccatatcgctgtgatgtatgtggaaagggctttcgttacaaatctgtgttattgatccaccaaggcgtgcacacagggcggaggccttataaatgtgaagagtgcggcaaggccttcggccgcagttcaaacctgctggtccatcagcgcgttcatacaggggaaaagccctataagtgtagtgagtgcgggaaaggtttttcctacagctctgtgctgcaggttcatcagaggctgcatactggggagaaaccctacacttgcagcgaatgcggcaaaggcttctgtgcaaagtccgcactgcataagcatcaacatatccaccccggggagaagccgtattcatgcggcgagtgcggaaaggggttcagctgcagctctcacttaagttcccaccagaaaacacacacaggagagagaccttaccaatgtgacaagtgcggaaagggctttagccacaactcatacttgcaagcccaccaacgagtgcacatgggtcagcatctgtataaatgcaacgtgtgtggcaagagcttctcatatagttctggcctgctcatgcatcaacgactgcacaccggggaaaaaccatacaaatgcgagtgcggcaaaagctttggtcgctccagtgatctgcacatccaccagcgagttcacacaggcgagaaaccttataagtgctcagagtgcgggaaggggttccggagaaattcagatctccactcccatcagcgtgtgcacaccggcgagcgcccatatgtgtgcgatgtgtgtggaaagggcttcatctactcgagtgaccttttgattcatcagcgggtccacaccggcgagaagccatacaaatgcgctgagtgtgggaagggattcagctacagtagtgggctgctcatccatcagcgtgtgcatactggcgagaaaccttaccggtgtcaggaatgcggaaagggattccgctgcacgtccagcttgcacaaacatcagagagtccatacagggaagaagccatatacatgcgatcagtgcgggaaggggtttagctatggtagcaacctcaggactcatcagcgactgcacactggtgaaaagccctatacatgttgcgaatgtggaaaggggtttcgttatggaagcggactcctgtcccacaagagagtccacaccggggaaaagccatataggtgccacgtgtgcggaaaggggtattctcagtcctcacatttgcaaggacatcagcgggtgcataccggagaaaagccttacaagtgtgaagaatgtggcaaagggttcggtagaaatagctgtctgcacgttcatcagcgagtgcatactggtgaaaaaccttacacctgcggggtgtgcggtaaagggttcagctacacaagtgggctgaggaatcatcagagggtccacctcggggaaaacccgtacaaatag

SEQ ID NO: 21359 - DNA, 1425 bp, Artificial Sequence
  Description of Artificial Sequence: Synthetic coding sequence
atgaccaccttcaaggaggccgtgaccttcaaggacgtggccgtgttctttacagaggaggagctgggtcttctggatccagcacagcgtaagctatatcaggatgtgatgttagaaaattttaccaacctgttatctgtcggccaccaaccatttcatcccttccattttttgagagaggagaaattctggatgatggaaactgccacccagagagaaggtaacagcgggggaaagacaatcgccgaggccggaccacacgaggactgtccatgccagcagatatgggagcaaaccgccagcgacctaacccagtcccaggattccattatcaacaacagtcactttttcgaacaaggcgatgttccttcacaggtggaagccggattgtccatcatccataccggccagaagcccagccagaatgggaaatgtaaacagtccttcagcgatgtcgccatctttgaccccccccaacagtttcacagcggagaaaagtcccacacttgtaatgaatgtggcaagagtttttgctatatctctgcactgaggatacatcagagagtgcatctgcgggagaaactgtcaaagtgcgatatgagagggaaggaattctctcagtctagctgtctgcagaccagggagagagttcacactggtgaaaagcccttcaaatgtgagcagtgcggaaagggattcaggtgtagagctatcctacaggtccattgcaagctccataccggggagaagccttatatttgcgagaagtgtggtcgtgccttcattcacgatttccagctccagaagcaccagatcatccataccggtgagaagccattcaaatgcgagatctgcggtaaatctttttgcttgagatccagtctcaaccggcactgtatggtgcacacagcagaaaagctgtataagtccgaagaatgtggtaaagggttcactgacagtctggatctgcacaagcaccagatcatccacaccggccagaaaccatacaattgtaaagagtgtgggaaaagcttccgctggagcagttacctgctcatacaccaaagaattcacagtggggagaaaccctaccgatgtgaggaatgcggcaaggggtacatctcgaaatcaggactcaacctacaccagagggtccataccggcgagcgcccctacaactgcaaagagtgcggcaaaagcttctctagggcctcttcaattctgaatcacaaaaaactccactgtcggaagaaaccattcaagtgcgaagactgtgggaaaagactagtgcatcgctcattctgcaaggaccagcagggtgatcataacggcgagaattcgtccaaatgtgaagattgtggcaagcgctataagagacgcctgaatctggacattatcctgtctttgttcctgaacgacatgtag

SEQ ID NO: 21360 - DNA, 1335 bp, Artificial Sequence
  Description of Artificial Sequence: Synthetic coding sequence
atggagccccccggccccgtgcggggccccctgcaggacagcagctggtacgagccatcagccgagctggtccagacccgaatggcagtcagtctcaccgctgctgaaacactagcactccagggtactcagggccaggagaagatgatgatgatgggaccaaaagaagaagagcagagttgcgagtacgagacacgccttcctggcaaccacagcacctctcaggagatcttccgacagaggtttcgccatctgaggtatcaagagacccccgggccaagagaagcgctgtcacagctgcgggttctgtgctgtgaatggcttagacctgagaagcacactaaggagcagattctagaattcctagtcctggagcagttcttaacaattcttcccgaagagctgcagagttgggtccgaggtcaccatcctaagagtggtgaagaggcggttactgtgcttgaggatctggagaaaggtctggagcccgagccccaggttcctggcccagcacatggcccagcgcaggaggagccatgggagaagaaggagagcctcggagccgctcaggaagccctctctatccagctccaaccaaaggagacccagccatttcctaaaagtgaacaggtttacctgcatttcttgtcagtggtgaccgaagacggtcctgagcccaaagacaagggcagcctcccgcagcccccaattaccgaggtcgagagccaggtcttttcagagaaattagccaccgacaccagcacctttgaagcaactagcgaggggaccctcgagttgcagcagcgaaatcccaaagcagagaggctgaggtggtctccggctcaggaggagtccttccgtcagatggtggtcatccacaaggagatacccacaggtaaaaaggaccacgagtgttcagagtgcggaaaaacgttcatctacaacagccacctcgtcgttcaccagcgtgtgcacagcggcgaaaagccctataagtgcagcgattgtggcaagactttcaaacagtcttcaaatttgggacagcaccagagaatccacaccggggaaaaaccatttgagtgcaacgagtgtggaaaagcgtttcgttggggagctcatctcgtccagcaccagcgtatccacagcggcgagaagccatacgaatgcaacgagtgtggaaaggccttcagtcagagctcctatctgtcccaacacagaagaatccactcgggcgaaaaaccattcatatgtaaggagtgtgggaaggcttatgggtggtgttccgagctcattagacacagacgagtgcatgcgcgcaaggaaccctctcactag

SEQ ID NO: 21361 - DNA, 579 bp, Artificial Sequence
  Description of Artificial Sequence: Synthetic coding sequence
atggccgtgagcctgaccgccgccgagaccctggccctgcagggcacgcaaggccaggagaaaatgatgatgatgggcccaaaggaagaggagcagtcctgtgagtatgagactaggttgcccggaaatcacagcacatcgcaagagatcttccggcaaagattccgacacctaaggtaccaggagacccccggaccccgagaggctctctcgcagcttagggtgttgtgttgtgagtggctccgtcctgagaagcataccaaagaacagattctggagttcctagtactggagcagttcttaaccatcctgccggaggaactccagagctgggtgaggggccatcaccccaagtcaggcgaagaagccgtgactgtcttggaagaccttgagaaaggactggagccagagcctcaggtcggcagaggcatctggtcagtgatgggagcccggttgatgacgttcaggcttgatagaggagcagcggtcggtgggggggccaagttcaaaccactcctggggcaggtagagcagctggtttgtgtatccgtttctgttttctccgcgctagaaccttag

SEQ ID NO: 21362 - DNA, 1704 bp, Artificial Sequence
  Description of Artificial Sequence: Synthetic coding sequence
ggccacaagaaccagaacgagatcgacaccctgcaggaggtgcggttgcgtttcttgtcatacgaggaccttatttgctggcaaatttgggagcagttcaccagcaaattaaccagcaatcaagacctcatcatcaatctacaaggcaagcggagtaagcttctcaagcagggggatagtccttgtcaggtttggactggcgagtcttcccaagtgagcgaagacgagaactacgttatcaaactgcaaggagaaagctcaaactctattaagaatcaggagctgccgctgaggaccacgtgggacttctggcggaagatgtatctgcgcgagccccaaaactaccagtctagatgtcaacaaatcgatgtcaagaacaaactgtgcaagtgcgatcactgcgtgcggcagagaattgcccaccagcatgacgatcatggcgtacacaagagggaaaaggcctttagccataacaactgtgggaaggactgtgtcaaagaaagctctcaacatagcattatacagtccggtgagcaaacctctgacgagaacggtaaggggctttcggttgggtcgaatctggaactgcatcagcagctgcatctacgcgataagccccacgtgaacgtagaatatggaaaaggaattggctattcaagcggcttacctaggcatcagtgtttccacatcggtgaaaagtgttatagaaacggggacagtggcgaaggattttctcagggcagccacttacagccccaccagcgggtgtccacaggtgaaaacctttatcgctgccaggtctatgcgcggtcttccaatcagaacagttgtctcccatcacacgaacttacccatccaggtgaaaaactgtgcacatgcggtaggtgtggcaaaggtttccaccattctttggactttgacatccattgcgttgactcagcgggggaaagggcttgtaaatgtgacgtctacgataaaggcttctcacagacctcacagctccaagcccaccagcgtgtgcacaccggcgagaagccttacaagtgcgaggtgtgtgacaagggattcagcaaagcgtctaacctccaggcacatcagagaattcatacaggtgagaagccctataaatgcgacgtctgcgacaagaactttagcaggaacagccacctgcaggcccaccaaagggtgcacaccggcgaaaaaccctacaagtgtgatacgtgtggcaaggacttctcccagatctcacatttgcaagcccatcagcgcgtgcacaaaggagaaaagccatataagtgcgagacatgtgggaagggcttcagtcaatcctcgcacctgcaggaccatcagcaggttcacactggagagaatccttataaatgtgatgtttgtggcaagggattctcctggtcttcccacctgcaggcccatcaaagagttcacacaggcgaaaaaccttacaaatgtgaagagtgccgaaaagggtttatctggaattcctacctgcacgtgcatcaaaggatccacacaggggagaagccatacaagtgtggcatgtgcgggaaaagttttagccagacttcccatctccaggctcatcagcgggtccataccggcgagaaaccatataaatgtttcgtgtgtggcaagggctttagtaagtcttcccttcagattcatcagagggttcatgatggagactag

SEQ ID NO: 21363 - DNA, 1959 bp, Artificial Sequence
  Description of Artificial Sequence: Synthetic coding sequence
atggtgaagcggagcatgcagcaggaggagctgaccatcctgaacatctatgctccaaatactggagcccccagatttattcgggcagtcgcttgtttcaggtccgggattttaggaagcgttgtccagaagcctctgcagccgtgtgtgttgcctcttcaggaaggcgaagccgcggtgatatacccactgtgggaggtgtcacagcgtggaactagcgctagtacagccagcttccccgggctgggtgtgggactcgccgtgttgccatctcaggaccccgcgctcccccagaaagagcaggagaaaatgaccaaattccagcttctggccatccggctacggctgcatttgctggatgttgtcggggatggcgacattcagggatgtggatgtggcctgcatcagggaggggccggtgtggctggaccatgtcctgaaaaagcggttcctcgctgcgatgccggggagctacaagagccagcagtttccggattaagcaccctgcagactcggtgcgacattactgtgggtaagcggcgtcaggcaagtgacgatggagataggaatcctaggagatgggtctttcgccaacgtatcgcccatcagcacgacgaccacggggtccacaagagggaaaaggcattctctcacaacaactgcggaaaggactgcgtgaaggagtcctcacagcatagtatcatccaaagtggagaacagacttccgacgaaaatgggaagggactaagcgtcggctctaatctggagttgcaccaacagcttcaccttcgcgataaaccccatgttaacgtggaatacggcaagggaatcggttactctagcggcctcccgcggcatcagtgcttccatatcggagagaagtgctacagaaatggagactcaggtgaggggtttagtcaagggtctcacctccaacctcatcagagagtgagcacaggggaaaacctctatagatgtcaggtctacgcgaggtcttcaaatcagaactcttgcctcccttcccacgagcttacccacccaggtgaaaaactctgtacctgtgggcgttgcgggaaaggattccatcacagcctggattttgatatccattgcgtcgattctgctggcgaaagggcctgcaagtgtgacgtttacgacaagggtttcagccagacctcacagctccaagcgcatcagcgtggccacagtagagacaaaacctataagtgggaggtctctgataggatttttaatcgcaactctggtctacaccagagagtgcacaccggggaaaagccttataagtgtgaagtctgtgacaagggtttttccaaagcatccaacttgcaggctcaccagcgcattcacacaggagagaagccatataaatgcgatgtctgtgataagaatttttctcgtaactcacatctccaggcccatcagcgggtccatactggagaaaaaccctacaagtgtgatacatgcgggaaggattttagccaaatctcccacttacaggcccaccagagggttcataaaggagaaaaaccctataaatgtgaaacatgtgggaagggattctctcaaagttcccacctgcaagatcatcagcaggtgcacactggagagaatccctacaagtgcgatgtatgtggcaagggcttttcatggtccagtcacttgcaggcacaccagcgagtgcatactggggagaaaccctataaatgtgaggaatgtaggaaggggtttatttggaacagttatctccatgtgcaccaacgtatccatactggggaaaagccatacaagtgcggcatgtgcgggaagagcttttcacagacctcacatctccaagcccaccagagggtacataccggggagaagccatataaatgctttgtctgcggtaaagggttcagcaaaagttccctcagttctgatagttcagaatctccttag

SEQ ID NO: 21364 - DNA, 2013 bp, Artificial Sequence
  Description of Artificial Sequence: Synthetic coding sequence
atgaccaagttccaggagatggtgaccttcaaggacgtggccgtggtttttacgagggaagaactcggtctattggatttagcccaaaggaagttataccaggatgtcatgttagagaactttaggaatctgctttccgtgggctatcaacccttcaaattggacgttattctgcaattggggaaagaggacaagctgcgaatgatggaaaccgaaatccagggcgatgggtgttcagggcacaaaaatcaaaatgagatcgatacactgcaggaggtacgtcttaggtttttaagttatgaagacctaatatgctggcagatttgggagcaattcaccagcaagctcaccagcaaccaggacctcattattaatctccagggcaagaggtctaaactcctgaaacaaggagacagcccgtgtcaggtgtggacaggcgagtcaagccaggtatcagaggacgagaattacgtgatcaagctgcagggagaaagctccaacagcataaaaaatcaggaattacctctgaggacaacatgggacttttggcgcaagatgtacctcagagagccccagaactaccagtctcgctgtcagcagatcgacgtcaagaacaagctgtgcaagtgtgaccactgcgtgagacagaggattgcacatcagcatgatgatcatggtgtccacaagcgtgagaaagcattttcacacaataactgcgggaaagactgcgtgaaagaatccagtcagcacagtatcatccagagcggggaacagaccagcgatgaaaacggcaaaggactgtccgttggtagcaatcttgagctacatcagcagctccatctgcgcgacaagccacatgtcaatgtggagtatggcaagggtatcgggtatagttcggggcttccgagacatcagtgcttccacatcggagagaagtgttatagaaatggcgactctggggaaggcttcagccaaggtagccacttgcaaccccatcagagagtatcaactggggagaacctctatcggtgccaggtgtacgccagatcctctaatcaaaatagttgccttccttcgcatgagctgacgcaccctggcgagaaactgtgcacgtgcggccggtgtggaaaggggttccaccactccttagacttcgatatccattgtgtagattctgccggggaaagggcctgcaagtgcgatgtctacgacaagggcttctctcaaacctctcaactgcaggcgcatcagagggggcattctcgcgataaaacctataagtgggaagtcagtgatcggatcttcaaccgaaacagcggactgcaccagagggtccatacgggagagaaaccatataagtgtgaagtatgcgacaagggattttctaaagcaagtaacctgcaagcacaccagaggatccacacaggtgaaaaaccatacaaatgcgacgtatgcgacaaaaacttcagtcgcaacagtcacctgcaagcccaccaacgggttcacaccggcgaaaagccttacaaatgcgatacatgcggaaaggatttttcgcagatctctcacctgcaggctcaccagcgagtccacaaaggggagaagccatataaatgcgagacttgcgggaagggattcagccagagctcacacctgcaggaccaccagcaggtgcacacaggcgagaacccatataagtgcgacgtgtgcgggaagggcttcagttggagctctcatctacaagcccaccagcgcgtgcacacgggcgaaaagccctataaatgcgaggaatgtcggaagggattcatatggaattcatacctgcacgtgcatcagcgcatccacacaggcgagaagccttataagtgtggtatgtgtggaaagagtttctctcagacgtcacacctgcaggctcaccagagagttcacacaggcgagaagccttataagtgtttcgtctgcgggaaaggcttcagtaagagctctctgagcagcgatagctcagagagtccttag

SEQ ID NO: 21365 - DNA, 321 bp, Artificial Sequence
  Description of Artificial Sequence: Synthetic coding sequence
ggccacaagaaccagaacgagatcgacaccctgcaggaggtgcggttgagattcctctcctatgaagatttgatctgctggcagatatgggaacagttcacctctaagttgacgagcaatcaagacctgatcatcaaccttcaggggaagcggtccaaactgctaaaacaaggagatagcccctgtcaggtatggactggggaatcctcgcaagtgagtgaagatgaaaattacgtgataaagctccaaggagagtcctctaactctattaaaaaccaggaactcccatcccagaagaagaaaaaaaaaaagaagaaatag

SEQ ID NO: 21366 - DNA, 2217 bp, Artificial Sequence
  Description of Artificial Sequence: Synthetic coding sequence
atgaccaagttccaggaggccgtgaccttcaaggacgtggccgtggcatttacagaagaggaacttggacttttggacagcgctcagaggaaactgtaccgagatgtgatgcttgagaacttccgtaatctcgtgtcggtggggcaccagtcgttcaagccagacatgatcagtcaacttgaacgggaggaaaagctgtggatgaaagagctccagacccagagagggaagcacagcggtgaccgcaatcagaatgaaatggctactttacataaagcaggattacgctgtttcagcctaggcgaacttagttgctggcagattaagcggcacatcgcgtccaagcttgcgaggtcgcaagattcaatgattaacattgagggaaaaagctcccagttcccgaagcaccacgatagtccgtgtcaggtcggtgccggtgagagtatccaggcgagcgttgatgataactgtcttgtcaatcatattggagaccactcgtccattattgaaaaccaggagtttcctactggtaaagtccctaatagctggtccaagatctacctgaacgaaacccagaactaccagaggtcatgcaagcagacacagatgaaaaataagctgtgcatttttgcaccttacgtggacatcttctcctgcatttcccaccatcacgacgataatatcgtgcataagcgggacaaagtccactccaacagtgattgtggtaaagacacactgaaagtctcccctctgacacagcgcagtattcacacaggacagaagacttaccagggcaacgagtgcgaagaagcttttaacgactcatcttccttggaactccacaaacaggtgcacttggggaagaaaagtcccgcatgttccactcacgagaaggatacctcctacagcagtgggattcctgttcagcagagcgtgcgtactggaaaaaagagatactggtgtcacgaatgcggcaaaggcttctcacagtcttcaaacctgcagacccaccaacgggttcacacaggcgaaaaaccatatacatgtcatgagtgtggcaagagctttaaccagtctagtcacctgtacgctcacctgccaattcacaccggcgaaaagccatacagatgcgacagttgtgggaaaggattcagtcggagtacagatctcaacattcattgccgagtacacacgggagagaagccttataagtgcgaagtctgcggcaaagggttcacccagcgttcccatttgcaggcacatgagcgaatccataccggggagaaaccttacaaatgtggtgactgcgggaagcgattcagttgtagtagtaacctgcacacacatcagcgtgtgcacactgaggaaaagccctataagtgcgatgaatgtggaaagtgtttcagcttgtctttcaatctccactcacaccagagggtccacacaggcgaaaaaccttataagtgcgaggagtgtggtaagggcttctcatcagcaagttcctttcagtctcaccagagggtacataccggcgagaagcctttccgttgcaatgtgtgcggcaaggggttctctcagtcaagttactttcaagcacatcagagggtccacacaggggagaagccatacaaatgcgaggtatgcgggaaacgattcaactggtctctcaacctgcacaatcaccagcgggtgcacacgggcgagaaaccatataagtgcgaggagtgcggcaaaggattcagccaggcttccaatctgcaggctcaccagtctgtgcacacgggcgagaagccttttaaatgtgacgcctgtcagaagcggtttagccaggcctctcatcttcaggcccaccagagagtacataccggagaaaaaccgtacaagtgcgacacttgtggcaaggcgttctctcagagatcgaatttacaggtacaccagatcatccacaccggagagaagccttttaaatgtgaggaatgcggcaaagaattttcttggtctgccgggctgtcggctcaccagcgagtccataccggcgagaaaccatacacgtgtcagcaatgcggaaaaggcttctcacaggcctctcactttcatacccatcaacgggttcatactggcgagcgcccttatatctgcgacgtgtgctgcaaagggttttcccagagaagccacttgatctaccatcaacgggttcatacaggaggcaatctgtag

SEQ ID NO: 21367 - DNA, 1767 bp, Artificial Sequence
  Description of Artificial Sequence: Synthetic coding sequence
agcggcgaccggaaccagaacgagatggccaccctgcacaaggccgggctgagatgcttcagtctgggcgagttgagctgctggcaaatcaagagacacatcgccagcaagctagcccgcagccaggactctatgatcaacattgaggggaaaagctcacagttccccaagcaccatgatagcccatgccaggtgggcgccggcgagagtatccaagctagtgtcgacgacaattgcctcgtaaatcatataggcgatcactcaagtattattgagaaccaagaattcccgacagggaaagtgccaaattcctggtcgaaaatctatctcaacgaaacacaaaattaccagcgatcatgtaagcagacacagatgaaaaacaaactgtgcatctttgcaccatacgtcgacattttttcttgcatcagtcatcaccatgatgataacatcgttcacaagagagataaggtgcatagtaactctgattgtggaaaagataccctaaaggtgagtccattgacacagagatccatacacacgggccaaaagacatatcaagggaacgaatgcgaggaggcattcaacgatagcagctccctcgaacttcataagcaggttcatctaggcaagaagagccccgcatgttctactcacgagaaagacaccagctactcctccggcatcccagtccaacagagcgtaaggaccgggaagaaaagatattggtgccacgaatgtgggaagggattcagccaatcaagtaacctccagactcaccaaagagtgcatactggggagaagccatatacttgccacgagtgtggtaagtcctttaaccagtcctctcatctctatgcacacttacctatccacactggggagaaaccgtaccgctgtgactcctgtggtaagggcttctccaggagcaccgacttgaatattcactgtcgagtgcacacaggagaaaaaccatataagtgcgaggtgtgcggaaagggattcacccagcgaagccacttgcaagcccacgaaaggatacatacaggggagaagccatacaagtcacagatatttatacctataagagattttaatttacacagccatcagcgggtgcatacaggggagaaaccctacaagtgcgaggaatgcgggaagggcttcagtagtgcaagttcatttcagtctcaccagcgcgtgcatacaggggagaagccgtttagatgtaatgtgtgcggtaaagggttcagtcagagctcatatttccaggcacatcagcgagtgcacaccggggagaaaccttacaaatgtgaagtatgcggcaagcgcttcaactggtcccttaacctacacaatcaccagcgcgtccacacaggcgagaagccctacaaatgcgaagagtgtgggaagggcttttctcaggcgtctaacctccaggctcaccagagcgtacataccggagaaaaaccttttaagtgtgatgcctgtcagaagagattctcccaggccagtcatctgcaggcccaccagagagtgcacacaggagaaaagccttataaatgtgacacctgtggcaaggcattttcgcagcgttctaatctgcaggtgcatcagattattcatactggagaaaaaccctttaaatgtgaggagtgtgggaaagagttctcttggtctgcagggctgtcagcccaccagcgcgtgcatacaggagagaaaccgtatacttgccagcaatgcggtaaggggtttagccaggcatcttag

SEQ ID NO: 21368 - DNA, 2217 bp, Artificial Sequence
  Description of Artificial Sequence: Synthetic coding sequence
atgggccggatccaggaggccgtgaccttcaaggacgtggccgtggcctttactgaggaagagctcgggcttctggatagcgcccagcgcaagctctaccgcgacgtgatgttagagaatttccgcaacctggtgagtgttggccatcagagttttaagcccgacatgattagtcaactggagcgagaggagaaactgtggatgaaagagcttcagacacaaagaggcaagcacagcggagataggaatcagaacgaaatggcgaccctgcacaaggccgggctgaggtgctttagtcttggggagctgagttgttggcagataaaacggcacatcgcatcgaagctggctaggtcccaggattcgatgatcaacatcgaaggcaagtccagccagtttccgaagcatcatgactcgccatgtcaggtgggcgctggcgaaagtatccaagcttcagtggacgacaactgcctggtcaatcatatcggcgatcactcgtctatcatagagaaccaggaatttccgacagggaaagtcccaaattcctggtcaaagatttatttaaacgagacccagaactatcagcgatcttgtaagcagactcagatgaagaataagctgtgcattttcgcaccctatgtcgatatcttctcttgcatctcacaccatcacgatgacaacattgtccacaaacgggacaaggtccatagtaatagcgattgcggcaaggataccctgaaggtgtcacctcttacacagcgctctattcacactggacagaagacttaccaggggaacgaatgtgaagaggctttcaatgactctagcagcctcgagcttcacaagcaggttcacctcggaaagaagagtccagcatgctctactcatgagaaagacaccagctacagctccggcattccagtgcaacagagtgttcggacgggcaagaaacgatactggtgccacgagtgtggtaaagggttttctcaatcttctaaccttcagacgcaccaacgggtacatacaggggagaaaccctacacctgccatgaatgtgggaaaagcttcaatcagtcttcacatctatatgcccacttgcccatccacacgggagagaagccataccgctgtgacagttgcggaaaaggctttagtcgcagtacggatttgaatatccattgcagggtccatactggtgaaaagccctataagtgtgaggtctgcggcaaaggatttacccagaggtcccatctgcaggcccacgaaagaatccacactggggaaaagccttataagtgtggggattgcggcaagcgctttagctgctcttccaacctgcatacacaccagagagttcataccgaagagaaaccatataagtgtgacgagtgcggaaagtgcttcagcctcagctttaacttgcactctcatcaaagagtgcatactggcgagaagccctacaaatgcgaggaatgtgggaagggattctcctctgcctcaagctttcagtcccaccagagagtgcacacgggagagaagccattcaggtgtaatgtatgcggcaaaggttttagccagagtagttacttccaagcccaccagcgtgtccatacgggcgagaagccttataaatgtgaggtgtgcgggaaacggtttaactggtctcttaatttacataaccaccaaagggttcacaccggagagaagccatataagtgcgaagagtgcggtaaggggttctcacaggcaagtaatctgcaagcgcaccagtccgtccatacgggtgagaagccattcaagtgcgacgcctgccagaaacgattttctcaggcctcgcatctacaggctcaccagcgtgtccatacaggagaaaaaccttacaagtgtgatacctgtggtaaagcattcagtcagcggtctaacctccaagtacaccagatcatccacactggtgaaaaaccttttaagtgtgaggaatgcggcaaggagttttcctggtccgctggcctgtcggctcatcaaagagtgcacactggagaaaagccttacacatgtcagcagtgcggcaagggcttttcccaggctagtcactttcatacacatcagagggtgcataccggcgagcgcccttacatttgtgacgtgtgctgtaagggcttcagccagagatcacatctcatttaccaccagcgtgttcatactggaggcaacctgtag

SEQ ID NO: 21369 - DNA, 546 bp, Artificial Sequence
  Description of Artificial Sequence: Synthetic coding sequence
atgggccggatccaggaggccgtgaccttcaaggacgtggccgtggcattcaccgaggaggagctcggattactggatagtgcacagcggaagctctacagggacgtgatgcttgaaaatttccgtaacctggtcagcgtcggccatcaaagtttcaaacccgacatgatcagtcaacttgagcgcgaagagaaactctggatgaaggagctgcaaactcagcgtggcgaccgaaatcagaatgagatggccaccctgcataaggccggtctgagatgcttctctctcggcgagctctcctgttggcagatcaagagacacatcgcatccaagctcgcacggtctcaggacagcatgatcaatattgaagggaagtctagccaatttccaaagcatcacgactccccatgtcaggtgggtgcgggtgagtccatccaggccagtgtcgatgacaattgtctggttaatcacataggcgatcacagctccatcattgagaaccaggagtttcccactggtaaaaagaagaaaaagaaaaagcagtag

SEQ ID NO: 21370 - DNA, 1740 bp, Artificial Sequence
  Description of Artificial Sequence: Synthetic coding sequence
atgaacaagagccaggagcaggtgagcttcaaggacgtgtgcgtggactttacacaggaggaatggtaccttctggacccagcccagaagattctgtatcgtgacgtcatattagaaaactattccaacctggtctcggtgggctattgtattacaaagccagaggtgatattcaagatcgaacaaggagaagagccttggattttggaaaagggtttcccaagccaatgtcaccccgagcggaaatggaaggtggatgatgttttggaatcgagtcaggaaaatgaagatgatcatttttgggagctgctgttccacaacaataagacagtgtccgtcgaaaacggcgatcggggatccaaaacattcaatctaggaaccgatccagtctcgctccggaactatccgtacaagatctgcgactcttgtgaaatgaatctaaaaaatatctccggattgatcatcagtaagaagaattgttcaagaaagaagcccgacgagttcaatgtctgtgaaaagcttttgctggacataagacatgagaaaattcctataggagaaaagtcatacaaatatgatcaaaagcgcaacgcaattaactaccatcaggatttgtctcagcccagctttggccagtcctttgaatattccaagaatggccagggctttcatgatgaagctgctttttttacaaataagcgctctcaaatcggtgagacagtgtgtaagtataacgaatgcggacgtactttcatagagtccctgaaactgaacataagccagaggcctcacctcgaaatggaaccctatggctgctctatctgcggcaagtccttttgtatgaacctccgcttcggccatcagagagctctaaccaaggacaacccctacgaatacaacgagtacggagaaattttttgcgataactctgcattcatcattcatcagggtgcctacaccaggaagatccttcgggagtataaagtgagcgataaaacctgggagaagtccgcattacttaagcatcagatcgtgcacatgggcgggaagtcctatgattacaacgagaatggctccaatttcagtaaaaaatcccaccttactcaactccggcgcgcacacaccggagaaaagactttcgaatgtggagaatgcggaaagaccttctgggagaaaagtaacttaacccagcaccagcgaactcacaccggcgagaagccttatgagtgtactgaatgcggaaaagccttctgtcagaagccacatctgactaatcatcagagaacccataccggtgaaaaaccatacgagtgcaaacagtgcggaaaaactttctgcgtcaaatctaatctgacagaacaccaacgcacacatacgggagaaaagccttacgagtgcaatgcttgcggtaaaagtttctgccaccgctccgccctgacagtgcaccagcgtacccacacgggcgagaaacccttcatttgtaacgaatgtggaaagagtttttgcgtaaagagcaacctcatcgtccatcaaagaacccacacaggcgagaagccgtataagtgtaacgaatgtggcaaaacattctgtgagaaatccgcattgacaaagcaccagcggacgcacaccggcgaaaaaccttacgagtgcaacgcctgtggcaaaacctttagtcagaggagcgtcttaaccaagcaccaacgcattcatacgagggttaaggctctgagcacctcctag

SEQ ID NO: 21371 - DNA, 360 bp, Artificial Sequence
  Description of Artificial Sequence: Synthetic coding sequence
atgaacaagagccaggagcaggtgagcttcaaggacgtgtgcgtggacttcacccaggaggagtggtacctccttgatccagcacagaaaatactgtaccgcgacgttatcctagagaattacagcaatctggtaagcgttggctactgcatcacaaagcccgaggtcatttttaagatcgaacagggcgaagagccctggatcctagagaagggttttccctcgcagtgccaccccgaaaggaaatggaaggtcgatgatgtgttggaatcatcacaggagaacgaagacgatcacttttgggaactgctatttcacaacaataagacgtggaatctgaagctgattaaggtggagtag

SEQ ID NO: 21372 - DNA, 1740 bp, Artificial Sequence
  Description of Artificial Sequence: Synthetic coding sequence
atgaacaagagccaggagcaggtgagcttcaaggacgtgtgcgtggactttacacaggaggaatggtatctgttagatcctgctcagaagatcctgtacagggacgtgatccttgaaaattactcaaacctggtcagtgtgggctactgtataacaaagcctgaggttatctttaagatcgagcagggggaggaaccatggatcttggaaaaaggcttcccctcccagtgtcatcctgagagaaaatggaaagtcgacgacgttctggaaagctcacaggaaaatgaagacgaccacttctgggaactcctgttccataacaataaaactgtgagcgttgaaaatggtgacagaggctccaagacctttaatttggggaccgatcccgtgtccttgaggaactatccctacaagatttgcgatagctgtgagatgaacttgaaaaatatctccggtctgatcattagcaagaagaactgctcacggaaaaagccagatgagttcaatgtgtgcgagaaactgttgttagacatacgccatgaaaagattcctatcggagaaaaaagctacaaatacgaccaaaagcgaaatgccatcaactaccaccaggatctcagtcaaccttccttcgggcagtcttttgagtattcaaaaaacggacagggttttcacgatgaagctgctttcttcaccaataagcgctcccaaattggtgaaactgtgtgcaagtataacgaatgtggcaggaccttcattgagtcattaaaattgaatatctctcagcggccccacctagagatggaaccttacggttgctccatttgcggcaaatctttttgcatgaacttgcggttcggccaccagcgcgccctgacaaaagataatccctatgaatacaatgagtacggggagatattctgcgataatagcgcatttatcattcaccagggggcatatactcgcaagatactgagagagtataaggtttccgacaagacatgggaaaagagcgcactgcttaaacatcagattgtacacatgggcggtaaatcctacgactataatgaaaacggttccaatttctcaaaaaagagtcacctgactcaactcagacgagcccatacgggagaaaagacctttgagtgcggagagtgtgggaagacattctgggagaaaagcaacctgacccaacatcaacgcacacatactggcgagaaaccttatgagtgcacagaatgcggaaaggccttttgtcagaaacctcacctgaccaaccatcagaggacccacacaggagagaaaccctacgagtgcaaacagtgcgggaagacgttctgcgtgaaatctaatctgaccgaacaccagaggactcacacaggagagaagccctacgaatgtaatgcttgtggaaagagtttttgccatagatccgcactgaccgtgcatcaacgcacgcacacaggcgagaagccttttatttgtaatgaatgcggtaaatcattctgtgtgaagagtaatctcattgtgcaccaaagaactcacaccggagagaaaccttacaagtgcaacgagtgtggcaaaaccttttgcgaaaagtcagctctgaccaaacaccaaaggacgcacaccggggaaaagccatacgaatgtaacgcctgtggtaagacgttttctcagaggtccgttctcaccaagcatcagcgtattcatactagggtaaaagccctgagcacgtcctag

SEQ ID NO: 21373 - DNA, 303 bp, Artificial Sequence
  Description of Artificial Sequence: Synthetic coding sequence
atgaacaagagccaggagcaggtgagcttcaaggacgtgtgcgtggatttcacccaagaggagtggtacttgttggaccctgcacagaaaatattatatcgcgacgtaatcctcgagaactactcaaacttagttagtgtggggtattgtattaccaaacccgaggtaatcttcaagattgagcagggcgaggagccatggatactggaaaagggttttccttcccagtgccatcccgagcggaaatggaaagtcgacgatgtcttagagtcatcccaggagaatgaagacgaccatttttag

SEQ ID NO: 21374 - DNA, 210 bp, Artificial Sequence
  Description of Artificial Sequence: Synthetic coding sequence
atgaacaagagccaggagcaggtgagcttcaaggacgtgtgcgtggattttacacaggaagagtggtacctactcgatccagcccagaaaatcctttacagagacgtgatcctcgagaattacagcaatttggtcagcgtgggatactgtattactaagcctgaagtgatttttaaaattgaacagggtgaggagccgtggatactatag

SEQ ID NO: 21375 - DNA, 1683 bp, Artificial Sequence
  Description of Artificial Sequence: Synthetic coding sequence
atggccgccgcccggctgctgcccgtgcccgccggcccccagcccctttcttttcaagcgaaactaaccttcgaagatgtcgctgtcctgttgagccaggacgagtgggaccggctgtgccctgctcagagaggactctatcggaacgtaatgatggaaacctatgggaatgtggttagcctcggactgcctggaagcaagcctgacataatttctcagctggaaaggggtgaggacccctgggtgctggaccgaaaaggcgctaaaaagagtcagggtctttggagcgattactcagacaaccttaaatatgaccataccacagcatgtacccaacaggattccctctcctgtccttgggaatgtgagactaagggggagtcccagaataccgacctcagccccaaacccctgatttctgagcagacagttattctcggcaaaactcccctcggccggatagaccaggaaaacaacgaaacaaaacagtcattttgtctttcgcccaatagcgtggaccatagggaggtgcaggtcctttcccagtctatgcccttgacaccccaccaggcagtgccatctggtgagagaccatacatgtgcgtggaatgtggaaaatgctttggccgttcgagccacctgctgcaacaccaacgaattcatacaggggaaaagccgtatgtctgttccgtatgtggcaaggcattctcccagtccagcgtgctcagcaagcaccggaggatccacaccggagaaaagccctatgaatgtaacgagtgtggtaaggccttccgggtcagttcagatctggcacagcatcataaaatacacactggagaaaagccacatgagtgccttgagtgccgcaaagcattcacccagctgtctcatctcatccagcaccagagaatacacaccggggaacggccttatgtatgccccctctgcggaaaagccttcaaccactcgactgtactgcggagtcaccagagagtgcacacaggtgaaaagcctcaccgctgtaatgaatgcggcaagacgttctccgtgaagaggactctcttgcagcatcagaggattcacaccggcgaaaagccctatacgtgttcagagtgtggcaaagccttctccgacagatctgtgctcattcaacaccacaacgtacacacaggagaaaagccttacgagtgttcggaatgcggaaagacattcagccaccgttcaacccttatgaatcatgagcggatccataccgaggagaagccatacgcttgctacgaatgtggcaaggcgttcgtccagcactcccacttaattcagcatcaacgggttcacaccggcgagaaaccttatgtgtgcggagagtgtggccacgctttttctgcaagacgctctttaatacaacacgaacgcatccacacaggagagaagccctttcagtgcactgaatgcgggaaggcctttagcttaaaggccactctgatcgtccatcttcgcactcatactggggaaaaaccctatgaatgtaattcctgtggaaaggcctttagtcagtatagcgtgctgatccagcaccagaggatacataccggcgagaaaccttacgaatgtggagaatgcggacgggcgttcaaccagcacggtcatctgattcaacaccaaaaggttcacaggaaactgtag

SEQ ID NO: 21376 - DNA, 369 bp, Artificial Sequence
  Description of Artificial Sequence: Synthetic coding sequence
atggccgccgcccggctgctgcccgtgcccgccggcccccaggccaaattgacattcgaggacgtggctgtccttctctctcaggacgagtgggaccggctgtgtcctgcccagcgcggactgtataggaatgtaatgatggaaacatatggaaatgtagtaagcttaggtctgcctggctctaagccagatatcatctctcagctggagcgaggtgaagacccttgggttctggataggaagggtgcgaaaaagagtcagggcctgtggagcgattattccgacaacctaaagtacgatcatacaacggcgtgcacccagcaagattctctctcatgtccctgggatccagtgccacagaaaccttag

SEQ ID NO: 21377 - DNA, 1332 bp, Artificial Sequence
  Description of Artificial Sequence: Synthetic coding sequence
atggccgccgcccggctgctgcccgtgcccgccggcccccaggccaagctgacatttgaagacgtggccgtgctgctgagtcaagacgagtgggaccgtttatgcccagcacagaggggtttatatcgcaacgtgatgatggagacatatggtaatgtcgtctcactcggcctgcctggctctaagcccgacattatttcccaactggagcggggggaggacccatgggttctggaccgcaaaggggcaaagaaaagtcaagggctgtggtccgactattccgataatctaaaatacgaccatactaccgcatgcactcaacaggattctctttcttgtccttgggaatgtgaaacgaagggagagtcacagaacactgacctgagtcctaaacctttaatctcagaacaaactgtgatcctagggaaaacccctctggggaggatcgatcaggaaaataacgagacaaagcagtcattttgcctgtcccctaacagtgtggaccatcgcgaagtgcaagttctctcacagtcgatgcccctgacaccgcaccaggccgttccctccggagaaaggccatacatgtgtgtcgagtgcggcaagtgcttcgggcggtcatcgcatctgctgcaacatcagagaatccatactggcgagaagccgtatgtatgttcagtctgcggcaaggctttttcccagtcttctgtcctgtcaaaacaccgtcgcatacacacaggcgaaaaaccgtacgagtgtaacgagtgtggtaaggccttccgcgtgtcatctgacctggcacagcaccataagatacacaccggggaaaagccgcacgaatgtctggagtgtcgcaaagcatttacccagctgtctcatctgattcaacaccaaaggatccacaccggggagcgcccctacgtatgtccactttgtgggaaagcattcaaccatagtaccgttttgaggtcacaccaacgggtccataccggcgagaagccgcatcgttgtaacgaatgcggaaaaacattctctgtaaagcgaacactcctacaacaccagaggattcacaccggtgagaaaccatttcaatgcaccgaatgcgggaaagcattttctctgaaggctacactgatagtccacctacgaacacataccggggaaaagccatatgaatgcaactcgtgcggtaaagctttcagtcagtactcagtcctgatccaacaccagcgtatccacactggggaaaaaccctatgaatgcggagagtgcggacgggcgttcaaccagcatggacatctcatacagcaccaaaaggtccatcggaagctctag

SEQ ID NO: 21378 - DNA, 1668 bp, Artificial Sequence
  Description of Artificial Sequence: Synthetic coding sequence
atggccgccgcccggctgctgcccgtgcccgccggcccccaggccaagctgacatttgaagacgttgctgtgttgttgtcacaggacgaatgggaccgcctttgccccgctcagcgtgggctgtatcgcaacgtgatgatggaaacatatgggaatgtggtgtctctgggattaccaggaagcaaacccgatattatcagtcagctggagaggggggaggacccatgggtcctggaccggaaaggagcgaagaaatctcagggcctgtggagcgattattcagataacctgaaatacgaccacaccaccgcttgcacgcagcaggactccctgagttgcccctgggaatgcgaaacaaagggggaatcccaaaacacagatctgtcccccaagccactaatatcagaacaaaccgttattctgggaaaaactccactcggcagaattgaccaggaaaacaatgaaacaaagcagtccttttgcctctcaccaaacagtgtagatcatagagaggtgcaggtgttgagtcagtcgatgccactaaccccacatcaagccgtaccctccggggaaagaccgtacatgtgcgtcgagtgtggaaaatgtttcggaaggtcctcccacctcctgcagcatcagagaatccataccggtgaaaagccatatgtttgttctgtgtgcggcaaggcatttagccagagctccgtcttaagtaaacacaggagaatacatacgggtgaaaagccatacgagtgtaacgaatgtgggaaggcatttagagtcagctccgatctagctcaacaccacaaaatacataccggtgagaagcctcacgaatgtctggagtgtcggaaagcattcacacagctctcacatctaattcaacaccagaggattcacactggtgagcggccctacgtgtgcccgctgtgtgggaaggcctttaaccactctaccgtcttgcggtctcatcagcgcgtccataccggagagaagccccaccggtgcaacgagtgtggcaaaactttttcagtcaaacggacgctgctgcaacaccagagaatccatacaggggaaaagccttacacctgtagtgaatgcgggaaagcgtttagtgatcgctccgtgttgatacagcaccataacgtacatactggagagaaaccgtacgagtgcagcgaatgtgggaaaacgttctcacatcgatccacattgatgaaccatgaaaggatccataccgaagaaaagccctacgcgtgctacgagtgtggaaaggccttcgtccagcactcacacctgatacagcaccagagggttcacactggggagaagccatacgtctgtggagagtgcggacacgccttcagcgcacggaggagccttattcagcacgagagaatccacaccggggagaagccttttcaatgtaccgagtgcggaaaggcgtttagcctcaaggcaaccctgattgtacatctgcgtactcacaccggcgaaaaaccctacgaatgtaacagttgtgggaaagcatttagccagtactcagtgctgattcaacatcagcggatccacactggagagaagccttatgagtgtggagaatgcggccgcgcttttaatcagcacggccatctgatccagcatcagaaggtccaccgaaagctttag

SEQ ID NO: 21379 - DNA, 369 bp, Artificial Sequence
  Description of Artificial Sequence: Synthetic coding sequence
atggccgccgcccggctgctgcccgtgcccgccggcccccaggccaaactcacttttgaagacgttgcggtgctcctcagccaagacgagtgggaccggctgtgtccagcacagcggggactctatcgcaatgtcatgatggagacatacggcaatgtggtttcacttggcttgcctgggagcaaacctgatatcatttctcagctcgaacgcggcgaagacccatgggtgctcgacagaaagggtgctaaaaaaagccagggactgtggagcgattacagtgataatctgaagtatgaccacaccacggcatgcacgcagcaggacagtctaagttgtccatgggatccggtacctcaaaagccatag

SEQ ID NO: 21380 - DNA, 384 bp, Artificial Sequence
  Description of Artificial Sequence: Synthetic coding sequence
atggccgccgcccggctgctgcccgtgcccgccggcccccagcccctgtctttccaggcaaagttaactttcgaagatgtcgctgtgttgctgtcccaggatgaatgggatcggctgtgtcctgcacaacgcggtttgtataggaacgttatgatggaaacttacggaaacgtagtatcgctcggcctgccagggtcgaaacccgatatcatttcgcagttggaacgcggagaggacccttgggtcttggatagaaaaggggctaaaaagagtcagggtctctggtctgactacagcgataatctcaagtacgaccacactaccgcatgcactcagcaggatagccttagctgcccatgggatcctgtgcctcaaaagccctag
